United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 45

SEQ ID NO: 2014598 - RNA, 21 nt, Human
uaaaugcaguuacaaauuaua

SEQ ID NO: 2014599 - RNA, 14 nt, Human
uaaaucucuucugu

SEQ ID NO: 2014600 - RNA, 18 nt, Human
uaaaucucuucuguguuu

SEQ ID NO: 2014601 - RNA, 21 nt, Human
uaaaucuguccaacugagaag

SEQ ID NO: 2014602 - RNA, 14 nt, Human
uaaaucuccaaaau

SEQ ID NO: 2014603 - RNA, 15 nt, Human
uaaaucuccaaaaua

SEQ ID NO: 2014604 - RNA, 18 nt, Human
uaaaucuccaaaauaaaa

SEQ ID NO: 2014605 - RNA, 21 nt, Human
aauaauucuuuuuuauuaauc

SEQ ID NO: 2014606 - RNA, 23 nt, Human
aauaauucuuuuuuauuaaucac

SEQ ID NO: 2014607 - RNA, 13 nt, Human
aauaauugacagg

SEQ ID NO: 2014608 - RNA, 14 nt, Human
aauaauucuuuuuu

SEQ ID NO: 2014609 - RNA, 15 nt, Human
aauaauucuuuuuua

SEQ ID NO: 2014610 - RNA, 20 nt, Human
aauaauucuuuuuuauuaau

SEQ ID NO: 2014611 - RNA, 22 nt, Human
aauaacuguaauuauuugaaug

SEQ ID NO: 2014612 - RNA, 20 nt, Human
aauaagaauagaacaacaua

SEQ ID NO: 2014613 - RNA, 12 nt, Human
aauaagaaaaga

SEQ ID NO: 2014614 - RNA, 15 nt, Human
aauaacuguaauuau

SEQ ID NO: 2014615 - RNA, 13 nt, Human
aauaauuuuguaa

SEQ ID NO: 2014616 - RNA, 14 nt, Human
aauaauuuuguaau

SEQ ID NO: 2014617 - RNA, 15 nt, Human
aauaauuuuguaaug

SEQ ID NO: 2014618 - RNA, 17 nt, Human
aauaauuuguggugauu

SEQ ID NO: 2014619 - RNA, 19 nt, Human
uaaauaaugugaaacugga

SEQ ID NO: 2014620 - RNA, 18 nt, Human
uaaauaaguuauaaagau

SEQ ID NO: 2014621 - RNA, 12 nt, Human
uaaauaauucuu

SEQ ID NO: 2014622 - RNA, 13 nt, Human
uaaauaauucuuu

SEQ ID NO: 2014623 - RNA, 21 nt, Human
uaaauaaaguuuguugaaaca

SEQ ID NO: 2014624 - RNA, 12 nt, Human
uaaauaaaguuu

SEQ ID NO: 2014625 - RNA, 15 nt, Human
uaacuuuuauaaacu

SEQ ID NO: 2014626 - RNA, 17 nt, Human
uaacuuuuauaaacuuu

SEQ ID NO: 2014627 - RNA, 18 nt, Human
uaacuuuuauaaacuuua

SEQ ID NO: 2014628 - RNA, 21 nt, Human
uaacuaaaauaauuuuguaau

SEQ ID NO: 2014629 - RNA, 20 nt, Human
uaacuaaaauaauuuuguaa

SEQ ID NO: 2014630 - RNA, 19 nt, Human
uaacuaacaaacagauucu

SEQ ID NO: 2014631 - RNA, 18 nt, Human
uaacuacauauugaauag

SEQ ID NO: 2014632 - RNA, 17 nt, Human
uaacuaccuuuggcuua

SEQ ID NO: 2014633 - RNA, 21 nt, Human
uaacuaccuuuggcuuaauuc

SEQ ID NO: 2014634 - RNA, 22 nt, Human
uaacuaccuuuggcuuaauucc

SEQ ID NO: 2014635 - RNA, 18 nt, Human
uaagaauauuugaaugua

SEQ ID NO: 2014636 - RNA, 13 nt, Human
uaagaaugaguuu

SEQ ID NO: 2014637 - RNA, 18 nt, Human
uaagaaugaguuucuuag

SEQ ID NO: 2014638 - RNA, 17 nt, Human
uaagacauuuuuggaag

SEQ ID NO: 2014639 - RNA, 20 nt, Human
uaagaaugaguuucuuagac

SEQ ID NO: 2014640 - RNA, 20 nt, Human
aauaugaaauuuuuuuucau

SEQ ID NO: 2014641 - RNA, 23 nt, Human
aauaugaaauuuuuuuucaugcu

SEQ ID NO: 2014642 - RNA, 19 nt, Human
aauaucuuuuuuuuaauaa

SEQ ID NO: 2014643 - RNA, 20 nt, Human
aauaucugaaaauguaugug

SEQ ID NO: 2014644 - RNA, 15 nt, Human
aauaucuugcuugaa

SEQ ID NO: 2014645 - RNA, 17 nt, Human
aauaucuugcuugaacu

SEQ ID NO: 2014646 - RNA, 13 nt, Human
aauauccucaauu

SEQ ID NO: 2014647 - RNA, 16 nt, Human
aauaucuccgucaacu

SEQ ID NO: 2014648 - RNA, 16 nt, Human
aauaucuaguaauaua

SEQ ID NO: 2014649 - RNA, 18 nt, Human
aauaucuaguaauauauu

SEQ ID NO: 2014650 - RNA, 21 nt, Human
aauaucuaguaauauauuuaa

SEQ ID NO: 2014651 - RNA, 21 nt, Human
aauaucuccgucaacucauau

SEQ ID NO: 2014652 - RNA, 19 nt, Human
aauaucugaaaauguaugu

SEQ ID NO: 2014653 - RNA, 18 nt, Human
aauaucugaaaauguaug

SEQ ID NO: 2014654 - RNA, 17 nt, Human
aauaucugaaaauguau

SEQ ID NO: 2014655 - RNA, 16 nt, Human
aauaucugaaaaugua

SEQ ID NO: 2014656 - RNA, 15 nt, Human
aauaugcacacauuu

SEQ ID NO: 2014657 - RNA, 17 nt, Human
aauauugauaugcuuau

SEQ ID NO: 2014658 - RNA, 18 nt, Human
aauauugauaugcuuaua

SEQ ID NO: 2014659 - RNA, 18 nt, Human
aauaugauuaaaaauauc

SEQ ID NO: 2014660 - RNA, 22 nt, Human
aauauugcugauggugcaauga

SEQ ID NO: 2014661 - RNA, 21 nt, Human
aauauugcugauggugcaaug

SEQ ID NO: 2014662 - RNA, 18 nt, Human
aauauugcugauggugca

SEQ ID NO: 2014663 - RNA, 15 nt, Human
aauauugcugauggu

SEQ ID NO: 2014664 - RNA, 13 nt, Human
aauauugcugaug

SEQ ID NO: 2014665 - RNA, 12 nt, Human
aauauugcugau

SEQ ID NO: 2014666 - RNA, 11 nt, Human
aauauugcuga

SEQ ID NO: 2014667 - RNA, 21 nt, Human
aaucacuguguauauuugauu

SEQ ID NO: 2014668 - RNA, 23 nt, Human
aaucacuguguauauuugauuua

SEQ ID NO: 2014669 - RNA, 17 nt, Human
aauauuuucauuauaca

SEQ ID NO: 2014670 - RNA, 22 nt, Human
aaucacuguguauauuugauuu

SEQ ID NO: 2014671 - RNA, 11 nt, Human
aauauuuuaau

SEQ ID NO: 2014672 - RNA, 20 nt, Human
aauauuuuaauuuuuaaaug

SEQ ID NO: 2014673 - RNA, 21 nt, Human
aauauuuuaauuuuuaaaugc

SEQ ID NO: 2014674 - RNA, 21 nt, Human
aauauuuuagguguaaaauaa

SEQ ID NO: 2014675 - RNA, 14 nt, Human
aauauuguuaaggg

SEQ ID NO: 2014676 - RNA, 16 nt, Human
aauagaugcugacugu

SEQ ID NO: 2014677 - RNA, 20 nt, Human
aauagccugccucuucucua

SEQ ID NO: 2014678 - RNA, 13 nt, Human
aauagcugggacu

SEQ ID NO: 2014679 - RNA, 14 nt, Human
aauagcugggacua

SEQ ID NO: 2014680 - RNA, 18 nt, Human
aauagacaauuuauuaug

SEQ ID NO: 2014681 - RNA, 16 nt, Human
aauagacagcaugaga

SEQ ID NO: 2014682 - RNA, 23 nt, Human
aauagacaauuuauuauggcaca

SEQ ID NO: 2014683 - RNA, 18 nt, Human
aauagacccacaagaggc

SEQ ID NO: 2014684 - RNA, 16 nt, Human
aauaggaaaaacugau

SEQ ID NO: 2014685 - RNA, 15 nt, Human
aauaggaaaaacuga

SEQ ID NO: 2014686 - RNA, 15 nt, Human
aauagcuuuaaugau

SEQ ID NO: 2014687 - RNA, 16 nt, Human
aauagcuuuaaugaua

SEQ ID NO: 2014688 - RNA, 18 nt, Human
aauaggaaaaacugauuu

SEQ ID NO: 2014689 - RNA, 17 nt, Human
aauaggaaaaacugauu

SEQ ID NO: 2014690 - RNA, 24 nt, Human
aauagcuuuuuucucugauacaga

SEQ ID NO: 2014691 - RNA, 19 nt, Human
aauaggaaaaacugauuuu

SEQ ID NO: 2014692 - RNA, 18 nt, Human
aauaggcguaacuaauuu

SEQ ID NO: 2014693 - RNA, 14 nt, Human
aauaggacuuguuu

SEQ ID NO: 2014694 - RNA, 15 nt, Human
aauaggacuuguuuu

SEQ ID NO: 2014695 - RNA, 14 nt, Human
aauaggaugggcuu

SEQ ID NO: 2014696 - RNA, 20 nt, Human
aauaggaugggcuucugugc

SEQ ID NO: 2014697 - RNA, 16 nt, Human
aauaguaauauaauac

SEQ ID NO: 2014698 - RNA, 13 nt, Human
aauaguaggcaag

SEQ ID NO: 2014699 - RNA, 21 nt, Human
aauaguaggcaagauggcaca

SEQ ID NO: 2014700 - RNA, 18 nt, Human
aauagggcuaggaauaua

SEQ ID NO: 2014701 - RNA, 12 nt, Human
aauaguaauaua

SEQ ID NO: 2014702 - RNA, 13 nt, Human
aauaguaauauaa

SEQ ID NO: 2014703 - RNA, 14 nt, Human
aauaguaauauaau

SEQ ID NO: 2014704 - RNA, 15 nt, Human
aauaguaauauaaua

SEQ ID NO: 2014705 - RNA, 14 nt, Human
uaacaugauuuggg

SEQ ID NO: 2014706 - RNA, 14 nt, Human
uaacauggaaguac

SEQ ID NO: 2014707 - RNA, 17 nt, Human
uaacauagaauugcaau

SEQ ID NO: 2014708 - RNA, 23 nt, Human
uaacauagaauugcaaucuauaa

SEQ ID NO: 2014709 - RNA, 16 nt, Human
uaaccucuaaauucuu

SEQ ID NO: 2014710 - RNA, 14 nt, Human
uaaccucuguucag

SEQ ID NO: 2014711 - RNA, 18 nt, Human
uaaccucuguucaggaag

SEQ ID NO: 2014712 - RNA, 15 nt, Human
uaacauggaaguacu

SEQ ID NO: 2014713 - RNA, 16 nt, Human
uaacauggaaguacua

SEQ ID NO: 2014714 - RNA, 15 nt, Human
uaacuaaaagguaug

SEQ ID NO: 2014715 - RNA, 12 nt, Human
uaacuaaaauaa

SEQ ID NO: 2014716 - RNA, 18 nt, Human
uaacuaaaauaauuuugu

SEQ ID NO: 2014717 - RNA, 19 nt, Human
uaacuaaaauaauuuugua

SEQ ID NO: 2014718 - RNA, 14 nt, Human
uaacuaaaagguau

SEQ ID NO: 2014719 - RNA, 14 nt, Human
aauauccauauuaa

SEQ ID NO: 2014720 - RNA, 22 nt, Human
aauaucccuuggacauuuuaug

SEQ ID NO: 2014721 - RNA, 21 nt, Human
aauaucccuuggacauuuuau

SEQ ID NO: 2014722 - RNA, 20 nt, Human
aauaucccuuggacauuuua

SEQ ID NO: 2014723 - RNA, 21 nt, Human
aauauauuaguaagauacugu

SEQ ID NO: 2014724 - RNA, 17 nt, Human
aauaucaaauuaauugu

SEQ ID NO: 2014725 - RNA, 19 nt, Human
aauaucaaauuaauugugu

SEQ ID NO: 2014726 - RNA, 21 nt, Human
aauaucaaauuaauuguguga

SEQ ID NO: 2014727 - RNA, 17 nt, Human
aauauauggucuaaugu

SEQ ID NO: 2014728 - RNA, 18 nt, Human
aauauauggucuaauguu

SEQ ID NO: 2014729 - RNA, 19 nt, Human
aauauauggucuaauguuu

SEQ ID NO: 2014730 - RNA, 20 nt, Human
aauauauggucuaauguuua

SEQ ID NO: 2014731 - RNA, 15 nt, Human
aaucauuguccagag

SEQ ID NO: 2014732 - RNA, 17 nt, Human
aaucauuguccagagcu

SEQ ID NO: 2014733 - RNA, 12 nt, Human
aaucuaaaugga

SEQ ID NO: 2014734 - RNA, 19 nt, Human
aauccuuacaaaugauugc

SEQ ID NO: 2014735 - RNA, 18 nt, Human
aaucuaaauggaaccacu

SEQ ID NO: 2014736 - RNA, 13 nt, Human
aaucuaaauggaa

SEQ ID NO: 2014737 - RNA, 15 nt, Human
aaucuaaauggaacc

SEQ ID NO: 2014738 - RNA, 14 nt, Human
aaucuacugcauuu

SEQ ID NO: 2014739 - RNA, 13 nt, Human
aaucuacugcauu

SEQ ID NO: 2014740 - RNA, 15 nt, Human
aaucuacugcauuua

SEQ ID NO: 2014741 - RNA, 14 nt, Human
aaucuauagaaagu

SEQ ID NO: 2014742 - RNA, 22 nt, Human
aaucuagccagugaacauaauu

SEQ ID NO: 2014743 - RNA, 15 nt, Human
aaucucaaauaacua

SEQ ID NO: 2014744 - RNA, 12 nt, Human
aaucucaaauuu

SEQ ID NO: 2014745 - RNA, 14 nt, Human
aaucucaaauuucu

SEQ ID NO: 2014746 - RNA, 15 nt, Human
aaucuauagaaagug

SEQ ID NO: 2014747 - RNA, 14 nt, Human
aaucuuauaauuua

SEQ ID NO: 2014748 - RNA, 16 nt, Human
aaucuuauaauuuaaa

SEQ ID NO: 2014749 - RNA, 23 nt, Human
aaucugucugcuggucacuucuu

SEQ ID NO: 2014750 - RNA, 11 nt, Human
aaucugucugc

SEQ ID NO: 2014751 - RNA, 14 nt, Human
aaucugucugcugg

SEQ ID NO: 2014752 - RNA, 22 nt, Human
aaucugucugcuggucacuucu

SEQ ID NO: 2014753 - RNA, 17 nt, Human
aaucauggugcucagag

SEQ ID NO: 2014754 - RNA, 13 nt, Human
aaucauguuucuu

SEQ ID NO: 2014755 - RNA, 15 nt, Human
aaucaucaagucuuu

SEQ ID NO: 2014756 - RNA, 20 nt, Human
uaaguuugcacucaaaucuu

SEQ ID NO: 2014757 - RNA, 21 nt, Human
uaaguuuggcaaacagaaugu

SEQ ID NO: 2014758 - RNA, 12 nt, Human
uaaguuugcacu

SEQ ID NO: 2014759 - RNA, 13 nt, Human
uaaguuugcacuc

SEQ ID NO: 2014760 - RNA, 17 nt, Human
uaaguuugcacucaaau

SEQ ID NO: 2014761 - RNA, 21 nt, Human
uaaguuuugacaagcuggcuu

SEQ ID NO: 2014762 - RNA, 17 nt, Human
aaucagacuaugaaguu

SEQ ID NO: 2014763 - RNA, 14 nt, Human
aaucagacuaugaa

SEQ ID NO: 2014764 - RNA, 20 nt, Human
uaaguuuuuauggcuuuugu

SEQ ID NO: 2014765 - RNA, 15 nt, Human
uaaugaaacuuggau

SEQ ID NO: 2014766 - RNA, 15 nt, Human
uaaugacaggccugu

SEQ ID NO: 2014767 - RNA, 20 nt, Human
uaaugacaggccuguccaac

SEQ ID NO: 2014768 - RNA, 23 nt, Human
uaaugaaagacuguacaaaguag

SEQ ID NO: 2014769 - RNA, 22 nt, Human
uaaugaaagacuguacaaagua

SEQ ID NO: 2014770 - RNA, 21 nt, Human
uaaugacuuaagcacacuuga

SEQ ID NO: 2014771 - RNA, 17 nt, Human
uaaugagcaauaucugc

SEQ ID NO: 2014772 - RNA, 15 nt, Human
uaaugacuuaagcac

SEQ ID NO: 2014773 - RNA, 14 nt, Human
uaaugacauucaau

SEQ ID NO: 2014774 - RNA, 17 nt, Human
uaaugacauucaauaaa

SEQ ID NO: 2014775 - RNA, 19 nt, Human
uaaugacauucaauaaagu

SEQ ID NO: 2014776 - RNA, 19 nt, Human
uaaugaaagacuguacaaa

SEQ ID NO: 2014777 - RNA, 18 nt, Human
uaaugaaagacuguacaa

SEQ ID NO: 2014778 - RNA, 17 nt, Human
uaaugaaagacuguaca

SEQ ID NO: 2014779 - RNA, 14 nt, Human
uaaugaaagacugu

SEQ ID NO: 2014780 - RNA, 14 nt, Human
uaaugaaacuugga

SEQ ID NO: 2014781 - RNA, 22 nt, Human
uaaucauauuagacuucuguuu

SEQ ID NO: 2014782 - RNA, 12 nt, Human
uaaucauauuag

SEQ ID NO: 2014783 - RNA, 14 nt, Human
uaaucauauuagac

SEQ ID NO: 2014784 - RNA, 23 nt, Human
aaucuuccuggucgaaaguuagu

SEQ ID NO: 2014785 - RNA, 17 nt, Human
uaauaccuuagaaggua

SEQ ID NO: 2014786 - RNA, 22 nt, Human
uaauacugaaccacuuguagau

SEQ ID NO: 2014787 - RNA, 20 nt, Human
uaauacugaaccacuuguag

SEQ ID NO: 2014788 - RNA, 21 nt, Human
uaauacugaaccacuuguaga

SEQ ID NO: 2014789 - RNA, 13 nt, Human
uaauacugaacca

SEQ ID NO: 2014790 - RNA, 14 nt, Human
uaauacugaaccac

SEQ ID NO: 2014791 - RNA, 15 nt, Human
uaauacugaaccacu

SEQ ID NO: 2014792 - RNA, 19 nt, Human
uaauacugaaccacuugua

SEQ ID NO: 2014793 - RNA, 20 nt, Human
aaucuuauuaaaguuucaaa

SEQ ID NO: 2014794 - RNA, 21 nt, Human
aaucuuauuaaaguuucaaaa

SEQ ID NO: 2014795 - RNA, 19 nt, Human
aaucuuccuggucgaaagu

SEQ ID NO: 2014796 - RNA, 21 nt, Human
aaucuuccuggucgaaaguua

SEQ ID NO: 2014797 - RNA, 20 nt, Human
aaucuucugaacuuggcgcu

SEQ ID NO: 2014798 - RNA, 13 nt, Human
aaucuucugaacu

SEQ ID NO: 2014799 - RNA, 19 nt, Human
uaauagguuuggacaaaau

SEQ ID NO: 2014800 - RNA, 18 nt, Human
uaauaggcucugccugac

SEQ ID NO: 2014801 - RNA, 14 nt, Human
uaauagguuuggac

SEQ ID NO: 2014802 - RNA, 23 nt, Human
uaaucaagagccuuaaaacauca

SEQ ID NO: 2014803 - RNA, 23 nt, Human
uaaucaacauggcuacuugcuuu

SEQ ID NO: 2014804 - RNA, 14 nt, Human
uaaucaagagccuu

SEQ ID NO: 2014805 - RNA, 18 nt, Human
uaaucaagagccuuaaaa

SEQ ID NO: 2014806 - RNA, 19 nt, Human
uaaucaagagccuuaaaac

SEQ ID NO: 2014807 - RNA, 20 nt, Human
uaaucaagagccuuaaaaca

SEQ ID NO: 2014808 - RNA, 21 nt, Human
uaaucaccagggccaaaagcu

SEQ ID NO: 2014809 - RNA, 14 nt, Human
aaucuugugaaaau

SEQ ID NO: 2014810 - RNA, 19 nt, Human
aaucuugugaaaauaauug

SEQ ID NO: 2014811 - RNA, 18 nt, Human
aaucuuguugguucacca

SEQ ID NO: 2014812 - RNA, 19 nt, Human
aaucuuguugguucaccau

SEQ ID NO: 2014813 - RNA, 22 nt, Human
uaauguaacugcucuugggcaa

SEQ ID NO: 2014814 - RNA, 21 nt, Human
uaauguaacugcucuugggca

SEQ ID NO: 2014815 - RNA, 13 nt, Human
uaaugaggaaacu

SEQ ID NO: 2014816 - RNA, 18 nt, Human
uaaugguaguuuuacagu

SEQ ID NO: 2014817 - RNA, 18 nt, Human
uaaugagcaauaucugcu

SEQ ID NO: 2014818 - RNA, 21 nt, Human
uaaugagcaauaucugcuaga

SEQ ID NO: 2014819 - RNA, 22 nt, Human
uaauggugaugcagucuuagau

SEQ ID NO: 2014820 - RNA, 15 nt, Human
aaugagccuggcaag

SEQ ID NO: 2014821 - RNA, 19 nt, Human
aaugagacucuagggucca

SEQ ID NO: 2014822 - RNA, 15 nt, Human
aaugagaauuuaagc

SEQ ID NO: 2014823 - RNA, 13 nt, Human
aaugagacagcag

SEQ ID NO: 2014824 - RNA, 22 nt, Human
aaugagacagcagucuuaugcu

SEQ ID NO: 2014825 - RNA, 18 nt, Human
aaugacuuacuguacaug

SEQ ID NO: 2014826 - RNA, 14 nt, Human
aaugacuuacugua

SEQ ID NO: 2014827 - RNA, 17 nt, Human
aaugacuuacuguacau

SEQ ID NO: 2014828 - RNA, 15 nt, Human
aaugaaaaccacauu

SEQ ID NO: 2014829 - RNA, 22 nt, Human
aaugacagguuugggaccccug

SEQ ID NO: 2014830 - RNA, 15 nt, Human
aaugacaggccuguc

SEQ ID NO: 2014831 - RNA, 20 nt, Human
aaugacucaggacauccccc

SEQ ID NO: 2014832 - RNA, 19 nt, Human
uacauauaagugauugcug

SEQ ID NO: 2014833 - RNA, 17 nt, Human
uacauauguauacaugu

SEQ ID NO: 2014834 - RNA, 18 nt, Human
uacauauguauacaugug

SEQ ID NO: 2014835 - RNA, 23 nt, Human
uacauauguauacaugugccaug

SEQ ID NO: 2014836 - RNA, 21 nt, Human
uacauauuagcgacaacagau

SEQ ID NO: 2014837 - RNA, 12 nt, Human
aauguacugcau

SEQ ID NO: 2014838 - RNA, 12 nt, Human
uacauauugaau

SEQ ID NO: 2014839 - RNA, 19 nt, Human
uacauaaugcgugcauacc

SEQ ID NO: 2014840 - RNA, 20 nt, Human
uacauaaugcgugcauacca

SEQ ID NO: 2014841 - RNA, 15 nt, Human
uacaguaucucaggg

SEQ ID NO: 2014842 - RNA, 17 nt, Human
uacauaaugcgugcaua

SEQ ID NO: 2014843 - RNA, 14 nt, Human
aauguauguguaag

SEQ ID NO: 2014844 - RNA, 12 nt, Human
aauguaugugua

SEQ ID NO: 2014845 - RNA, 15 nt, Human
aauguauucauauuu

SEQ ID NO: 2014846 - RNA, 16 nt, Human
aauguauucauauuug

SEQ ID NO: 2014847 - RNA, 17 nt, Human
aauguauucauauuugu

SEQ ID NO: 2014848 - RNA, 20 nt, Human
aauguauucauauuuguacu

SEQ ID NO: 2014849 - RNA, 18 nt, Human
aauguaugcuucauacag

SEQ ID NO: 2014850 - RNA, 21 nt, Human
aauguaugcuucauacaggga

SEQ ID NO: 2014851 - RNA, 18 nt, Human
aauguacugcauaugaaa

SEQ ID NO: 2014852 - RNA, 14 nt, Human
aauguacugcauau

SEQ ID NO: 2014853 - RNA, 14 nt, Human
aaugugacuuugaa

SEQ ID NO: 2014854 - RNA, 22 nt, Human
aaugugagugguugaauaugau

SEQ ID NO: 2014855 - RNA, 23 nt, Human
aaugugagugguugaauaugauu

SEQ ID NO: 2014856 - RNA, 14 nt, Human
aauguggcuccugg

SEQ ID NO: 2014857 - RNA, 19 nt, Human
aaugugauauaaacagcuu

SEQ ID NO: 2014858 - RNA, 11 nt, Human
aaugugauaug

SEQ ID NO: 2014859 - RNA, 14 nt, Human
uacacuccagugag

SEQ ID NO: 2014860 - RNA, 14 nt, Human
uacagaggacagua

SEQ ID NO: 2014861 - RNA, 23 nt, Human
uacagagcccacgcccccacugg

SEQ ID NO: 2014862 - RNA, 19 nt, Human
uacagagccguaaaaacug

SEQ ID NO: 2014863 - RNA, 20 nt, Human
uacagagccguaaaaacuga

SEQ ID NO: 2014864 - RNA, 18 nt, Human
uacagaggacaguauuug

SEQ ID NO: 2014865 - RNA, 15 nt, Human
uacaggcauagaguu

SEQ ID NO: 2014866 - RNA, 18 nt, Human
uacagaggccaugggccu

SEQ ID NO: 2014867 - RNA, 17 nt, Human
uacaggcuccugccacc

SEQ ID NO: 2014868 - RNA, 22 nt, Human
uacagagccguaaaaacugaag

SEQ ID NO: 2014869 - RNA, 14 nt, Human
uacaggcuccugcc

SEQ ID NO: 2014870 - RNA, 15 nt, Human
uacaggcuccugcca

SEQ ID NO: 2014871 - RNA, 22 nt, Human
uacaggcgugagccaccgugcc

SEQ ID NO: 2014872 - RNA, 19 nt, Human
uacaccacuacauucuguu

SEQ ID NO: 2014873 - RNA, 20 nt, Human
uacaccacuacauucuguua

SEQ ID NO: 2014874 - RNA, 15 nt, Human
uacaccacuacauuc

SEQ ID NO: 2014875 - RNA, 16 nt, Human
uacaccacuacauucu

SEQ ID NO: 2014876 - RNA, 17 nt, Human
uacaccacuacauucug

SEQ ID NO: 2014877 - RNA, 18 nt, Human
uacaccacuacauucugu

SEQ ID NO: 2014878 - RNA, 21 nt, Human
aauggacguguuaugacucca

SEQ ID NO: 2014879 - RNA, 20 nt, Human
aauggacgguuuaggugaaa

SEQ ID NO: 2014880 - RNA, 14 nt, Human
aauggacauuucua

SEQ ID NO: 2014881 - RNA, 13 nt, Human
aauggaaugagaa

SEQ ID NO: 2014882 - RNA, 19 nt, Human
aauggacuuuuguacauag

SEQ ID NO: 2014883 - RNA, 11 nt, Human
uaauuucaagc

SEQ ID NO: 2014884 - RNA, 19 nt, Human
uaauuucaagcuuauuuug

SEQ ID NO: 2014885 - RNA, 15 nt, Human
uacaaaaagcauaaa

SEQ ID NO: 2014886 - RNA, 20 nt, Human
uacaaaaagcauaaaaauua

SEQ ID NO: 2014887 - RNA, 15 nt, Human
uacaaaagcauguga

SEQ ID NO: 2014888 - RNA, 20 nt, Human
uacaaaaccacaguguacca

SEQ ID NO: 2014889 - RNA, 21 nt, Human
uacaaaaccacaguguaccau

SEQ ID NO: 2014890 - RNA, 23 nt, Human
uacaaaaccacaguguaccauua

SEQ ID NO: 2014891 - RNA, 22 nt, Human
uaauuguuguuuguauguauaa

SEQ ID NO: 2014892 - RNA, 23 nt, Human
uaauuguuguuuguauguauaau

SEQ ID NO: 2014893 - RNA, 15 nt, Human
uaauuuaaaauugug

SEQ ID NO: 2014894 - RNA, 16 nt, Human
uaauuuaaaauuguga

SEQ ID NO: 2014895 - RNA, 15 nt, Human
uaauuccaugaaugu

SEQ ID NO: 2014896 - RNA, 15 nt, Human
uaauuguuguuugua

SEQ ID NO: 2014897 - RNA, 18 nt, Human
uaauuguuguuuguaugu

SEQ ID NO: 2014898 - RNA, 19 nt, Human
uaauuguuguuuguaugua

SEQ ID NO: 2014899 - RNA, 13 nt, Human
uaauuccacagcu

SEQ ID NO: 2014900 - RNA, 14 nt, Human
uaauuccacagcug

SEQ ID NO: 2014901 - RNA, 17 nt, Human
uaauuccacagcugcuc

SEQ ID NO: 2014902 - RNA, 18 nt, Human
uaauuauuucacuuuaga

SEQ ID NO: 2014903 - RNA, 12 nt, Human
uaauuauuugaa

SEQ ID NO: 2014904 - RNA, 13 nt, Human
uaauuauuugaau

SEQ ID NO: 2014905 - RNA, 16 nt, Human
uaauuauuugucucag

SEQ ID NO: 2014906 - RNA, 12 nt, Human
uaauucaaagca

SEQ ID NO: 2014907 - RNA, 19 nt, Human
uaauucaaagcaccaaaau

SEQ ID NO: 2014908 - RNA, 21 nt, Human
uaauucaaagcaccaaaauaa

SEQ ID NO: 2014909 - RNA, 18 nt, Human
uaauuauugauguuuuca

SEQ ID NO: 2014910 - RNA, 17 nt, Human
aaugcugucuuucuugc

SEQ ID NO: 2014911 - RNA, 19 nt, Human
aaugcugucuuucuugcuc

SEQ ID NO: 2014912 - RNA, 21 nt, Human
aaugcugucuuucuugcuccc

SEQ ID NO: 2014913 - RNA, 22 nt, Human
aaugcugucuuucuugcucccu

SEQ ID NO: 2014914 - RNA, 13 nt, Human
aauggacauuucu

SEQ ID NO: 2014915 - RNA, 16 nt, Human
aauggacguguuauga

SEQ ID NO: 2014916 - RNA, 17 nt, Human
aauggaaacagaggacc

SEQ ID NO: 2014917 - RNA, 18 nt, Human
aauggaaacagaggacca

SEQ ID NO: 2014918 - RNA, 24 nt, Human
aaugcccagccccuucugacccau

SEQ ID NO: 2014919 - RNA, 23 nt, Human
aaugcccagccccuucugaccca

SEQ ID NO: 2014920 - RNA, 22 nt, Human
aaugcccagccccuucugaccc

SEQ ID NO: 2014921 - RNA, 20 nt, Human
aaugcccagccccuucugac

SEQ ID NO: 2014922 - RNA, 20 nt, Human
aaugcugugcccuaaagugu

SEQ ID NO: 2014923 - RNA, 21 nt, Human
aaugcugugcccuaaagugua

SEQ ID NO: 2014924 - RNA, 21 nt, Human
aaugccccugaauuuaaauag

SEQ ID NO: 2014925 - RNA, 13 nt, Human
aaugcugugcccu

SEQ ID NO: 2014926 - RNA, 15 nt, Human
aaugcccagccccuu

SEQ ID NO: 2014927 - RNA, 14 nt, Human
aaugcccagccccu

SEQ ID NO: 2014928 - RNA, 16 nt, Human
aaugcauaaaauguua

SEQ ID NO: 2014929 - RNA, 18 nt, Human
uacaaaauguaacuguua

SEQ ID NO: 2014930 - RNA, 23 nt, Human
uacaaaauguaacuguuaccauu

SEQ ID NO: 2014931 - RNA, 12 nt, Human
uacaaaauguaa

SEQ ID NO: 2014932 - RNA, 14 nt, Human
uacaaaauguaacu

SEQ ID NO: 2014933 - RNA, 15 nt, Human
uacaaaauguaacug

SEQ ID NO: 2014934 - RNA, 14 nt, Human
uacaaggacagccc

SEQ ID NO: 2014935 - RNA, 13 nt, Human
aaugcauaaaaug

SEQ ID NO: 2014936 - RNA, 23 nt, Human
aaugcaguuacaaauuauaaugu

SEQ ID NO: 2014937 - RNA, 17 nt, Human
aaugcaguuacaaauua

SEQ ID NO: 2014938 - RNA, 20 nt, Human
aaugcaguuacaaauuauaa

SEQ ID NO: 2014939 - RNA, 22 nt, Human
uacaaguaguucuguauuugaa

SEQ ID NO: 2014940 - RNA, 23 nt, Human
uacaaguaguucuguauuugaaa

SEQ ID NO: 2014941 - RNA, 14 nt, Human
uacaaguaguucug

SEQ ID NO: 2014942 - RNA, 15 nt, Human
uacaaguaguucugu

SEQ ID NO: 2014943 - RNA, 16 nt, Human
uacaaguaguucugua

SEQ ID NO: 2014944 - RNA, 17 nt, Human
uacaaguaguucuguau

SEQ ID NO: 2014945 - RNA, 18 nt, Human
uacaaguaguucuguauu

SEQ ID NO: 2014946 - RNA, 19 nt, Human
uacaaguaguucuguauuu

SEQ ID NO: 2014947 - RNA, 21 nt, Human
uacaaguaguucuguauuuga

SEQ ID NO: 2014948 - RNA, 20 nt, Human
aagaauugucuuucugucuc

SEQ ID NO: 2014949 - RNA, 20 nt, Human
aagacaaaaagcuacuuauu

SEQ ID NO: 2014950 - RNA, 23 nt, Human
aagacaaaaagcuacuuauugua

SEQ ID NO: 2014951 - RNA, 13 nt, Human
aagaauuuaaaga

SEQ ID NO: 2014952 - RNA, 14 nt, Human
aagaauuuaaagaa

SEQ ID NO: 2014953 - RNA, 16 nt, Human
aagaauuuacuuugga

SEQ ID NO: 2014954 - RNA, 16 nt, Human
aagacaaaaagcuacu

SEQ ID NO: 2014955 - RNA, 13 nt, Human
aagacaaauagua

SEQ ID NO: 2014956 - RNA, 14 nt, Human
aagaauuucacaag

SEQ ID NO: 2014957 - RNA, 15 nt, Human
aagacccgagcuggg

SEQ ID NO: 2014958 - RNA, 16 nt, Human
aagaauugaagcagga

SEQ ID NO: 2014959 - RNA, 12 nt, Human
aagaauguaaag

SEQ ID NO: 2014960 - RNA, 13 nt, Human
aagaauguaaagc

SEQ ID NO: 2014961 - RNA, 14 nt, Human
aagaaugaguuucu

SEQ ID NO: 2014962 - RNA, 21 nt, Human
aagaaugaguuucuuagacuu

SEQ ID NO: 2014963 - RNA, 15 nt, Human
aagaaugcaugcuuu

SEQ ID NO: 2014964 - RNA, 20 nt, Human
aagaaugcaugcuuuccaua

SEQ ID NO: 2014965 - RNA, 16 nt, Human
guggcagcucaccucu

SEQ ID NO: 2014966 - RNA, 14 nt, Human
guggcagcucaccu

SEQ ID NO: 2014967 - RNA, 20 nt, Human
guggcagcucaccucucccu

SEQ ID NO: 2014968 - RNA, 17 nt, Human
guggcagcuauaggaaa

SEQ ID NO: 2014969 - RNA, 18 nt, Human
aagaaugaagguuuuugu

SEQ ID NO: 2014970 - RNA, 21 nt, Human
aagaaugaagguuuuuguaaa

SEQ ID NO: 2014971 - RNA, 22 nt, Human
aagaaugaagguuuuuguaaag

SEQ ID NO: 2014972 - RNA, 23 nt, Human
aagaaugaagguuuuuguaaaga

SEQ ID NO: 2014973 - RNA, 18 nt, Human
guggcaccagcagccugg

SEQ ID NO: 2014974 - RNA, 14 nt, Human
guggcaccugucug

SEQ ID NO: 2014975 - RNA, 15 nt, Human
guggcaccugucugc

SEQ ID NO: 2014976 - RNA, 18 nt, Human
guggcaccugucugcucc

SEQ ID NO: 2014977 - RNA, 20 nt, Human
guggcaccugucugcuccag

SEQ ID NO: 2014978 - RNA, 19 nt, Human
guggcaccagcagccugga

SEQ ID NO: 2014979 - RNA, 20 nt, Human
guggauuuaacagaaaugua

SEQ ID NO: 2014980 - RNA, 22 nt, Human
guggauucuuguuuugcuuccc

SEQ ID NO: 2014981 - RNA, 18 nt, Human
guggauucugaggcccug

SEQ ID NO: 2014982 - RNA, 18 nt, Human
guggauucuuguuuugcu

SEQ ID NO: 2014983 - RNA, 18 nt, Human
guggauuuaacagaaaug

SEQ ID NO: 2014984 - RNA, 19 nt, Human
guggauuuaacagaaaugu

SEQ ID NO: 2014985 - RNA, 22 nt, Human
gugcuaucucccccagccccau

SEQ ID NO: 2014986 - RNA, 23 nt, Human
gugcuauuguagagccagagguc

SEQ ID NO: 2014987 - RNA, 24 nt, Human
gugcuauuacgaaguucaagauca

SEQ ID NO: 2014988 - RNA, 12 nt, Human
gugcuauguucu

SEQ ID NO: 2014989 - RNA, 15 nt, Human
gugcucaggagcccu

SEQ ID NO: 2014990 - RNA, 16 nt, Human
gugcucaaaaugcaaa

SEQ ID NO: 2014991 - RNA, 21 nt, Human
gugcugggauuacaagcguga

SEQ ID NO: 2014992 - RNA, 22 nt, Human
gugcugggauuacaagcgugag

SEQ ID NO: 2014993 - RNA, 14 nt, Human
guggaagugugggu

SEQ ID NO: 2014994 - RNA, 15 nt, Human
guggaaguguggguc

SEQ ID NO: 2014995 - RNA, 19 nt, Human
guggaagugugggucugug

SEQ ID NO: 2014996 - RNA, 20 nt, Human
guggaagugugggucugugu

SEQ ID NO: 2014997 - RNA, 20 nt, Human
gugcugggauuacaggcgug

SEQ ID NO: 2014998 - RNA, 20 nt, Human
gugcugggauuacaggugug

SEQ ID NO: 2014999 - RNA, 15 nt, Human
guggaauuauuuuaa

SEQ ID NO: 2015000 - RNA, 16 nt, Human
guggaauuauuuuaaa

SEQ ID NO: 2015001 - RNA, 18 nt, Human
guggaauuauuuuaaaag

SEQ ID NO: 2015002 - RNA, 21 nt, Human
guggaagugugggucugugug

SEQ ID NO: 2015003 - RNA, 22 nt, Human
guggaagugugggucugugugu

SEQ ID NO: 2015004 - RNA, 19 nt, Human
guggaauuauuuuaaaaga

SEQ ID NO: 2015005 - RNA, 23 nt, Human
guggacacagcucuucuccaggc

SEQ ID NO: 2015006 - RNA, 18 nt, Human
guggacacagcucuucuc

SEQ ID NO: 2015007 - RNA, 22 nt, Human
guggacacagcucuucuccagg

SEQ ID NO: 2015008 - RNA, 16 nt, Human
guggacccugaaaugu

SEQ ID NO: 2015009 - RNA, 18 nt, Human
guggacccugaaaugugu

SEQ ID NO: 2015010 - RNA, 19 nt, Human
guggacccugaaaugugug

SEQ ID NO: 2015011 - RNA, 23 nt, Human
guggacccugaaaugugugugau

SEQ ID NO: 2015012 - RNA, 21 nt, Human
guggaugccugguggcagcug

SEQ ID NO: 2015013 - RNA, 21 nt, Human
guggauggaaggggcugacag

SEQ ID NO: 2015014 - RNA, 15 nt, Human
aagaaaaaggaugca

SEQ ID NO: 2015015 - RNA, 17 nt, Human
aagaaaaaggaugcaca

SEQ ID NO: 2015016 - RNA, 13 nt, Human
aagaaaaagcaaa

SEQ ID NO: 2015017 - RNA, 11 nt, Human
aagaaaaaagu

SEQ ID NO: 2015018 - RNA, 23 nt, Human
aagaaaaaaccguguuugucucu

SEQ ID NO: 2015019 - RNA, 18 nt, Human
aagaaaaaagagaaaaga

SEQ ID NO: 2015020 - RNA, 20 nt, Human
aagaaaaaagagaaaagaaa

SEQ ID NO: 2015021 - RNA, 18 nt, Human
aagaaaaaggaugcacag

SEQ ID NO: 2015022 - RNA, 17 nt, Human
aagaaaaagcaaaaggc

SEQ ID NO: 2015023 - RNA, 19 nt, Human
aagaaacucuauggucuua

SEQ ID NO: 2015024 - RNA, 21 nt, Human
aagaaacucuauggucuuaua

SEQ ID NO: 2015025 - RNA, 22 nt, Human
aagaaagacuaucuaaauguug

SEQ ID NO: 2015026 - RNA, 20 nt, Human
aagaaagacuaucuaaaugu

SEQ ID NO: 2015027 - RNA, 16 nt, Human
aagaaagaacuaucuu

SEQ ID NO: 2015028 - RNA, 20 nt, Human
aagaaauauguauucuguaa

SEQ ID NO: 2015029 - RNA, 15 nt, Human
aagaaauaguucugu

SEQ ID NO: 2015030 - RNA, 13 nt, Human
aagaaauauaccu

SEQ ID NO: 2015031 - RNA, 21 nt, Human
aagaaauaauuuuauuccaga

SEQ ID NO: 2015032 - RNA, 15 nt, Human
aagaaauacuguaca

SEQ ID NO: 2015033 - RNA, 12 nt, Human
aagaaauaauuu

SEQ ID NO: 2015034 - RNA, 13 nt, Human
aagaaauacugua

SEQ ID NO: 2015035 - RNA, 19 nt, Human
aagaagugugucacccuua

SEQ ID NO: 2015036 - RNA, 16 nt, Human
aagaagugaaaaucua

SEQ ID NO: 2015037 - RNA, 22 nt, Human
aagaagugaaaaucuacacucc

SEQ ID NO: 2015038 - RNA, 21 nt, Human
gugcuaucucccccagcccca

SEQ ID NO: 2015039 - RNA, 22 nt, Human
gugcuaggaacacuccuucaca

SEQ ID NO: 2015040 - RNA, 18 nt, Human
gugcuaggaacacuccuu

SEQ ID NO: 2015041 - RNA, 17 nt, Human
aagaauagcuuuaauga

SEQ ID NO: 2015042 - RNA, 13 nt, Human
aagaauaggacuu

SEQ ID NO: 2015043 - RNA, 17 nt, Human
aagaauaggacuuguuu

SEQ ID NO: 2015044 - RNA, 19 nt, Human
aagaauaggacuuguuuuu

SEQ ID NO: 2015045 - RNA, 21 nt, Human
aagaauaggacuuguuuuugu

SEQ ID NO: 2015046 - RNA, 22 nt, Human
aagaauaggacuuguuuuuguu

SEQ ID NO: 2015047 - RNA, 17 nt, Human
aagaauagcauuguaaa

SEQ ID NO: 2015048 - RNA, 18 nt, Human
aagaauagcauuguaaaa

SEQ ID NO: 2015049 - RNA, 23 nt, Human
aagaauagcauuguaaaagcauu

SEQ ID NO: 2015050 - RNA, 18 nt, Human
aacuugucuuuggacccu

SEQ ID NO: 2015051 - RNA, 22 nt, Human
aacuugucuuuggacccugagg

SEQ ID NO: 2015052 - RNA, 16 nt, Human
aacuuguauuaugugu

SEQ ID NO: 2015053 - RNA, 15 nt, Human
aacuuguauuaugug

SEQ ID NO: 2015054 - RNA, 11 nt, Human
gugccuuaugg

SEQ ID NO: 2015055 - RNA, 22 nt, Human
aacuugggagugugguuucuuu

SEQ ID NO: 2015056 - RNA, 23 nt, Human
aacuugggagugugguuucuuuu

SEQ ID NO: 2015057 - RNA, 12 nt, Human
aacuugggaacu

SEQ ID NO: 2015058 - RNA, 11 nt, Human
aacuugggagu

SEQ ID NO: 2015059 - RNA, 21 nt, Human
aacuuuaagaacuaaaauguu

SEQ ID NO: 2015060 - RNA, 13 nt, Human
aacuuuaccuuuu

SEQ ID NO: 2015061 - RNA, 14 nt, Human
aagaaaaaaaaaga

SEQ ID NO: 2015062 - RNA, 15 nt, Human
aagaaaaaaaaagaa

SEQ ID NO: 2015063 - RNA, 18 nt, Human
aagaaaaaaaaagaaaaa

SEQ ID NO: 2015064 - RNA, 19 nt, Human
aagaaaaaaaaagaaaaaa

SEQ ID NO: 2015065 - RNA, 13 nt, Human
aagaaaaaaaugu

SEQ ID NO: 2015066 - RNA, 20 nt, Human
aagaaaaaaaugucaaaagu

SEQ ID NO: 2015067 - RNA, 21 nt, Human
gugaaccaccacacccagccc

SEQ ID NO: 2015068 - RNA, 13 nt, Human
gugccgagcccuu

SEQ ID NO: 2015069 - RNA, 15 nt, Human
gugccucaagagaag

SEQ ID NO: 2015070 - RNA, 12 nt, Human
gugccuaaaaua

SEQ ID NO: 2015071 - RNA, 17 nt, Human
gugccuaaaauaagaau

SEQ ID NO: 2015072 - RNA, 16 nt, Human
gugccuaaauaaguua

SEQ ID NO: 2015073 - RNA, 15 nt, Human
gugccuaauguguuu

SEQ ID NO: 2015074 - RNA, 23 nt, Human
gugccuuauggaacacucugaga

SEQ ID NO: 2015075 - RNA, 21 nt, Human
gugccuuauggaacacucuga

SEQ ID NO: 2015076 - RNA, 14 nt, Human
gugccuuauggaac

SEQ ID NO: 2015077 - RNA, 15 nt, Human
gugccucugccuguc

SEQ ID NO: 2015078 - RNA, 13 nt, Human
gugccucugggac

SEQ ID NO: 2015079 - RNA, 12 nt, Human
gugccucuggga

SEQ ID NO: 2015080 - RNA, 13 nt, Human
gugccucugccug

SEQ ID NO: 2015081 - RNA, 17 nt, Human
gugucuuuccacuccuc

SEQ ID NO: 2015082 - RNA, 15 nt, Human
gugucuuucucuuuu

SEQ ID NO: 2015083 - RNA, 17 nt, Human
gugucuugcaauggcag

SEQ ID NO: 2015084 - RNA, 18 nt, Human
gugucuugcaauggcagc

SEQ ID NO: 2015085 - RNA, 12 nt, Human
aagcaaucaaga

SEQ ID NO: 2015086 - RNA, 14 nt, Human
guguguaauuuaaa

SEQ ID NO: 2015087 - RNA, 13 nt, Human
gugugaggcagga

SEQ ID NO: 2015088 - RNA, 17 nt, Human
gugugacuacuccccca

SEQ ID NO: 2015089 - RNA, 18 nt, Human
gugucuuuuuucacuaca

SEQ ID NO: 2015090 - RNA, 17 nt, Human
gugugaaaaugugugug

SEQ ID NO: 2015091 - RNA, 17 nt, Human
guguugccacuuuccaa

SEQ ID NO: 2015092 - RNA, 16 nt, Human
guguugcuuauguugu

SEQ ID NO: 2015093 - RNA, 15 nt, Human
guguuguguguggga

SEQ ID NO: 2015094 - RNA, 23 nt, Human
guguuuccuggcacugcuuccag

SEQ ID NO: 2015095 - RNA, 12 nt, Human
guguguaugugg

SEQ ID NO: 2015096 - RNA, 19 nt, Human
guguguccaaaacugccuc

SEQ ID NO: 2015097 - RNA, 18 nt, Human
guguguaugcgugugugu

SEQ ID NO: 2015098 - RNA, 12 nt, Human
aagauauuuuau

SEQ ID NO: 2015099 - RNA, 13 nt, Human
aagauauuccuga

SEQ ID NO: 2015100 - RNA, 21 nt, Human
aagauauacuuguuuuuguaa

SEQ ID NO: 2015101 - RNA, 12 nt, Human
aagaugcagccg

SEQ ID NO: 2015102 - RNA, 20 nt, Human
guggugguuuucuguucuuu

SEQ ID NO: 2015103 - RNA, 16 nt, Human
gugguuuguggcuuua

SEQ ID NO: 2015104 - RNA, 17 nt, Human
gugguuuucuguucuuu

SEQ ID NO: 2015105 - RNA, 21 nt, Human
aagagguuuggcuccugccca

SEQ ID NO: 2015106 - RNA, 14 nt, Human
aagagguuuuaaag

SEQ ID NO: 2015107 - RNA, 18 nt, Human
aagagguuuuaaagcuuc

SEQ ID NO: 2015108 - RNA, 18 nt, Human
aagagguuuuaaaaaaau

SEQ ID NO: 2015109 - RNA, 15 nt, Human
aagauauacuuguuu

SEQ ID NO: 2015110 - RNA, 16 nt, Human
aagauauacuuguuuu

SEQ ID NO: 2015111 - RNA, 19 nt, Human
aagauauacuuguuuuugu

SEQ ID NO: 2015112 - RNA, 18 nt, Human
aagaugugacauguuuua

SEQ ID NO: 2015113 - RNA, 14 nt, Human
aagaugugacaugu

SEQ ID NO: 2015114 - RNA, 22 nt, Human
aagcaaagacuuuccucuuagu

SEQ ID NO: 2015115 - RNA, 13 nt, Human
aagcaaaggagau

SEQ ID NO: 2015116 - RNA, 12 nt, Human
aagcaaaggaga

SEQ ID NO: 2015117 - RNA, 22 nt, Human
gugggacacccugugauggggc

SEQ ID NO: 2015118 - RNA, 23 nt, Human
guggcgcagcauauucaggaagc

SEQ ID NO: 2015119 - RNA, 13 nt, Human
gugggagugugua

SEQ ID NO: 2015120 - RNA, 14 nt, Human
gugggaguguguaa

SEQ ID NO: 2015121 - RNA, 13 nt, Human
gugggauccucca

SEQ ID NO: 2015122 - RNA, 14 nt, Human
gugggagugggccc

SEQ ID NO: 2015123 - RNA, 13 nt, Human
gugggagugggcc

SEQ ID NO: 2015124 - RNA, 16 nt, Human
gugggucugugugugu

SEQ ID NO: 2015125 - RNA, 13 nt, Human
gugggucugugug

SEQ ID NO: 2015126 - RNA, 21 nt, Human
guggugggcauucucucucca

SEQ ID NO: 2015127 - RNA, 16 nt, Human
gugguuucagaaaugu

SEQ ID NO: 2015128 - RNA, 14 nt, Human
guggugguuuucug

SEQ ID NO: 2015129 - RNA, 15 nt, Human
guggggggcuucaua

SEQ ID NO: 2015130 - RNA, 19 nt, Human
gugggggccccgucucagg

SEQ ID NO: 2015131 - RNA, 20 nt, Human
gugggggccccgucucaggu

SEQ ID NO: 2015132 - RNA, 16 nt, Human
guggggggcuucauac

SEQ ID NO: 2015133 - RNA, 20 nt, Human
gugggggaucacagccucug

SEQ ID NO: 2015134 - RNA, 21 nt, Human
gugggaguaguuggagcauug

SEQ ID NO: 2015135 - RNA, 14 nt, Human
guggguacgggagg

SEQ ID NO: 2015136 - RNA, 14 nt, Human
gugggggggcagag

SEQ ID NO: 2015137 - RNA, 15 nt, Human
gugggggggcagagc

SEQ ID NO: 2015138 - RNA, 18 nt, Human
aagacuaucuaaauguug

SEQ ID NO: 2015139 - RNA, 17 nt, Human
aagacugaguacguugu

SEQ ID NO: 2015140 - RNA, 17 nt, Human
aagacuguacaaaguag

SEQ ID NO: 2015141 - RNA, 21 nt, Human
aagacugaguacguugugcau

SEQ ID NO: 2015142 - RNA, 22 nt, Human
aagacugaguacguugugcauu

SEQ ID NO: 2015143 - RNA, 21 nt, Human
aagacccuuguggucccaccc

SEQ ID NO: 2015144 - RNA, 18 nt, Human
aagacccuugugguccca

SEQ ID NO: 2015145 - RNA, 22 nt, Human
aagacccuuguggucccacccc

SEQ ID NO: 2015146 - RNA, 22 nt, Human
aagaccuaaccagggccagaag

SEQ ID NO: 2015147 - RNA, 17 nt, Human
aagacuaucuaaauguu

SEQ ID NO: 2015148 - RNA, 16 nt, Human
aagacuaucuaaaugu

SEQ ID NO: 2015149 - RNA, 23 nt, Human
aagaccuggggcugcugugaagc

SEQ ID NO: 2015150 - RNA, 18 nt, Human
guggcccgacagccuggc

SEQ ID NO: 2015151 - RNA, 19 nt, Human
guggcccgacagccuggca

SEQ ID NO: 2015152 - RNA, 22 nt, Human
guggcccgguugaacucacucc

SEQ ID NO: 2015153 - RNA, 20 nt, Human
aagaggaacagcacugggga

SEQ ID NO: 2015154 - RNA, 22 nt, Human
aagaggaacagcacuggggagu

SEQ ID NO: 2015155 - RNA, 13 nt, Human
aagaggaaaagaa

SEQ ID NO: 2015156 - RNA, 16 nt, Human
aagaggaaaagaaauc

SEQ ID NO: 2015157 - RNA, 19 nt, Human
aagaggaaaauauugacaa

SEQ ID NO: 2015158 - RNA, 16 nt, Human
aagagcuuaacagugu

SEQ ID NO: 2015159 - RNA, 13 nt, Human
aagagcuuagaaa

SEQ ID NO: 2015160 - RNA, 14 nt, Human
aagagcuuagaaac

SEQ ID NO: 2015161 - RNA, 19 nt, Human
aagagcuuagaaacuggaa

SEQ ID NO: 2015162 - RNA, 21 nt, Human
aagagcuuagaaacuggaaau

SEQ ID NO: 2015163 - RNA, 12 nt, Human
aagagcuuuccu

SEQ ID NO: 2015164 - RNA, 16 nt, Human
aagagccuuaaaacau

SEQ ID NO: 2015165 - RNA, 13 nt, Human
aagagccuuaaaa

SEQ ID NO: 2015166 - RNA, 14 nt, Human
aagagccuuaaaac

SEQ ID NO: 2015167 - RNA, 21 nt, Human
aagagauuuaaacucugaauu

SEQ ID NO: 2015168 - RNA, 17 nt, Human
aagagcaaggaagguaa

SEQ ID NO: 2015169 - RNA, 18 nt, Human
aaggaugcacagaguugu

SEQ ID NO: 2015170 - RNA, 15 nt, Human
aaggaugcuuguaca

SEQ ID NO: 2015171 - RNA, 16 nt, Human
aaggaugcuuguacau

SEQ ID NO: 2015172 - RNA, 17 nt, Human
aaggaugcuuguacaua

SEQ ID NO: 2015173 - RNA, 19 nt, Human
aaggaugcuuguacauaau

SEQ ID NO: 2015174 - RNA, 19 nt, Human
aaggaugccccgucccccu

SEQ ID NO: 2015175 - RNA, 22 nt, Human
guugaugggaugauugaagaaa

SEQ ID NO: 2015176 - RNA, 23 nt, Human
aaggaugaucuaggaagacuuug

SEQ ID NO: 2015177 - RNA, 18 nt, Human
aaggaugaucuaggaaga

SEQ ID NO: 2015178 - RNA, 17 nt, Human
aaggauccugagccaga

SEQ ID NO: 2015179 - RNA, 15 nt, Human
aaggauccugagcca

SEQ ID NO: 2015180 - RNA, 13 nt, Human
aaggauccugagc

SEQ ID NO: 2015181 - RNA, 12 nt, Human
guugaugcaauc

SEQ ID NO: 2015182 - RNA, 24 nt, Human
guugaugcaauccuuacaaaugau

SEQ ID NO: 2015183 - RNA, 17 nt, Human
guugaugggaugauuga

SEQ ID NO: 2015184 - RNA, 21 nt, Human
guugaugggaugauugaagaa

SEQ ID NO: 2015185 - RNA, 14 nt, Human
aaggauccugagcc

SEQ ID NO: 2015186 - RNA, 21 nt, Human
guugaugccugugaacugaac

SEQ ID NO: 2015187 - RNA, 23 nt, Human
guugaugaucuuugcagacaggc

SEQ ID NO: 2015188 - RNA, 23 nt, Human
aaggcuauggggauagaugugug

SEQ ID NO: 2015189 - RNA, 19 nt, Human
aaggcuaccuuuguauucu

SEQ ID NO: 2015190 - RNA, 14 nt, Human
aaggccaccucuuc

SEQ ID NO: 2015191 - RNA, 20 nt, Human
aaggccaccucuuccuggcc

SEQ ID NO: 2015192 - RNA, 21 nt, Human
aaggccaccucuuccuggccg

SEQ ID NO: 2015193 - RNA, 22 nt, Human
aaggccaccucuuccuggccgg

SEQ ID NO: 2015194 - RNA, 18 nt, Human
aaggccaaaggaagcaca

SEQ ID NO: 2015195 - RNA, 14 nt, Human
aaggcuccaggagc

SEQ ID NO: 2015196 - RNA, 17 nt, Human
guugcccaggcaggucu

SEQ ID NO: 2015197 - RNA, 18 nt, Human
guugcccaggcaggucuu

SEQ ID NO: 2015198 - RNA, 19 nt, Human
guugcccaggcaggucuug

SEQ ID NO: 2015199 - RNA, 21 nt, Human
guugcccaggcuggcgugcag

SEQ ID NO: 2015200 - RNA, 15 nt, Human
guugcccaggcaggu

SEQ ID NO: 2015201 - RNA, 16 nt, Human
guugcccagugugagg

SEQ ID NO: 2015202 - RNA, 23 nt, Human
guuuaauugaaagaauguaaagc

SEQ ID NO: 2015203 - RNA, 13 nt, Human
guuuaugugugug

SEQ ID NO: 2015204 - RNA, 16 nt, Human
guuuaugugugugugu

SEQ ID NO: 2015205 - RNA, 12 nt, Human
guuuauguuuug

SEQ ID NO: 2015206 - RNA, 23 nt, Human
guuuauguuuugguccacuuuuc

SEQ ID NO: 2015207 - RNA, 20 nt, Human
guuuaagacauuuuuggaag

SEQ ID NO: 2015208 - RNA, 23 nt, Human
guuuaaggaauaugggagaaaua

SEQ ID NO: 2015209 - RNA, 19 nt, Human
guuuaagcagaauuggaaa

SEQ ID NO: 2015210 - RNA, 12 nt, Human
guuuaagcagaa

SEQ ID NO: 2015211 - RNA, 18 nt, Human
guuuaagcagaauuggaa

SEQ ID NO: 2015212 - RNA, 18 nt, Human
guuguaucagcacgugug

SEQ ID NO: 2015213 - RNA, 14 nt, Human
guuguaugaucugu

SEQ ID NO: 2015214 - RNA, 16 nt, Human
guuguauaaauuuauu

SEQ ID NO: 2015215 - RNA, 17 nt, Human
guuguauaaauuuauuu

SEQ ID NO: 2015216 - RNA, 19 nt, Human
guuguauaaauuuauuuac

SEQ ID NO: 2015217 - RNA, 21 nt, Human
guuguauaaauuuauuuacug

SEQ ID NO: 2015218 - RNA, 12 nt, Human
guuguauucauu

SEQ ID NO: 2015219 - RNA, 13 nt, Human
guuguacuuuaaa

SEQ ID NO: 2015220 - RNA, 18 nt, Human
guuguaccgcaaugugac

SEQ ID NO: 2015221 - RNA, 14 nt, Human
guugcugguacaca

SEQ ID NO: 2015222 - RNA, 15 nt, Human
guugcugguacacac

SEQ ID NO: 2015223 - RNA, 17 nt, Human
guugcugucagucuuga

SEQ ID NO: 2015224 - RNA, 12 nt, Human
guugcugguaaa

SEQ ID NO: 2015225 - RNA, 16 nt, Human
guugcugguaaaauga

SEQ ID NO: 2015226 - RNA, 12 nt, Human
guugcugccuca

SEQ ID NO: 2015227 - RNA, 18 nt, Human
guuggucccccuuccaug

SEQ ID NO: 2015228 - RNA, 13 nt, Human
guuggguggaugc

SEQ ID NO: 2015229 - RNA, 17 nt, Human
aagggccuggccugagc

SEQ ID NO: 2015230 - RNA, 14 nt, Human
aagggccuggccug

SEQ ID NO: 2015231 - RNA, 19 nt, Human
aagggccuggccugagcug

SEQ ID NO: 2015232 - RNA, 14 nt, Human
aagggcuuuccugu

SEQ ID NO: 2015233 - RNA, 13 nt, Human
aagggaaaaauca

SEQ ID NO: 2015234 - RNA, 22 nt, Human
aaggggaauguuugccucugcc

SEQ ID NO: 2015235 - RNA, 23 nt, Human
aaggggaauguuugccucugccu

SEQ ID NO: 2015236 - RNA, 15 nt, Human
aaggggaauuaacaa

SEQ ID NO: 2015237 - RNA, 20 nt, Human
aagggcuuuucaaaaucauu

SEQ ID NO: 2015238 - RNA, 16 nt, Human
aaggggaaucuggagg

SEQ ID NO: 2015239 - RNA, 21 nt, Human
aaggggaaucuggagguagcc

SEQ ID NO: 2015240 - RNA, 13 nt, Human
aagggccuggccu

SEQ ID NO: 2015241 - RNA, 22 nt, Human
aaggcuuuucaaccacaaaacu

SEQ ID NO: 2015242 - RNA, 15 nt, Human
aaggcuugcugcaga

SEQ ID NO: 2015243 - RNA, 16 nt, Human
aaggcuuauaaaacag

SEQ ID NO: 2015244 - RNA, 13 nt, Human
guuucaaaaaucu

SEQ ID NO: 2015245 - RNA, 14 nt, Human
guuucaaaaaucug

SEQ ID NO: 2015246 - RNA, 15 nt, Human
guuucaaaaaucuga

SEQ ID NO: 2015247 - RNA, 16 nt, Human
guuucaaaaaucugaa

SEQ ID NO: 2015248 - RNA, 15 nt, Human
aaguaauaugcacac

SEQ ID NO: 2015249 - RNA, 16 nt, Human
aaguaauaugcacaca

SEQ ID NO: 2015250 - RNA, 19 nt, Human
guuucuaaaggcuaccuuu

SEQ ID NO: 2015251 - RNA, 17 nt, Human
aaguaagucucaaggua

SEQ ID NO: 2015252 - RNA, 16 nt, Human
aaguaagucucaaggu

SEQ ID NO: 2015253 - RNA, 12 nt, Human
aaguaauaugca

SEQ ID NO: 2015254 - RNA, 22 nt, Human
aaguaaaaacaaagaaauuaug

SEQ ID NO: 2015255 - RNA, 18 nt, Human
aagguuuuuguaaagauu

SEQ ID NO: 2015256 - RNA, 14 nt, Human
aagguuuuuguaaa

SEQ ID NO: 2015257 - RNA, 17 nt, Human
aagguuuuuguaaagau

SEQ ID NO: 2015258 - RNA, 20 nt, Human
aaguaaaaacaaagaaauua

SEQ ID NO: 2015259 - RNA, 13 nt, Human
aaguaaaaacaaa

SEQ ID NO: 2015260 - RNA, 14 nt, Human
aagguuuuugauag

SEQ ID NO: 2015261 - RNA, 19 nt, Human
aagguuuuugauagcauug

SEQ ID NO: 2015262 - RNA, 16 nt, Human
aaggguaucaggugcu

SEQ ID NO: 2015263 - RNA, 13 nt, Human
aagggguuuucuu

SEQ ID NO: 2015264 - RNA, 22 nt, Human
aagggguuuucuugauaauuuu

SEQ ID NO: 2015265 - RNA, 12 nt, Human
aagggguuuucu

SEQ ID NO: 2015266 - RNA, 20 nt, Human
aagggaaaaaucaaguauua

SEQ ID NO: 2015267 - RNA, 14 nt, Human
aagguaaaaaguua

SEQ ID NO: 2015268 - RNA, 11 nt, Human
guuuucuguuc

SEQ ID NO: 2015269 - RNA, 16 nt, Human
guuuucuuaacuuaaa

SEQ ID NO: 2015270 - RNA, 17 nt, Human
guuuucuuaaccaucuu

SEQ ID NO: 2015271 - RNA, 16 nt, Human
guuuucuuaaccaucu

SEQ ID NO: 2015272 - RNA, 12 nt, Human
guuuucuguucu

SEQ ID NO: 2015273 - RNA, 20 nt, Human
guuuucuuaaccagaucauu

SEQ ID NO: 2015274 - RNA, 14 nt, Human
guuuuacaguguuu

SEQ ID NO: 2015275 - RNA, 15 nt, Human
guuuuacugcagcuu

SEQ ID NO: 2015276 - RNA, 16 nt, Human
guuuuacccuauaucu

SEQ ID NO: 2015277 - RNA, 19 nt, Human
guuuuagaaacaauaugga

SEQ ID NO: 2015278 - RNA, 23 nt, Human
guuuuacaauaaaaucuugaaaa

SEQ ID NO: 2015279 - RNA, 18 nt, Human
guuuggggaugagaaagg

SEQ ID NO: 2015280 - RNA, 20 nt, Human
guuugggccccagaggcugg

SEQ ID NO: 2015281 - RNA, 19 nt, Human
guuugccccguucuguuug

SEQ ID NO: 2015282 - RNA, 14 nt, Human
guuugccccguucu

SEQ ID NO: 2015283 - RNA, 14 nt, Human
guuugcauuucaga

SEQ ID NO: 2015284 - RNA, 15 nt, Human
guuugcauuucagaa

SEQ ID NO: 2015285 - RNA, 20 nt, Human
guuugccacuuugcaaagga

SEQ ID NO: 2015286 - RNA, 22 nt, Human
guuugggaccccuggugguuca

SEQ ID NO: 2015287 - RNA, 23 nt, Human
guuugggaagagcuuagaaacug

SEQ ID NO: 2015288 - RNA, 16 nt, Human
guuugggaccccuggu

SEQ ID NO: 2015289 - RNA, 21 nt, Human
guuugggaagagcuuagaaac

SEQ ID NO: 2015290 - RNA, 13 nt, Human
guuugccucugcc

SEQ ID NO: 2015291 - RNA, 16 nt, Human
guuugccucugccucu

SEQ ID NO: 2015292 - RNA, 22 nt, Human
guuucuaaaggcuaccuuugua

SEQ ID NO: 2015293 - RNA, 23 nt, Human
guuucuaaaggcuaccuuuguau

SEQ ID NO: 2015294 - RNA, 17 nt, Human
guuucugucguuaaaaa

SEQ ID NO: 2015295 - RNA, 22 nt, Human
guuugauucagacagcugccug

SEQ ID NO: 2015296 - RNA, 21 nt, Human
guuugauuugucacugcuuca

SEQ ID NO: 2015297 - RNA, 22 nt, Human
guuucugucguuaaaaacagau

SEQ ID NO: 2015298 - RNA, 14 nt, Human
guuucugucuccuc

SEQ ID NO: 2015299 - RNA, 21 nt, Human
guuucugugguuggcugggaa

SEQ ID NO: 2015300 - RNA, 22 nt, Human
guuucugugguuggcugggaaa

SEQ ID NO: 2015301 - RNA, 13 nt, Human
guuacaaaaugua

SEQ ID NO: 2015302 - RNA, 14 nt, Human
guuacaaaauguaa

SEQ ID NO: 2015303 - RNA, 16 nt, Human
guuacaaaauguaacu

SEQ ID NO: 2015304 - RNA, 17 nt, Human
guuacaaaauguaacug

SEQ ID NO: 2015305 - RNA, 18 nt, Human
guuacaaaauguaacugu

SEQ ID NO: 2015306 - RNA, 21 nt, Human
guuacaaaauguaacuguuac

SEQ ID NO: 2015307 - RNA, 15 nt, Human
guuacaaauuauaau

SEQ ID NO: 2015308 - RNA, 17 nt, Human
guuacaaauuauaaugu

SEQ ID NO: 2015309 - RNA, 20 nt, Human
guuacaaauuauaauguauu

SEQ ID NO: 2015310 - RNA, 21 nt, Human
guuagauauagagucauugua

SEQ ID NO: 2015311 - RNA, 13 nt, Human
guuagauuaagaa

SEQ ID NO: 2015312 - RNA, 16 nt, Human
guuagauuaagaaaua

SEQ ID NO: 2015313 - RNA, 17 nt, Human
guuaguaugaggcauuu

SEQ ID NO: 2015314 - RNA, 20 nt, Human
guuaguaugaggcauuuguu

SEQ ID NO: 2015315 - RNA, 18 nt, Human
guuaaugauagcuacugu

SEQ ID NO: 2015316 - RNA, 22 nt, Human
guuaaggagaaucauguuucuu

SEQ ID NO: 2015317 - RNA, 22 nt, Human
guuaaguugauggugaugaaau

SEQ ID NO: 2015318 - RNA, 12 nt, Human
guguuugucucu

SEQ ID NO: 2015319 - RNA, 15 nt, Human
guguuugucucuucu

SEQ ID NO: 2015320 - RNA, 17 nt, Human
guguuugucucuucugg

SEQ ID NO: 2015321 - RNA, 16 nt, Human
guuaagccuuuggaaa

SEQ ID NO: 2015322 - RNA, 12 nt, Human
guuaagccuuug

SEQ ID NO: 2015323 - RNA, 13 nt, Human
guuaagccuuugg

SEQ ID NO: 2015324 - RNA, 18 nt, Human
guguuuuaaaaugagaaa

SEQ ID NO: 2015325 - RNA, 17 nt, Human
guguuucauccuuccca

SEQ ID NO: 2015326 - RNA, 17 nt, Human
guucaggguuggccccu

SEQ ID NO: 2015327 - RNA, 18 nt, Human
guucaggguuggccccug

SEQ ID NO: 2015328 - RNA, 19 nt, Human
guucaggguuggccccugc

SEQ ID NO: 2015329 - RNA, 15 nt, Human
guucaguguuucugg

SEQ ID NO: 2015330 - RNA, 17 nt, Human
guucaguguuucugggg

SEQ ID NO: 2015331 - RNA, 23 nt, Human
guuauuucccuuuagcuguguua

SEQ ID NO: 2015332 - RNA, 18 nt, Human
guuauuucccuuuagcug

SEQ ID NO: 2015333 - RNA, 22 nt, Human
guuauuuauucugggaauguau

SEQ ID NO: 2015334 - RNA, 18 nt, Human
guucagcuccagcucacc

SEQ ID NO: 2015335 - RNA, 16 nt, Human
guucagcuccagcuca

SEQ ID NO: 2015336 - RNA, 17 nt, Human
guucagcuccagcucac

SEQ ID NO: 2015337 - RNA, 17 nt, Human
aagcuaggccuggccag

SEQ ID NO: 2015338 - RNA, 18 nt, Human
aagcuaggccuggccaga

SEQ ID NO: 2015339 - RNA, 17 nt, Human
aagccuggucagcccaa

SEQ ID NO: 2015340 - RNA, 16 nt, Human
aagcuaggccuggcca

SEQ ID NO: 2015341 - RNA, 22 nt, Human
aagcuaggccuggccagaugca

SEQ ID NO: 2015342 - RNA, 15 nt, Human
aagccuggucagccc

SEQ ID NO: 2015343 - RNA, 14 nt, Human
aagccuggaaaaaa

SEQ ID NO: 2015344 - RNA, 12 nt, Human
aagccugcuccu

SEQ ID NO: 2015345 - RNA, 16 nt, Human
aagccugcuccuuccc

SEQ ID NO: 2015346 - RNA, 17 nt, Human
aagccugcuccuucccu

SEQ ID NO: 2015347 - RNA, 19 nt, Human
aagccuccuccagccgcca

SEQ ID NO: 2015348 - RNA, 15 nt, Human
aagccucgacacaga

SEQ ID NO: 2015349 - RNA, 14 nt, Human
guucuuuaaacugu

SEQ ID NO: 2015350 - RNA, 23 nt, Human
guucuuguuuuuaaguuugcacu

SEQ ID NO: 2015351 - RNA, 23 nt, Human
guucuuuaaacugucgugucaua

SEQ ID NO: 2015352 - RNA, 18 nt, Human
guucuuguuuuuaaguuu

SEQ ID NO: 2015353 - RNA, 21 nt, Human
guucuugguuuguaaauuaac

SEQ ID NO: 2015354 - RNA, 17 nt, Human
guucuuaguuugcaguu

SEQ ID NO: 2015355 - RNA, 22 nt, Human
guugaugaucuuugcagacagg

SEQ ID NO: 2015356 - RNA, 20 nt, Human
guugaggaaagcacagaggc

SEQ ID NO: 2015357 - RNA, 16 nt, Human
guucuacccaggugcu

SEQ ID NO: 2015358 - RNA, 22 nt, Human
guucccuuugacgccaucccag

SEQ ID NO: 2015359 - RNA, 21 nt, Human
guucccuuugacgccauccca

SEQ ID NO: 2015360 - RNA, 20 nt, Human
guucccuuugacgccauccc

SEQ ID NO: 2015361 - RNA, 12 nt, Human
guucuguauuug

SEQ ID NO: 2015362 - RNA, 14 nt, Human
guucuguauuugaa

SEQ ID NO: 2015363 - RNA, 12 nt, Human
guucugguguua

SEQ ID NO: 2015364 - RNA, 16 nt, Human
guucccauuugcuccu

SEQ ID NO: 2015365 - RNA, 20 nt, Human
guucccauuugcuccuuucu

SEQ ID NO: 2015366 - RNA, 20 nt, Human
guucccuacuuccugugacu

SEQ ID NO: 2015367 - RNA, 21 nt, Human
guucccagauggcuggaaggg

SEQ ID NO: 2015368 - RNA, 20 nt, Human
guuccauggccucuucagau

SEQ ID NO: 2015369 - RNA, 21 nt, Human
aagcucuacugaggugcuaug

SEQ ID NO: 2015370 - RNA, 18 nt, Human
aagcugaacacauuucuu

SEQ ID NO: 2015371 - RNA, 17 nt, Human
aagcugaacacugaagu

SEQ ID NO: 2015372 - RNA, 22 nt, Human
aagcuauucaguaauaacucua

SEQ ID NO: 2015373 - RNA, 17 nt, Human
aagcuaucguaaaauua

SEQ ID NO: 2015374 - RNA, 16 nt, Human
aagcuuauuuuggaga

SEQ ID NO: 2015375 - RNA, 17 nt, Human
guccucugaaugaaccu

SEQ ID NO: 2015376 - RNA, 13 nt, Human
guccucugaauga

SEQ ID NO: 2015377 - RNA, 18 nt, Human
guccucuuaacuguggug

SEQ ID NO: 2015378 - RNA, 18 nt, Human
guccuuaucuagcugcau

SEQ ID NO: 2015379 - RNA, 16 nt, Human
guccuuaucuagcugc

SEQ ID NO: 2015380 - RNA, 17 nt, Human
guccuuaucuagcugca

SEQ ID NO: 2015381 - RNA, 15 nt, Human
aacauacucccaucu

SEQ ID NO: 2015382 - RNA, 14 nt, Human
aacauacucccauc

SEQ ID NO: 2015383 - RNA, 22 nt, Human
aacauacaaaugcaucuuugau

SEQ ID NO: 2015384 - RNA, 14 nt, Human
aacauacaaaugca

SEQ ID NO: 2015385 - RNA, 15 nt, Human
aacauacaaaugcau

SEQ ID NO: 2015386 - RNA, 20 nt, Human
aacauacaaaugcaucuuug

SEQ ID NO: 2015387 - RNA, 21 nt, Human
aacauacaaaugcaucuuuga

SEQ ID NO: 2015388 - RNA, 14 nt, Human
aacauucuauuuca

SEQ ID NO: 2015389 - RNA, 15 nt, Human
aacauucuauuucaa

SEQ ID NO: 2015390 - RNA, 21 nt, Human
aacauacgugugcaugugucu

SEQ ID NO: 2015391 - RNA, 20 nt, Human
aacauuuguucuauagcuuu

SEQ ID NO: 2015392 - RNA, 20 nt, Human
aacauugcauauaacuuaua

SEQ ID NO: 2015393 - RNA, 21 nt, Human
aacauugcauauaacuuauau

SEQ ID NO: 2015394 - RNA, 16 nt, Human
aacauuguagccucaa

SEQ ID NO: 2015395 - RNA, 22 nt, Human
aacauugcauauaacuuauauu

SEQ ID NO: 2015396 - RNA, 14 nt, Human
aacauuguagccuc

SEQ ID NO: 2015397 - RNA, 19 nt, Human
aacaguuguguuugaagca

SEQ ID NO: 2015398 - RNA, 13 nt, Human
aacaguuucaaaa

SEQ ID NO: 2015399 - RNA, 20 nt, Human
aacaguguggccucuucuga

SEQ ID NO: 2015400 - RNA, 14 nt, Human
aacaguaaucaguu

SEQ ID NO: 2015401 - RNA, 21 nt, Human
aacaguacccugguugugugu

SEQ ID NO: 2015402 - RNA, 15 nt, Human
aacagugcuguuucc

SEQ ID NO: 2015403 - RNA, 19 nt, Human
aacagacuggaagcacagc

SEQ ID NO: 2015404 - RNA, 22 nt, Human
aacaggcugggcuucaguggca

SEQ ID NO: 2015405 - RNA, 13 nt, Human
aacaggcugggcu

SEQ ID NO: 2015406 - RNA, 23 nt, Human
aacaggcugggcuucaguggcag

SEQ ID NO: 2015407 - RNA, 22 nt, Human
aacaguagugauaguuguaccg

SEQ ID NO: 2015408 - RNA, 15 nt, Human
aacagaaauugguac

SEQ ID NO: 2015409 - RNA, 22 nt, Human
aacagaaauugguaccuugcac

SEQ ID NO: 2015410 - RNA, 10 nt, Human
aacagaaaug

SEQ ID NO: 2015411 - RNA, 11 nt, Human
aacagaaaugu

SEQ ID NO: 2015412 - RNA, 21 nt, Human
aacagaaauguacagcaagga

SEQ ID NO: 2015413 - RNA, 12 nt, Human
aacagaaauugg

SEQ ID NO: 2015414 - RNA, 13 nt, Human
aacagaaauuggu

SEQ ID NO: 2015415 - RNA, 14 nt, Human
aacagaaauuggua

SEQ ID NO: 2015416 - RNA, 21 nt, Human
guccggucccugucccagugc

SEQ ID NO: 2015417 - RNA, 14 nt, Human
aacacuuuaauggg

SEQ ID NO: 2015418 - RNA, 23 nt, Human
aacacuugugacuuuugcuuuaa

SEQ ID NO: 2015419 - RNA, 12 nt, Human
gucauuuucauu

SEQ ID NO: 2015420 - RNA, 15 nt, Human
gucccaacuuguaaa

SEQ ID NO: 2015421 - RNA, 13 nt, Human
guccgagcuuuga

SEQ ID NO: 2015422 - RNA, 23 nt, Human
aacaauaggaugggcuucugugc

SEQ ID NO: 2015423 - RNA, 18 nt, Human
aacaagucagucauucag

SEQ ID NO: 2015424 - RNA, 16 nt, Human
aacaagucccuguaau

SEQ ID NO: 2015425 - RNA, 15 nt, Human
aacaagucagucauu

SEQ ID NO: 2015426 - RNA, 23 nt, Human
aacaaggcaaggcugucaauuac

SEQ ID NO: 2015427 - RNA, 16 nt, Human
aacaaggcuugcugca

SEQ ID NO: 2015428 - RNA, 14 nt, Human
aacaauuuucagau

SEQ ID NO: 2015429 - RNA, 16 nt, Human
aacaauuuucagauuu

SEQ ID NO: 2015430 - RNA, 17 nt, Human
aacaauuuucagauuug

SEQ ID NO: 2015431 - RNA, 18 nt, Human
aacaauuuucagauuugc

SEQ ID NO: 2015432 - RNA, 19 nt, Human
aacaauuuucagauuugca

SEQ ID NO: 2015433 - RNA, 20 nt, Human
aacaauuuucagauuugcac

SEQ ID NO: 2015434 - RNA, 21 nt, Human
aacaauuuucagauuugcaca

SEQ ID NO: 2015435 - RNA, 22 nt, Human
aacaauuuucagauuugcacaa

SEQ ID NO: 2015436 - RNA, 23 nt, Human
aacaauuuucagauuugcacaaa

SEQ ID NO: 2015437 - RNA, 23 nt, Human
aaauuuuuaaucuuuaauuuuac

SEQ ID NO: 2015438 - RNA, 15 nt, Human
aaauuuuucauauuu

SEQ ID NO: 2015439 - RNA, 16 nt, Human
aaauuuuucauauuuu

SEQ ID NO: 2015440 - RNA, 17 nt, Human
aaauuuuucauauuuua

SEQ ID NO: 2015441 - RNA, 19 nt, Human
aaauuuuucauauuuuaau

SEQ ID NO: 2015442 - RNA, 12 nt, Human
aaauuuuucaua

SEQ ID NO: 2015443 - RNA, 13 nt, Human
aaauuuuucauau

SEQ ID NO: 2015444 - RNA, 14 nt, Human
aaauuuuucauauu

SEQ ID NO: 2015445 - RNA, 16 nt, Human
gucacaggcaggucca

SEQ ID NO: 2015446 - RNA, 13 nt, Human
gucacaggcaggu

SEQ ID NO: 2015447 - RNA, 15 nt, Human
gucacaggcaggucc

SEQ ID NO: 2015448 - RNA, 16 nt, Human
aacaagaccacguuuc

SEQ ID NO: 2015449 - RNA, 17 nt, Human
aacaagaccacguuucu

SEQ ID NO: 2015450 - RNA, 19 nt, Human
aacaagaccacguuucuaa

SEQ ID NO: 2015451 - RNA, 20 nt, Human
aacaagaccacguuucuaaa

SEQ ID NO: 2015452 - RNA, 21 nt, Human
aacaagccuccuuuuaaagua

SEQ ID NO: 2015453 - RNA, 21 nt, Human
aacacucauugaccugaggcc

SEQ ID NO: 2015454 - RNA, 11 nt, Human
aacacucugag

SEQ ID NO: 2015455 - RNA, 12 nt, Human
aacacuccuuca

SEQ ID NO: 2015456 - RNA, 13 nt, Human
aacacucugagac

SEQ ID NO: 2015457 - RNA, 12 nt, Human
aacacucugaga

SEQ ID NO: 2015458 - RNA, 14 nt, Human
aacacucugagacu

SEQ ID NO: 2015459 - RNA, 21 nt, Human
aacacuguguauuguuguaaa

SEQ ID NO: 2015460 - RNA, 20 nt, Human
aacacuguucucugcccucc

SEQ ID NO: 2015461 - RNA, 15 nt, Human
aacacuguucucugc

SEQ ID NO: 2015462 - RNA, 22 nt, Human
guccaagggguccccuccagga

SEQ ID NO: 2015463 - RNA, 20 nt, Human
guccaagggguccccuccag

SEQ ID NO: 2015464 - RNA, 15 nt, Human
guccacaacacacag

SEQ ID NO: 2015465 - RNA, 21 nt, Human
aacacuguucucugcccucca

SEQ ID NO: 2015466 - RNA, 12 nt, Human
aacacuguuauc

SEQ ID NO: 2015467 - RNA, 18 nt, Human
aacacuguuaucauuuuu

SEQ ID NO: 2015468 - RNA, 21 nt, Human
aacacuguuaucauuuuuucc

SEQ ID NO: 2015469 - RNA, 21 nt, Human
gucauuugagcagggcucagc

SEQ ID NO: 2015470 - RNA, 11 nt, Human
aacacuuccau

SEQ ID NO: 2015471 - RNA, 22 nt, Human
gucauuugagcagggcucagcg

SEQ ID NO: 2015472 - RNA, 21 nt, Human
aacacuugugacuuuugcuuu

SEQ ID NO: 2015473 - RNA, 16 nt, Human
aacacuugugacuuuu

SEQ ID NO: 2015474 - RNA, 22 nt, Human
aacacuugugacuuuugcuuua

SEQ ID NO: 2015475 - RNA, 13 nt, Human
guccaagcagauu

SEQ ID NO: 2015476 - RNA, 11 nt, Human
gucauuuucau

SEQ ID NO: 2015477 - RNA, 13 nt, Human
aacucccuuucaa

SEQ ID NO: 2015478 - RNA, 14 nt, Human
aacucccuuucaac

SEQ ID NO: 2015479 - RNA, 17 nt, Human
aacucuaaguguuugcu

SEQ ID NO: 2015480 - RNA, 20 nt, Human
aacucuaaguguuugcugca

SEQ ID NO: 2015481 - RNA, 19 nt, Human
gugaaccaccacacccagc

SEQ ID NO: 2015482 - RNA, 18 nt, Human
aacuaggaaggcacuucu

SEQ ID NO: 2015483 - RNA, 20 nt, Human
aacuagauuacauucaguug

SEQ ID NO: 2015484 - RNA, 13 nt, Human
aacucccugcccc

SEQ ID NO: 2015485 - RNA, 19 nt, Human
aacucccugccccccagcc

SEQ ID NO: 2015486 - RNA, 12 nt, Human
aacuccaugaug

SEQ ID NO: 2015487 - RNA, 23 nt, Human
aacuaggaaggcacuucugccug

SEQ ID NO: 2015488 - RNA, 15 nt, Human
aacuaaaguuguacu

SEQ ID NO: 2015489 - RNA, 16 nt, Human
aacuaaaguuguacuu

SEQ ID NO: 2015490 - RNA, 17 nt, Human
aacuaaaguuguacuuu

SEQ ID NO: 2015491 - RNA, 19 nt, Human
aacuaaaguuguacuuuaa

SEQ ID NO: 2015492 - RNA, 19 nt, Human
aacguggcugcuucaagga

SEQ ID NO: 2015493 - RNA, 16 nt, Human
aacguggcugcuucaa

SEQ ID NO: 2015494 - RNA, 22 nt, Human
aacguggcugcuucaaggaucc

SEQ ID NO: 2015495 - RNA, 15 nt, Human
aacguggcugcuuca

SEQ ID NO: 2015496 - RNA, 20 nt, Human
aaccugcucuccucuugcca

SEQ ID NO: 2015497 - RNA, 11 nt, Human
aaccugcucuc

SEQ ID NO: 2015498 - RNA, 15 nt, Human
aaccugcucuccucu

SEQ ID NO: 2015499 - RNA, 15 nt, Human
gucuuuggacccuga

SEQ ID NO: 2015500 - RNA, 14 nt, Human
gucuuuggacccug

SEQ ID NO: 2015501 - RNA, 17 nt, Human
gucuuuggacccugagg

SEQ ID NO: 2015502 - RNA, 19 nt, Human
gucuuuucuugcaugaggc

SEQ ID NO: 2015503 - RNA, 14 nt, Human
gucuuuucuugcau

SEQ ID NO: 2015504 - RNA, 24 nt, Human
gucuuuucuugcaugaggcuagug

SEQ ID NO: 2015505 - RNA, 17 nt, Human
gucuuuuccucgcuucu

SEQ ID NO: 2015506 - RNA, 16 nt, Human
gucuuugagcucccac

SEQ ID NO: 2015507 - RNA, 15 nt, Human
gucuuuucuuugcca

SEQ ID NO: 2015508 - RNA, 19 nt, Human
gucuuuucuuugccaucuc

SEQ ID NO: 2015509 - RNA, 20 nt, Human
gucuuuucuuugccaucucu

SEQ ID NO: 2015510 - RNA, 15 nt, Human
gucuuagauguauau

SEQ ID NO: 2015511 - RNA, 18 nt, Human
gucuuagaucauaguuuu

SEQ ID NO: 2015512 - RNA, 14 nt, Human
gucuuccuacucuu

SEQ ID NO: 2015513 - RNA, 16 nt, Human
gucuuccuacucuucu

SEQ ID NO: 2015514 - RNA, 19 nt, Human
gucuuccuacucuucucuc

SEQ ID NO: 2015515 - RNA, 22 nt, Human
gucuuccuacucuucucucugc

SEQ ID NO: 2015516 - RNA, 16 nt, Human
gucuuccuauuucaga

SEQ ID NO: 2015517 - RNA, 18 nt, Human
gucuuccuauuucagaag

SEQ ID NO: 2015518 - RNA, 20 nt, Human
gucuuccuauuucagaaguu

SEQ ID NO: 2015519 - RNA, 23 nt, Human
gucuuccuauuucagaaguuuaa

SEQ ID NO: 2015520 - RNA, 12 nt, Human
gucuggcugcag

SEQ ID NO: 2015521 - RNA, 13 nt, Human
gucuggcugcaga

SEQ ID NO: 2015522 - RNA, 14 nt, Human
gucuggcugcagag

SEQ ID NO: 2015523 - RNA, 15 nt, Human
gucuggcuucacaga

SEQ ID NO: 2015524 - RNA, 18 nt, Human
gucugcuccagcucuggc

SEQ ID NO: 2015525 - RNA, 14 nt, Human
gucugcuccagcuc

SEQ ID NO: 2015526 - RNA, 16 nt, Human
gucugcuccagcucug

SEQ ID NO: 2015527 - RNA, 12 nt, Human
aaccucuuccuc

SEQ ID NO: 2015528 - RNA, 21 nt, Human
aaccucuccucauguucugcu

SEQ ID NO: 2015529 - RNA, 18 nt, Human
aaccucuagaauuuuaag

SEQ ID NO: 2015530 - RNA, 20 nt, Human
gucugcuggucacuucuucu

SEQ ID NO: 2015531 - RNA, 22 nt, Human
gucucauaguuggacuuucuag

SEQ ID NO: 2015532 - RNA, 18 nt, Human
gucucccccacccuuguu

SEQ ID NO: 2015533 - RNA, 20 nt, Human
gucucccccacccuuguucc

SEQ ID NO: 2015534 - RNA, 22 nt, Human
gucucccccacccuuguuccag

SEQ ID NO: 2015535 - RNA, 14 nt, Human
aaccaaaaagaaaa

SEQ ID NO: 2015536 - RNA, 14 nt, Human
gucuccucaggacc

SEQ ID NO: 2015537 - RNA, 15 nt, Human
gucuccucaggacca

SEQ ID NO: 2015538 - RNA, 20 nt, Human
gucuccucuauccugggcuu

SEQ ID NO: 2015539 - RNA, 16 nt, Human
gucucccucccuuggg

SEQ ID NO: 2015540 - RNA, 16 nt, Human
gucuccuacugaggau

SEQ ID NO: 2015541 - RNA, 21 nt, Human
aaccaucauugaaaucuuuuu

SEQ ID NO: 2015542 - RNA, 23 nt, Human
aaccaucauugaaaucuuuuugc

SEQ ID NO: 2015543 - RNA, 20 nt, Human
aaccaucauugaaaucuuuu

SEQ ID NO: 2015544 - RNA, 19 nt, Human
aaccaucauugaaaucuuu

SEQ ID NO: 2015545 - RNA, 20 nt, Human
aaccacaucuugcucugcug

SEQ ID NO: 2015546 - RNA, 22 nt, Human
aaccacaucuugcucugcugac

SEQ ID NO: 2015547 - RNA, 19 nt, Human
aaccaaagcgaauuuuaaa

SEQ ID NO: 2015548 - RNA, 20 nt, Human
aaccaaaaguuauuaaaauu

SEQ ID NO: 2015549 - RNA, 22 nt, Human
aaccaaaaguuauuaaaauugu

SEQ ID NO: 2015550 - RNA, 13 nt, Human
aaccaaagaagaa

SEQ ID NO: 2015551 - RNA, 16 nt, Human
aaccacaaaacucauc

SEQ ID NO: 2015552 - RNA, 18 nt, Human
aaccacaucuugcucugc

SEQ ID NO: 2015553 - RNA, 17 nt, Human
aaccuccgccucuuggg

SEQ ID NO: 2015554 - RNA, 14 nt, Human
aaccuccugggcua

SEQ ID NO: 2015555 - RNA, 24 nt, Human
aaccucuaaauucuuucauuuuag

SEQ ID NO: 2015556 - RNA, 12 nt, Human
aacccccagcuc

SEQ ID NO: 2015557 - RNA, 17 nt, Human
aaccuaguacugccccc

SEQ ID NO: 2015558 - RNA, 13 nt, Human
aacccccagccug

SEQ ID NO: 2015559 - RNA, 14 nt, Human
aacccccagccugc

SEQ ID NO: 2015560 - RNA, 15 nt, Human
aacccccagccugcu

SEQ ID NO: 2015561 - RNA, 18 nt, Human
aacccaaauguucaucaa

SEQ ID NO: 2015562 - RNA, 11 nt, Human
aacccagcucu

SEQ ID NO: 2015563 - RNA, 14 nt, Human
aacccagcucuggu

SEQ ID NO: 2015564 - RNA, 13 nt, Human
aacccagcucugg

SEQ ID NO: 2015565 - RNA, 13 nt, Human
aacccaaauguuc

SEQ ID NO: 2015566 - RNA, 23 nt, Human
aaccauuuugcugucccuuuucc

SEQ ID NO: 2015567 - RNA, 20 nt, Human
aacccauauuuguacaccaa

SEQ ID NO: 2015568 - RNA, 16 nt, Human
aaccccaaguuaguuc

SEQ ID NO: 2015569 - RNA, 17 nt, Human
aacccagcucuggucca

SEQ ID NO: 2015570 - RNA, 11 nt, Human
aacccagcugc

SEQ ID NO: 2015571 - RNA, 15 nt, Human
aacccagcugcaccc

SEQ ID NO: 2015572 - RNA, 16 nt, Human
aacccagcugcacccc

SEQ ID NO: 2015573 - RNA, 21 nt, Human
aacccagcugcaccccuuccu

SEQ ID NO: 2015574 - RNA, 23 nt, Human
aacccagcugcaccccuuccugg

SEQ ID NO: 2015575 - RNA, 15 nt, Human
aacccagcuuacauu

SEQ ID NO: 2015576 - RNA, 19 nt, Human
aaaugagccuggcaagaau

SEQ ID NO: 2015577 - RNA, 13 nt, Human
aaaugagccuggc

SEQ ID NO: 2015578 - RNA, 16 nt, Human
aaaugagaaaucuaaa

SEQ ID NO: 2015579 - RNA, 14 nt, Human
aaaugagaaaucua

SEQ ID NO: 2015580 - RNA, 13 nt, Human
aaaugagaaaucu

SEQ ID NO: 2015581 - RNA, 9 nt, Human
aaaugaggg

SEQ ID NO: 2015582 - RNA, 22 nt, Human
aaaugaguccaaacuggaauga

SEQ ID NO: 2015583 - RNA, 23 nt, Human
aaaugagguacucuccuggaaau

SEQ ID NO: 2015584 - RNA, 16 nt, Human
aaaugagguacucucc

SEQ ID NO: 2015585 - RNA, 17 nt, Human
aaaugaggucagagccu

SEQ ID NO: 2015586 - RNA, 19 nt, Human
aaaugaggucagagccugc

SEQ ID NO: 2015587 - RNA, 11 nt, Human
aaaugagaaau

SEQ ID NO: 2015588 - RNA, 14 nt, Human
aaaugacuuuauua

SEQ ID NO: 2015589 - RNA, 15 nt, Human
aaaugacuuuauuau

SEQ ID NO: 2015590 - RNA, 18 nt, Human
aaaugacuuuauuauuua

SEQ ID NO: 2015591 - RNA, 20 nt, Human
aaaugacuuuauuauuuauu

SEQ ID NO: 2015592 - RNA, 21 nt, Human
aaaugacuuuauuauuuauuu

SEQ ID NO: 2015593 - RNA, 14 nt, Human
aaaugaacaucuau

SEQ ID NO: 2015594 - RNA, 16 nt, Human
aaaugaacacaaauua

SEQ ID NO: 2015595 - RNA, 18 nt, Human
aaaugaacacaaauuaug

SEQ ID NO: 2015596 - RNA, 13 nt, Human
aaaugaacacaaa

SEQ ID NO: 2015597 - RNA, 15 nt, Human
aaaugaacacaaauu

SEQ ID NO: 2015598 - RNA, 13 nt, Human
aaaugaagaauuu

SEQ ID NO: 2015599 - RNA, 15 nt, Human
aaaugaagaauuuaa

SEQ ID NO: 2015600 - RNA, 19 nt, Human
aaaugaagagcuguugaug

SEQ ID NO: 2015601 - RNA, 16 nt, Human
aaaugaagaauuuaaa

SEQ ID NO: 2015602 - RNA, 18 nt, Human
aaaugaagaauuuaaaga

SEQ ID NO: 2015603 - RNA, 21 nt, Human
aaaugaaagcagggacuugaa

SEQ ID NO: 2015604 - RNA, 22 nt, Human
aaaugaaagcagggacuugaac

SEQ ID NO: 2015605 - RNA, 18 nt, Human
aaaugcaugauugcagaa

SEQ ID NO: 2015606 - RNA, 21 nt, Human
aaaugcaugauugcagaauug

SEQ ID NO: 2015607 - RNA, 13 nt, Human
aaaugcauguugc

SEQ ID NO: 2015608 - RNA, 14 nt, Human
aaaugcaucuuuga

SEQ ID NO: 2015609 - RNA, 15 nt, Human
aaaugcaucuuugau

SEQ ID NO: 2015610 - RNA, 16 nt, Human
aaaugcaucuuugaug

SEQ ID NO: 2015611 - RNA, 18 nt, Human
aaaugcaucuuugaugug

SEQ ID NO: 2015612 - RNA, 19 nt, Human
aaaugcaucuuugaugugu

SEQ ID NO: 2015613 - RNA, 20 nt, Human
aaaugcaucuuugauguguu

SEQ ID NO: 2015614 - RNA, 21 nt, Human
aaaugcaucuuugauguguug

SEQ ID NO: 2015615 - RNA, 17 nt, Human
aaaugcaguuacaaauu

SEQ ID NO: 2015616 - RNA, 18 nt, Human
aaaugcaccuggaauaua

SEQ ID NO: 2015617 - RNA, 22 nt, Human
aaaugcaccuggaauauauaac

SEQ ID NO: 2015618 - RNA, 19 nt, Human
aaaugaugugccugcuuca

SEQ ID NO: 2015619 - RNA, 15 nt, Human
aaaugauuucacagu

SEQ ID NO: 2015620 - RNA, 16 nt, Human
aaaugauugcuuuuaa

SEQ ID NO: 2015621 - RNA, 17 nt, Human
aaaugauugcuuuuaaa

SEQ ID NO: 2015622 - RNA, 20 nt, Human
aaaugauugcuuuuaaaauu

SEQ ID NO: 2015623 - RNA, 22 nt, Human
aaaugauugcuuuuaaaauuuu

SEQ ID NO: 2015624 - RNA, 23 nt, Human
aaaugauugcuuuuaaaauuuua

SEQ ID NO: 2015625 - RNA, 20 nt, Human
aaaugcaaaaaaucuuaaua

SEQ ID NO: 2015626 - RNA, 22 nt, Human
aaaugcaaaaaaucuuaauacu

SEQ ID NO: 2015627 - RNA, 22 nt, Human
aaaugcaaacugggcuggaaga

SEQ ID NO: 2015628 - RNA, 14 nt, Human
aaaugcaccuggaa

SEQ ID NO: 2015629 - RNA, 20 nt, Human
aaaugggcagagcagagacc

SEQ ID NO: 2015630 - RNA, 18 nt, Human
aaaugggcagagcagaga

SEQ ID NO: 2015631 - RNA, 21 nt, Human
aaaugccuccaaaguauugua

SEQ ID NO: 2015632 - RNA, 15 nt, Human
aaaugggcagagcag

SEQ ID NO: 2015633 - RNA, 13 nt, Human
aaaugcccagcuu

SEQ ID NO: 2015634 - RNA, 18 nt, Human
aaaugcccagccccuucu

SEQ ID NO: 2015635 - RNA, 15 nt, Human
aaaugcccagccccu

SEQ ID NO: 2015636 - RNA, 14 nt, Human
aaaugcccagcccc

SEQ ID NO: 2015637 - RNA, 13 nt, Human
aaaugcccagccc

SEQ ID NO: 2015638 - RNA, 14 nt, Human
aaaugcauuucuaa

SEQ ID NO: 2015639 - RNA, 24 nt, Human
aaaggaguuucuuuagcugacaga

SEQ ID NO: 2015640 - RNA, 19 nt, Human
aaaggagacuguguuuggu

SEQ ID NO: 2015641 - RNA, 22 nt, Human
aaaggagcucgaaggauauugu

SEQ ID NO: 2015642 - RNA, 17 nt, Human
aaaggagagcuagcagc

SEQ ID NO: 2015643 - RNA, 13 nt, Human
aaaggacugugau

SEQ ID NO: 2015644 - RNA, 12 nt, Human
guagcugggacu

SEQ ID NO: 2015645 - RNA, 18 nt, Human
guagcugggacuacaggc

SEQ ID NO: 2015646 - RNA, 19 nt, Human
guagcugggacuacaggca

SEQ ID NO: 2015647 - RNA, 21 nt, Human
guagcugggacuacaggcacc

SEQ ID NO: 2015648 - RNA, 18 nt, Human
guagcugggauuacaggc

SEQ ID NO: 2015649 - RNA, 20 nt, Human
guagcuguaaggcaugaagg

SEQ ID NO: 2015650 - RNA, 22 nt, Human
guaggcagccugagagucuaga

SEQ ID NO: 2015651 - RNA, 13 nt, Human
guaggauuacuag

SEQ ID NO: 2015652 - RNA, 14 nt, Human
guaggauaugccug

SEQ ID NO: 2015653 - RNA, 22 nt, Human
guaggauaugccugcucuuugg

SEQ ID NO: 2015654 - RNA, 18 nt, Human
guaggcaagauggcacag

SEQ ID NO: 2015655 - RNA, 15 nt, Human
guaggaguucuauuu

SEQ ID NO: 2015656 - RNA, 16 nt, Human
guaggaacugcugggc

SEQ ID NO: 2015657 - RNA, 15 nt, Human
guaggaagacuuugg

SEQ ID NO: 2015658 - RNA, 15 nt, Human
guagcuuaagaaaaa

SEQ ID NO: 2015659 - RNA, 16 nt, Human
guagcuuaagaaaaaa

SEQ ID NO: 2015660 - RNA, 11 nt, Human
guagcuuugca

SEQ ID NO: 2015661 - RNA, 13 nt, Human
guagcuuugcacu

SEQ ID NO: 2015662 - RNA, 18 nt, Human
guaggaagguuaauguuc

SEQ ID NO: 2015663 - RNA, 16 nt, Human
guaggaauauuauauu

SEQ ID NO: 2015664 - RNA, 21 nt, Human
guaggacaaggugcaggcagg

SEQ ID NO: 2015665 - RNA, 21 nt, Human
guaggaauauuauauuuggau

SEQ ID NO: 2015666 - RNA, 20 nt, Human
guaggacaaggugcaggcag

SEQ ID NO: 2015667 - RNA, 17 nt, Human
guaggaauauuauauuu

SEQ ID NO: 2015668 - RNA, 18 nt, Human
guaggaauauuauauuug

SEQ ID NO: 2015669 - RNA, 19 nt, Human
guaggaauauuauauuugg

SEQ ID NO: 2015670 - RNA, 20 nt, Human
guaggaauauuauauuugga

SEQ ID NO: 2015671 - RNA, 22 nt, Human
aaaucuauagaaaguguucugu

SEQ ID NO: 2015672 - RNA, 14 nt, Human
aaaucuaugauucc

SEQ ID NO: 2015673 - RNA, 16 nt, Human
aaaucuaugauuccag

SEQ ID NO: 2015674 - RNA, 13 nt, Human
aaaucuauagaaa

SEQ ID NO: 2015675 - RNA, 14 nt, Human
aaaucuauagaaag

SEQ ID NO: 2015676 - RNA, 15 nt, Human
aaaucuauagaaagu

SEQ ID NO: 2015677 - RNA, 17 nt, Human
aaaucuauagaaagugu

SEQ ID NO: 2015678 - RNA, 19 nt, Human
aaaucuauagaaaguguuc

SEQ ID NO: 2015679 - RNA, 19 nt, Human
aaaucuaaugacauucaau

SEQ ID NO: 2015680 - RNA, 19 nt, Human
aaaucuacacuccagugag

SEQ ID NO: 2015681 - RNA, 15 nt, Human
aaaucucaaauuucu

SEQ ID NO: 2015682 - RNA, 16 nt, Human
aaaucucaaauuucua

SEQ ID NO: 2015683 - RNA, 17 nt, Human
aaaucucaaauuucuaa

SEQ ID NO: 2015684 - RNA, 19 nt, Human
aaaucucaaauuucuaaau

SEQ ID NO: 2015685 - RNA, 17 nt, Human
aaaugaaaaucgugaca

SEQ ID NO: 2015686 - RNA, 11 nt, Human
aaaugaaaauu

SEQ ID NO: 2015687 - RNA, 18 nt, Human
aaaucccuuaccucggug

SEQ ID NO: 2015688 - RNA, 15 nt, Human
aaaucccauuuaaaa

SEQ ID NO: 2015689 - RNA, 13 nt, Human
aaaucgaugcagu

SEQ ID NO: 2015690 - RNA, 14 nt, Human
guaugggagagaag

SEQ ID NO: 2015691 - RNA, 21 nt, Human
guauggcuuuauuuuuuugaa

SEQ ID NO: 2015692 - RNA, 22 nt, Human
guauggcuuuauuuuuuugaac

SEQ ID NO: 2015693 - RNA, 20 nt, Human
guauggaagguggagcguuc

SEQ ID NO: 2015694 - RNA, 16 nt, Human
guaugcacaauuccau

SEQ ID NO: 2015695 - RNA, 15 nt, Human
guaugcaagcaguuu

SEQ ID NO: 2015696 - RNA, 18 nt, Human
guaugcaagcaguuucaa

SEQ ID NO: 2015697 - RNA, 23 nt, Human
guaugcaagcaguuucaauaaag

SEQ ID NO: 2015698 - RNA, 15 nt, Human
guaugcacaauucca

SEQ ID NO: 2015699 - RNA, 19 nt, Human
guaucaacacacauuuuaa

SEQ ID NO: 2015700 - RNA, 19 nt, Human
guaucaaucuuuagaaaag

SEQ ID NO: 2015701 - RNA, 22 nt, Human
guaugaucacggcucacugcag

SEQ ID NO: 2015702 - RNA, 15 nt, Human
guaucccuacuguaa

SEQ ID NO: 2015703 - RNA, 18 nt, Human
guauguggaagugugggu

SEQ ID NO: 2015704 - RNA, 21 nt, Human
guauguggaagugugggucug

SEQ ID NO: 2015705 - RNA, 19 nt, Human
guaugugggggucugugug

SEQ ID NO: 2015706 - RNA, 20 nt, Human
guaugugggggucugugugu

SEQ ID NO: 2015707 - RNA, 16 nt, Human
guauguggaagugugg

SEQ ID NO: 2015708 - RNA, 17 nt, Human
guauguggaaguguggg

SEQ ID NO: 2015709 - RNA, 15 nt, Human
guauguggaagugug

SEQ ID NO: 2015710 - RNA, 15 nt, Human
guaugggagagaaga

SEQ ID NO: 2015711 - RNA, 16 nt, Human
guaugggacuggccuc

SEQ ID NO: 2015712 - RNA, 13 nt, Human
guaugguggcugg

SEQ ID NO: 2015713 - RNA, 15 nt, Human
guauucuuauuuaau

SEQ ID NO: 2015714 - RNA, 15 nt, Human
guauugccaaacauu

SEQ ID NO: 2015715 - RNA, 16 nt, Human
guauugccaaacauua

SEQ ID NO: 2015716 - RNA, 12 nt, Human
guauucucuuuu

SEQ ID NO: 2015717 - RNA, 14 nt, Human
guauucucuuuuca

SEQ ID NO: 2015718 - RNA, 15 nt, Human
guauucugucuucau

SEQ ID NO: 2015719 - RNA, 18 nt, Human
guauucucuuuucaagaa

SEQ ID NO: 2015720 - RNA, 21 nt, Human
guauaaaagccuguuuaagag

SEQ ID NO: 2015721 - RNA, 18 nt, Human
guauaaaagccuguuuaa

SEQ ID NO: 2015722 - RNA, 18 nt, Human
guauaaaagggacugaga

SEQ ID NO: 2015723 - RNA, 21 nt, Human
guauaaagaauaggacuuguu

SEQ ID NO: 2015724 - RNA, 22 nt, Human
guauaaagaauaggacuuguuu

SEQ ID NO: 2015725 - RNA, 18 nt, Human
guauaaaggcauugauau

SEQ ID NO: 2015726 - RNA, 22 nt, Human
guauauugauccagaaagaaaa

SEQ ID NO: 2015727 - RNA, 19 nt, Human
guaucaaauacauuuaaaa

SEQ ID NO: 2015728 - RNA, 18 nt, Human
guauauucuauuuuacaa

SEQ ID NO: 2015729 - RNA, 17 nt, Human
guauauucuauuuuaca

SEQ ID NO: 2015730 - RNA, 12 nt, Human
guauauuauaau

SEQ ID NO: 2015731 - RNA, 14 nt, Human
guauauuauaauag

SEQ ID NO: 2015732 - RNA, 12 nt, Human
guauaaauuuau

SEQ ID NO: 2015733 - RNA, 13 nt, Human
guauaaauuuauu

SEQ ID NO: 2015734 - RNA, 14 nt, Human
guauaaauuuauuu

SEQ ID NO: 2015735 - RNA, 23 nt, Human
guauaaauuuauuuacugcuagu

SEQ ID NO: 2015736 - RNA, 17 nt, Human
aaaugggggugcauuug

SEQ ID NO: 2015737 - RNA, 18 nt, Human
aaaugggggugcauuuga

SEQ ID NO: 2015738 - RNA, 15 nt, Human
aaaugggggugcauu

SEQ ID NO: 2015739 - RNA, 16 nt, Human
aaaugggggugcauuu

SEQ ID NO: 2015740 - RNA, 17 nt, Human
aaauguacauguauuaa

SEQ ID NO: 2015741 - RNA, 23 nt, Human
aaauguacauguauuaaauuaca

SEQ ID NO: 2015742 - RNA, 20 nt, Human
aaauguaauguggcuucugg

SEQ ID NO: 2015743 - RNA, 12 nt, Human
aaauguacaugu

SEQ ID NO: 2015744 - RNA, 13 nt, Human
aaauguacaugua

SEQ ID NO: 2015745 - RNA, 14 nt, Human
aaauguacauguau

SEQ ID NO: 2015746 - RNA, 16 nt, Human
aaauguacauguauua

SEQ ID NO: 2015747 - RNA, 15 nt, Human
guaguucaagaaaug

SEQ ID NO: 2015748 - RNA, 19 nt, Human
guaguucaagaaaugaaga

SEQ ID NO: 2015749 - RNA, 20 nt, Human
guaguucaagaaaugaagag

SEQ ID NO: 2015750 - RNA, 17 nt, Human
guauaaaagccuguuua

SEQ ID NO: 2015751 - RNA, 17 nt, Human
guaguucuuuaaacugu

SEQ ID NO: 2015752 - RNA, 17 nt, Human
guaguucuguauuugaa

SEQ ID NO: 2015753 - RNA, 18 nt, Human
guaguucuguauuugaaa

SEQ ID NO: 2015754 - RNA, 20 nt, Human
guaguucuguauuugaaagu

SEQ ID NO: 2015755 - RNA, 14 nt, Human
guaguucuuuaaac

SEQ ID NO: 2015756 - RNA, 16 nt, Human
guaguucuaccggcuu

SEQ ID NO: 2015757 - RNA, 14 nt, Human
guaguucuguauuu

SEQ ID NO: 2015758 - RNA, 15 nt, Human
guaguucuguauuug

SEQ ID NO: 2015759 - RNA, 16 nt, Human
guaguucuguauuuga

SEQ ID NO: 2015760 - RNA, 18 nt, Human
gucaaaguggugagaggc

SEQ ID NO: 2015761 - RNA, 19 nt, Human
gucaaaguggugagaggca

SEQ ID NO: 2015762 - RNA, 17 nt, Human
guauuuuuguauucaau

SEQ ID NO: 2015763 - RNA, 17 nt, Human
guauuuuuuaaugcuaa

SEQ ID NO: 2015764 - RNA, 17 nt, Human
guauuuuuuuacuaaua

SEQ ID NO: 2015765 - RNA, 21 nt, Human
guauuuuuuuacuaauagaca

SEQ ID NO: 2015766 - RNA, 16 nt, Human
gucaaaugcuagaaaa

SEQ ID NO: 2015767 - RNA, 13 nt, Human
gucaacauuucuc

SEQ ID NO: 2015768 - RNA, 17 nt, Human
gucaacauuucucaugu

SEQ ID NO: 2015769 - RNA, 15 nt, Human
gucacaaauuucucu

SEQ ID NO: 2015770 - RNA, 19 nt, Human
gucaacucauauuuucaug

SEQ ID NO: 2015771 - RNA, 16 nt, Human
gucacacacuuuggcu

SEQ ID NO: 2015772 - RNA, 20 nt, Human
gucacacaguauuacuucug

SEQ ID NO: 2015773 - RNA, 22 nt, Human
aaauuuccugggagcuuuugua

SEQ ID NO: 2015774 - RNA, 14 nt, Human
guauuuuuuuacua

SEQ ID NO: 2015775 - RNA, 15 nt, Human
guauuuuuuuacuaa

SEQ ID NO: 2015776 - RNA, 20 nt, Human
aaauuuaguauuuuguuuca

SEQ ID NO: 2015777 - RNA, 21 nt, Human
aaauuuacuacaauauguaca

SEQ ID NO: 2015778 - RNA, 21 nt, Human
aaauuuacugucuaagauuaa

SEQ ID NO: 2015779 - RNA, 17 nt, Human
aaauuucagcagcugca

SEQ ID NO: 2015780 - RNA, 18 nt, Human
aaauuucagcagcugcag

SEQ ID NO: 2015781 - RNA, 21 nt, Human
aaauuaacuuuuauaaacuuu

SEQ ID NO: 2015782 - RNA, 19 nt, Human
aaauuaacuuuuauaaacu

SEQ ID NO: 2015783 - RNA, 20 nt, Human
aaauguuaaguugaugguga

SEQ ID NO: 2015784 - RNA, 16 nt, Human
aaauguuaaagaugua

SEQ ID NO: 2015785 - RNA, 21 nt, Human
aaauguuaaagauguagcaaa

SEQ ID NO: 2015786 - RNA, 12 nt, Human
aaauguuaugua

SEQ ID NO: 2015787 - RNA, 13 nt, Human
aaauguuauguau

SEQ ID NO: 2015788 - RNA, 14 nt, Human
aaauguuauguaua

SEQ ID NO: 2015789 - RNA, 23 nt, Human
aaauguuauguauauggugguaa

SEQ ID NO: 2015790 - RNA, 20 nt, Human
aaauuacguacuaaggauac

SEQ ID NO: 2015791 - RNA, 22 nt, Human
aaauuaacuuuuauaaacuuua

SEQ ID NO: 2015792 - RNA, 23 nt, Human
aaauuaacuuuuauaaacuuuac

SEQ ID NO: 2015793 - RNA, 16 nt, Human
guauuuaauucauguu

SEQ ID NO: 2015794 - RNA, 12 nt, Human
aaauguuaaaga

SEQ ID NO: 2015795 - RNA, 15 nt, Human
aaauguuaaagaugu

SEQ ID NO: 2015796 - RNA, 20 nt, Human
guauuuaauagguuuggaca

SEQ ID NO: 2015797 - RNA, 17 nt, Human
guauuuaagccuaaaga

SEQ ID NO: 2015798 - RNA, 19 nt, Human
guauuuaagccuaaagauu

SEQ ID NO: 2015799 - RNA, 12 nt, Human
guauuuaagccu

SEQ ID NO: 2015800 - RNA, 22 nt, Human
guauuggcuagagguucaaaga

SEQ ID NO: 2015801 - RNA, 17 nt, Human
guauugccaaacauuaa

SEQ ID NO: 2015802 - RNA, 21 nt, Human
guauugccaaacauuaauguu

SEQ ID NO: 2015803 - RNA, 23 nt, Human
guauugccaaacauuaauguuga

SEQ ID NO: 2015804 - RNA, 24 nt, Human
guauugccaaacauuaauguugau

SEQ ID NO: 2015805 - RNA, 14 nt, Human
aaauucaugcugcu

SEQ ID NO: 2015806 - RNA, 12 nt, Human
aaauuauauucc

SEQ ID NO: 2015807 - RNA, 14 nt, Human
caagugagacccug

SEQ ID NO: 2015808 - RNA, 12 nt, Human
caagugaaaaau

SEQ ID NO: 2015809 - RNA, 23 nt, Human
caagugaaaaaggaggaagagaa

SEQ ID NO: 2015810 - RNA, 22 nt, Human
caagugaaaaaggaggaagaga

SEQ ID NO: 2015811 - RNA, 21 nt, Human
caagguucugggugcaggagc

SEQ ID NO: 2015812 - RNA, 13 nt, Human
caagguucugggu

SEQ ID NO: 2015813 - RNA, 20 nt, Human
caagugauucuccugccuca

SEQ ID NO: 2015814 - RNA, 19 nt, Human
caagugagacccugucuca

SEQ ID NO: 2015815 - RNA, 15 nt, Human
caagugagacccugu

SEQ ID NO: 2015816 - RNA, 19 nt, Human
caagugauucuccugccuc

SEQ ID NO: 2015817 - RNA, 18 nt, Human
caagugauucuccugccu

SEQ ID NO: 2015818 - RNA, 14 nt, Human
caagguaaggaggg

SEQ ID NO: 2015819 - RNA, 22 nt, Human
caaggggaaucuggagguagcc

SEQ ID NO: 2015820 - RNA, 23 nt, Human
caaggggaauguuugccucugcc

SEQ ID NO: 2015821 - RNA, 17 nt, Human
caaggugugccccgugg

SEQ ID NO: 2015822 - RNA, 13 nt, Human
caaggucauuuuu

SEQ ID NO: 2015823 - RNA, 23 nt, Human
caagguaggguaggcagccugag

SEQ ID NO: 2015824 - RNA, 13 nt, Human
caagguagaauga

SEQ ID NO: 2015825 - RNA, 18 nt, Human
caagguagaaugaccuug

SEQ ID NO: 2015826 - RNA, 20 nt, Human
caagguagaaugaccuugua

SEQ ID NO: 2015827 - RNA, 16 nt, Human
caagggaggcccagcg

SEQ ID NO: 2015828 - RNA, 14 nt, Human
caagggaggcccag

SEQ ID NO: 2015829 - RNA, 15 nt, Human
caagggaggcccagc

SEQ ID NO: 2015830 - RNA, 14 nt, Human
caagggccuggccu

SEQ ID NO: 2015831 - RNA, 13 nt, Human
caagggccuggcc

SEQ ID NO: 2015832 - RNA, 15 nt, Human
caagggccuggccug

SEQ ID NO: 2015833 - RNA, 21 nt, Human
caaggggaauguuugccucug

SEQ ID NO: 2015834 - RNA, 23 nt, Human
caagagccugagagugaggugga

SEQ ID NO: 2015835 - RNA, 12 nt, Human
caagagccuuaa

SEQ ID NO: 2015836 - RNA, 14 nt, Human
caagagccuuaaaa

SEQ ID NO: 2015837 - RNA, 15 nt, Human
caagagccuuaaaac

SEQ ID NO: 2015838 - RNA, 16 nt, Human
caagagccuuaaaaca

SEQ ID NO: 2015839 - RNA, 17 nt, Human
caagagccuuaaaacau

SEQ ID NO: 2015840 - RNA, 17 nt, Human
caagagggcacuggugg

SEQ ID NO: 2015841 - RNA, 18 nt, Human
caagagggcacugguggc

SEQ ID NO: 2015842 - RNA, 19 nt, Human
caagagggcacugguggcc

SEQ ID NO: 2015843 - RNA, 20 nt, Human
caagagggcacugguggccc

SEQ ID NO: 2015844 - RNA, 17 nt, Human
caagacuuauuuucaca

SEQ ID NO: 2015845 - RNA, 11 nt, Human
caagagccuga

SEQ ID NO: 2015846 - RNA, 13 nt, Human
caagagccugaga

SEQ ID NO: 2015847 - RNA, 17 nt, Human
caagagcccaggccucc

SEQ ID NO: 2015848 - RNA, 12 nt, Human
caagcagauucg

SEQ ID NO: 2015849 - RNA, 15 nt, Human
caagaggugggaggg

SEQ ID NO: 2015850 - RNA, 16 nt, Human
caagaggugggagggc

SEQ ID NO: 2015851 - RNA, 20 nt, Human
caagagguuuggcuccugcc

SEQ ID NO: 2015852 - RNA, 22 nt, Human
caagagguuuggcuccugccca

SEQ ID NO: 2015853 - RNA, 23 nt, Human
caagagguuuggcuccugcccac

SEQ ID NO: 2015854 - RNA, 12 nt, Human
caagagggucug

SEQ ID NO: 2015855 - RNA, 16 nt, Human
caagagggucugagga

SEQ ID NO: 2015856 - RNA, 17 nt, Human
caagagggucugaggaa

SEQ ID NO: 2015857 - RNA, 22 nt, Human
caagacgcugugcugcccugcc

SEQ ID NO: 2015858 - RNA, 21 nt, Human
caagacgcugugcugcccugc

SEQ ID NO: 2015859 - RNA, 20 nt, Human
caagacgcugugcugcccug

SEQ ID NO: 2015860 - RNA, 13 nt, Human
caagaccuucucc

SEQ ID NO: 2015861 - RNA, 13 nt, Human
caagaaaugaaag

SEQ ID NO: 2015862 - RNA, 23 nt, Human
caagacccuuguggucccacccc

SEQ ID NO: 2015863 - RNA, 14 nt, Human
caacuugcaagggc

SEQ ID NO: 2015864 - RNA, 12 nt, Human
caacuugccuuu

SEQ ID NO: 2015865 - RNA, 17 nt, Human
caagcuguugaccaggc

SEQ ID NO: 2015866 - RNA, 19 nt, Human
caagcuguugaccaggcac

SEQ ID NO: 2015867 - RNA, 14 nt, Human
caagcuuauuuugg

SEQ ID NO: 2015868 - RNA, 14 nt, Human
caaggauccugagc

SEQ ID NO: 2015869 - RNA, 20 nt, Human
caaggacuaggguccugggg

SEQ ID NO: 2015870 - RNA, 21 nt, Human
caaggacuaggguccugggga

SEQ ID NO: 2015871 - RNA, 16 nt, Human
caaggacuaggguccu

SEQ ID NO: 2015872 - RNA, 21 nt, Human
caagcuuuuacaacagugcug

SEQ ID NO: 2015873 - RNA, 14 nt, Human
caaggacuaggguc

SEQ ID NO: 2015874 - RNA, 18 nt, Human
caaggacuaggguccugg

SEQ ID NO: 2015875 - RNA, 19 nt, Human
caaggacuaggguccuggg

SEQ ID NO: 2015876 - RNA, 23 nt, Human
caagggaauuucuucaacucccu

SEQ ID NO: 2015877 - RNA, 14 nt, Human
caaggcugucaauu

SEQ ID NO: 2015878 - RNA, 13 nt, Human
caaggcugucaau

SEQ ID NO: 2015879 - RNA, 21 nt, Human
caaggcugggggaagaagcuc

SEQ ID NO: 2015880 - RNA, 16 nt, Human
caaggauccugagcca

SEQ ID NO: 2015881 - RNA, 15 nt, Human
caaggauccugagcc

SEQ ID NO: 2015882 - RNA, 17 nt, Human
caaggauccugagccag

SEQ ID NO: 2015883 - RNA, 20 nt, Human
caagcccaguucagcuuggg

SEQ ID NO: 2015884 - RNA, 14 nt, Human
caagcccaggaggg

SEQ ID NO: 2015885 - RNA, 17 nt, Human
caagcauucucuccauu

SEQ ID NO: 2015886 - RNA, 13 nt, Human
caagcauguggau

SEQ ID NO: 2015887 - RNA, 15 nt, Human
caagcaucacuuuuu

SEQ ID NO: 2015888 - RNA, 22 nt, Human
caagcaguuucaauaaaguuug

SEQ ID NO: 2015889 - RNA, 15 nt, Human
caagcaguuucaaua

SEQ ID NO: 2015890 - RNA, 16 nt, Human
caagcaguuucaauaa

SEQ ID NO: 2015891 - RNA, 20 nt, Human
caagcaguuucaauaaaguu

SEQ ID NO: 2015892 - RNA, 21 nt, Human
caagcaguuucaauaaaguuu

SEQ ID NO: 2015893 - RNA, 13 nt, Human
caagcaguuucaa

SEQ ID NO: 2015894 - RNA, 14 nt, Human
caagcaguuucaau

SEQ ID NO: 2015895 - RNA, 21 nt, Human
caaccugauugugucucuugg

SEQ ID NO: 2015896 - RNA, 19 nt, Human
caaccugauugugucucuu

SEQ ID NO: 2015897 - RNA, 17 nt, Human
caaccugauugugucuc

SEQ ID NO: 2015898 - RNA, 23 nt, Human
caacugcaucaagaugugacaug

SEQ ID NO: 2015899 - RNA, 20 nt, Human
caacugcaucaagaugugac

SEQ ID NO: 2015900 - RNA, 17 nt, Human
caacugcaucaagaugu

SEQ ID NO: 2015901 - RNA, 15 nt, Human
caacugaucuguuau

SEQ ID NO: 2015902 - RNA, 17 nt, Human
caacaggcugggcuuca

SEQ ID NO: 2015903 - RNA, 16 nt, Human
caaauuuacagagaca

SEQ ID NO: 2015904 - RNA, 17 nt, Human
caaauuuacagagacag

SEQ ID NO: 2015905 - RNA, 23 nt, Human
caaauuuacagagacagaaagca

SEQ ID NO: 2015906 - RNA, 14 nt, Human
caacaggcugggcu

SEQ ID NO: 2015907 - RNA, 16 nt, Human
caacauacucccaucu

SEQ ID NO: 2015908 - RNA, 15 nt, Human
caacauacucccauc

SEQ ID NO: 2015909 - RNA, 14 nt, Human
caacauacucccau

SEQ ID NO: 2015910 - RNA, 16 nt, Human
caacuugccuuugaag

SEQ ID NO: 2015911 - RNA, 20 nt, Human
caacaggcugggcuucagug

SEQ ID NO: 2015912 - RNA, 23 nt, Human
auuuuaaaugugugagugcaugu

SEQ ID NO: 2015913 - RNA, 16 nt, Human
auuuuaagccuuuguu

SEQ ID NO: 2015914 - RNA, 18 nt, Human
auuuuaagccuuuguuga

SEQ ID NO: 2015915 - RNA, 19 nt, Human
auuuuaagccuuuguugaa

SEQ ID NO: 2015916 - RNA, 22 nt, Human
auuuuaagccuuuguugaacug

SEQ ID NO: 2015917 - RNA, 23 nt, Human
auuuuaagccuuuguugaacugu

SEQ ID NO: 2015918 - RNA, 16 nt, Human
auuuuaagcuaggaaa

SEQ ID NO: 2015919 - RNA, 17 nt, Human
auuuuaagcuaggaaaa

SEQ ID NO: 2015920 - RNA, 16 nt, Human
auuuguaccauuucag

SEQ ID NO: 2015921 - RNA, 12 nt, Human
auuuuaaaugug

SEQ ID NO: 2015922 - RNA, 13 nt, Human
auuuuaaaugugu

SEQ ID NO: 2015923 - RNA, 18 nt, Human
auuuuaaaugugugagug

SEQ ID NO: 2015924 - RNA, 14 nt, Human
caaacugcacauga

SEQ ID NO: 2015925 - RNA, 22 nt, Human
caaacugcacaugauuucacaa

SEQ ID NO: 2015926 - RNA, 15 nt, Human
caaacugcacaugau

SEQ ID NO: 2015927 - RNA, 18 nt, Human
caaacugcacaugauuuc

SEQ ID NO: 2015928 - RNA, 19 nt, Human
caaacugcacaugauuuca

SEQ ID NO: 2015929 - RNA, 21 nt, Human
caaacugcacaugauuucaca

SEQ ID NO: 2015930 - RNA, 19 nt, Human
auuuuaagcuaggaaaaga

SEQ ID NO: 2015931 - RNA, 20 nt, Human
auuuuaagcuaggaaaagaa

SEQ ID NO: 2015932 - RNA, 22 nt, Human
auuuuaagcuaggaaaagaaau

SEQ ID NO: 2015933 - RNA, 23 nt, Human
auuuuaagcuaggaaaagaaauc

SEQ ID NO: 2015934 - RNA, 21 nt, Human
caaagagguuuuaaaaaaauc

SEQ ID NO: 2015935 - RNA, 14 nt, Human
caaagagguuuuaa

SEQ ID NO: 2015936 - RNA, 21 nt, Human
caaagaccaauuuuuugugug

SEQ ID NO: 2015937 - RNA, 13 nt, Human
caaagcccagcuu

SEQ ID NO: 2015938 - RNA, 12 nt, Human
caaagaaauuau

SEQ ID NO: 2015939 - RNA, 20 nt, Human
caaacuggaaugagcagcuu

SEQ ID NO: 2015940 - RNA, 20 nt, Human
caaacuggccgcgggggcag

SEQ ID NO: 2015941 - RNA, 22 nt, Human
caaagaaucaccuaauuaauuu

SEQ ID NO: 2015942 - RNA, 13 nt, Human
caaagaaauuaug

SEQ ID NO: 2015943 - RNA, 13 nt, Human
caaagacaaauag

SEQ ID NO: 2015944 - RNA, 23 nt, Human
caaagaaugaauuucaacgccug

SEQ ID NO: 2015945 - RNA, 14 nt, Human
caaagacaaauagu

SEQ ID NO: 2015946 - RNA, 15 nt, Human
caaagacaaauagua

SEQ ID NO: 2015947 - RNA, 16 nt, Human
caaagacaaauaguag

SEQ ID NO: 2015948 - RNA, 23 nt, Human
caaagacaaauaguaggcaagau

SEQ ID NO: 2015949 - RNA, 18 nt, Human
caaauucugucucuggau

SEQ ID NO: 2015950 - RNA, 12 nt, Human
caaauguuucua

SEQ ID NO: 2015951 - RNA, 19 nt, Human
caaauguuucuaagguaac

SEQ ID NO: 2015952 - RNA, 17 nt, Human
caaauuguaagcaugca

SEQ ID NO: 2015953 - RNA, 21 nt, Human
caaauauuuagauguaauuuu

SEQ ID NO: 2015954 - RNA, 13 nt, Human
caaauauuguuaa

SEQ ID NO: 2015955 - RNA, 22 nt, Human
caaauauuuagauguaauuuug

SEQ ID NO: 2015956 - RNA, 23 nt, Human
caaauauuuagauguaauuuugu

SEQ ID NO: 2015957 - RNA, 19 nt, Human
caaaguggugagaggcauc

SEQ ID NO: 2015958 - RNA, 21 nt, Human
caaaguucccuacuuccugug

SEQ ID NO: 2015959 - RNA, 22 nt, Human
caaaguucccuacuuccuguga

SEQ ID NO: 2015960 - RNA, 20 nt, Human
caaaggguaucaggugcugc

SEQ ID NO: 2015961 - RNA, 21 nt, Human
caaaggguaucaggugcugcc

SEQ ID NO: 2015962 - RNA, 17 nt, Human
caaaguggugagaggca

SEQ ID NO: 2015963 - RNA, 16 nt, Human
caaaguggugagaggc

SEQ ID NO: 2015964 - RNA, 23 nt, Human
caaaggguaucaggugcugccau

SEQ ID NO: 2015965 - RNA, 20 nt, Human
caaaggagauuggaaggaac

SEQ ID NO: 2015966 - RNA, 19 nt, Human
caaaggcuguauucagcaa

SEQ ID NO: 2015967 - RNA, 18 nt, Human
caaaggcuguauucagca

SEQ ID NO: 2015968 - RNA, 14 nt, Human
caaaggagauugga

SEQ ID NO: 2015969 - RNA, 17 nt, Human
caaagccccauuaacug

SEQ ID NO: 2015970 - RNA, 16 nt, Human
caaugaccuuucaaua

SEQ ID NO: 2015971 - RNA, 15 nt, Human
caaugaccuuucaau

SEQ ID NO: 2015972 - RNA, 13 nt, Human
caaugauggucac

SEQ ID NO: 2015973 - RNA, 14 nt, Human
caaugaccuuucaa

SEQ ID NO: 2015974 - RNA, 13 nt, Human
caaugaccuuuca

SEQ ID NO: 2015975 - RNA, 18 nt, Human
caaucuuuagaaaaggca

SEQ ID NO: 2015976 - RNA, 22 nt, Human
caaugcaaaccaucauugaaau

SEQ ID NO: 2015977 - RNA, 21 nt, Human
caaugcaaaccaucauugaaa

SEQ ID NO: 2015978 - RNA, 14 nt, Human
caaugcaaaccauc

SEQ ID NO: 2015979 - RNA, 14 nt, Human
caaugauggucacc

SEQ ID NO: 2015980 - RNA, 23 nt, Human
caaugcaaaccaucauugaaauc

SEQ ID NO: 2015981 - RNA, 13 nt, Human
caaugcacuuugu

SEQ ID NO: 2015982 - RNA, 14 nt, Human
caaugcacugacau

SEQ ID NO: 2015983 - RNA, 11 nt, Human
caauccuuaca

SEQ ID NO: 2015984 - RNA, 12 nt, Human
caauccuuacaa

SEQ ID NO: 2015985 - RNA, 13 nt, Human
caauccuuacaaa

SEQ ID NO: 2015986 - RNA, 14 nt, Human
caauccuuacaaau

SEQ ID NO: 2015987 - RNA, 15 nt, Human
caauccuuacaaaug

SEQ ID NO: 2015988 - RNA, 16 nt, Human
caauccuuacaaauga

SEQ ID NO: 2015989 - RNA, 17 nt, Human
caauccuuacaaaugau

SEQ ID NO: 2015990 - RNA, 20 nt, Human
caauccuuacaaaugauugc

SEQ ID NO: 2015991 - RNA, 18 nt, Human
caaucucggcucacugca

SEQ ID NO: 2015992 - RNA, 21 nt, Human
caaucucguauagaagucuuc

SEQ ID NO: 2015993 - RNA, 22 nt, Human
caaucucguauagaagucuuca

SEQ ID NO: 2015994 - RNA, 16 nt, Human
caaucuuacuuuguaa

SEQ ID NO: 2015995 - RNA, 17 nt, Human
caaucuuacuuuguaaa

SEQ ID NO: 2015996 - RNA, 19 nt, Human
caaucuuacuuuguaaauu

SEQ ID NO: 2015997 - RNA, 22 nt, Human
caaucuuacuuuguaaauucug

SEQ ID NO: 2015998 - RNA, 23 nt, Human
caaucuuacuuuguaaauucuga

SEQ ID NO: 2015999 - RNA, 14 nt, Human
cacacccagcccac

SEQ ID NO: 2016000 - RNA, 20 nt, Human
cacacccagcccacuucugc

SEQ ID NO: 2016001 - RNA, 12 nt, Human
cacaccuccucc

SEQ ID NO: 2016002 - RNA, 14 nt, Human
cacaccuccuccca

SEQ ID NO: 2016003 - RNA, 16 nt, Human
cacaccuccucccacu

SEQ ID NO: 2016004 - RNA, 19 nt, Human
cacaccuccucccacugcc

SEQ ID NO: 2016005 - RNA, 21 nt, Human
cacaccuccucccacugccca

SEQ ID NO: 2016006 - RNA, 22 nt, Human
cacaccuccucccacugcccac

SEQ ID NO: 2016007 - RNA, 21 nt, Human
cacaccagagcccaccuuggc

SEQ ID NO: 2016008 - RNA, 22 nt, Human
cacaccagagcccaccuuggcu

SEQ ID NO: 2016009 - RNA, 22 nt, Human
cacacagauuugagcucagccc

SEQ ID NO: 2016010 - RNA, 13 nt, Human
cacacagcucugu

SEQ ID NO: 2016011 - RNA, 14 nt, Human
cacacagcucuguc

SEQ ID NO: 2016012 - RNA, 15 nt, Human
cacacagcucugucc

SEQ ID NO: 2016013 - RNA, 14 nt, Human
cacacaagugcagu

SEQ ID NO: 2016014 - RNA, 20 nt, Human
cacaaucucggcucacugca

SEQ ID NO: 2016015 - RNA, 22 nt, Human
cacaaucucggcucacugcauc

SEQ ID NO: 2016016 - RNA, 23 nt, Human
cacaaucucggcucacugcaucc

SEQ ID NO: 2016017 - RNA, 24 nt, Human
cacaaucucggcucacugcauccu

SEQ ID NO: 2016018 - RNA, 15 nt, Human
cacacaccagagccc

SEQ ID NO: 2016019 - RNA, 14 nt, Human
cacacacaaaaaaa

SEQ ID NO: 2016020 - RNA, 17 nt, Human
cacacacaaaaaaagac

SEQ ID NO: 2016021 - RNA, 16 nt, Human
cacacaccagagccca

SEQ ID NO: 2016022 - RNA, 20 nt, Human
cacacaccagagcccaccuu

SEQ ID NO: 2016023 - RNA, 21 nt, Human
cacacagaggcugccucuccc

SEQ ID NO: 2016024 - RNA, 18 nt, Human
cacacagauuugagcuca

SEQ ID NO: 2016025 - RNA, 20 nt, Human
cacacagauuugagcucagc

SEQ ID NO: 2016026 - RNA, 11 nt, Human
cacacacacaa

SEQ ID NO: 2016027 - RNA, 13 nt, Human
cacacacacaaaa

SEQ ID NO: 2016028 - RNA, 14 nt, Human
cacacacuuuggcu

SEQ ID NO: 2016029 - RNA, 22 nt, Human
cacaaacugcuuccuuucuuga

SEQ ID NO: 2016030 - RNA, 17 nt, Human
cacaaacgggcucagca

SEQ ID NO: 2016031 - RNA, 20 nt, Human
caauguaaacacuuaacaga

SEQ ID NO: 2016032 - RNA, 22 nt, Human
caauuauaaacucauuuugcuu

SEQ ID NO: 2016033 - RNA, 18 nt, Human
caaugguuuucuugugug

SEQ ID NO: 2016034 - RNA, 14 nt, Human
caaugcacuuuguu

SEQ ID NO: 2016035 - RNA, 23 nt, Human
cacaagaaaugaaagcagggacu

SEQ ID NO: 2016036 - RNA, 23 nt, Human
cacaagacccaaaaggcagaagc

SEQ ID NO: 2016037 - RNA, 19 nt, Human
cacaaucucggcucacugc

SEQ ID NO: 2016038 - RNA, 13 nt, Human
cacaagaaaugaa

SEQ ID NO: 2016039 - RNA, 15 nt, Human
cacaagaaaugaaag

SEQ ID NO: 2016040 - RNA, 17 nt, Human
cacaaagguagcuuuuc

SEQ ID NO: 2016041 - RNA, 17 nt, Human
cacaaauauuaaaaagu

SEQ ID NO: 2016042 - RNA, 13 nt, Human
cacaaaugacuuu

SEQ ID NO: 2016043 - RNA, 14 nt, Human
cacaaaugacuuua

SEQ ID NO: 2016044 - RNA, 15 nt, Human
cacaaaugacuuuau

SEQ ID NO: 2016045 - RNA, 20 nt, Human
cacaaaugacuuuauuauuu

SEQ ID NO: 2016046 - RNA, 22 nt, Human
cacaaaugacuuuauuauuuau

SEQ ID NO: 2016047 - RNA, 13 nt, Human
cacaaauauuaaa

SEQ ID NO: 2016048 - RNA, 14 nt, Human
cacaaauauuaaaa

SEQ ID NO: 2016049 - RNA, 20 nt, Human
cacaaauauuaaaaagucuu

SEQ ID NO: 2016050 - RNA, 13 nt, Human
caccaagcccagu

SEQ ID NO: 2016051 - RNA, 12 nt, Human
caccaagcccag

SEQ ID NO: 2016052 - RNA, 17 nt, Human
caccaaucuuacuuugu

SEQ ID NO: 2016053 - RNA, 22 nt, Human
caccaaucuuacuuuguaaauu

SEQ ID NO: 2016054 - RNA, 18 nt, Human
caccaaucuuacuuugua

SEQ ID NO: 2016055 - RNA, 19 nt, Human
caccaaucuuacuuuguaa

SEQ ID NO: 2016056 - RNA, 22 nt, Human
cacauguccaagaagcccagga

SEQ ID NO: 2016057 - RNA, 21 nt, Human
cacauguccaagaagcccagg

SEQ ID NO: 2016058 - RNA, 19 nt, Human
cacauguccaagaagccca

SEQ ID NO: 2016059 - RNA, 18 nt, Human
cacauguccaagaagccc

SEQ ID NO: 2016060 - RNA, 17 nt, Human
caccaacgucugugcca

SEQ ID NO: 2016061 - RNA, 18 nt, Human
caccaacuacuaccugua

SEQ ID NO: 2016062 - RNA, 15 nt, Human
caccacgcccggcua

SEQ ID NO: 2016063 - RNA, 14 nt, Human
caccacgcccggcu

SEQ ID NO: 2016064 - RNA, 15 nt, Human
caccacacucagccc

SEQ ID NO: 2016065 - RNA, 19 nt, Human
caccacacugauccagccc

SEQ ID NO: 2016066 - RNA, 14 nt, Human
caccacacucagcc

SEQ ID NO: 2016067 - RNA, 19 nt, Human
caccacacccagcccacuu

SEQ ID NO: 2016068 - RNA, 17 nt, Human
caccagagcccaccuug

SEQ ID NO: 2016069 - RNA, 18 nt, Human
caccagagcccaccuugg

SEQ ID NO: 2016070 - RNA, 20 nt, Human
caccagagcccaccuuggcu

SEQ ID NO: 2016071 - RNA, 22 nt, Human
caccagagcccaccuuggcuca

SEQ ID NO: 2016072 - RNA, 15 nt, Human
caccagagcccaccu

SEQ ID NO: 2016073 - RNA, 19 nt, Human
caccauguuggccaggcug

SEQ ID NO: 2016074 - RNA, 20 nt, Human
caccauguuggccaggcugc

SEQ ID NO: 2016075 - RNA, 20 nt, Human
caccauguuggccaggcugg

SEQ ID NO: 2016076 - RNA, 22 nt, Human
caccaugagggaagaauaaaga

SEQ ID NO: 2016077 - RNA, 19 nt, Human
caccaucugcugucuuuuc

SEQ ID NO: 2016078 - RNA, 10 nt, Human
caccaucugc

SEQ ID NO: 2016079 - RNA, 15 nt, Human
caccaucugcugucu

SEQ ID NO: 2016080 - RNA, 16 nt, Human
caccaucugcugucuu

SEQ ID NO: 2016081 - RNA, 24 nt, Human
caccaucaagccaccaacauacuc

SEQ ID NO: 2016082 - RNA, 19 nt, Human
caccaucaagccaccaaca

SEQ ID NO: 2016083 - RNA, 17 nt, Human
caccaucaagccaccaa

SEQ ID NO: 2016084 - RNA, 16 nt, Human
caccaucaagccacca

SEQ ID NO: 2016085 - RNA, 15 nt, Human
caccaucaugucugg

SEQ ID NO: 2016086 - RNA, 17 nt, Human
caccaucaugucuggcu

SEQ ID NO: 2016087 - RNA, 18 nt, Human
caccaucaugucuggcua

SEQ ID NO: 2016088 - RNA, 13 nt, Human
caccauccccucc

SEQ ID NO: 2016089 - RNA, 21 nt, Human
caccauauuaccacagacaua

SEQ ID NO: 2016090 - RNA, 18 nt, Human
caccauaggucaccuuua

SEQ ID NO: 2016091 - RNA, 15 nt, Human
caccaucaagccacc

SEQ ID NO: 2016092 - RNA, 14 nt, Human
caccaucaagccac

SEQ ID NO: 2016093 - RNA, 13 nt, Human
caccaucaagcca

SEQ ID NO: 2016094 - RNA, 20 nt, Human
caccagguagaacgccaggg

SEQ ID NO: 2016095 - RNA, 13 nt, Human
caccaguacauuc

SEQ ID NO: 2016096 - RNA, 21 nt, Human
caccaguacauucucaguuuu

SEQ ID NO: 2016097 - RNA, 22 nt, Human
caccaguacauucucaguuuuu

SEQ ID NO: 2016098 - RNA, 14 nt, Human
caccagugaccugg

SEQ ID NO: 2016099 - RNA, 15 nt, Human
caccagugaccugga

SEQ ID NO: 2016100 - RNA, 15 nt, Human
caccagaugugacag

SEQ ID NO: 2016101 - RNA, 16 nt, Human
caccagggccaaaagc

SEQ ID NO: 2016102 - RNA, 22 nt, Human
caccagggccaaaagcuucccu

SEQ ID NO: 2016103 - RNA, 16 nt, Human
cacaugagauaauaug

SEQ ID NO: 2016104 - RNA, 12 nt, Human
cacaugauuuca

SEQ ID NO: 2016105 - RNA, 14 nt, Human
cacaugauuucaca

SEQ ID NO: 2016106 - RNA, 16 nt, Human
cacaugauuucacaaa

SEQ ID NO: 2016107 - RNA, 17 nt, Human
cacaugauuucacaaau

SEQ ID NO: 2016108 - RNA, 17 nt, Human
cacaugcaaggucauuu

SEQ ID NO: 2016109 - RNA, 19 nt, Human
cacaugcaaggucauuuuu

SEQ ID NO: 2016110 - RNA, 20 nt, Human
cacaugcaaggucauuuuuu

SEQ ID NO: 2016111 - RNA, 18 nt, Human
cacaugcacgugugugca

SEQ ID NO: 2016112 - RNA, 18 nt, Human
cacaugauuucacaaaua

SEQ ID NO: 2016113 - RNA, 19 nt, Human
cacaugauuucacaaauau

SEQ ID NO: 2016114 - RNA, 20 nt, Human
cacaugauuucacaaauauu

SEQ ID NO: 2016115 - RNA, 17 nt, Human
cacauguccaagaagcc

SEQ ID NO: 2016116 - RNA, 16 nt, Human
cacauguccaagaagc

SEQ ID NO: 2016117 - RNA, 19 nt, Human
cacaugccaggggccuuug

SEQ ID NO: 2016118 - RNA, 14 nt, Human
cacaugccaggggc

SEQ ID NO: 2016119 - RNA, 20 nt, Human
cacaugccucucucaggcca

SEQ ID NO: 2016120 - RNA, 21 nt, Human
cacaugccucucucaggccaa

SEQ ID NO: 2016121 - RNA, 21 nt, Human
cacaugagcaucaggccaggc

SEQ ID NO: 2016122 - RNA, 20 nt, Human
cacaugagcaucaggccagg

SEQ ID NO: 2016123 - RNA, 19 nt, Human
cacaugagcaucaggccag

SEQ ID NO: 2016124 - RNA, 18 nt, Human
cacaugagcaucaggcca

SEQ ID NO: 2016125 - RNA, 17 nt, Human
cacaugagcaucaggcc

SEQ ID NO: 2016126 - RNA, 13 nt, Human
cacaugagcauca

SEQ ID NO: 2016127 - RNA, 15 nt, Human
cacaugagauaauau

SEQ ID NO: 2016128 - RNA, 19 nt, Human
cacaggcagguccaggguu

SEQ ID NO: 2016129 - RNA, 15 nt, Human
cacaggccacccugu

SEQ ID NO: 2016130 - RNA, 16 nt, Human
cacaggccacccugug

SEQ ID NO: 2016131 - RNA, 18 nt, Human
cacaggccacccugugca

SEQ ID NO: 2016132 - RNA, 23 nt, Human
cacaguccuuaccagcagagcac

SEQ ID NO: 2016133 - RNA, 23 nt, Human
cacaggccacccugugcagaagg

SEQ ID NO: 2016134 - RNA, 14 nt, Human
cacagucuccccca

SEQ ID NO: 2016135 - RNA, 14 nt, Human
cacaggcccggcuc

SEQ ID NO: 2016136 - RNA, 17 nt, Human
cacaggaucagucugau

SEQ ID NO: 2016137 - RNA, 15 nt, Human
cacaggacucugccu

SEQ ID NO: 2016138 - RNA, 16 nt, Human
cacaggacucugccuc

SEQ ID NO: 2016139 - RNA, 19 nt, Human
cacaggacagggguuccuu

SEQ ID NO: 2016140 - RNA, 23 nt, Human
cacaggacaggaaaguggcaccu

SEQ ID NO: 2016141 - RNA, 18 nt, Human
cacaggacagggguuccu

SEQ ID NO: 2016142 - RNA, 15 nt, Human
cacagcccagcuugg

SEQ ID NO: 2016143 - RNA, 21 nt, Human
cacagcucuucuccaggcugu

SEQ ID NO: 2016144 - RNA, 19 nt, Human
cacagcucuucuccaggcu

SEQ ID NO: 2016145 - RNA, 20 nt, Human
cacagcucuucuccaggcug

SEQ ID NO: 2016146 - RNA, 19 nt, Human
cacacguaaugaaacuugg

SEQ ID NO: 2016147 - RNA, 19 nt, Human
cacacgcugcucugcccca

SEQ ID NO: 2016148 - RNA, 20 nt, Human
cacacguaaugaaacuugga

SEQ ID NO: 2016149 - RNA, 20 nt, Human
cacagcaacgaucacaaaug

SEQ ID NO: 2016150 - RNA, 22 nt, Human
cacacggacacucaaaagcugg

SEQ ID NO: 2016151 - RNA, 12 nt, Human
cacacgcugccu

SEQ ID NO: 2016152 - RNA, 13 nt, Human
cacacgcugccuu

SEQ ID NO: 2016153 - RNA, 14 nt, Human
cacacgcugccuuc

SEQ ID NO: 2016154 - RNA, 13 nt, Human
cacacgcugcucu

SEQ ID NO: 2016155 - RNA, 16 nt, Human
cacacgcugcucugcc

SEQ ID NO: 2016156 - RNA, 17 nt, Human
cacacgcugcucugccc

SEQ ID NO: 2016157 - RNA, 21 nt, Human
cacagcaacgaucacaaauga

SEQ ID NO: 2016158 - RNA, 22 nt, Human
cacagcaacgaucacaaaugac

SEQ ID NO: 2016159 - RNA, 18 nt, Human
cacagcucuucuccaggc

SEQ ID NO: 2016160 - RNA, 22 nt, Human
caccauucguacauaauacuga

SEQ ID NO: 2016161 - RNA, 23 nt, Human
caccauucguacauaauacugaa

SEQ ID NO: 2016162 - RNA, 20 nt, Human
caccauucguacauaauacu

SEQ ID NO: 2016163 - RNA, 18 nt, Human
caccauguuggccaggcu

SEQ ID NO: 2016164 - RNA, 19 nt, Human
caccauugcaacaaaauac

SEQ ID NO: 2016165 - RNA, 15 nt, Human
caccauuuccccagg

SEQ ID NO: 2016166 - RNA, 17 nt, Human
caccauuuccccagggc

SEQ ID NO: 2016167 - RNA, 20 nt, Human
caccauuuccccagggcacg

SEQ ID NO: 2016168 - RNA, 18 nt, Human
caccauuuccccagggca

SEQ ID NO: 2016169 - RNA, 19 nt, Human
caccauuuccccagggcac

SEQ ID NO: 2016170 - RNA, 13 nt, Human
cacccaagggccu

SEQ ID NO: 2016171 - RNA, 16 nt, Human
cacccaagcaggaggc

SEQ ID NO: 2016172 - RNA, 13 nt, Human
uuuuuucuuacug

SEQ ID NO: 2016173 - RNA, 13 nt, Human
uuuuuugaagugu

SEQ ID NO: 2016174 - RNA, 12 nt, Human
uuuuuucuuuca

SEQ ID NO: 2016175 - RNA, 13 nt, Human
uuuuuugaaauca

SEQ ID NO: 2016176 - RNA, 12 nt, Human
uuuuuugaaaug

SEQ ID NO: 2016177 - RNA, 19 nt, Human
uuuuuugaacucuucucau

SEQ ID NO: 2016178 - RNA, 13 nt, Human
uuuugaaaaacug

SEQ ID NO: 2016179 - RNA, 22 nt, Human
uuuugaaaaaugcacugggaaa

SEQ ID NO: 2016180 - RNA, 11 nt, Human
uuuugaaaagu

SEQ ID NO: 2016181 - RNA, 20 nt, Human
uuuugaaaaguaauauuuau

SEQ ID NO: 2016182 - RNA, 22 nt, Human
uuuugaaaucaguaaacacugu

SEQ ID NO: 2016183 - RNA, 13 nt, Human
uuuuucugcuuua

SEQ ID NO: 2016184 - RNA, 20 nt, Human
uuuuucugcuuuagacuuga

SEQ ID NO: 2016185 - RNA, 11 nt, Human
uuuuucuggac

SEQ ID NO: 2016186 - RNA, 11 nt, Human
uuuuucugugg

SEQ ID NO: 2016187 - RNA, 11 nt, Human
uuuuucuguau

SEQ ID NO: 2016188 - RNA, 13 nt, Human
uuuugaaauguca

SEQ ID NO: 2016189 - RNA, 13 nt, Human
uuuugaaaugcug

SEQ ID NO: 2016190 - RNA, 16 nt, Human
uuuugaaaugcugaaa

SEQ ID NO: 2016191 - RNA, 18 nt, Human
uuuugaaaugcugaaaau

SEQ ID NO: 2016192 - RNA, 20 nt, Human
uuuugaaaugcugaaaauug

SEQ ID NO: 2016193 - RNA, 12 nt, Human
uuuuuuacuaau

SEQ ID NO: 2016194 - RNA, 15 nt, Human
uuuuucuuaaaaagu

SEQ ID NO: 2016195 - RNA, 21 nt, Human
uuuuucuuaauauauagcauu

SEQ ID NO: 2016196 - RNA, 20 nt, Human
uuuuuuauacaggaugauga

SEQ ID NO: 2016197 - RNA, 13 nt, Human
uuuuucuuaauca

SEQ ID NO: 2016198 - RNA, 17 nt, Human
uuuuuuccuucagugcc

SEQ ID NO: 2016199 - RNA, 12 nt, Human
uuuuuucugaaa

SEQ ID NO: 2016200 - RNA, 15 nt, Human
uuuguaaauuaacuu

SEQ ID NO: 2016201 - RNA, 20 nt, Human
uuugguuaugaauacuuugc

SEQ ID NO: 2016202 - RNA, 16 nt, Human
uuugguuauagugcaa

SEQ ID NO: 2016203 - RNA, 18 nt, Human
uuugguuauagugcaaua

SEQ ID NO: 2016204 - RNA, 13 nt, Human
uuugguuauagug

SEQ ID NO: 2016205 - RNA, 16 nt, Human
uuuguaaauuaacuuu

SEQ ID NO: 2016206 - RNA, 17 nt, Human
uuuguaaauuaacuuuu

SEQ ID NO: 2016207 - RNA, 16 nt, Human
uuuggugucuuucucu

SEQ ID NO: 2016208 - RNA, 19 nt, Human
uuuggugguuucagaaaug

SEQ ID NO: 2016209 - RNA, 22 nt, Human
uuuguaaauuaacuuuuauaaa

SEQ ID NO: 2016210 - RNA, 21 nt, Human
uuugguuauagugcaauauau

SEQ ID NO: 2016211 - RNA, 23 nt, Human
uuugucaguguagaucaacucau

SEQ ID NO: 2016212 - RNA, 15 nt, Human
uuugucacugcuuca

SEQ ID NO: 2016213 - RNA, 21 nt, Human
uuugucauuuucauuagcaaa

SEQ ID NO: 2016214 - RNA, 18 nt, Human
uuuguccuccugcugcca

SEQ ID NO: 2016215 - RNA, 13 nt, Human
uuuguguuccaaa

SEQ ID NO: 2016216 - RNA, 12 nt, Human
uuuguguuuauu

SEQ ID NO: 2016217 - RNA, 15 nt, Human
uuuguguuuauucuu

SEQ ID NO: 2016218 - RNA, 16 nt, Human
uuuguguuuauucuug

SEQ ID NO: 2016219 - RNA, 22 nt, Human
uuuguguuuauucuugaugaaa

SEQ ID NO: 2016220 - RNA, 21 nt, Human
uuuguccccaccgcagacagg

SEQ ID NO: 2016221 - RNA, 13 nt, Human
uuuguccccaccg

SEQ ID NO: 2016222 - RNA, 14 nt, Human
uuugucauuuucau

SEQ ID NO: 2016223 - RNA, 15 nt, Human
uuugucauuuucauu

SEQ ID NO: 2016224 - RNA, 16 nt, Human
uuugucauuuucauua

SEQ ID NO: 2016225 - RNA, 18 nt, Human
uuugucauuuucauuagc

SEQ ID NO: 2016226 - RNA, 23 nt, Human
uuuguucauuucauccuuucacu

SEQ ID NO: 2016227 - RNA, 17 nt, Human
uuuguuaauaaagugca

SEQ ID NO: 2016228 - RNA, 13 nt, Human
uuuguugugugcc

SEQ ID NO: 2016229 - RNA, 21 nt, Human
uuuguugugugccucuagcug

SEQ ID NO: 2016230 - RNA, 23 nt, Human
uuuguugugugccucuagcugaa

SEQ ID NO: 2016231 - RNA, 18 nt, Human
uuuguuccagaaucugua

SEQ ID NO: 2016232 - RNA, 16 nt, Human
uuuguugucagcugaa

SEQ ID NO: 2016233 - RNA, 16 nt, Human
uuugagguggaagagg

SEQ ID NO: 2016234 - RNA, 18 nt, Human
uuugaggaaauuugcagc

SEQ ID NO: 2016235 - RNA, 23 nt, Human
uuugagguuggaaaauaucuuug

SEQ ID NO: 2016236 - RNA, 12 nt, Human
uuugagucuuuu

SEQ ID NO: 2016237 - RNA, 22 nt, Human
uuugagucuuuuuuuuuuaagu

SEQ ID NO: 2016238 - RNA, 17 nt, Human
uuugaggucuguucuuu

SEQ ID NO: 2016239 - RNA, 22 nt, Human
uuugaggucuguucuuuccaaa

SEQ ID NO: 2016240 - RNA, 14 nt, Human
uuugagcucagccc

SEQ ID NO: 2016241 - RNA, 10 nt, Human
uuugagcucc

SEQ ID NO: 2016242 - RNA, 19 nt, Human
uuugagcucccacuucugc

SEQ ID NO: 2016243 - RNA, 17 nt, Human
uuugaggaaauuugcag

SEQ ID NO: 2016244 - RNA, 22 nt, Human
uuucuuacugucuuuuuucuaa

SEQ ID NO: 2016245 - RNA, 13 nt, Human
uuucuuagacuuu

SEQ ID NO: 2016246 - RNA, 15 nt, Human
uuugagcccuuguuu

SEQ ID NO: 2016247 - RNA, 15 nt, Human
uuugagcagggcuca

SEQ ID NO: 2016248 - RNA, 13 nt, Human
uuucuuaauauau

SEQ ID NO: 2016249 - RNA, 16 nt, Human
uuucuuaauauauagc

SEQ ID NO: 2016250 - RNA, 20 nt, Human
uuucuuaauauauagcauuu

SEQ ID NO: 2016251 - RNA, 21 nt, Human
uuucuuaaucauuuuuuauau

SEQ ID NO: 2016252 - RNA, 22 nt, Human
uuucuuaauauauagcauuuau

SEQ ID NO: 2016253 - RNA, 15 nt, Human
uuucuuaaucauuuu

SEQ ID NO: 2016254 - RNA, 23 nt, Human
uuugcauaacguauaaaagccug

SEQ ID NO: 2016255 - RNA, 19 nt, Human
uuugcauaacguauaaaag

SEQ ID NO: 2016256 - RNA, 14 nt, Human
uuugcagcucagaa

SEQ ID NO: 2016257 - RNA, 21 nt, Human
uuugcagaggcuaugggaaga

SEQ ID NO: 2016258 - RNA, 13 nt, Human
uuugcacuuuucu

SEQ ID NO: 2016259 - RNA, 22 nt, Human
uuugcacuuuuucuuaaucauu

SEQ ID NO: 2016260 - RNA, 14 nt, Human
uuugcagacaggca

SEQ ID NO: 2016261 - RNA, 18 nt, Human
uuugccauguuggccagg

SEQ ID NO: 2016262 - RNA, 21 nt, Human
uuuggaacagugcuacugaaa

SEQ ID NO: 2016263 - RNA, 20 nt, Human
uuugccaugugcuucugcca

SEQ ID NO: 2016264 - RNA, 15 nt, Human
uuugcagcuuccaau

SEQ ID NO: 2016265 - RNA, 15 nt, Human
uuugccagugggaac

SEQ ID NO: 2016266 - RNA, 16 nt, Human
uuugccagugggaacu

SEQ ID NO: 2016267 - RNA, 22 nt, Human
uuugccauagaguacacugccu

SEQ ID NO: 2016268 - RNA, 15 nt, Human
uuugccaucucugcu

SEQ ID NO: 2016269 - RNA, 18 nt, Human
uuugccaucucugcucca

SEQ ID NO: 2016270 - RNA, 14 nt, Human
uuugccaugugcuu

SEQ ID NO: 2016271 - RNA, 19 nt, Human
uuuuaauuucaagcuuauu

SEQ ID NO: 2016272 - RNA, 17 nt, Human
uuuuaauuugguuuuca

SEQ ID NO: 2016273 - RNA, 21 nt, Human
uuuuaauuugguuuucacauu

SEQ ID NO: 2016274 - RNA, 22 nt, Human
uuuuacauaaauuuaguauuuu

SEQ ID NO: 2016275 - RNA, 13 nt, Human
uuuuaauuuuguc

SEQ ID NO: 2016276 - RNA, 16 nt, Human
uuuuaauuuugucugc

SEQ ID NO: 2016277 - RNA, 16 nt, Human
uuuuacagcugccugc

SEQ ID NO: 2016278 - RNA, 22 nt, Human
uuuuaaaaugagaaaucuaaaa

SEQ ID NO: 2016279 - RNA, 14 nt, Human
uuuuaaaauguaca

SEQ ID NO: 2016280 - RNA, 15 nt, Human
uuuuaaaauguacau

SEQ ID NO: 2016281 - RNA, 12 nt, Human
uuuuaaaaugua

SEQ ID NO: 2016282 - RNA, 21 nt, Human
uuuuaaaauguacauguauua

SEQ ID NO: 2016283 - RNA, 23 nt, Human
uuuuaaaauuguacaugaacaug

SEQ ID NO: 2016284 - RNA, 13 nt, Human
uuuuaaaauuuua

SEQ ID NO: 2016285 - RNA, 15 nt, Human
uuuuaaaaugagaaa

SEQ ID NO: 2016286 - RNA, 14 nt, Human
uuuuaaaaucuuau

SEQ ID NO: 2016287 - RNA, 15 nt, Human
uuuuaaaaucuuauu

SEQ ID NO: 2016288 - RNA, 22 nt, Human
uuuuaaaaucuuauuaaaguuu

SEQ ID NO: 2016289 - RNA, 16 nt, Human
uuuuauauauaugcau

SEQ ID NO: 2016290 - RNA, 20 nt, Human
uuuuauaucaauuuaaaaaa

SEQ ID NO: 2016291 - RNA, 14 nt, Human
uuuuacuguacaga

SEQ ID NO: 2016292 - RNA, 20 nt, Human
uuuuaugauacuugaaaauu

SEQ ID NO: 2016293 - RNA, 16 nt, Human
uuuuaugauacuugaa

SEQ ID NO: 2016294 - RNA, 18 nt, Human
uuuuaucgucacugcuua

SEQ ID NO: 2016295 - RNA, 16 nt, Human
uuuuauauguugcuau

SEQ ID NO: 2016296 - RNA, 14 nt, Human
uuuuaucaggauuu

SEQ ID NO: 2016297 - RNA, 17 nt, Human
uuuuccucgcuucuuuc

SEQ ID NO: 2016298 - RNA, 18 nt, Human
uuuuccucgcuucuuuca

SEQ ID NO: 2016299 - RNA, 15 nt, Human
uuuuccauuuuauaa

SEQ ID NO: 2016300 - RNA, 19 nt, Human
uuuuccaugaguccccugu

SEQ ID NO: 2016301 - RNA, 18 nt, Human
uuuuccaugaguccccug

SEQ ID NO: 2016302 - RNA, 13 nt, Human
uuuuccauuuuau

SEQ ID NO: 2016303 - RNA, 14 nt, Human
uuuuccauuuuaua

SEQ ID NO: 2016304 - RNA, 15 nt, Human
uuuuccuucagugcc

SEQ ID NO: 2016305 - RNA, 21 nt, Human
uuuuccucgcuucuuucaagg

SEQ ID NO: 2016306 - RNA, 13 nt, Human
uuuuccuugcaua

SEQ ID NO: 2016307 - RNA, 14 nt, Human
uuuuccuugcauac

SEQ ID NO: 2016308 - RNA, 17 nt, Human
uuuucuugcaugaggcu

SEQ ID NO: 2016309 - RNA, 12 nt, Human
uuuucuugauaa

SEQ ID NO: 2016310 - RNA, 16 nt, Human
uuuucuugauaauuuu

SEQ ID NO: 2016311 - RNA, 19 nt, Human
uuuucuugauaauuuuccu

SEQ ID NO: 2016312 - RNA, 14 nt, Human
uuuucuucucccuc

SEQ ID NO: 2016313 - RNA, 16 nt, Human
uuuucaagaaguucuu

SEQ ID NO: 2016314 - RNA, 12 nt, Human
uuuucaaguauu

SEQ ID NO: 2016315 - RNA, 20 nt, Human
uuuucaaguauuuaagccua

SEQ ID NO: 2016316 - RNA, 16 nt, Human
uuuucaaguauuuaag

SEQ ID NO: 2016317 - RNA, 17 nt, Human
uuuucaaguauuuaagc

SEQ ID NO: 2016318 - RNA, 19 nt, Human
uuuucaaccucuagaauuu

SEQ ID NO: 2016319 - RNA, 17 nt, Human
uuuucaacgcagcccug

SEQ ID NO: 2016320 - RNA, 21 nt, Human
uuuucaacgcagcccugcuuu

SEQ ID NO: 2016321 - RNA, 22 nt, Human
uuuucaacgcagcccugcuuug

SEQ ID NO: 2016322 - RNA, 13 nt, Human
uuuuaugaugacg

SEQ ID NO: 2016323 - RNA, 20 nt, Human
uuuuaugaugacguacaagu

SEQ ID NO: 2016324 - RNA, 24 nt, Human
uuuucaaucucguauagaagucuu

SEQ ID NO: 2016325 - RNA, 16 nt, Human
uuuucaauauauuugu

SEQ ID NO: 2016326 - RNA, 20 nt, Human
uuuucaaucucguauagaag

SEQ ID NO: 2016327 - RNA, 13 nt, Human
uuuucaaugugau

SEQ ID NO: 2016328 - RNA, 15 nt, Human
uuuucacaguucucu

SEQ ID NO: 2016329 - RNA, 19 nt, Human
uuuucacugcuggcugccu

SEQ ID NO: 2016330 - RNA, 20 nt, Human
uuuucacugcuggcugccuu

SEQ ID NO: 2016331 - RNA, 12 nt, Human
uuucucuuugaa

SEQ ID NO: 2016332 - RNA, 13 nt, Human
uuucucuuugaaa

SEQ ID NO: 2016333 - RNA, 14 nt, Human
uuucucuuugaaac

SEQ ID NO: 2016334 - RNA, 12 nt, Human
uuucucuuagaa

SEQ ID NO: 2016335 - RNA, 13 nt, Human
uuucucuuagaaa

SEQ ID NO: 2016336 - RNA, 12 nt, Human
uuucucuucaua

SEQ ID NO: 2016337 - RNA, 13 nt, Human
uuucucuucuccc

SEQ ID NO: 2016338 - RNA, 16 nt, Human
uuucucuucuccccuu

SEQ ID NO: 2016339 - RNA, 19 nt, Human
uuucucuucuccccuucca

SEQ ID NO: 2016340 - RNA, 20 nt, Human
uuucucuucuccccuuccau

SEQ ID NO: 2016341 - RNA, 16 nt, Human
uuucuaggacugaauu

SEQ ID NO: 2016342 - RNA, 17 nt, Human
uuucuccguaugcacau

SEQ ID NO: 2016343 - RNA, 19 nt, Human
uuucuagcauauauguguc

SEQ ID NO: 2016344 - RNA, 15 nt, Human
uuucuagccagagga

SEQ ID NO: 2016345 - RNA, 15 nt, Human
uuucuaaugugugaa

SEQ ID NO: 2016346 - RNA, 20 nt, Human
uuucuaagguaacaagauga

SEQ ID NO: 2016347 - RNA, 14 nt, Human
uuuccuauaccauu

SEQ ID NO: 2016348 - RNA, 16 nt, Human
uuuccuauaccauuuc

SEQ ID NO: 2016349 - RNA, 16 nt, Human
uuuccuauaugaugau

SEQ ID NO: 2016350 - RNA, 18 nt, Human
uuuccaggaaaaagaacu

SEQ ID NO: 2016351 - RNA, 19 nt, Human
uuuccaggaaaaagaacuu

SEQ ID NO: 2016352 - RNA, 21 nt, Human
uuuccuacuugcacucuucua

SEQ ID NO: 2016353 - RNA, 21 nt, Human
uuuccucuuuggucuacacug

SEQ ID NO: 2016354 - RNA, 12 nt, Human
uuuccucuugaa

SEQ ID NO: 2016355 - RNA, 23 nt, Human
uuuccugacagaaggacucaggu

SEQ ID NO: 2016356 - RNA, 22 nt, Human
uuuccucaaaacuucagacaua

SEQ ID NO: 2016357 - RNA, 18 nt, Human
uuucuaaaggcuaccuuu

SEQ ID NO: 2016358 - RNA, 17 nt, Human
uuucuaaagcugccagc

SEQ ID NO: 2016359 - RNA, 14 nt, Human
uuucuaaagcugcc

SEQ ID NO: 2016360 - RNA, 14 nt, Human
uuucuaaaggcuac

SEQ ID NO: 2016361 - RNA, 22 nt, Human
uuucauugcugggcuugucugu

SEQ ID NO: 2016362 - RNA, 22 nt, Human
uuucagguagaggugcaugccu

SEQ ID NO: 2016363 - RNA, 16 nt, Human
uuucagccaagaauuc

SEQ ID NO: 2016364 - RNA, 15 nt, Human
uuucagccaagaauu

SEQ ID NO: 2016365 - RNA, 12 nt, Human
uuuccagagcau

SEQ ID NO: 2016366 - RNA, 13 nt, Human
uuuccagagcauu

SEQ ID NO: 2016367 - RNA, 17 nt, Human
uuuccagagcauuccag

SEQ ID NO: 2016368 - RNA, 13 nt, Human
uuuccaggaaggc

SEQ ID NO: 2016369 - RNA, 19 nt, Human
uuuccagagcauuccaguc

SEQ ID NO: 2016370 - RNA, 15 nt, Human
uuucauugcugugac

SEQ ID NO: 2016371 - RNA, 18 nt, Human
uuucauugcugugacagu

SEQ ID NO: 2016372 - RNA, 12 nt, Human
uuuccaaaguac

SEQ ID NO: 2016373 - RNA, 15 nt, Human
uuuccaaaguacacu

SEQ ID NO: 2016374 - RNA, 16 nt, Human
uuuauuuauuuauuca

SEQ ID NO: 2016375 - RNA, 16 nt, Human
uuuauuucagcaaacu

SEQ ID NO: 2016376 - RNA, 19 nt, Human
uuuauuucagcaaacuugu

SEQ ID NO: 2016377 - RNA, 16 nt, Human
uuuauuucuccuuuug

SEQ ID NO: 2016378 - RNA, 17 nt, Human
uuuauuucuccuuuugu

SEQ ID NO: 2016379 - RNA, 13 nt, Human
uuuauuucuccuu

SEQ ID NO: 2016380 - RNA, 15 nt, Human
uuuauuucuccuuuu

SEQ ID NO: 2016381 - RNA, 13 nt, Human
uuuauuuccagug

SEQ ID NO: 2016382 - RNA, 21 nt, Human
uuuauuucuccuuuuguguuc

SEQ ID NO: 2016383 - RNA, 22 nt, Human
uuucaauaggaaaaacugauuu

SEQ ID NO: 2016384 - RNA, 20 nt, Human
uuucaauaggaaaaacugau

SEQ ID NO: 2016385 - RNA, 23 nt, Human
uuucaaucucguauagaagucuu

SEQ ID NO: 2016386 - RNA, 13 nt, Human
uuucaaucucgua

SEQ ID NO: 2016387 - RNA, 19 nt, Human
uuucaaucucguauagaag

SEQ ID NO: 2016388 - RNA, 17 nt, Human
uuucaauauuuuccuuc

SEQ ID NO: 2016389 - RNA, 13 nt, Human
uuuauuuuaaaac

SEQ ID NO: 2016390 - RNA, 15 nt, Human
uuucagcagcugcag

SEQ ID NO: 2016391 - RNA, 13 nt, Human
uuucagcaggcag

SEQ ID NO: 2016392 - RNA, 14 nt, Human
uuucagcaggcagc

SEQ ID NO: 2016393 - RNA, 19 nt, Human
uuuagaagaagugugucac

SEQ ID NO: 2016394 - RNA, 14 nt, Human
uuuagaacagguuu

SEQ ID NO: 2016395 - RNA, 15 nt, Human
uuuagaacagguuuu

SEQ ID NO: 2016396 - RNA, 17 nt, Human
uuuagaagaaguguguc

SEQ ID NO: 2016397 - RNA, 13 nt, Human
uuuagacuugaaa

SEQ ID NO: 2016398 - RNA, 14 nt, Human
uuuagacuugaaaa

SEQ ID NO: 2016399 - RNA, 15 nt, Human
uuuagacuugaaaag

SEQ ID NO: 2016400 - RNA, 19 nt, Human
uuuagacuugaaaagagac

SEQ ID NO: 2016401 - RNA, 20 nt, Human
uuuagacuugaaaagagaca

SEQ ID NO: 2016402 - RNA, 21 nt, Human
uuuagacuugaaaagagacag

SEQ ID NO: 2016403 - RNA, 22 nt, Human
uuuagacuugaaaagagacagg

SEQ ID NO: 2016404 - RNA, 23 nt, Human
uuuagacuugaaaagagacaggc

SEQ ID NO: 2016405 - RNA, 12 nt, Human
uuuagacuugaa

SEQ ID NO: 2016406 - RNA, 22 nt, Human
uuuacauggcuggagcuagaau

SEQ ID NO: 2016407 - RNA, 15 nt, Human
uuuacuuuguguuca

SEQ ID NO: 2016408 - RNA, 22 nt, Human
uuuacuuuuuuuuuauuuuauu

SEQ ID NO: 2016409 - RNA, 21 nt, Human
uuuacuuuuuuuuuauuuuau

SEQ ID NO: 2016410 - RNA, 17 nt, Human
uuuacauggcuggagcu

SEQ ID NO: 2016411 - RNA, 16 nt, Human
uuuaaucuacugcauu

SEQ ID NO: 2016412 - RNA, 17 nt, Human
uuuaaucuacugcauuu

SEQ ID NO: 2016413 - RNA, 13 nt, Human
uuuaaucuacugc

SEQ ID NO: 2016414 - RNA, 18 nt, Human
uuuaaucuacugcauuua

SEQ ID NO: 2016415 - RNA, 20 nt, Human
uuuacaagacaacauuguaa

SEQ ID NO: 2016416 - RNA, 16 nt, Human
uuguauuguccuauua

SEQ ID NO: 2016417 - RNA, 21 nt, Human
uuguauucaauuaaagaaaua

SEQ ID NO: 2016418 - RNA, 14 nt, Human
uuguauucugucuu

SEQ ID NO: 2016419 - RNA, 13 nt, Human
uuguauucaauua

SEQ ID NO: 2016420 - RNA, 18 nt, Human
uuguauucaauuaaagaa

SEQ ID NO: 2016421 - RNA, 20 nt, Human
uuguauuuuacuaauaaaau

SEQ ID NO: 2016422 - RNA, 15 nt, Human
uuguauuuauuuagu

SEQ ID NO: 2016423 - RNA, 14 nt, Human
uuguauuuauucuu

SEQ ID NO: 2016424 - RNA, 9 nt, Human
uuguauuuu

SEQ ID NO: 2016425 - RNA, 16 nt, Human
uuuauugucaaagugg

SEQ ID NO: 2016426 - RNA, 14 nt, Human
uuuauugucaaagu

SEQ ID NO: 2016427 - RNA, 15 nt, Human
uuuauuuauauguau

SEQ ID NO: 2016428 - RNA, 15 nt, Human
uuuauuuauauuuau

SEQ ID NO: 2016429 - RNA, 17 nt, Human
uuuauuuauauuuauug

SEQ ID NO: 2016430 - RNA, 18 nt, Human
uuuaugcaaggucuugca

SEQ ID NO: 2016431 - RNA, 23 nt, Human
uuuauuauuuauuuuuuuuaauu

SEQ ID NO: 2016432 - RNA, 14 nt, Human
uuuauucaaacuga

SEQ ID NO: 2016433 - RNA, 14 nt, Human
uuuaugcauauuau

SEQ ID NO: 2016434 - RNA, 13 nt, Human
uuuauuccagagc

SEQ ID NO: 2016435 - RNA, 23 nt, Human
uuuauugcaucuggguagcugua

SEQ ID NO: 2016436 - RNA, 22 nt, Human
uuuauugccaaaacccagcugc

SEQ ID NO: 2016437 - RNA, 24 nt, Human
uuuauugcaucuggguagcuguaa

SEQ ID NO: 2016438 - RNA, 16 nt, Human
uuuaucuuugauaaca

SEQ ID NO: 2016439 - RNA, 12 nt, Human
uuuaucuuugau

SEQ ID NO: 2016440 - RNA, 15 nt, Human
uuuaucuagauguaa

SEQ ID NO: 2016441 - RNA, 16 nt, Human
uuuaucuagauguaaa

SEQ ID NO: 2016442 - RNA, 17 nt, Human
uuuaucuagauguaaau

SEQ ID NO: 2016443 - RNA, 20 nt, Human
uuuaucuagauguaaauuuu

SEQ ID NO: 2016444 - RNA, 15 nt, Human
uuuaugaagaaaaua

SEQ ID NO: 2016445 - RNA, 16 nt, Human
uuuaugaagaaaauac

SEQ ID NO: 2016446 - RNA, 18 nt, Human
uuuaugaagaaaauacuu

SEQ ID NO: 2016447 - RNA, 12 nt, Human
uuuaugaagaaa

SEQ ID NO: 2016448 - RNA, 13 nt, Human
uuuaugaagaaaa

SEQ ID NO: 2016449 - RNA, 14 nt, Human
uuuauaaacuuuac

SEQ ID NO: 2016450 - RNA, 16 nt, Human
uuuaucgucacugcuu

SEQ ID NO: 2016451 - RNA, 16 nt, Human
uuuauaaacuuuaccu

SEQ ID NO: 2016452 - RNA, 21 nt, Human
uuuaucgucacugcuuaacuu

SEQ ID NO: 2016453 - RNA, 21 nt, Human
uuuaucuaccaacuuucaaga

SEQ ID NO: 2016454 - RNA, 19 nt, Human
uucaggaagcucagggccu

SEQ ID NO: 2016455 - RNA, 17 nt, Human
uucaggaagcucagggc

SEQ ID NO: 2016456 - RNA, 15 nt, Human
uucaggaagcucagg

SEQ ID NO: 2016457 - RNA, 20 nt, Human
uucaggaagcucagggccug

SEQ ID NO: 2016458 - RNA, 15 nt, Human
uucaggcucuucucc

SEQ ID NO: 2016459 - RNA, 17 nt, Human
uucaggcauuuuccccc

SEQ ID NO: 2016460 - RNA, 17 nt, Human
uucagcugacuuuucug

SEQ ID NO: 2016461 - RNA, 18 nt, Human
uucagcugcauacaguuu

SEQ ID NO: 2016462 - RNA, 16 nt, Human
uucaggaagcucaggg

SEQ ID NO: 2016463 - RNA, 21 nt, Human
uucagcugguugagguuucaa

SEQ ID NO: 2016464 - RNA, 24 nt, Human
uucagcucugcaagaauugaagca

SEQ ID NO: 2016465 - RNA, 17 nt, Human
uucagcucugcaagaau

SEQ ID NO: 2016466 - RNA, 23 nt, Human
uucagcuccagcucaccagcccc

SEQ ID NO: 2016467 - RNA, 17 nt, Human
uucaccccaaucccagc

SEQ ID NO: 2016468 - RNA, 18 nt, Human
uucacucuuggagccugc

SEQ ID NO: 2016469 - RNA, 19 nt, Human
uucacucuuggagccugca

SEQ ID NO: 2016470 - RNA, 14 nt, Human
uucacucuuggagc

SEQ ID NO: 2016471 - RNA, 14 nt, Human
uucacucuccuugg

SEQ ID NO: 2016472 - RNA, 15 nt, Human
uucagagacuccugc

SEQ ID NO: 2016473 - RNA, 13 nt, Human
uucagacucucuc

SEQ ID NO: 2016474 - RNA, 13 nt, Human
uucagaggcucag

SEQ ID NO: 2016475 - RNA, 22 nt, Human
uucagaggcucagauuguaaua

SEQ ID NO: 2016476 - RNA, 12 nt, Human
uucagaggcuca

SEQ ID NO: 2016477 - RNA, 14 nt, Human
uuacgugaguccug

SEQ ID NO: 2016478 - RNA, 13 nt, Human
uuacgugaguccu

SEQ ID NO: 2016479 - RNA, 12 nt, Human
uuauuuucuaaa

SEQ ID NO: 2016480 - RNA, 13 nt, Human
uucaaagauauuu

SEQ ID NO: 2016481 - RNA, 15 nt, Human
uucaaagcaaauguc

SEQ ID NO: 2016482 - RNA, 13 nt, Human
uuauuuugaugua

SEQ ID NO: 2016483 - RNA, 16 nt, Human
uuauuuugauguaaag

SEQ ID NO: 2016484 - RNA, 14 nt, Human
uuauuuucuaaagu

SEQ ID NO: 2016485 - RNA, 23 nt, Human
uucaaauuguaagcaugcacaaa

SEQ ID NO: 2016486 - RNA, 19 nt, Human
uucaaagcaccaaaauaag

SEQ ID NO: 2016487 - RNA, 21 nt, Human
uucaaagcaccaaaauaagaa

SEQ ID NO: 2016488 - RNA, 23 nt, Human
uucaaagcaccaaaauaagaaaa

SEQ ID NO: 2016489 - RNA, 19 nt, Human
uucaacagcaagugugaau

SEQ ID NO: 2016490 - RNA, 20 nt, Human
uucaacagcaagugugaaua

SEQ ID NO: 2016491 - RNA, 20 nt, Human
uucaacaaggcuugcugcag

SEQ ID NO: 2016492 - RNA, 17 nt, Human
uucaaccauuccccaug

SEQ ID NO: 2016493 - RNA, 20 nt, Human
uucaaccauuccccauggga

SEQ ID NO: 2016494 - RNA, 13 nt, Human
uucaacgcagccc

SEQ ID NO: 2016495 - RNA, 20 nt, Human
uucaacccccuuaacuguau

SEQ ID NO: 2016496 - RNA, 14 nt, Human
uucaacgcagcccu

SEQ ID NO: 2016497 - RNA, 15 nt, Human
uucaacgcagcccug

SEQ ID NO: 2016498 - RNA, 16 nt, Human
uucaaucccaggaugu

SEQ ID NO: 2016499 - RNA, 23 nt, Human
uucaaccucuagaauuuuaagcc

SEQ ID NO: 2016500 - RNA, 15 nt, Human
uucaaccucuagaau

SEQ ID NO: 2016501 - RNA, 22 nt, Human
uucaaucucguauagaagucuu

SEQ ID NO: 2016502 - RNA, 23 nt, Human
uucaaucucguauagaagucuuc

SEQ ID NO: 2016503 - RNA, 19 nt, Human
uucaaucuggauucauauu

SEQ ID NO: 2016504 - RNA, 20 nt, Human
uucaaucuggauucauauuu

SEQ ID NO: 2016505 - RNA, 23 nt, Human
uucaaucuggauucauauuuaau

SEQ ID NO: 2016506 - RNA, 22 nt, Human
uucaaugugauauaaacagcuu

SEQ ID NO: 2016507 - RNA, 19 nt, Human
uucaaugccccugaauuua

SEQ ID NO: 2016508 - RNA, 14 nt, Human
uucaauuaaagaaa

SEQ ID NO: 2016509 - RNA, 15 nt, Human
uucaauuaaagaaau

SEQ ID NO: 2016510 - RNA, 16 nt, Human
uucaauuaaagaaaua

SEQ ID NO: 2016511 - RNA, 18 nt, Human
uucaauucucauuuguca

SEQ ID NO: 2016512 - RNA, 14 nt, Human
uuccaucugauucc

SEQ ID NO: 2016513 - RNA, 17 nt, Human
uuccaucugauuccagc

SEQ ID NO: 2016514 - RNA, 13 nt, Human
uuccaugacaaua

SEQ ID NO: 2016515 - RNA, 17 nt, Human
uuccaugaauguuccug

SEQ ID NO: 2016516 - RNA, 12 nt, Human
uuccaugaaugu

SEQ ID NO: 2016517 - RNA, 17 nt, Human
uuccaugaguccccugu

SEQ ID NO: 2016518 - RNA, 17 nt, Human
uuccaugucgccucugc

SEQ ID NO: 2016519 - RNA, 16 nt, Human
uuccaugucgccucug

SEQ ID NO: 2016520 - RNA, 18 nt, Human
uuccaugucgccucugca

SEQ ID NO: 2016521 - RNA, 19 nt, Human
uuccaugucgccucugcau

SEQ ID NO: 2016522 - RNA, 14 nt, Human
uuccccaagacauu

SEQ ID NO: 2016523 - RNA, 20 nt, Human
uuccaugucgccucugcauu

SEQ ID NO: 2016524 - RNA, 21 nt, Human
uuccaugucgccucugcauuc

SEQ ID NO: 2016525 - RNA, 17 nt, Human
uuccauuuacugcauuc

SEQ ID NO: 2016526 - RNA, 23 nt, Human
uuccagcaggagggacagucuca

SEQ ID NO: 2016527 - RNA, 12 nt, Human
uuccagcaggag

SEQ ID NO: 2016528 - RNA, 13 nt, Human
uuccagcaggagg

SEQ ID NO: 2016529 - RNA, 20 nt, Human
uuccagcacaaccuucaagc

SEQ ID NO: 2016530 - RNA, 12 nt, Human
uuccagccugcc

SEQ ID NO: 2016531 - RNA, 14 nt, Human
uuccagccugccac

SEQ ID NO: 2016532 - RNA, 16 nt, Human
uuccagccugccacuc

SEQ ID NO: 2016533 - RNA, 17 nt, Human
uuccaucuaaaaauaua

SEQ ID NO: 2016534 - RNA, 19 nt, Human
uucauuuuacaguuacuuu

SEQ ID NO: 2016535 - RNA, 13 nt, Human
uucauuuugcuuu

SEQ ID NO: 2016536 - RNA, 14 nt, Human
uucauuuugcuuua

SEQ ID NO: 2016537 - RNA, 13 nt, Human
uuccacugagacc

SEQ ID NO: 2016538 - RNA, 15 nt, Human
uucauuuugcuuuaa

SEQ ID NO: 2016539 - RNA, 17 nt, Human
uucauuuugcuuuaauu

SEQ ID NO: 2016540 - RNA, 19 nt, Human
uuccacuuauaggaauuga

SEQ ID NO: 2016541 - RNA, 21 nt, Human
uuccacuuagaaauugcauuu

SEQ ID NO: 2016542 - RNA, 23 nt, Human
uucauaaugacuuaagcacacuu

SEQ ID NO: 2016543 - RNA, 13 nt, Human
uucauaaugacuu

SEQ ID NO: 2016544 - RNA, 15 nt, Human
uucaucuaggauuuu

SEQ ID NO: 2016545 - RNA, 14 nt, Human
uucauaagauauuu

SEQ ID NO: 2016546 - RNA, 21 nt, Human
uucagugccuuauggaacacu

SEQ ID NO: 2016547 - RNA, 19 nt, Human
uucagugccuuauggaaca

SEQ ID NO: 2016548 - RNA, 16 nt, Human
uucaggcucuucuccu

SEQ ID NO: 2016549 - RNA, 23 nt, Human
uucagggaagauaaguuggaaac

SEQ ID NO: 2016550 - RNA, 20 nt, Human
uucagggaagauaaguugga

SEQ ID NO: 2016551 - RNA, 21 nt, Human
uucagggaagauaaguuggaa

SEQ ID NO: 2016552 - RNA, 22 nt, Human
uucaggcuuuaggcauaugcuu

SEQ ID NO: 2016553 - RNA, 18 nt, Human
uucagggaagauaaguug

SEQ ID NO: 2016554 - RNA, 19 nt, Human
uucagggaagauaaguugg

SEQ ID NO: 2016555 - RNA, 13 nt, Human
uucaguggcagcu

SEQ ID NO: 2016556 - RNA, 23 nt, Human
uucaucucuagggaccagaacca

SEQ ID NO: 2016557 - RNA, 11 nt, Human
uucaucuugaa

SEQ ID NO: 2016558 - RNA, 20 nt, Human
uucaucuuccaacucaaacu

SEQ ID NO: 2016559 - RNA, 18 nt, Human
uucaugaaagauucaaug

SEQ ID NO: 2016560 - RNA, 13 nt, Human
uucaugaaauccu

SEQ ID NO: 2016561 - RNA, 12 nt, Human
uucaugaaaugc

SEQ ID NO: 2016562 - RNA, 13 nt, Human
uucaugaaaugcu

SEQ ID NO: 2016563 - RNA, 23 nt, Human
uucaugaaaugcuaugucauuuc

SEQ ID NO: 2016564 - RNA, 15 nt, Human
uucaugaaaugcuau

SEQ ID NO: 2016565 - RNA, 20 nt, Human
uucaugaaaugcuaugucau

SEQ ID NO: 2016566 - RNA, 21 nt, Human
uucaugaaaugcuaugucauu

SEQ ID NO: 2016567 - RNA, 22 nt, Human
uucaugaaaugcuaugucauuu

SEQ ID NO: 2016568 - RNA, 12 nt, Human
uucaucuugaau

SEQ ID NO: 2016569 - RNA, 17 nt, Human
uucaucuugaauuguaa

SEQ ID NO: 2016570 - RNA, 19 nt, Human
uucauuuaggugaggaagc

SEQ ID NO: 2016571 - RNA, 14 nt, Human
uucauuucauccuu

SEQ ID NO: 2016572 - RNA, 16 nt, Human
uucauuucauccuuuc

SEQ ID NO: 2016573 - RNA, 21 nt, Human
uuccucccucccucuuucccu

SEQ ID NO: 2016574 - RNA, 19 nt, Human
uuccucccucccucuuucc

SEQ ID NO: 2016575 - RNA, 12 nt, Human
uuccucccuccc

SEQ ID NO: 2016576 - RNA, 12 nt, Human
uuccuccugaca

SEQ ID NO: 2016577 - RNA, 19 nt, Human
uuccuccugacaccccacu

SEQ ID NO: 2016578 - RNA, 20 nt, Human
uuccuccugacaccccacuu

SEQ ID NO: 2016579 - RNA, 22 nt, Human
uuccucccucccucuuucccuc

SEQ ID NO: 2016580 - RNA, 22 nt, Human
uuccuagccaccgccuccuaca

SEQ ID NO: 2016581 - RNA, 20 nt, Human
uuccuagguauaauucacau

SEQ ID NO: 2016582 - RNA, 22 nt, Human
uuccuagcuggagaggagcccu

SEQ ID NO: 2016583 - RNA, 18 nt, Human
uuccuaguucaucccuuc

SEQ ID NO: 2016584 - RNA, 23 nt, Human
uuccucauaguaugguggcuggg

SEQ ID NO: 2016585 - RNA, 21 nt, Human
uuccuaguucaucccuucucu

SEQ ID NO: 2016586 - RNA, 22 nt, Human
uuccuaguucaucccuucucuu

SEQ ID NO: 2016587 - RNA, 15 nt, Human
uuccuauaacacugu

SEQ ID NO: 2016588 - RNA, 15 nt, Human
uuccuagccaccgcc

SEQ ID NO: 2016589 - RNA, 21 nt, Human
uuccuagccaccgccuccuac

SEQ ID NO: 2016590 - RNA, 14 nt, Human
uuccuagccaccgc

SEQ ID NO: 2016591 - RNA, 19 nt, Human
uucccuuugacgccauccc

SEQ ID NO: 2016592 - RNA, 14 nt, Human
uuccuagagaacug

SEQ ID NO: 2016593 - RNA, 15 nt, Human
uucccuuuagcugug

SEQ ID NO: 2016594 - RNA, 20 nt, Human
uucccuuccaguuuauucca

SEQ ID NO: 2016595 - RNA, 22 nt, Human
uuccccacuugagaauuacccu

SEQ ID NO: 2016596 - RNA, 21 nt, Human
uuccccacccuccccuuccca

SEQ ID NO: 2016597 - RNA, 22 nt, Human
uuccccacccuccccuucccag

SEQ ID NO: 2016598 - RNA, 17 nt, Human
uucccugguaagaaaaa

SEQ ID NO: 2016599 - RNA, 18 nt, Human
uucccugguaagaaaaag

SEQ ID NO: 2016600 - RNA, 13 nt, Human
uucccuggguuag

SEQ ID NO: 2016601 - RNA, 21 nt, Human
uucccuggguuagacugccag

SEQ ID NO: 2016602 - RNA, 23 nt, Human
uucccuggguuagacugccagcu

SEQ ID NO: 2016603 - RNA, 16 nt, Human
uucccugguaagaaaa

SEQ ID NO: 2016604 - RNA, 22 nt, Human
uucccugguaagaaaaagcaaa

SEQ ID NO: 2016605 - RNA, 12 nt, Human
uuccuuucuuga

SEQ ID NO: 2016606 - RNA, 22 nt, Human
uucggccuccauccugaggcuc

SEQ ID NO: 2016607 - RNA, 18 nt, Human
uucggccuccauccugag

SEQ ID NO: 2016608 - RNA, 19 nt, Human
uucggccuccauccugagg

SEQ ID NO: 2016609 - RNA, 17 nt, Human
uucuaaaggcuaccuuu

SEQ ID NO: 2016610 - RNA, 18 nt, Human
uucuaaaggcuaccuuug

SEQ ID NO: 2016611 - RNA, 17 nt, Human
uucuaauaagcuaguug

SEQ ID NO: 2016612 - RNA, 19 nt, Human
uucuaauaagcuaguugaa

SEQ ID NO: 2016613 - RNA, 20 nt, Human
uucuaauaagcuaguugaau

SEQ ID NO: 2016614 - RNA, 23 nt, Human
uucuaauaagcuaguugaauacu

SEQ ID NO: 2016615 - RNA, 19 nt, Human
uucuaaacuaggcuccuuc

SEQ ID NO: 2016616 - RNA, 20 nt, Human
uucuaaacuaggcuccuuca

SEQ ID NO: 2016617 - RNA, 16 nt, Human
uucuaaaggcuaccuu

SEQ ID NO: 2016618 - RNA, 12 nt, Human
uucuaaagauag

SEQ ID NO: 2016619 - RNA, 19 nt, Human
uuccuucauucaacccacc

SEQ ID NO: 2016620 - RNA, 23 nt, Human
uuccuucagugccuuauggaaca

SEQ ID NO: 2016621 - RNA, 19 nt, Human
uuccuucagugccuuaugg

SEQ ID NO: 2016622 - RNA, 16 nt, Human
uuccuucagugccuua

SEQ ID NO: 2016623 - RNA, 13 nt, Human
uuccugcccuggg

SEQ ID NO: 2016624 - RNA, 16 nt, Human
uuccugcccugggagg

SEQ ID NO: 2016625 - RNA, 22 nt, Human
uuccugcccugggaggcaguga

SEQ ID NO: 2016626 - RNA, 19 nt, Human
uuccugcccugcuguuuau

SEQ ID NO: 2016627 - RNA, 11 nt, Human
uuccugcccug

SEQ ID NO: 2016628 - RNA, 13 nt, Human
uuccuuccucuga

SEQ ID NO: 2016629 - RNA, 17 nt, Human
uuccuuccucugagccu

SEQ ID NO: 2016630 - RNA, 23 nt, Human
uucucaucuugacagagccugcc

SEQ ID NO: 2016631 - RNA, 11 nt, Human
uucucaugccu

SEQ ID NO: 2016632 - RNA, 12 nt, Human
uucucaugccuc

SEQ ID NO: 2016633 - RNA, 14 nt, Human
uucucaugccucag

SEQ ID NO: 2016634 - RNA, 21 nt, Human
uucucaugccucagccuccug

SEQ ID NO: 2016635 - RNA, 21 nt, Human
uucuauuuauuuauuuauuca

SEQ ID NO: 2016636 - RNA, 14 nt, Human
uucuauuguuucuu

SEQ ID NO: 2016637 - RNA, 16 nt, Human
uucuauuuucucugau

SEQ ID NO: 2016638 - RNA, 22 nt, Human
uucuauuuucucugauacuuuu

SEQ ID NO: 2016639 - RNA, 13 nt, Human
uucuauuuuacaa

SEQ ID NO: 2016640 - RNA, 16 nt, Human
uucuaugacacaugca

SEQ ID NO: 2016641 - RNA, 17 nt, Human
uucuaugacacaugcaa

SEQ ID NO: 2016642 - RNA, 14 nt, Human
uucucugauacaga

SEQ ID NO: 2016643 - RNA, 15 nt, Human
uucucugauacagaa

SEQ ID NO: 2016644 - RNA, 16 nt, Human
uucucugauacagaaa

SEQ ID NO: 2016645 - RNA, 12 nt, Human
uucucucugcuc

SEQ ID NO: 2016646 - RNA, 17 nt, Human
uucucugauacagaaaa

SEQ ID NO: 2016647 - RNA, 15 nt, Human
uucucugcccagcuu

SEQ ID NO: 2016648 - RNA, 18 nt, Human
uucucugcccagcuuuuc

SEQ ID NO: 2016649 - RNA, 20 nt, Human
uucucugcccagcuuuucau

SEQ ID NO: 2016650 - RNA, 21 nt, Human
uucugacccaugcugcccugu

SEQ ID NO: 2016651 - RNA, 20 nt, Human
uucugacccaugcugcccug

SEQ ID NO: 2016652 - RNA, 18 nt, Human
uucugacccaugcugccc

SEQ ID NO: 2016653 - RNA, 16 nt, Human
uucugacccaugcugc

SEQ ID NO: 2016654 - RNA, 22 nt, Human
uucucugguacaauuucuuuug

SEQ ID NO: 2016655 - RNA, 11 nt, Human
uucucuguaca

SEQ ID NO: 2016656 - RNA, 12 nt, Human
uucucuguacau

SEQ ID NO: 2016657 - RNA, 18 nt, Human
uucucuguacauauuagc

SEQ ID NO: 2016658 - RNA, 18 nt, Human
uucucuccagccccugga

SEQ ID NO: 2016659 - RNA, 22 nt, Human
uucucuccuguaccucuugagc

SEQ ID NO: 2016660 - RNA, 20 nt, Human
uucucucuacugguccucuu

SEQ ID NO: 2016661 - RNA, 12 nt, Human
uucucuccauuu

SEQ ID NO: 2016662 - RNA, 11 nt, Human
uucuccaggcu

SEQ ID NO: 2016663 - RNA, 16 nt, Human
uucuccaagcaggaca

SEQ ID NO: 2016664 - RNA, 13 nt, Human
uucuccacccugc

SEQ ID NO: 2016665 - RNA, 17 nt, Human
uucuccagucauuaugu

SEQ ID NO: 2016666 - RNA, 19 nt, Human
uucuccagucauuauguua

SEQ ID NO: 2016667 - RNA, 12 nt, Human
uugcuuaaaugu

SEQ ID NO: 2016668 - RNA, 13 nt, Human
uugcuuaaaugug

SEQ ID NO: 2016669 - RNA, 14 nt, Human
uugcuuaaauguga

SEQ ID NO: 2016670 - RNA, 15 nt, Human
uugcuuaaaugugaa

SEQ ID NO: 2016671 - RNA, 16 nt, Human
uugcuuaaaugugaau

SEQ ID NO: 2016672 - RNA, 17 nt, Human
uugcuuaaaugugaauu

SEQ ID NO: 2016673 - RNA, 20 nt, Human
uugcuuaaaugugaauuacu

SEQ ID NO: 2016674 - RNA, 24 nt, Human
uugcuuaaaugugaauuacuaacu

SEQ ID NO: 2016675 - RNA, 21 nt, Human
uugcuuaauuacaauauuucu

SEQ ID NO: 2016676 - RNA, 20 nt, Human
uugcuggggccgaaagaaca

SEQ ID NO: 2016677 - RNA, 22 nt, Human
uugcugccucggauccccuucc

SEQ ID NO: 2016678 - RNA, 23 nt, Human
uugcugccucggauccccuuccu

SEQ ID NO: 2016679 - RNA, 15 nt, Human
uugcugguaaaauga

SEQ ID NO: 2016680 - RNA, 16 nt, Human
uugcugguaaaaugaa

SEQ ID NO: 2016681 - RNA, 23 nt, Human
uugcugguaaaaugaagaauuua

SEQ ID NO: 2016682 - RNA, 14 nt, Human
uugcugguacacac

SEQ ID NO: 2016683 - RNA, 19 nt, Human
uuggaacaguaaucaguuu

SEQ ID NO: 2016684 - RNA, 20 nt, Human
uuggaacaguaaucaguuug

SEQ ID NO: 2016685 - RNA, 13 nt, Human
uuggaaauuucac

SEQ ID NO: 2016686 - RNA, 21 nt, Human
uuggaaaucaaauguaaaguu

SEQ ID NO: 2016687 - RNA, 16 nt, Human
uuggaaaucaaaugua

SEQ ID NO: 2016688 - RNA, 18 nt, Human
uuggaaaucaaauguaaa

SEQ ID NO: 2016689 - RNA, 19 nt, Human
uuggaaaucaaauguaaag

SEQ ID NO: 2016690 - RNA, 15 nt, Human
uuggauucugagagc

SEQ ID NO: 2016691 - RNA, 17 nt, Human
uuggauucugagagcug

SEQ ID NO: 2016692 - RNA, 16 nt, Human
uuggcaaacucuccac

SEQ ID NO: 2016693 - RNA, 20 nt, Human
uuggcaaacucuccaccaca

SEQ ID NO: 2016694 - RNA, 17 nt, Human
uuggcaaaaaggcagga

SEQ ID NO: 2016695 - RNA, 14 nt, Human
uuggauuguccccg

SEQ ID NO: 2016696 - RNA, 19 nt, Human
uuggaaggaacguccccug

SEQ ID NO: 2016697 - RNA, 11 nt, Human
uuggaaggaac

SEQ ID NO: 2016698 - RNA, 20 nt, Human
uuggaagugaaaacuuugua

SEQ ID NO: 2016699 - RNA, 20 nt, Human
uuggaagggcuuuucaaaau

SEQ ID NO: 2016700 - RNA, 15 nt, Human
uuggaaguuuuaauc

SEQ ID NO: 2016701 - RNA, 14 nt, Human
uuggaccauuuucc

SEQ ID NO: 2016702 - RNA, 16 nt, Human
uuggacauuuuauguc

SEQ ID NO: 2016703 - RNA, 17 nt, Human
uuggacauuuuaugucu

SEQ ID NO: 2016704 - RNA, 18 nt, Human
uuggacauuuuaugucuu

SEQ ID NO: 2016705 - RNA, 20 nt, Human
uuggacauuuuaugucuuuc

SEQ ID NO: 2016706 - RNA, 16 nt, Human
uugccucugccucuga

SEQ ID NO: 2016707 - RNA, 18 nt, Human
uugccucugccucugaca

SEQ ID NO: 2016708 - RNA, 11 nt, Human
uugccucugcc

SEQ ID NO: 2016709 - RNA, 14 nt, Human
uugccucugccucu

SEQ ID NO: 2016710 - RNA, 12 nt, Human
uugcccagccuc

SEQ ID NO: 2016711 - RNA, 16 nt, Human
uugcccagccucuuuc

SEQ ID NO: 2016712 - RNA, 19 nt, Human
uugcccagccucuuucccu

SEQ ID NO: 2016713 - RNA, 18 nt, Human
uugccagucaccccggcc

SEQ ID NO: 2016714 - RNA, 13 nt, Human
uugccagucaccc

SEQ ID NO: 2016715 - RNA, 18 nt, Human
uugccacugccucuuccu

SEQ ID NO: 2016716 - RNA, 17 nt, Human
uugccauagaguacacu

SEQ ID NO: 2016717 - RNA, 23 nt, Human
uugcccacgcuggagugcaguga

SEQ ID NO: 2016718 - RNA, 23 nt, Human
uugccauagaguacacugccugc

SEQ ID NO: 2016719 - RNA, 15 nt, Human
uugcccacuccugcu

SEQ ID NO: 2016720 - RNA, 16 nt, Human
uugcccacuccugcuc

SEQ ID NO: 2016721 - RNA, 17 nt, Human
uugcccacuccugcucu

SEQ ID NO: 2016722 - RNA, 21 nt, Human
uugcccacuccugcucugcuc

SEQ ID NO: 2016723 - RNA, 11 nt, Human
uugcccaggca

SEQ ID NO: 2016724 - RNA, 22 nt, Human
uugcccacuccugcucugcucg

SEQ ID NO: 2016725 - RNA, 22 nt, Human
uugcugauggugcaaugaccuu

SEQ ID NO: 2016726 - RNA, 17 nt, Human
uugcugauuuuauucuu

SEQ ID NO: 2016727 - RNA, 18 nt, Human
uugcugauuuuauucuug

SEQ ID NO: 2016728 - RNA, 19 nt, Human
uugcugauuuuauucuuga

SEQ ID NO: 2016729 - RNA, 20 nt, Human
uugcugauggugcaaugacc

SEQ ID NO: 2016730 - RNA, 11 nt, Human
uugcugccuca

SEQ ID NO: 2016731 - RNA, 12 nt, Human
uugcugccucau

SEQ ID NO: 2016732 - RNA, 15 nt, Human
uugcugccucaugcu

SEQ ID NO: 2016733 - RNA, 20 nt, Human
uugcugauuuuauucuugau

SEQ ID NO: 2016734 - RNA, 18 nt, Human
uugcugcaauuuuauaag

SEQ ID NO: 2016735 - RNA, 23 nt, Human
uuggcaaacucuccaccacacgu

SEQ ID NO: 2016736 - RNA, 18 nt, Human
uuggcaauaaauuuugaa

SEQ ID NO: 2016737 - RNA, 13 nt, Human
uuggcauucccca

SEQ ID NO: 2016738 - RNA, 14 nt, Human
uuggccaggcuggu

SEQ ID NO: 2016739 - RNA, 24 nt, Human
uuggccaaagccaaagcuaggccu

SEQ ID NO: 2016740 - RNA, 18 nt, Human
uuggcugggggccucagu

SEQ ID NO: 2016741 - RNA, 16 nt, Human
uuggcugcugaaggcu

SEQ ID NO: 2016742 - RNA, 21 nt, Human
uuggccauaagcaacaauuuu

SEQ ID NO: 2016743 - RNA, 21 nt, Human
uuggcugggggccucagugcc

SEQ ID NO: 2016744 - RNA, 22 nt, Human
uuggcugggggccucagugcca

SEQ ID NO: 2016745 - RNA, 22 nt, Human
uuggcuuuggguugcaggaccu

SEQ ID NO: 2016746 - RNA, 12 nt, Human
uugggaggcuga

SEQ ID NO: 2016747 - RNA, 16 nt, Human
uugggaggccauuugu

SEQ ID NO: 2016748 - RNA, 14 nt, Human
uugguaaaccuuuu

SEQ ID NO: 2016749 - RNA, 12 nt, Human
uugguaaaccuu

SEQ ID NO: 2016750 - RNA, 20 nt, Human
uuggguggggggcuucauac

SEQ ID NO: 2016751 - RNA, 21 nt, Human
uuggguggggggcuucauaca

SEQ ID NO: 2016752 - RNA, 22 nt, Human
uuggguggggggcuucauacac

SEQ ID NO: 2016753 - RNA, 17 nt, Human
uuggguggggggcuuca

SEQ ID NO: 2016754 - RNA, 19 nt, Human
uuggguggggggcuucaua

SEQ ID NO: 2016755 - RNA, 16 nt, Human
uuggguggaugccugg

SEQ ID NO: 2016756 - RNA, 18 nt, Human
uuguacagauucuuuauu

SEQ ID NO: 2016757 - RNA, 14 nt, Human
uuguagagccaggg

SEQ ID NO: 2016758 - RNA, 15 nt, Human
uuguagagccagggu

SEQ ID NO: 2016759 - RNA, 13 nt, Human
uuguacauaaaca

SEQ ID NO: 2016760 - RNA, 21 nt, Human
uuguauucucuccuguaccuc

SEQ ID NO: 2016761 - RNA, 14 nt, Human
uuguauucagaguu

SEQ ID NO: 2016762 - RNA, 14 nt, Human
uuguauuacaaauc

SEQ ID NO: 2016763 - RNA, 12 nt, Human
uuguagauuuga

SEQ ID NO: 2016764 - RNA, 14 nt, Human
uuguagauuugauu

SEQ ID NO: 2016765 - RNA, 23 nt, Human
uuguacacccaugaaagaaaacu

SEQ ID NO: 2016766 - RNA, 13 nt, Human
uuguacagacaac

SEQ ID NO: 2016767 - RNA, 12 nt, Human
uuguacagacaa

SEQ ID NO: 2016768 - RNA, 13 nt, Human
uugguccugcugc

SEQ ID NO: 2016769 - RNA, 12 nt, Human
uugguccugcug

SEQ ID NO: 2016770 - RNA, 16 nt, Human
uuggucccccuuccau

SEQ ID NO: 2016771 - RNA, 22 nt, Human
uuggucccccuuccauggacuu

SEQ ID NO: 2016772 - RNA, 18 nt, Human
uuguaaauaaaggaacca

SEQ ID NO: 2016773 - RNA, 18 nt, Human
uuguaaagauuucuguuc

SEQ ID NO: 2016774 - RNA, 16 nt, Human
uuguaaagauuucugu

SEQ ID NO: 2016775 - RNA, 17 nt, Human
uuguaaagauuucuguu

SEQ ID NO: 2016776 - RNA, 23 nt, Human
uuguaaagaaaaauauuuaaugu

SEQ ID NO: 2016777 - RNA, 16 nt, Human
uuguaaaggaauuuaa

SEQ ID NO: 2016778 - RNA, 20 nt, Human
uugacgccaucccagcccca

SEQ ID NO: 2016779 - RNA, 19 nt, Human
uugacguauuauuguccuu

SEQ ID NO: 2016780 - RNA, 18 nt, Human
uugagcugcuuuuuuuga

SEQ ID NO: 2016781 - RNA, 20 nt, Human
uugagcugcuuuuuuugaaa

SEQ ID NO: 2016782 - RNA, 21 nt, Human
uugagcugcuuuuuuugaaac

SEQ ID NO: 2016783 - RNA, 18 nt, Human
uugaggaaacaacagcuu

SEQ ID NO: 2016784 - RNA, 17 nt, Human
uugaggaaauuugcagc

SEQ ID NO: 2016785 - RNA, 15 nt, Human
uugaggaaaaauaug

SEQ ID NO: 2016786 - RNA, 17 nt, Human
uugaggaaaaauaugug

SEQ ID NO: 2016787 - RNA, 20 nt, Human
uugaggaaaaauaugugaag

SEQ ID NO: 2016788 - RNA, 21 nt, Human
uugaggaaaaauaugugaagg

SEQ ID NO: 2016789 - RNA, 20 nt, Human
uugauagcacagacccugcc

SEQ ID NO: 2016790 - RNA, 19 nt, Human
uugauagcacagacccugc

SEQ ID NO: 2016791 - RNA, 18 nt, Human
uugaauguaugcuucaua

SEQ ID NO: 2016792 - RNA, 20 nt, Human
uugaauggcaauguuuugcu

SEQ ID NO: 2016793 - RNA, 21 nt, Human
uugaccgugaggccagagaca

SEQ ID NO: 2016794 - RNA, 20 nt, Human
uugaccgugaggccagagac

SEQ ID NO: 2016795 - RNA, 15 nt, Human
uugaccucaggugau

SEQ ID NO: 2016796 - RNA, 22 nt, Human
uugaccugaggcccuucucucc

SEQ ID NO: 2016797 - RNA, 19 nt, Human
uugaccugaggcccuucuc

SEQ ID NO: 2016798 - RNA, 12 nt, Human
uugaccugaggc

SEQ ID NO: 2016799 - RNA, 14 nt, Human
uugacgccauccca

SEQ ID NO: 2016800 - RNA, 22 nt, Human
uugacgccaucccagccccaau

SEQ ID NO: 2016801 - RNA, 15 nt, Human
uugacgccaucccag

SEQ ID NO: 2016802 - RNA, 13 nt, Human
uugauuuauuaac

SEQ ID NO: 2016803 - RNA, 14 nt, Human
uugauuuauuaacu

SEQ ID NO: 2016804 - RNA, 15 nt, Human
uugauuuauuaacuu

SEQ ID NO: 2016805 - RNA, 17 nt, Human
uugauuuauuaacuuaa

SEQ ID NO: 2016806 - RNA, 20 nt, Human
uugauuuauuaacuuaauaa

SEQ ID NO: 2016807 - RNA, 14 nt, Human
uugaugaaaagcuu

SEQ ID NO: 2016808 - RNA, 15 nt, Human
uugaugaaaagcuuu

SEQ ID NO: 2016809 - RNA, 17 nt, Human
uugaucuuccucugcua

SEQ ID NO: 2016810 - RNA, 19 nt, Human
uugaucuuccucugcuaaa

SEQ ID NO: 2016811 - RNA, 21 nt, Human
uugauagcacagacccugccc

SEQ ID NO: 2016812 - RNA, 13 nt, Human
uugcaaaaaucca

SEQ ID NO: 2016813 - RNA, 19 nt, Human
uugauuuuuuuuuuuaauc

SEQ ID NO: 2016814 - RNA, 18 nt, Human
uugauuuccguuaaaaua

SEQ ID NO: 2016815 - RNA, 21 nt, Human
uugauuuauuaacuuaauaau

SEQ ID NO: 2016816 - RNA, 22 nt, Human
uugauuucuaguuauuuauucu

SEQ ID NO: 2016817 - RNA, 19 nt, Human
uugauuuuccaucuaaaaa

SEQ ID NO: 2016818 - RNA, 22 nt, Human
uugauuuuccaucuaaaaauau

SEQ ID NO: 2016819 - RNA, 14 nt, Human
uugcaacaggcugg

SEQ ID NO: 2016820 - RNA, 17 nt, Human
uugcaacaggcugggcu

SEQ ID NO: 2016821 - RNA, 12 nt, Human
uugcaacaaaau

SEQ ID NO: 2016822 - RNA, 13 nt, Human
uugcaacaaaaua

SEQ ID NO: 2016823 - RNA, 11 nt, Human
uugcagaacuu

SEQ ID NO: 2016824 - RNA, 17 nt, Human
uugcaacaaaauacauu

SEQ ID NO: 2016825 - RNA, 16 nt, Human
uugcagacaggcaagc

SEQ ID NO: 2016826 - RNA, 21 nt, Human
uugcagaacuugaagccugcu

SEQ ID NO: 2016827 - RNA, 22 nt, Human
uugcagacaggcaagcaccucc

SEQ ID NO: 2016828 - RNA, 23 nt, Human
uugcaggagcaguaucaugaagc

SEQ ID NO: 2016829 - RNA, 14 nt, Human
uugcauagaauaaa

SEQ ID NO: 2016830 - RNA, 20 nt, Human
uugcauacaaacaagcauau

SEQ ID NO: 2016831 - RNA, 13 nt, Human
uugcauacaaaca

SEQ ID NO: 2016832 - RNA, 14 nt, Human
uugcauacaaacaa

SEQ ID NO: 2016833 - RNA, 14 nt, Human
uugccacugccucu

SEQ ID NO: 2016834 - RNA, 15 nt, Human
uugccacugccucuu

SEQ ID NO: 2016835 - RNA, 22 nt, Human
uugaaaacacuguucucugccc

SEQ ID NO: 2016836 - RNA, 14 nt, Human
uugaaacuuuaaga

SEQ ID NO: 2016837 - RNA, 14 nt, Human
uugaaacuuugaga

SEQ ID NO: 2016838 - RNA, 16 nt, Human
uugaaacuuugagauc

SEQ ID NO: 2016839 - RNA, 20 nt, Human
uugaaacuuugagaucuaaa

SEQ ID NO: 2016840 - RNA, 18 nt, Human
uucuuuauaauucuacuu

SEQ ID NO: 2016841 - RNA, 20 nt, Human
uucuuuaguagcaacuaaaa

SEQ ID NO: 2016842 - RNA, 21 nt, Human
uugaaaacacuguucucugcc

SEQ ID NO: 2016843 - RNA, 19 nt, Human
uugaaaacacuguucucug

SEQ ID NO: 2016844 - RNA, 15 nt, Human
uugaaaaaugcaugu

SEQ ID NO: 2016845 - RNA, 19 nt, Human
uucuuucaagggcuuuccu

SEQ ID NO: 2016846 - RNA, 23 nt, Human
uucuuucaagggcuuuccugugc

SEQ ID NO: 2016847 - RNA, 22 nt, Human
uugaacuuugaccucugcagca

SEQ ID NO: 2016848 - RNA, 21 nt, Human
uugaacucuucucauuacuug

SEQ ID NO: 2016849 - RNA, 12 nt, Human
uugaacugaagg

SEQ ID NO: 2016850 - RNA, 15 nt, Human
uugaacugagcuugg

SEQ ID NO: 2016851 - RNA, 16 nt, Human
uugaacugagcuugga

SEQ ID NO: 2016852 - RNA, 16 nt, Human
uugaacugauaaagau

SEQ ID NO: 2016853 - RNA, 19 nt, Human
uugaacucuucaaucucuu

SEQ ID NO: 2016854 - RNA, 16 nt, Human
uugaacucuucucauu

SEQ ID NO: 2016855 - RNA, 19 nt, Human
uugaacucuucucauuacu

SEQ ID NO: 2016856 - RNA, 20 nt, Human
uugaacucuucucauuacuu

SEQ ID NO: 2016857 - RNA, 15 nt, Human
uugaaagaauguaaa

SEQ ID NO: 2016858 - RNA, 13 nt, Human
uugaaucuuuaau

SEQ ID NO: 2016859 - RNA, 14 nt, Human
uugaaucuuuaauu

SEQ ID NO: 2016860 - RNA, 17 nt, Human
uugaagacagagcuaca

SEQ ID NO: 2016861 - RNA, 16 nt, Human
uugaaagaauguaaag

SEQ ID NO: 2016862 - RNA, 20 nt, Human
uugaagaccuaaccagggcc

SEQ ID NO: 2016863 - RNA, 19 nt, Human
uugaagacuuuucuuucag

SEQ ID NO: 2016864 - RNA, 23 nt, Human
uucuuauuuaaugaaagacugua

SEQ ID NO: 2016865 - RNA, 19 nt, Human
uucuuauuuaaugaaagac

SEQ ID NO: 2016866 - RNA, 11 nt, Human
uucuguucuuu

SEQ ID NO: 2016867 - RNA, 14 nt, Human
uucuucaacucccu

SEQ ID NO: 2016868 - RNA, 21 nt, Human
uucuucaaaauauaaaaugcc

SEQ ID NO: 2016869 - RNA, 23 nt, Human
uucuucaaaauauaaaaugccaa

SEQ ID NO: 2016870 - RNA, 16 nt, Human
uucuucaaaccuuugu

SEQ ID NO: 2016871 - RNA, 11 nt, Human
uucuucaaaau

SEQ ID NO: 2016872 - RNA, 17 nt, Human
uucuugguuuguaaauu

SEQ ID NO: 2016873 - RNA, 18 nt, Human
uucuugguuuguaaauua

SEQ ID NO: 2016874 - RNA, 23 nt, Human
uucuugguuuguaaauuaacuuu

SEQ ID NO: 2016875 - RNA, 22 nt, Human
uucuucacuguccuccaagcca

SEQ ID NO: 2016876 - RNA, 13 nt, Human
uucuugguuugua

SEQ ID NO: 2016877 - RNA, 16 nt, Human
uucuugguuuguaaau

SEQ ID NO: 2016878 - RNA, 23 nt, Human
uucuguggguuucuaaagcugcc

SEQ ID NO: 2016879 - RNA, 12 nt, Human
uucuguggcuca

SEQ ID NO: 2016880 - RNA, 16 nt, Human
uucuguggcucacaga

SEQ ID NO: 2016881 - RNA, 20 nt, Human
uucugagcuuacguaguucu

SEQ ID NO: 2016882 - RNA, 14 nt, Human
uucugagcuggccu

SEQ ID NO: 2016883 - RNA, 17 nt, Human
uucuguccuacucugug

SEQ ID NO: 2016884 - RNA, 22 nt, Human
uucuguggcgaggcaugcuauc

SEQ ID NO: 2016885 - RNA, 20 nt, Human
uucugugguuggcugggaaa

SEQ ID NO: 2016886 - RNA, 17 nt, Human
uucuguguuuauucaaa

SEQ ID NO: 2016887 - RNA, 13 nt, Human
uucuguuaaaaug

SEQ ID NO: 2016888 - RNA, 16 nt, Human
uucuguuaaaaugcau

SEQ ID NO: 2016889 - RNA, 22 nt, Human
uucuguuaaaaugcaugauugc

SEQ ID NO: 2016890 - RNA, 13 nt, Human
uucuguuacaaaa

SEQ ID NO: 2016891 - RNA, 14 nt, Human
uucuguuacaaaau

SEQ ID NO: 2016892 - RNA, 22 nt, Human
uucuguuacaaaauguaacugu

SEQ ID NO: 2016893 - RNA, 15 nt, Human
uucuguuacaaaaug

SEQ ID NO: 2016894 - RNA, 16 nt, Human
uucuguuacaaaaugu

SEQ ID NO: 2016895 - RNA, 17 nt, Human
uucuguuacaaaaugua

SEQ ID NO: 2016896 - RNA, 20 nt, Human
uucuguuacaaaauguaacu

SEQ ID NO: 2016897 - RNA, 21 nt, Human
uucuguccgagcuuugaaaau

SEQ ID NO: 2016898 - RNA, 17 nt, Human
uucuguccgagcuuuga

SEQ ID NO: 2016899 - RNA, 14 nt, Human
uucugagcauuuaa

SEQ ID NO: 2016900 - RNA, 14 nt, Human
uucugacucuuccc

SEQ ID NO: 2016901 - RNA, 20 nt, Human
ugugcgugcauguguguuca

SEQ ID NO: 2016902 - RNA, 17 nt, Human
ugugccucugggacugg

SEQ ID NO: 2016903 - RNA, 15 nt, Human
ugugccucugccugu

SEQ ID NO: 2016904 - RNA, 23 nt, Human
ugugccugcuucagccucccaca

SEQ ID NO: 2016905 - RNA, 18 nt, Human
ugugcaugugucuuuaua

SEQ ID NO: 2016906 - RNA, 14 nt, Human
ugugccugcuucag

SEQ ID NO: 2016907 - RNA, 20 nt, Human
ugugcuguguuugcuccccu

SEQ ID NO: 2016908 - RNA, 21 nt, Human
ugugcuguguuugcuccccuu

SEQ ID NO: 2016909 - RNA, 15 nt, Human
ugugcuaaacgugua

SEQ ID NO: 2016910 - RNA, 21 nt, Human
ugugcuaaacguguauguuuu

SEQ ID NO: 2016911 - RNA, 22 nt, Human
ugugcuaaacguguauguuuuu

SEQ ID NO: 2016912 - RNA, 22 nt, Human
ugugcguggggcucccgccucc

SEQ ID NO: 2016913 - RNA, 21 nt, Human
ugugcguggggcucccgccuc

SEQ ID NO: 2016914 - RNA, 22 nt, Human
ugugcuuauguaugagguacaa

SEQ ID NO: 2016915 - RNA, 15 nt, Human
ugugcuucugccacc

SEQ ID NO: 2016916 - RNA, 15 nt, Human
ugugcagagcugaag

SEQ ID NO: 2016917 - RNA, 21 nt, Human
ugugcagagcugaagagcugg

SEQ ID NO: 2016918 - RNA, 16 nt, Human
ugugcaguaucuguga

SEQ ID NO: 2016919 - RNA, 14 nt, Human
ugugcaguaacuug

SEQ ID NO: 2016920 - RNA, 16 nt, Human
ugugcacaugcacgug

SEQ ID NO: 2016921 - RNA, 22 nt, Human
ugugcacaugcacgugugugca

SEQ ID NO: 2016922 - RNA, 16 nt, Human
ugugccucugggacug

SEQ ID NO: 2016923 - RNA, 15 nt, Human
ugugccucugggacu

SEQ ID NO: 2016924 - RNA, 13 nt, Human
ugugccucuggga

SEQ ID NO: 2016925 - RNA, 14 nt, Human
ugugccucugccug

SEQ ID NO: 2016926 - RNA, 21 nt, Human
uguggagaagcggcuggcagc

SEQ ID NO: 2016927 - RNA, 12 nt, Human
uguggagaagcg

SEQ ID NO: 2016928 - RNA, 21 nt, Human
uguggcuccuggggguucuuu

SEQ ID NO: 2016929 - RNA, 15 nt, Human
uguggacacagcucu

SEQ ID NO: 2016930 - RNA, 16 nt, Human
uguggacacagcucuu

SEQ ID NO: 2016931 - RNA, 15 nt, Human
uguggacuuaggaag

SEQ ID NO: 2016932 - RNA, 19 nt, Human
uguggaaaagccaagaggc

SEQ ID NO: 2016933 - RNA, 21 nt, Human
uguggaaaagccaagaggcug

SEQ ID NO: 2016934 - RNA, 23 nt, Human
uguggaaaagccaagaggcugca

SEQ ID NO: 2016935 - RNA, 17 nt, Human
uguggaaaaugaaaauu

SEQ ID NO: 2016936 - RNA, 14 nt, Human
uguggacacagcuc

SEQ ID NO: 2016937 - RNA, 13 nt, Human
uguggacacagcu

SEQ ID NO: 2016938 - RNA, 14 nt, Human
ugugggucugugug

SEQ ID NO: 2016939 - RNA, 16 nt, Human
ugugggucugugugug

SEQ ID NO: 2016940 - RNA, 20 nt, Human
ugugggucugugugugugua

SEQ ID NO: 2016941 - RNA, 16 nt, Human
ugugggggucugugug

SEQ ID NO: 2016942 - RNA, 14 nt, Human
ugugggggguccuu

SEQ ID NO: 2016943 - RNA, 21 nt, Human
ugugggggccccgucucaggu

SEQ ID NO: 2016944 - RNA, 12 nt, Human
ugugggaagggg

SEQ ID NO: 2016945 - RNA, 12 nt, Human
uguggcuucugg

SEQ ID NO: 2016946 - RNA, 15 nt, Human
ugugagggcagugca

SEQ ID NO: 2016947 - RNA, 23 nt, Human
ugugaguacuacaguccucccau

SEQ ID NO: 2016948 - RNA, 20 nt, Human
ugugaguacuacaguccucc

SEQ ID NO: 2016949 - RNA, 19 nt, Human
ugugaguacuacaguccuc

SEQ ID NO: 2016950 - RNA, 14 nt, Human
ugugagggaaagag

SEQ ID NO: 2016951 - RNA, 15 nt, Human
ugugagggaaagagc

SEQ ID NO: 2016952 - RNA, 22 nt, Human
ugugagggaaagagcuuuccua

SEQ ID NO: 2016953 - RNA, 12 nt, Human
ugugagggcagu

SEQ ID NO: 2016954 - RNA, 18 nt, Human
ugugaggggcucucucau

SEQ ID NO: 2016955 - RNA, 18 nt, Human
ugugaguacuacaguccu

SEQ ID NO: 2016956 - RNA, 14 nt, Human
ugugcaagagaggg

SEQ ID NO: 2016957 - RNA, 13 nt, Human
ugugauauaagug

SEQ ID NO: 2016958 - RNA, 19 nt, Human
ugugcaagcuuuuccuaau

SEQ ID NO: 2016959 - RNA, 17 nt, Human
ugugauauaaacagcuu

SEQ ID NO: 2016960 - RNA, 18 nt, Human
ugugcaagcuuuuccuaa

SEQ ID NO: 2016961 - RNA, 21 nt, Human
ugugauacaaugcugugcccu

SEQ ID NO: 2016962 - RNA, 23 nt, Human
ugugaguauucucauucuuccca

SEQ ID NO: 2016963 - RNA, 13 nt, Human
ugugaguauucuc

SEQ ID NO: 2016964 - RNA, 15 nt, Human
ugugaguauucucau

SEQ ID NO: 2016965 - RNA, 17 nt, Human
ugugaguuuguuucuuu

SEQ ID NO: 2016966 - RNA, 19 nt, Human
ugugaguuuguuucuuuga

SEQ ID NO: 2016967 - RNA, 21 nt, Human
ugugaguuuguuucuuugaau

SEQ ID NO: 2016968 - RNA, 16 nt, Human
ugugaaucauuuuacc

SEQ ID NO: 2016969 - RNA, 21 nt, Human
ugugaauacugcuugaauaaa

SEQ ID NO: 2016970 - RNA, 14 nt, Human
ugugaauaauuaca

SEQ ID NO: 2016971 - RNA, 16 nt, Human
ugugaauaauuacagu

SEQ ID NO: 2016972 - RNA, 14 nt, Human
ugugaauacugcuu

SEQ ID NO: 2016973 - RNA, 18 nt, Human
ugugaauacugcuugaau

SEQ ID NO: 2016974 - RNA, 21 nt, Human
ugugacaaggauugcuacugu

SEQ ID NO: 2016975 - RNA, 22 nt, Human
ugugaccacugcagaagacagu

SEQ ID NO: 2016976 - RNA, 15 nt, Human
ugugacauguuuuau

SEQ ID NO: 2016977 - RNA, 13 nt, Human
ugugacaguguug

SEQ ID NO: 2016978 - RNA, 20 nt, Human
ugugacaucucuauucccca

SEQ ID NO: 2016979 - RNA, 21 nt, Human
ugugacaucucuauuccccac

SEQ ID NO: 2016980 - RNA, 14 nt, Human
ugugaaaggaaaga

SEQ ID NO: 2016981 - RNA, 13 nt, Human
ugugaaaggaaag

SEQ ID NO: 2016982 - RNA, 14 nt, Human
ugugaaacagacuu

SEQ ID NO: 2016983 - RNA, 13 nt, Human
ugugaaacauguu

SEQ ID NO: 2016984 - RNA, 17 nt, Human
ugugaaaaaaaaaaugc

SEQ ID NO: 2016985 - RNA, 20 nt, Human
ugugaaaaaaaaaaugcuga

SEQ ID NO: 2016986 - RNA, 18 nt, Human
ugucuuuggacccugagg

SEQ ID NO: 2016987 - RNA, 17 nt, Human
ugucuuuggacccugag

SEQ ID NO: 2016988 - RNA, 16 nt, Human
ugucugcuccagcucu

SEQ ID NO: 2016989 - RNA, 22 nt, Human
ugucuuuggacccugaggccca

SEQ ID NO: 2016990 - RNA, 19 nt, Human
ugucuuuggacccugaggc

SEQ ID NO: 2016991 - RNA, 14 nt, Human
ugucuuuuuucuaa

SEQ ID NO: 2016992 - RNA, 16 nt, Human
ugucuuuuuucacuac

SEQ ID NO: 2016993 - RNA, 19 nt, Human
ugucucaagagggcacugg

SEQ ID NO: 2016994 - RNA, 11 nt, Human
uguccccacca

SEQ ID NO: 2016995 - RNA, 12 nt, Human
uguccccaccau

SEQ ID NO: 2016996 - RNA, 14 nt, Human
uguccccaccaucu

SEQ ID NO: 2016997 - RNA, 16 nt, Human
uguccccaccaucugc

SEQ ID NO: 2016998 - RNA, 17 nt, Human
uguccccaccaucugcu

SEQ ID NO: 2016999 - RNA, 21 nt, Human
uguccccaccaucugcugucu

SEQ ID NO: 2017000 - RNA, 20 nt, Human
ugucccaugugagcugcugc

SEQ ID NO: 2017001 - RNA, 22 nt, Human
ugucccaugugagcugcugcca

SEQ ID NO: 2017002 - RNA, 23 nt, Human
ugucucaagagggcacugguggc

SEQ ID NO: 2017003 - RNA, 20 nt, Human
ugucucaagagggcacuggu

SEQ ID NO: 2017004 - RNA, 21 nt, Human
ugucucaagagggcacuggug

SEQ ID NO: 2017005 - RNA, 16 nt, Human
ugucucaggucccugc

SEQ ID NO: 2017006 - RNA, 17 nt, Human
ugucucaggucccugca

SEQ ID NO: 2017007 - RNA, 16 nt, Human
ugucugccacauuaac

SEQ ID NO: 2017008 - RNA, 18 nt, Human
ugucugccacauuaacua

SEQ ID NO: 2017009 - RNA, 21 nt, Human
ugucucaguccaugaagaugu

SEQ ID NO: 2017010 - RNA, 22 nt, Human
ugucucaguccaugaagaugua

SEQ ID NO: 2017011 - RNA, 14 nt, Human
ugucuggcugcaga

SEQ ID NO: 2017012 - RNA, 17 nt, Human
ugucugcuccagcucug

SEQ ID NO: 2017013 - RNA, 16 nt, Human
ugucuggcugcagagc

SEQ ID NO: 2017014 - RNA, 17 nt, Human
ugucuggcugcagagca

SEQ ID NO: 2017015 - RNA, 16 nt, Human
ugucugccccaaguuu

SEQ ID NO: 2017016 - RNA, 17 nt, Human
ugucugccccaaguuuu

SEQ ID NO: 2017017 - RNA, 22 nt, Human
ugucugccccaaguuuugugaa

SEQ ID NO: 2017018 - RNA, 15 nt, Human
uguaaauuuauguga

SEQ ID NO: 2017019 - RNA, 16 nt, Human
uguaaauuuaugugau

SEQ ID NO: 2017020 - RNA, 12 nt, Human
uguaaauucuga

SEQ ID NO: 2017021 - RNA, 13 nt, Human
uguaaauucugau

SEQ ID NO: 2017022 - RNA, 14 nt, Human
uguaaauucugauu

SEQ ID NO: 2017023 - RNA, 15 nt, Human
uguaaauucugauuu

SEQ ID NO: 2017024 - RNA, 18 nt, Human
uguaaauucugauuucuu

SEQ ID NO: 2017025 - RNA, 19 nt, Human
uguaaauucugauuucuuu

SEQ ID NO: 2017026 - RNA, 22 nt, Human
uguaaauucugauuucuuuuca

SEQ ID NO: 2017027 - RNA, 23 nt, Human
uguaacuaaaauaauuuuguaau

SEQ ID NO: 2017028 - RNA, 14 nt, Human
uguaacuaaaauaa

SEQ ID NO: 2017029 - RNA, 15 nt, Human
uguaacuaaaauaau

SEQ ID NO: 2017030 - RNA, 22 nt, Human
uguaacgugugcuguguuugcu

SEQ ID NO: 2017031 - RNA, 18 nt, Human
uguaacgugugcuguguu

SEQ ID NO: 2017032 - RNA, 19 nt, Human
uguaacgugugcuguguuu

SEQ ID NO: 2017033 - RNA, 15 nt, Human
uguaaucacagcuac

SEQ ID NO: 2017034 - RNA, 21 nt, Human
uguaacuguuaccauuggaaa

SEQ ID NO: 2017035 - RNA, 12 nt, Human
uguaauccagca

SEQ ID NO: 2017036 - RNA, 12 nt, Human
uguaacuauguu

SEQ ID NO: 2017037 - RNA, 13 nt, Human
uguaacuauguuu

SEQ ID NO: 2017038 - RNA, 17 nt, Human
uguaacuauguuuuauc

SEQ ID NO: 2017039 - RNA, 22 nt, Human
uguaacugcucuugggcaauau

SEQ ID NO: 2017040 - RNA, 23 nt, Human
uguaacugcucuugggcaauauu

SEQ ID NO: 2017041 - RNA, 14 nt, Human
uguaacuguuacca

SEQ ID NO: 2017042 - RNA, 17 nt, Human
uguaacuguuaccauug

SEQ ID NO: 2017043 - RNA, 20 nt, Human
uguaacuguuaccauuggaa

SEQ ID NO: 2017044 - RNA, 21 nt, Human
uguaacuguuuagaugaaugu

SEQ ID NO: 2017045 - RNA, 13 nt, Human
uguaaauuaacuu

SEQ ID NO: 2017046 - RNA, 14 nt, Human
uguaaauuaacuuu

SEQ ID NO: 2017047 - RNA, 15 nt, Human
uguaaauuaacuuuu

SEQ ID NO: 2017048 - RNA, 16 nt, Human
uguaaauuaacuuuua

SEQ ID NO: 2017049 - RNA, 17 nt, Human
uguaaauuaacuuuuau

SEQ ID NO: 2017050 - RNA, 18 nt, Human
uggguuuccaacaauuca

SEQ ID NO: 2017051 - RNA, 20 nt, Human
ugguagugguuguaucugug

SEQ ID NO: 2017052 - RNA, 17 nt, Human
ugguaguugaggaaagc

SEQ ID NO: 2017053 - RNA, 14 nt, Human
ugguaguuucugug

SEQ ID NO: 2017054 - RNA, 15 nt, Human
ugguaguuucugugg

SEQ ID NO: 2017055 - RNA, 14 nt, Human
uguaaacaaaucuu

SEQ ID NO: 2017056 - RNA, 19 nt, Human
uguaaacaaaucuuuccau

SEQ ID NO: 2017057 - RNA, 15 nt, Human
uguaccauuaaaaua

SEQ ID NO: 2017058 - RNA, 17 nt, Human
uguaccauuaaaauaug

SEQ ID NO: 2017059 - RNA, 19 nt, Human
uguaccauuaaaauaugca

SEQ ID NO: 2017060 - RNA, 23 nt, Human
uguaccauuaaaauaugcacuaa

SEQ ID NO: 2017061 - RNA, 15 nt, Human
uguaccgcaauguga

SEQ ID NO: 2017062 - RNA, 22 nt, Human
uguaccucuugagccuugaacu

SEQ ID NO: 2017063 - RNA, 14 nt, Human
uguaccucuugagc

SEQ ID NO: 2017064 - RNA, 23 nt, Human
uguaccucuugagccuugaacuu

SEQ ID NO: 2017065 - RNA, 20 nt, Human
uguaauguaggggaaaguuu

SEQ ID NO: 2017066 - RNA, 23 nt, Human
uguaauguaucaaauacauuuaa

SEQ ID NO: 2017067 - RNA, 15 nt, Human
uguaauguaacugcu

SEQ ID NO: 2017068 - RNA, 18 nt, Human
uguaauguaacugcucuu

SEQ ID NO: 2017069 - RNA, 12 nt, Human
uguaauguaacu

SEQ ID NO: 2017070 - RNA, 13 nt, Human
uguaauguaacug

SEQ ID NO: 2017071 - RNA, 14 nt, Human
uguaauguaacugc

SEQ ID NO: 2017072 - RNA, 12 nt, Human
uguaaugacagg

SEQ ID NO: 2017073 - RNA, 13 nt, Human
uguaccauuaaaa

SEQ ID NO: 2017074 - RNA, 14 nt, Human
uguaccauuaaaau

SEQ ID NO: 2017075 - RNA, 19 nt, Human
uguacuauaacauagaauu

SEQ ID NO: 2017076 - RNA, 18 nt, Human
uguacuaucuuaucucag

SEQ ID NO: 2017077 - RNA, 20 nt, Human
uguacuauaacauagaauug

SEQ ID NO: 2017078 - RNA, 12 nt, Human
uguacuccuccc

SEQ ID NO: 2017079 - RNA, 13 nt, Human
uguacuccuccca

SEQ ID NO: 2017080 - RNA, 17 nt, Human
uguacgucugacaggca

SEQ ID NO: 2017081 - RNA, 16 nt, Human
uguacgucugacaggc

SEQ ID NO: 2017082 - RNA, 17 nt, Human
uguagauaauacaguuc

SEQ ID NO: 2017083 - RNA, 13 nt, Human
ugucauagccagu

SEQ ID NO: 2017084 - RNA, 16 nt, Human
ugucaucaccauggaa

SEQ ID NO: 2017085 - RNA, 23 nt, Human
ugucauucgcuacuaugauuuaa

SEQ ID NO: 2017086 - RNA, 13 nt, Human
ugucauugcuucu

SEQ ID NO: 2017087 - RNA, 17 nt, Human
ugucauugcuucuucug

SEQ ID NO: 2017088 - RNA, 18 nt, Human
ugucauugcuucuucuga

SEQ ID NO: 2017089 - RNA, 22 nt, Human
ugucauuagugagacauauuua

SEQ ID NO: 2017090 - RNA, 24 nt, Human
ugucauuagugagacauauuuaca

SEQ ID NO: 2017091 - RNA, 23 nt, Human
ugucccaaaaagaaaggagggga

SEQ ID NO: 2017092 - RNA, 19 nt, Human
ugucccaugugagcugcug

SEQ ID NO: 2017093 - RNA, 20 nt, Human
ugucauacucgagucugagg

SEQ ID NO: 2017094 - RNA, 14 nt, Human
ugucaguguuuggu

SEQ ID NO: 2017095 - RNA, 17 nt, Human
ugucaguuguuauuuau

SEQ ID NO: 2017096 - RNA, 18 nt, Human
ugucaguuguuauuuauu

SEQ ID NO: 2017097 - RNA, 22 nt, Human
ugucaguuguuauuuauugaaa

SEQ ID NO: 2017098 - RNA, 14 nt, Human
ugucaguuuauguu

SEQ ID NO: 2017099 - RNA, 16 nt, Human
ugucaguuuauguuuu

SEQ ID NO: 2017100 - RNA, 22 nt, Human
ugucaguuuauguuuuggucca

SEQ ID NO: 2017101 - RNA, 20 nt, Human
ugucagugugacugaucucu

SEQ ID NO: 2017102 - RNA, 12 nt, Human
ugucagugugac

SEQ ID NO: 2017103 - RNA, 19 nt, Human
uguagcaaacccugucaaa

SEQ ID NO: 2017104 - RNA, 21 nt, Human
uguagcaaacccugucaaaca

SEQ ID NO: 2017105 - RNA, 22 nt, Human
uguagcaaacccugucaaacau

SEQ ID NO: 2017106 - RNA, 23 nt, Human
uguagcaaacccugucaaacauu

SEQ ID NO: 2017107 - RNA, 16 nt, Human
uguagauuugauuuuu

SEQ ID NO: 2017108 - RNA, 13 nt, Human
uguagauuugauu

SEQ ID NO: 2017109 - RNA, 15 nt, Human
uguagcaaacccugu

SEQ ID NO: 2017110 - RNA, 18 nt, Human
uguagcaaacccugucaa

SEQ ID NO: 2017111 - RNA, 20 nt, Human
uguauaauucaaagcaccaa

SEQ ID NO: 2017112 - RNA, 19 nt, Human
uguaucccaugagccucag

SEQ ID NO: 2017113 - RNA, 23 nt, Human
uguaucccaugagccucagcauc

SEQ ID NO: 2017114 - RNA, 19 nt, Human
uguauacguuucaaaaaca

SEQ ID NO: 2017115 - RNA, 12 nt, Human
uguauacaugug

SEQ ID NO: 2017116 - RNA, 17 nt, Human
uguauugcuuucuuuca

SEQ ID NO: 2017117 - RNA, 17 nt, Human
uguauuguaacuauguu

SEQ ID NO: 2017118 - RNA, 13 nt, Human
uguauugcuuucu

SEQ ID NO: 2017119 - RNA, 12 nt, Human
uguauuugaaag

SEQ ID NO: 2017120 - RNA, 13 nt, Human
uguauuugaaagu

SEQ ID NO: 2017121 - RNA, 14 nt, Human
uguaugcacuuugu

SEQ ID NO: 2017122 - RNA, 12 nt, Human
uguaugcauaau

SEQ ID NO: 2017123 - RNA, 17 nt, Human
uguaugcauaauaaucc

SEQ ID NO: 2017124 - RNA, 22 nt, Human
uguaugcauaauaauccugcaa

SEQ ID NO: 2017125 - RNA, 16 nt, Human
uguaugcaagcaguuu

SEQ ID NO: 2017126 - RNA, 18 nt, Human
uguaugcaagcaguuuca

SEQ ID NO: 2017127 - RNA, 19 nt, Human
uguaugcaagcaguuucaa

SEQ ID NO: 2017128 - RNA, 20 nt, Human
uguaugcaagcaguuucaau

SEQ ID NO: 2017129 - RNA, 19 nt, Human
uguauccuuucacacauuu

SEQ ID NO: 2017130 - RNA, 11 nt, Human
uguguguaugu

SEQ ID NO: 2017131 - RNA, 20 nt, Human
ugugugccucuagcugaauu

SEQ ID NO: 2017132 - RNA, 19 nt, Human
ugugugcggagucauuuug

SEQ ID NO: 2017133 - RNA, 16 nt, Human
uguguguccaaaacug

SEQ ID NO: 2017134 - RNA, 19 nt, Human
uguguguccaaaacugccu

SEQ ID NO: 2017135 - RNA, 15 nt, Human
ugugugauauuucag

SEQ ID NO: 2017136 - RNA, 16 nt, Human
ugugugauauuucaga

SEQ ID NO: 2017137 - RNA, 14 nt, Human
ugugugcagagcug

SEQ ID NO: 2017138 - RNA, 17 nt, Human
ugugugcagagcugaag

SEQ ID NO: 2017139 - RNA, 22 nt, Human
ugugugccgagcccuugcccau

SEQ ID NO: 2017140 - RNA, 16 nt, Human
ugugugccucuagcug

SEQ ID NO: 2017141 - RNA, 17 nt, Human
ugugugccucuagcuga

SEQ ID NO: 2017142 - RNA, 18 nt, Human
ugugugccucuagcugaa

SEQ ID NO: 2017143 - RNA, 14 nt, Human
ugugugcccagcuu

SEQ ID NO: 2017144 - RNA, 13 nt, Human
ugugugcccagcu

SEQ ID NO: 2017145 - RNA, 18 nt, Human
ugugugccgagcccuugc

SEQ ID NO: 2017146 - RNA, 20 nt, Human
ugugugccgagcccuugccc

SEQ ID NO: 2017147 - RNA, 21 nt, Human
ugugugccgagcccuugccca

SEQ ID NO: 2017148 - RNA, 14 nt, Human
uguguugugugugg

SEQ ID NO: 2017149 - RNA, 23 nt, Human
uguguugugugugggagugugua

SEQ ID NO: 2017150 - RNA, 19 nt, Human
uguguguccccuugcagcc

SEQ ID NO: 2017151 - RNA, 17 nt, Human
uguguuuacagagaugu

SEQ ID NO: 2017152 - RNA, 17 nt, Human
uguguuuagaauugaag

SEQ ID NO: 2017153 - RNA, 18 nt, Human
uguguuuagaauugaagg

SEQ ID NO: 2017154 - RNA, 15 nt, Human
uguguuuaugugugu

SEQ ID NO: 2017155 - RNA, 12 nt, Human
uguguuuauuca

SEQ ID NO: 2017156 - RNA, 14 nt, Human
uguguuuauucaaa

SEQ ID NO: 2017157 - RNA, 22 nt, Human
uguguuuauucaaacugaaaag

SEQ ID NO: 2017158 - RNA, 23 nt, Human
uguguuuauucaaacugaaaagc

SEQ ID NO: 2017159 - RNA, 13 nt, Human
uguguuuauuguc

SEQ ID NO: 2017160 - RNA, 12 nt, Human
uguguuuauucu

SEQ ID NO: 2017161 - RNA, 14 nt, Human
uguguuuauucuug

SEQ ID NO: 2017162 - RNA, 15 nt, Human
uguguuuauucuuga

SEQ ID NO: 2017163 - RNA, 20 nt, Human
uguguuuauucuugaugaaa

SEQ ID NO: 2017164 - RNA, 22 nt, Human
uguguuuagaauugaagguuuu

SEQ ID NO: 2017165 - RNA, 13 nt, Human
uguguuuaugugu

SEQ ID NO: 2017166 - RNA, 22 nt, Human
uguguuuaggaacuacugagga

SEQ ID NO: 2017167 - RNA, 13 nt, Human
uguguauuguugu

SEQ ID NO: 2017168 - RNA, 20 nt, Human
uguguauuguuguaaaaugu

SEQ ID NO: 2017169 - RNA, 23 nt, Human
uguguauuucaguuauugucccu

SEQ ID NO: 2017170 - RNA, 14 nt, Human
uguguauguggggg

SEQ ID NO: 2017171 - RNA, 13 nt, Human
uguguaugugggg

SEQ ID NO: 2017172 - RNA, 15 nt, Human
uguguauauuugauu

SEQ ID NO: 2017173 - RNA, 21 nt, Human
uguguauauuugauuuauuaa

SEQ ID NO: 2017174 - RNA, 23 nt, Human
uguguaugugggggucugugugu

SEQ ID NO: 2017175 - RNA, 15 nt, Human
uguucagcuccagcu

SEQ ID NO: 2017176 - RNA, 16 nt, Human
uguucagcuccagcuc

SEQ ID NO: 2017177 - RNA, 11 nt, Human
uguucagcugg

SEQ ID NO: 2017178 - RNA, 18 nt, Human
uguucagcuccagcucac

SEQ ID NO: 2017179 - RNA, 14 nt, Human
uguucagcuccagc

SEQ ID NO: 2017180 - RNA, 17 nt, Human
uguuagauuaagaaaua

SEQ ID NO: 2017181 - RNA, 20 nt, Human
uguuagauuaagaaauagac

SEQ ID NO: 2017182 - RNA, 13 nt, Human
uguuagaauguaa

SEQ ID NO: 2017183 - RNA, 19 nt, Human
uguuagaauguaagguaua

SEQ ID NO: 2017184 - RNA, 18 nt, Human
uguuaccauuggaaauuu

SEQ ID NO: 2017185 - RNA, 22 nt, Human
uguucaaaggagcaagaacuuu

SEQ ID NO: 2017186 - RNA, 14 nt, Human
uguuaguuuuccuu

SEQ ID NO: 2017187 - RNA, 16 nt, Human
uguguuugcuccccuu

SEQ ID NO: 2017188 - RNA, 22 nt, Human
uguguuuauucuugaugaaaag

SEQ ID NO: 2017189 - RNA, 23 nt, Human
uguguuuauucuugaugaaaagc

SEQ ID NO: 2017190 - RNA, 17 nt, Human
uguuaccauuggaaauu

SEQ ID NO: 2017191 - RNA, 16 nt, Human
uguuacugucuucagu

SEQ ID NO: 2017192 - RNA, 15 nt, Human
uguuacugucuucag

SEQ ID NO: 2017193 - RNA, 22 nt, Human
uguuacauuuuuaagugcugca

SEQ ID NO: 2017194 - RNA, 16 nt, Human
uguuaccauuggaaau

SEQ ID NO: 2017195 - RNA, 13 nt, Human
uguuacauuuuua

SEQ ID NO: 2017196 - RNA, 12 nt, Human
uguuacauguau

SEQ ID NO: 2017197 - RNA, 15 nt, Human
uguuacauguaucaa

SEQ ID NO: 2017198 - RNA, 20 nt, Human
uguucaugaaagauucaaug

SEQ ID NO: 2017199 - RNA, 13 nt, Human
uguucauaaauaa

SEQ ID NO: 2017200 - RNA, 12 nt, Human
uguucaguguua

SEQ ID NO: 2017201 - RNA, 17 nt, Human
uguucacuaaacucuga

SEQ ID NO: 2017202 - RNA, 18 nt, Human
uguucaggaaguccuuau

SEQ ID NO: 2017203 - RNA, 15 nt, Human
uguucacuaaacucu

SEQ ID NO: 2017204 - RNA, 17 nt, Human
uguucagcuuuuauucc

SEQ ID NO: 2017205 - RNA, 12 nt, Human
uguucuauagcu

SEQ ID NO: 2017206 - RNA, 21 nt, Human
uguucuccagucauuauguua

SEQ ID NO: 2017207 - RNA, 13 nt, Human
uguucucugagga

SEQ ID NO: 2017208 - RNA, 16 nt, Human
uguucucugaggacac

SEQ ID NO: 2017209 - RNA, 12 nt, Human
uguucucugccc

SEQ ID NO: 2017210 - RNA, 18 nt, Human
uguucucugaggacacua

SEQ ID NO: 2017211 - RNA, 11 nt, Human
uguugaaagau

SEQ ID NO: 2017212 - RNA, 16 nt, Human
uguugaaacuuuaaga

SEQ ID NO: 2017213 - RNA, 20 nt, Human
uguucuuucuggcuaugcau

SEQ ID NO: 2017214 - RNA, 22 nt, Human
uguucuuucuggcuaugcauuu

SEQ ID NO: 2017215 - RNA, 14 nt, Human
uguucuuucuggcu

SEQ ID NO: 2017216 - RNA, 17 nt, Human
uguucugcacacagcac

SEQ ID NO: 2017217 - RNA, 18 nt, Human
uguucugacccugcuuca

SEQ ID NO: 2017218 - RNA, 15 nt, Human
uguucugacccugcu

SEQ ID NO: 2017219 - RNA, 19 nt, Human
uguucucugcccuccaaga

SEQ ID NO: 2017220 - RNA, 19 nt, Human
uguugaagagguuuuaaag

SEQ ID NO: 2017221 - RNA, 14 nt, Human
uguugaacuguuag

SEQ ID NO: 2017222 - RNA, 15 nt, Human
uguugaacuguuaga

SEQ ID NO: 2017223 - RNA, 12 nt, Human
uguugaacaaaa

SEQ ID NO: 2017224 - RNA, 14 nt, Human
uguugaacaaaaua

SEQ ID NO: 2017225 - RNA, 15 nt, Human
uguugaacaaaauaa

SEQ ID NO: 2017226 - RNA, 18 nt, Human
uguugaacaaaauaaauu

SEQ ID NO: 2017227 - RNA, 19 nt, Human
uguugaacaaaauaaauug

SEQ ID NO: 2017228 - RNA, 18 nt, Human
uguugaagagcagcuccu

SEQ ID NO: 2017229 - RNA, 11 nt, Human
uguugaagagc

SEQ ID NO: 2017230 - RNA, 13 nt, Human
uguugaagagcag

SEQ ID NO: 2017231 - RNA, 22 nt, Human
uguugaggcuuauauuugugua

SEQ ID NO: 2017232 - RNA, 13 nt, Human
uguugcugccuca

SEQ ID NO: 2017233 - RNA, 14 nt, Human
uguugcugauuuua

SEQ ID NO: 2017234 - RNA, 16 nt, Human
uguugcugauuuuauu

SEQ ID NO: 2017235 - RNA, 11 nt, Human
uguuggccagg

SEQ ID NO: 2017236 - RNA, 14 nt, Human
uguugcugccucau

SEQ ID NO: 2017237 - RNA, 14 nt, Human
uguugcuuauguug

SEQ ID NO: 2017238 - RNA, 20 nt, Human
uguugcuuauguuguuuugu

SEQ ID NO: 2017239 - RNA, 14 nt, Human
uguuggccaggcug

SEQ ID NO: 2017240 - RNA, 13 nt, Human
uguuggccaggcu

SEQ ID NO: 2017241 - RNA, 18 nt, Human
uguuggccaggcugcucu

SEQ ID NO: 2017242 - RNA, 19 nt, Human
uguuguucuuggcaauaaa

SEQ ID NO: 2017243 - RNA, 23 nt, Human
uguuguucuuggcaauaaauuuu

SEQ ID NO: 2017244 - RNA, 13 nt, Human
uguuguuuaaugu

SEQ ID NO: 2017245 - RNA, 12 nt, Human
uguuguuuguau

SEQ ID NO: 2017246 - RNA, 12 nt, Human
uguuuaaaacac

SEQ ID NO: 2017247 - RNA, 20 nt, Human
uguuuaaaacaccuucuaua

SEQ ID NO: 2017248 - RNA, 14 nt, Human
uguuguuuuguaca

SEQ ID NO: 2017249 - RNA, 16 nt, Human
uguuguuuuguacaga

SEQ ID NO: 2017250 - RNA, 19 nt, Human
uguuguuuuguacagaugu

SEQ ID NO: 2017251 - RNA, 21 nt, Human
uguuuacagaggacaguauuu

SEQ ID NO: 2017252 - RNA, 17 nt, Human
uguuuacagauccccaa

SEQ ID NO: 2017253 - RNA, 14 nt, Human
uguuuacagaggac

SEQ ID NO: 2017254 - RNA, 15 nt, Human
uguuuaaugguaguu

SEQ ID NO: 2017255 - RNA, 14 nt, Human
uuaccagcagagca

SEQ ID NO: 2017256 - RNA, 19 nt, Human
uuacauuuguaauuuaagg

SEQ ID NO: 2017257 - RNA, 20 nt, Human
uuacauuuuuaagugcugca

SEQ ID NO: 2017258 - RNA, 21 nt, Human
uuacauuuuuaagugcugcau

SEQ ID NO: 2017259 - RNA, 22 nt, Human
uuacauuuuuaagugcugcauu

SEQ ID NO: 2017260 - RNA, 23 nt, Human
uuacauuuuuaagugcugcauuu

SEQ ID NO: 2017261 - RNA, 14 nt, Human
uuacauuuguaauu

SEQ ID NO: 2017262 - RNA, 18 nt, Human
uuacauuuguaauuuaag

SEQ ID NO: 2017263 - RNA, 19 nt, Human
uuaccuuuuuuauacauaa

SEQ ID NO: 2017264 - RNA, 20 nt, Human
uuaccuuuuuuauacauaaa

SEQ ID NO: 2017265 - RNA, 22 nt, Human
uuaccuuuuuuauacauaaaca

SEQ ID NO: 2017266 - RNA, 19 nt, Human
uuacgaaguucaagaucaa

SEQ ID NO: 2017267 - RNA, 20 nt, Human
uuacgaaguucaagaucaaa

SEQ ID NO: 2017268 - RNA, 16 nt, Human
uuacggaacucaaaua

SEQ ID NO: 2017269 - RNA, 20 nt, Human
uuacgguuuuccagguuuaa

SEQ ID NO: 2017270 - RNA, 15 nt, Human
uuacagaggacagua

SEQ ID NO: 2017271 - RNA, 16 nt, Human
uuacagagaugucucu

SEQ ID NO: 2017272 - RNA, 20 nt, Human
uuacagagacagaaagcaga

SEQ ID NO: 2017273 - RNA, 15 nt, Human
uuacaauguaacuuu

SEQ ID NO: 2017274 - RNA, 23 nt, Human
uuacaauaaaaucuugaaaaugc

SEQ ID NO: 2017275 - RNA, 13 nt, Human
uuacaauauuugu

SEQ ID NO: 2017276 - RNA, 15 nt, Human
uuacaauauuugugu

SEQ ID NO: 2017277 - RNA, 16 nt, Human
uuacaauauuugugug

SEQ ID NO: 2017278 - RNA, 18 nt, Human
uuacaauauuugugugcu

SEQ ID NO: 2017279 - RNA, 22 nt, Human
uuacaauauuugugugcuaaac

SEQ ID NO: 2017280 - RNA, 14 nt, Human
uuacauuuccuaaa

SEQ ID NO: 2017281 - RNA, 15 nt, Human
uuacauuucgauguu

SEQ ID NO: 2017282 - RNA, 13 nt, Human
uuacauuuguaau

SEQ ID NO: 2017283 - RNA, 23 nt, Human
uuacauggcuggagcuagaauuu

SEQ ID NO: 2017284 - RNA, 22 nt, Human
uuacauggcuggagcuagaauu

SEQ ID NO: 2017285 - RNA, 17 nt, Human
uuaaggaugcuuguaca

SEQ ID NO: 2017286 - RNA, 18 nt, Human
uuaaggaugcuuguacau

SEQ ID NO: 2017287 - RNA, 19 nt, Human
uuaaggaugcuuguacaua

SEQ ID NO: 2017288 - RNA, 20 nt, Human
uuaaggaugcuuguacauaa

SEQ ID NO: 2017289 - RNA, 21 nt, Human
uuaaggaagacaaugugaaaa

SEQ ID NO: 2017290 - RNA, 23 nt, Human
uuaaggaaauuuguaccauuuca

SEQ ID NO: 2017291 - RNA, 15 nt, Human
uuaaggacugacuga

SEQ ID NO: 2017292 - RNA, 16 nt, Human
uuaaggacugacugag

SEQ ID NO: 2017293 - RNA, 18 nt, Human
uuaaggacugacugaggc

SEQ ID NO: 2017294 - RNA, 17 nt, Human
uuaaggagaaucauguu

SEQ ID NO: 2017295 - RNA, 18 nt, Human
uuaaggagaaucauguuu

SEQ ID NO: 2017296 - RNA, 20 nt, Human
uuaaggagaaucauguuucu

SEQ ID NO: 2017297 - RNA, 21 nt, Human
uuaaggagaaucauguuucuu

SEQ ID NO: 2017298 - RNA, 22 nt, Human
uuaaggagaaucauguuucuuu

SEQ ID NO: 2017299 - RNA, 16 nt, Human
uuaauagguuuggaca

SEQ ID NO: 2017300 - RNA, 21 nt, Human
uuaauaauuagaaacaccaaa

SEQ ID NO: 2017301 - RNA, 22 nt, Human
uuaaggaugcuuguacauaaug

SEQ ID NO: 2017302 - RNA, 15 nt, Human
uuaaggccacaucca

SEQ ID NO: 2017303 - RNA, 14 nt, Human
uuaauggaaauguu

SEQ ID NO: 2017304 - RNA, 12 nt, Human
uuaauggaugaa

SEQ ID NO: 2017305 - RNA, 18 nt, Human
uuaauggaugaaaucaua

SEQ ID NO: 2017306 - RNA, 17 nt, Human
uuaaugucacaggcagg

SEQ ID NO: 2017307 - RNA, 22 nt, Human
uuaaugucaauucuugccaaau

SEQ ID NO: 2017308 - RNA, 18 nt, Human
uuaaugucacaggcaggu

SEQ ID NO: 2017309 - RNA, 22 nt, Human
uuaauguccucucaaaguaaaa

SEQ ID NO: 2017310 - RNA, 21 nt, Human
uuaauagguuuggacaaaaug

SEQ ID NO: 2017311 - RNA, 13 nt, Human
uuaauaugaaauu

SEQ ID NO: 2017312 - RNA, 14 nt, Human
uuaauaugaaauuu

SEQ ID NO: 2017313 - RNA, 23 nt, Human
uuaauaugaaauuuuuuuucaug

SEQ ID NO: 2017314 - RNA, 17 nt, Human
uuaaugcuaaucuugug

SEQ ID NO: 2017315 - RNA, 18 nt, Human
uuaaugcuaaucuuguga

SEQ ID NO: 2017316 - RNA, 22 nt, Human
uuaaugcuaaucuugugaaaau

SEQ ID NO: 2017317 - RNA, 23 nt, Human
uuaaugcuaaucuugugaaaaua

SEQ ID NO: 2017318 - RNA, 18 nt, Human
uuaaaagauaaauauuau

SEQ ID NO: 2017319 - RNA, 16 nt, Human
uuaaacuuaaucuaaa

SEQ ID NO: 2017320 - RNA, 18 nt, Human
uuaaacuuaaucuaaaug

SEQ ID NO: 2017321 - RNA, 15 nt, Human
uuaaaacauuaaaau

SEQ ID NO: 2017322 - RNA, 23 nt, Human
uuaaaacaucauuccuuuuuauu

SEQ ID NO: 2017323 - RNA, 16 nt, Human
uuaaaacaucauuccu

SEQ ID NO: 2017324 - RNA, 18 nt, Human
uuaaaacaucauuccuuu

SEQ ID NO: 2017325 - RNA, 11 nt, Human
uuaaagaugua

SEQ ID NO: 2017326 - RNA, 15 nt, Human
uuaaagauguagcaa

SEQ ID NO: 2017327 - RNA, 16 nt, Human
uuaaagauguagcaaa

SEQ ID NO: 2017328 - RNA, 21 nt, Human
uuaaagauguagcaaacccug

SEQ ID NO: 2017329 - RNA, 20 nt, Human
uuaaacuuaaucuaaaugga

SEQ ID NO: 2017330 - RNA, 14 nt, Human
uuaaagacuuuuau

SEQ ID NO: 2017331 - RNA, 16 nt, Human
uuaaaugcaccuggaa

SEQ ID NO: 2017332 - RNA, 17 nt, Human
uuaaaugcaccuggaau

SEQ ID NO: 2017333 - RNA, 18 nt, Human
uuaaaugcaccuggaaua

SEQ ID NO: 2017334 - RNA, 15 nt, Human
uuaaagcuuccauug

SEQ ID NO: 2017335 - RNA, 20 nt, Human
uuaaagcuuccauuguuguc

SEQ ID NO: 2017336 - RNA, 19 nt, Human
uuaaauagcuuuuuucucu

SEQ ID NO: 2017337 - RNA, 18 nt, Human
uuaaauaguaaaaauaaa

SEQ ID NO: 2017338 - RNA, 18 nt, Human
uuaaaugcccagccccuu

SEQ ID NO: 2017339 - RNA, 17 nt, Human
uuaaaugcccagccccu

SEQ ID NO: 2017340 - RNA, 20 nt, Human
uuaaaugcaguuacaaauua

SEQ ID NO: 2017341 - RNA, 18 nt, Human
uguuuuaaaaugagaaau

SEQ ID NO: 2017342 - RNA, 16 nt, Human
uguuuguugucagcug

SEQ ID NO: 2017343 - RNA, 17 nt, Human
uguuuguugucagcuga

SEQ ID NO: 2017344 - RNA, 22 nt, Human
uguuuccuggcacugcuuccag

SEQ ID NO: 2017345 - RNA, 21 nt, Human
uguuuccuggcacugcuucca

SEQ ID NO: 2017346 - RNA, 20 nt, Human
uguuuccuggcacugcuucc

SEQ ID NO: 2017347 - RNA, 15 nt, Human
uguuucucccgugcu

SEQ ID NO: 2017348 - RNA, 16 nt, Human
uguuucucccgugcuu

SEQ ID NO: 2017349 - RNA, 20 nt, Human
uguuuuguaaacuuugaaau

SEQ ID NO: 2017350 - RNA, 21 nt, Human
uguuuuguaaacuuugaaaua

SEQ ID NO: 2017351 - RNA, 16 nt, Human
uguuuuguaaacuuug

SEQ ID NO: 2017352 - RNA, 17 nt, Human
uguuuuguaaacuuuga

SEQ ID NO: 2017353 - RNA, 18 nt, Human
uguuuuguaaacuuugaa

SEQ ID NO: 2017354 - RNA, 19 nt, Human
uguuuuguaaacuuugaaa

SEQ ID NO: 2017355 - RNA, 13 nt, Human
uguuuuguaaacu

SEQ ID NO: 2017356 - RNA, 15 nt, Human
uguuuuguaaacuuu

SEQ ID NO: 2017357 - RNA, 22 nt, Human
uguuuuguaaacuuugaaauau

SEQ ID NO: 2017358 - RNA, 12 nt, Human
uguuuuucaguu

SEQ ID NO: 2017359 - RNA, 13 nt, Human
uguuuuucaguuc

SEQ ID NO: 2017360 - RNA, 14 nt, Human
uguuuuucaguuca

SEQ ID NO: 2017361 - RNA, 15 nt, Human
uguuuuucaguucaa

SEQ ID NO: 2017362 - RNA, 17 nt, Human
uguuuuucaguucaaag

SEQ ID NO: 2017363 - RNA, 19 nt, Human
uguuuuucaguucaaaguc

SEQ ID NO: 2017364 - RNA, 23 nt, Human
uguuuuaaaaugagaaaucuaaa

SEQ ID NO: 2017365 - RNA, 16 nt, Human
uguuuugccagcccau

SEQ ID NO: 2017366 - RNA, 17 nt, Human
uguuuugccagcccauu

SEQ ID NO: 2017367 - RNA, 17 nt, Human
uguuuugcuuccccucc

SEQ ID NO: 2017368 - RNA, 19 nt, Human
uguuuugcuuuugcucgau

SEQ ID NO: 2017369 - RNA, 21 nt, Human
uguuuuggauuuggagagaaa

SEQ ID NO: 2017370 - RNA, 22 nt, Human
uguuuuggauuuggagagaaau

SEQ ID NO: 2017371 - RNA, 13 nt, Human
uguuuuugucuua

SEQ ID NO: 2017372 - RNA, 14 nt, Human
uguuuuuguuuugu

SEQ ID NO: 2017373 - RNA, 17 nt, Human
uguuuuucgucauucca

SEQ ID NO: 2017374 - RNA, 13 nt, Human
uguuuuuugaagu

SEQ ID NO: 2017375 - RNA, 15 nt, Human
uguuuuuugaagugu

SEQ ID NO: 2017376 - RNA, 16 nt, Human
uguuuuuugaaguguu

SEQ ID NO: 2017377 - RNA, 17 nt, Human
uguuuuuugagucuuuu

SEQ ID NO: 2017378 - RNA, 13 nt, Human
uuaaaacacguuu

SEQ ID NO: 2017379 - RNA, 19 nt, Human
uuaaaacacguuuuaagga

SEQ ID NO: 2017380 - RNA, 21 nt, Human
uuaaaacacguuuuaaggacu

SEQ ID NO: 2017381 - RNA, 22 nt, Human
uuaaaacacguuuuaaggacug

SEQ ID NO: 2017382 - RNA, 23 nt, Human
uuaaaacacguuuuaaggacuga

SEQ ID NO: 2017383 - RNA, 9 nt, Human
uguuuuuug

SEQ ID NO: 2017384 - RNA, 18 nt, Human
uguuuuuguuuuguugca

SEQ ID NO: 2017385 - RNA, 14 nt, Human
ugggccuccugugu

SEQ ID NO: 2017386 - RNA, 23 nt, Human
ugggcauuacuguuuaagacacu

SEQ ID NO: 2017387 - RNA, 16 nt, Human
ugggccuccugugugu

SEQ ID NO: 2017388 - RNA, 22 nt, Human
ugggccuccugugugugcgccu

SEQ ID NO: 2017389 - RNA, 18 nt, Human
ugggccuucagggaguga

SEQ ID NO: 2017390 - RNA, 15 nt, Human
ugggccuucagggag

SEQ ID NO: 2017391 - RNA, 16 nt, Human
ugggagcuuuuguaga

SEQ ID NO: 2017392 - RNA, 24 nt, Human
ugggagcugccuguucagcuccag

SEQ ID NO: 2017393 - RNA, 18 nt, Human
ugggagcuggaguccacu

SEQ ID NO: 2017394 - RNA, 14 nt, Human
ugggcagucauuuu

SEQ ID NO: 2017395 - RNA, 17 nt, Human
ugggcgugagaccugcc

SEQ ID NO: 2017396 - RNA, 18 nt, Human
ugggcgugagaccugccc

SEQ ID NO: 2017397 - RNA, 19 nt, Human
ugggcgugagaccugcccc

SEQ ID NO: 2017398 - RNA, 18 nt, Human
ugggcuucaguggcagcu

SEQ ID NO: 2017399 - RNA, 19 nt, Human
ugggcuucaguggcagcug

SEQ ID NO: 2017400 - RNA, 19 nt, Human
ugggcuuggggaccagagc

SEQ ID NO: 2017401 - RNA, 20 nt, Human
ugggcuucaguggcagcugc

SEQ ID NO: 2017402 - RNA, 21 nt, Human
ugggcuuggggaccagagcug

SEQ ID NO: 2017403 - RNA, 16 nt, Human
uggggcagcuugaggg

SEQ ID NO: 2017404 - RNA, 21 nt, Human
ugggugucaagagggucugag

SEQ ID NO: 2017405 - RNA, 23 nt, Human
ugggugucaagagggucugagga

SEQ ID NO: 2017406 - RNA, 17 nt, Human
uggguccaggccuacuc

SEQ ID NO: 2017407 - RNA, 18 nt, Human
uggguccaggccuacucc

SEQ ID NO: 2017408 - RNA, 21 nt, Human
uggguccaggccuacuccugu

SEQ ID NO: 2017409 - RNA, 23 nt, Human
uggguccaggccuacuccugucu

SEQ ID NO: 2017410 - RNA, 14 nt, Human
uggguguggcgcag

SEQ ID NO: 2017411 - RNA, 23 nt, Human
uggguucaagcgauucuucugcu

SEQ ID NO: 2017412 - RNA, 16 nt, Human
uggguucacugcaacc

SEQ ID NO: 2017413 - RNA, 17 nt, Human
uggguuggaaaacagua

SEQ ID NO: 2017414 - RNA, 21 nt, Human
uggguuccuuccucugagccu

SEQ ID NO: 2017415 - RNA, 22 nt, Human
uggguuccuuccucugagccuu

SEQ ID NO: 2017416 - RNA, 21 nt, Human
uggguuccagcaauucuccug

SEQ ID NO: 2017417 - RNA, 17 nt, Human
ugggguggggaccucag

SEQ ID NO: 2017418 - RNA, 19 nt, Human
ugggguggggggggugcug

SEQ ID NO: 2017419 - RNA, 16 nt, Human
uggggcauccaugggg

SEQ ID NO: 2017420 - RNA, 22 nt, Human
ugggucaugaugcucuuuccca

SEQ ID NO: 2017421 - RNA, 17 nt, Human
uggguagggcucugaca

SEQ ID NO: 2017422 - RNA, 22 nt, Human
uggguagcuguaaggcaugaag

SEQ ID NO: 2017423 - RNA, 13 nt, Human
uggguagcuguaa

SEQ ID NO: 2017424 - RNA, 22 nt, Human
ugggguggggggggugcugggc

SEQ ID NO: 2017425 - RNA, 21 nt, Human
ugggguggggggggugcuggg

SEQ ID NO: 2017426 - RNA, 23 nt, Human
ugggagcugccuguucagcucca

SEQ ID NO: 2017427 - RNA, 13 nt, Human
ugggagccgggca

SEQ ID NO: 2017428 - RNA, 23 nt, Human
ugggagccgggcaaacuggccgc

SEQ ID NO: 2017429 - RNA, 16 nt, Human
ugggacaugggaaagg

SEQ ID NO: 2017430 - RNA, 16 nt, Human
ugggacagggcauggc

SEQ ID NO: 2017431 - RNA, 19 nt, Human
ugggacauccugucaucug

SEQ ID NO: 2017432 - RNA, 14 nt, Human
ugggacccaguggc

SEQ ID NO: 2017433 - RNA, 17 nt, Human
ugggacccaguggcagg

SEQ ID NO: 2017434 - RNA, 18 nt, Human
ugggacccaguggcaggg

SEQ ID NO: 2017435 - RNA, 19 nt, Human
ugggacccaguggcagggc

SEQ ID NO: 2017436 - RNA, 20 nt, Human
ugggacccaguggcagggca

SEQ ID NO: 2017437 - RNA, 21 nt, Human
ugggacccaguggcagggcac

SEQ ID NO: 2017438 - RNA, 22 nt, Human
ugggacccaguggcagggcaca

SEQ ID NO: 2017439 - RNA, 20 nt, Human
ugggaccacaggugcccgcc

SEQ ID NO: 2017440 - RNA, 22 nt, Human
ugggaaugaaugucagugugac

SEQ ID NO: 2017441 - RNA, 15 nt, Human
uggcuuuucacugcu

SEQ ID NO: 2017442 - RNA, 14 nt, Human
uggcuuuucacugc

SEQ ID NO: 2017443 - RNA, 14 nt, Human
ugggaauguauagu

SEQ ID NO: 2017444 - RNA, 20 nt, Human
ugggaauguauaguauuuga

SEQ ID NO: 2017445 - RNA, 21 nt, Human
ugggaauguauaguauuugaa

SEQ ID NO: 2017446 - RNA, 22 nt, Human
ugggaauguauaguauuugaaa

SEQ ID NO: 2017447 - RNA, 23 nt, Human
ugggaauguauaguauuugaaaa

SEQ ID NO: 2017448 - RNA, 22 nt, Human
uggcugguuagagguucccuuu

SEQ ID NO: 2017449 - RNA, 14 nt, Human
uggcugggggccuc

SEQ ID NO: 2017450 - RNA, 15 nt, Human
uggcugggggccuca

SEQ ID NO: 2017451 - RNA, 17 nt, Human
uggcuuuuacccuuuuu

SEQ ID NO: 2017452 - RNA, 20 nt, Human
uggcucagguggggucacuc

SEQ ID NO: 2017453 - RNA, 22 nt, Human
uggcucagguggggucacucug

SEQ ID NO: 2017454 - RNA, 13 nt, Human
uggcuccugccca

SEQ ID NO: 2017455 - RNA, 15 nt, Human
uggcuccugcccacu

SEQ ID NO: 2017456 - RNA, 15 nt, Human
uggcucuuccaggcu

SEQ ID NO: 2017457 - RNA, 13 nt, Human
uggcucuuccagg

SEQ ID NO: 2017458 - RNA, 12 nt, Human
uggcucuacaca

SEQ ID NO: 2017459 - RNA, 14 nt, Human
uggcucuacacaua

SEQ ID NO: 2017460 - RNA, 15 nt, Human
uggcucuacacauau

SEQ ID NO: 2017461 - RNA, 16 nt, Human
uggcucuuccaggcug

SEQ ID NO: 2017462 - RNA, 12 nt, Human
uggcugggggcc

SEQ ID NO: 2017463 - RNA, 21 nt, Human
uggccuugggauccaggcccc

SEQ ID NO: 2017464 - RNA, 18 nt, Human
uggccuugggauccaggc

SEQ ID NO: 2017465 - RNA, 17 nt, Human
uggccuucggccuccau

SEQ ID NO: 2017466 - RNA, 18 nt, Human
uggccuucggccuccauc

SEQ ID NO: 2017467 - RNA, 15 nt, Human
uggccagaugcacca

SEQ ID NO: 2017468 - RNA, 22 nt, Human
uggcgugcaguggugcgaucug

SEQ ID NO: 2017469 - RNA, 14 nt, Human
uggcgcugccccug

SEQ ID NO: 2017470 - RNA, 15 nt, Human
uggcgcugccccugg

SEQ ID NO: 2017471 - RNA, 18 nt, Human
uggcgcuagaggccaugg

SEQ ID NO: 2017472 - RNA, 13 nt, Human
uggagauguuuag

SEQ ID NO: 2017473 - RNA, 20 nt, Human
uggagaggcccggccucuca

SEQ ID NO: 2017474 - RNA, 14 nt, Human
uggagagauaggaa

SEQ ID NO: 2017475 - RNA, 16 nt, Human
uggagagcccagaguc

SEQ ID NO: 2017476 - RNA, 17 nt, Human
uggaauuauuuuaaaag

SEQ ID NO: 2017477 - RNA, 19 nt, Human
uggaauuauuuuaaaagau

SEQ ID NO: 2017478 - RNA, 12 nt, Human
uggacaggcaug

SEQ ID NO: 2017479 - RNA, 16 nt, Human
uggacaggcauguucu

SEQ ID NO: 2017480 - RNA, 13 nt, Human
uggagagaaauau

SEQ ID NO: 2017481 - RNA, 17 nt, Human
uggagacugucucaaga

SEQ ID NO: 2017482 - RNA, 13 nt, Human
uggauaccauuau

SEQ ID NO: 2017483 - RNA, 15 nt, Human
uggauaccauuauau

SEQ ID NO: 2017484 - RNA, 14 nt, Human
uggaggcucaaauu

SEQ ID NO: 2017485 - RNA, 22 nt, Human
uggaggcaugugaugagaggaa

SEQ ID NO: 2017486 - RNA, 23 nt, Human
uggcagcugcgguccacccagga

SEQ ID NO: 2017487 - RNA, 21 nt, Human
uggcagcugcgguccacccag

SEQ ID NO: 2017488 - RNA, 22 nt, Human
uggcagcugcgguccacccagg

SEQ ID NO: 2017489 - RNA, 18 nt, Human
uggcacugcuuccaguga

SEQ ID NO: 2017490 - RNA, 16 nt, Human
uggcacugcuuccagu

SEQ ID NO: 2017491 - RNA, 14 nt, Human
uggcacugcuucca

SEQ ID NO: 2017492 - RNA, 20 nt, Human
uggaugccacagcccagcuu

SEQ ID NO: 2017493 - RNA, 14 nt, Human
uggaugccuggugg

SEQ ID NO: 2017494 - RNA, 14 nt, Human
uggcagugggagcu

SEQ ID NO: 2017495 - RNA, 15 nt, Human
uggcagugggagcug

SEQ ID NO: 2017496 - RNA, 16 nt, Human
uggcagugggagcugc

SEQ ID NO: 2017497 - RNA, 19 nt, Human
uggcagugggagcugccug

SEQ ID NO: 2017498 - RNA, 12 nt, Human
uggcaggcaggg

SEQ ID NO: 2017499 - RNA, 11 nt, Human
uggcaggcagg

SEQ ID NO: 2017500 - RNA, 21 nt, Human
uggcaggcaggggcccugcag

SEQ ID NO: 2017501 - RNA, 13 nt, Human
uggcagggcacag

SEQ ID NO: 2017502 - RNA, 14 nt, Human
uggcagggcacagg

SEQ ID NO: 2017503 - RNA, 15 nt, Human
uggcagggcacaggg

SEQ ID NO: 2017504 - RNA, 16 nt, Human
uggcagggcacagggc

SEQ ID NO: 2017505 - RNA, 17 nt, Human
uggcagggcacagggcc

SEQ ID NO: 2017506 - RNA, 18 nt, Human
uggcagggcacagggccu

SEQ ID NO: 2017507 - RNA, 20 nt, Human
uggcagugggagcugccugu

SEQ ID NO: 2017508 - RNA, 21 nt, Human
uggcagggcacagggccuggc

SEQ ID NO: 2017509 - RNA, 19 nt, Human
uggcagggcacagggccug

SEQ ID NO: 2017510 - RNA, 20 nt, Human
uggcagggcacagggccugg

SEQ ID NO: 2017511 - RNA, 22 nt, Human
uggccacuccagaccccuggcu

SEQ ID NO: 2017512 - RNA, 18 nt, Human
ugcuuccagugaggcucu

SEQ ID NO: 2017513 - RNA, 13 nt, Human
ugcugccucaugc

SEQ ID NO: 2017514 - RNA, 14 nt, Human
ugcugccuccagaa

SEQ ID NO: 2017515 - RNA, 13 nt, Human
ugcugccucagga

SEQ ID NO: 2017516 - RNA, 15 nt, Human
ugcugccucaggaau

SEQ ID NO: 2017517 - RNA, 20 nt, Human
ugcuuccagugaggcucugc

SEQ ID NO: 2017518 - RNA, 19 nt, Human
ugcuuccagugaggcucug

SEQ ID NO: 2017519 - RNA, 21 nt, Human
ugcuuccagugaggcucugcc

SEQ ID NO: 2017520 - RNA, 12 nt, Human
ugcuucucacug

SEQ ID NO: 2017521 - RNA, 16 nt, Human
ugcuucuucagagacu

SEQ ID NO: 2017522 - RNA, 12 nt, Human
ugcuucugccac

SEQ ID NO: 2017523 - RNA, 13 nt, Human
ugcuucugccacc

SEQ ID NO: 2017524 - RNA, 18 nt, Human
ugcuucucugcccagcuu

SEQ ID NO: 2017525 - RNA, 14 nt, Human
ugcuuuccaaagcc

SEQ ID NO: 2017526 - RNA, 14 nt, Human
ugcuuuccauauuu

SEQ ID NO: 2017527 - RNA, 15 nt, Human
ugcuuuccauauuuu

SEQ ID NO: 2017528 - RNA, 21 nt, Human
ugcuuuccauauuuuuuuccu

SEQ ID NO: 2017529 - RNA, 22 nt, Human
ugcuuuccauauuuuuuuccuu

SEQ ID NO: 2017530 - RNA, 13 nt, Human
ugcuuuuuuugaa

SEQ ID NO: 2017531 - RNA, 15 nt, Human
ugcuuuuuuugaaac

SEQ ID NO: 2017532 - RNA, 20 nt, Human
ugcuuuuuuugaaacuuuga

SEQ ID NO: 2017533 - RNA, 21 nt, Human
ugcuuuagacuugaaaagaga

SEQ ID NO: 2017534 - RNA, 19 nt, Human
ugcuuuagacuugaaaaga

SEQ ID NO: 2017535 - RNA, 14 nt, Human
ugcuuguugacaga

SEQ ID NO: 2017536 - RNA, 14 nt, Human
ugcuugaacuuaca

SEQ ID NO: 2017537 - RNA, 18 nt, Human
ugcuuguuaacugagugc

SEQ ID NO: 2017538 - RNA, 12 nt, Human
uggaagacagcu

SEQ ID NO: 2017539 - RNA, 11 nt, Human
uggaagacagc

SEQ ID NO: 2017540 - RNA, 23 nt, Human
uggaacucuugacagcuauaauu

SEQ ID NO: 2017541 - RNA, 14 nt, Human
uggaacucucgagc

SEQ ID NO: 2017542 - RNA, 14 nt, Human
uggaaaaaaacauc

SEQ ID NO: 2017543 - RNA, 11 nt, Human
uggaaaauaaa

SEQ ID NO: 2017544 - RNA, 15 nt, Human
uggaaaauaaaucaa

SEQ ID NO: 2017545 - RNA, 16 nt, Human
uggaaaauaaauuauu

SEQ ID NO: 2017546 - RNA, 15 nt, Human
uggaaaauaaauuau

SEQ ID NO: 2017547 - RNA, 16 nt, Human
uggaauacucuuauau

SEQ ID NO: 2017548 - RNA, 21 nt, Human
uggaagugugggucugugugu

SEQ ID NO: 2017549 - RNA, 15 nt, Human
uggaagacagcucuu

SEQ ID NO: 2017550 - RNA, 14 nt, Human
uggaagacagcucu

SEQ ID NO: 2017551 - RNA, 23 nt, Human
uggaagugugggucugugugugu

SEQ ID NO: 2017552 - RNA, 21 nt, Human
uggaagugugugaucuguggg

SEQ ID NO: 2017553 - RNA, 16 nt, Human
uggaauaucuccguca

SEQ ID NO: 2017554 - RNA, 18 nt, Human
uggaaucauuguccagag

SEQ ID NO: 2017555 - RNA, 20 nt, Human
uggaaucauuguccagagcu

SEQ ID NO: 2017556 - RNA, 15 nt, Human
uggaauuauuuuaaa

SEQ ID NO: 2017557 - RNA, 22 nt, Human
uggaauuagaacccuugcacag

SEQ ID NO: 2017558 - RNA, 23 nt, Human
uggaauuagaacccuugcacagc

SEQ ID NO: 2017559 - RNA, 23 nt, Human
ugcacagcuaacauggaaguacu

SEQ ID NO: 2017560 - RNA, 20 nt, Human
ugcacagcuaacauggaagu

SEQ ID NO: 2017561 - RNA, 18 nt, Human
ugcacagcuaacauggaa

SEQ ID NO: 2017562 - RNA, 18 nt, Human
ugcacagugcaucucagc

SEQ ID NO: 2017563 - RNA, 12 nt, Human
ugcacaggcaga

SEQ ID NO: 2017564 - RNA, 23 nt, Human
ugcacaggcagagcccagacccu

SEQ ID NO: 2017565 - RNA, 19 nt, Human
ugcacagugcaucucagcc

SEQ ID NO: 2017566 - RNA, 20 nt, Human
ugcacagugcaucucagccc

SEQ ID NO: 2017567 - RNA, 18 nt, Human
ugcacauaaacucuuuua

SEQ ID NO: 2017568 - RNA, 13 nt, Human
ugcacaucuguuu

SEQ ID NO: 2017569 - RNA, 17 nt, Human
ugcacagcuaacaugga

SEQ ID NO: 2017570 - RNA, 23 nt, Human
ugcacagaguuguuacauuuuua

SEQ ID NO: 2017571 - RNA, 21 nt, Human
ugcacagaguuguuacauuuu

SEQ ID NO: 2017572 - RNA, 22 nt, Human
ugcacagaguuguuacauuuuu

SEQ ID NO: 2017573 - RNA, 22 nt, Human
ugaagucuuuguacagacaaca

SEQ ID NO: 2017574 - RNA, 17 nt, Human
ugaagucuguauuguaa

SEQ ID NO: 2017575 - RNA, 20 nt, Human
ugaagucuuuguacagacaa

SEQ ID NO: 2017576 - RNA, 17 nt, Human
ugaagucuuuguacaga

SEQ ID NO: 2017577 - RNA, 16 nt, Human
ugaaggcuggguucug

SEQ ID NO: 2017578 - RNA, 13 nt, Human
ugaaguccggaac

SEQ ID NO: 2017579 - RNA, 16 nt, Human
ugcagauaaacaguag

SEQ ID NO: 2017580 - RNA, 20 nt, Human
ugcagaguauuuuuguauuc

SEQ ID NO: 2017581 - RNA, 17 nt, Human
ugcagauaaacaguagu

SEQ ID NO: 2017582 - RNA, 19 nt, Human
ugcagaguucagggaagau

SEQ ID NO: 2017583 - RNA, 24 nt, Human
ugcagaguucagggaagauaaguu

SEQ ID NO: 2017584 - RNA, 20 nt, Human
ugcacuuuguucuggcucuu

SEQ ID NO: 2017585 - RNA, 19 nt, Human
ugcacuuuguucuggcucu

SEQ ID NO: 2017586 - RNA, 18 nt, Human
ugcacuuuguucuggcuc

SEQ ID NO: 2017587 - RNA, 15 nt, Human
ugcacuuuguucugg

SEQ ID NO: 2017588 - RNA, 22 nt, Human
ugcacuugggggcucagcaagg

SEQ ID NO: 2017589 - RNA, 19 nt, Human
ugcacuugggggcucagca

SEQ ID NO: 2017590 - RNA, 21 nt, Human
ugcacuugggggcucagcaag

SEQ ID NO: 2017591 - RNA, 17 nt, Human
ugcacuuggggcacagg

SEQ ID NO: 2017592 - RNA, 21 nt, Human
ugcacuuggggcacagggaga

SEQ ID NO: 2017593 - RNA, 21 nt, Human
ugcacuugcagacucuacaga

SEQ ID NO: 2017594 - RNA, 16 nt, Human
ugcacuugcagacucu

SEQ ID NO: 2017595 - RNA, 19 nt, Human
ugcacguacacacacauac

SEQ ID NO: 2017596 - RNA, 16 nt, Human
ugcacguacacacaca

SEQ ID NO: 2017597 - RNA, 14 nt, Human
ugcaggaccucagg

SEQ ID NO: 2017598 - RNA, 17 nt, Human
ugcaggaaauggcugug

SEQ ID NO: 2017599 - RNA, 22 nt, Human
ugcagcuuuaaaaaauuaaucu

SEQ ID NO: 2017600 - RNA, 17 nt, Human
ugcacaucuguuuugua

SEQ ID NO: 2017601 - RNA, 16 nt, Human
ugcaggaccucaggug

SEQ ID NO: 2017602 - RNA, 15 nt, Human
ugcaggaccucaggu

SEQ ID NO: 2017603 - RNA, 18 nt, Human
ugcaggaccucaggugag

SEQ ID NO: 2017604 - RNA, 14 nt, Human
ugcagcaauaaagc

SEQ ID NO: 2017605 - RNA, 15 nt, Human
ugcagcaauaaagca

SEQ ID NO: 2017606 - RNA, 16 nt, Human
ugcagcaauaaagcag

SEQ ID NO: 2017607 - RNA, 16 nt, Human
ugcagccacuuaggac

SEQ ID NO: 2017608 - RNA, 17 nt, Human
ugcagccacuuaggaca

SEQ ID NO: 2017609 - RNA, 13 nt, Human
ugcagcuuuaaaa

SEQ ID NO: 2017610 - RNA, 10 nt, Human
ugcccagccc

SEQ ID NO: 2017611 - RNA, 18 nt, Human
ugcccaccuggccucugc

SEQ ID NO: 2017612 - RNA, 17 nt, Human
ugcccaccuggccucug

SEQ ID NO: 2017613 - RNA, 15 nt, Human
ugcccaccuggccuc

SEQ ID NO: 2017614 - RNA, 16 nt, Human
ugccaucucugcucca

SEQ ID NO: 2017615 - RNA, 13 nt, Human
ugccaucucugcu

SEQ ID NO: 2017616 - RNA, 15 nt, Human
ugccaucucugcucc

SEQ ID NO: 2017617 - RNA, 19 nt, Human
ugccaagagcccgucugcu

SEQ ID NO: 2017618 - RNA, 23 nt, Human
ugccaagagcccgucugcuccug

SEQ ID NO: 2017619 - RNA, 22 nt, Human
ugccagggacagaggggguggc

SEQ ID NO: 2017620 - RNA, 11 nt, Human
ugccagggaca

SEQ ID NO: 2017621 - RNA, 14 nt, Human
ugccagucaccccg

SEQ ID NO: 2017622 - RNA, 22 nt, Human
ugccaguaccagccccacccug

SEQ ID NO: 2017623 - RNA, 23 nt, Human
ugccaguaccagccccacccugu

SEQ ID NO: 2017624 - RNA, 23 nt, Human
ugccaguaacacaggccacccug

SEQ ID NO: 2017625 - RNA, 24 nt, Human
ugccaguaacacaggccacccugu

SEQ ID NO: 2017626 - RNA, 24 nt, Human
ugccagguuuuuggucugacccac

SEQ ID NO: 2017627 - RNA, 15 nt, Human
ugcaucguuucaucu

SEQ ID NO: 2017628 - RNA, 17 nt, Human
ugcaucguuucaucuuc

SEQ ID NO: 2017629 - RNA, 16 nt, Human
ugcaugugucuuuaua

SEQ ID NO: 2017630 - RNA, 18 nt, Human
ugcauccuccgccucccg

SEQ ID NO: 2017631 - RNA, 21 nt, Human
ugcauccuccgccucccgggu

SEQ ID NO: 2017632 - RNA, 12 nt, Human
ugcaucaguucu

SEQ ID NO: 2017633 - RNA, 19 nt, Human
ugcaggcagccaggccaca

SEQ ID NO: 2017634 - RNA, 18 nt, Human
ugcaggcagccaggccac

SEQ ID NO: 2017635 - RNA, 17 nt, Human
ugcaggcagccaggcca

SEQ ID NO: 2017636 - RNA, 22 nt, Human
ugcaggagcaguaucaugaagc

SEQ ID NO: 2017637 - RNA, 16 nt, Human
ugcaggcagccaggcc

SEQ ID NO: 2017638 - RNA, 19 nt, Human
ugcauguuacauaagauaa

SEQ ID NO: 2017639 - RNA, 22 nt, Human
ugccaaaacccagcugcacccc

SEQ ID NO: 2017640 - RNA, 15 nt, Human
ugccaaccucgcucc

SEQ ID NO: 2017641 - RNA, 19 nt, Human
ugccaaccucgcuccaacu

SEQ ID NO: 2017642 - RNA, 21 nt, Human
ugccaaccucgcuccaacucc

SEQ ID NO: 2017643 - RNA, 18 nt, Human
ugccaacugaucuguuau

SEQ ID NO: 2017644 - RNA, 20 nt, Human
ugccaaaaaaagacagggcu

SEQ ID NO: 2017645 - RNA, 16 nt, Human
ugccaaaacccagcug

SEQ ID NO: 2017646 - RNA, 17 nt, Human
ugccaaaacccagcugc

SEQ ID NO: 2017647 - RNA, 18 nt, Human
ugccaaaacccagcugca

SEQ ID NO: 2017648 - RNA, 19 nt, Human
ugccaaaacccagcugcac

SEQ ID NO: 2017649 - RNA, 20 nt, Human
ugccaaaacccagcugcacc

SEQ ID NO: 2017650 - RNA, 21 nt, Human
ugccaaaacccagcugcaccc

SEQ ID NO: 2017651 - RNA, 22 nt, Human
ugccugaagucacacagugagu

SEQ ID NO: 2017652 - RNA, 18 nt, Human
ugccugaagucacacagu

SEQ ID NO: 2017653 - RNA, 17 nt, Human
ugccugaagucacacag

SEQ ID NO: 2017654 - RNA, 22 nt, Human
ugccuccuugauauuuguauuu

SEQ ID NO: 2017655 - RNA, 18 nt, Human
ugccuccuugauauuugu

SEQ ID NO: 2017656 - RNA, 14 nt, Human
ugccucugggacug

SEQ ID NO: 2017657 - RNA, 18 nt, Human
ugccuccuuugugaggaa

SEQ ID NO: 2017658 - RNA, 17 nt, Human
ugccuccuuugugagga

SEQ ID NO: 2017659 - RNA, 18 nt, Human
ugccuccccucuccuucc

SEQ ID NO: 2017660 - RNA, 16 nt, Human
ugccuccuuugugagg

SEQ ID NO: 2017661 - RNA, 11 nt, Human
ugcccagcccc

SEQ ID NO: 2017662 - RNA, 16 nt, Human
ugcccagaucagccag

SEQ ID NO: 2017663 - RNA, 17 nt, Human
ugcccagaucagccaga

SEQ ID NO: 2017664 - RNA, 20 nt, Human
ugcccagaucagccagaagc

SEQ ID NO: 2017665 - RNA, 23 nt, Human
ugcccaggcuggcgugcaguggu

SEQ ID NO: 2017666 - RNA, 22 nt, Human
ugcccagcccccuggucuuuga

SEQ ID NO: 2017667 - RNA, 19 nt, Human
ugccuaaggcugaacuugu

SEQ ID NO: 2017668 - RNA, 17 nt, Human
ugccuccccucuccuuc

SEQ ID NO: 2017669 - RNA, 20 nt, Human
ugccuaggauucacacccca

SEQ ID NO: 2017670 - RNA, 22 nt, Human
ugccuaggauucacaccccacc

SEQ ID NO: 2017671 - RNA, 23 nt, Human
ugccuaggauucacaccccaccu

SEQ ID NO: 2017672 - RNA, 13 nt, Human
ugcgcaggcuggc

SEQ ID NO: 2017673 - RNA, 16 nt, Human
ugcgcaggcuggcccu

SEQ ID NO: 2017674 - RNA, 17 nt, Human
ugcgcaggcuggcccug

SEQ ID NO: 2017675 - RNA, 19 nt, Human
ugcgcaggcuggcccugcc

SEQ ID NO: 2017676 - RNA, 23 nt, Human
ugcggugcuaucucccccagccc

SEQ ID NO: 2017677 - RNA, 13 nt, Human
ugcgccuacagga

SEQ ID NO: 2017678 - RNA, 13 nt, Human
ugccuucagcucu

SEQ ID NO: 2017679 - RNA, 17 nt, Human
ugccuucagcucuacag

SEQ ID NO: 2017680 - RNA, 18 nt, Human
ugccuucagcucuacagc

SEQ ID NO: 2017681 - RNA, 22 nt, Human
ugccuuauggaacacucugaga

SEQ ID NO: 2017682 - RNA, 21 nt, Human
ugccuuauggaacacucugag

SEQ ID NO: 2017683 - RNA, 20 nt, Human
ugccuuauggaacacucuga

SEQ ID NO: 2017684 - RNA, 18 nt, Human
ugccuuauggaacacucu

SEQ ID NO: 2017685 - RNA, 20 nt, Human
ugcucuuuggccugaugacc

SEQ ID NO: 2017686 - RNA, 23 nt, Human
ugcucuuuggccugaugaccaau

SEQ ID NO: 2017687 - RNA, 19 nt, Human
ugcuccuggcccacugcau

SEQ ID NO: 2017688 - RNA, 16 nt, Human
ugcuccuucccuugcu

SEQ ID NO: 2017689 - RNA, 23 nt, Human
ugcugaauacagaggcaacugca

SEQ ID NO: 2017690 - RNA, 18 nt, Human
ugcugaauacagaggcaa

SEQ ID NO: 2017691 - RNA, 22 nt, Human
ugcugaaaauugccuuucugug

SEQ ID NO: 2017692 - RNA, 22 nt, Human
ugcugaaugguuuucaaaauaa

SEQ ID NO: 2017693 - RNA, 18 nt, Human
ugcugaaugguuuucaaa

SEQ ID NO: 2017694 - RNA, 17 nt, Human
ugcugaaugguuuucaa

SEQ ID NO: 2017695 - RNA, 16 nt, Human
ugcugaaguccggaac

SEQ ID NO: 2017696 - RNA, 23 nt, Human
ugcugauggugcaaugaccuuuc

SEQ ID NO: 2017697 - RNA, 20 nt, Human
ugcugauggugcaaugaccu

SEQ ID NO: 2017698 - RNA, 13 nt, Human
ugcugcagauacu

SEQ ID NO: 2017699 - RNA, 16 nt, Human
ugcugcagggcuuuaa

SEQ ID NO: 2017700 - RNA, 21 nt, Human
ugcugcagggcuuuaaaauuc

SEQ ID NO: 2017701 - RNA, 16 nt, Human
ugcugcaguugccagu

SEQ ID NO: 2017702 - RNA, 15 nt, Human
ugcugcaguugccag

SEQ ID NO: 2017703 - RNA, 15 nt, Human
ugcugacagacacag

SEQ ID NO: 2017704 - RNA, 16 nt, Human
ugcugacagacacagg

SEQ ID NO: 2017705 - RNA, 19 nt, Human
ugcugacagacacaggccc

SEQ ID NO: 2017706 - RNA, 22 nt, Human
ugcugaugacccccccagcuuc

SEQ ID NO: 2017707 - RNA, 23 nt, Human
ugcugaugacccccccagcuuca

SEQ ID NO: 2017708 - RNA, 16 nt, Human
ugcugagucuguucug

SEQ ID NO: 2017709 - RNA, 19 nt, Human
ugcugagucuguucuggua

SEQ ID NO: 2017710 - RNA, 21 nt, Human
ugcugagucuguucugguaau

SEQ ID NO: 2017711 - RNA, 16 nt, Human
ugcucagcugucaagg

SEQ ID NO: 2017712 - RNA, 20 nt, Human
ugcucagcugucaaggcuca

SEQ ID NO: 2017713 - RNA, 14 nt, Human
ugcucaggagcccu

SEQ ID NO: 2017714 - RNA, 19 nt, Human
ugcuccucuccccagcaag

SEQ ID NO: 2017715 - RNA, 12 nt, Human
ugcuccugagcc

SEQ ID NO: 2017716 - RNA, 13 nt, Human
ugcuccugagccc

SEQ ID NO: 2017717 - RNA, 14 nt, Human
ugcuccugagcccc

SEQ ID NO: 2017718 - RNA, 15 nt, Human
ugcuccugagccccc

SEQ ID NO: 2017719 - RNA, 16 nt, Human
ugcuccugagccccca

SEQ ID NO: 2017720 - RNA, 21 nt, Human
ugcuccugagcccccagcuuc

SEQ ID NO: 2017721 - RNA, 20 nt, Human
ugcuagaacucccuuucaac

SEQ ID NO: 2017722 - RNA, 21 nt, Human
ugcuagaacucccuuucaaca

SEQ ID NO: 2017723 - RNA, 19 nt, Human
ugcuaggaacacuccuuca

SEQ ID NO: 2017724 - RNA, 17 nt, Human
ugcuaggaacacuccuu

SEQ ID NO: 2017725 - RNA, 16 nt, Human
ugcuaggaacacuccu

SEQ ID NO: 2017726 - RNA, 15 nt, Human
ugcgugcauaccacu

SEQ ID NO: 2017727 - RNA, 19 nt, Human
ugcuagaacucccuuucaa

SEQ ID NO: 2017728 - RNA, 18 nt, Human
ugcuagaacucccuuuca

SEQ ID NO: 2017729 - RNA, 13 nt, Human
ucuuaugcuucca

SEQ ID NO: 2017730 - RNA, 17 nt, Human
ucuuaugcuuccagaaa

SEQ ID NO: 2017731 - RNA, 20 nt, Human
ucuuaugcuuccagaaacac

SEQ ID NO: 2017732 - RNA, 15 nt, Human
ucuucaguaagccgu

SEQ ID NO: 2017733 - RNA, 13 nt, Human
ucuuaugggcugg

SEQ ID NO: 2017734 - RNA, 14 nt, Human
ucuuauacauuuga

SEQ ID NO: 2017735 - RNA, 15 nt, Human
ucuuauacauuugau

SEQ ID NO: 2017736 - RNA, 21 nt, Human
ucuuaguguugcguccugccu

SEQ ID NO: 2017737 - RNA, 23 nt, Human
ucuuaaaauggcaaguuuuccau

SEQ ID NO: 2017738 - RNA, 16 nt, Human
ucuuaguggauguucu

SEQ ID NO: 2017739 - RNA, 14 nt, Human
ucuuagugugugca

SEQ ID NO: 2017740 - RNA, 13 nt, Human
ucuuccaggcagc

SEQ ID NO: 2017741 - RNA, 14 nt, Human
ucuuccaggcuggg

SEQ ID NO: 2017742 - RNA, 16 nt, Human
ucuucaguaagccgug

SEQ ID NO: 2017743 - RNA, 21 nt, Human
ucuuccacaagagcccaggcc

SEQ ID NO: 2017744 - RNA, 22 nt, Human
ucuuccaaccauuuaucuugaa

SEQ ID NO: 2017745 - RNA, 21 nt, Human
ucuucuccacuuucuagccag

SEQ ID NO: 2017746 - RNA, 19 nt, Human
ucuucuccacuuucuagcc

SEQ ID NO: 2017747 - RNA, 13 nt, Human
ucuucuccacugg

SEQ ID NO: 2017748 - RNA, 12 nt, Human
ucuucuauuuau

SEQ ID NO: 2017749 - RNA, 18 nt, Human
ucuucuagcauaucuuuc

SEQ ID NO: 2017750 - RNA, 22 nt, Human
ucuucuauuuauuuauuuauuc

SEQ ID NO: 2017751 - RNA, 20 nt, Human
ucuugccucagcuuccccag

SEQ ID NO: 2017752 - RNA, 20 nt, Human
ucuugccuauauuuuccuga

SEQ ID NO: 2017753 - RNA, 19 nt, Human
ucuugccucagcuucccca

SEQ ID NO: 2017754 - RNA, 18 nt, Human
ucuugccucagcuucccc

SEQ ID NO: 2017755 - RNA, 19 nt, Human
ucuugccuauauuuuccug

SEQ ID NO: 2017756 - RNA, 15 nt, Human
ucuugaacugagcuu

SEQ ID NO: 2017757 - RNA, 17 nt, Human
ucuugaacucuuggccu

SEQ ID NO: 2017758 - RNA, 21 nt, Human
ucuugaauuguaaggaaugau

SEQ ID NO: 2017759 - RNA, 20 nt, Human
ucuugacagagccugcccca

SEQ ID NO: 2017760 - RNA, 14 nt, Human
ucuugacccugcac

SEQ ID NO: 2017761 - RNA, 15 nt, Human
ucuugacccugcacc

SEQ ID NO: 2017762 - RNA, 16 nt, Human
ucuugacccugcaccc

SEQ ID NO: 2017763 - RNA, 17 nt, Human
ucuugacccugcacccu

SEQ ID NO: 2017764 - RNA, 18 nt, Human
ucuugacccugcacccuc

SEQ ID NO: 2017765 - RNA, 19 nt, Human
ucuugacccugcacccucc

SEQ ID NO: 2017766 - RNA, 15 nt, Human
ucuugaccucugccu

SEQ ID NO: 2017767 - RNA, 15 nt, Human
ucuucuccaggcugu

SEQ ID NO: 2017768 - RNA, 16 nt, Human
ucuugaacuccuggcc

SEQ ID NO: 2017769 - RNA, 17 nt, Human
ucuugaacuccuggccu

SEQ ID NO: 2017770 - RNA, 18 nt, Human
ucuugaacuccuggccuc

SEQ ID NO: 2017771 - RNA, 13 nt, Human
ucuucuccaggcu

SEQ ID NO: 2017772 - RNA, 14 nt, Human
ucuucuccaggcug

SEQ ID NO: 2017773 - RNA, 12 nt, Human
ucuucuccaggc

SEQ ID NO: 2017774 - RNA, 16 nt, Human
ucuucuccacuggaug

SEQ ID NO: 2017775 - RNA, 12 nt, Human
ucuugcucuccu

SEQ ID NO: 2017776 - RNA, 15 nt, Human
ucuugcucucuuuua

SEQ ID NO: 2017777 - RNA, 12 nt, Human
ucuugcucugcu

SEQ ID NO: 2017778 - RNA, 13 nt, Human
ucuugcucugcug

SEQ ID NO: 2017779 - RNA, 11 nt, Human
ucuugcucugc

SEQ ID NO: 2017780 - RNA, 21 nt, Human
ucuugccugccuaacaaaaua

SEQ ID NO: 2017781 - RNA, 18 nt, Human
ucuuguuuuuuuuuucca

SEQ ID NO: 2017782 - RNA, 21 nt, Human
ucuuguuuuuuuuuuccacuu

SEQ ID NO: 2017783 - RNA, 17 nt, Human
ucuugugaaaauaauug

SEQ ID NO: 2017784 - RNA, 15 nt, Human
ucuugucuuccuauu

SEQ ID NO: 2017785 - RNA, 19 nt, Human
ucuugucuuccuauuucag

SEQ ID NO: 2017786 - RNA, 20 nt, Human
ucuugucuuccuauuucaga

SEQ ID NO: 2017787 - RNA, 15 nt, Human
ucuguguguuuaugu

SEQ ID NO: 2017788 - RNA, 16 nt, Human
ucuguguguuuaugug

SEQ ID NO: 2017789 - RNA, 22 nt, Human
ucuguguguguguauguggggg

SEQ ID NO: 2017790 - RNA, 19 nt, Human
ucuguguguuuaugugugu

SEQ ID NO: 2017791 - RNA, 20 nt, Human
ucuguguguuuaugugugug

SEQ ID NO: 2017792 - RNA, 20 nt, Human
ucuguguuuacagagauguc

SEQ ID NO: 2017793 - RNA, 12 nt, Human
ucuguguuuauu

SEQ ID NO: 2017794 - RNA, 17 nt, Human
ucuguguuuauucaaac

SEQ ID NO: 2017795 - RNA, 15 nt, Human
ucuguuaaaaugcau

SEQ ID NO: 2017796 - RNA, 13 nt, Human
ucuguuaaaaugc

SEQ ID NO: 2017797 - RNA, 14 nt, Human
ucuguuaaaaugca

SEQ ID NO: 2017798 - RNA, 19 nt, Human
ucuguuacacuuuuuggaa

SEQ ID NO: 2017799 - RNA, 22 nt, Human
ucuguuacaaaauguaacuguu

SEQ ID NO: 2017800 - RNA, 12 nt, Human
ucuguuacaaaa

SEQ ID NO: 2017801 - RNA, 14 nt, Human
ucuguuacaaaaug

SEQ ID NO: 2017802 - RNA, 16 nt, Human
ucuguuacaaaaugua

SEQ ID NO: 2017803 - RNA, 17 nt, Human
ucuguuacaaaauguaa

SEQ ID NO: 2017804 - RNA, 19 nt, Human
ucuguuacaaaauguaacu

SEQ ID NO: 2017805 - RNA, 20 nt, Human
ucuguuacaaaauguaacug

SEQ ID NO: 2017806 - RNA, 18 nt, Human
ucuuaaaaaguggaaaaa

SEQ ID NO: 2017807 - RNA, 12 nt, Human
ucuguuuucaau

SEQ ID NO: 2017808 - RNA, 22 nt, Human
ucuguuuucaaucucguauaga

SEQ ID NO: 2017809 - RNA, 14 nt, Human
ucuguucaggaagu

SEQ ID NO: 2017810 - RNA, 22 nt, Human
ucuguucaggaaguccuuaucu

SEQ ID NO: 2017811 - RNA, 14 nt, Human
ucuguucagcguuu

SEQ ID NO: 2017812 - RNA, 19 nt, Human
ucuguucagcguuuugcaa

SEQ ID NO: 2017813 - RNA, 20 nt, Human
ucuguucagcguuuugcaag

SEQ ID NO: 2017814 - RNA, 21 nt, Human
ucuguuauagguccuuuagaa

SEQ ID NO: 2017815 - RNA, 22 nt, Human
ucuguuauagguccuuuagaaa

SEQ ID NO: 2017816 - RNA, 23 nt, Human
ucuguuauagguccuuuagaaac

SEQ ID NO: 2017817 - RNA, 15 nt, Human
ucuguguguguguau

SEQ ID NO: 2017818 - RNA, 18 nt, Human
ucuguguguguguaugug

SEQ ID NO: 2017819 - RNA, 19 nt, Human
ucuguguguguguaugugg

SEQ ID NO: 2017820 - RNA, 21 nt, Human
ucuguguguguguaugugggg

SEQ ID NO: 2017821 - RNA, 22 nt, Human
ucugugucagguggggcagcuu

SEQ ID NO: 2017822 - RNA, 23 nt, Human
ucuguggguuucuaaagcugcca

SEQ ID NO: 2017823 - RNA, 12 nt, Human
ucugugguuggc

SEQ ID NO: 2017824 - RNA, 13 nt, Human
ucugugguuggcu

SEQ ID NO: 2017825 - RNA, 14 nt, Human
ucugugguuggcug

SEQ ID NO: 2017826 - RNA, 19 nt, Human
ucugugguuggcugggaaa

SEQ ID NO: 2017827 - RNA, 20 nt, Human
ucugugguuggcugggaaau

SEQ ID NO: 2017828 - RNA, 17 nt, Human
ucuguacgucugacagg

SEQ ID NO: 2017829 - RNA, 23 nt, Human
ucuguacagagccguaaaaacug

SEQ ID NO: 2017830 - RNA, 12 nt, Human
ucuguacauauu

SEQ ID NO: 2017831 - RNA, 19 nt, Human
ucuguccgagcuuugaaaa

SEQ ID NO: 2017832 - RNA, 18 nt, Human
ucuguacaucucuacuua

SEQ ID NO: 2017833 - RNA, 22 nt, Human
ucuguggguuucuaaagcugcc

SEQ ID NO: 2017834 - RNA, 16 nt, Human
ucuggcucuuccaggc

SEQ ID NO: 2017835 - RNA, 15 nt, Human
ucuggcucuuccagg

SEQ ID NO: 2017836 - RNA, 17 nt, Human
ucuggcucuuccaggcu

SEQ ID NO: 2017837 - RNA, 13 nt, Human
ucugggacacagu

SEQ ID NO: 2017838 - RNA, 17 nt, Human
ucugggaauguauagua

SEQ ID NO: 2017839 - RNA, 14 nt, Human
ucugggaauguaua

SEQ ID NO: 2017840 - RNA, 12 nt, Human
ucugggacacag

SEQ ID NO: 2017841 - RNA, 23 nt, Human
ucuguacagagcccacgccccca

SEQ ID NO: 2017842 - RNA, 22 nt, Human
ucuguacagagccguaaaaacu

SEQ ID NO: 2017843 - RNA, 22 nt, Human
ucuguaagcuguuugguuuuaa

SEQ ID NO: 2017844 - RNA, 23 nt, Human
ucuguaagcuguuugguuuuaaa

SEQ ID NO: 2017845 - RNA, 14 nt, Human
ucuggcuaugcauu

SEQ ID NO: 2017846 - RNA, 17 nt, Human
ucuggcuaugcauuuga

SEQ ID NO: 2017847 - RNA, 16 nt, Human
ucuggcucuacacaua

SEQ ID NO: 2017848 - RNA, 17 nt, Human
ucuggaggaccugcccg

SEQ ID NO: 2017849 - RNA, 14 nt, Human
ucuggagagcccag

SEQ ID NO: 2017850 - RNA, 23 nt, Human
ucuggagcccacuguacuugcuc

SEQ ID NO: 2017851 - RNA, 23 nt, Human
ugaaaugaggucagagccugcag

SEQ ID NO: 2017852 - RNA, 21 nt, Human
ugaaaugaggucagagccugc

SEQ ID NO: 2017853 - RNA, 22 nt, Human
ugaaaugaggucagagccugca

SEQ ID NO: 2017854 - RNA, 19 nt, Human
ugaaaugaggucagagccu

SEQ ID NO: 2017855 - RNA, 20 nt, Human
ugaaaugaggucagagccug

SEQ ID NO: 2017856 - RNA, 13 nt, Human
ugaaaugaacaca

SEQ ID NO: 2017857 - RNA, 14 nt, Human
ugaaaugaacacaa

SEQ ID NO: 2017858 - RNA, 17 nt, Human
ugaaaugaacacaaauu

SEQ ID NO: 2017859 - RNA, 18 nt, Human
ugaaaugaacacaaauua

SEQ ID NO: 2017860 - RNA, 22 nt, Human
ugaaaugaacacaaauuaugcu

SEQ ID NO: 2017861 - RNA, 17 nt, Human
ugaaaucuuuuugcuuu

SEQ ID NO: 2017862 - RNA, 18 nt, Human
ugaaaggcaaacauuuga

SEQ ID NO: 2017863 - RNA, 15 nt, Human
ugaaaucauucauuu

SEQ ID NO: 2017864 - RNA, 22 nt, Human
ugaaauccuggguuuucuuaac

SEQ ID NO: 2017865 - RNA, 15 nt, Human
ugaaagggcccagag

SEQ ID NO: 2017866 - RNA, 16 nt, Human
ugaaagggcccagaga

SEQ ID NO: 2017867 - RNA, 17 nt, Human
ugaaagggcccagagag

SEQ ID NO: 2017868 - RNA, 18 nt, Human
ugaaagggcccagagagg

SEQ ID NO: 2017869 - RNA, 13 nt, Human
ugaaaagaggugu

SEQ ID NO: 2017870 - RNA, 16 nt, Human
ugaaaagagacaggca

SEQ ID NO: 2017871 - RNA, 22 nt, Human
ugaaaagaggugugcaagagag

SEQ ID NO: 2017872 - RNA, 18 nt, Human
ugaaacccugucucuacu

SEQ ID NO: 2017873 - RNA, 22 nt, Human
ugaaagauggcugugccucugc

SEQ ID NO: 2017874 - RNA, 23 nt, Human
ugaaagauggcugugccucugcc

SEQ ID NO: 2017875 - RNA, 21 nt, Human
ugaaagauggcugugccucug

SEQ ID NO: 2017876 - RNA, 18 nt, Human
ugaaaccuaguacugccc

SEQ ID NO: 2017877 - RNA, 19 nt, Human
ugaaaccuaguacugcccc

SEQ ID NO: 2017878 - RNA, 18 nt, Human
ugaaagcagggacuugaa

SEQ ID NO: 2017879 - RNA, 19 nt, Human
ugaaagcagggacuugaac

SEQ ID NO: 2017880 - RNA, 23 nt, Human
ugaaagcagggacuugaacccau

SEQ ID NO: 2017881 - RNA, 17 nt, Human
ugaaaggaaagaggcuc

SEQ ID NO: 2017882 - RNA, 17 nt, Human
ugaaaggaauuuugcua

SEQ ID NO: 2017883 - RNA, 22 nt, Human
ugaaaggaauuuugcuaaguaa

SEQ ID NO: 2017884 - RNA, 13 nt, Human
ugaaagauucaau

SEQ ID NO: 2017885 - RNA, 12 nt, Human
ugaaaggaaaga

SEQ ID NO: 2017886 - RNA, 19 nt, Human
ugaaaacuuuaugcuaagu

SEQ ID NO: 2017887 - RNA, 16 nt, Human
ugaaaacuaaguucuc

SEQ ID NO: 2017888 - RNA, 15 nt, Human
ugaaaagaaaaauga

SEQ ID NO: 2017889 - RNA, 13 nt, Human
ugaaaacuuugua

SEQ ID NO: 2017890 - RNA, 16 nt, Human
ugaaaacuuuguagua

SEQ ID NO: 2017891 - RNA, 15 nt, Human
ucuuuuucuggacuc

SEQ ID NO: 2017892 - RNA, 16 nt, Human
ucuuuuugcuuugcuu

SEQ ID NO: 2017893 - RNA, 14 nt, Human
ucuuuuugaaucuu

SEQ ID NO: 2017894 - RNA, 14 nt, Human
ucuuuuugaaaugu

SEQ ID NO: 2017895 - RNA, 13 nt, Human
ucuuuuuuacaaa

SEQ ID NO: 2017896 - RNA, 18 nt, Human
ucuuuuuuacaaaggcug

SEQ ID NO: 2017897 - RNA, 19 nt, Human
ucuuuuuuacaaaggcugu

SEQ ID NO: 2017898 - RNA, 17 nt, Human
ucuuuuugcucuaaaau

SEQ ID NO: 2017899 - RNA, 20 nt, Human
ucuuuuugcucuaaaauauu

SEQ ID NO: 2017900 - RNA, 15 nt, Human
ucuuuuuuauuaauc

SEQ ID NO: 2017901 - RNA, 16 nt, Human
ucuuuuuuauuaauca

SEQ ID NO: 2017902 - RNA, 21 nt, Human
ucuuuuuuauuaaucacugug

SEQ ID NO: 2017903 - RNA, 24 nt, Human
ucuuuuuuauuaaucacuguguau

SEQ ID NO: 2017904 - RNA, 20 nt, Human
ucuuuugguuaugaauacuu

SEQ ID NO: 2017905 - RNA, 17 nt, Human
ucuuuugccguuauuaa

SEQ ID NO: 2017906 - RNA, 19 nt, Human
ucuuuugccguuauuaaaa

SEQ ID NO: 2017907 - RNA, 20 nt, Human
ucuuuucuuugccaucucug

SEQ ID NO: 2017908 - RNA, 19 nt, Human
ucuuuucugaaucuucuga

SEQ ID NO: 2017909 - RNA, 20 nt, Human
ucuuuucugaaucuucugaa

SEQ ID NO: 2017910 - RNA, 22 nt, Human
ucuuuucugaaucuucugaaac

SEQ ID NO: 2017911 - RNA, 18 nt, Human
ucuuuucuuugccaucuc

SEQ ID NO: 2017912 - RNA, 12 nt, Human
ucuuuucugaau

SEQ ID NO: 2017913 - RNA, 14 nt, Human
ucuuuucugaaucu

SEQ ID NO: 2017914 - RNA, 15 nt, Human
ucuuuucugaaucuu

SEQ ID NO: 2017915 - RNA, 18 nt, Human
ucuuuucugaaucuucug

SEQ ID NO: 2017916 - RNA, 22 nt, Human
ugaagacuuuucuuucagccaa

SEQ ID NO: 2017917 - RNA, 17 nt, Human
ugaagacuuuucuuuca

SEQ ID NO: 2017918 - RNA, 17 nt, Human
ugaagaccuaaccaggg

SEQ ID NO: 2017919 - RNA, 19 nt, Human
ugaagaccuaaccagggcc

SEQ ID NO: 2017920 - RNA, 22 nt, Human
ugaagaccuaaccagggccaga

SEQ ID NO: 2017921 - RNA, 23 nt, Human
ugaagaccuaaccagggccagaa

SEQ ID NO: 2017922 - RNA, 14 nt, Human
ugaagacuuuucuu

SEQ ID NO: 2017923 - RNA, 16 nt, Human
ugaacuuggaagcaca

SEQ ID NO: 2017924 - RNA, 15 nt, Human
ugaagacagcccgau

SEQ ID NO: 2017925 - RNA, 15 nt, Human
ugaagaccuaaccag

SEQ ID NO: 2017926 - RNA, 23 nt, Human
ugaagacagcccgauccuccccu

SEQ ID NO: 2017927 - RNA, 12 nt, Human
ugaacuugguuc

SEQ ID NO: 2017928 - RNA, 14 nt, Human
ugaacuuggcgcug

SEQ ID NO: 2017929 - RNA, 19 nt, Human
ugaacuggguacuugugga

SEQ ID NO: 2017930 - RNA, 16 nt, Human
ugaagacagagcuaca

SEQ ID NO: 2017931 - RNA, 14 nt, Human
ugaagacagagcua

SEQ ID NO: 2017932 - RNA, 22 nt, Human
ugaacuuguaaaggaauuuaaa

SEQ ID NO: 2017933 - RNA, 20 nt, Human
ugaaggagagcccuucauuu

SEQ ID NO: 2017934 - RNA, 18 nt, Human
ugaagaugggggccucuu

SEQ ID NO: 2017935 - RNA, 22 nt, Human
ugaagaugggggccucuuucag

SEQ ID NO: 2017936 - RNA, 15 nt, Human
ugaaggaugccaaga

SEQ ID NO: 2017937 - RNA, 20 nt, Human
ugaaggaggcuccaggcagc

SEQ ID NO: 2017938 - RNA, 21 nt, Human
ugaaggaggcuccaggcagca

SEQ ID NO: 2017939 - RNA, 22 nt, Human
ugaaggaggcuccaggcagcac

SEQ ID NO: 2017940 - RNA, 14 nt, Human
ugaaggaggccacc

SEQ ID NO: 2017941 - RNA, 16 nt, Human
ugaaggaggccaccuc

SEQ ID NO: 2017942 - RNA, 17 nt, Human
ugaaggaggccaccucc

SEQ ID NO: 2017943 - RNA, 18 nt, Human
ugaaggaggccaccuccu

SEQ ID NO: 2017944 - RNA, 20 nt, Human
ugaaggaggccaccuccuaa

SEQ ID NO: 2017945 - RNA, 21 nt, Human
ugaaggaggccaccuccuaaa

SEQ ID NO: 2017946 - RNA, 19 nt, Human
ugaaggaggcuccaggcag

SEQ ID NO: 2017947 - RNA, 20 nt, Human
ugaaggcucgagcaugccug

SEQ ID NO: 2017948 - RNA, 21 nt, Human
ugaaggcucgagcaugccugg

SEQ ID NO: 2017949 - RNA, 15 nt, Human
ugaacauacaaaugc

SEQ ID NO: 2017950 - RNA, 16 nt, Human
ugaacauacaaaugca

SEQ ID NO: 2017951 - RNA, 23 nt, Human
ugaacauacaaaugcaucuuuga

SEQ ID NO: 2017952 - RNA, 13 nt, Human
ugaacauguuuua

SEQ ID NO: 2017953 - RNA, 14 nt, Human
ugaacacauuucuu

SEQ ID NO: 2017954 - RNA, 12 nt, Human
ugaacacauuuc

SEQ ID NO: 2017955 - RNA, 12 nt, Human
ugaacacaaauu

SEQ ID NO: 2017956 - RNA, 14 nt, Human
ugaacacaaauuau

SEQ ID NO: 2017957 - RNA, 17 nt, Human
ugaacacaaauuaugcu

SEQ ID NO: 2017958 - RNA, 19 nt, Human
ugaaauggacuuuuguaca

SEQ ID NO: 2017959 - RNA, 16 nt, Human
ugaaaugcugaaaauu

SEQ ID NO: 2017960 - RNA, 17 nt, Human
ugaaaugcugaaaauug

SEQ ID NO: 2017961 - RNA, 19 nt, Human
ugaaaugcugaaaauugcc

SEQ ID NO: 2017962 - RNA, 17 nt, Human
ugaaaugcuaugucauu

SEQ ID NO: 2017963 - RNA, 18 nt, Human
ugaaaugcuaugucauuu

SEQ ID NO: 2017964 - RNA, 20 nt, Human
ugaaaugcuaugucauuuca

SEQ ID NO: 2017965 - RNA, 21 nt, Human
ugaaaugcuaugucauuucau

SEQ ID NO: 2017966 - RNA, 22 nt, Human
ugaaaugcuaugucauuucaug

SEQ ID NO: 2017967 - RNA, 15 nt, Human
ugaaaugcugaaaau

SEQ ID NO: 2017968 - RNA, 12 nt, Human
ugaacugagcuu

SEQ ID NO: 2017969 - RNA, 15 nt, Human
ugaacugagcuugga

SEQ ID NO: 2017970 - RNA, 13 nt, Human
ugaacugauaaag

SEQ ID NO: 2017971 - RNA, 11 nt, Human
ugaacugaagg

SEQ ID NO: 2017972 - RNA, 17 nt, Human
ugaacugaacucugaca

SEQ ID NO: 2017973 - RNA, 19 nt, Human
ugaacugaacucugacaac

SEQ ID NO: 2017974 - RNA, 16 nt, Human
ugaacugagcuuggaa

SEQ ID NO: 2017975 - RNA, 15 nt, Human
ugaacugauaaagau

SEQ ID NO: 2017976 - RNA, 20 nt, Human
ugaaccacaucuugcucugc

SEQ ID NO: 2017977 - RNA, 21 nt, Human
ugaaccacaucuugcucugcu

SEQ ID NO: 2017978 - RNA, 15 nt, Human
ugaacucuucaaucu

SEQ ID NO: 2017979 - RNA, 22 nt, Human
ugaaccacaucuugcucugcug

SEQ ID NO: 2017980 - RNA, 12 nt, Human
ugaacugaaagu

SEQ ID NO: 2017981 - RNA, 14 nt, Human
ugaacugaacucug

SEQ ID NO: 2017982 - RNA, 18 nt, Human
ugaacucuucaaucucuu

SEQ ID NO: 2017983 - RNA, 14 nt, Human
ugaacucuucucau

SEQ ID NO: 2017984 - RNA, 18 nt, Human
ugaacucuucucauuacu

SEQ ID NO: 2017985 - RNA, 21 nt, Human
ugaacucuucucauuacuugu

SEQ ID NO: 2017986 - RNA, 20 nt, Human
ucggaaccugugagcugcac

SEQ ID NO: 2017987 - RNA, 19 nt, Human
ucgcccaggcuggagugca

SEQ ID NO: 2017988 - RNA, 14 nt, Human
ucgcccagucccag

SEQ ID NO: 2017989 - RNA, 17 nt, Human
ucgcccagucccagcag

SEQ ID NO: 2017990 - RNA, 18 nt, Human
ucgcccagucccagcagc

SEQ ID NO: 2017991 - RNA, 19 nt, Human
ucgcccagucccagcagcc

SEQ ID NO: 2017992 - RNA, 21 nt, Human
ucgcccagucccagcagccag

SEQ ID NO: 2017993 - RNA, 12 nt, Human
ucgcccaggcug

SEQ ID NO: 2017994 - RNA, 14 nt, Human
ucgcccaggcugga

SEQ ID NO: 2017995 - RNA, 17 nt, Human
ucgcaauguaagacucg

SEQ ID NO: 2017996 - RNA, 21 nt, Human
ucgcacucuggcagcaccgcc

SEQ ID NO: 2017997 - RNA, 19 nt, Human
ucgcacucuggcagcaccg

SEQ ID NO: 2017998 - RNA, 13 nt, Human
ucgagucugaggc

SEQ ID NO: 2017999 - RNA, 22 nt, Human
uccuuuuuauuuauauguaugu

SEQ ID NO: 2018000 - RNA, 23 nt, Human
uccuuuuuauuuauauguaugug

SEQ ID NO: 2018001 - RNA, 17 nt, Human
ucgaguuacagacaaag

SEQ ID NO: 2018002 - RNA, 16 nt, Human
ucgaguggcccaacag

SEQ ID NO: 2018003 - RNA, 17 nt, Human
ucgaguuacagccuggg

SEQ ID NO: 2018004 - RNA, 15 nt, Human
ucgaguuacagacaa

SEQ ID NO: 2018005 - RNA, 14 nt, Human
ucgagugagacaga

SEQ ID NO: 2018006 - RNA, 23 nt, Human
ucgagugagacagacuagaaguu

SEQ ID NO: 2018007 - RNA, 14 nt, Human
ucgagucugaggcc

SEQ ID NO: 2018008 - RNA, 20 nt, Human
ucgagugccgcaucucacag

SEQ ID NO: 2018009 - RNA, 22 nt, Human
ucgagugccgcaucucacagcu

SEQ ID NO: 2018010 - RNA, 23 nt, Human
ucgagugccgcaucucacagcua

SEQ ID NO: 2018011 - RNA, 14 nt, Human
uccuuuuggaguca

SEQ ID NO: 2018012 - RNA, 23 nt, Human
uccuuuuggagucagacagaugu

SEQ ID NO: 2018013 - RNA, 13 nt, Human
uccuuuuuauuua

SEQ ID NO: 2018014 - RNA, 14 nt, Human
uccuuuuuauuuau

SEQ ID NO: 2018015 - RNA, 15 nt, Human
uccuuuuuauuuaua

SEQ ID NO: 2018016 - RNA, 18 nt, Human
uccuuuuuauuuauaugu

SEQ ID NO: 2018017 - RNA, 12 nt, Human
uccuuuuguguu

SEQ ID NO: 2018018 - RNA, 13 nt, Human
uccuuuuguguuc

SEQ ID NO: 2018019 - RNA, 16 nt, Human
uccuuuuguguuccaa

SEQ ID NO: 2018020 - RNA, 19 nt, Human
uccuuuuguguuccaaaca

SEQ ID NO: 2018021 - RNA, 17 nt, Human
uccugucaucugagaau

SEQ ID NO: 2018022 - RNA, 15 nt, Human
uccuuacaaaugauu

SEQ ID NO: 2018023 - RNA, 16 nt, Human
uccuuacaaaugauug

SEQ ID NO: 2018024 - RNA, 18 nt, Human
uccuuacaaaugauugcu

SEQ ID NO: 2018025 - RNA, 20 nt, Human
uccuuacaaaugauugcuuu

SEQ ID NO: 2018026 - RNA, 19 nt, Human
uccugucaagcaaucaaga

SEQ ID NO: 2018027 - RNA, 15 nt, Human
uccugucaucugaga

SEQ ID NO: 2018028 - RNA, 14 nt, Human
uccuuaccagcaga

SEQ ID NO: 2018029 - RNA, 16 nt, Human
uccuucaaagcaaaug

SEQ ID NO: 2018030 - RNA, 15 nt, Human
uccuuacauaaacau

SEQ ID NO: 2018031 - RNA, 17 nt, Human
uccuuaugcuugggccu

SEQ ID NO: 2018032 - RNA, 21 nt, Human
uccuucaacaaggcuugcugc

SEQ ID NO: 2018033 - RNA, 21 nt, Human
uccuuauggguagggcucuga

SEQ ID NO: 2018034 - RNA, 20 nt, Human
uccuucaacaaggcuugcug

SEQ ID NO: 2018035 - RNA, 19 nt, Human
uccuucaacaaggcuugcu

SEQ ID NO: 2018036 - RNA, 12 nt, Human
uccuucuguccu

SEQ ID NO: 2018037 - RNA, 19 nt, Human
uccuucuguccuacucugu

SEQ ID NO: 2018038 - RNA, 13 nt, Human
uccuucugggcau

SEQ ID NO: 2018039 - RNA, 14 nt, Human
uccuggucgaaagu

SEQ ID NO: 2018040 - RNA, 17 nt, Human
uccuggcccacugcauc

SEQ ID NO: 2018041 - RNA, 22 nt, Human
uccuggcaugggaaugaauguc

SEQ ID NO: 2018042 - RNA, 10 nt, Human
ucccucccuu

SEQ ID NO: 2018043 - RNA, 15 nt, Human
uccugguguggaaga

SEQ ID NO: 2018044 - RNA, 19 nt, Human
uccuguaggaguucuauuu

SEQ ID NO: 2018045 - RNA, 17 nt, Human
ucuacacuccagugaga

SEQ ID NO: 2018046 - RNA, 14 nt, Human
ucuacacugugcug

SEQ ID NO: 2018047 - RNA, 12 nt, Human
ucuacacugugc

SEQ ID NO: 2018048 - RNA, 19 nt, Human
ucuacugaggugcuauguu

SEQ ID NO: 2018049 - RNA, 18 nt, Human
ucuacugaggugcuaugu

SEQ ID NO: 2018050 - RNA, 15 nt, Human
ucuacacugugcuga

SEQ ID NO: 2018051 - RNA, 21 nt, Human
ucuacacugugcugagucuga

SEQ ID NO: 2018052 - RNA, 22 nt, Human
ucuagggaaaaaccagcgugug

SEQ ID NO: 2018053 - RNA, 16 nt, Human
ucuagaauuuuaagcc

SEQ ID NO: 2018054 - RNA, 19 nt, Human
ucuagggaaaaaccagcgu

SEQ ID NO: 2018055 - RNA, 17 nt, Human
ucuagggaccagaacca

SEQ ID NO: 2018056 - RNA, 22 nt, Human
ucuacugaggugcuauguucuu

SEQ ID NO: 2018057 - RNA, 24 nt, Human
ucuacugcauuuagggaguauucu

SEQ ID NO: 2018058 - RNA, 22 nt, Human
ucuaacuucaccauauuaccac

SEQ ID NO: 2018059 - RNA, 15 nt, Human
ucuaacuucaccaua

SEQ ID NO: 2018060 - RNA, 16 nt, Human
ucuaacuucaccauau

SEQ ID NO: 2018061 - RNA, 16 nt, Human
ucuaaauucuuucauu

SEQ ID NO: 2018062 - RNA, 22 nt, Human
ucuaaaucuccaaaauaaaacu

SEQ ID NO: 2018063 - RNA, 14 nt, Human
ucuaaaucugucca

SEQ ID NO: 2018064 - RNA, 21 nt, Human
ucuaaaucuguccaacugaga

SEQ ID NO: 2018065 - RNA, 21 nt, Human
ucucagaaucucaaauaacua

SEQ ID NO: 2018066 - RNA, 17 nt, Human
ucucagaaucucaaaua

SEQ ID NO: 2018067 - RNA, 18 nt, Human
ucucacuguugcccaggc

SEQ ID NO: 2018068 - RNA, 19 nt, Human
ucucacuguugcccaggcu

SEQ ID NO: 2018069 - RNA, 20 nt, Human
ucucacuguugcccaggcug

SEQ ID NO: 2018070 - RNA, 21 nt, Human
ucucacuguugcccaggcugg

SEQ ID NO: 2018071 - RNA, 18 nt, Human
ucucacucugucgcccag

SEQ ID NO: 2018072 - RNA, 22 nt, Human
ucucacucugucgcccagucug

SEQ ID NO: 2018073 - RNA, 17 nt, Human
ucucacucugucgccca

SEQ ID NO: 2018074 - RNA, 22 nt, Human
ucucaaacucuugaccucaggu

SEQ ID NO: 2018075 - RNA, 13 nt, Human
ucucaaacucuug

SEQ ID NO: 2018076 - RNA, 21 nt, Human
ucucaaacucuugaccucagg

SEQ ID NO: 2018077 - RNA, 22 nt, Human
ucucaacaaggcaaaaacaaag

SEQ ID NO: 2018078 - RNA, 14 nt, Human
ucucaacaugucuc

SEQ ID NO: 2018079 - RNA, 18 nt, Human
ucucaacaugucuccuac

SEQ ID NO: 2018080 - RNA, 15 nt, Human
ucuaguaauaaagac

SEQ ID NO: 2018081 - RNA, 17 nt, Human
ucuaguaauaaagacuc

SEQ ID NO: 2018082 - RNA, 19 nt, Human
ucuaguaauaaagacucua

SEQ ID NO: 2018083 - RNA, 14 nt, Human
ucuaguacugugaa

SEQ ID NO: 2018084 - RNA, 15 nt, Human
ucuaguacugugaau

SEQ ID NO: 2018085 - RNA, 13 nt, Human
ucuaguacuguga

SEQ ID NO: 2018086 - RNA, 14 nt, Human
ucuaguaauauauu

SEQ ID NO: 2018087 - RNA, 21 nt, Human
ucuaguaauauauuuaaaggg

SEQ ID NO: 2018088 - RNA, 15 nt, Human
ucucucgugaguaua

SEQ ID NO: 2018089 - RNA, 12 nt, Human
ucucucuccaag

SEQ ID NO: 2018090 - RNA, 17 nt, Human
ucucucucaauuuuugg

SEQ ID NO: 2018091 - RNA, 21 nt, Human
ucucucuauuucccccuuucu

SEQ ID NO: 2018092 - RNA, 14 nt, Human
ucucuauuccccac

SEQ ID NO: 2018093 - RNA, 17 nt, Human
ucucuauuccccacccu

SEQ ID NO: 2018094 - RNA, 23 nt, Human
ucucuauuucccccuuucuuccu

SEQ ID NO: 2018095 - RNA, 22 nt, Human
ucucucuuguucuuacuuuccu

SEQ ID NO: 2018096 - RNA, 13 nt, Human
ucucugaggacac

SEQ ID NO: 2018097 - RNA, 15 nt, Human
ucucuacaaaaagca

SEQ ID NO: 2018098 - RNA, 13 nt, Human
ucuccuguaccuc

SEQ ID NO: 2018099 - RNA, 21 nt, Human
ucuccugcguguucucagagg

SEQ ID NO: 2018100 - RNA, 18 nt, Human
ucucuaguuugauuaaau

SEQ ID NO: 2018101 - RNA, 19 nt, Human
ucucuaguuugauuaaauu

SEQ ID NO: 2018102 - RNA, 22 nt, Human
ucucagugguuaagauuccuaa

SEQ ID NO: 2018103 - RNA, 21 nt, Human
ucucagugucaaugcagcccc

SEQ ID NO: 2018104 - RNA, 16 nt, Human
ucucaggucugaguug

SEQ ID NO: 2018105 - RNA, 15 nt, Human
ucucaggucccugca

SEQ ID NO: 2018106 - RNA, 17 nt, Human
ucucccccagccccauc

SEQ ID NO: 2018107 - RNA, 15 nt, Human
ucucccccagcccca

SEQ ID NO: 2018108 - RNA, 14 nt, Human
ucucccccagcccc

SEQ ID NO: 2018109 - RNA, 21 nt, Human
ucuccccuuccauuucugccu

SEQ ID NO: 2018110 - RNA, 20 nt, Human
ucucccccagccccauccuc

SEQ ID NO: 2018111 - RNA, 18 nt, Human
ucucccccagccccaucc

SEQ ID NO: 2018112 - RNA, 22 nt, Human
ucucccccagccccauccucug

SEQ ID NO: 2018113 - RNA, 22 nt, Human
ucuccugaaaaaagcaguucuu

SEQ ID NO: 2018114 - RNA, 22 nt, Human
ucuccucuugccacugccucuu

SEQ ID NO: 2018115 - RNA, 16 nt, Human
ucucccgggacucugc

SEQ ID NO: 2018116 - RNA, 22 nt, Human
ucuccugccucagccucccaaa

SEQ ID NO: 2018117 - RNA, 19 nt, Human
ucuccugcguguucucaga

SEQ ID NO: 2018118 - RNA, 14 nt, Human
ucugaaauuuccug

SEQ ID NO: 2018119 - RNA, 17 nt, Human
ucugaaauauaaagucu

SEQ ID NO: 2018120 - RNA, 13 nt, Human
ucugaaagggacg

SEQ ID NO: 2018121 - RNA, 14 nt, Human
ucugaaaauguaug

SEQ ID NO: 2018122 - RNA, 23 nt, Human
ucugaaaauguauguguaaguau

SEQ ID NO: 2018123 - RNA, 15 nt, Human
ucucuuuucaaaaca

SEQ ID NO: 2018124 - RNA, 16 nt, Human
ucucuuuucaaaacau

SEQ ID NO: 2018125 - RNA, 14 nt, Human
ucucuuuucaagaa

SEQ ID NO: 2018126 - RNA, 16 nt, Human
ucugaaaauguaugug

SEQ ID NO: 2018127 - RNA, 21 nt, Human
ucucuuuuugcccccucuccu

SEQ ID NO: 2018128 - RNA, 11 nt, Human
ucucugcaggu

SEQ ID NO: 2018129 - RNA, 18 nt, Human
ucucuucacagucacauu

SEQ ID NO: 2018130 - RNA, 23 nt, Human
ucucuuccaaccauuuaucuuga

SEQ ID NO: 2018131 - RNA, 15 nt, Human
ucucuuccaggcagc

SEQ ID NO: 2018132 - RNA, 16 nt, Human
ucucuuccaggcagcc

SEQ ID NO: 2018133 - RNA, 18 nt, Human
ucucuuccaggcagccgc

SEQ ID NO: 2018134 - RNA, 12 nt, Human
ucucuuugaaac

SEQ ID NO: 2018135 - RNA, 14 nt, Human
ucucuuugaaacau

SEQ ID NO: 2018136 - RNA, 11 nt, Human
ucucuuugccc

SEQ ID NO: 2018137 - RNA, 13 nt, Human
ucucuucuccuua

SEQ ID NO: 2018138 - RNA, 14 nt, Human
ucucuucucugcca

SEQ ID NO: 2018139 - RNA, 18 nt, Human
ucucuucuccccuuccau

SEQ ID NO: 2018140 - RNA, 21 nt, Human
ucucuucuccccuuccauuuc

SEQ ID NO: 2018141 - RNA, 11 nt, Human
ucucuucuccu

SEQ ID NO: 2018142 - RNA, 12 nt, Human
ucucuucuccuu

SEQ ID NO: 2018143 - RNA, 13 nt, Human
ucucuucuccacu

SEQ ID NO: 2018144 - RNA, 14 nt, Human
ucucuucuccacug

SEQ ID NO: 2018145 - RNA, 15 nt, Human
ucucuucuccacugg

SEQ ID NO: 2018146 - RNA, 16 nt, Human
ucucuucuccacugga

SEQ ID NO: 2018147 - RNA, 11 nt, Human
ucucuucucca

SEQ ID NO: 2018148 - RNA, 20 nt, Human
ucugaacuuggcgcugcccc

SEQ ID NO: 2018149 - RNA, 21 nt, Human
ucugaacuuggcgcugccccu

SEQ ID NO: 2018150 - RNA, 14 nt, Human
ucugacccaugcug

SEQ ID NO: 2018151 - RNA, 18 nt, Human
ucugacccaugcugcccu

SEQ ID NO: 2018152 - RNA, 17 nt, Human
ucugacccaugcugccc

SEQ ID NO: 2018153 - RNA, 16 nt, Human
ucugacccaugcugcc

SEQ ID NO: 2018154 - RNA, 15 nt, Human
ucugacccaugcugc

SEQ ID NO: 2018155 - RNA, 20 nt, Human
ucugagcauuagauuucuca

SEQ ID NO: 2018156 - RNA, 22 nt, Human
ucugagcaagaggauuuugcgu

SEQ ID NO: 2018157 - RNA, 22 nt, Human
ucugagcauuagauuucucauu

SEQ ID NO: 2018158 - RNA, 16 nt, Human
ucugaggaauccagac

SEQ ID NO: 2018159 - RNA, 17 nt, Human
ucugaggaauccagacc

SEQ ID NO: 2018160 - RNA, 20 nt, Human
ucugaggacacuaaccacgc

SEQ ID NO: 2018161 - RNA, 23 nt, Human
ucugaggacacuaaccacgcugg

SEQ ID NO: 2018162 - RNA, 14 nt, Human
ucugaggacaagag

SEQ ID NO: 2018163 - RNA, 17 nt, Human
ucugaggacaagagaaa

SEQ ID NO: 2018164 - RNA, 17 nt, Human
ucugagcuuacguaguu

SEQ ID NO: 2018165 - RNA, 16 nt, Human
ucugagcuggccucuc

SEQ ID NO: 2018166 - RNA, 22 nt, Human
ucugagcuggccucucacugcc

SEQ ID NO: 2018167 - RNA, 19 nt, Human
ucugagcuuacguaguucu

SEQ ID NO: 2018168 - RNA, 23 nt, Human
ucugauucccaagcucugcuccu

SEQ ID NO: 2018169 - RNA, 18 nt, Human
ucugaggacaagagaaaa

SEQ ID NO: 2018170 - RNA, 14 nt, Human
ucugcacaagcugc

SEQ ID NO: 2018171 - RNA, 19 nt, Human
ucugcacaagcugcacccu

SEQ ID NO: 2018172 - RNA, 15 nt, Human
uccauggacuuuguu

SEQ ID NO: 2018173 - RNA, 14 nt, Human
uccauggacuuugu

SEQ ID NO: 2018174 - RNA, 23 nt, Human
uccauggcgaaaacaucuccuua

SEQ ID NO: 2018175 - RNA, 13 nt, Human
uccauggacuuug

SEQ ID NO: 2018176 - RNA, 21 nt, Human
ucccaaagugcugggauuaca

SEQ ID NO: 2018177 - RNA, 19 nt, Human
uccauggggucucucacag

SEQ ID NO: 2018178 - RNA, 22 nt, Human
uccauggggucucucacagaca

SEQ ID NO: 2018179 - RNA, 23 nt, Human
uccauggggucucucacagacag

SEQ ID NO: 2018180 - RNA, 21 nt, Human
uccauggguuccaguuucaga

SEQ ID NO: 2018181 - RNA, 23 nt, Human
uccagcucaccagccccagugcc

SEQ ID NO: 2018182 - RNA, 16 nt, Human
uccauccaggccauuc

SEQ ID NO: 2018183 - RNA, 20 nt, Human
ucccaaaugugugcccagcu

SEQ ID NO: 2018184 - RNA, 21 nt, Human
ucccaaaugugugcccagcuu

SEQ ID NO: 2018185 - RNA, 13 nt, Human
ucccaacucaccc

SEQ ID NO: 2018186 - RNA, 19 nt, Human
uccauguagccuuuaauau

SEQ ID NO: 2018187 - RNA, 15 nt, Human
uccauguaugcauaa

SEQ ID NO: 2018188 - RNA, 20 nt, Human
uccauguaugcauaauaauc

SEQ ID NO: 2018189 - RNA, 15 nt, Human
ucccaacucacccca

SEQ ID NO: 2018190 - RNA, 14 nt, Human
ucccaacucacccc

SEQ ID NO: 2018191 - RNA, 16 nt, Human
ucccaacucaccccag

SEQ ID NO: 2018192 - RNA, 17 nt, Human
ucccaagcucugcuccu

SEQ ID NO: 2018193 - RNA, 18 nt, Human
ucccaaggcucugagcaa

SEQ ID NO: 2018194 - RNA, 12 nt, Human
ucccaagcucug

SEQ ID NO: 2018195 - RNA, 13 nt, Human
ucccaagcucugc

SEQ ID NO: 2018196 - RNA, 14 nt, Human
ucccaagcucugcu

SEQ ID NO: 2018197 - RNA, 15 nt, Human
ucccaagcucugcuc

SEQ ID NO: 2018198 - RNA, 22 nt, Human
ucccaggcauuccccaggaggc

SEQ ID NO: 2018199 - RNA, 20 nt, Human
ucccaggcgccccuuccccc

SEQ ID NO: 2018200 - RNA, 18 nt, Human
ucccaggcgccccuuccc

SEQ ID NO: 2018201 - RNA, 21 nt, Human
ucccaggcgccccuucccccu

SEQ ID NO: 2018202 - RNA, 15 nt, Human
ucccaggcugagccu

SEQ ID NO: 2018203 - RNA, 13 nt, Human
ucccaggagccug

SEQ ID NO: 2018204 - RNA, 17 nt, Human
ucccaggagccugccca

SEQ ID NO: 2018205 - RNA, 18 nt, Human
ucccaggagccugcccag

SEQ ID NO: 2018206 - RNA, 21 nt, Human
ucccaggcauuccccaggagg

SEQ ID NO: 2018207 - RNA, 20 nt, Human
ucccaggcauuccccaggag

SEQ ID NO: 2018208 - RNA, 13 nt, Human
ucccaccucagcc

SEQ ID NO: 2018209 - RNA, 22 nt, Human
ucccaaggcucugagcaaaugu

SEQ ID NO: 2018210 - RNA, 16 nt, Human
ucccaagguucugggu

SEQ ID NO: 2018211 - RNA, 14 nt, Human
ucccaccucagccu

SEQ ID NO: 2018212 - RNA, 15 nt, Human
ucccaccucagccuc

SEQ ID NO: 2018213 - RNA, 20 nt, Human
ucccaucucacacaugagca

SEQ ID NO: 2018214 - RNA, 16 nt, Human
ucccaggcugagccuc

SEQ ID NO: 2018215 - RNA, 18 nt, Human
ucccaggcugagccucag

SEQ ID NO: 2018216 - RNA, 21 nt, Human
ucccaggcucucaacagggga

SEQ ID NO: 2018217 - RNA, 23 nt, Human
ucccaucucacacaugagcauca

SEQ ID NO: 2018218 - RNA, 12 nt, Human
ucccaugcccug

SEQ ID NO: 2018219 - RNA, 11 nt, Human
ucccauggugc

SEQ ID NO: 2018220 - RNA, 22 nt, Human
uccccagacuccaccaagccug

SEQ ID NO: 2018221 - RNA, 21 nt, Human
uccccagaacucugccugccc

SEQ ID NO: 2018222 - RNA, 17 nt, Human
uccccagaacucugccu

SEQ ID NO: 2018223 - RNA, 19 nt, Human
uccccagaacucugccugc

SEQ ID NO: 2018224 - RNA, 22 nt, Human
uccccacuugagaauuacccuu

SEQ ID NO: 2018225 - RNA, 16 nt, Human
ucccccuccaccugcu

SEQ ID NO: 2018226 - RNA, 17 nt, Human
ucccccaucucuucugg

SEQ ID NO: 2018227 - RNA, 14 nt, Human
ucccccucccccag

SEQ ID NO: 2018228 - RNA, 21 nt, Human
ucccccucccccagccacucc

SEQ ID NO: 2018229 - RNA, 13 nt, Human
ucccccucuggcu

SEQ ID NO: 2018230 - RNA, 13 nt, Human
ucccccugcccca

SEQ ID NO: 2018231 - RNA, 13 nt, Human
uccccaggaggcc

SEQ ID NO: 2018232 - RNA, 16 nt, Human
ucccccaguccccuuc

SEQ ID NO: 2018233 - RNA, 21 nt, Human
ucccccuuccauggacuuugu

SEQ ID NO: 2018234 - RNA, 11 nt, Human
ucccccuuucu

SEQ ID NO: 2018235 - RNA, 15 nt, Human
ucccccuuucuuccu

SEQ ID NO: 2018236 - RNA, 16 nt, Human
ucccccuuucuuccuc

SEQ ID NO: 2018237 - RNA, 21 nt, Human
ucccccuuucuuccucauucc

SEQ ID NO: 2018238 - RNA, 20 nt, Human
uccccgcacugggcuugggg

SEQ ID NO: 2018239 - RNA, 13 nt, Human
uccccugcuccug

SEQ ID NO: 2018240 - RNA, 21 nt, Human
uccccugcuggguguggcgca

SEQ ID NO: 2018241 - RNA, 20 nt, Human
uccccugcuggguguggcgc

SEQ ID NO: 2018242 - RNA, 15 nt, Human
uccccugcugggugu

SEQ ID NO: 2018243 - RNA, 14 nt, Human
uccccugcugggug

SEQ ID NO: 2018244 - RNA, 23 nt, Human
uccccuguccccgcacugggcuu

SEQ ID NO: 2018245 - RNA, 22 nt, Human
uccccuguagagugggagcuga

SEQ ID NO: 2018246 - RNA, 15 nt, Human
uccccuguucacucu

SEQ ID NO: 2018247 - RNA, 19 nt, Human
uccccugugccagcccaga

SEQ ID NO: 2018248 - RNA, 20 nt, Human
uccccugugccagcccagag

SEQ ID NO: 2018249 - RNA, 17 nt, Human
uccccugugccagccca

SEQ ID NO: 2018250 - RNA, 19 nt, Human
uccccuguagagugggagc

SEQ ID NO: 2018251 - RNA, 20 nt, Human
uccccuggaagcagugccca

SEQ ID NO: 2018252 - RNA, 21 nt, Human
uccccuggaagcagugcccag

SEQ ID NO: 2018253 - RNA, 22 nt, Human
uccccuggaagcagugcccagg

SEQ ID NO: 2018254 - RNA, 23 nt, Human
uccccuggaagcagugcccaggu

SEQ ID NO: 2018255 - RNA, 24 nt, Human
uccccugcuggguguggcgcagca

SEQ ID NO: 2018256 - RNA, 17 nt, Human
uccccuggaagcagugc

SEQ ID NO: 2018257 - RNA, 19 nt, Human
uccccuggaagcagugccc

SEQ ID NO: 2018258 - RNA, 13 nt, Human
uccccugcuggcc

SEQ ID NO: 2018259 - RNA, 15 nt, Human
ucccucccucuuucc

SEQ ID NO: 2018260 - RNA, 15 nt, Human
ucccuacuuccugug

SEQ ID NO: 2018261 - RNA, 16 nt, Human
ucccuacuuccuguga

SEQ ID NO: 2018262 - RNA, 17 nt, Human
ucccucccucuuucccu

SEQ ID NO: 2018263 - RNA, 12 nt, Human
ucccucccugcu

SEQ ID NO: 2018264 - RNA, 16 nt, Human
ucccucccugcuguca

SEQ ID NO: 2018265 - RNA, 15 nt, Human
ucccuacuguaauuu

SEQ ID NO: 2018266 - RNA, 13 nt, Human
ucccuaauaaagc

SEQ ID NO: 2018267 - RNA, 12 nt, Human
ucccuaauaaag

SEQ ID NO: 2018268 - RNA, 11 nt, Human
ucccuaauaaa

SEQ ID NO: 2018269 - RNA, 11 nt, Human
uccccuuccuu

SEQ ID NO: 2018270 - RNA, 19 nt, Human
uccccuuccuaccacccgg

SEQ ID NO: 2018271 - RNA, 21 nt, Human
uccccuuccuaauuccacagc

SEQ ID NO: 2018272 - RNA, 15 nt, Human
uccccuuccauuucu

SEQ ID NO: 2018273 - RNA, 12 nt, Human
uccccuucccag

SEQ ID NO: 2018274 - RNA, 16 nt, Human
uccccuuccccuuccu

SEQ ID NO: 2018275 - RNA, 18 nt, Human
uccccuuccccuuccuuc

SEQ ID NO: 2018276 - RNA, 22 nt, Human
uccccuuccuaauuccacagcu

SEQ ID NO: 2018277 - RNA, 18 nt, Human
uccccuucccgugaccug

SEQ ID NO: 2018278 - RNA, 16 nt, Human
uccccuuccuaccacc

SEQ ID NO: 2018279 - RNA, 12 nt, Human
uccaaagcagag

SEQ ID NO: 2018280 - RNA, 15 nt, Human
uccaaagcagagagc

SEQ ID NO: 2018281 - RNA, 17 nt, Human
uccaaagccaaugugaa

SEQ ID NO: 2018282 - RNA, 20 nt, Human
uccaagaagcccaggaaagg

SEQ ID NO: 2018283 - RNA, 14 nt, Human
uccaagaauuucua

SEQ ID NO: 2018284 - RNA, 22 nt, Human
uccaagaagcccaggaaaggcu

SEQ ID NO: 2018285 - RNA, 13 nt, Human
uccaagcaaaugu

SEQ ID NO: 2018286 - RNA, 19 nt, Human
uccaagaccuucuccuuca

SEQ ID NO: 2018287 - RNA, 16 nt, Human
uccaaacuggaaugag

SEQ ID NO: 2018288 - RNA, 17 nt, Human
uccaaacuggaaugagc

SEQ ID NO: 2018289 - RNA, 16 nt, Human
uccaaaauaaaacuuu

SEQ ID NO: 2018290 - RNA, 17 nt, Human
uccaaaauaaaacuuuu

SEQ ID NO: 2018291 - RNA, 19 nt, Human
uccaaacuaccuuccaguu

SEQ ID NO: 2018292 - RNA, 22 nt, Human
ucauucagauaugauucaaaug

SEQ ID NO: 2018293 - RNA, 24 nt, Human
ucauucaccaguacauucucaguu

SEQ ID NO: 2018294 - RNA, 20 nt, Human
ucauucauauuacaauauuu

SEQ ID NO: 2018295 - RNA, 22 nt, Human
ucauucauauuacaauauuugu

SEQ ID NO: 2018296 - RNA, 14 nt, Human
ucauucagcaucug

SEQ ID NO: 2018297 - RNA, 12 nt, Human
ucauucauauua

SEQ ID NO: 2018298 - RNA, 15 nt, Human
ucauucauauuacaa

SEQ ID NO: 2018299 - RNA, 19 nt, Human
ucauucauauuacaauauu

SEQ ID NO: 2018300 - RNA, 12 nt, Human
ucauuucugauu

SEQ ID NO: 2018301 - RNA, 14 nt, Human
uccaccuacaugag

SEQ ID NO: 2018302 - RNA, 15 nt, Human
uccaccguccccucc

SEQ ID NO: 2018303 - RNA, 14 nt, Human
uccaccguccccuc

SEQ ID NO: 2018304 - RNA, 12 nt, Human
uccaccugccag

SEQ ID NO: 2018305 - RNA, 14 nt, Human
uccacaagagccca

SEQ ID NO: 2018306 - RNA, 14 nt, Human
uccacaacacacag

SEQ ID NO: 2018307 - RNA, 17 nt, Human
uccagcaggagggacag

SEQ ID NO: 2018308 - RNA, 22 nt, Human
uccagcaggagggacagucuca

SEQ ID NO: 2018309 - RNA, 12 nt, Human
uccagcaggccc

SEQ ID NO: 2018310 - RNA, 13 nt, Human
uccagcaggccca

SEQ ID NO: 2018311 - RNA, 15 nt, Human
uccagcaggcccaug

SEQ ID NO: 2018312 - RNA, 22 nt, Human
uccagcaggcccaugggaggcu

SEQ ID NO: 2018313 - RNA, 23 nt, Human
uccagccaaagccuccuccagcc

SEQ ID NO: 2018314 - RNA, 12 nt, Human
uccagcaggagg

SEQ ID NO: 2018315 - RNA, 12 nt, Human
uccacuuggucu

SEQ ID NO: 2018316 - RNA, 13 nt, Human
uccacuuggucug

SEQ ID NO: 2018317 - RNA, 13 nt, Human
uccaccugccagg

SEQ ID NO: 2018318 - RNA, 13 nt, Human
uccaccucuggga

SEQ ID NO: 2018319 - RNA, 16 nt, Human
uccagaacucuuccuc

SEQ ID NO: 2018320 - RNA, 18 nt, Human
uccagaacucuuccucca

SEQ ID NO: 2018321 - RNA, 14 nt, Human
uccacuuggucugu

SEQ ID NO: 2018322 - RNA, 16 nt, Human
uccagaaaugucccuu

SEQ ID NO: 2018323 - RNA, 19 nt, Human
uccagaaaugucccuuucu

SEQ ID NO: 2018324 - RNA, 20 nt, Human
uccagaaaugucccuuucuu

SEQ ID NO: 2018325 - RNA, 22 nt, Human
uccagaaaugucccuuucuucu

SEQ ID NO: 2018326 - RNA, 21 nt, Human
ucaucucuagggaccagaacc

SEQ ID NO: 2018327 - RNA, 22 nt, Human
ucaucucuagggaccagaacca

SEQ ID NO: 2018328 - RNA, 16 nt, Human
ucaucuguaagcuguu

SEQ ID NO: 2018329 - RNA, 11 nt, Human
ucaucuguaag

SEQ ID NO: 2018330 - RNA, 15 nt, Human
ucauacccaccccca

SEQ ID NO: 2018331 - RNA, 14 nt, Human
ucauacccaccccc

SEQ ID NO: 2018332 - RNA, 20 nt, Human
ucauacccacccccacccaa

SEQ ID NO: 2018333 - RNA, 21 nt, Human
ucauacccacccccacccaag

SEQ ID NO: 2018334 - RNA, 19 nt, Human
ucaugcuccccugugccag

SEQ ID NO: 2018335 - RNA, 16 nt, Human
ucauuaggugugacug

SEQ ID NO: 2018336 - RNA, 23 nt, Human
ucauucaccaguacauucucagu

SEQ ID NO: 2018337 - RNA, 18 nt, Human
ucauuaggugugacugaa

SEQ ID NO: 2018338 - RNA, 21 nt, Human
ucauuaggugugacugaauuu

SEQ ID NO: 2018339 - RNA, 22 nt, Human
ucauuaggugugacugaauuuc

SEQ ID NO: 2018340 - RNA, 13 nt, Human
ucauaaugacuua

SEQ ID NO: 2018341 - RNA, 15 nt, Human
ucaguuacucuucag

SEQ ID NO: 2018342 - RNA, 19 nt, Human
ucaguuaugacauccacaa

SEQ ID NO: 2018343 - RNA, 23 nt, Human
ucaguuauugucccuggcuuccu

SEQ ID NO: 2018344 - RNA, 12 nt, Human
ucaguucaaagu

SEQ ID NO: 2018345 - RNA, 13 nt, Human
ucaguucaaaguc

SEQ ID NO: 2018346 - RNA, 16 nt, Human
ucaguucaaagucaug

SEQ ID NO: 2018347 - RNA, 20 nt, Human
ucaguucaaagucaugaugu

SEQ ID NO: 2018348 - RNA, 21 nt, Human
ucaguucaaagucaugauguu

SEQ ID NO: 2018349 - RNA, 22 nt, Human
ucaguucaaagucaugauguuu

SEQ ID NO: 2018350 - RNA, 17 nt, Human
ucaguuguuaguguguc

SEQ ID NO: 2018351 - RNA, 15 nt, Human
ucauaauuauuauuu

SEQ ID NO: 2018352 - RNA, 13 nt, Human
ucauacccacccc

SEQ ID NO: 2018353 - RNA, 17 nt, Human
ucagugugacugaucuc

SEQ ID NO: 2018354 - RNA, 13 nt, Human
ucagugugacuga

SEQ ID NO: 2018355 - RNA, 11 nt, Human
ucaguguacau

SEQ ID NO: 2018356 - RNA, 18 nt, Human
ucaguguacacucugagu

SEQ ID NO: 2018357 - RNA, 23 nt, Human
ucagugguuggcaauuguuucaa

SEQ ID NO: 2018358 - RNA, 15 nt, Human
ucagucuggcccuuc

SEQ ID NO: 2018359 - RNA, 20 nt, Human
ucaguggggcccauggaugu

SEQ ID NO: 2018360 - RNA, 24 nt, Human
ucagucugauucccaagcucugcu

SEQ ID NO: 2018361 - RNA, 20 nt, Human
ucacgccuguaauccuagca

SEQ ID NO: 2018362 - RNA, 16 nt, Human
ucacgcuccuuucuga

SEQ ID NO: 2018363 - RNA, 19 nt, Human
ucacgccuguaauccuagc

SEQ ID NO: 2018364 - RNA, 16 nt, Human
ucacgccacugcacua

SEQ ID NO: 2018365 - RNA, 13 nt, Human
ucacgccacugca

SEQ ID NO: 2018366 - RNA, 14 nt, Human
ucacgccacugcac

SEQ ID NO: 2018367 - RNA, 18 nt, Human
ucaccuuuguccccaccg

SEQ ID NO: 2018368 - RNA, 17 nt, Human
ucaccuuuguccccacc

SEQ ID NO: 2018369 - RNA, 15 nt, Human
ucaccuuugucccca

SEQ ID NO: 2018370 - RNA, 14 nt, Human
ucaccuuugucccc

SEQ ID NO: 2018371 - RNA, 22 nt, Human
ucaccuuuguccccaccgcaga

SEQ ID NO: 2018372 - RNA, 16 nt, Human
ucacgagucauccaga

SEQ ID NO: 2018373 - RNA, 23 nt, Human
ucacagggacugaaaaccucucc

SEQ ID NO: 2018374 - RNA, 14 nt, Human
ucacaggcugggcu

SEQ ID NO: 2018375 - RNA, 18 nt, Human
ucacaggcugggcugggc

SEQ ID NO: 2018376 - RNA, 19 nt, Human
ucacaggcugggcugggca

SEQ ID NO: 2018377 - RNA, 20 nt, Human
ucacaggcugggcugggcac

SEQ ID NO: 2018378 - RNA, 19 nt, Human
ucacaggccccaggaaagg

SEQ ID NO: 2018379 - RNA, 12 nt, Human
ucacaggcaggu

SEQ ID NO: 2018380 - RNA, 15 nt, Human
ucacaggcaggucca

SEQ ID NO: 2018381 - RNA, 14 nt, Human
ucaccucacucagc

SEQ ID NO: 2018382 - RNA, 15 nt, Human
ucaccucacucagca

SEQ ID NO: 2018383 - RNA, 16 nt, Human
ucaccucacucagcac

SEQ ID NO: 2018384 - RNA, 18 nt, Human
ucaccucacucagcacca

SEQ ID NO: 2018385 - RNA, 19 nt, Human
ucaccucacucagcaccac

SEQ ID NO: 2018386 - RNA, 20 nt, Human
ucaccucacucagcaccacu

SEQ ID NO: 2018387 - RNA, 21 nt, Human
ucaccucacucagcaccacuc

SEQ ID NO: 2018388 - RNA, 23 nt, Human
ucaccucacucagcaccacucaa

SEQ ID NO: 2018389 - RNA, 12 nt, Human
ucaccuuugucc

SEQ ID NO: 2018390 - RNA, 14 nt, Human
ucaccuuucccauc

SEQ ID NO: 2018391 - RNA, 15 nt, Human
ucaccuugguuccug

SEQ ID NO: 2018392 - RNA, 17 nt, Human
ucaccuugguuccuggg

SEQ ID NO: 2018393 - RNA, 13 nt, Human
ucaccuuuauucu

SEQ ID NO: 2018394 - RNA, 14 nt, Human
ucacucuccuuggu

SEQ ID NO: 2018395 - RNA, 12 nt, Human
ucacucuccuug

SEQ ID NO: 2018396 - RNA, 19 nt, Human
ucacucuacuuagcauguc

SEQ ID NO: 2018397 - RNA, 20 nt, Human
ucacucuacuuagcaugucc

SEQ ID NO: 2018398 - RNA, 11 nt, Human
ucacucucagg

SEQ ID NO: 2018399 - RNA, 13 nt, Human
ucacucuggcagc

SEQ ID NO: 2018400 - RNA, 12 nt, Human
ucacucuggcag

SEQ ID NO: 2018401 - RNA, 23 nt, Human
ucacucuccuuggugucgggcau

SEQ ID NO: 2018402 - RNA, 12 nt, Human
ucacucucagga

SEQ ID NO: 2018403 - RNA, 22 nt, Human
ucacucuggcagcucagagagg

SEQ ID NO: 2018404 - RNA, 20 nt, Human
ucacucuggcagcucagaga

SEQ ID NO: 2018405 - RNA, 19 nt, Human
ucacucuggcagcucagag

SEQ ID NO: 2018406 - RNA, 18 nt, Human
ucacucuggcagcucaga

SEQ ID NO: 2018407 - RNA, 17 nt, Human
ucacucuggcagcucag

SEQ ID NO: 2018408 - RNA, 16 nt, Human
ucacucuggcagcuca

SEQ ID NO: 2018409 - RNA, 15 nt, Human
ucacucuggcagcuc

SEQ ID NO: 2018410 - RNA, 14 nt, Human
ucacucuggcagcu

SEQ ID NO: 2018411 - RNA, 17 nt, Human
ucacggaagagccuugc

SEQ ID NO: 2018412 - RNA, 16 nt, Human
ucacggaagagccuug

SEQ ID NO: 2018413 - RNA, 14 nt, Human
ucacggaagagccu

SEQ ID NO: 2018414 - RNA, 13 nt, Human
ucacggcucacug

SEQ ID NO: 2018415 - RNA, 15 nt, Human
ucacggcucacugca

SEQ ID NO: 2018416 - RNA, 20 nt, Human
ucacggcucacugcagccuc

SEQ ID NO: 2018417 - RNA, 13 nt, Human
ucacuccuugaaa

SEQ ID NO: 2018418 - RNA, 14 nt, Human
ucacucuaagaugu

SEQ ID NO: 2018419 - RNA, 21 nt, Human
ucacucuaagauguuauauuu

SEQ ID NO: 2018420 - RNA, 22 nt, Human
ucacucuaagauguuauauuuu

SEQ ID NO: 2018421 - RNA, 15 nt, Human
ucacucuaagauguu

SEQ ID NO: 2018422 - RNA, 16 nt, Human
ucacucuaagauguua

SEQ ID NO: 2018423 - RNA, 17 nt, Human
ucacucuaagauguuau

SEQ ID NO: 2018424 - RNA, 18 nt, Human
ucacuccuaccugguaau

SEQ ID NO: 2018425 - RNA, 14 nt, Human
ucagaccagcucuu

SEQ ID NO: 2018426 - RNA, 22 nt, Human
ucagacauagaauuaacacaug

SEQ ID NO: 2018427 - RNA, 19 nt, Human
ucagacauagaauuaacac

SEQ ID NO: 2018428 - RNA, 17 nt, Human
ucagaaaugacuuuuug

SEQ ID NO: 2018429 - RNA, 20 nt, Human
ucagacagcugccugggauc

SEQ ID NO: 2018430 - RNA, 19 nt, Human
ucagacagcugccugggau

SEQ ID NO: 2018431 - RNA, 18 nt, Human
ucagacagcugccuggga

SEQ ID NO: 2018432 - RNA, 17 nt, Human
ucagacagcugccuggg

SEQ ID NO: 2018433 - RNA, 16 nt, Human
ucagacagcugccugg

SEQ ID NO: 2018434 - RNA, 15 nt, Human
ucagacagcugccug

SEQ ID NO: 2018435 - RNA, 18 nt, Human
ucagcacgauuucuguuu

SEQ ID NO: 2018436 - RNA, 22 nt, Human
ucagcaaggcgcuaacuugcuu

SEQ ID NO: 2018437 - RNA, 24 nt, Human
ucagcaaggcgcuaacuugcuuaa

SEQ ID NO: 2018438 - RNA, 18 nt, Human
ucagcaaggccaccucuu

SEQ ID NO: 2018439 - RNA, 23 nt, Human
ucagcaaggccaccucuuccugg

SEQ ID NO: 2018440 - RNA, 19 nt, Human
ucagcaaggcgcuaacuug

SEQ ID NO: 2018441 - RNA, 20 nt, Human
ucagcaaggcgcuaacuugc

SEQ ID NO: 2018442 - RNA, 12 nt, Human
ucagcaaggcca

SEQ ID NO: 2018443 - RNA, 13 nt, Human
ucagcaaggccac

SEQ ID NO: 2018444 - RNA, 14 nt, Human
ucagcaaggccacc

SEQ ID NO: 2018445 - RNA, 15 nt, Human
ucagcaaggccaccu

SEQ ID NO: 2018446 - RNA, 16 nt, Human
ucagcaaggccaccuc

SEQ ID NO: 2018447 - RNA, 17 nt, Human
ucagcaaggccaccucu

SEQ ID NO: 2018448 - RNA, 19 nt, Human
ucagcacgauuucuguuua

SEQ ID NO: 2018449 - RNA, 23 nt, Human
ucagagugcaagccccugcucca

SEQ ID NO: 2018450 - RNA, 22 nt, Human
ucagaguugaugguuguacaua

SEQ ID NO: 2018451 - RNA, 20 nt, Human
ucagcaaacuuguugaauuu

SEQ ID NO: 2018452 - RNA, 21 nt, Human
ucagaggggaauaaacuguug

SEQ ID NO: 2018453 - RNA, 12 nt, Human
ucagaggcccca

SEQ ID NO: 2018454 - RNA, 22 nt, Human
ucagaggccccaauaccccaug

SEQ ID NO: 2018455 - RNA, 15 nt, Human
ucacugcuuaacuuc

SEQ ID NO: 2018456 - RNA, 17 nt, Human
ucacugcuuaacuucac

SEQ ID NO: 2018457 - RNA, 18 nt, Human
ucacugcuuaacuucaca

SEQ ID NO: 2018458 - RNA, 20 nt, Human
ucacugcuuaacuucacaua

SEQ ID NO: 2018459 - RNA, 22 nt, Human
ucacucugucgcccagucugga

SEQ ID NO: 2018460 - RNA, 19 nt, Human
ucacucugucgcccagucu

SEQ ID NO: 2018461 - RNA, 12 nt, Human
ucacucugucgc

SEQ ID NO: 2018462 - RNA, 16 nt, Human
ucacucugucgcccag

SEQ ID NO: 2018463 - RNA, 13 nt, Human
ucacuggcauggu

SEQ ID NO: 2018464 - RNA, 21 nt, Human
ucacuggccacaguuguuuga

SEQ ID NO: 2018465 - RNA, 22 nt, Human
ucagaaauaauaaaaaauuuca

SEQ ID NO: 2018466 - RNA, 20 nt, Human
ucagaaagggcagaaguagg

SEQ ID NO: 2018467 - RNA, 17 nt, Human
ucagaaauacagauaaa

SEQ ID NO: 2018468 - RNA, 22 nt, Human
ucagaaauacagauaaaugauu

SEQ ID NO: 2018469 - RNA, 22 nt, Human
ucagaaacaaagcauuugacuu

SEQ ID NO: 2018470 - RNA, 17 nt, Human
ucagaaagccuuucauu

SEQ ID NO: 2018471 - RNA, 23 nt, Human
ucagaaagccuuucauuuugcuu

SEQ ID NO: 2018472 - RNA, 23 nt, Human
ucagaaaaaagguucuuugugua

SEQ ID NO: 2018473 - RNA, 10 nt, Human
ucagaaaaaa

SEQ ID NO: 2018474 - RNA, 12 nt, Human
ucacuuuuauuu

SEQ ID NO: 2018475 - RNA, 22 nt, Human
ucacuuuuauuuagcaccaggg

SEQ ID NO: 2018476 - RNA, 23 nt, Human
uauuucugaggagccugcaacau

SEQ ID NO: 2018477 - RNA, 11 nt, Human
uauuucuccuu

SEQ ID NO: 2018478 - RNA, 12 nt, Human
uauuucuccuuu

SEQ ID NO: 2018479 - RNA, 15 nt, Human
uauuucuccuuuugu

SEQ ID NO: 2018480 - RNA, 16 nt, Human
uauuuggaugcagagu

SEQ ID NO: 2018481 - RNA, 19 nt, Human
uauuuggaugcagaguuca

SEQ ID NO: 2018482 - RNA, 15 nt, Human
uauuuggaugcagag

SEQ ID NO: 2018483 - RNA, 14 nt, Human
uauuuggaauuaga

SEQ ID NO: 2018484 - RNA, 15 nt, Human
uauuuggaauuagaa

SEQ ID NO: 2018485 - RNA, 16 nt, Human
uauuuggaauuagaac

SEQ ID NO: 2018486 - RNA, 20 nt, Human
uauuuggaugcagaguucag

SEQ ID NO: 2018487 - RNA, 23 nt, Human
uauuuuaguggacccugaaaugu

SEQ ID NO: 2018488 - RNA, 21 nt, Human
uauuuuaguggacccugaaau

SEQ ID NO: 2018489 - RNA, 22 nt, Human
uauuuuaguggacccugaaaug

SEQ ID NO: 2018490 - RNA, 22 nt, Human
uauuuuagguguaaaauaauua

SEQ ID NO: 2018491 - RNA, 24 nt, Human
uauuuauuaaauuuuuuuguauga

SEQ ID NO: 2018492 - RNA, 21 nt, Human
uauuuauucugggaauguaua

SEQ ID NO: 2018493 - RNA, 12 nt, Human
uauuuauugaaa

SEQ ID NO: 2018494 - RNA, 16 nt, Human
uauuuauugaaaugau

SEQ ID NO: 2018495 - RNA, 20 nt, Human
uauuuauugaaaugauuuca

SEQ ID NO: 2018496 - RNA, 12 nt, Human
uauuuauugacu

SEQ ID NO: 2018497 - RNA, 15 nt, Human
uauuuauugacucuu

SEQ ID NO: 2018498 - RNA, 17 nt, Human
uauuuauugacucuuga

SEQ ID NO: 2018499 - RNA, 21 nt, Human
uauuuauugacucuugaguug

SEQ ID NO: 2018500 - RNA, 15 nt, Human
uauuuauuaaauuuu

SEQ ID NO: 2018501 - RNA, 23 nt, Human
uauuuauuaaaugcccagccccu

SEQ ID NO: 2018502 - RNA, 20 nt, Human
uaucugaaaauguaugugua

SEQ ID NO: 2018503 - RNA, 13 nt, Human
uaucugaaaguca

SEQ ID NO: 2018504 - RNA, 15 nt, Human
uaucugaaaauguau

SEQ ID NO: 2018505 - RNA, 14 nt, Human
uaucugaaaaugua

SEQ ID NO: 2018506 - RNA, 15 nt, Human
uauuuuuuuacuaau

SEQ ID NO: 2018507 - RNA, 12 nt, Human
uauuuuuuuccu

SEQ ID NO: 2018508 - RNA, 18 nt, Human
uauuuuuuuccuuacaua

SEQ ID NO: 2018509 - RNA, 19 nt, Human
uauuuuuuuccuuacauaa

SEQ ID NO: 2018510 - RNA, 16 nt, Human
uauuuuuuucugaaau

SEQ ID NO: 2018511 - RNA, 17 nt, Human
uauuuuuuucugaaauu

SEQ ID NO: 2018512 - RNA, 22 nt, Human
uauuuuuuucugaauuauuuuc

SEQ ID NO: 2018513 - RNA, 17 nt, Human
ucaaaaaggcuuauaaa

SEQ ID NO: 2018514 - RNA, 19 nt, Human
ucaaaaaggcuuauaaaac

SEQ ID NO: 2018515 - RNA, 20 nt, Human
ucaaaaaggcuuauaaaaca

SEQ ID NO: 2018516 - RNA, 21 nt, Human
ucaaaaaggcuuauaaaacag

SEQ ID NO: 2018517 - RNA, 14 nt, Human
ucaaacucuuaaaa

SEQ ID NO: 2018518 - RNA, 15 nt, Human
ucaaacgugaaaaug

SEQ ID NO: 2018519 - RNA, 16 nt, Human
ucaaacgugaaaaugc

SEQ ID NO: 2018520 - RNA, 22 nt, Human
ucaaaacgguuuuacugcagcu

SEQ ID NO: 2018521 - RNA, 23 nt, Human
ucaaacggccucacuaggcuucu

SEQ ID NO: 2018522 - RNA, 23 nt, Human
uauuuuauacucauggaagagau

SEQ ID NO: 2018523 - RNA, 16 nt, Human
uauuuuauguugcaua

SEQ ID NO: 2018524 - RNA, 15 nt, Human
uauuuuauguugcau

SEQ ID NO: 2018525 - RNA, 21 nt, Human
uauuuucaacgcagcccugcu

SEQ ID NO: 2018526 - RNA, 17 nt, Human
uauuuugaaauggaaau

SEQ ID NO: 2018527 - RNA, 21 nt, Human
uauuuugaagugagaaaauga

SEQ ID NO: 2018528 - RNA, 13 nt, Human
uauuuuuguuguu

SEQ ID NO: 2018529 - RNA, 13 nt, Human
ucaauaggaaaaa

SEQ ID NO: 2018530 - RNA, 14 nt, Human
ucaaguggcaaagc

SEQ ID NO: 2018531 - RNA, 19 nt, Human
ucaaguggcaaagcuguuc

SEQ ID NO: 2018532 - RNA, 22 nt, Human
ucaaguggcaaagcuguucuuc

SEQ ID NO: 2018533 - RNA, 14 nt, Human
ucaauaggaaaaac

SEQ ID NO: 2018534 - RNA, 23 nt, Human
ucaauagcccaggauauauuuua

SEQ ID NO: 2018535 - RNA, 14 nt, Human
ucaaugcacugaca

SEQ ID NO: 2018536 - RNA, 19 nt, Human
ucaaugguuuaacauauaa

SEQ ID NO: 2018537 - RNA, 22 nt, Human
ucaaugcuguuuggguuuccaa

SEQ ID NO: 2018538 - RNA, 18 nt, Human
ucaauuacaggaaguacu

SEQ ID NO: 2018539 - RNA, 13 nt, Human
ucaauuacaggaa

SEQ ID NO: 2018540 - RNA, 18 nt, Human
ucaaugcacugacauugu

SEQ ID NO: 2018541 - RNA, 17 nt, Human
ucaaugcuauaacuaug

SEQ ID NO: 2018542 - RNA, 22 nt, Human
ucaaugccccugaauuuaaaua

SEQ ID NO: 2018543 - RNA, 17 nt, Human
ucaaugcuggagaaaaa

SEQ ID NO: 2018544 - RNA, 15 nt, Human
ucaaugcuguuuggg

SEQ ID NO: 2018545 - RNA, 19 nt, Human
ucaauuacaggaaguacug

SEQ ID NO: 2018546 - RNA, 21 nt, Human
ucacacaguauuacuucugcu

SEQ ID NO: 2018547 - RNA, 22 nt, Human
ucacacaguauuacuucugcua

SEQ ID NO: 2018548 - RNA, 13 nt, Human
ucacacagugagu

SEQ ID NO: 2018549 - RNA, 21 nt, Human
ucacacaugagcaucaggcca

SEQ ID NO: 2018550 - RNA, 22 nt, Human
ucacacagugagucgaggacag

SEQ ID NO: 2018551 - RNA, 23 nt, Human
ucacacagugagucgaggacagg

SEQ ID NO: 2018552 - RNA, 14 nt, Human
ucacaggaaguaga

SEQ ID NO: 2018553 - RNA, 19 nt, Human
ucacaggaaguagaggagg

SEQ ID NO: 2018554 - RNA, 11 nt, Human
ucacaggcagg

SEQ ID NO: 2018555 - RNA, 16 nt, Human
ucaaacuuuacuaugg

SEQ ID NO: 2018556 - RNA, 15 nt, Human
ucaaacuuuacuaug

SEQ ID NO: 2018557 - RNA, 13 nt, Human
ucaaacuuuacua

SEQ ID NO: 2018558 - RNA, 22 nt, Human
ucaaacucuugaccucagguga

SEQ ID NO: 2018559 - RNA, 12 nt, Human
ucaaacugaaaa

SEQ ID NO: 2018560 - RNA, 21 nt, Human
ucaaacugaaaagcugagacc

SEQ ID NO: 2018561 - RNA, 18 nt, Human
ucaacuaaaguuguacuu

SEQ ID NO: 2018562 - RNA, 20 nt, Human
ucaacuaaaguuguacuuua

SEQ ID NO: 2018563 - RNA, 13 nt, Human
ucaaccuccuggg

SEQ ID NO: 2018564 - RNA, 14 nt, Human
ucaaccuccugggc

SEQ ID NO: 2018565 - RNA, 21 nt, Human
ucaacuaaaguuguacuuuaa

SEQ ID NO: 2018566 - RNA, 22 nt, Human
ucaacuaaaguuguacuuuaaa

SEQ ID NO: 2018567 - RNA, 15 nt, Human
ucaacuaaauccaaa

SEQ ID NO: 2018568 - RNA, 18 nt, Human
ucaagcuccaucuuauuu

SEQ ID NO: 2018569 - RNA, 19 nt, Human
ucaaggauccugagccaga

SEQ ID NO: 2018570 - RNA, 18 nt, Human
ucaaggauccugagccag

SEQ ID NO: 2018571 - RNA, 20 nt, Human
ucaaggauccugagccagau

SEQ ID NO: 2018572 - RNA, 23 nt, Human
ucaaggauccugagccagauuuc

SEQ ID NO: 2018573 - RNA, 22 nt, Human
ucaagugauucuccugccucag

SEQ ID NO: 2018574 - RNA, 22 nt, Human
ucaagccuagauguuuuauaca

SEQ ID NO: 2018575 - RNA, 15 nt, Human
ucaagcccaggaggg

SEQ ID NO: 2018576 - RNA, 15 nt, Human
ucaagcgauucucuu

SEQ ID NO: 2018577 - RNA, 16 nt, Human
ucaagcgauucuucug

SEQ ID NO: 2018578 - RNA, 17 nt, Human
ucaagcgauucuucugc

SEQ ID NO: 2018579 - RNA, 22 nt, Human
guuuucggugccaucagugccc

SEQ ID NO: 2018580 - RNA, 16 nt, Human
guuuucaguguacaug

SEQ ID NO: 2018581 - RNA, 17 nt, Human
guuuucaguguacaugg

SEQ ID NO: 2018582 - RNA, 22 nt, Human
guuuucaggugcucaaaaugca

SEQ ID NO: 2018583 - RNA, 16 nt, Human
guuuguugugaggauu

SEQ ID NO: 2018584 - RNA, 18 nt, Human
guuuguucuuguuuuuaa

SEQ ID NO: 2018585 - RNA, 10 nt, Human
guuuguuuca

SEQ ID NO: 2018586 - RNA, 20 nt, Human
guuuuuaaaaucuuauuaaa

SEQ ID NO: 2018587 - RNA, 13 nt, Human
guuuuuaaaaucu

SEQ ID NO: 2018588 - RNA, 15 nt, Human
guuuuuaaaaucuua

SEQ ID NO: 2018589 - RNA, 16 nt, Human
guuuuguuuuuugagu

SEQ ID NO: 2018590 - RNA, 14 nt, Human
guuuuuaaaaauua

SEQ ID NO: 2018591 - RNA, 15 nt, Human
guuuuuaaaaauuag

SEQ ID NO: 2018592 - RNA, 19 nt, Human
guuuuuauggcuuuugugc

SEQ ID NO: 2018593 - RNA, 22 nt, Human
guuuuuauggcuuuugugcauu

SEQ ID NO: 2018594 - RNA, 23 nt, Human
guuuuuauggcuuuugugcauua

SEQ ID NO: 2018595 - RNA, 19 nt, Human
guuuugugaaauuuuucau

SEQ ID NO: 2018596 - RNA, 20 nt, Human
guuuugugaaauuuuucaua

SEQ ID NO: 2018597 - RNA, 22 nt, Human
guuuugugaaauuuuucauauu

SEQ ID NO: 2018598 - RNA, 23 nt, Human
guuuugugaaauuuuucauauuu

SEQ ID NO: 2018599 - RNA, 13 nt, Human
guuuugugaaauu

SEQ ID NO: 2018600 - RNA, 14 nt, Human
guuuugugaaauuu

SEQ ID NO: 2018601 - RNA, 18 nt, Human
guuuugugaaauuuuuca

SEQ ID NO: 2018602 - RNA, 13 nt, Human
guuuuguuuuuug

SEQ ID NO: 2018603 - RNA, 19 nt, Human
guuuucucuugagagggug

SEQ ID NO: 2018604 - RNA, 12 nt, Human
guuuucucuuga

SEQ ID NO: 2018605 - RNA, 13 nt, Human
guuuucucucuau

SEQ ID NO: 2018606 - RNA, 16 nt, Human
guuuuuauuucuccuu

SEQ ID NO: 2018607 - RNA, 17 nt, Human
guuuuuauuucuccuuu

SEQ ID NO: 2018608 - RNA, 21 nt, Human
guuuuucaguucaaagucaug

SEQ ID NO: 2018609 - RNA, 20 nt, Human
guuuuucaguucaaagucau

SEQ ID NO: 2018610 - RNA, 12 nt, Human
guuuuucaguuc

SEQ ID NO: 2018611 - RNA, 12 nt, Human
uaaaaaaaagaa

SEQ ID NO: 2018612 - RNA, 14 nt, Human
uaaaaaaaagaaaa

SEQ ID NO: 2018613 - RNA, 20 nt, Human
uaaaaaaaacucuuuaacuu

SEQ ID NO: 2018614 - RNA, 11 nt, Human
uaaaaaaaaga

SEQ ID NO: 2018615 - RNA, 17 nt, Human
uaaaaaaaagaaaaaag

SEQ ID NO: 2018616 - RNA, 15 nt, Human
uaaaaaaaagaaaaa

SEQ ID NO: 2018617 - RNA, 16 nt, Human
uaaaaaaaagaaaaaa

SEQ ID NO: 2018618 - RNA, 14 nt, Human
uaaaaaaacagcuu

SEQ ID NO: 2018619 - RNA, 10 nt, Human
uaaaaaaaga

SEQ ID NO: 2018620 - RNA, 11 nt, Human
uaaaaaaagaa

SEQ ID NO: 2018621 - RNA, 14 nt, Human
uaaaaaaagaaaaa

SEQ ID NO: 2018622 - RNA, 15 nt, Human
uaaaaaaagaaaaaa

SEQ ID NO: 2018623 - RNA, 11 nt, Human
uaaaaaacacu

SEQ ID NO: 2018624 - RNA, 14 nt, Human
uaaaaacugaaguu

SEQ ID NO: 2018625 - RNA, 15 nt, Human
uaaaaacugaaguuc

SEQ ID NO: 2018626 - RNA, 16 nt, Human
uaaaaacugaaguucu

SEQ ID NO: 2018627 - RNA, 17 nt, Human
uaaaaagaaaacaaaac

SEQ ID NO: 2018628 - RNA, 21 nt, Human
uaaaaagaaaacaaaaccaaa

SEQ ID NO: 2018629 - RNA, 15 nt, Human
uaaaaacaaaaggca

SEQ ID NO: 2018630 - RNA, 21 nt, Human
uaaaaaauuuaaaaagcccaa

SEQ ID NO: 2018631 - RNA, 14 nt, Human
uaaaaaaugacaaa

SEQ ID NO: 2018632 - RNA, 15 nt, Human
uaaaaaagcugugug

SEQ ID NO: 2018633 - RNA, 21 nt, Human
uaaaaaacuuucuacucauuu

SEQ ID NO: 2018634 - RNA, 23 nt, Human
uaaaaaacugcugacuguuuucu

SEQ ID NO: 2018635 - RNA, 20 nt, Human
uaaaaaacugcugacuguuu

SEQ ID NO: 2018636 - RNA, 12 nt, Human
uaaaaaacacug

SEQ ID NO: 2018637 - RNA, 20 nt, Human
guuuccuggcacugcuucca

SEQ ID NO: 2018638 - RNA, 16 nt, Human
guuuccuggcacugcu

SEQ ID NO: 2018639 - RNA, 14 nt, Human
guuuccugcaggcc

SEQ ID NO: 2018640 - RNA, 13 nt, Human
guuuccugcccug

SEQ ID NO: 2018641 - RNA, 17 nt, Human
guuuccugcccugggag

SEQ ID NO: 2018642 - RNA, 22 nt, Human
guuuccuggcacugcuuccagu

SEQ ID NO: 2018643 - RNA, 21 nt, Human
guuuccuggcacugcuuccag

SEQ ID NO: 2018644 - RNA, 16 nt, Human
guuuccuuauauuaug

SEQ ID NO: 2018645 - RNA, 16 nt, Human
guuuccugcaggccag

SEQ ID NO: 2018646 - RNA, 22 nt, Human
guuuccugcccugggaggcagu

SEQ ID NO: 2018647 - RNA, 23 nt, Human
guuucagguagaggugcaugccu

SEQ ID NO: 2018648 - RNA, 14 nt, Human
guuucagaaaugug

SEQ ID NO: 2018649 - RNA, 18 nt, Human
guuucagaaauguguuau

SEQ ID NO: 2018650 - RNA, 19 nt, Human
guuucagguagaggugcau

SEQ ID NO: 2018651 - RNA, 16 nt, Human
guuuaguaaucauauu

SEQ ID NO: 2018652 - RNA, 17 nt, Human
guuuagauuuuguguuu

SEQ ID NO: 2018653 - RNA, 22 nt, Human
guuuagauuuuguguuuauucu

SEQ ID NO: 2018654 - RNA, 12 nt, Human
guuuagauuugc

SEQ ID NO: 2018655 - RNA, 22 nt, Human
guuuagauuugccauagaguac

SEQ ID NO: 2018656 - RNA, 14 nt, Human
guuuagauuuugug

SEQ ID NO: 2018657 - RNA, 18 nt, Human
guuuagaugaaugucagu

SEQ ID NO: 2018658 - RNA, 17 nt, Human
guuuagaugaaugucag

SEQ ID NO: 2018659 - RNA, 20 nt, Human
guuuaggauguugaaaaagu

SEQ ID NO: 2018660 - RNA, 19 nt, Human
gguugggagaaugucagua

SEQ ID NO: 2018661 - RNA, 23 nt, Human
gguugggacccaguggcagggca

SEQ ID NO: 2018662 - RNA, 16 nt, Human
guuuacucacagccag

SEQ ID NO: 2018663 - RNA, 17 nt, Human
guuuacucacagccagc

SEQ ID NO: 2018664 - RNA, 13 nt, Human
guuuacuuuaacu

SEQ ID NO: 2018665 - RNA, 14 nt, Human
guuuacuuuaacuu

SEQ ID NO: 2018666 - RNA, 13 nt, Human
guuuagaaagcuu

SEQ ID NO: 2018667 - RNA, 17 nt, Human
guuuagaaagcuugccc

SEQ ID NO: 2018668 - RNA, 21 nt, Human
gguuggccccugcccggcugc

SEQ ID NO: 2018669 - RNA, 19 nt, Human
gguuggcugggaaaucgag

SEQ ID NO: 2018670 - RNA, 19 nt, Human
gguugggacccaguggcag

SEQ ID NO: 2018671 - RNA, 21 nt, Human
gguugggacccaguggcaggg

SEQ ID NO: 2018672 - RNA, 22 nt, Human
gguugggacccaguggcagggc

SEQ ID NO: 2018673 - RNA, 18 nt, Human
guuuguuccccaagacau

SEQ ID NO: 2018674 - RNA, 19 nt, Human
guuuguggaaaaugaaaau

SEQ ID NO: 2018675 - RNA, 17 nt, Human
guuuguaaauuaacuuu

SEQ ID NO: 2018676 - RNA, 16 nt, Human
guuugguuuuaaaaua

SEQ ID NO: 2018677 - RNA, 17 nt, Human
guuugguuuuaaaauac

SEQ ID NO: 2018678 - RNA, 14 nt, Human
guuugguuuuuauu

SEQ ID NO: 2018679 - RNA, 22 nt, Human
guuugguuuuuauuucuccuuu

SEQ ID NO: 2018680 - RNA, 15 nt, Human
guuuguaaaaaugua

SEQ ID NO: 2018681 - RNA, 19 nt, Human
guuuguaaauuaacuuuua

SEQ ID NO: 2018682 - RNA, 13 nt, Human
guuugucucuucu

SEQ ID NO: 2018683 - RNA, 14 nt, Human
guuugucucuucug

SEQ ID NO: 2018684 - RNA, 15 nt, Human
guuugucucuucugg

SEQ ID NO: 2018685 - RNA, 18 nt, Human
guuugaggaaauuugcag

SEQ ID NO: 2018686 - RNA, 22 nt, Human
guuugaggauuaguuuagaaca

SEQ ID NO: 2018687 - RNA, 14 nt, Human
guuugauaaauagu

SEQ ID NO: 2018688 - RNA, 15 nt, Human
guuugauaaauagug

SEQ ID NO: 2018689 - RNA, 13 nt, Human
guuugaucuuccu

SEQ ID NO: 2018690 - RNA, 21 nt, Human
guuugaucuuccucugcuaaa

SEQ ID NO: 2018691 - RNA, 22 nt, Human
guuugaucuuccucugcuaaau

SEQ ID NO: 2018692 - RNA, 17 nt, Human
guuugauuaaauucuug

SEQ ID NO: 2018693 - RNA, 19 nt, Human
guuugauuaaauucuugca

SEQ ID NO: 2018694 - RNA, 22 nt, Human
guuugauuaaauucuugcaaag

SEQ ID NO: 2018695 - RNA, 20 nt, Human
guuugaugcauuaaaagaaa

SEQ ID NO: 2018696 - RNA, 14 nt, Human
guuucuuuguaaug

SEQ ID NO: 2018697 - RNA, 19 nt, Human
guuucuuucucugaggaca

SEQ ID NO: 2018698 - RNA, 20 nt, Human
guuucuuucucugaggacaa

SEQ ID NO: 2018699 - RNA, 12 nt, Human
guuucuuugaau

SEQ ID NO: 2018700 - RNA, 17 nt, Human
guuucuuuguaaugaaa

SEQ ID NO: 2018701 - RNA, 17 nt, Human
guuucuuugaauuuuca

SEQ ID NO: 2018702 - RNA, 18 nt, Human
guuucuuugaauuuucau

SEQ ID NO: 2018703 - RNA, 19 nt, Human
guuucuuugaauuuucauu

SEQ ID NO: 2018704 - RNA, 20 nt, Human
guuucuuugaauuuucauuu

SEQ ID NO: 2018705 - RNA, 16 nt, Human
guuugaaccaagaacu

SEQ ID NO: 2018706 - RNA, 21 nt, Human
guuucuuugaauuuucauuuu

SEQ ID NO: 2018707 - RNA, 20 nt, Human
guuucuuugaucaugaauaa

SEQ ID NO: 2018708 - RNA, 15 nt, Human
guuucuaaagcugcc

SEQ ID NO: 2018709 - RNA, 14 nt, Human
guuucuaaagcugc

SEQ ID NO: 2018710 - RNA, 16 nt, Human
guuucuaaagcugcca

SEQ ID NO: 2018711 - RNA, 20 nt, Human
guuucuaaagcugccagccg

SEQ ID NO: 2018712 - RNA, 13 nt, Human
guuuccuucccuc

SEQ ID NO: 2018713 - RNA, 21 nt, Human
guuuccuugaggggagccagg

SEQ ID NO: 2018714 - RNA, 21 nt, Human
uaaacacucuugaaaaaugca

SEQ ID NO: 2018715 - RNA, 11 nt, Human
uaaacacuguu

SEQ ID NO: 2018716 - RNA, 14 nt, Human
uaaacacuguguau

SEQ ID NO: 2018717 - RNA, 23 nt, Human
uaaacaagaccacguuucuaaag

SEQ ID NO: 2018718 - RNA, 16 nt, Human
uaaaauggcaacaaac

SEQ ID NO: 2018719 - RNA, 17 nt, Human
uaaaauggcaacaaacu

SEQ ID NO: 2018720 - RNA, 13 nt, Human
uaaaaugcaaaaa

SEQ ID NO: 2018721 - RNA, 15 nt, Human
uaaaaugcaaaaaau

SEQ ID NO: 2018722 - RNA, 17 nt, Human
uaaaaugcaaaaaaucu

SEQ ID NO: 2018723 - RNA, 18 nt, Human
uaaaaugcaaaaaaucuu

SEQ ID NO: 2018724 - RNA, 19 nt, Human
uaaaaugcaaaaaaucuua

SEQ ID NO: 2018725 - RNA, 20 nt, Human
uaaaaugcaaaaaaucuuaa

SEQ ID NO: 2018726 - RNA, 13 nt, Human
uaaacaaaucuuu

SEQ ID NO: 2018727 - RNA, 16 nt, Human
uaaacaaaucuuucca

SEQ ID NO: 2018728 - RNA, 18 nt, Human
uaaaauggcaacaaacug

SEQ ID NO: 2018729 - RNA, 20 nt, Human
uaaaauggcaacaaacugca

SEQ ID NO: 2018730 - RNA, 22 nt, Human
uaaaauggcaacaaacugcaca

SEQ ID NO: 2018731 - RNA, 19 nt, Human
uaaaauggcaaguuuucca

SEQ ID NO: 2018732 - RNA, 18 nt, Human
uaaacaagaccacguuuc

SEQ ID NO: 2018733 - RNA, 22 nt, Human
uaaacugcccccucugcccugc

SEQ ID NO: 2018734 - RNA, 23 nt, Human
uaaacugcccccucugcccugcg

SEQ ID NO: 2018735 - RNA, 20 nt, Human
uaaacugcccccucugcccu

SEQ ID NO: 2018736 - RNA, 21 nt, Human
uaaacugcccccucugcccug

SEQ ID NO: 2018737 - RNA, 22 nt, Human
uaaacuuuaccuuuuuuauaca

SEQ ID NO: 2018738 - RNA, 16 nt, Human
uaaacuuuaccuuuuu

SEQ ID NO: 2018739 - RNA, 14 nt, Human
uaaacuuaaucuaa

SEQ ID NO: 2018740 - RNA, 13 nt, Human
uaaacuuaaucua

SEQ ID NO: 2018741 - RNA, 18 nt, Human
uaaacuuaaucuaaaugg

SEQ ID NO: 2018742 - RNA, 19 nt, Human
uaaacuuaaucuaaaugga

SEQ ID NO: 2018743 - RNA, 21 nt, Human
uaaaagggacugagaaauuua

SEQ ID NO: 2018744 - RNA, 20 nt, Human
uaaaagggacugagaaauuu

SEQ ID NO: 2018745 - RNA, 19 nt, Human
uaaaagggacugagaaauu

SEQ ID NO: 2018746 - RNA, 17 nt, Human
uaaaagggacugagaaa

SEQ ID NO: 2018747 - RNA, 14 nt, Human
uaaaagcauuuugu

SEQ ID NO: 2018748 - RNA, 15 nt, Human
uaaaagcauuuugua

SEQ ID NO: 2018749 - RNA, 16 nt, Human
uaaaagcauuuuguaa

SEQ ID NO: 2018750 - RNA, 17 nt, Human
uaaaagcauuuuguaau

SEQ ID NO: 2018751 - RNA, 18 nt, Human
uaaaagcauuuuguaaua

SEQ ID NO: 2018752 - RNA, 12 nt, Human
uaaaagcccagg

SEQ ID NO: 2018753 - RNA, 19 nt, Human
uaaaagccuaggucuauuu

SEQ ID NO: 2018754 - RNA, 18 nt, Human
uaaaagcccaggagccca

SEQ ID NO: 2018755 - RNA, 19 nt, Human
uaaaagcccaggagcccau

SEQ ID NO: 2018756 - RNA, 14 nt, Human
uaaaagcccaggag

SEQ ID NO: 2018757 - RNA, 15 nt, Human
uaaaagcccaggagc

SEQ ID NO: 2018758 - RNA, 16 nt, Human
uaaaagcccaggagcc

SEQ ID NO: 2018759 - RNA, 17 nt, Human
uaaaagcccaggagccc

SEQ ID NO: 2018760 - RNA, 12 nt, Human
uaaaagccuugg

SEQ ID NO: 2018761 - RNA, 19 nt, Human
uaaaagccuuggccucaga

SEQ ID NO: 2018762 - RNA, 21 nt, Human
uaaaagccuuggccucagagg

SEQ ID NO: 2018763 - RNA, 16 nt, Human
uaaaagaugcaaugua

SEQ ID NO: 2018764 - RNA, 17 nt, Human
uaaaagcaggcuucuau

SEQ ID NO: 2018765 - RNA, 21 nt, Human
uaaaagcaggcuucuaugaaa

SEQ ID NO: 2018766 - RNA, 15 nt, Human
uaaaaaugguuuaaa

SEQ ID NO: 2018767 - RNA, 22 nt, Human
uaaaauauuuaugaagaaaaua

SEQ ID NO: 2018768 - RNA, 21 nt, Human
uaaaauauuuaugaagaaaau

SEQ ID NO: 2018769 - RNA, 12 nt, Human
uaaaaggcccag

SEQ ID NO: 2018770 - RNA, 13 nt, Human
uaaaaggcccaga

SEQ ID NO: 2018771 - RNA, 14 nt, Human
uaaaaggcccagag

SEQ ID NO: 2018772 - RNA, 16 nt, Human
uaaaaugagaaaucua

SEQ ID NO: 2018773 - RNA, 15 nt, Human
uaaaaugagaaaucu

SEQ ID NO: 2018774 - RNA, 15 nt, Human
uaaaaugauugaaaa

SEQ ID NO: 2018775 - RNA, 13 nt, Human
uaaaaugagaaau

SEQ ID NO: 2018776 - RNA, 17 nt, Human
uaaaaugaagaauuuaa

SEQ ID NO: 2018777 - RNA, 15 nt, Human
uaaaaugaagaauuu

SEQ ID NO: 2018778 - RNA, 16 nt, Human
uaaaaugaagaauuua

SEQ ID NO: 2018779 - RNA, 20 nt, Human
uaaacuuuuuucuuacuguc

SEQ ID NO: 2018780 - RNA, 17 nt, Human
uaaacuuugaaauauau

SEQ ID NO: 2018781 - RNA, 18 nt, Human
uaaacuuucuuaauauuu

SEQ ID NO: 2018782 - RNA, 11 nt, Human
uaaacuuugaa

SEQ ID NO: 2018783 - RNA, 12 nt, Human
uaaacuuugaaa

SEQ ID NO: 2018784 - RNA, 13 nt, Human
uaaacuuugaaau

SEQ ID NO: 2018785 - RNA, 14 nt, Human
uaaacuuugaaaua

SEQ ID NO: 2018786 - RNA, 15 nt, Human
uaaacuuugaaauau

SEQ ID NO: 2018787 - RNA, 16 nt, Human
uaaacuuugaaauaua

SEQ ID NO: 2018788 - RNA, 23 nt, Human
uaaagcauauccauucagaauga

SEQ ID NO: 2018789 - RNA, 14 nt, Human
uaaagcgaaaaacu

SEQ ID NO: 2018790 - RNA, 17 nt, Human
uaaagcgaaaaacucaa

SEQ ID NO: 2018791 - RNA, 14 nt, Human
uaaaggaauuuaaa

SEQ ID NO: 2018792 - RNA, 22 nt, Human
uaaaguguauuuuuuuacuaau

SEQ ID NO: 2018793 - RNA, 23 nt, Human
uaaaguguauuuuuuuacuaaua

SEQ ID NO: 2018794 - RNA, 21 nt, Human
uaaaguguauuuuuuuacuaa

SEQ ID NO: 2018795 - RNA, 20 nt, Human
uaaaguguauuuuuuuacua

SEQ ID NO: 2018796 - RNA, 13 nt, Human
uaaaguuucuguu

SEQ ID NO: 2018797 - RNA, 24 nt, Human
uaaaguuucaaaaaucugaagauu

SEQ ID NO: 2018798 - RNA, 12 nt, Human
uaaaguuugauc

SEQ ID NO: 2018799 - RNA, 15 nt, Human
uaaaguuugaucuuc

SEQ ID NO: 2018800 - RNA, 17 nt, Human
uaaaguuugaucuuccu

SEQ ID NO: 2018801 - RNA, 14 nt, Human
uaaaguuuguugaa

SEQ ID NO: 2018802 - RNA, 14 nt, Human
uaaauaaaacccuu

SEQ ID NO: 2018803 - RNA, 17 nt, Human
uaaauaaaaauaauccu

SEQ ID NO: 2018804 - RNA, 19 nt, Human
uaaauauguagauaaugga

SEQ ID NO: 2018805 - RNA, 14 nt, Human
uaaauauuaagcau

SEQ ID NO: 2018806 - RNA, 14 nt, Human
uaaauauucacacu

SEQ ID NO: 2018807 - RNA, 18 nt, Human
uaaauauucacacuugaa

SEQ ID NO: 2018808 - RNA, 19 nt, Human
uaaauauucacacuugaac

SEQ ID NO: 2018809 - RNA, 19 nt, Human
uaaaucagccguguaacca

SEQ ID NO: 2018810 - RNA, 20 nt, Human
uaaaucagacuaugaaguuu

SEQ ID NO: 2018811 - RNA, 19 nt, Human
uaaaucaaguuggcuucua

SEQ ID NO: 2018812 - RNA, 22 nt, Human
uaaaucauacuccuaugcuuua

SEQ ID NO: 2018813 - RNA, 22 nt, Human
uaaauauauuuuaagacgaaac

SEQ ID NO: 2018814 - RNA, 16 nt, Human
uaaauauauuuuaaga

SEQ ID NO: 2018815 - RNA, 22 nt, Human
uaaauaucccuuggacauuuua

SEQ ID NO: 2018816 - RNA, 18 nt, Human
uaaauauaugcuaagucu

SEQ ID NO: 2018817 - RNA, 21 nt, Human
uaaauauagcaguagucuuuu

SEQ ID NO: 2018818 - RNA, 20 nt, Human
uaacuuuuauaaacuuuacc

SEQ ID NO: 2018819 - RNA, 23 nt, Human
uaacuguccuuuuucuucccuua

SEQ ID NO: 2018820 - RNA, 17 nt, Human
uaacuggugauauaucu

SEQ ID NO: 2018821 - RNA, 18 nt, Human
uaacuggugauauaucuc

SEQ ID NO: 2018822 - RNA, 16 nt, Human
uaacuguaauuauuug

SEQ ID NO: 2018823 - RNA, 18 nt, Human
uaacuguaauuauuugaa

SEQ ID NO: 2018824 - RNA, 19 nt, Human
uaacuguaauuauuugaau

SEQ ID NO: 2018825 - RNA, 17 nt, Human
uaacugagugccuuuug

SEQ ID NO: 2018826 - RNA, 23 nt, Human
uaacugauuaguaagucuugccu

SEQ ID NO: 2018827 - RNA, 16 nt, Human
uaacugagugccuuuu

SEQ ID NO: 2018828 - RNA, 21 nt, Human
uaaccaagguagaaugaccuu

SEQ ID NO: 2018829 - RNA, 13 nt, Human
uaaccacagcucc

SEQ ID NO: 2018830 - RNA, 14 nt, Human
uaaccacagcuccu

SEQ ID NO: 2018831 - RNA, 17 nt, Human
uaaccacagcuccuuuu

SEQ ID NO: 2018832 - RNA, 18 nt, Human
uaaccacagcuccuuuuc

SEQ ID NO: 2018833 - RNA, 14 nt, Human
uaaccagcagaaau

SEQ ID NO: 2018834 - RNA, 19 nt, Human
uaaccacagcuccuuuucc

SEQ ID NO: 2018835 - RNA, 21 nt, Human
uaaccacagcuccuuuuccag

SEQ ID NO: 2018836 - RNA, 23 nt, Human
uaaccacagcuccuuuuccagag

SEQ ID NO: 2018837 - RNA, 16 nt, Human
uaaccagcagaaaugc

SEQ ID NO: 2018838 - RNA, 19 nt, Human
uaaccagcagaaaugccuu

SEQ ID NO: 2018839 - RNA, 16 nt, Human
uaaccagggccagaag

SEQ ID NO: 2018840 - RNA, 19 nt, Human
uaacaggcagauacaggaa

SEQ ID NO: 2018841 - RNA, 13 nt, Human
uaacaggcaaaca

SEQ ID NO: 2018842 - RNA, 15 nt, Human
uaacaggcaaacauu

SEQ ID NO: 2018843 - RNA, 20 nt, Human
uaacaggcaaacauuuucuc

SEQ ID NO: 2018844 - RNA, 22 nt, Human
uaacaggcaaacauuuucucuu

SEQ ID NO: 2018845 - RNA, 15 nt, Human
uaacagccgcuccag

SEQ ID NO: 2018846 - RNA, 16 nt, Human
uaacagccgcuccaga

SEQ ID NO: 2018847 - RNA, 18 nt, Human
uaacagccgcuccagagu

SEQ ID NO: 2018848 - RNA, 15 nt, Human
uaacagcaguuucag

SEQ ID NO: 2018849 - RNA, 17 nt, Human
uaacagcaguuucaggu

SEQ ID NO: 2018850 - RNA, 14 nt, Human
uaacagaaauguac

SEQ ID NO: 2018851 - RNA, 15 nt, Human
uaacagaaauguaca

SEQ ID NO: 2018852 - RNA, 12 nt, Human
uaacagaaaugu

SEQ ID NO: 2018853 - RNA, 13 nt, Human
uaacagaaaugua

SEQ ID NO: 2018854 - RNA, 14 nt, Human
uaaauuuaguauuu

SEQ ID NO: 2018855 - RNA, 23 nt, Human
uaaauugggguuuauuucagcaa

SEQ ID NO: 2018856 - RNA, 14 nt, Human
uaaauugucuuaau

SEQ ID NO: 2018857 - RNA, 15 nt, Human
uaaauugcuccuuga

SEQ ID NO: 2018858 - RNA, 19 nt, Human
uaaauugcucacaguuauu

SEQ ID NO: 2018859 - RNA, 24 nt, Human
uaaauugcucacaguuauuacaua

SEQ ID NO: 2018860 - RNA, 19 nt, Human
uaaauccacccauguuauc

SEQ ID NO: 2018861 - RNA, 12 nt, Human
uaaauugauguu

SEQ ID NO: 2018862 - RNA, 13 nt, Human
uaaauugauguug

SEQ ID NO: 2018863 - RNA, 14 nt, Human
uaaauugauguuga

SEQ ID NO: 2018864 - RNA, 15 nt, Human
uaaauugauguugau

SEQ ID NO: 2018865 - RNA, 18 nt, Human
uaaauugauguugaugca

SEQ ID NO: 2018866 - RNA, 19 nt, Human
uaaauugauguugaugcaa

SEQ ID NO: 2018867 - RNA, 20 nt, Human
uaaauugauguugaugcaau

SEQ ID NO: 2018868 - RNA, 20 nt, Human
uaaggaugcuuguacauaau

SEQ ID NO: 2018869 - RNA, 21 nt, Human
uaaggaugcuuguacauaaug

SEQ ID NO: 2018870 - RNA, 22 nt, Human
uaaggaugcuuguacauaaugc

SEQ ID NO: 2018871 - RNA, 23 nt, Human
uaaggaugcuuguacauaaugcg

SEQ ID NO: 2018872 - RNA, 18 nt, Human
uaaggaugcuuguacaua

SEQ ID NO: 2018873 - RNA, 15 nt, Human
uaaggcaaucauggu

SEQ ID NO: 2018874 - RNA, 13 nt, Human
uaaggcaugaagg

SEQ ID NO: 2018875 - RNA, 19 nt, Human
uaaggaugcuuguacauaa

SEQ ID NO: 2018876 - RNA, 21 nt, Human
uaagccuuuggaaacagcucg

SEQ ID NO: 2018877 - RNA, 21 nt, Human
uaagccuuuguugaacuguua

SEQ ID NO: 2018878 - RNA, 14 nt, Human
uaagccuuuggaaa

SEQ ID NO: 2018879 - RNA, 17 nt, Human
uaagccuuuggaaacag

SEQ ID NO: 2018880 - RNA, 13 nt, Human
uaagccaugagaa

SEQ ID NO: 2018881 - RNA, 20 nt, Human
uaagccagacaucaacagau

SEQ ID NO: 2018882 - RNA, 21 nt, Human
uaagccagacaucaacagaua

SEQ ID NO: 2018883 - RNA, 14 nt, Human
uaagccaugagaau

SEQ ID NO: 2018884 - RNA, 13 nt, Human
uaagccagacauc

SEQ ID NO: 2018885 - RNA, 21 nt, Human
uaagccaaaauuaagguguuu

SEQ ID NO: 2018886 - RNA, 17 nt, Human
uaagccaaaauuaaggu

SEQ ID NO: 2018887 - RNA, 19 nt, Human
uaagccaaaauuaaggugu

SEQ ID NO: 2018888 - RNA, 19 nt, Human
uaagaucucagugguuaag

SEQ ID NO: 2018889 - RNA, 13 nt, Human
uaagaucucagug

SEQ ID NO: 2018890 - RNA, 19 nt, Human
uaagaucgguuaacaaaua

SEQ ID NO: 2018891 - RNA, 16 nt, Human
uaagaucgguuaacaa

SEQ ID NO: 2018892 - RNA, 17 nt, Human
uaagaucgguuaacaaa

SEQ ID NO: 2018893 - RNA, 15 nt, Human
uaagcaugcacaaau

SEQ ID NO: 2018894 - RNA, 22 nt, Human
uaagcaugacagaaaauaugua

SEQ ID NO: 2018895 - RNA, 23 nt, Human
uaagcaucuaaggacaagguaag

SEQ ID NO: 2018896 - RNA, 17 nt, Human
uaagcaucuaaggacaa

SEQ ID NO: 2018897 - RNA, 19 nt, Human
uaacuuuuauaaacuuuac

SEQ ID NO: 2018898 - RNA, 21 nt, Human
uaacuuuuauaaacuuuaccu

SEQ ID NO: 2018899 - RNA, 22 nt, Human
uaacuuuuauaaacuuuaccuu

SEQ ID NO: 2018900 - RNA, 22 nt, Human
uaagaaccuuuugagugccuua

SEQ ID NO: 2018901 - RNA, 18 nt, Human
uaagaaauacuguacaau

SEQ ID NO: 2018902 - RNA, 15 nt, Human
uaagaaauacagacu

SEQ ID NO: 2018903 - RNA, 16 nt, Human
uaagaaauacuguaca

SEQ ID NO: 2018904 - RNA, 19 nt, Human
uaagaacugcuuucuuucg

SEQ ID NO: 2018905 - RNA, 13 nt, Human
uaagaaauaaauc

SEQ ID NO: 2018906 - RNA, 16 nt, Human
uaagaacuaaaauguu

SEQ ID NO: 2018907 - RNA, 22 nt, Human
uaagaacugcuuucuuucguuu

SEQ ID NO: 2018908 - RNA, 13 nt, Human
uaagaagaaacua

SEQ ID NO: 2018909 - RNA, 17 nt, Human
uaagagagucuauuuac

SEQ ID NO: 2018910 - RNA, 22 nt, Human
uaagaggcagggucucacucug

SEQ ID NO: 2018911 - RNA, 23 nt, Human
uaagagggagggagggcuccaga

SEQ ID NO: 2018912 - RNA, 22 nt, Human
uaagagggagggagggcuccag

SEQ ID NO: 2018913 - RNA, 12 nt, Human
uaagagggaggg

SEQ ID NO: 2018914 - RNA, 14 nt, Human
uaagauaaaugugc

SEQ ID NO: 2018915 - RNA, 21 nt, Human
uaagaucacuguuuagauuug

SEQ ID NO: 2018916 - RNA, 18 nt, Human
uaagaucacuguuuagau

SEQ ID NO: 2018917 - RNA, 20 nt, Human
uaagaucacuguuuagauuu

SEQ ID NO: 2018918 - RNA, 12 nt, Human
uaagaucacugu

SEQ ID NO: 2018919 - RNA, 13 nt, Human
uaagaucacuguu

SEQ ID NO: 2018920 - RNA, 14 nt, Human
uaagaucacuguuu

SEQ ID NO: 2018921 - RNA, 15 nt, Human
uaagaucacuguuua

SEQ ID NO: 2018922 - RNA, 17 nt, Human
uaagaucacuguuuaga

SEQ ID NO: 2018923 - RNA, 12 nt, Human
uaagauacuguu

SEQ ID NO: 2018924 - RNA, 16 nt, Human
uaagauauacuuguuu

SEQ ID NO: 2018925 - RNA, 23 nt, Human
uaagauauacuuguuuuuguaaa

SEQ ID NO: 2018926 - RNA, 17 nt, Human
uaagauaaaugugcuga

SEQ ID NO: 2018927 - RNA, 16 nt, Human
uaagauaaaugugcug

SEQ ID NO: 2018928 - RNA, 11 nt, Human
uaaucuaaaug

SEQ ID NO: 2018929 - RNA, 15 nt, Human
uaaugauaugcuugu

SEQ ID NO: 2018930 - RNA, 16 nt, Human
uaaugauaugcuugua

SEQ ID NO: 2018931 - RNA, 19 nt, Human
uaaugccacuaaauugaca

SEQ ID NO: 2018932 - RNA, 17 nt, Human
uaaugaugucguuugaa

SEQ ID NO: 2018933 - RNA, 23 nt, Human
uaaugaugucguuugaaucacag

SEQ ID NO: 2018934 - RNA, 18 nt, Human
uaaugauuccuauaaauc

SEQ ID NO: 2018935 - RNA, 12 nt, Human
uaaugauuguuu

SEQ ID NO: 2018936 - RNA, 22 nt, Human
uaauauauuuaaagggaaauug

SEQ ID NO: 2018937 - RNA, 18 nt, Human
uaauauauuuaaagggaa

SEQ ID NO: 2018938 - RNA, 19 nt, Human
uaauauauuuaaagggaaa

SEQ ID NO: 2018939 - RNA, 15 nt, Human
uaauauauuuaaagg

SEQ ID NO: 2018940 - RNA, 18 nt, Human
uaauauaauacacaaaau

SEQ ID NO: 2018941 - RNA, 13 nt, Human
uaaucgaccugcc

SEQ ID NO: 2018942 - RNA, 14 nt, Human
uaaucgaccugccu

SEQ ID NO: 2018943 - RNA, 16 nt, Human
uaaucgaccugccucg

SEQ ID NO: 2018944 - RNA, 16 nt, Human
uaaucguguccccuau

SEQ ID NO: 2018945 - RNA, 17 nt, Human
uaaucgggguauaauag

SEQ ID NO: 2018946 - RNA, 18 nt, Human
uaauauguuuccuucccu

SEQ ID NO: 2018947 - RNA, 17 nt, Human
uaauacacaaaaucaaa

SEQ ID NO: 2018948 - RNA, 14 nt, Human
uaauacacaaaauc

SEQ ID NO: 2018949 - RNA, 16 nt, Human
uaauacacaaaaucaa

SEQ ID NO: 2018950 - RNA, 21 nt, Human
uaauaguucagguaacaggca

SEQ ID NO: 2018951 - RNA, 16 nt, Human
uaauaauaaagaauag

SEQ ID NO: 2018952 - RNA, 11 nt, Human
uaauaauaaau

SEQ ID NO: 2018953 - RNA, 13 nt, Human
uaauaauaaauag

SEQ ID NO: 2018954 - RNA, 14 nt, Human
uaauaauaaauagu

SEQ ID NO: 2018955 - RNA, 15 nt, Human
uaauaauaaauaguu

SEQ ID NO: 2018956 - RNA, 18 nt, Human
uaauaauaaauaguucuu

SEQ ID NO: 2018957 - RNA, 14 nt, Human
uaauaaagacucua

SEQ ID NO: 2018958 - RNA, 15 nt, Human
uaauaaagacucuac

SEQ ID NO: 2018959 - RNA, 20 nt, Human
uaagugguacuaacuuuccu

SEQ ID NO: 2018960 - RNA, 15 nt, Human
uaaggcaugaaggau

SEQ ID NO: 2018961 - RNA, 22 nt, Human
uaaggccaaguacacugagagc

SEQ ID NO: 2018962 - RNA, 11 nt, Human
uaauaaagcug

SEQ ID NO: 2018963 - RNA, 17 nt, Human
uaauaaagcgaaaaacu

SEQ ID NO: 2018964 - RNA, 20 nt, Human
uaauaaagcgaaaaacucaa

SEQ ID NO: 2018965 - RNA, 15 nt, Human
uaauaaccagacaca

SEQ ID NO: 2018966 - RNA, 19 nt, Human
uaauaaccuuuaagucaga

SEQ ID NO: 2018967 - RNA, 18 nt, Human
uaauaagggaaaaaucaa

SEQ ID NO: 2018968 - RNA, 23 nt, Human
uaauaagggaaaaaucaaguauu

SEQ ID NO: 2018969 - RNA, 14 nt, Human
uaauaagggaaaaa

SEQ ID NO: 2018970 - RNA, 15 nt, Human
uaauaagggaaaaau

SEQ ID NO: 2018971 - RNA, 16 nt, Human
uaauaagggaaaaauc

SEQ ID NO: 2018972 - RNA, 17 nt, Human
uaauaagggaaaaauca

SEQ ID NO: 2018973 - RNA, 13 nt, Human
uaauaaccagaca

SEQ ID NO: 2018974 - RNA, 14 nt, Human
uaauaaccagacac

SEQ ID NO: 2018975 - RNA, 17 nt, Human
uaauuaaaacacaacau

SEQ ID NO: 2018976 - RNA, 14 nt, Human
uaaugcgugcauac

SEQ ID NO: 2018977 - RNA, 19 nt, Human
uaaugcgcaggcuggcccu

SEQ ID NO: 2018978 - RNA, 22 nt, Human
uaaugcgcaggcuggcccugcc

SEQ ID NO: 2018979 - RNA, 23 nt, Human
uaaugcgcaggcuggcccugccc

SEQ ID NO: 2018980 - RNA, 20 nt, Human
uaauguuuaaaauuucuuag

SEQ ID NO: 2018981 - RNA, 16 nt, Human
uaauguuuaagcagaa

SEQ ID NO: 2018982 - RNA, 22 nt, Human
uaauguuuaagcagaauuggaa

SEQ ID NO: 2018983 - RNA, 19 nt, Human
uaauucuuugaccuguugg

SEQ ID NO: 2018984 - RNA, 11 nt, Human
uaauucuuuaa

SEQ ID NO: 2018985 - RNA, 12 nt, Human
uaauucuuuaau

SEQ ID NO: 2018986 - RNA, 14 nt, Human
uaauucuuuaauga

SEQ ID NO: 2018987 - RNA, 11 nt, Human
uaauucuuugc

SEQ ID NO: 2018988 - RNA, 13 nt, Human
uaauucuuugcaa

SEQ ID NO: 2018989 - RNA, 14 nt, Human
uaauucuuugcaaa

SEQ ID NO: 2018990 - RNA, 16 nt, Human
uaauucuuugcaaaaa

SEQ ID NO: 2018991 - RNA, 17 nt, Human
uaauucuuugcaaaaau

SEQ ID NO: 2018992 - RNA, 21 nt, Human
uaauucuuugcaaaaauccaa

SEQ ID NO: 2018993 - RNA, 22 nt, Human
uaauucuuauuccauauuagaa

SEQ ID NO: 2018994 - RNA, 15 nt, Human
uaauucuuauuccau

SEQ ID NO: 2018995 - RNA, 16 nt, Human
uaauucuuauuccaua

SEQ ID NO: 2018996 - RNA, 17 nt, Human
uaauucuuauuccauau

SEQ ID NO: 2018997 - RNA, 19 nt, Human
uaauucuuauuccauauua

SEQ ID NO: 2018998 - RNA, 20 nt, Human
uaauugacaggauuauugga

SEQ ID NO: 2018999 - RNA, 15 nt, Human
uaauucuuuuuuauu

SEQ ID NO: 2019000 - RNA, 16 nt, Human
uaauucuuuuuuauua

SEQ ID NO: 2019001 - RNA, 17 nt, Human
uaauucuuuuuuauuaa

SEQ ID NO: 2019002 - RNA, 18 nt, Human
uaauucuuuuuuauuaau

SEQ ID NO: 2019003 - RNA, 19 nt, Human
uaauucuuuuuuauuaauc

SEQ ID NO: 2019004 - RNA, 20 nt, Human
uaauucuuuuuuauuaauca

SEQ ID NO: 2019005 - RNA, 21 nt, Human
uaauucuuuuuuauuaaucac

SEQ ID NO: 2019006 - RNA, 22 nt, Human
uaauugacaggauuauuggaaa

SEQ ID NO: 2019007 - RNA, 19 nt, Human
uaauugacaggcgaaagaa

SEQ ID NO: 2019008 - RNA, 15 nt, Human
uaauugaaagaaugu

SEQ ID NO: 2019009 - RNA, 17 nt, Human
uaauugaaagaauguaa

SEQ ID NO: 2019010 - RNA, 23 nt, Human
uaauucugaaguuauauuuccua

SEQ ID NO: 2019011 - RNA, 14 nt, Human
uaauucugaaguua

SEQ ID NO: 2019012 - RNA, 16 nt, Human
uaauucugaaguuaua

SEQ ID NO: 2019013 - RNA, 17 nt, Human
uaauucugaaguuauau

SEQ ID NO: 2019014 - RNA, 19 nt, Human
uaauucugaaguuauauuu

SEQ ID NO: 2019015 - RNA, 20 nt, Human
uaauucugaaguuauauuuc

SEQ ID NO: 2019016 - RNA, 18 nt, Human
uaauucuuagcucauucu

SEQ ID NO: 2019017 - RNA, 14 nt, Human
uaauucuuauucca

SEQ ID NO: 2019018 - RNA, 22 nt, Human
uaauuacagugccuaaaauaag

SEQ ID NO: 2019019 - RNA, 11 nt, Human
uaauuaauuuc

SEQ ID NO: 2019020 - RNA, 13 nt, Human
uaauuaauuucag

SEQ ID NO: 2019021 - RNA, 14 nt, Human
uaauuaauuucagu

SEQ ID NO: 2019022 - RNA, 16 nt, Human
uaauuacaauauuucu

SEQ ID NO: 2019023 - RNA, 18 nt, Human
uaauuacaauauuucuga

SEQ ID NO: 2019024 - RNA, 19 nt, Human
uaauuacaauauuucugau

SEQ ID NO: 2019025 - RNA, 19 nt, Human
uaauuacagugccuaaaau

SEQ ID NO: 2019026 - RNA, 19 nt, Human
uaauuugugauacaaugcu

SEQ ID NO: 2019027 - RNA, 22 nt, Human
uaauuugugauacaaugcugug

SEQ ID NO: 2019028 - RNA, 17 nt, Human
uaauuuguggugauuug

SEQ ID NO: 2019029 - RNA, 19 nt, Human
uaauuuggaccauuuuccu

SEQ ID NO: 2019030 - RNA, 14 nt, Human
uaauuuuauuuugu

SEQ ID NO: 2019031 - RNA, 22 nt, Human
uaauuuuccuuuaauaugaaau

SEQ ID NO: 2019032 - RNA, 15 nt, Human
uaauuuuauuccaga

SEQ ID NO: 2019033 - RNA, 15 nt, Human
uaauuugguuuucac

SEQ ID NO: 2019034 - RNA, 17 nt, Human
uaauuugguuuucacau

SEQ ID NO: 2019035 - RNA, 17 nt, Human
uaauuuggaccauuuuc

SEQ ID NO: 2019036 - RNA, 20 nt, Human
uaauuuggaccauuuuccug

SEQ ID NO: 2019037 - RNA, 18 nt, Human
uaauuugguuuucacauu

SEQ ID NO: 2019038 - RNA, 15 nt, Human
uaauuuguaagaaua

SEQ ID NO: 2019039 - RNA, 14 nt, Human
uaauuugugauaca

SEQ ID NO: 2019040 - RNA, 15 nt, Human
uaauuugugauacaa

SEQ ID NO: 2019041 - RNA, 18 nt, Human
uaauuugugauacaaugc

SEQ ID NO: 2019042 - RNA, 20 nt, Human
uaauugguuaucaugggaaa

SEQ ID NO: 2019043 - RNA, 20 nt, Human
uaauuggcuuuacuauuuuu

SEQ ID NO: 2019044 - RNA, 17 nt, Human
uaauugcauuugcuuuu

SEQ ID NO: 2019045 - RNA, 14 nt, Human
uaauugcacaacag

SEQ ID NO: 2019046 - RNA, 17 nt, Human
uaauugaucaguuuuca

SEQ ID NO: 2019047 - RNA, 16 nt, Human
uaauugcugaggcaug

SEQ ID NO: 2019048 - RNA, 22 nt, Human
uaauugugugauauuucagaaa

SEQ ID NO: 2019049 - RNA, 20 nt, Human
uaauugugugauauuucaga

SEQ ID NO: 2019050 - RNA, 21 nt, Human
uaauugugugauauuucagaa

SEQ ID NO: 2019051 - RNA, 12 nt, Human
uaauuguuccag

SEQ ID NO: 2019052 - RNA, 14 nt, Human
uaauuguugcauag

SEQ ID NO: 2019053 - RNA, 22 nt, Human
uaauugugcaagcuuuuccuaa

SEQ ID NO: 2019054 - RNA, 12 nt, Human
uaauuguauuuu

SEQ ID NO: 2019055 - RNA, 15 nt, Human
uaauuguauuuuugu

SEQ ID NO: 2019056 - RNA, 12 nt, Human
uaauugugugaa

SEQ ID NO: 2019057 - RNA, 19 nt, Human
uaauugugugaacuuggaa

SEQ ID NO: 2019058 - RNA, 20 nt, Human
uaauugugugaacuuggaag

SEQ ID NO: 2019059 - RNA, 21 nt, Human
uaauugugugaacuuggaagc

SEQ ID NO: 2019060 - RNA, 22 nt, Human
uaauugugugaacuuggaagca

SEQ ID NO: 2019061 - RNA, 15 nt, Human
uaauugugugauauu

SEQ ID NO: 2019062 - RNA, 19 nt, Human
uaauugugugauauuucag

SEQ ID NO: 2019063 - RNA, 16 nt, Human
uagaaaguguucuguu

SEQ ID NO: 2019064 - RNA, 19 nt, Human
uagaaaguguucuguuaca

SEQ ID NO: 2019065 - RNA, 22 nt, Human
uagaaagcuuuguugaaagaaa

SEQ ID NO: 2019066 - RNA, 22 nt, Human
uagaaaguguucuguuacaaaa

SEQ ID NO: 2019067 - RNA, 20 nt, Human
uagaaaguguucuguuacaa

SEQ ID NO: 2019068 - RNA, 21 nt, Human
uagaaaguguucuguuacaaa

SEQ ID NO: 2019069 - RNA, 23 nt, Human
uagaaagcugcugugaucccagu

SEQ ID NO: 2019070 - RNA, 13 nt, Human
uacuuuauagaag

SEQ ID NO: 2019071 - RNA, 15 nt, Human
uacuuuccaauucuc

SEQ ID NO: 2019072 - RNA, 14 nt, Human
uagaaacuggaaau

SEQ ID NO: 2019073 - RNA, 17 nt, Human
uagaaacuggaaauacu

SEQ ID NO: 2019074 - RNA, 18 nt, Human
uagaaacuggaaauacua

SEQ ID NO: 2019075 - RNA, 14 nt, Human
uacuuuauagaaga

SEQ ID NO: 2019076 - RNA, 16 nt, Human
uacuuuauagaagaau

SEQ ID NO: 2019077 - RNA, 18 nt, Human
uacuuuauagaagaaugc

SEQ ID NO: 2019078 - RNA, 19 nt, Human
uacuuuauagaagaaugca

SEQ ID NO: 2019079 - RNA, 13 nt, Human
uagaacagguuuu

SEQ ID NO: 2019080 - RNA, 12 nt, Human
uagaacagguuu

SEQ ID NO: 2019081 - RNA, 14 nt, Human
uagaacagguuuuu

SEQ ID NO: 2019082 - RNA, 15 nt, Human
uagaaauguuugcug

SEQ ID NO: 2019083 - RNA, 17 nt, Human
uagaaauguuugcugaa

SEQ ID NO: 2019084 - RNA, 17 nt, Human
uagaacaacauauacaa

SEQ ID NO: 2019085 - RNA, 23 nt, Human
uagaaauaucugaaaauguaugu

SEQ ID NO: 2019086 - RNA, 21 nt, Human
uagaaauaucugaaaauguau

SEQ ID NO: 2019087 - RNA, 20 nt, Human
uagaaauaucugaaaaugua

SEQ ID NO: 2019088 - RNA, 15 nt, Human
uagaaauauaauuga

SEQ ID NO: 2019089 - RNA, 17 nt, Human
uacugcauaugaaagga

SEQ ID NO: 2019090 - RNA, 21 nt, Human
uacuguaucaugacaaagacu

SEQ ID NO: 2019091 - RNA, 21 nt, Human
uacuguuuaagacacuuccgu

SEQ ID NO: 2019092 - RNA, 17 nt, Human
uacuuagcacuuggccu

SEQ ID NO: 2019093 - RNA, 21 nt, Human
uacuuagcacuuggccugaga

SEQ ID NO: 2019094 - RNA, 16 nt, Human
uacuugcacucuucua

SEQ ID NO: 2019095 - RNA, 21 nt, Human
uacuugcucuugaugccuggc

SEQ ID NO: 2019096 - RNA, 17 nt, Human
uacuugauaacaauguu

SEQ ID NO: 2019097 - RNA, 21 nt, Human
uacuugauaacaauguuuuaa

SEQ ID NO: 2019098 - RNA, 16 nt, Human
uacuugauaagggacu

SEQ ID NO: 2019099 - RNA, 14 nt, Human
uacuugcacucuuc

SEQ ID NO: 2019100 - RNA, 22 nt, Human
uacuuuaacuuaguuuugcaua

SEQ ID NO: 2019101 - RNA, 23 nt, Human
uacuuuaacuuaguuuugcauag

SEQ ID NO: 2019102 - RNA, 21 nt, Human
uacuuuaacuuaguuuugcau

SEQ ID NO: 2019103 - RNA, 19 nt, Human
uacuuguggacacagcucu

SEQ ID NO: 2019104 - RNA, 15 nt, Human
uacuuguggacacag

SEQ ID NO: 2019105 - RNA, 18 nt, Human
uacuuguggacacagcuc

SEQ ID NO: 2019106 - RNA, 15 nt, Human
uacuuggucacagcc

SEQ ID NO: 2019107 - RNA, 17 nt, Human
uacuuggucacagccag

SEQ ID NO: 2019108 - RNA, 18 nt, Human
uacuuggucacagccagg

SEQ ID NO: 2019109 - RNA, 19 nt, Human
uacuuggucacagccaggc

SEQ ID NO: 2019110 - RNA, 17 nt, Human
uacuacaguccucccau

SEQ ID NO: 2019111 - RNA, 12 nt, Human
uacuacaguccu

SEQ ID NO: 2019112 - RNA, 14 nt, Human
uacuacaauaugua

SEQ ID NO: 2019113 - RNA, 17 nt, Human
uacuacaauauguacau

SEQ ID NO: 2019114 - RNA, 13 nt, Human
uacuaacuuuccu

SEQ ID NO: 2019115 - RNA, 19 nt, Human
uacuaacuucuaaaacugu

SEQ ID NO: 2019116 - RNA, 20 nt, Human
uacuaacuucuaaaacugua

SEQ ID NO: 2019117 - RNA, 22 nt, Human
uacuaauaaaauuuaaaagucu

SEQ ID NO: 2019118 - RNA, 15 nt, Human
uacuaauagacaauu

SEQ ID NO: 2019119 - RNA, 17 nt, Human
uacuaauagacaauuua

SEQ ID NO: 2019120 - RNA, 19 nt, Human
uacuaaccagcagaaaugc

SEQ ID NO: 2019121 - RNA, 12 nt, Human
uacuaacuucua

SEQ ID NO: 2019122 - RNA, 17 nt, Human
uacuaacuucuaaaacu

SEQ ID NO: 2019123 - RNA, 18 nt, Human
uacuaacuucuaaaacug

SEQ ID NO: 2019124 - RNA, 17 nt, Human
uacuaaccagcagaaau

SEQ ID NO: 2019125 - RNA, 21 nt, Human
uacgacucuuuuccaaacaca

SEQ ID NO: 2019126 - RNA, 18 nt, Human
uacgaaguucaagaucaa

SEQ ID NO: 2019127 - RNA, 21 nt, Human
uacgacaaaggacgcucccag

SEQ ID NO: 2019128 - RNA, 18 nt, Human
uacuaaccagcagaaaug

SEQ ID NO: 2019129 - RNA, 22 nt, Human
uaccuuuuuuauacauaaacaa

SEQ ID NO: 2019130 - RNA, 16 nt, Human
uacgaaguucaagauc

SEQ ID NO: 2019131 - RNA, 17 nt, Human
uacgaaguucaagauca

SEQ ID NO: 2019132 - RNA, 18 nt, Human
uaccuuuuuuauacauaa

SEQ ID NO: 2019133 - RNA, 20 nt, Human
uaccuuugaauucaagaaca

SEQ ID NO: 2019134 - RNA, 19 nt, Human
uaccuuuuuuauacauaaa

SEQ ID NO: 2019135 - RNA, 20 nt, Human
uaccuuuuuuauacauaaac

SEQ ID NO: 2019136 - RNA, 20 nt, Human
uaccuuuguauucucuccug

SEQ ID NO: 2019137 - RNA, 19 nt, Human
uaccuuugacaaagguaaa

SEQ ID NO: 2019138 - RNA, 23 nt, Human
uaccuugcacacaucaucuguaa

SEQ ID NO: 2019139 - RNA, 19 nt, Human
uaccuugucauuuuggucu

SEQ ID NO: 2019140 - RNA, 16 nt, Human
uaccuugaacugaagg

SEQ ID NO: 2019141 - RNA, 21 nt, Human
uaccuugcacacaucaucugu

SEQ ID NO: 2019142 - RNA, 22 nt, Human
uacccaucccauaugccugggc

SEQ ID NO: 2019143 - RNA, 14 nt, Human
uacuaccuguaaug

SEQ ID NO: 2019144 - RNA, 17 nt, Human
uacuaccuccucuccug

SEQ ID NO: 2019145 - RNA, 15 nt, Human
uacuaccuccucucc

SEQ ID NO: 2019146 - RNA, 20 nt, Human
uacuacaguuuguuaguaug

SEQ ID NO: 2019147 - RNA, 20 nt, Human
uacuacaguccucccaucuc

SEQ ID NO: 2019148 - RNA, 12 nt, Human
uacucaccucac

SEQ ID NO: 2019149 - RNA, 14 nt, Human
uacucaccucaccc

SEQ ID NO: 2019150 - RNA, 15 nt, Human
uacucagggaaagca

SEQ ID NO: 2019151 - RNA, 17 nt, Human
uacucagggaaagcauu

SEQ ID NO: 2019152 - RNA, 21 nt, Human
uacucagggaaagcauuuaaa

SEQ ID NO: 2019153 - RNA, 16 nt, Human
uacucagaauucucua

SEQ ID NO: 2019154 - RNA, 22 nt, Human
uacucagaauucucuaguuuga

SEQ ID NO: 2019155 - RNA, 17 nt, Human
uacucccaucugugaaa

SEQ ID NO: 2019156 - RNA, 16 nt, Human
uacucccaucugugaa

SEQ ID NO: 2019157 - RNA, 14 nt, Human
uacucccaucugug

SEQ ID NO: 2019158 - RNA, 12 nt, Human
uacucccaucug

SEQ ID NO: 2019159 - RNA, 16 nt, Human
uacucauggaagagau

SEQ ID NO: 2019160 - RNA, 22 nt, Human
uacuccugucuucugcuuuguu

SEQ ID NO: 2019161 - RNA, 20 nt, Human
uacuccugucuucugcuuug

SEQ ID NO: 2019162 - RNA, 21 nt, Human
uacuccugucuucugcuuugu

SEQ ID NO: 2019163 - RNA, 13 nt, Human
uacuccugucuuc

SEQ ID NO: 2019164 - RNA, 15 nt, Human
uacuccugucuucug

SEQ ID NO: 2019165 - RNA, 17 nt, Human
uacuccugucuucugcu

SEQ ID NO: 2019166 - RNA, 19 nt, Human
uacuccugucuucugcuuu

SEQ ID NO: 2019167 - RNA, 21 nt, Human
uacugagcagugauauucuuu

SEQ ID NO: 2019168 - RNA, 22 nt, Human
uacugaggauauggacacuggu

SEQ ID NO: 2019169 - RNA, 14 nt, Human
uacugauggaauuu

SEQ ID NO: 2019170 - RNA, 15 nt, Human
uacugaggugcuaug

SEQ ID NO: 2019171 - RNA, 15 nt, Human
uacugagcagugaua

SEQ ID NO: 2019172 - RNA, 18 nt, Human
uacugagcagugauauuc

SEQ ID NO: 2019173 - RNA, 19 nt, Human
uacauaagauaaaugugcu

SEQ ID NO: 2019174 - RNA, 18 nt, Human
uacauaagauaaaugugc

SEQ ID NO: 2019175 - RNA, 18 nt, Human
uacaguuccuagguauaa

SEQ ID NO: 2019176 - RNA, 19 nt, Human
uacaguuacucagaauucu

SEQ ID NO: 2019177 - RNA, 23 nt, Human
uacaguuacucagaauucucuag

SEQ ID NO: 2019178 - RNA, 14 nt, Human
uacaguuacuuuuc

SEQ ID NO: 2019179 - RNA, 15 nt, Human
uacaguuacuuuucc

SEQ ID NO: 2019180 - RNA, 16 nt, Human
uacaguuacuuuuccu

SEQ ID NO: 2019181 - RNA, 17 nt, Human
uacaguuacuuuuccuu

SEQ ID NO: 2019182 - RNA, 22 nt, Human
uacauaagauaaaugugcugaa

SEQ ID NO: 2019183 - RNA, 21 nt, Human
uacaugagguacugagaguga

SEQ ID NO: 2019184 - RNA, 22 nt, Human
uacaugagguacugagagugaa

SEQ ID NO: 2019185 - RNA, 15 nt, Human
uacaugaugauuuca

SEQ ID NO: 2019186 - RNA, 17 nt, Human
uacaugaugauuucaga

SEQ ID NO: 2019187 - RNA, 22 nt, Human
uacaugaugauuucagaaacaa

SEQ ID NO: 2019188 - RNA, 12 nt, Human
uaccaacuuuca

SEQ ID NO: 2019189 - RNA, 13 nt, Human
uaccaacuuucaa

SEQ ID NO: 2019190 - RNA, 14 nt, Human
uaccaacuuucaag

SEQ ID NO: 2019191 - RNA, 15 nt, Human
uaccaacuuucaaga

SEQ ID NO: 2019192 - RNA, 21 nt, Human
uaccaacuuucaagaacuugu

SEQ ID NO: 2019193 - RNA, 17 nt, Human
uacauuuguaauuuaag

SEQ ID NO: 2019194 - RNA, 19 nt, Human
uacauuuguaauuuaaggu

SEQ ID NO: 2019195 - RNA, 18 nt, Human
uacauuuguauuuuucca

SEQ ID NO: 2019196 - RNA, 19 nt, Human
uacccacccccacccaagg

SEQ ID NO: 2019197 - RNA, 17 nt, Human
uacccacccccacccaa

SEQ ID NO: 2019198 - RNA, 23 nt, Human
uacccacccccacccaagggccu

SEQ ID NO: 2019199 - RNA, 15 nt, Human
uacccaaauuaagag

SEQ ID NO: 2019200 - RNA, 15 nt, Human
uacccacccccaccc

SEQ ID NO: 2019201 - RNA, 12 nt, Human
uacccaccccca

SEQ ID NO: 2019202 - RNA, 11 nt, Human
uacccacugcu

SEQ ID NO: 2019203 - RNA, 12 nt, Human
uacccacugcuc

SEQ ID NO: 2019204 - RNA, 13 nt, Human
uacccacugcucu

SEQ ID NO: 2019205 - RNA, 14 nt, Human
uacccacugcucug

SEQ ID NO: 2019206 - RNA, 16 nt, Human
uacccagcgagcccug

SEQ ID NO: 2019207 - RNA, 22 nt, Human
uacccaggugcuaggaacacuc

SEQ ID NO: 2019208 - RNA, 18 nt, Human
uacccagcgagcccuggu

SEQ ID NO: 2019209 - RNA, 19 nt, Human
uaccauuuccguaauucuu

SEQ ID NO: 2019210 - RNA, 20 nt, Human
uaccauuuccguaauucuua

SEQ ID NO: 2019211 - RNA, 13 nt, Human
uaccauuucagua

SEQ ID NO: 2019212 - RNA, 23 nt, Human
uaccauuuugggguacccacugc

SEQ ID NO: 2019213 - RNA, 22 nt, Human
uaccauuuccguaauucuuauu

SEQ ID NO: 2019214 - RNA, 15 nt, Human
uaccaccacgcccgg

SEQ ID NO: 2019215 - RNA, 20 nt, Human
uaccauuggaaauuucacgu

SEQ ID NO: 2019216 - RNA, 13 nt, Human
uaccauuggaaau

SEQ ID NO: 2019217 - RNA, 15 nt, Human
uaccauuggaaauuu

SEQ ID NO: 2019218 - RNA, 17 nt, Human
uaccauuggaaauuuca

SEQ ID NO: 2019219 - RNA, 19 nt, Human
uaccauuggaaauuucacg

SEQ ID NO: 2019220 - RNA, 13 nt, Human
uaccacagacaua

SEQ ID NO: 2019221 - RNA, 21 nt, Human
uaccaagaaaggaaccuguca

SEQ ID NO: 2019222 - RNA, 24 nt, Human
uacagcaaggagauuuacaacugg

SEQ ID NO: 2019223 - RNA, 13 nt, Human
uacagaauuuuau

SEQ ID NO: 2019224 - RNA, 17 nt, Human
uacacuguuucaaacuu

SEQ ID NO: 2019225 - RNA, 18 nt, Human
uacacuguuucaaacuuu

SEQ ID NO: 2019226 - RNA, 19 nt, Human
uacacuguuucaaacuuua

SEQ ID NO: 2019227 - RNA, 18 nt, Human
uacagaaaaguugaauuu

SEQ ID NO: 2019228 - RNA, 22 nt, Human
uacagaaaaguugaauuuuaca

SEQ ID NO: 2019229 - RNA, 13 nt, Human
uacacuuuaugca

SEQ ID NO: 2019230 - RNA, 21 nt, Human
uacagcuugaccgugaggcca

SEQ ID NO: 2019231 - RNA, 17 nt, Human
uacagcccaccuggcuu

SEQ ID NO: 2019232 - RNA, 22 nt, Human
uacagcuugaccgugaggccag

SEQ ID NO: 2019233 - RNA, 23 nt, Human
uacagcuugaccgugaggccaga

SEQ ID NO: 2019234 - RNA, 17 nt, Human
uacaggaaaagcugcug

SEQ ID NO: 2019235 - RNA, 18 nt, Human
uacaggaaaagcugcuga

SEQ ID NO: 2019236 - RNA, 19 nt, Human
uacaggaaaagcugcugac

SEQ ID NO: 2019237 - RNA, 16 nt, Human
uacaggcacccaccau

SEQ ID NO: 2019238 - RNA, 14 nt, Human
uacaggauuugaaa

SEQ ID NO: 2019239 - RNA, 17 nt, Human
uaauuuugaaaaacugc

SEQ ID NO: 2019240 - RNA, 13 nt, Human
uaauuuugaaaaa

SEQ ID NO: 2019241 - RNA, 12 nt, Human
uaauuuuguaau

SEQ ID NO: 2019242 - RNA, 19 nt, Human
uaauuuuguaauguaucaa

SEQ ID NO: 2019243 - RNA, 11 nt, Human
uaauuuugucu

SEQ ID NO: 2019244 - RNA, 18 nt, Human
uaauuuugauagugggac

SEQ ID NO: 2019245 - RNA, 20 nt, Human
uaauuuugauagugggacca

SEQ ID NO: 2019246 - RNA, 19 nt, Human
uacaagagcuuaacagugu

SEQ ID NO: 2019247 - RNA, 15 nt, Human
uacaagacacaguga

SEQ ID NO: 2019248 - RNA, 17 nt, Human
uacaagacaacauugua

SEQ ID NO: 2019249 - RNA, 18 nt, Human
uacaagacaacauuguaa

SEQ ID NO: 2019250 - RNA, 13 nt, Human
uacacaaaaucaa

SEQ ID NO: 2019251 - RNA, 20 nt, Human
uacacaaaaucaaauaauac

SEQ ID NO: 2019252 - RNA, 16 nt, Human
uacacugugcugaguc

SEQ ID NO: 2019253 - RNA, 14 nt, Human
uacacuguuucaaa

SEQ ID NO: 2019254 - RNA, 23 nt, Human
uacacuggcaaugguaguuucug

SEQ ID NO: 2019255 - RNA, 24 nt, Human
uacacuggcaaugguaguuucugu

SEQ ID NO: 2019256 - RNA, 18 nt, Human
uacacugccugccuuaag

SEQ ID NO: 2019257 - RNA, 21 nt, Human
uacacugccugccuuaaguga

SEQ ID NO: 2019258 - RNA, 18 nt, Human
uacacuggcaaugguagu

SEQ ID NO: 2019259 - RNA, 20 nt, Human
uacacuggcaaugguaguuu

SEQ ID NO: 2019260 - RNA, 22 nt, Human
uacacuggcaaugguaguuucu

SEQ ID NO: 2019261 - RNA, 22 nt, Human
uacacacugcauguuugugauu

SEQ ID NO: 2019262 - RNA, 16 nt, Human
uacacacgcugccuuc

SEQ ID NO: 2019263 - RNA, 17 nt, Human
uacacacgcugccuucg

SEQ ID NO: 2019264 - RNA, 17 nt, Human
uacacugccugccuuaa

SEQ ID NO: 2019265 - RNA, 23 nt, Human
uacacaaugguuuucuugugugu

SEQ ID NO: 2019266 - RNA, 21 nt, Human
uacacaaugguuuucuugugu

SEQ ID NO: 2019267 - RNA, 17 nt, Human
uacacaaugguuuucuu

SEQ ID NO: 2019268 - RNA, 21 nt, Human
uacacacacacgcgugcacac

SEQ ID NO: 2019269 - RNA, 15 nt, Human
uacacacacauacac

SEQ ID NO: 2019270 - RNA, 14 nt, Human
uacacacgcugccu

SEQ ID NO: 2019271 - RNA, 15 nt, Human
uacacacgcugccuu

SEQ ID NO: 2019272 - RNA, 17 nt, Human
uacacacugcauguuug

SEQ ID NO: 2019273 - RNA, 17 nt, Human
uaggaaggcacuucugc

SEQ ID NO: 2019274 - RNA, 19 nt, Human
uaggaaggcacuucugccu

SEQ ID NO: 2019275 - RNA, 21 nt, Human
uaggaaggcacuucugccuga

SEQ ID NO: 2019276 - RNA, 17 nt, Human
uaggaagacuuuggaaa

SEQ ID NO: 2019277 - RNA, 16 nt, Human
uaggaagacuuuggaa

SEQ ID NO: 2019278 - RNA, 15 nt, Human
uaggaagacuuugga

SEQ ID NO: 2019279 - RNA, 14 nt, Human
uaggaagacuuugg

SEQ ID NO: 2019280 - RNA, 13 nt, Human
uaggaagacuuug

SEQ ID NO: 2019281 - RNA, 13 nt, Human
uaggaacaaaucu

SEQ ID NO: 2019282 - RNA, 14 nt, Human
uaggaacacuccuu

SEQ ID NO: 2019283 - RNA, 13 nt, Human
uaggaacacuccu

SEQ ID NO: 2019284 - RNA, 15 nt, Human
uaggaacugcugggc

SEQ ID NO: 2019285 - RNA, 18 nt, Human
uaggaacugcugggcuug

SEQ ID NO: 2019286 - RNA, 21 nt, Human
uaggaacuuaaauaaugugaa

SEQ ID NO: 2019287 - RNA, 17 nt, Human
uaggaacacuccuucac

SEQ ID NO: 2019288 - RNA, 14 nt, Human
uaggaacaaaucuu

SEQ ID NO: 2019289 - RNA, 16 nt, Human
uaggaacaaaucuucc

SEQ ID NO: 2019290 - RNA, 22 nt, Human
uaggaacaaaucuuccuggucg

SEQ ID NO: 2019291 - RNA, 13 nt, Human
uaggccaugggac

SEQ ID NO: 2019292 - RNA, 17 nt, Human
uaggccguuccuucaaa

SEQ ID NO: 2019293 - RNA, 19 nt, Human
uaggccaaagacaaauagu

SEQ ID NO: 2019294 - RNA, 21 nt, Human
uaggaaguuagccuuuaucua

SEQ ID NO: 2019295 - RNA, 18 nt, Human
uaggccaaagacaaauag

SEQ ID NO: 2019296 - RNA, 18 nt, Human
uaggccaaucagaagcua

SEQ ID NO: 2019297 - RNA, 19 nt, Human
uaggccucaggugaaacuc

SEQ ID NO: 2019298 - RNA, 14 nt, Human
uaggccuggccaga

SEQ ID NO: 2019299 - RNA, 13 nt, Human
uaggccuggccag

SEQ ID NO: 2019300 - RNA, 23 nt, Human
uaggaauugacccacaagaaaug

SEQ ID NO: 2019301 - RNA, 20 nt, Human
uaggaauugacccacaagaa

SEQ ID NO: 2019302 - RNA, 14 nt, Human
uaggaauuguguuu

SEQ ID NO: 2019303 - RNA, 15 nt, Human
uaggaagguuaaugu

SEQ ID NO: 2019304 - RNA, 14 nt, Human
uaggaaggucauuu

SEQ ID NO: 2019305 - RNA, 16 nt, Human
uaggaaggucauuucc

SEQ ID NO: 2019306 - RNA, 18 nt, Human
uaggaaggucauuuccau

SEQ ID NO: 2019307 - RNA, 19 nt, Human
uaggaaggucauuuccaug

SEQ ID NO: 2019308 - RNA, 23 nt, Human
uaggaaggucauuuccauguaug

SEQ ID NO: 2019309 - RNA, 19 nt, Human
uaggaaguuaaaagcacaa

SEQ ID NO: 2019310 - RNA, 11 nt, Human
uagccucacgc

SEQ ID NO: 2019311 - RNA, 16 nt, Human
uagccccacaggaggu

SEQ ID NO: 2019312 - RNA, 13 nt, Human
uagccccauaauu

SEQ ID NO: 2019313 - RNA, 18 nt, Human
uagcccucacccuggggc

SEQ ID NO: 2019314 - RNA, 12 nt, Human
uagcccugcccg

SEQ ID NO: 2019315 - RNA, 20 nt, Human
uagcccaggauauauuuuau

SEQ ID NO: 2019316 - RNA, 21 nt, Human
uagcccaggauauauuuuauu

SEQ ID NO: 2019317 - RNA, 22 nt, Human
uagcccaggauauauuuuauuu

SEQ ID NO: 2019318 - RNA, 14 nt, Human
uagcccaaaaccaa

SEQ ID NO: 2019319 - RNA, 11 nt, Human
uagcugggacu

SEQ ID NO: 2019320 - RNA, 17 nt, Human
uagcucuguacaucuuu

SEQ ID NO: 2019321 - RNA, 18 nt, Human
uagcugggacuacaggug

SEQ ID NO: 2019322 - RNA, 22 nt, Human
uagcugggagaaagagagagcu

SEQ ID NO: 2019323 - RNA, 17 nt, Human
uagcuggagaggagccc

SEQ ID NO: 2019324 - RNA, 19 nt, Human
uagcuggagaggagcccug

SEQ ID NO: 2019325 - RNA, 23 nt, Human
uagcuggagaggagcccugccuc

SEQ ID NO: 2019326 - RNA, 12 nt, Human
uagcugggacua

SEQ ID NO: 2019327 - RNA, 20 nt, Human
uagcugggacuacaggcacc

SEQ ID NO: 2019328 - RNA, 21 nt, Human
uagcucuaggagggcuggcaa

SEQ ID NO: 2019329 - RNA, 17 nt, Human
uagccugccucuucucu

SEQ ID NO: 2019330 - RNA, 22 nt, Human
uagcucauucuccuuguguuac

SEQ ID NO: 2019331 - RNA, 19 nt, Human
uagaguagagguauaauug

SEQ ID NO: 2019332 - RNA, 19 nt, Human
uagaguaaaaagaaaacaa

SEQ ID NO: 2019333 - RNA, 13 nt, Human
uagaguacacugc

SEQ ID NO: 2019334 - RNA, 17 nt, Human
uagaguacacugccugc

SEQ ID NO: 2019335 - RNA, 21 nt, Human
uagaguacacugccugccuua

SEQ ID NO: 2019336 - RNA, 22 nt, Human
uagaguacacugccugccuuaa

SEQ ID NO: 2019337 - RNA, 21 nt, Human
uagagucauuguaauguugug

SEQ ID NO: 2019338 - RNA, 14 nt, Human
uagagucauuguaa

SEQ ID NO: 2019339 - RNA, 15 nt, Human
uagagucauuguaau

SEQ ID NO: 2019340 - RNA, 16 nt, Human
uagagucauuguaaug

SEQ ID NO: 2019341 - RNA, 19 nt, Human
uagagucauuguaauguug

SEQ ID NO: 2019342 - RNA, 19 nt, Human
uagagguucaaagauauuu

SEQ ID NO: 2019343 - RNA, 16 nt, Human
uagagguucaaagaua

SEQ ID NO: 2019344 - RNA, 21 nt, Human
uagagguucaaagauauuuug

SEQ ID NO: 2019345 - RNA, 17 nt, Human
uagaguaaaaagaaaac

SEQ ID NO: 2019346 - RNA, 16 nt, Human
uagagagagaccacuu

SEQ ID NO: 2019347 - RNA, 16 nt, Human
uagaacccuugcacag

SEQ ID NO: 2019348 - RNA, 12 nt, Human
uagaaccaggca

SEQ ID NO: 2019349 - RNA, 23 nt, Human
uagaaccaggcaacuugggaacu

SEQ ID NO: 2019350 - RNA, 20 nt, Human
uagacugccacaaggaagaa

SEQ ID NO: 2019351 - RNA, 22 nt, Human
uagacugccagcucuuccuagc

SEQ ID NO: 2019352 - RNA, 20 nt, Human
uagacuggccugaaccacag

SEQ ID NO: 2019353 - RNA, 22 nt, Human
uagacugccacaaggaagaaau

SEQ ID NO: 2019354 - RNA, 23 nt, Human
uagacugccacaaggaagaaauu

SEQ ID NO: 2019355 - RNA, 11 nt, Human
uagacugccag

SEQ ID NO: 2019356 - RNA, 12 nt, Human
uagacugccagc

SEQ ID NO: 2019357 - RNA, 13 nt, Human
uagacugccagcu

SEQ ID NO: 2019358 - RNA, 14 nt, Human
uagacugccagcuc

SEQ ID NO: 2019359 - RNA, 16 nt, Human
uagacugccagcucuu

SEQ ID NO: 2019360 - RNA, 17 nt, Human
uagacugccagcucuuc

SEQ ID NO: 2019361 - RNA, 23 nt, Human
uagacuuuuccaauaugugauuu

SEQ ID NO: 2019362 - RNA, 14 nt, Human
uagacuuuuccaau

SEQ ID NO: 2019363 - RNA, 20 nt, Human
uagacuuuuccaauauguga

SEQ ID NO: 2019364 - RNA, 14 nt, Human
uagacuugaaaaga

SEQ ID NO: 2019365 - RNA, 18 nt, Human
uagacuugaaaagagaca

SEQ ID NO: 2019366 - RNA, 19 nt, Human
uagacuugaaaagagacag

SEQ ID NO: 2019367 - RNA, 20 nt, Human
uagacuugaaaagagacagg

SEQ ID NO: 2019368 - RNA, 23 nt, Human
uagacuugaaaagagacaggcag

SEQ ID NO: 2019369 - RNA, 11 nt, Human
uagaugugugg

SEQ ID NO: 2019370 - RNA, 16 nt, Human
uagaugugcugcuuug

SEQ ID NO: 2019371 - RNA, 15 nt, Human
uagaugugagaaaac

SEQ ID NO: 2019372 - RNA, 13 nt, Human
uagauguaaauuu

SEQ ID NO: 2019373 - RNA, 14 nt, Human
uagauguaaauuuu

SEQ ID NO: 2019374 - RNA, 16 nt, Human
uagauguaauuuugug

SEQ ID NO: 2019375 - RNA, 12 nt, Human
uagauguauaua

SEQ ID NO: 2019376 - RNA, 18 nt, Human
uagauaauacaccacuac

SEQ ID NO: 2019377 - RNA, 15 nt, Human
uagauaauuaaccaa

SEQ ID NO: 2019378 - RNA, 21 nt, Human
uagauacaccucaacuaaauc

SEQ ID NO: 2019379 - RNA, 13 nt, Human
uagauguuuuaua

SEQ ID NO: 2019380 - RNA, 18 nt, Human
uagauuaaaucauacucc

SEQ ID NO: 2019381 - RNA, 16 nt, Human
uagcacuuugggaggc

SEQ ID NO: 2019382 - RNA, 19 nt, Human
uagcagagaaugaaagggc

SEQ ID NO: 2019383 - RNA, 23 nt, Human
uagcagagaaugaaagggcccag

SEQ ID NO: 2019384 - RNA, 15 nt, Human
uauauuuuucuuaaa

SEQ ID NO: 2019385 - RNA, 17 nt, Human
uauauuuuucuuaaaaa

SEQ ID NO: 2019386 - RNA, 18 nt, Human
uauauuuuucuuaaaaag

SEQ ID NO: 2019387 - RNA, 20 nt, Human
uauauuuuucuuaaaaagua

SEQ ID NO: 2019388 - RNA, 19 nt, Human
uauauuuuuuguuaaauga

SEQ ID NO: 2019389 - RNA, 17 nt, Human
uaucaggugcugccauc

SEQ ID NO: 2019390 - RNA, 23 nt, Human
uaucaggauuuccucuugaacca

SEQ ID NO: 2019391 - RNA, 16 nt, Human
uaucaggauuuccucu

SEQ ID NO: 2019392 - RNA, 16 nt, Human
uaucaugacaaagacu

SEQ ID NO: 2019393 - RNA, 16 nt, Human
uaucaugucaaacgug

SEQ ID NO: 2019394 - RNA, 11 nt, Human
uaucaugaagc

SEQ ID NO: 2019395 - RNA, 18 nt, Human
uauccugggcuuuuguuu

SEQ ID NO: 2019396 - RNA, 23 nt, Human
uauccugggcuuuuguuuugcuu

SEQ ID NO: 2019397 - RNA, 14 nt, Human
uauccuuuucugug

SEQ ID NO: 2019398 - RNA, 15 nt, Human
uauccuuuucugugu

SEQ ID NO: 2019399 - RNA, 16 nt, Human
uauccuuuucuguguu

SEQ ID NO: 2019400 - RNA, 17 nt, Human
uauccuuuucuguguuu

SEQ ID NO: 2019401 - RNA, 22 nt, Human
uaucaugugaaaucauucauuu

SEQ ID NO: 2019402 - RNA, 17 nt, Human
uaucaugugaaaucauu

SEQ ID NO: 2019403 - RNA, 21 nt, Human
uaucaugucaaacgugaaaau

SEQ ID NO: 2019404 - RNA, 15 nt, Human
uaucuaaauguugaa

SEQ ID NO: 2019405 - RNA, 19 nt, Human
uaucgucacugcuuaacuu

SEQ ID NO: 2019406 - RNA, 19 nt, Human
uaucgcccuggcaggcagg

SEQ ID NO: 2019407 - RNA, 20 nt, Human
uauauacuuguuguuuaaug

SEQ ID NO: 2019408 - RNA, 15 nt, Human
uauauaccguggggg

SEQ ID NO: 2019409 - RNA, 19 nt, Human
uauauaccugcgcuuguuu

SEQ ID NO: 2019410 - RNA, 19 nt, Human
uauaugcauauauauaugu

SEQ ID NO: 2019411 - RNA, 20 nt, Human
uauaugcucugcauguuaca

SEQ ID NO: 2019412 - RNA, 12 nt, Human
uauauuucaagu

SEQ ID NO: 2019413 - RNA, 18 nt, Human
uauauuuccuauaccauu

SEQ ID NO: 2019414 - RNA, 21 nt, Human
uauauuuccuauaccauuucc

SEQ ID NO: 2019415 - RNA, 22 nt, Human
uauauuuccuauaccauuuccg

SEQ ID NO: 2019416 - RNA, 14 nt, Human
uauauuuuaagacg

SEQ ID NO: 2019417 - RNA, 13 nt, Human
uauauuuuaagac

SEQ ID NO: 2019418 - RNA, 21 nt, Human
uauauuucccugaaggaacca

SEQ ID NO: 2019419 - RNA, 13 nt, Human
uauauguaugugu

SEQ ID NO: 2019420 - RNA, 12 nt, Human
uauauuuauuga

SEQ ID NO: 2019421 - RNA, 13 nt, Human
uauauuuauugac

SEQ ID NO: 2019422 - RNA, 21 nt, Human
uauauuuauugacucuugagu

SEQ ID NO: 2019423 - RNA, 20 nt, Human
uauauggugguaauaaggga

SEQ ID NO: 2019424 - RNA, 22 nt, Human
uauauggugguaauaagggaaa

SEQ ID NO: 2019425 - RNA, 15 nt, Human
uauauggucuaaugu

SEQ ID NO: 2019426 - RNA, 17 nt, Human
uauauggucuaauguuu

SEQ ID NO: 2019427 - RNA, 22 nt, Human
uauaugcauauauauaugugug

SEQ ID NO: 2019428 - RNA, 21 nt, Human
uaguuguaccgcaaugugacu

SEQ ID NO: 2019429 - RNA, 16 nt, Human
uaguuuacugagaaug

SEQ ID NO: 2019430 - RNA, 14 nt, Human
uaguuguuaaguuu

SEQ ID NO: 2019431 - RNA, 17 nt, Human
uaguuuauuuuaaaaca

SEQ ID NO: 2019432 - RNA, 12 nt, Human
uaguuugcaguu

SEQ ID NO: 2019433 - RNA, 23 nt, Human
uaguuugauuaaauucuugcaaa

SEQ ID NO: 2019434 - RNA, 13 nt, Human
uaguuucuccaag

SEQ ID NO: 2019435 - RNA, 14 nt, Human
uaguuucugugguu

SEQ ID NO: 2019436 - RNA, 15 nt, Human
uaguggauguucuga

SEQ ID NO: 2019437 - RNA, 15 nt, Human
uaguggauggaaggg

SEQ ID NO: 2019438 - RNA, 18 nt, Human
uaguggacccugaaaugu

SEQ ID NO: 2019439 - RNA, 19 nt, Human
uaguggacccugaaaugug

SEQ ID NO: 2019440 - RNA, 20 nt, Human
uaguggacccugaaaugugu

SEQ ID NO: 2019441 - RNA, 21 nt, Human
uaguggacccugaaaugugug

SEQ ID NO: 2019442 - RNA, 18 nt, Human
uaguggauggaaggggcu

SEQ ID NO: 2019443 - RNA, 21 nt, Human
uaguguagauuccauuuacug

SEQ ID NO: 2019444 - RNA, 13 nt, Human
uagugaugguucc

SEQ ID NO: 2019445 - RNA, 23 nt, Human
uagucaacaguacccugguugug

SEQ ID NO: 2019446 - RNA, 19 nt, Human
uagucaagacgaacaugua

SEQ ID NO: 2019447 - RNA, 12 nt, Human
uagugcugugaa

SEQ ID NO: 2019448 - RNA, 15 nt, Human
uaguggacccugaaa

SEQ ID NO: 2019449 - RNA, 17 nt, Human
uaguggacccugaaaug

SEQ ID NO: 2019450 - RNA, 17 nt, Human
uagugcugugaaaaaaa

SEQ ID NO: 2019451 - RNA, 13 nt, Human
uagugcugugaaa

SEQ ID NO: 2019452 - RNA, 16 nt, Human
uagugcugugaaaaaa

SEQ ID NO: 2019453 - RNA, 14 nt, Human
uagugaugguuccc

SEQ ID NO: 2019454 - RNA, 18 nt, Human
uagugaugguuccccugu

SEQ ID NO: 2019455 - RNA, 17 nt, Human
uauaauucuacuuugag

SEQ ID NO: 2019456 - RNA, 20 nt, Human
uauaauucacauuguauuca

SEQ ID NO: 2019457 - RNA, 15 nt, Human
uauaauguauucaua

SEQ ID NO: 2019458 - RNA, 18 nt, Human
uauaauguauucauauuu

SEQ ID NO: 2019459 - RNA, 19 nt, Human
uauaauguauucauauuug

SEQ ID NO: 2019460 - RNA, 20 nt, Human
uauaauguaagcucuacuga

SEQ ID NO: 2019461 - RNA, 19 nt, Human
uauaauguaagcucuacug

SEQ ID NO: 2019462 - RNA, 14 nt, Human
uauaauguaagcuc

SEQ ID NO: 2019463 - RNA, 18 nt, Human
uauaaugggauuggguuu

SEQ ID NO: 2019464 - RNA, 20 nt, Human
uauacucuuauagacaacau

SEQ ID NO: 2019465 - RNA, 17 nt, Human
uauacccccugcaaagc

SEQ ID NO: 2019466 - RNA, 20 nt, Human
uauaauguauucauauuugu

SEQ ID NO: 2019467 - RNA, 20 nt, Human
uauaaauugucuuaauggau

SEQ ID NO: 2019468 - RNA, 14 nt, Human
uauaaauuuauuua

SEQ ID NO: 2019469 - RNA, 15 nt, Human
uauaaauuuauuuac

SEQ ID NO: 2019470 - RNA, 16 nt, Human
uauaaauuuauuuacu

SEQ ID NO: 2019471 - RNA, 18 nt, Human
uauaaugaaugaaacauu

SEQ ID NO: 2019472 - RNA, 22 nt, Human
uauaaauuuauuuacugcuagu

SEQ ID NO: 2019473 - RNA, 20 nt, Human
uauaaugaaugaaacauuuu

SEQ ID NO: 2019474 - RNA, 11 nt, Human
uauaaugaaug

SEQ ID NO: 2019475 - RNA, 17 nt, Human
uauaaauugucuuaaug

SEQ ID NO: 2019476 - RNA, 17 nt, Human
uaguuugcauuucagaa

SEQ ID NO: 2019477 - RNA, 18 nt, Human
uaguuugcauuucagaaa

SEQ ID NO: 2019478 - RNA, 13 nt, Human
uaguuugcauuuc

SEQ ID NO: 2019479 - RNA, 16 nt, Human
uaguuugcauuucaga

SEQ ID NO: 2019480 - RNA, 19 nt, Human
uaguuuuacccuauaucua

SEQ ID NO: 2019481 - RNA, 21 nt, Human
ggcagcucaccucucccuugg

SEQ ID NO: 2019482 - RNA, 18 nt, Human
ggcagcucaccucucccu

SEQ ID NO: 2019483 - RNA, 22 nt, Human
ggcagcucaccucucccuugga

SEQ ID NO: 2019484 - RNA, 21 nt, Human
ggcagcuugaggguugggcug

SEQ ID NO: 2019485 - RNA, 19 nt, Human
ggcagcugcgguccaccca

SEQ ID NO: 2019486 - RNA, 14 nt, Human
ggcagguccccaga

SEQ ID NO: 2019487 - RNA, 19 nt, Human
ggcagguccccagacucca

SEQ ID NO: 2019488 - RNA, 23 nt, Human
ggcaggucuugaacuccuggccu

SEQ ID NO: 2019489 - RNA, 13 nt, Human
ggcagguccaggg

SEQ ID NO: 2019490 - RNA, 14 nt, Human
ggcaggaaggcuga

SEQ ID NO: 2019491 - RNA, 13 nt, Human
ggcagaucuccca

SEQ ID NO: 2019492 - RNA, 19 nt, Human
ggcagaucucccacaugcc

SEQ ID NO: 2019493 - RNA, 20 nt, Human
ggcagaugcagcucuuccug

SEQ ID NO: 2019494 - RNA, 21 nt, Human
ggcagaugcagcucuuccugg

SEQ ID NO: 2019495 - RNA, 15 nt, Human
ggcagaugcagcucu

SEQ ID NO: 2019496 - RNA, 18 nt, Human
ggcagaugcagcucuucc

SEQ ID NO: 2019497 - RNA, 13 nt, Human
ggcagcacccagg

SEQ ID NO: 2019498 - RNA, 19 nt, Human
ggcagcaccgccucuuccc

SEQ ID NO: 2019499 - RNA, 12 nt, Human
ggcagcaccgcc

SEQ ID NO: 2019500 - RNA, 17 nt, Human
ggcagaggaaagcaaag

SEQ ID NO: 2019501 - RNA, 21 nt, Human
ggcagaggagaacuugcugcc

SEQ ID NO: 2019502 - RNA, 22 nt, Human
ggcagaggagaacuugcugccu

SEQ ID NO: 2019503 - RNA, 23 nt, Human
ggcagaguugaagacagagcuac

SEQ ID NO: 2019504 - RNA, 23 nt, Human
ggcagauacaggaaaagcugcug

SEQ ID NO: 2019505 - RNA, 19 nt, Human
ggcaacugcauuggcuuug

SEQ ID NO: 2019506 - RNA, 15 nt, Human
ggcaaggcugucaau

SEQ ID NO: 2019507 - RNA, 18 nt, Human
ggcaacuugggaacuaga

SEQ ID NO: 2019508 - RNA, 23 nt, Human
ggcaacuugggaacuagacuccc

SEQ ID NO: 2019509 - RNA, 18 nt, Human
ggcaacugcauuggcuuu

SEQ ID NO: 2019510 - RNA, 12 nt, Human
ggauccccuucc

SEQ ID NO: 2019511 - RNA, 13 nt, Human
ggaucagcugagc

SEQ ID NO: 2019512 - RNA, 21 nt, Human
ggaucagucugauucccaagc

SEQ ID NO: 2019513 - RNA, 16 nt, Human
ggaucaggcucccagg

SEQ ID NO: 2019514 - RNA, 18 nt, Human
ggaucaggcucccaggag

SEQ ID NO: 2019515 - RNA, 12 nt, Human
ggauccaggccc

SEQ ID NO: 2019516 - RNA, 13 nt, Human
ggauccaggcccc

SEQ ID NO: 2019517 - RNA, 17 nt, Human
ggauccaggccccuccc

SEQ ID NO: 2019518 - RNA, 18 nt, Human
ggauccaggccccucccu

SEQ ID NO: 2019519 - RNA, 19 nt, Human
ggcaacccccagccugcua

SEQ ID NO: 2019520 - RNA, 19 nt, Human
ggauccaggccccucccuc

SEQ ID NO: 2019521 - RNA, 16 nt, Human
ggcaaggcugucaauu

SEQ ID NO: 2019522 - RNA, 16 nt, Human
ggcaaggggaaucugg

SEQ ID NO: 2019523 - RNA, 20 nt, Human
ggcaaguuuuccauauuuuu

SEQ ID NO: 2019524 - RNA, 22 nt, Human
ggcaauaaaagcccaggagccc

SEQ ID NO: 2019525 - RNA, 15 nt, Human
ggcaauaaauuuuga

SEQ ID NO: 2019526 - RNA, 16 nt, Human
ggcaaguuuucccuga

SEQ ID NO: 2019527 - RNA, 16 nt, Human
ggcaauaaaagcccag

SEQ ID NO: 2019528 - RNA, 17 nt, Human
ggcaauaaaagcccagg

SEQ ID NO: 2019529 - RNA, 20 nt, Human
ggcaauaaaagcccaggagc

SEQ ID NO: 2019530 - RNA, 17 nt, Human
ggcacccggccccugcu

SEQ ID NO: 2019531 - RNA, 15 nt, Human
ggcacccggccccug

SEQ ID NO: 2019532 - RNA, 16 nt, Human
ggcacccggccccugc

SEQ ID NO: 2019533 - RNA, 16 nt, Human
ggcagagcagagacca

SEQ ID NO: 2019534 - RNA, 15 nt, Human
ggcagagcagagacc

SEQ ID NO: 2019535 - RNA, 20 nt, Human
ggcagagcagagaccauccc

SEQ ID NO: 2019536 - RNA, 16 nt, Human
ggcaccucacaggccc

SEQ ID NO: 2019537 - RNA, 19 nt, Human
ggcaccucacaggccccag

SEQ ID NO: 2019538 - RNA, 12 nt, Human
ggcagagcagag

SEQ ID NO: 2019539 - RNA, 15 nt, Human
ggccccucccucucc

SEQ ID NO: 2019540 - RNA, 23 nt, Human
ggccccucccucuccagcaggcc

SEQ ID NO: 2019541 - RNA, 21 nt, Human
ggccccucagggucccuggug

SEQ ID NO: 2019542 - RNA, 20 nt, Human
ggccccucagggucccuggu

SEQ ID NO: 2019543 - RNA, 19 nt, Human
ggccccucagggucccugg

SEQ ID NO: 2019544 - RNA, 16 nt, Human
ggccccucaggguccc

SEQ ID NO: 2019545 - RNA, 17 nt, Human
ggccccugccacccugg

SEQ ID NO: 2019546 - RNA, 18 nt, Human
ggccccugccacccuggg

SEQ ID NO: 2019547 - RNA, 17 nt, Human
ggccccugccagacccc

SEQ ID NO: 2019548 - RNA, 19 nt, Human
ggccccugccagacccccu

SEQ ID NO: 2019549 - RNA, 13 nt, Human
ggccccugcccgg

SEQ ID NO: 2019550 - RNA, 13 nt, Human
ggccccugccacc

SEQ ID NO: 2019551 - RNA, 16 nt, Human
ggccccugccacccug

SEQ ID NO: 2019552 - RNA, 17 nt, Human
ggccccugagaucucug

SEQ ID NO: 2019553 - RNA, 21 nt, Human
ggccccugagaucucugcagg

SEQ ID NO: 2019554 - RNA, 12 nt, Human
ggccccugccac

SEQ ID NO: 2019555 - RNA, 12 nt, Human
ggcccccugccu

SEQ ID NO: 2019556 - RNA, 13 nt, Human
ggcccccugccug

SEQ ID NO: 2019557 - RNA, 17 nt, Human
ggcccccugccugcccu

SEQ ID NO: 2019558 - RNA, 15 nt, Human
ggccccgucucaggu

SEQ ID NO: 2019559 - RNA, 18 nt, Human
ggccccgucucaggucug

SEQ ID NO: 2019560 - RNA, 19 nt, Human
ggccccgucucaggucuga

SEQ ID NO: 2019561 - RNA, 12 nt, Human
ggccaggcuggu

SEQ ID NO: 2019562 - RNA, 15 nt, Human
ggccauggaggcagu

SEQ ID NO: 2019563 - RNA, 16 nt, Human
ggccaggcugcucuug

SEQ ID NO: 2019564 - RNA, 22 nt, Human
ggccaugggacagggaggacgc

SEQ ID NO: 2019565 - RNA, 13 nt, Human
ggccaugggccuc

SEQ ID NO: 2019566 - RNA, 13 nt, Human
ggcccccacaugg

SEQ ID NO: 2019567 - RNA, 17 nt, Human
ggccacaagacccuugu

SEQ ID NO: 2019568 - RNA, 16 nt, Human
ggccacaagacccuug

SEQ ID NO: 2019569 - RNA, 15 nt, Human
ggcauuccccaggag

SEQ ID NO: 2019570 - RNA, 22 nt, Human
ggccaccugcggugcuaucucc

SEQ ID NO: 2019571 - RNA, 16 nt, Human
ggccaccugcggugcu

SEQ ID NO: 2019572 - RNA, 17 nt, Human
ggccacacaagugcagu

SEQ ID NO: 2019573 - RNA, 16 nt, Human
ggccaaucagaagcua

SEQ ID NO: 2019574 - RNA, 15 nt, Human
ggcagguuggugggg

SEQ ID NO: 2019575 - RNA, 23 nt, Human
ggcauguucucugaggacacuaa

SEQ ID NO: 2019576 - RNA, 14 nt, Human
ggccaggccagagg

SEQ ID NO: 2019577 - RNA, 16 nt, Human
ggccaggccagaggga

SEQ ID NO: 2019578 - RNA, 22 nt, Human
ggccaggcugggucgcccugga

SEQ ID NO: 2019579 - RNA, 18 nt, Human
ggccaggcugggucgccc

SEQ ID NO: 2019580 - RNA, 17 nt, Human
ggccaggccagcugccu

SEQ ID NO: 2019581 - RNA, 15 nt, Human
ggccaggccagcugc

SEQ ID NO: 2019582 - RNA, 11 nt, Human
ggccaggcugg

SEQ ID NO: 2019583 - RNA, 14 nt, Human
ggccaggagccucc

SEQ ID NO: 2019584 - RNA, 16 nt, Human
ggccacugugaagaga

SEQ ID NO: 2019585 - RNA, 16 nt, Human
ggccaggagccuccug

SEQ ID NO: 2019586 - RNA, 11 nt, Human
ggccacuguga

SEQ ID NO: 2019587 - RNA, 11 nt, Human
ggagugacaga

SEQ ID NO: 2019588 - RNA, 16 nt, Human
ggagugacagaggcag

SEQ ID NO: 2019589 - RNA, 20 nt, Human
ggagucccaccuuggcugca

SEQ ID NO: 2019590 - RNA, 21 nt, Human
ggagucccaccuuggcugcag

SEQ ID NO: 2019591 - RNA, 14 nt, Human
ggaggggagacuuu

SEQ ID NO: 2019592 - RNA, 16 nt, Human
ggaggggagacuuuga

SEQ ID NO: 2019593 - RNA, 21 nt, Human
ggagucauuuuguguugaaga

SEQ ID NO: 2019594 - RNA, 16 nt, Human
ggagucauuucugauu

SEQ ID NO: 2019595 - RNA, 20 nt, Human
ggaguccaggacaggagaug

SEQ ID NO: 2019596 - RNA, 15 nt, Human
ggagggcuccagaca

SEQ ID NO: 2019597 - RNA, 14 nt, Human
ggagggcuccagac

SEQ ID NO: 2019598 - RNA, 17 nt, Human
ggagggcuccagacaca

SEQ ID NO: 2019599 - RNA, 14 nt, Human
ggauagaugugugg

SEQ ID NO: 2019600 - RNA, 15 nt, Human
ggauagaugugugga

SEQ ID NO: 2019601 - RNA, 13 nt, Human
ggauagaugugug

SEQ ID NO: 2019602 - RNA, 16 nt, Human
ggaucacagccucuga

SEQ ID NO: 2019603 - RNA, 17 nt, Human
ggagugacagaggcagc

SEQ ID NO: 2019604 - RNA, 18 nt, Human
ggagugacagaggcagcc

SEQ ID NO: 2019605 - RNA, 19 nt, Human
ggagugacagaggcagccc

SEQ ID NO: 2019606 - RNA, 21 nt, Human
ggagugacagaggcagcccca

SEQ ID NO: 2019607 - RNA, 12 nt, Human
ggagugagcugg

SEQ ID NO: 2019608 - RNA, 21 nt, Human
ggagugaguugauagcacaga

SEQ ID NO: 2019609 - RNA, 14 nt, Human
ggagugagcugguu

SEQ ID NO: 2019610 - RNA, 12 nt, Human
ggagggauuugg

SEQ ID NO: 2019611 - RNA, 12 nt, Human
ggagggagggcu

SEQ ID NO: 2019612 - RNA, 13 nt, Human
ggagggcuccaga

SEQ ID NO: 2019613 - RNA, 12 nt, Human
ggagggcuccag

SEQ ID NO: 2019614 - RNA, 21 nt, Human
ggaggaucucuugagccuggg

SEQ ID NO: 2019615 - RNA, 17 nt, Human
ggaggaucucuugagcc

SEQ ID NO: 2019616 - RNA, 23 nt, Human
ggaggaucacuugaguccagaag

SEQ ID NO: 2019617 - RNA, 13 nt, Human
ggagggacagucu

SEQ ID NO: 2019618 - RNA, 15 nt, Human
ggaggauguucuggg

SEQ ID NO: 2019619 - RNA, 19 nt, Human
ggaggacgcucucuggccu

SEQ ID NO: 2019620 - RNA, 20 nt, Human
ggagcccugccucuccgccc

SEQ ID NO: 2019621 - RNA, 20 nt, Human
ggaggacgcucucuggccuu

SEQ ID NO: 2019622 - RNA, 21 nt, Human
ggaggacgcucucuggccuuc

SEQ ID NO: 2019623 - RNA, 21 nt, Human
ggagccgggcaaacuggccgc

SEQ ID NO: 2019624 - RNA, 21 nt, Human
ggacccaguggcagggcacag

SEQ ID NO: 2019625 - RNA, 11 nt, Human
ggacccagugg

SEQ ID NO: 2019626 - RNA, 14 nt, Human
ggacccaguggcag

SEQ ID NO: 2019627 - RNA, 16 nt, Human
ggacccaguggcaggg

SEQ ID NO: 2019628 - RNA, 17 nt, Human
ggacccaguggcagggc

SEQ ID NO: 2019629 - RNA, 18 nt, Human
ggacccaguggcagggca

SEQ ID NO: 2019630 - RNA, 19 nt, Human
ggacccaguggcagggcac

SEQ ID NO: 2019631 - RNA, 15 nt, Human
ggaccucucccaggg

SEQ ID NO: 2019632 - RNA, 14 nt, Human
ggaccucucccagg

SEQ ID NO: 2019633 - RNA, 12 nt, Human
ggaccucuccca

SEQ ID NO: 2019634 - RNA, 17 nt, Human
ggaccagcuuggcucag

SEQ ID NO: 2019635 - RNA, 18 nt, Human
ggaccagcuuggcucagg

SEQ ID NO: 2019636 - RNA, 20 nt, Human
ggaagccagcaggcucucag

SEQ ID NO: 2019637 - RNA, 21 nt, Human
ggaccuucacucuaagauguu

SEQ ID NO: 2019638 - RNA, 22 nt, Human
ggaccuucacucuaagauguua

SEQ ID NO: 2019639 - RNA, 15 nt, Human
ggacuccucugucca

SEQ ID NO: 2019640 - RNA, 14 nt, Human
ggacuccucugucc

SEQ ID NO: 2019641 - RNA, 12 nt, Human
ggacuccucugu

SEQ ID NO: 2019642 - RNA, 13 nt, Human
ggacucuaaaguc

SEQ ID NO: 2019643 - RNA, 11 nt, Human
ggacucugccu

SEQ ID NO: 2019644 - RNA, 21 nt, Human
ggacucuucagcacaaaagga

SEQ ID NO: 2019645 - RNA, 10 nt, Human
ggacugccac

SEQ ID NO: 2019646 - RNA, 13 nt, Human
ggacugccaccuc

SEQ ID NO: 2019647 - RNA, 14 nt, Human
ggacugccaccucc

SEQ ID NO: 2019648 - RNA, 15 nt, Human
ggacugccaccuccc

SEQ ID NO: 2019649 - RNA, 17 nt, Human
ggacugccaccuccccu

SEQ ID NO: 2019650 - RNA, 21 nt, Human
ggacugccagucccccugccc

SEQ ID NO: 2019651 - RNA, 21 nt, Human
ggacugccaccuccccuugcc

SEQ ID NO: 2019652 - RNA, 23 nt, Human
ggacugccaccuccccuugccag

SEQ ID NO: 2019653 - RNA, 21 nt, Human
ggagaccccuuggggagcagg

SEQ ID NO: 2019654 - RNA, 21 nt, Human
ggagagcuagcagcagggagg

SEQ ID NO: 2019655 - RNA, 17 nt, Human
ggagagcuagcagcagg

SEQ ID NO: 2019656 - RNA, 20 nt, Human
ggagcaaaaucgaugcagug

SEQ ID NO: 2019657 - RNA, 12 nt, Human
ggagcccuggga

SEQ ID NO: 2019658 - RNA, 13 nt, Human
ggagcccugggag

SEQ ID NO: 2019659 - RNA, 12 nt, Human
ggagcccugccu

SEQ ID NO: 2019660 - RNA, 19 nt, Human
ggagcccugccucuccgcc

SEQ ID NO: 2019661 - RNA, 20 nt, Human
ggagauuuacaacuggggga

SEQ ID NO: 2019662 - RNA, 15 nt, Human
ggagaggggcacagg

SEQ ID NO: 2019663 - RNA, 14 nt, Human
ggagaugcugugcc

SEQ ID NO: 2019664 - RNA, 15 nt, Human
ggagaugcugugccc

SEQ ID NO: 2019665 - RNA, 23 nt, Human
ggagaugcugugccccuggccuu

SEQ ID NO: 2019666 - RNA, 24 nt, Human
ggagaugcugugccccuggccuug

SEQ ID NO: 2019667 - RNA, 16 nt, Human
gcugggacgcucugcu

SEQ ID NO: 2019668 - RNA, 20 nt, Human
gcugggacaugggaaagggg

SEQ ID NO: 2019669 - RNA, 17 nt, Human
gcuggccgggagccuga

SEQ ID NO: 2019670 - RNA, 13 nt, Human
gcuggcccugccc

SEQ ID NO: 2019671 - RNA, 12 nt, Human
gcuggcccugcc

SEQ ID NO: 2019672 - RNA, 17 nt, Human
gcugggacgcucugcug

SEQ ID NO: 2019673 - RNA, 19 nt, Human
gcugggacuacagguguga

SEQ ID NO: 2019674 - RNA, 13 nt, Human
gcugggacuacag

SEQ ID NO: 2019675 - RNA, 18 nt, Human
gcugggacuacaggcacc

SEQ ID NO: 2019676 - RNA, 19 nt, Human
gcugggacuacaggcaccc

SEQ ID NO: 2019677 - RNA, 20 nt, Human
gcugggacuacaggcaccca

SEQ ID NO: 2019678 - RNA, 22 nt, Human
gcugcuugggcuucauccuccu

SEQ ID NO: 2019679 - RNA, 17 nt, Human
gcugcuugggcuucauc

SEQ ID NO: 2019680 - RNA, 18 nt, Human
gcuggaccuugaacuggg

SEQ ID NO: 2019681 - RNA, 21 nt, Human
gcuggaccuugaacuggguac

SEQ ID NO: 2019682 - RNA, 22 nt, Human
gcuggaccuugaacuggguacu

SEQ ID NO: 2019683 - RNA, 16 nt, Human
gcugcuugggcuucau

SEQ ID NO: 2019684 - RNA, 22 nt, Human
gcugcuucaaggauccugagcc

SEQ ID NO: 2019685 - RNA, 21 nt, Human
gcugcuucaaggauccugagc

SEQ ID NO: 2019686 - RNA, 15 nt, Human
gcugcuucauguuug

SEQ ID NO: 2019687 - RNA, 20 nt, Human
gcugcuguguguggcuucug

SEQ ID NO: 2019688 - RNA, 23 nt, Human
gcugcuucaaggauccugagcca

SEQ ID NO: 2019689 - RNA, 20 nt, Human
gcugcucagggaaaagcagc

SEQ ID NO: 2019690 - RNA, 21 nt, Human
gcugcucagggaaaagcagcu

SEQ ID NO: 2019691 - RNA, 13 nt, Human
gcugcuucaagga

SEQ ID NO: 2019692 - RNA, 19 nt, Human
gcugcgguccacccaggag

SEQ ID NO: 2019693 - RNA, 17 nt, Human
gcugcgguccacccagg

SEQ ID NO: 2019694 - RNA, 18 nt, Human
gcugcgguccacccagga

SEQ ID NO: 2019695 - RNA, 22 nt, Human
gcuagcagcagggagggcuucu

SEQ ID NO: 2019696 - RNA, 18 nt, Human
gcugcccuggugcugcca

SEQ ID NO: 2019697 - RNA, 19 nt, Human
gcugcccuggugcugccac

SEQ ID NO: 2019698 - RNA, 11 nt, Human
gcugcccugug

SEQ ID NO: 2019699 - RNA, 20 nt, Human
gcugcccuggugcugccaca

SEQ ID NO: 2019700 - RNA, 22 nt, Human
gcugcccuggugcugccacacu

SEQ ID NO: 2019701 - RNA, 14 nt, Human
gcuagcacagcucc

SEQ ID NO: 2019702 - RNA, 15 nt, Human
gcuagcacagcuccc

SEQ ID NO: 2019703 - RNA, 24 nt, Human
gcuagaggccauggaggcaguagg

SEQ ID NO: 2019704 - RNA, 20 nt, Human
gcuagaggccauggaggcag

SEQ ID NO: 2019705 - RNA, 16 nt, Human
gcugcgguccacccag

SEQ ID NO: 2019706 - RNA, 14 nt, Human
gcugcccugugagu

SEQ ID NO: 2019707 - RNA, 12 nt, Human
gcugcccuguga

SEQ ID NO: 2019708 - RNA, 23 nt, Human
gcugcccuggugcugccacacuu

SEQ ID NO: 2019709 - RNA, 17 nt, Human
gcugcccuuucugggca

SEQ ID NO: 2019710 - RNA, 23 nt, Human
gcugggggaagaagcucucuccu

SEQ ID NO: 2019711 - RNA, 12 nt, Human
gcuggggccagu

SEQ ID NO: 2019712 - RNA, 19 nt, Human
gcuggggccaggcuggguc

SEQ ID NO: 2019713 - RNA, 16 nt, Human
gcuggggccaggcugg

SEQ ID NO: 2019714 - RNA, 18 nt, Human
gcugggcuucaguggcag

SEQ ID NO: 2019715 - RNA, 19 nt, Human
gcugggcuucaguggcagc

SEQ ID NO: 2019716 - RNA, 13 nt, Human
gcugggggccuca

SEQ ID NO: 2019717 - RNA, 15 nt, Human
gcuggucccacucag

SEQ ID NO: 2019718 - RNA, 19 nt, Human
gcuggucccacucagucca

SEQ ID NO: 2019719 - RNA, 19 nt, Human
gcugggggccucagugcca

SEQ ID NO: 2019720 - RNA, 20 nt, Human
gcugggggccucagugccac

SEQ ID NO: 2019721 - RNA, 18 nt, Human
gcugggggaugggccuga

SEQ ID NO: 2019722 - RNA, 19 nt, Human
gcugggggaugggccugag

SEQ ID NO: 2019723 - RNA, 18 nt, Human
gcugggagagccuuccag

SEQ ID NO: 2019724 - RNA, 17 nt, Human
gcugggagagccuucca

SEQ ID NO: 2019725 - RNA, 13 nt, Human
gcugggagagccu

SEQ ID NO: 2019726 - RNA, 12 nt, Human
gcugggagagcc

SEQ ID NO: 2019727 - RNA, 22 nt, Human
gcugggagagccuuccaggggu

SEQ ID NO: 2019728 - RNA, 19 nt, Human
gcugggagagccuuccagg

SEQ ID NO: 2019729 - RNA, 14 nt, Human
gcugggacugggaa

SEQ ID NO: 2019730 - RNA, 21 nt, Human
gcugggaugauuggagggggg

SEQ ID NO: 2019731 - RNA, 16 nt, Human
gcugggagcucugcag

SEQ ID NO: 2019732 - RNA, 15 nt, Human
gcugggagcucugca

SEQ ID NO: 2019733 - RNA, 17 nt, Human
gcugggcuucaguggca

SEQ ID NO: 2019734 - RNA, 21 nt, Human
gcugggauuacaggcuccugc

SEQ ID NO: 2019735 - RNA, 17 nt, Human
gcugggauuacaggcgu

SEQ ID NO: 2019736 - RNA, 18 nt, Human
gcugggauuacaggcgug

SEQ ID NO: 2019737 - RNA, 19 nt, Human
gcugggauuacaggcuccu

SEQ ID NO: 2019738 - RNA, 20 nt, Human
gcugggauuacaggcuccug

SEQ ID NO: 2019739 - RNA, 23 nt, Human
gcugucaauuacaggaaguacug

SEQ ID NO: 2019740 - RNA, 22 nt, Human
gcugucaauuacaggaaguacu

SEQ ID NO: 2019741 - RNA, 19 nt, Human
gcugucaauuacaggaagu

SEQ ID NO: 2019742 - RNA, 17 nt, Human
gcugucaauuacaggaa

SEQ ID NO: 2019743 - RNA, 21 nt, Human
gcugucccuuacgugaguccu

SEQ ID NO: 2019744 - RNA, 22 nt, Human
gcugucccuuacgugaguccug

SEQ ID NO: 2019745 - RNA, 19 nt, Human
gcugucccuuacgugaguc

SEQ ID NO: 2019746 - RNA, 17 nt, Human
gcugucuccauguuuga

SEQ ID NO: 2019747 - RNA, 23 nt, Human
gcugucuguuguauucauugugg

SEQ ID NO: 2019748 - RNA, 15 nt, Human
gcugucuggcacagc

SEQ ID NO: 2019749 - RNA, 19 nt, Human
gcugucuggcacagccugc

SEQ ID NO: 2019750 - RNA, 16 nt, Human
gcugucuuucuugcuc

SEQ ID NO: 2019751 - RNA, 17 nt, Human
gcugucuuucuugcucc

SEQ ID NO: 2019752 - RNA, 18 nt, Human
gcugucuuucuugcuccc

SEQ ID NO: 2019753 - RNA, 19 nt, Human
gcugucuuucuugcucccu

SEQ ID NO: 2019754 - RNA, 20 nt, Human
gcugucuuucuugcucccug

SEQ ID NO: 2019755 - RNA, 21 nt, Human
gcugguuagagguucccuuug

SEQ ID NO: 2019756 - RNA, 15 nt, Human
gcugguucaggguug

SEQ ID NO: 2019757 - RNA, 14 nt, Human
gcugucaaggcuca

SEQ ID NO: 2019758 - RNA, 16 nt, Human
gcugucaauuacagga

SEQ ID NO: 2019759 - RNA, 22 nt, Human
gcugguucaggguuggccccug

SEQ ID NO: 2019760 - RNA, 16 nt, Human
gcuggugucaccugaa

SEQ ID NO: 2019761 - RNA, 18 nt, Human
gcuggugucaccugaaga

SEQ ID NO: 2019762 - RNA, 20 nt, Human
gcuggucccacucaguccau

SEQ ID NO: 2019763 - RNA, 17 nt, Human
ggaacagacuggaagca

SEQ ID NO: 2019764 - RNA, 17 nt, Human
ggaaaucaaagugcuau

SEQ ID NO: 2019765 - RNA, 20 nt, Human
ggaaaucaaagugcuauuac

SEQ ID NO: 2019766 - RNA, 20 nt, Human
ggaaaguggcaccugucugc

SEQ ID NO: 2019767 - RNA, 14 nt, Human
ggaaaauaaauuau

SEQ ID NO: 2019768 - RNA, 17 nt, Human
ggaaaauaaaaaaagaa

SEQ ID NO: 2019769 - RNA, 19 nt, Human
ggaaaauaaaaaaagaaaa

SEQ ID NO: 2019770 - RNA, 20 nt, Human
ggaaaauaaaaaaagaaaaa

SEQ ID NO: 2019771 - RNA, 21 nt, Human
ggaaaauaaaaaaagaaaaaa

SEQ ID NO: 2019772 - RNA, 15 nt, Human
ggaaaagacuaagau

SEQ ID NO: 2019773 - RNA, 15 nt, Human
ggaaaaucagccugc

SEQ ID NO: 2019774 - RNA, 23 nt, Human
ggaaaguauucucuuuucaagaa

SEQ ID NO: 2019775 - RNA, 23 nt, Human
ggaaaguaagggaagcagaagga

SEQ ID NO: 2019776 - RNA, 21 nt, Human
ggaaaguacauuuuuugaaau

SEQ ID NO: 2019777 - RNA, 22 nt, Human
ggaaaguacauuuuuugaaaug

SEQ ID NO: 2019778 - RNA, 23 nt, Human
ggaacuagacucccaagcuggac

SEQ ID NO: 2019779 - RNA, 23 nt, Human
ggaacguagucggcacagccugg

SEQ ID NO: 2019780 - RNA, 17 nt, Human
ggaacagcacuggggag

SEQ ID NO: 2019781 - RNA, 21 nt, Human
ggaacagcacuggggagucuu

SEQ ID NO: 2019782 - RNA, 19 nt, Human
ggaacagacuggaagcaca

SEQ ID NO: 2019783 - RNA, 20 nt, Human
ggaacagacuggaagcacag

SEQ ID NO: 2019784 - RNA, 14 nt, Human
ggaagccagcaggc

SEQ ID NO: 2019785 - RNA, 13 nt, Human
ggaagccagcagg

SEQ ID NO: 2019786 - RNA, 18 nt, Human
ggaagccagcaggcucuc

SEQ ID NO: 2019787 - RNA, 17 nt, Human
ggaagccagcaggcucu

SEQ ID NO: 2019788 - RNA, 16 nt, Human
ggaagccagcaggcuc

SEQ ID NO: 2019789 - RNA, 15 nt, Human
ggaagccagcaggcu

SEQ ID NO: 2019790 - RNA, 22 nt, Human
ggaagcacaugccucucucagg

SEQ ID NO: 2019791 - RNA, 21 nt, Human
ggaagcacaugccucucucag

SEQ ID NO: 2019792 - RNA, 23 nt, Human
ggaagcacaugccucucucaggc

SEQ ID NO: 2019793 - RNA, 13 nt, Human
ggaagcagaagga

SEQ ID NO: 2019794 - RNA, 13 nt, Human
ggaagcagcuuuc

SEQ ID NO: 2019795 - RNA, 22 nt, Human
ggaagcagguuaaauguuuugu

SEQ ID NO: 2019796 - RNA, 14 nt, Human
ggaagcagugccca

SEQ ID NO: 2019797 - RNA, 15 nt, Human
ggaagcagugcccag

SEQ ID NO: 2019798 - RNA, 16 nt, Human
ggaagcagugcccagg

SEQ ID NO: 2019799 - RNA, 18 nt, Human
ggaagcagugcccaggug

SEQ ID NO: 2019800 - RNA, 13 nt, Human
ggaagagccuugc

SEQ ID NO: 2019801 - RNA, 16 nt, Human
ggaagauaaguuggaa

SEQ ID NO: 2019802 - RNA, 18 nt, Human
ggaagauaaguuggaaac

SEQ ID NO: 2019803 - RNA, 17 nt, Human
ggaagcacaugccucuc

SEQ ID NO: 2019804 - RNA, 15 nt, Human
ggaagcacaugccuc

SEQ ID NO: 2019805 - RNA, 14 nt, Human
ggaagcacaugccu

SEQ ID NO: 2019806 - RNA, 13 nt, Human
ggaagcacaugcc

SEQ ID NO: 2019807 - RNA, 17 nt, Human
ggaagcacagcuucauu

SEQ ID NO: 2019808 - RNA, 20 nt, Human
gcuuccagugaggcucugcc

SEQ ID NO: 2019809 - RNA, 19 nt, Human
gcuuccagugaggcucugc

SEQ ID NO: 2019810 - RNA, 21 nt, Human
gcuuccagugaggcucugccc

SEQ ID NO: 2019811 - RNA, 17 nt, Human
gcuucucacugccaugc

SEQ ID NO: 2019812 - RNA, 16 nt, Human
gcuucuaugaaagacu

SEQ ID NO: 2019813 - RNA, 17 nt, Human
gcuugcccuggugccuc

SEQ ID NO: 2019814 - RNA, 19 nt, Human
gcuugcccuggugccucac

SEQ ID NO: 2019815 - RNA, 17 nt, Human
gcuugccauuuuucaaa

SEQ ID NO: 2019816 - RNA, 18 nt, Human
gcuugccauuuuucaaaa

SEQ ID NO: 2019817 - RNA, 13 nt, Human
gcuuggaggaagg

SEQ ID NO: 2019818 - RNA, 15 nt, Human
gcuuggaggaaggaa

SEQ ID NO: 2019819 - RNA, 14 nt, Human
gcuuggaggaagga

SEQ ID NO: 2019820 - RNA, 19 nt, Human
gcuucuggugaccuuccaa

SEQ ID NO: 2019821 - RNA, 22 nt, Human
gcuugaggguugggcugguguc

SEQ ID NO: 2019822 - RNA, 16 nt, Human
gcuucuguugcugccu

SEQ ID NO: 2019823 - RNA, 21 nt, Human
gcuucugugcccagaauacug

SEQ ID NO: 2019824 - RNA, 15 nt, Human
gcuucugugcccaga

SEQ ID NO: 2019825 - RNA, 19 nt, Human
gcuucugugcccagaauac

SEQ ID NO: 2019826 - RNA, 22 nt, Human
gcuugcagagaugaggccgcca

SEQ ID NO: 2019827 - RNA, 14 nt, Human
gcuugcacucucuu

SEQ ID NO: 2019828 - RNA, 18 nt, Human
gcuugcacucucuuggcu

SEQ ID NO: 2019829 - RNA, 14 nt, Human
gcuuggcccuggca

SEQ ID NO: 2019830 - RNA, 15 nt, Human
gcuuggcccuggcag

SEQ ID NO: 2019831 - RNA, 17 nt, Human
gcuuggcccuggcagcc

SEQ ID NO: 2019832 - RNA, 15 nt, Human
gcuuggcccuuuccu

SEQ ID NO: 2019833 - RNA, 13 nt, Human
gcuuggcccaggg

SEQ ID NO: 2019834 - RNA, 14 nt, Human
gcuuggcccagggg

SEQ ID NO: 2019835 - RNA, 12 nt, Human
gcuuggcccugg

SEQ ID NO: 2019836 - RNA, 14 nt, Human
gcuuugggcugccc

SEQ ID NO: 2019837 - RNA, 19 nt, Human
gcuuuaauuccaugaaugu

SEQ ID NO: 2019838 - RNA, 20 nt, Human
gcuuuaauuccaugaauguu

SEQ ID NO: 2019839 - RNA, 14 nt, Human
ggaaaaacugauuu

SEQ ID NO: 2019840 - RNA, 13 nt, Human
ggaaaaauagccu

SEQ ID NO: 2019841 - RNA, 15 nt, Human
ggaaaacgauuuaau

SEQ ID NO: 2019842 - RNA, 13 nt, Human
ggaaaagaaaucu

SEQ ID NO: 2019843 - RNA, 14 nt, Human
ggaaaagaaaucua

SEQ ID NO: 2019844 - RNA, 15 nt, Human
ggaaaaauagccugc

SEQ ID NO: 2019845 - RNA, 22 nt, Human
ggaaaaccaagccguggcuucc

SEQ ID NO: 2019846 - RNA, 22 nt, Human
ggaaaaaguauuaauucucuuu

SEQ ID NO: 2019847 - RNA, 12 nt, Human
ggaaaaauaugu

SEQ ID NO: 2019848 - RNA, 13 nt, Human
ggaaaaauaugug

SEQ ID NO: 2019849 - RNA, 16 nt, Human
ggaaaaauaugugaag

SEQ ID NO: 2019850 - RNA, 17 nt, Human
gcuuuuacccuuuuucu

SEQ ID NO: 2019851 - RNA, 22 nt, Human
gcuuuuacccuuuuucuugaau

SEQ ID NO: 2019852 - RNA, 23 nt, Human
ggaaaaaauugcuuuugagagaa

SEQ ID NO: 2019853 - RNA, 14 nt, Human
gcuuuuacuuaaac

SEQ ID NO: 2019854 - RNA, 20 nt, Human
ggaaaaaauaacaaugaaag

SEQ ID NO: 2019855 - RNA, 15 nt, Human
gcuuugggcugcccu

SEQ ID NO: 2019856 - RNA, 16 nt, Human
gcuuugggcugcccug

SEQ ID NO: 2019857 - RNA, 13 nt, Human
gcuuuuacccuuu

SEQ ID NO: 2019858 - RNA, 18 nt, Human
gcuuuuaaggaaaggcaa

SEQ ID NO: 2019859 - RNA, 14 nt, Human
gcuuuuaaaacuac

SEQ ID NO: 2019860 - RNA, 20 nt, Human
gcuuuuaaaacuacuuagca

SEQ ID NO: 2019861 - RNA, 12 nt, Human
gcuuuuaaaauu

SEQ ID NO: 2019862 - RNA, 14 nt, Human
gcuuuuaaaauuuu

SEQ ID NO: 2019863 - RNA, 16 nt, Human
gcuuuuaaaauuuuaa

SEQ ID NO: 2019864 - RNA, 15 nt, Human
ggcugcuuuccaaag

SEQ ID NO: 2019865 - RNA, 23 nt, Human
ggcugcuucaaggauccugagcc

SEQ ID NO: 2019866 - RNA, 19 nt, Human
ggcugggagagccuuccag

SEQ ID NO: 2019867 - RNA, 16 nt, Human
ggcuggaaggggucca

SEQ ID NO: 2019868 - RNA, 23 nt, Human
ggcugggagagccuuccaggggu

SEQ ID NO: 2019869 - RNA, 20 nt, Human
ggcugggagagccuuccagg

SEQ ID NO: 2019870 - RNA, 14 nt, Human
ggcugggcagagga

SEQ ID NO: 2019871 - RNA, 13 nt, Human
ggcugggcagagg

SEQ ID NO: 2019872 - RNA, 19 nt, Human
ggcugggcagaggaaagca

SEQ ID NO: 2019873 - RNA, 15 nt, Human
ggcugggcagaggaa

SEQ ID NO: 2019874 - RNA, 18 nt, Human
ggcugggagagccuucca

SEQ ID NO: 2019875 - RNA, 22 nt, Human
ggcugcuucaaggauccugagc

SEQ ID NO: 2019876 - RNA, 14 nt, Human
ggcugcuucaagga

SEQ ID NO: 2019877 - RNA, 12 nt, Human
ggcugcuucaag

SEQ ID NO: 2019878 - RNA, 11 nt, Human
ggcugcuucaa

SEQ ID NO: 2019879 - RNA, 14 nt, Human
ggcugcugugaagc

SEQ ID NO: 2019880 - RNA, 17 nt, Human
ggcugcugaaggcucga

SEQ ID NO: 2019881 - RNA, 15 nt, Human
ggcugcugaaggcuc

SEQ ID NO: 2019882 - RNA, 18 nt, Human
ggcugcugaaggcucgag

SEQ ID NO: 2019883 - RNA, 12 nt, Human
ggcugcagggag

SEQ ID NO: 2019884 - RNA, 14 nt, Human
ggcugcugaaggcu

SEQ ID NO: 2019885 - RNA, 13 nt, Human
ggcugcagggagu

SEQ ID NO: 2019886 - RNA, 20 nt, Human
ggccccugccagacccccug

SEQ ID NO: 2019887 - RNA, 14 nt, Human
ggcucuggagccca

SEQ ID NO: 2019888 - RNA, 13 nt, Human
ggcucuggagccc

SEQ ID NO: 2019889 - RNA, 17 nt, Human
ggcucugccucccauca

SEQ ID NO: 2019890 - RNA, 20 nt, Human
ggccccugcccggcugcgga

SEQ ID NO: 2019891 - RNA, 16 nt, Human
ggccccugcccggcug

SEQ ID NO: 2019892 - RNA, 17 nt, Human
ggccccugcccggcugc

SEQ ID NO: 2019893 - RNA, 15 nt, Human
ggcugaggugggagg

SEQ ID NO: 2019894 - RNA, 13 nt, Human
ggcugagguggga

SEQ ID NO: 2019895 - RNA, 16 nt, Human
ggcugcagccaggcca

SEQ ID NO: 2019896 - RNA, 22 nt, Human
ggcugcagccaggccacuggcc

SEQ ID NO: 2019897 - RNA, 19 nt, Human
ggcugcaccggcuggccug

SEQ ID NO: 2019898 - RNA, 18 nt, Human
ggcugcaccggcuggccu

SEQ ID NO: 2019899 - RNA, 17 nt, Human
ggcugcaccggcuggcc

SEQ ID NO: 2019900 - RNA, 24 nt, Human
ggcugcaaaggguaucaggugcug

SEQ ID NO: 2019901 - RNA, 22 nt, Human
ggcugagugcaggcccacccug

SEQ ID NO: 2019902 - RNA, 18 nt, Human
ggcugagugcaggcccac

SEQ ID NO: 2019903 - RNA, 19 nt, Human
ggcugagugcaggcccacc

SEQ ID NO: 2019904 - RNA, 20 nt, Human
ggcugagugcaggcccaccc

SEQ ID NO: 2019905 - RNA, 21 nt, Human
ggcugagugcaggcccacccu

SEQ ID NO: 2019906 - RNA, 17 nt, Human
ggcugaguagcucugcc

SEQ ID NO: 2019907 - RNA, 13 nt, Human
ggcugagugcagg

SEQ ID NO: 2019908 - RNA, 15 nt, Human
ggcugagugcaggcc

SEQ ID NO: 2019909 - RNA, 16 nt, Human
ggcugagugcaggccc

SEQ ID NO: 2019910 - RNA, 17 nt, Human
ggcugagugcaggccca

SEQ ID NO: 2019911 - RNA, 22 nt, Human
ggcugcaaaggguaucaggugc

SEQ ID NO: 2019912 - RNA, 23 nt, Human
ggcugcaaaggguaucaggugcu

SEQ ID NO: 2019913 - RNA, 18 nt, Human
ggcugcaaaggguaucag

SEQ ID NO: 2019914 - RNA, 13 nt, Human
gggaaugaagaua

SEQ ID NO: 2019915 - RNA, 16 nt, Human
gggaagggggcuggga

SEQ ID NO: 2019916 - RNA, 14 nt, Human
gggaagggggcugg

SEQ ID NO: 2019917 - RNA, 18 nt, Human
gggaaggggggucagaag

SEQ ID NO: 2019918 - RNA, 17 nt, Human
gggaagggggcugggac

SEQ ID NO: 2019919 - RNA, 14 nt, Human
ggcuuuugugcauu

SEQ ID NO: 2019920 - RNA, 21 nt, Human
gggaaggauacaaaagcaugu

SEQ ID NO: 2019921 - RNA, 23 nt, Human
gggaaggauacaaaagcauguga

SEQ ID NO: 2019922 - RNA, 22 nt, Human
gggaaggcagggagggccuggg

SEQ ID NO: 2019923 - RNA, 13 nt, Human
gggaaggccugac

SEQ ID NO: 2019924 - RNA, 15 nt, Human
gggaaggccugacuu

SEQ ID NO: 2019925 - RNA, 20 nt, Human
gggaccccuggugguucacu

SEQ ID NO: 2019926 - RNA, 14 nt, Human
gggaccccugagcu

SEQ ID NO: 2019927 - RNA, 20 nt, Human
gggacaaguagccaccugag

SEQ ID NO: 2019928 - RNA, 20 nt, Human
gggacccuccaaggccaggc

SEQ ID NO: 2019929 - RNA, 24 nt, Human
gggacccuccaaggccaggccuug

SEQ ID NO: 2019930 - RNA, 15 nt, Human
gggacaaccuuggcu

SEQ ID NO: 2019931 - RNA, 20 nt, Human
gggacaaccuuggcuuggcc

SEQ ID NO: 2019932 - RNA, 15 nt, Human
gggaauggcagcugc

SEQ ID NO: 2019933 - RNA, 17 nt, Human
gggaauuucuucaacuc

SEQ ID NO: 2019934 - RNA, 23 nt, Human
gggacaaggacuaggguccuggg

SEQ ID NO: 2019935 - RNA, 15 nt, Human
gggaccucaggccug

SEQ ID NO: 2019936 - RNA, 13 nt, Human
gggaccucaggcc

SEQ ID NO: 2019937 - RNA, 12 nt, Human
gggaccucaggc

SEQ ID NO: 2019938 - RNA, 23 nt, Human
gggaccucucccagggucccugg

SEQ ID NO: 2019939 - RNA, 16 nt, Human
gggaccucucccaggg

SEQ ID NO: 2019940 - RNA, 12 nt, Human
gggaccucuccc

SEQ ID NO: 2019941 - RNA, 17 nt, Human
gggacuacaggcaccca

SEQ ID NO: 2019942 - RNA, 16 nt, Human
gggacucaaugcacug

SEQ ID NO: 2019943 - RNA, 16 nt, Human
ggcuuauauuugugua

SEQ ID NO: 2019944 - RNA, 14 nt, Human
ggcuuauaaaacag

SEQ ID NO: 2019945 - RNA, 21 nt, Human
ggcuuaauuauugauguuuuc

SEQ ID NO: 2019946 - RNA, 21 nt, Human
ggcuuagucacugagacagcc

SEQ ID NO: 2019947 - RNA, 18 nt, Human
ggcugggcuucaguggca

SEQ ID NO: 2019948 - RNA, 13 nt, Human
ggcugggcuucag

SEQ ID NO: 2019949 - RNA, 17 nt, Human
ggcugggcuucaguggc

SEQ ID NO: 2019950 - RNA, 17 nt, Human
ggcugggcucccuuccc

SEQ ID NO: 2019951 - RNA, 18 nt, Human
ggcugggcucccuuccca

SEQ ID NO: 2019952 - RNA, 12 nt, Human
ggcugggcuuca

SEQ ID NO: 2019953 - RNA, 10 nt, Human
ggcuuuugug

SEQ ID NO: 2019954 - RNA, 19 nt, Human
ggcuuuucacugcuggcug

SEQ ID NO: 2019955 - RNA, 22 nt, Human
ggcuuuucacugcuggcugccu

SEQ ID NO: 2019956 - RNA, 14 nt, Human
ggcuuuucacugcu

SEQ ID NO: 2019957 - RNA, 19 nt, Human
ggcuuuccugugccaggug

SEQ ID NO: 2019958 - RNA, 15 nt, Human
ggcuuuucacugcug

SEQ ID NO: 2019959 - RNA, 17 nt, Human
ggcuuuucacugcuggc

SEQ ID NO: 2019960 - RNA, 17 nt, Human
ggcuuuauuuuuuugaa

SEQ ID NO: 2019961 - RNA, 22 nt, Human
ggcuuuauuuuuuugaacucuu

SEQ ID NO: 2019962 - RNA, 23 nt, Human
ggcuuucaggagcuccauacaca

SEQ ID NO: 2019963 - RNA, 13 nt, Human
ggcuuguaguucu

SEQ ID NO: 2019964 - RNA, 16 nt, Human
ggcuugucauagccag

SEQ ID NO: 2019965 - RNA, 16 nt, Human
ggcuuguaguucuuua

SEQ ID NO: 2019966 - RNA, 14 nt, Human
ggcuuuaaaauucu

SEQ ID NO: 2019967 - RNA, 12 nt, Human
ggcuuuaaaauu

SEQ ID NO: 2019968 - RNA, 19 nt, Human
ggcuuggggaccagagcug

SEQ ID NO: 2019969 - RNA, 21 nt, Human
ggcuuggggaccagagcugcc

SEQ ID NO: 2019970 - RNA, 22 nt, Human
ggcuugaguuuaaauuguaaua

SEQ ID NO: 2019971 - RNA, 13 nt, Human
gggcaauggaaau

SEQ ID NO: 2019972 - RNA, 16 nt, Human
gggcaauauucucugu

SEQ ID NO: 2019973 - RNA, 19 nt, Human
gggcaauauucucuguaca

SEQ ID NO: 2019974 - RNA, 20 nt, Human
gggcaauauucucuguacau

SEQ ID NO: 2019975 - RNA, 23 nt, Human
gggcaauauucucuguacauauu

SEQ ID NO: 2019976 - RNA, 20 nt, Human
gggaugacaugcacucagcu

SEQ ID NO: 2019977 - RNA, 20 nt, Human
gggcaacccccagccugcua

SEQ ID NO: 2019978 - RNA, 18 nt, Human
gggcaacccuggugacca

SEQ ID NO: 2019979 - RNA, 23 nt, Human
gggauccuggaguucugguuccu

SEQ ID NO: 2019980 - RNA, 16 nt, Human
gggauccuccaggugc

SEQ ID NO: 2019981 - RNA, 15 nt, Human
gggauccuccaggug

SEQ ID NO: 2019982 - RNA, 14 nt, Human
gggauagaugugug

SEQ ID NO: 2019983 - RNA, 15 nt, Human
gggauaggggcagag

SEQ ID NO: 2019984 - RNA, 21 nt, Human
gggauaugauuuaaaucagcc

SEQ ID NO: 2019985 - RNA, 13 nt, Human
gggauagaugugu

SEQ ID NO: 2019986 - RNA, 13 nt, Human
gggauagagagag

SEQ ID NO: 2019987 - RNA, 13 nt, Human
gggacugagaaau

SEQ ID NO: 2019988 - RNA, 10 nt, Human
gggacucugc

SEQ ID NO: 2019989 - RNA, 17 nt, Human
gggaggugggauccucc

SEQ ID NO: 2019990 - RNA, 19 nt, Human
gggacugaaaaccucuccu

SEQ ID NO: 2019991 - RNA, 18 nt, Human
gggacugaaaaccucucc

SEQ ID NO: 2019992 - RNA, 16 nt, Human
gggaggugaccccagg

SEQ ID NO: 2019993 - RNA, 21 nt, Human
gggagugugguuucuuuuuga

SEQ ID NO: 2019994 - RNA, 11 nt, Human
gggagugugua

SEQ ID NO: 2019995 - RNA, 18 nt, Human
gggagugacagaggcagc

SEQ ID NO: 2019996 - RNA, 11 nt, Human
gggagugagcu

SEQ ID NO: 2019997 - RNA, 14 nt, Human
gggagugagcuggu

SEQ ID NO: 2019998 - RNA, 13 nt, Human
gggcacagggccu

SEQ ID NO: 2019999 - RNA, 14 nt, Human
gggcacagggccug

SEQ ID NO: 2020000 - RNA, 16 nt, Human
gggcacagggccuggc

SEQ ID NO: 2020001 - RNA, 23 nt, Human
gggcacacgcugcucugccccag

SEQ ID NO: 2020002 - RNA, 21 nt, Human
gggcacagaaaauggaagaca

SEQ ID NO: 2020003 - RNA, 20 nt, Human
gggcacagaaaauggaagac

SEQ ID NO: 2020004 - RNA, 13 nt, Human
gggcacacgcugc

SEQ ID NO: 2020005 - RNA, 16 nt, Human
gggcacacgcugcucu

SEQ ID NO: 2020006 - RNA, 18 nt, Human
gggcacacgcugcucugc

SEQ ID NO: 2020007 - RNA, 19 nt, Human
gggcacacgcugcucugcc

SEQ ID NO: 2020008 - RNA, 20 nt, Human
gggcacacgcugcucugccc

SEQ ID NO: 2020009 - RNA, 22 nt, Human
gggcacacgcugcucugcccca

SEQ ID NO: 2020010 - RNA, 18 nt, Human
gggcacagaaaauggaag

SEQ ID NO: 2020011 - RNA, 15 nt, Human
gggcacaccuccucc

SEQ ID NO: 2020012 - RNA, 17 nt, Human
gggcacaccuccuccca

SEQ ID NO: 2020013 - RNA, 23 nt, Human
gggcacaccgggcacucagaaga

SEQ ID NO: 2020014 - RNA, 16 nt, Human
gggcacucagaagaca

SEQ ID NO: 2020015 - RNA, 19 nt, Human
gggcacucagaagacacug

SEQ ID NO: 2020016 - RNA, 14 nt, Human
gggcaccggggccu

SEQ ID NO: 2020017 - RNA, 16 nt, Human
gggcacagggucucua

SEQ ID NO: 2020018 - RNA, 13 nt, Human
gggcacagggucu

SEQ ID NO: 2020019 - RNA, 18 nt, Human
gggcacagggccuggccc

SEQ ID NO: 2020020 - RNA, 20 nt, Human
gggcacagggccuggcccau

SEQ ID NO: 2020021 - RNA, 13 nt, Human
gggcacaggucag

SEQ ID NO: 2020022 - RNA, 15 nt, Human
gggcacaggucaggc

SEQ ID NO: 2020023 - RNA, 18 nt, Human
gggcagaaggaagacuuc

SEQ ID NO: 2020024 - RNA, 14 nt, Human
gggcagaaggaaga

SEQ ID NO: 2020025 - RNA, 20 nt, Human
gggcacucagaagacacuga

SEQ ID NO: 2020026 - RNA, 19 nt, Human
gggcacgugguugaguggg

SEQ ID NO: 2020027 - RNA, 16 nt, Human
gggcacugcucucacc

SEQ ID NO: 2020028 - RNA, 17 nt, Human
gggcacugcucucaccu

SEQ ID NO: 2020029 - RNA, 13 nt, Human
gggcacugguggc

SEQ ID NO: 2020030 - RNA, 16 nt, Human
gggcacugguggcccg

SEQ ID NO: 2020031 - RNA, 17 nt, Human
gggcagguugguggggg

SEQ ID NO: 2020032 - RNA, 12 nt, Human
gggcagagcaga

SEQ ID NO: 2020033 - RNA, 11 nt, Human
gggcagagagg

SEQ ID NO: 2020034 - RNA, 11 nt, Human
gggcagagcag

SEQ ID NO: 2020035 - RNA, 19 nt, Human
gggcaggggaggccaucug

SEQ ID NO: 2020036 - RNA, 20 nt, Human
gggcaggggaggccaucugg

SEQ ID NO: 2020037 - RNA, 14 nt, Human
gggcagagaggcug

SEQ ID NO: 2020038 - RNA, 18 nt, Human
gggcagagaggcuguggu

SEQ ID NO: 2020039 - RNA, 14 nt, Human
gggcagagcacagc

SEQ ID NO: 2020040 - RNA, 21 nt, Human
gggccccugccucucugcagg

SEQ ID NO: 2020041 - RNA, 19 nt, Human
gggccccugccucucugca

SEQ ID NO: 2020042 - RNA, 18 nt, Human
gggccccugccucucugc

SEQ ID NO: 2020043 - RNA, 17 nt, Human
gggccccugccucucug

SEQ ID NO: 2020044 - RNA, 13 nt, Human
gggccccugccag

SEQ ID NO: 2020045 - RNA, 15 nt, Human
gggccccugccucuc

SEQ ID NO: 2020046 - RNA, 13 nt, Human
gggccccugccuc

SEQ ID NO: 2020047 - RNA, 23 nt, Human
gggcccccagcgagagucccugc

SEQ ID NO: 2020048 - RNA, 14 nt, Human
gggccccagaggcu

SEQ ID NO: 2020049 - RNA, 12 nt, Human
gggccccaccug

SEQ ID NO: 2020050 - RNA, 22 nt, Human
gggccccaccugcagcucccuc

SEQ ID NO: 2020051 - RNA, 13 nt, Human
gggccuggccuga

SEQ ID NO: 2020052 - RNA, 13 nt, Human
gggcccugccucc

SEQ ID NO: 2020053 - RNA, 14 nt, Human
gggcccugcagcuc

SEQ ID NO: 2020054 - RNA, 21 nt, Human
gggcccugcagcucucaugcu

SEQ ID NO: 2020055 - RNA, 22 nt, Human
gggccccugccucucugcaggu

SEQ ID NO: 2020056 - RNA, 13 nt, Human
gggccuggcuccc

SEQ ID NO: 2020057 - RNA, 17 nt, Human
gggccuggcucaggugg

SEQ ID NO: 2020058 - RNA, 18 nt, Human
gggccuggccugagcugg

SEQ ID NO: 2020059 - RNA, 14 nt, Human
gggccuggccugag

SEQ ID NO: 2020060 - RNA, 15 nt, Human
gggccuggcucccuc

SEQ ID NO: 2020061 - RNA, 17 nt, Human
gggccuggcucccucac

SEQ ID NO: 2020062 - RNA, 23 nt, Human
gggcauccauggggucucucaca

SEQ ID NO: 2020063 - RNA, 14 nt, Human
gggcauccaugggg

SEQ ID NO: 2020064 - RNA, 12 nt, Human
gggcaugacacg

SEQ ID NO: 2020065 - RNA, 15 nt, Human
gggcauggccaggug

SEQ ID NO: 2020066 - RNA, 17 nt, Human
gggcauggccagguggc

SEQ ID NO: 2020067 - RNA, 20 nt, Human
gggcauggccagguggccac

SEQ ID NO: 2020068 - RNA, 13 nt, Human
gggcauucucucu

SEQ ID NO: 2020069 - RNA, 18 nt, Human
gggcauucucucuccaag

SEQ ID NO: 2020070 - RNA, 23 nt, Human
gggccacagagaaaguacuucuc

SEQ ID NO: 2020071 - RNA, 16 nt, Human
gggccacagagaaagu

SEQ ID NO: 2020072 - RNA, 20 nt, Human
gggccaaaagcuucccuccc

SEQ ID NO: 2020073 - RNA, 17 nt, Human
gggcccagagagggugg

SEQ ID NO: 2020074 - RNA, 21 nt, Human
gggcccacccaagcaggaggc

SEQ ID NO: 2020075 - RNA, 14 nt, Human
ggucccaccccaca

SEQ ID NO: 2020076 - RNA, 17 nt, Human
ggucccaccccacacac

SEQ ID NO: 2020077 - RNA, 19 nt, Human
ggucagguugacaggaggu

SEQ ID NO: 2020078 - RNA, 22 nt, Human
ggucucacucugucgcccaguc

SEQ ID NO: 2020079 - RNA, 23 nt, Human
ggucucacucugucgcccagucu

SEQ ID NO: 2020080 - RNA, 21 nt, Human
ggucucucacagacaggaccc

SEQ ID NO: 2020081 - RNA, 23 nt, Human
ggucucucacagacaggaccccu

SEQ ID NO: 2020082 - RNA, 19 nt, Human
ggucucggaucaggcuccc

SEQ ID NO: 2020083 - RNA, 16 nt, Human
ggucucuagugcugug

SEQ ID NO: 2020084 - RNA, 19 nt, Human
ggucucuagugcugugaaa

SEQ ID NO: 2020085 - RNA, 12 nt, Human
ggugacaguggc

SEQ ID NO: 2020086 - RNA, 21 nt, Human
ggugacagagugagacucugu

SEQ ID NO: 2020087 - RNA, 14 nt, Human
ggucugacccacug

SEQ ID NO: 2020088 - RNA, 21 nt, Human
ggucugaguuguuaccccaag

SEQ ID NO: 2020089 - RNA, 20 nt, Human
ggugaccuuccaagagccug

SEQ ID NO: 2020090 - RNA, 21 nt, Human
ggugaccuuccaagagccuga

SEQ ID NO: 2020091 - RNA, 19 nt, Human
ggugaccuuccaagagccu

SEQ ID NO: 2020092 - RNA, 22 nt, Human
ggugaccagcaccaucucuccu

SEQ ID NO: 2020093 - RNA, 22 nt, Human
gguggccucccaacucacccca

SEQ ID NO: 2020094 - RNA, 23 nt, Human
gguggccacuccagaccccuggc

SEQ ID NO: 2020095 - RNA, 20 nt, Human
gguggccacuccagaccccu

SEQ ID NO: 2020096 - RNA, 21 nt, Human
gguggccacuccagaccccug

SEQ ID NO: 2020097 - RNA, 22 nt, Human
gguggccacuccagaccccugg

SEQ ID NO: 2020098 - RNA, 22 nt, Human
gguggcgcuagaggccauggag

SEQ ID NO: 2020099 - RNA, 23 nt, Human
gguggccucccaacucaccccag

SEQ ID NO: 2020100 - RNA, 21 nt, Human
ggugcuaucucccccagcccc

SEQ ID NO: 2020101 - RNA, 18 nt, Human
ggugcugcaguauguugc

SEQ ID NO: 2020102 - RNA, 15 nt, Human
ggugcugccauccag

SEQ ID NO: 2020103 - RNA, 21 nt, Human
ggugcugccauccagguucag

SEQ ID NO: 2020104 - RNA, 19 nt, Human
gguggcagugggagcugcc

SEQ ID NO: 2020105 - RNA, 22 nt, Human
gguggcagugggagcugccugu

SEQ ID NO: 2020106 - RNA, 21 nt, Human
gguggcaucauuccaggcccg

SEQ ID NO: 2020107 - RNA, 20 nt, Human
ggugcuaucucccccagccc

SEQ ID NO: 2020108 - RNA, 19 nt, Human
ggugcuaucucccccagcc

SEQ ID NO: 2020109 - RNA, 17 nt, Human
ggugcuaucucccccag

SEQ ID NO: 2020110 - RNA, 16 nt, Human
ggugcuaucuccccca

SEQ ID NO: 2020111 - RNA, 15 nt, Human
ggugagaagcagagg

SEQ ID NO: 2020112 - RNA, 16 nt, Human
ggugagaggggaacag

SEQ ID NO: 2020113 - RNA, 19 nt, Human
ggugagcauuacaggcaag

SEQ ID NO: 2020114 - RNA, 15 nt, Human
ggugggugaaaggaa

SEQ ID NO: 2020115 - RNA, 15 nt, Human
gguggguuaauuaaa

SEQ ID NO: 2020116 - RNA, 16 nt, Human
gguggugaccucugcc

SEQ ID NO: 2020117 - RNA, 14 nt, Human
gguggugaccucug

SEQ ID NO: 2020118 - RNA, 15 nt, Human
gguggugaccucugc

SEQ ID NO: 2020119 - RNA, 18 nt, Human
gguguaaucaugaaggag

SEQ ID NO: 2020120 - RNA, 15 nt, Human
ggugguuuucuguuc

SEQ ID NO: 2020121 - RNA, 18 nt, Human
ggugguuuucuguucuuu

SEQ ID NO: 2020122 - RNA, 22 nt, Human
ggugguucacucuuggagccug

SEQ ID NO: 2020123 - RNA, 23 nt, Human
ggugguucacucuuggagccugc

SEQ ID NO: 2020124 - RNA, 21 nt, Human
ggugguuauggagaggguguc

SEQ ID NO: 2020125 - RNA, 17 nt, Human
ggugguuucagaaaugu

SEQ ID NO: 2020126 - RNA, 18 nt, Human
ggugguuucagaaaugug

SEQ ID NO: 2020127 - RNA, 19 nt, Human
ggugucaccugaagacuca

SEQ ID NO: 2020128 - RNA, 17 nt, Human
ggugucaguauccaggc

SEQ ID NO: 2020129 - RNA, 13 nt, Human
gguguccccacca

SEQ ID NO: 2020130 - RNA, 18 nt, Human
gguguccccaccaucugc

SEQ ID NO: 2020131 - RNA, 21 nt, Human
gguguccccaccaucugcugu

SEQ ID NO: 2020132 - RNA, 19 nt, Human
ggugucaagagggucugag

SEQ ID NO: 2020133 - RNA, 17 nt, Human
ggugucaagagggucug

SEQ ID NO: 2020134 - RNA, 13 nt, Human
gguuauggagagg

SEQ ID NO: 2020135 - RNA, 21 nt, Human
gguuaguggauggaaggggcu

SEQ ID NO: 2020136 - RNA, 22 nt, Human
gguuaguggauggaaggggcug

SEQ ID NO: 2020137 - RNA, 15 nt, Human
gguuauagugcaaua

SEQ ID NO: 2020138 - RNA, 17 nt, Human
gguuauagugcaauaua

SEQ ID NO: 2020139 - RNA, 17 nt, Human
gguuaggcauuguggga

SEQ ID NO: 2020140 - RNA, 18 nt, Human
gguuaccgauuucaaagu

SEQ ID NO: 2020141 - RNA, 14 nt, Human
gguuagauauagag

SEQ ID NO: 2020142 - RNA, 21 nt, Human
gguuacccaguuagcucucaa

SEQ ID NO: 2020143 - RNA, 13 nt, Human
gguuaacaaauaa

SEQ ID NO: 2020144 - RNA, 21 nt, Human
gguuaacaaauaacaacuuuu

SEQ ID NO: 2020145 - RNA, 12 nt, Human
gguuaaaaugga

SEQ ID NO: 2020146 - RNA, 13 nt, Human
gguuaaauguuuu

SEQ ID NO: 2020147 - RNA, 14 nt, Human
gguuaaauguuuug

SEQ ID NO: 2020148 - RNA, 13 nt, Human
gguucaaagauau

SEQ ID NO: 2020149 - RNA, 23 nt, Human
gguuauuuugauguaaagauguu

SEQ ID NO: 2020150 - RNA, 16 nt, Human
gguuauuuaaaaugua

SEQ ID NO: 2020151 - RNA, 18 nt, Human
gguuauuuaaaauguaaa

SEQ ID NO: 2020152 - RNA, 19 nt, Human
gguucacucuuggagccug

SEQ ID NO: 2020153 - RNA, 20 nt, Human
gguucacucuuggagccugc

SEQ ID NO: 2020154 - RNA, 16 nt, Human
gguucaccauugagac

SEQ ID NO: 2020155 - RNA, 21 nt, Human
gguucaaagauauuuugcuuu

SEQ ID NO: 2020156 - RNA, 17 nt, Human
gguucaaaccugugaag

SEQ ID NO: 2020157 - RNA, 13 nt, Human
gguucaaaugugu

SEQ ID NO: 2020158 - RNA, 21 nt, Human
gguucacucuuggagccugca

SEQ ID NO: 2020159 - RNA, 23 nt, Human
gguucacucuuggagccugcaga

SEQ ID NO: 2020160 - RNA, 14 nt, Human
gguucuuucuuccu

SEQ ID NO: 2020161 - RNA, 16 nt, Human
gguucuuucuuccucu

SEQ ID NO: 2020162 - RNA, 13 nt, Human
gguugagguuuca

SEQ ID NO: 2020163 - RNA, 18 nt, Human
gguucuuucauuugcuuu

SEQ ID NO: 2020164 - RNA, 16 nt, Human
ggggcaacccugguga

SEQ ID NO: 2020165 - RNA, 13 nt, Human
ggggcacagggag

SEQ ID NO: 2020166 - RNA, 12 nt, Human
ggggcucagcaa

SEQ ID NO: 2020167 - RNA, 14 nt, Human
ggggcucagcaagg

SEQ ID NO: 2020168 - RNA, 20 nt, Human
ggggcucccgccuccaaccc

SEQ ID NO: 2020169 - RNA, 15 nt, Human
ggggcucagcaaggc

SEQ ID NO: 2020170 - RNA, 20 nt, Human
ggggcucagcaaggccaccu

SEQ ID NO: 2020171 - RNA, 21 nt, Human
ggggcucagcaaggccaccuc

SEQ ID NO: 2020172 - RNA, 17 nt, Human
ggggcugaggugggagg

SEQ ID NO: 2020173 - RNA, 19 nt, Human
ggggaaaaucagccugcuc

SEQ ID NO: 2020174 - RNA, 17 nt, Human
ggggaaaaucagccugc

SEQ ID NO: 2020175 - RNA, 16 nt, Human
ggggaaaaucagccug

SEQ ID NO: 2020176 - RNA, 17 nt, Human
gggcuuuccugugccag

SEQ ID NO: 2020177 - RNA, 21 nt, Human
gggcuuuccugugccagguga

SEQ ID NO: 2020178 - RNA, 22 nt, Human
gggcuuggggaccagagcugcc

SEQ ID NO: 2020179 - RNA, 17 nt, Human
gggcuuguaguucuuua

SEQ ID NO: 2020180 - RNA, 17 nt, Human
gggcuugucauagccag

SEQ ID NO: 2020181 - RNA, 13 nt, Human
gggcuuuaaaauu

SEQ ID NO: 2020182 - RNA, 11 nt, Human
gggccugggcc

SEQ ID NO: 2020183 - RNA, 15 nt, Human
gggccugggccuggc

SEQ ID NO: 2020184 - RNA, 15 nt, Human
ggggaaaagagauga

SEQ ID NO: 2020185 - RNA, 21 nt, Human
ggggaaaaucagccugcucca

SEQ ID NO: 2020186 - RNA, 15 nt, Human
ggggaggccaucugg

SEQ ID NO: 2020187 - RNA, 14 nt, Human
ggggagggugacag

SEQ ID NO: 2020188 - RNA, 18 nt, Human
ggggaggggcugugggcg

SEQ ID NO: 2020189 - RNA, 22 nt, Human
ggggcugcaccggcuggccugg

SEQ ID NO: 2020190 - RNA, 21 nt, Human
ggggcugcaccggcuggccug

SEQ ID NO: 2020191 - RNA, 12 nt, Human
ggggcugcaccg

SEQ ID NO: 2020192 - RNA, 19 nt, Human
ggggcugaggugggaggau

SEQ ID NO: 2020193 - RNA, 23 nt, Human
ggggcugcaccggcuggccuggc

SEQ ID NO: 2020194 - RNA, 22 nt, Human
gggggaggugggauccuccagg

SEQ ID NO: 2020195 - RNA, 22 nt, Human
gggguggcccgaaagggucucc

SEQ ID NO: 2020196 - RNA, 17 nt, Human
gggguggggaccucagg

SEQ ID NO: 2020197 - RNA, 20 nt, Human
gggguggggggggugcuggg

SEQ ID NO: 2020198 - RNA, 18 nt, Human
ggggugcugggccccugc

SEQ ID NO: 2020199 - RNA, 12 nt, Human
gggguggccucc

SEQ ID NO: 2020200 - RNA, 12 nt, Human
gggucugaggaa

SEQ ID NO: 2020201 - RNA, 21 nt, Human
gggucugaggaauccagaccc

SEQ ID NO: 2020202 - RNA, 17 nt, Human
gggucuccucaggacca

SEQ ID NO: 2020203 - RNA, 15 nt, Human
gggucucuagugcug

SEQ ID NO: 2020204 - RNA, 20 nt, Human
gggucucuagugcugugaaa

SEQ ID NO: 2020205 - RNA, 18 nt, Human
gggucucucacagacagg

SEQ ID NO: 2020206 - RNA, 22 nt, Human
gggucucucacagacaggaccc

SEQ ID NO: 2020207 - RNA, 24 nt, Human
gggucucucacagacaggaccccu

SEQ ID NO: 2020208 - RNA, 11 nt, Human
gggguuuuucu

SEQ ID NO: 2020209 - RNA, 17 nt, Human
ggguaagugagagaggg

SEQ ID NO: 2020210 - RNA, 14 nt, Human
gggucucacucugu

SEQ ID NO: 2020211 - RNA, 17 nt, Human
gggugcugggccccugc

SEQ ID NO: 2020212 - RNA, 22 nt, Human
ggguucaagcgauucuucugcu

SEQ ID NO: 2020213 - RNA, 18 nt, Human
ggguuagacugccagcuc

SEQ ID NO: 2020214 - RNA, 18 nt, Human
ggguguuguauggggagg

SEQ ID NO: 2020215 - RNA, 23 nt, Human
ggguucaagcgauucuucugcuu

SEQ ID NO: 2020216 - RNA, 12 nt, Human
ggguucuaccca

SEQ ID NO: 2020217 - RNA, 20 nt, Human
ggguuccuuccucugagccu

SEQ ID NO: 2020218 - RNA, 21 nt, Human
ggguuccuuccucugagccuu

SEQ ID NO: 2020219 - RNA, 19 nt, Human
ggguuccuuccucugagcc

SEQ ID NO: 2020220 - RNA, 19 nt, Human
ggguucuuucuuccucugc

SEQ ID NO: 2020221 - RNA, 13 nt, Human
ggguuccuucugg

SEQ ID NO: 2020222 - RNA, 17 nt, Human
ggguucuuucuuccucu

SEQ ID NO: 2020223 - RNA, 16 nt, Human
ggguucuuucuuccuc

SEQ ID NO: 2020224 - RNA, 17 nt, Human
gggugcagcaucuggaa

SEQ ID NO: 2020225 - RNA, 20 nt, Human
gggugcugcuaauucuuugc

SEQ ID NO: 2020226 - RNA, 18 nt, Human
gggugaguccuccagaac

SEQ ID NO: 2020227 - RNA, 18 nt, Human
gggucuugcaaaauuccu

SEQ ID NO: 2020228 - RNA, 22 nt, Human
gggucuugcaaaauuccugacg

SEQ ID NO: 2020229 - RNA, 20 nt, Human
gggucuugguuccagccugc

SEQ ID NO: 2020230 - RNA, 11 nt, Human
gggucuuccua

SEQ ID NO: 2020231 - RNA, 19 nt, Human
gggugacagagcaagugag

SEQ ID NO: 2020232 - RNA, 17 nt, Human
gggugaagugaagacaa

SEQ ID NO: 2020233 - RNA, 18 nt, Human
gguagcauuuguguugaa

SEQ ID NO: 2020234 - RNA, 19 nt, Human
gguagcccccucuucccug

SEQ ID NO: 2020235 - RNA, 14 nt, Human
gguagaacgccagg

SEQ ID NO: 2020236 - RNA, 23 nt, Human
gguagaacgccagggaccccaga

SEQ ID NO: 2020237 - RNA, 18 nt, Human
gguagaaugaccuuguaa

SEQ ID NO: 2020238 - RNA, 20 nt, Human
gguagaaugaccuuguaaug

SEQ ID NO: 2020239 - RNA, 20 nt, Human
gguagaggugcaugccuaau

SEQ ID NO: 2020240 - RNA, 22 nt, Human
gguagaagcccuucuaccuucc

SEQ ID NO: 2020241 - RNA, 23 nt, Human
gguagaaauaucugaaaauguau

SEQ ID NO: 2020242 - RNA, 11 nt, Human
gguacccacug

SEQ ID NO: 2020243 - RNA, 16 nt, Human
gguacccacugcucug

SEQ ID NO: 2020244 - RNA, 13 nt, Human
gguacccacugcu

SEQ ID NO: 2020245 - RNA, 22 nt, Human
gguagaaauaucugaaaaugua

SEQ ID NO: 2020246 - RNA, 20 nt, Human
gguacuuguggacacagcuc

SEQ ID NO: 2020247 - RNA, 16 nt, Human
gguacuuguggacaca

SEQ ID NO: 2020248 - RNA, 17 nt, Human
gguacuuguggacacag

SEQ ID NO: 2020249 - RNA, 12 nt, Human
ggucacucuggc

SEQ ID NO: 2020250 - RNA, 22 nt, Human
ggucaccucacucagcaccacu

SEQ ID NO: 2020251 - RNA, 19 nt, Human
ggucaccucacucagcacc

SEQ ID NO: 2020252 - RNA, 21 nt, Human
ggucaccucacucagcaccac

SEQ ID NO: 2020253 - RNA, 16 nt, Human
ggucacaggacucugc

SEQ ID NO: 2020254 - RNA, 18 nt, Human
ggucacaggacucugccu

SEQ ID NO: 2020255 - RNA, 16 nt, Human
ggucaaaugcuagaaa

SEQ ID NO: 2020256 - RNA, 16 nt, Human
ggucccaccccacaca

SEQ ID NO: 2020257 - RNA, 15 nt, Human
ggucccaccccacac

SEQ ID NO: 2020258 - RNA, 17 nt, Human
ggucaggccgggcagag

SEQ ID NO: 2020259 - RNA, 11 nt, Human
ggucagagccu

SEQ ID NO: 2020260 - RNA, 15 nt, Human
ggucacuucuucugu

SEQ ID NO: 2020261 - RNA, 17 nt, Human
ggucagaagagagggug

SEQ ID NO: 2020262 - RNA, 19 nt, Human
gccuuacccucauguucuu

SEQ ID NO: 2020263 - RNA, 20 nt, Human
gccuuagaagucacacagua

SEQ ID NO: 2020264 - RNA, 17 nt, Human
gccuuagaaccuuucuu

SEQ ID NO: 2020265 - RNA, 16 nt, Human
gccuuagaaccuuucu

SEQ ID NO: 2020266 - RNA, 23 nt, Human
gccuuauggaacacucugagacu

SEQ ID NO: 2020267 - RNA, 22 nt, Human
gccuuauggaacacucugagac

SEQ ID NO: 2020268 - RNA, 21 nt, Human
gccuuauggaacacucugaga

SEQ ID NO: 2020269 - RNA, 15 nt, Human
gccuuagggaagcug

SEQ ID NO: 2020270 - RNA, 22 nt, Human
gccuuagggaagcuggccugag

SEQ ID NO: 2020271 - RNA, 15 nt, Human
gccugguggcagcug

SEQ ID NO: 2020272 - RNA, 18 nt, Human
gccuguaaucacagcuac

SEQ ID NO: 2020273 - RNA, 14 nt, Human
gccuggugguuuuc

SEQ ID NO: 2020274 - RNA, 16 nt, Human
gccuggugguuuucaa

SEQ ID NO: 2020275 - RNA, 16 nt, Human
gccugguggcagcugc

SEQ ID NO: 2020276 - RNA, 17 nt, Human
gccugguggcagcugcg

SEQ ID NO: 2020277 - RNA, 16 nt, Human
gccuuucagcaggcag

SEQ ID NO: 2020278 - RNA, 17 nt, Human
gccuuucagcaggcagc

SEQ ID NO: 2020279 - RNA, 18 nt, Human
gccuuucagcaggcagcc

SEQ ID NO: 2020280 - RNA, 22 nt, Human
gccuuugggugcuguuuugcca

SEQ ID NO: 2020281 - RNA, 17 nt, Human
gccuuugggugcuguuu

SEQ ID NO: 2020282 - RNA, 21 nt, Human
gccuuuuguucauuucauccu

SEQ ID NO: 2020283 - RNA, 18 nt, Human
gccuucggccuccauccu

SEQ ID NO: 2020284 - RNA, 13 nt, Human
gccuucagcucua

SEQ ID NO: 2020285 - RNA, 16 nt, Human
gccuucagcucuacag

SEQ ID NO: 2020286 - RNA, 19 nt, Human
gccuugggauccaggcccc

SEQ ID NO: 2020287 - RNA, 14 nt, Human
gccuugggcucugc

SEQ ID NO: 2020288 - RNA, 15 nt, Human
gccuugggcucugcu

SEQ ID NO: 2020289 - RNA, 16 nt, Human
gccuugggcucugcug

SEQ ID NO: 2020290 - RNA, 17 nt, Human
gccuugggcucugcuga

SEQ ID NO: 2020291 - RNA, 19 nt, Human
gccuucggccuccauccug

SEQ ID NO: 2020292 - RNA, 21 nt, Human
gccuuuaucuaccaacuuuca

SEQ ID NO: 2020293 - RNA, 22 nt, Human
gccuuuaucuaccaacuuucaa

SEQ ID NO: 2020294 - RNA, 15 nt, Human
gccuuggggacaacc

SEQ ID NO: 2020295 - RNA, 20 nt, Human
gcuaacuugcuuaaauguga

SEQ ID NO: 2020296 - RNA, 22 nt, Human
gcuaacuugcuuaaaugugaau

SEQ ID NO: 2020297 - RNA, 14 nt, Human
gcuaagaauauuug

SEQ ID NO: 2020298 - RNA, 16 nt, Human
gcuaagaauauuugaa

SEQ ID NO: 2020299 - RNA, 23 nt, Human
gcuaagaaaccaggaguaaaaga

SEQ ID NO: 2020300 - RNA, 18 nt, Human
gcuaacuugcuuaaaugu

SEQ ID NO: 2020301 - RNA, 19 nt, Human
gcuaacuugcuuaaaugug

SEQ ID NO: 2020302 - RNA, 22 nt, Human
gcuacacaggggaaaagaggag

SEQ ID NO: 2020303 - RNA, 14 nt, Human
gcuaacauggaagu

SEQ ID NO: 2020304 - RNA, 18 nt, Human
gcuaacauggaaguacua

SEQ ID NO: 2020305 - RNA, 17 nt, Human
gcuaacauggaaguacu

SEQ ID NO: 2020306 - RNA, 17 nt, Human
gcgucgcccucccaggc

SEQ ID NO: 2020307 - RNA, 16 nt, Human
gcgucgcccucccagg

SEQ ID NO: 2020308 - RNA, 14 nt, Human
gcgugagccacugc

SEQ ID NO: 2020309 - RNA, 16 nt, Human
gcgugagccacugcac

SEQ ID NO: 2020310 - RNA, 16 nt, Human
gcgugagaccugcccc

SEQ ID NO: 2020311 - RNA, 15 nt, Human
gcgugagccacugca

SEQ ID NO: 2020312 - RNA, 22 nt, Human
gcuagacgagcaggcuucuucc

SEQ ID NO: 2020313 - RNA, 21 nt, Human
gcuagacgagcaggcuucuuc

SEQ ID NO: 2020314 - RNA, 21 nt, Human
gcuacauuuccgccacauccc

SEQ ID NO: 2020315 - RNA, 20 nt, Human
gcuacauggggucugggugg

SEQ ID NO: 2020316 - RNA, 15 nt, Human
gcuacauuuccgcca

SEQ ID NO: 2020317 - RNA, 19 nt, Human
gcggaaugaaccacaucuu

SEQ ID NO: 2020318 - RNA, 21 nt, Human
gcgcuucacuuggguccaggc

SEQ ID NO: 2020319 - RNA, 16 nt, Human
gcggacagccacggcc

SEQ ID NO: 2020320 - RNA, 19 nt, Human
gcggacagccacggccagg

SEQ ID NO: 2020321 - RNA, 23 nt, Human
gcggacagccacggccaggccag

SEQ ID NO: 2020322 - RNA, 18 nt, Human
gcggggacagcuccuucu

SEQ ID NO: 2020323 - RNA, 16 nt, Human
gcggacaucagcuggu

SEQ ID NO: 2020324 - RNA, 19 nt, Human
gcggggacagcuccuucug

SEQ ID NO: 2020325 - RNA, 23 nt, Human
gcggggacagcuccuucuguccu

SEQ ID NO: 2020326 - RNA, 20 nt, Human
gcgguccacccaggagcccc

SEQ ID NO: 2020327 - RNA, 23 nt, Human
gcgguccacccaggagccccgag

SEQ ID NO: 2020328 - RNA, 22 nt, Human
gcgcuccgggacguggcaccuc

SEQ ID NO: 2020329 - RNA, 20 nt, Human
gcgccuacaggagugagcac

SEQ ID NO: 2020330 - RNA, 21 nt, Human
gcgccuacaggagugagcacu

SEQ ID NO: 2020331 - RNA, 14 nt, Human
gcgcugccccuggc

SEQ ID NO: 2020332 - RNA, 23 nt, Human
gcgcucgaaguugaucuccccag

SEQ ID NO: 2020333 - RNA, 17 nt, Human
gcgcugccccuggcagc

SEQ ID NO: 2020334 - RNA, 18 nt, Human
gcgccuacaggagugagc

SEQ ID NO: 2020335 - RNA, 14 nt, Human
gccucccugccagu

SEQ ID NO: 2020336 - RNA, 15 nt, Human
gccucucccaucacu

SEQ ID NO: 2020337 - RNA, 17 nt, Human
gccucucugcagguccc

SEQ ID NO: 2020338 - RNA, 16 nt, Human
gccucucugcaggucc

SEQ ID NO: 2020339 - RNA, 14 nt, Human
gccucucugcaggu

SEQ ID NO: 2020340 - RNA, 10 nt, Human
gccucucugc

SEQ ID NO: 2020341 - RNA, 12 nt, Human
gccucagccucc

SEQ ID NO: 2020342 - RNA, 14 nt, Human
gccucagccuccca

SEQ ID NO: 2020343 - RNA, 22 nt, Human
gccucagccucccaaagugcug

SEQ ID NO: 2020344 - RNA, 18 nt, Human
gccucccgaauagcuggg

SEQ ID NO: 2020345 - RNA, 19 nt, Human
gccucccgaauagcuggga

SEQ ID NO: 2020346 - RNA, 21 nt, Human
gccucccgaguagcugggacu

SEQ ID NO: 2020347 - RNA, 23 nt, Human
gccucccgaguagcugggacuac

SEQ ID NO: 2020348 - RNA, 20 nt, Human
gccucccgaauagcugggac

SEQ ID NO: 2020349 - RNA, 20 nt, Human
gccugcagagcugcgggcug

SEQ ID NO: 2020350 - RNA, 14 nt, Human
gccuggacccugug

SEQ ID NO: 2020351 - RNA, 11 nt, Human
gccugcccagg

SEQ ID NO: 2020352 - RNA, 12 nt, Human
gccugcccaggc

SEQ ID NO: 2020353 - RNA, 21 nt, Human
gccucugcacuccccugcugg

SEQ ID NO: 2020354 - RNA, 12 nt, Human
gccucugcauuc

SEQ ID NO: 2020355 - RNA, 15 nt, Human
gccucugcacucccc

SEQ ID NO: 2020356 - RNA, 15 nt, Human
gccucugcauucagg

SEQ ID NO: 2020357 - RNA, 16 nt, Human
gccugagaggggaagc

SEQ ID NO: 2020358 - RNA, 13 nt, Human
gccugagaugccu

SEQ ID NO: 2020359 - RNA, 14 nt, Human
gccugagaugccug

SEQ ID NO: 2020360 - RNA, 18 nt, Human
gccugaagaguccucuga

SEQ ID NO: 2020361 - RNA, 20 nt, Human
gccugaagaguccucugaau

SEQ ID NO: 2020362 - RNA, 15 nt, Human
gccugaagucacaca

SEQ ID NO: 2020363 - RNA, 20 nt, Human
gccucugcacuccccugcug

SEQ ID NO: 2020364 - RNA, 19 nt, Human
gccucugcacuccccugcu

SEQ ID NO: 2020365 - RNA, 18 nt, Human
gccucugcacuccccugc

SEQ ID NO: 2020366 - RNA, 17 nt, Human
gccucugcacuccccug

SEQ ID NO: 2020367 - RNA, 16 nt, Human
gccucugcacuccccu

SEQ ID NO: 2020368 - RNA, 16 nt, Human
gccucugacacacagc

SEQ ID NO: 2020369 - RNA, 15 nt, Human
gccucugacacacag

SEQ ID NO: 2020370 - RNA, 22 nt, Human
gccucaagugauucuccugccu

SEQ ID NO: 2020371 - RNA, 24 nt, Human
gccucaagugauucuccugccuca

SEQ ID NO: 2020372 - RNA, 19 nt, Human
gccucaaauccaggacccu

SEQ ID NO: 2020373 - RNA, 22 nt, Human
gccucaaauccaggacccugcc

SEQ ID NO: 2020374 - RNA, 18 nt, Human
gccucagcauccuggcac

SEQ ID NO: 2020375 - RNA, 17 nt, Human
gccucagcauccuggca

SEQ ID NO: 2020376 - RNA, 21 nt, Human
gccucagcauccuggcacccg

SEQ ID NO: 2020377 - RNA, 21 nt, Human
gccuaagauauacuuguuuuu

SEQ ID NO: 2020378 - RNA, 14 nt, Human
gccuaaggcugaac

SEQ ID NO: 2020379 - RNA, 17 nt, Human
gccuauuuuaauaaaca

SEQ ID NO: 2020380 - RNA, 21 nt, Human
gccuauuuucaugauuucuuu

SEQ ID NO: 2020381 - RNA, 15 nt, Human
gccucaaauccagga

SEQ ID NO: 2020382 - RNA, 16 nt, Human
gccucaaauccaggac

SEQ ID NO: 2020383 - RNA, 18 nt, Human
gccucaaauccaggaccc

SEQ ID NO: 2020384 - RNA, 14 nt, Human
gccucaaauccagg

SEQ ID NO: 2020385 - RNA, 23 nt, Human
gccgucuaccugaggggccucuu

SEQ ID NO: 2020386 - RNA, 22 nt, Human
gccgucuaccugaggggccucu

SEQ ID NO: 2020387 - RNA, 20 nt, Human
gccgucuaccugaggggccu

SEQ ID NO: 2020388 - RNA, 18 nt, Human
gccgucuaccugaggggc

SEQ ID NO: 2020389 - RNA, 15 nt, Human
gccuaaaaauaaagc

SEQ ID NO: 2020390 - RNA, 19 nt, Human
gccguugcugacuuagaau

SEQ ID NO: 2020391 - RNA, 18 nt, Human
gccguugccgcugauguu

SEQ ID NO: 2020392 - RNA, 17 nt, Human
gccguugcugacuuaga

SEQ ID NO: 2020393 - RNA, 18 nt, Human
gccguugcugacuuagaa

SEQ ID NO: 2020394 - RNA, 11 nt, Human
gccguggcuuc

SEQ ID NO: 2020395 - RNA, 12 nt, Human
gccguggcuucc

SEQ ID NO: 2020396 - RNA, 13 nt, Human
gccguggcuuccc

SEQ ID NO: 2020397 - RNA, 15 nt, Human
gccguggcuucccgc

SEQ ID NO: 2020398 - RNA, 13 nt, Human
gcccuucucucca

SEQ ID NO: 2020399 - RNA, 21 nt, Human
gcccuucggaggaccagggcu

SEQ ID NO: 2020400 - RNA, 22 nt, Human
gcccuuccucuccacugccuuc

SEQ ID NO: 2020401 - RNA, 13 nt, Human
gcccuuccucugc

SEQ ID NO: 2020402 - RNA, 14 nt, Human
gcccuuccucugcu

SEQ ID NO: 2020403 - RNA, 15 nt, Human
gcccuuccucugcuc

SEQ ID NO: 2020404 - RNA, 17 nt, Human
gcccuuccucugcuccc

SEQ ID NO: 2020405 - RNA, 16 nt, Human
gccgagauagccaagg

SEQ ID NO: 2020406 - RNA, 15 nt, Human
gcccuugcccaugcu

SEQ ID NO: 2020407 - RNA, 17 nt, Human
gccgagauagccaaggc

SEQ ID NO: 2020408 - RNA, 17 nt, Human
gccgcagcccugcagag

SEQ ID NO: 2020409 - RNA, 16 nt, Human
gccgcagcccugcaga

SEQ ID NO: 2020410 - RNA, 15 nt, Human
gccgcagcccugcag

SEQ ID NO: 2020411 - RNA, 14 nt, Human
gccgggcagagcac

SEQ ID NO: 2020412 - RNA, 17 nt, Human
gccgggcagagcacagc

SEQ ID NO: 2020413 - RNA, 16 nt, Human
gccgggcaaacuggcc

SEQ ID NO: 2020414 - RNA, 12 nt, Human
gcccggcuccag

SEQ ID NO: 2020415 - RNA, 19 nt, Human
gccccuucugacccaugcu

SEQ ID NO: 2020416 - RNA, 20 nt, Human
gccccuucugacccaugcug

SEQ ID NO: 2020417 - RNA, 18 nt, Human
gcccgggcucugccuccc

SEQ ID NO: 2020418 - RNA, 15 nt, Human
gcccgggcucugccu

SEQ ID NO: 2020419 - RNA, 14 nt, Human
gcccgggcucugcc

SEQ ID NO: 2020420 - RNA, 13 nt, Human
gcccgggcucugc

SEQ ID NO: 2020421 - RNA, 13 nt, Human
gcccggcuccagg

SEQ ID NO: 2020422 - RNA, 14 nt, Human
gcccggcuccaggc

SEQ ID NO: 2020423 - RNA, 12 nt, Human
gcccgggcucug

SEQ ID NO: 2020424 - RNA, 15 nt, Human
gcccggcuccaggcu

SEQ ID NO: 2020425 - RNA, 22 nt, Human
gcccuccucccucccagcucca

SEQ ID NO: 2020426 - RNA, 18 nt, Human
gcccuccucccucccagc

SEQ ID NO: 2020427 - RNA, 20 nt, Human
gcccuccucccucccagcuc

SEQ ID NO: 2020428 - RNA, 22 nt, Human
gcccucugcccacucccugcaa

SEQ ID NO: 2020429 - RNA, 20 nt, Human
gcccgggcucugccucccau

SEQ ID NO: 2020430 - RNA, 19 nt, Human
gcccgggcucugccuccca

SEQ ID NO: 2020431 - RNA, 21 nt, Human
gcccgggcucugccucccauc

SEQ ID NO: 2020432 - RNA, 15 nt, Human
gcccucccugccccu

SEQ ID NO: 2020433 - RNA, 19 nt, Human
gccccugcacuccagccug

SEQ ID NO: 2020434 - RNA, 23 nt, Human
gccccuggcagccccuguucugg

SEQ ID NO: 2020435 - RNA, 11 nt, Human
gccccugagcc

SEQ ID NO: 2020436 - RNA, 13 nt, Human
gccccugcacaaa

SEQ ID NO: 2020437 - RNA, 12 nt, Human
gccccugagccc

SEQ ID NO: 2020438 - RNA, 13 nt, Human
gccccugagccca

SEQ ID NO: 2020439 - RNA, 14 nt, Human
gccccugagcccac

SEQ ID NO: 2020440 - RNA, 15 nt, Human
gccccugagcccacu

SEQ ID NO: 2020441 - RNA, 16 nt, Human
gccccugagcccacug

SEQ ID NO: 2020442 - RNA, 17 nt, Human
gccccuucccccuccaa

SEQ ID NO: 2020443 - RNA, 23 nt, Human
gccccucaacucuccuccagagu

SEQ ID NO: 2020444 - RNA, 15 nt, Human
gccccguucuguuug

SEQ ID NO: 2020445 - RNA, 21 nt, Human
gccccucagggucccuggugg

SEQ ID NO: 2020446 - RNA, 19 nt, Human
gccccucagggucccuggu

SEQ ID NO: 2020447 - RNA, 22 nt, Human
gccccgaggccuucucugaagg

SEQ ID NO: 2020448 - RNA, 14 nt, Human
gccccgcccaggcu

SEQ ID NO: 2020449 - RNA, 22 nt, Human
gccccauucugccugcccaggc

SEQ ID NO: 2020450 - RNA, 23 nt, Human
gccccauucugccugcccaggcc

SEQ ID NO: 2020451 - RNA, 23 nt, Human
gccccgaggccuucucugaagga

SEQ ID NO: 2020452 - RNA, 21 nt, Human
gccccgucuacagcuccccca

SEQ ID NO: 2020453 - RNA, 13 nt, Human
gccccgucucagg

SEQ ID NO: 2020454 - RNA, 14 nt, Human
gccccgucucaggu

SEQ ID NO: 2020455 - RNA, 17 nt, Human
gccccgucucaggucug

SEQ ID NO: 2020456 - RNA, 17 nt, Human
gccccgugggguuccuc

SEQ ID NO: 2020457 - RNA, 17 nt, Human
gccccgucccccucugg

SEQ ID NO: 2020458 - RNA, 21 nt, Human
gccccgucccccucuggcucc

SEQ ID NO: 2020459 - RNA, 18 nt, Human
gccccgucuacagcuccc

SEQ ID NO: 2020460 - RNA, 15 nt, Human
gccccaggaaaggcc

SEQ ID NO: 2020461 - RNA, 17 nt, Human
gccccagcuugggcaga

SEQ ID NO: 2020462 - RNA, 22 nt, Human
gccccaggaaaggcccagccac

SEQ ID NO: 2020463 - RNA, 14 nt, Human
gccccagcgcugac

SEQ ID NO: 2020464 - RNA, 23 nt, Human
gccccagcgcugacgugucagga

SEQ ID NO: 2020465 - RNA, 22 nt, Human
gcccaucugggggccucuucug

SEQ ID NO: 2020466 - RNA, 15 nt, Human
gccccagugcccaca

SEQ ID NO: 2020467 - RNA, 16 nt, Human
gccccagugcccacag

SEQ ID NO: 2020468 - RNA, 17 nt, Human
gccccagugcccacagg

SEQ ID NO: 2020469 - RNA, 21 nt, Human
gccccagugcccacaggauca

SEQ ID NO: 2020470 - RNA, 23 nt, Human
gccccauccucuguacagagccc

SEQ ID NO: 2020471 - RNA, 17 nt, Human
gccccauucugccugcc

SEQ ID NO: 2020472 - RNA, 18 nt, Human
gccccauucugccugccc

SEQ ID NO: 2020473 - RNA, 20 nt, Human
gccccauucugccugcccag

SEQ ID NO: 2020474 - RNA, 21 nt, Human
gccccauucugccugcccagg

SEQ ID NO: 2020475 - RNA, 21 nt, Human
gcccacccugcuuggcccagg

SEQ ID NO: 2020476 - RNA, 22 nt, Human
gcccacccugcuuggcccaggg

SEQ ID NO: 2020477 - RNA, 23 nt, Human
gcccacccugcuuggcccagggg

SEQ ID NO: 2020478 - RNA, 18 nt, Human
gcccaggccuccuacagc

SEQ ID NO: 2020479 - RNA, 16 nt, Human
gcccaggaaaggcucc

SEQ ID NO: 2020480 - RNA, 15 nt, Human
gcccaggaaaggcuc

SEQ ID NO: 2020481 - RNA, 12 nt, Human
gcccaggaaagg

SEQ ID NO: 2020482 - RNA, 11 nt, Human
gcccaggcugg

SEQ ID NO: 2020483 - RNA, 17 nt, Human
gcccaggccugccuguu

SEQ ID NO: 2020484 - RNA, 23 nt, Human
gcccagcuuuucauugcugugac

SEQ ID NO: 2020485 - RNA, 16 nt, Human
gcccaggcuggcgugc

SEQ ID NO: 2020486 - RNA, 14 nt, Human
gcccaggcuggcgu

SEQ ID NO: 2020487 - RNA, 15 nt, Human
gcccaggcuggcgug

SEQ ID NO: 2020488 - RNA, 18 nt, Human
gcccauccccaggcaccu

SEQ ID NO: 2020489 - RNA, 22 nt, Human
gcccagucuggaaugcaguggu

SEQ ID NO: 2020490 - RNA, 18 nt, Human
gcccagucccagcagcca

SEQ ID NO: 2020491 - RNA, 19 nt, Human
gcccagucccagcagccag

SEQ ID NO: 2020492 - RNA, 20 nt, Human
gcccagucccagcagccagc

SEQ ID NO: 2020493 - RNA, 12 nt, Human
gcccagucccag

SEQ ID NO: 2020494 - RNA, 13 nt, Human
gcccagucccagc

SEQ ID NO: 2020495 - RNA, 14 nt, Human
gcccagucccagca

SEQ ID NO: 2020496 - RNA, 15 nt, Human
gcccagucccagcag

SEQ ID NO: 2020497 - RNA, 16 nt, Human
gcccagucccagcagc

SEQ ID NO: 2020498 - RNA, 17 nt, Human
gcccagucccagcagcc

SEQ ID NO: 2020499 - RNA, 18 nt, Human
gccaggaagccagcaggc

SEQ ID NO: 2020500 - RNA, 17 nt, Human
gccaggaagccagcagg

SEQ ID NO: 2020501 - RNA, 11 nt, Human
gccaggaagcc

SEQ ID NO: 2020502 - RNA, 15 nt, Human
gccaggaaccugucc

SEQ ID NO: 2020503 - RNA, 22 nt, Human
gccaggaaccuguccuaaggaa

SEQ ID NO: 2020504 - RNA, 19 nt, Human
gccaggaagccagcaggcu

SEQ ID NO: 2020505 - RNA, 20 nt, Human
gccaggaagccagcaggcuc

SEQ ID NO: 2020506 - RNA, 23 nt, Human
gccaggggaaaaucagccugcuc

SEQ ID NO: 2020507 - RNA, 22 nt, Human
gccaggggaaaaucagccugcu

SEQ ID NO: 2020508 - RNA, 21 nt, Human
gccaggggaaaaucagccugc

SEQ ID NO: 2020509 - RNA, 17 nt, Human
gccaggggaaaaucagc

SEQ ID NO: 2020510 - RNA, 17 nt, Human
gccaucccagccccaau

SEQ ID NO: 2020511 - RNA, 16 nt, Human
gccaucccagccccaa

SEQ ID NO: 2020512 - RNA, 15 nt, Human
gccaucccagcccca

SEQ ID NO: 2020513 - RNA, 14 nt, Human
gccaucccagcccc

SEQ ID NO: 2020514 - RNA, 13 nt, Human
gccaucccagccc

SEQ ID NO: 2020515 - RNA, 19 nt, Human
gccauccagguucagcuug

SEQ ID NO: 2020516 - RNA, 20 nt, Human
gccauccagguucagcuugu

SEQ ID NO: 2020517 - RNA, 13 nt, Human
gccauggaggcag

SEQ ID NO: 2020518 - RNA, 14 nt, Human
gccaugggacaggg

SEQ ID NO: 2020519 - RNA, 19 nt, Human
gccaugggacagggaggac

SEQ ID NO: 2020520 - RNA, 22 nt, Human
gccauuucuuccacaagagccc

SEQ ID NO: 2020521 - RNA, 20 nt, Human
gccauuucuuccacaagagc

SEQ ID NO: 2020522 - RNA, 17 nt, Human
gccauuucuuccacaag

SEQ ID NO: 2020523 - RNA, 16 nt, Human
gcccaaagaugcagcc

SEQ ID NO: 2020524 - RNA, 15 nt, Human
gcccaaagaugcagc

SEQ ID NO: 2020525 - RNA, 16 nt, Human
gccauuuguguuuaua

SEQ ID NO: 2020526 - RNA, 19 nt, Human
gcccacaggaucagucuga

SEQ ID NO: 2020527 - RNA, 13 nt, Human
gcccacaggauca

SEQ ID NO: 2020528 - RNA, 18 nt, Human
gcccacaggaucagucug

SEQ ID NO: 2020529 - RNA, 15 nt, Human
gcccaccccucaaca

SEQ ID NO: 2020530 - RNA, 20 nt, Human
gcccacccgguucaguguuu

SEQ ID NO: 2020531 - RNA, 20 nt, Human
gcccacccugcuuggcccag

SEQ ID NO: 2020532 - RNA, 14 nt, Human
gccacggccaggcc

SEQ ID NO: 2020533 - RNA, 15 nt, Human
gccacggccaggcca

SEQ ID NO: 2020534 - RNA, 20 nt, Human
gccacuauuguuagucucuu

SEQ ID NO: 2020535 - RNA, 21 nt, Human
gccacuauuguuagucucuug

SEQ ID NO: 2020536 - RNA, 22 nt, Human
gccacguucuuacuaguuuccc

SEQ ID NO: 2020537 - RNA, 14 nt, Human
gccacguuuucacc

SEQ ID NO: 2020538 - RNA, 16 nt, Human
gccacggccaggccag

SEQ ID NO: 2020539 - RNA, 15 nt, Human
gccagagacacaagc

SEQ ID NO: 2020540 - RNA, 12 nt, Human
gccagagacaca

SEQ ID NO: 2020541 - RNA, 18 nt, Human
gccagagggagugacaga

SEQ ID NO: 2020542 - RNA, 17 nt, Human
gccacugcaccgggcca

SEQ ID NO: 2020543 - RNA, 18 nt, Human
gccacugcaccgggccac

SEQ ID NO: 2020544 - RNA, 14 nt, Human
gccacucaggccca

SEQ ID NO: 2020545 - RNA, 22 nt, Human
gccacucaggcccaaagccucg

SEQ ID NO: 2020546 - RNA, 19 nt, Human
gccacuccagaccccuggc

SEQ ID NO: 2020547 - RNA, 16 nt, Human
gccacuccagaccccu

SEQ ID NO: 2020548 - RNA, 18 nt, Human
gccacuccagaccccugg

SEQ ID NO: 2020549 - RNA, 12 nt, Human
gccagccuugac

SEQ ID NO: 2020550 - RNA, 20 nt, Human
gccagccgagauagccaagg

SEQ ID NO: 2020551 - RNA, 21 nt, Human
gccagccgagauagccaaggc

SEQ ID NO: 2020552 - RNA, 17 nt, Human
gccagauucuuuccuga

SEQ ID NO: 2020553 - RNA, 15 nt, Human
gccagauguccuaau

SEQ ID NO: 2020554 - RNA, 16 nt, Human
gccagauucuuuccug

SEQ ID NO: 2020555 - RNA, 19 nt, Human
gccagagggagugacagag

SEQ ID NO: 2020556 - RNA, 20 nt, Human
gccagagggagugacagagg

SEQ ID NO: 2020557 - RNA, 15 nt, Human
gccagcugcuugggc

SEQ ID NO: 2020558 - RNA, 16 nt, Human
gccagcugcuugggcu

SEQ ID NO: 2020559 - RNA, 22 nt, Human
gccagcugcugagccgcagaga

SEQ ID NO: 2020560 - RNA, 13 nt, Human
gccagcugccucc

SEQ ID NO: 2020561 - RNA, 14 nt, Human
gccagcugcuuggg

SEQ ID NO: 2020562 - RNA, 15 nt, Human
gccagcugcugagcc

SEQ ID NO: 2020563 - RNA, 16 nt, Human
gccagcugcugagccg

SEQ ID NO: 2020564 - RNA, 18 nt, Human
gccagcugcugagccgca

SEQ ID NO: 2020565 - RNA, 19 nt, Human
gccagcugcugagccgcag

SEQ ID NO: 2020566 - RNA, 20 nt, Human
gccagcugcugagccgcaga

SEQ ID NO: 2020567 - RNA, 22 nt, Human
gccagccuugaccauucuccac

SEQ ID NO: 2020568 - RNA, 21 nt, Human
gccagccuugaccauucucca

SEQ ID NO: 2020569 - RNA, 20 nt, Human
gccagccuugaccauucucc

SEQ ID NO: 2020570 - RNA, 14 nt, Human
gccagccuugacca

SEQ ID NO: 2020571 - RNA, 19 nt, Human
gccagcgggaauggcagcu

SEQ ID NO: 2020572 - RNA, 11 nt, Human
gcaggucccua

SEQ ID NO: 2020573 - RNA, 10 nt, Human
gcaggucccu

SEQ ID NO: 2020574 - RNA, 23 nt, Human
gcagguccccagacuccaccaag

SEQ ID NO: 2020575 - RNA, 13 nt, Human
gcaggucccuaau

SEQ ID NO: 2020576 - RNA, 12 nt, Human
gcaggucccuaa

SEQ ID NO: 2020577 - RNA, 23 nt, Human
gcagugcuuccaaggauggacca

SEQ ID NO: 2020578 - RNA, 16 nt, Human
gcagugggagcugccu

SEQ ID NO: 2020579 - RNA, 20 nt, Human
gcaggauucuuccucccucc

SEQ ID NO: 2020580 - RNA, 14 nt, Human
gcagggagggccug

SEQ ID NO: 2020581 - RNA, 17 nt, Human
gcagggagggccugggc

SEQ ID NO: 2020582 - RNA, 16 nt, Human
gcagggagggcuucug

SEQ ID NO: 2020583 - RNA, 18 nt, Human
gcagggagggccugggcc

SEQ ID NO: 2020584 - RNA, 22 nt, Human
gcagggagggccugggccccag

SEQ ID NO: 2020585 - RNA, 12 nt, Human
gcagggcucagc

SEQ ID NO: 2020586 - RNA, 14 nt, Human
gcauauauauaugu

SEQ ID NO: 2020587 - RNA, 18 nt, Human
gcauauauauaugugugu

SEQ ID NO: 2020588 - RNA, 19 nt, Human
gcauauauuaaaagcaggc

SEQ ID NO: 2020589 - RNA, 21 nt, Human
gcauauauuaaagcaucagga

SEQ ID NO: 2020590 - RNA, 15 nt, Human
gcauauucaggaagc

SEQ ID NO: 2020591 - RNA, 23 nt, Human
gcauauuauuuuauguugcauag

SEQ ID NO: 2020592 - RNA, 18 nt, Human
gcauauuauuuuauguug

SEQ ID NO: 2020593 - RNA, 20 nt, Human
gcauauucaggaagcucagg

SEQ ID NO: 2020594 - RNA, 21 nt, Human
gcauauucuaguaauaaagac

SEQ ID NO: 2020595 - RNA, 18 nt, Human
gcauauucaggaagcuca

SEQ ID NO: 2020596 - RNA, 17 nt, Human
gcauauucaggaagcuc

SEQ ID NO: 2020597 - RNA, 21 nt, Human
gcaucaagaugugacauguuu

SEQ ID NO: 2020598 - RNA, 22 nt, Human
gcauauucuaguaauaaagacu

SEQ ID NO: 2020599 - RNA, 23 nt, Human
gcauauucuaguaauaaagacuc

SEQ ID NO: 2020600 - RNA, 15 nt, Human
gcagugggccuggcc

SEQ ID NO: 2020601 - RNA, 17 nt, Human
gcagugggagcugccug

SEQ ID NO: 2020602 - RNA, 18 nt, Human
gcagugggagcugccugu

SEQ ID NO: 2020603 - RNA, 13 nt, Human
gcaguuacaaauu

SEQ ID NO: 2020604 - RNA, 20 nt, Human
gcaguuacaaauuauaaugu

SEQ ID NO: 2020605 - RNA, 22 nt, Human
gcaguuaugugaccucacgugc

SEQ ID NO: 2020606 - RNA, 17 nt, Human
gcaguuccccuggaagc

SEQ ID NO: 2020607 - RNA, 23 nt, Human
gcaguuccccuggaagcagugcc

SEQ ID NO: 2020608 - RNA, 16 nt, Human
gcaguucgaccagcca

SEQ ID NO: 2020609 - RNA, 18 nt, Human
gcaguucgaccagccagg

SEQ ID NO: 2020610 - RNA, 16 nt, Human
gcauaggccugcuuug

SEQ ID NO: 2020611 - RNA, 22 nt, Human
gcauaggccugcuuugucuccu

SEQ ID NO: 2020612 - RNA, 23 nt, Human
gcauaggccugcuuugucuccuc

SEQ ID NO: 2020613 - RNA, 16 nt, Human
gcauauaacuuauauu

SEQ ID NO: 2020614 - RNA, 23 nt, Human
gcauauaacuuauauuguaagaa

SEQ ID NO: 2020615 - RNA, 15 nt, Human
gcauauaacuuauau

SEQ ID NO: 2020616 - RNA, 15 nt, Human
gcaugcugucccuua

SEQ ID NO: 2020617 - RNA, 21 nt, Human
gcaugcuguauuaugaaaucg

SEQ ID NO: 2020618 - RNA, 14 nt, Human
gcaugcuuuccaua

SEQ ID NO: 2020619 - RNA, 19 nt, Human
gcauggagaaugcaccaua

SEQ ID NO: 2020620 - RNA, 17 nt, Human
gcauguuugugauugac

SEQ ID NO: 2020621 - RNA, 20 nt, Human
gcauuagauuucucauuugc

SEQ ID NO: 2020622 - RNA, 17 nt, Human
gcauuagugggaaaaag

SEQ ID NO: 2020623 - RNA, 17 nt, Human
gcauuccagucaggcuc

SEQ ID NO: 2020624 - RNA, 15 nt, Human
gcauuaaaagaaaau

SEQ ID NO: 2020625 - RNA, 13 nt, Human
gcauguuuugcau

SEQ ID NO: 2020626 - RNA, 15 nt, Human
gcauguuuugcaugu

SEQ ID NO: 2020627 - RNA, 13 nt, Human
gcauuaaaagaaa

SEQ ID NO: 2020628 - RNA, 14 nt, Human
gcauuaaaagaaaa

SEQ ID NO: 2020629 - RNA, 22 nt, Human
gcaugccuggauggggcugcac

SEQ ID NO: 2020630 - RNA, 17 nt, Human
gcaugccuggauggggc

SEQ ID NO: 2020631 - RNA, 17 nt, Human
gcaugaauuugugaagg

SEQ ID NO: 2020632 - RNA, 23 nt, Human
gcaucaagaggugggagggcccu

SEQ ID NO: 2020633 - RNA, 23 nt, Human
gcaugaaguaauaugcacacauu

SEQ ID NO: 2020634 - RNA, 15 nt, Human
gcaugaauuugugaa

SEQ ID NO: 2020635 - RNA, 17 nt, Human
gcaucaggccaggcccu

SEQ ID NO: 2020636 - RNA, 16 nt, Human
gcaucaggccaggccc

SEQ ID NO: 2020637 - RNA, 15 nt, Human
gcaucaggccaggcc

SEQ ID NO: 2020638 - RNA, 13 nt, Human
gcaucaggccagg

SEQ ID NO: 2020639 - RNA, 20 nt, Human
gccaaaggaagcacaugccu

SEQ ID NO: 2020640 - RNA, 16 nt, Human
gccaaaggaagcacau

SEQ ID NO: 2020641 - RNA, 14 nt, Human
gccaaaggaagcac

SEQ ID NO: 2020642 - RNA, 12 nt, Human
gccaaagacaaa

SEQ ID NO: 2020643 - RNA, 14 nt, Human
gccaaagacaaaua

SEQ ID NO: 2020644 - RNA, 15 nt, Human
gccaaagacaaauag

SEQ ID NO: 2020645 - RNA, 19 nt, Human
gccaaacucaccugccccu

SEQ ID NO: 2020646 - RNA, 23 nt, Human
gccaaaauuaagguguuugaaaa

SEQ ID NO: 2020647 - RNA, 13 nt, Human
gccaaacacacag

SEQ ID NO: 2020648 - RNA, 14 nt, Human
gccaaacaggcccu

SEQ ID NO: 2020649 - RNA, 11 nt, Human
gccaaacauua

SEQ ID NO: 2020650 - RNA, 12 nt, Human
gccaaacauuaa

SEQ ID NO: 2020651 - RNA, 19 nt, Human
gccaaacauuaauguugau

SEQ ID NO: 2020652 - RNA, 21 nt, Human
gccaaacucaccugccccuca

SEQ ID NO: 2020653 - RNA, 24 nt, Human
gccaaacauuaauguugauuucua

SEQ ID NO: 2020654 - RNA, 22 nt, Human
gccaaacauuaauguugauuuc

SEQ ID NO: 2020655 - RNA, 23 nt, Human
gccaaacauuaauguugauuucu

SEQ ID NO: 2020656 - RNA, 15 nt, Human
gccaaaagcugcuca

SEQ ID NO: 2020657 - RNA, 14 nt, Human
gccaaaagcugcuc

SEQ ID NO: 2020658 - RNA, 14 nt, Human
gccaaaagcuuccc

SEQ ID NO: 2020659 - RNA, 15 nt, Human
gccaaaagcuucccu

SEQ ID NO: 2020660 - RNA, 20 nt, Human
gccaaaagcuucccucccug

SEQ ID NO: 2020661 - RNA, 22 nt, Human
gccaaaagcuucccucccugcu

SEQ ID NO: 2020662 - RNA, 14 nt, Human
gccaaaauuaaggu

SEQ ID NO: 2020663 - RNA, 21 nt, Human
gccaaaauuaagguguuugaa

SEQ ID NO: 2020664 - RNA, 12 nt, Human
gcauuuuguaau

SEQ ID NO: 2020665 - RNA, 13 nt, Human
gcauuuuggcgcu

SEQ ID NO: 2020666 - RNA, 13 nt, Human
gccaaaacccagc

SEQ ID NO: 2020667 - RNA, 16 nt, Human
gccaaaacccagcugc

SEQ ID NO: 2020668 - RNA, 19 nt, Human
gccaaaacccagcugcacc

SEQ ID NO: 2020669 - RNA, 20 nt, Human
gcauuuucccccuuggcucu

SEQ ID NO: 2020670 - RNA, 22 nt, Human
gcauuuugcuaaaugugaauga

SEQ ID NO: 2020671 - RNA, 17 nt, Human
gcauuuuacuguacaga

SEQ ID NO: 2020672 - RNA, 16 nt, Human
gcauuuuacuguacag

SEQ ID NO: 2020673 - RNA, 14 nt, Human
gcauuugcuuuugu

SEQ ID NO: 2020674 - RNA, 21 nt, Human
gcauuuggugguuucagaaau

SEQ ID NO: 2020675 - RNA, 23 nt, Human
gcauuugcugaauacagaggcaa

SEQ ID NO: 2020676 - RNA, 12 nt, Human
gcauuccccacu

SEQ ID NO: 2020677 - RNA, 12 nt, Human
gcauuccccagg

SEQ ID NO: 2020678 - RNA, 14 nt, Human
gcauucggagggag

SEQ ID NO: 2020679 - RNA, 13 nt, Human
gcauucucacucc

SEQ ID NO: 2020680 - RNA, 15 nt, Human
gcauucucacuccua

SEQ ID NO: 2020681 - RNA, 18 nt, Human
gcauucucacuccuaccu

SEQ ID NO: 2020682 - RNA, 23 nt, Human
gcauucucuccauuucacuggcu

SEQ ID NO: 2020683 - RNA, 14 nt, Human
gcauucucucucca

SEQ ID NO: 2020684 - RNA, 23 nt, Human
gcauugccaguaacacaggccac

SEQ ID NO: 2020685 - RNA, 14 nt, Human
gcagaagacaguau

SEQ ID NO: 2020686 - RNA, 19 nt, Human
gcagaacuugaagccugcu

SEQ ID NO: 2020687 - RNA, 14 nt, Human
gcagaaggaagacu

SEQ ID NO: 2020688 - RNA, 13 nt, Human
gcagaaggaagac

SEQ ID NO: 2020689 - RNA, 12 nt, Human
gcagaaggaaga

SEQ ID NO: 2020690 - RNA, 14 nt, Human
gcacugggcuuggg

SEQ ID NO: 2020691 - RNA, 23 nt, Human
gcacugggcuuggggaccagagc

SEQ ID NO: 2020692 - RNA, 22 nt, Human
gcacugggcuuggggaccagag

SEQ ID NO: 2020693 - RNA, 22 nt, Human
gcacugauauauuuaaaaacaa

SEQ ID NO: 2020694 - RNA, 17 nt, Human
gcacugaggaccagcca

SEQ ID NO: 2020695 - RNA, 19 nt, Human
gcacuaaggugugcucuga

SEQ ID NO: 2020696 - RNA, 18 nt, Human
gcacuaaggugugcucug

SEQ ID NO: 2020697 - RNA, 17 nt, Human
gcacuaaggugugcucu

SEQ ID NO: 2020698 - RNA, 18 nt, Human
gcacccggccccugcugg

SEQ ID NO: 2020699 - RNA, 14 nt, Human
gcaaugaccuuuca

SEQ ID NO: 2020700 - RNA, 13 nt, Human
gcaaugaccuuuc

SEQ ID NO: 2020701 - RNA, 19 nt, Human
gcacagcuaacauggaagu

SEQ ID NO: 2020702 - RNA, 20 nt, Human
gcacagcucccuucuguuga

SEQ ID NO: 2020703 - RNA, 14 nt, Human
gcacagcugcucug

SEQ ID NO: 2020704 - RNA, 19 nt, Human
gcacagcguuaugugucug

SEQ ID NO: 2020705 - RNA, 16 nt, Human
gcacagcuucauuucc

SEQ ID NO: 2020706 - RNA, 17 nt, Human
gcacaggcugagugcag

SEQ ID NO: 2020707 - RNA, 18 nt, Human
gcacaggcugagugcagg

SEQ ID NO: 2020708 - RNA, 19 nt, Human
gcacaggcugagugcaggc

SEQ ID NO: 2020709 - RNA, 20 nt, Human
gcacaggcugagugcaggcc

SEQ ID NO: 2020710 - RNA, 21 nt, Human
gcacaggcugagugcaggccc

SEQ ID NO: 2020711 - RNA, 13 nt, Human
gcacaggcugagu

SEQ ID NO: 2020712 - RNA, 15 nt, Human
gcacaggcagggcag

SEQ ID NO: 2020713 - RNA, 16 nt, Human
gcacaggcagggcagg

SEQ ID NO: 2020714 - RNA, 20 nt, Human
gcacaggcagggcaggacca

SEQ ID NO: 2020715 - RNA, 21 nt, Human
gcacaggcagggcaggaccag

SEQ ID NO: 2020716 - RNA, 11 nt, Human
gcacaggcaga

SEQ ID NO: 2020717 - RNA, 13 nt, Human
gcacaggcagggc

SEQ ID NO: 2020718 - RNA, 14 nt, Human
gcacaggcagggca

SEQ ID NO: 2020719 - RNA, 14 nt, Human
gcacccggccccug

SEQ ID NO: 2020720 - RNA, 16 nt, Human
gcacccauccaccguc

SEQ ID NO: 2020721 - RNA, 22 nt, Human
gcacccauccaccguccccucc

SEQ ID NO: 2020722 - RNA, 23 nt, Human
gcacccauccaccguccccuccc

SEQ ID NO: 2020723 - RNA, 15 nt, Human
gcacccggccccugc

SEQ ID NO: 2020724 - RNA, 17 nt, Human
gcacccggccccugcug

SEQ ID NO: 2020725 - RNA, 14 nt, Human
gcaccuccugccuc

SEQ ID NO: 2020726 - RNA, 15 nt, Human
gcaccuccugccucg

SEQ ID NO: 2020727 - RNA, 17 nt, Human
gcaccacucaagaccaa

SEQ ID NO: 2020728 - RNA, 18 nt, Human
gcaccacucaagaccaaa

SEQ ID NO: 2020729 - RNA, 13 nt, Human
gcaccacucaaga

SEQ ID NO: 2020730 - RNA, 19 nt, Human
gcaccacugcacuccagcc

SEQ ID NO: 2020731 - RNA, 13 nt, Human
gcaccacccuccu

SEQ ID NO: 2020732 - RNA, 15 nt, Human
gcaccacccuccuuc

SEQ ID NO: 2020733 - RNA, 16 nt, Human
gcaccacccuccuucc

SEQ ID NO: 2020734 - RNA, 17 nt, Human
gcaccacccuccuuccc

SEQ ID NO: 2020735 - RNA, 18 nt, Human
gcagaaggaagacuucau

SEQ ID NO: 2020736 - RNA, 15 nt, Human
gcagaagcccugaug

SEQ ID NO: 2020737 - RNA, 19 nt, Human
gcagagaaugaaagggccc

SEQ ID NO: 2020738 - RNA, 20 nt, Human
gcagagaaugaaagggccca

SEQ ID NO: 2020739 - RNA, 21 nt, Human
gcagagaaugaaagggcccag

SEQ ID NO: 2020740 - RNA, 21 nt, Human
gcagagaauucucuuauccaa

SEQ ID NO: 2020741 - RNA, 21 nt, Human
gcagagaagugacgguuccua

SEQ ID NO: 2020742 - RNA, 22 nt, Human
gcagagaaugaaagggcccaga

SEQ ID NO: 2020743 - RNA, 23 nt, Human
gcagagaaugaaagggcccagag

SEQ ID NO: 2020744 - RNA, 19 nt, Human
gcagagaccaucccugaag

SEQ ID NO: 2020745 - RNA, 17 nt, Human
gcagagaccaucccuga

SEQ ID NO: 2020746 - RNA, 15 nt, Human
gcagagaccaucccu

SEQ ID NO: 2020747 - RNA, 14 nt, Human
gcagagaccauccc

SEQ ID NO: 2020748 - RNA, 15 nt, Human
gcagaguugaagaca

SEQ ID NO: 2020749 - RNA, 19 nt, Human
gcagaugcaaugacucagg

SEQ ID NO: 2020750 - RNA, 13 nt, Human
gcagaugcaauga

SEQ ID NO: 2020751 - RNA, 14 nt, Human
gcagaugcagcucu

SEQ ID NO: 2020752 - RNA, 15 nt, Human
gcagaugcagcucuu

SEQ ID NO: 2020753 - RNA, 19 nt, Human
gcagaugcagcucuuccug

SEQ ID NO: 2020754 - RNA, 13 nt, Human
gcagaugccuggg

SEQ ID NO: 2020755 - RNA, 19 nt, Human
gcagauuuugcccuugaca

SEQ ID NO: 2020756 - RNA, 17 nt, Human
gcagaguugaagacaga

SEQ ID NO: 2020757 - RNA, 16 nt, Human
gcagaguugaagacag

SEQ ID NO: 2020758 - RNA, 19 nt, Human
gcagaguugaagacagagc

SEQ ID NO: 2020759 - RNA, 14 nt, Human
gcagaguucaggga

SEQ ID NO: 2020760 - RNA, 13 nt, Human
gcagaguuacuug

SEQ ID NO: 2020761 - RNA, 15 nt, Human
gcagaguuacuugau

SEQ ID NO: 2020762 - RNA, 16 nt, Human
gcagcaccgccucuuc

SEQ ID NO: 2020763 - RNA, 19 nt, Human
gcagcaccgccucuucccg

SEQ ID NO: 2020764 - RNA, 15 nt, Human
gcagcacagcugaga

SEQ ID NO: 2020765 - RNA, 21 nt, Human
gcagcacccagguuuugcacu

SEQ ID NO: 2020766 - RNA, 21 nt, Human
gcagcaaggucuugcucuccu

SEQ ID NO: 2020767 - RNA, 16 nt, Human
gcagauuuuggccaug

SEQ ID NO: 2020768 - RNA, 14 nt, Human
gcagcaacacacau

SEQ ID NO: 2020769 - RNA, 12 nt, Human
gcagcaauaaag

SEQ ID NO: 2020770 - RNA, 17 nt, Human
gcagcaaggucuugcuc

SEQ ID NO: 2020771 - RNA, 14 nt, Human
gcaggaccagccca

SEQ ID NO: 2020772 - RNA, 15 nt, Human
gcaggaccagcccac

SEQ ID NO: 2020773 - RNA, 16 nt, Human
gcaggaccagcccacg

SEQ ID NO: 2020774 - RNA, 18 nt, Human
gcaggaccagcccacgcu

SEQ ID NO: 2020775 - RNA, 19 nt, Human
gcaggaccagcccacgcug

SEQ ID NO: 2020776 - RNA, 20 nt, Human
gcaggaccuucgggcugugc

SEQ ID NO: 2020777 - RNA, 22 nt, Human
gcaggaccagcccacgcugacu

SEQ ID NO: 2020778 - RNA, 21 nt, Human
gcaggaguuucguuuucaaaa

SEQ ID NO: 2020779 - RNA, 20 nt, Human
gcaggaguuucguuuucaaa

SEQ ID NO: 2020780 - RNA, 11 nt, Human
gcaggaggaag

SEQ ID NO: 2020781 - RNA, 13 nt, Human
gcaggagcaguau

SEQ ID NO: 2020782 - RNA, 17 nt, Human
gcaggagcaguaucaug

SEQ ID NO: 2020783 - RNA, 22 nt, Human
gcaggagcaguaucaugaagcc

SEQ ID NO: 2020784 - RNA, 12 nt, Human
gcagcagggcag

SEQ ID NO: 2020785 - RNA, 14 nt, Human
gcagccgugccuuc

SEQ ID NO: 2020786 - RNA, 15 nt, Human
gcagccgugccuuca

SEQ ID NO: 2020787 - RNA, 17 nt, Human
gcagccgugccuucagc

SEQ ID NO: 2020788 - RNA, 19 nt, Human
gcagccucaaccuccuggg

SEQ ID NO: 2020789 - RNA, 20 nt, Human
gcagccucaaccuccugggc

SEQ ID NO: 2020790 - RNA, 18 nt, Human
gcagccgugccuucagcu

SEQ ID NO: 2020791 - RNA, 24 nt, Human
gcagccugccuugcccacuccugc

SEQ ID NO: 2020792 - RNA, 21 nt, Human
gcagccucaaccuccugggcu

SEQ ID NO: 2020793 - RNA, 22 nt, Human
gcagccucaaccuccugggcua

SEQ ID NO: 2020794 - RNA, 23 nt, Human
gcagccugcgccaccgcccagag

SEQ ID NO: 2020795 - RNA, 14 nt, Human
gcagccuggacccu

SEQ ID NO: 2020796 - RNA, 17 nt, Human
gauucaggcauuuuccc

SEQ ID NO: 2020797 - RNA, 20 nt, Human
gauucaggcauuuucccccu

SEQ ID NO: 2020798 - RNA, 15 nt, Human
gauucccaagcucug

SEQ ID NO: 2020799 - RNA, 18 nt, Human
gauucagacagcugccug

SEQ ID NO: 2020800 - RNA, 17 nt, Human
gauucagacagcugccu

SEQ ID NO: 2020801 - RNA, 14 nt, Human
gauucagacagcug

SEQ ID NO: 2020802 - RNA, 13 nt, Human
gauucagacagcu

SEQ ID NO: 2020803 - RNA, 13 nt, Human
gauuacaagcgug

SEQ ID NO: 2020804 - RNA, 21 nt, Human
gauuacaagcgugagccacug

SEQ ID NO: 2020805 - RNA, 14 nt, Human
gauguuugugcagu

SEQ ID NO: 2020806 - RNA, 21 nt, Human
gauguuuuaaggaugcuugua

SEQ ID NO: 2020807 - RNA, 18 nt, Human
gauguucuggauaccauu

SEQ ID NO: 2020808 - RNA, 18 nt, Human
gauguucuagcauggcug

SEQ ID NO: 2020809 - RNA, 16 nt, Human
gaugcuagaacucccu

SEQ ID NO: 2020810 - RNA, 18 nt, Human
gaugcgggcauggcagcc

SEQ ID NO: 2020811 - RNA, 15 nt, Human
gaugcgcaguugcug

SEQ ID NO: 2020812 - RNA, 17 nt, Human
gaugccugguggcagcu

SEQ ID NO: 2020813 - RNA, 20 nt, Human
gaugccugugaacugaacuc

SEQ ID NO: 2020814 - RNA, 17 nt, Human
gauugcaacaggcuggg

SEQ ID NO: 2020815 - RNA, 18 nt, Human
gauugcaacaggcugggc

SEQ ID NO: 2020816 - RNA, 22 nt, Human
gauuggauuuuauguugacauu

SEQ ID NO: 2020817 - RNA, 23 nt, Human
gauugcuguguguugccugggac

SEQ ID NO: 2020818 - RNA, 16 nt, Human
gauucccaagcucugc

SEQ ID NO: 2020819 - RNA, 17 nt, Human
gauucccaagcucugcu

SEQ ID NO: 2020820 - RNA, 19 nt, Human
gauucuuuccugaggcugg

SEQ ID NO: 2020821 - RNA, 17 nt, Human
gauuaauagcauucgaa

SEQ ID NO: 2020822 - RNA, 22 nt, Human
gauucuuuccugaggcugggcu

SEQ ID NO: 2020823 - RNA, 20 nt, Human
gauucuuuccugaggcuggg

SEQ ID NO: 2020824 - RNA, 16 nt, Human
gauugcaacaggcugg

SEQ ID NO: 2020825 - RNA, 13 nt, Human
gauuuaaacucug

SEQ ID NO: 2020826 - RNA, 14 nt, Human
gauuuaaacucuga

SEQ ID NO: 2020827 - RNA, 11 nt, Human
gauuguuuaaa

SEQ ID NO: 2020828 - RNA, 21 nt, Human
gauuguuuaucuagauguaaa

SEQ ID NO: 2020829 - RNA, 15 nt, Human
gauugggccccugcc

SEQ ID NO: 2020830 - RNA, 16 nt, Human
gauugggaauccgccc

SEQ ID NO: 2020831 - RNA, 22 nt, Human
gauuucuguuuagauaauacac

SEQ ID NO: 2020832 - RNA, 21 nt, Human
gauuucuguuuagauaauaca

SEQ ID NO: 2020833 - RNA, 17 nt, Human
gauuuaaacucugaauu

SEQ ID NO: 2020834 - RNA, 17 nt, Human
gauuuguugauucucuc

SEQ ID NO: 2020835 - RNA, 22 nt, Human
gcaacuuuguauaaaagggacu

SEQ ID NO: 2020836 - RNA, 16 nt, Human
gcaagauugauguuuc

SEQ ID NO: 2020837 - RNA, 17 nt, Human
gcaagauggcacagggc

SEQ ID NO: 2020838 - RNA, 19 nt, Human
gcaagauggcacagggcau

SEQ ID NO: 2020839 - RNA, 22 nt, Human
gcaagauggcacagggcaugaa

SEQ ID NO: 2020840 - RNA, 15 nt, Human
gcaagcaccuccugc

SEQ ID NO: 2020841 - RNA, 16 nt, Human
gcaagcaccuccugcc

SEQ ID NO: 2020842 - RNA, 18 nt, Human
gcaagcaagaaacacugg

SEQ ID NO: 2020843 - RNA, 15 nt, Human
gcaagcaccaucccc

SEQ ID NO: 2020844 - RNA, 18 nt, Human
gcaagcaccuccugccuc

SEQ ID NO: 2020845 - RNA, 20 nt, Human
gcaagcaccuccugccucga

SEQ ID NO: 2020846 - RNA, 22 nt, Human
gcaagcaguuucaauaaaguuu

SEQ ID NO: 2020847 - RNA, 17 nt, Human
gcaagcaccauccccuc

SEQ ID NO: 2020848 - RNA, 18 nt, Human
gcaagcaccauccccucc

SEQ ID NO: 2020849 - RNA, 14 nt, Human
gcaagcaguuucaa

SEQ ID NO: 2020850 - RNA, 15 nt, Human
gcaagcaguuucaau

SEQ ID NO: 2020851 - RNA, 20 nt, Human
gcaaggaagguaaaaaguua

SEQ ID NO: 2020852 - RNA, 18 nt, Human
gcaaggcugucaauuaca

SEQ ID NO: 2020853 - RNA, 14 nt, Human
gcaaggcugucaau

SEQ ID NO: 2020854 - RNA, 14 nt, Human
gcaagggaggccca

SEQ ID NO: 2020855 - RNA, 21 nt, Human
gcaagggaauuucuucaacuc

SEQ ID NO: 2020856 - RNA, 18 nt, Human
gcaagguccggcccaucc

SEQ ID NO: 2020857 - RNA, 15 nt, Human
gcaagggaggcccag

SEQ ID NO: 2020858 - RNA, 18 nt, Human
gcaaggucuugcucuccu

SEQ ID NO: 2020859 - RNA, 17 nt, Human
gcaauccugcaagaaca

SEQ ID NO: 2020860 - RNA, 13 nt, Human
gcaauccuuacaa

SEQ ID NO: 2020861 - RNA, 14 nt, Human
gcaauccuuacaaa

SEQ ID NO: 2020862 - RNA, 16 nt, Human
gcaauccuuacaaaug

SEQ ID NO: 2020863 - RNA, 19 nt, Human
gcaauccuuacaaaugauu

SEQ ID NO: 2020864 - RNA, 14 nt, Human
gcaaucuauaauau

SEQ ID NO: 2020865 - RNA, 14 nt, Human
gcaaauggccucau

SEQ ID NO: 2020866 - RNA, 12 nt, Human
gcaaaugugaau

SEQ ID NO: 2020867 - RNA, 18 nt, Human
gcaacugcauuggcuuug

SEQ ID NO: 2020868 - RNA, 19 nt, Human
gcaaagagacccagucaau

SEQ ID NO: 2020869 - RNA, 20 nt, Human
gcaaacuuuauuuuguguuu

SEQ ID NO: 2020870 - RNA, 14 nt, Human
gcaaagaacucuua

SEQ ID NO: 2020871 - RNA, 22 nt, Human
gcaaagaacucuuacccuggca

SEQ ID NO: 2020872 - RNA, 23 nt, Human
gcaaaguucccuacuuccuguga

SEQ ID NO: 2020873 - RNA, 21 nt, Human
gcaaaccaucauugaaaucuu

SEQ ID NO: 2020874 - RNA, 20 nt, Human
gcaaaccaucauugaaaucu

SEQ ID NO: 2020875 - RNA, 19 nt, Human
gcaaaccaucauugaaauc

SEQ ID NO: 2020876 - RNA, 17 nt, Human
gcaaaccaucauugaaa

SEQ ID NO: 2020877 - RNA, 16 nt, Human
gcaaaccaucauugaa

SEQ ID NO: 2020878 - RNA, 14 nt, Human
gauuuuaaaugugu

SEQ ID NO: 2020879 - RNA, 15 nt, Human
gauuuuaaaugugug

SEQ ID NO: 2020880 - RNA, 16 nt, Human
gauuuuaaauguguga

SEQ ID NO: 2020881 - RNA, 12 nt, Human
gauuuuaaaaug

SEQ ID NO: 2020882 - RNA, 13 nt, Human
gauuuuaaaaugu

SEQ ID NO: 2020883 - RNA, 18 nt, Human
gauuuuaaaauguacaug

SEQ ID NO: 2020884 - RNA, 21 nt, Human
gauuuuaaaauguacauguau

SEQ ID NO: 2020885 - RNA, 22 nt, Human
gauuuuaaaauguacauguauu

SEQ ID NO: 2020886 - RNA, 12 nt, Human
gauuuuaaaugu

SEQ ID NO: 2020887 - RNA, 18 nt, Human
gcaaacuuuauuuugugu

SEQ ID NO: 2020888 - RNA, 23 nt, Human
gcaaacuggccgcgggggcaggg

SEQ ID NO: 2020889 - RNA, 16 nt, Human
gcaaacucaagcuucu

SEQ ID NO: 2020890 - RNA, 21 nt, Human
gcaaacucaagcuucuucacu

SEQ ID NO: 2020891 - RNA, 15 nt, Human
gcaaacccugucaaa

SEQ ID NO: 2020892 - RNA, 19 nt, Human
gcaaacccugucaaacauu

SEQ ID NO: 2020893 - RNA, 20 nt, Human
gcaaacccugucaaacauua

SEQ ID NO: 2020894 - RNA, 19 nt, Human
gcaaaccuaauugcacaac

SEQ ID NO: 2020895 - RNA, 22 nt, Human
gcaaaccuuucuauaauuuuac

SEQ ID NO: 2020896 - RNA, 18 nt, Human
gauccuaggcauuugcug

SEQ ID NO: 2020897 - RNA, 23 nt, Human
gauccuaaugaaugcauaaaaug

SEQ ID NO: 2020898 - RNA, 20 nt, Human
gaucccuuccaccugcucug

SEQ ID NO: 2020899 - RNA, 22 nt, Human
gaucccuuccaccugcucugcu

SEQ ID NO: 2020900 - RNA, 23 nt, Human
gaucccuuccaccugcucugcug

SEQ ID NO: 2020901 - RNA, 14 nt, Human
gauccuccaggugc

SEQ ID NO: 2020902 - RNA, 16 nt, Human
gauccucccaccucag

SEQ ID NO: 2020903 - RNA, 17 nt, Human
gauccucccaccucagc

SEQ ID NO: 2020904 - RNA, 13 nt, Human
gaucccuuccacc

SEQ ID NO: 2020905 - RNA, 19 nt, Human
gaucccuuccaccugcucu

SEQ ID NO: 2020906 - RNA, 13 nt, Human
gaucauccacugu

SEQ ID NO: 2020907 - RNA, 22 nt, Human
gaucauaguuuuauuuauauuu

SEQ ID NO: 2020908 - RNA, 12 nt, Human
gaucauaguuuu

SEQ ID NO: 2020909 - RNA, 13 nt, Human
gaucauaguuuua

SEQ ID NO: 2020910 - RNA, 14 nt, Human
gaucauaguuuuau

SEQ ID NO: 2020911 - RNA, 15 nt, Human
gaucauaguuuuauu

SEQ ID NO: 2020912 - RNA, 16 nt, Human
gaucauaguuuuauuu

SEQ ID NO: 2020913 - RNA, 18 nt, Human
gaucauaguuuuauuuau

SEQ ID NO: 2020914 - RNA, 19 nt, Human
gaucauaguuuuauuuaua

SEQ ID NO: 2020915 - RNA, 20 nt, Human
gaucuaggaagacuuuggaa

SEQ ID NO: 2020916 - RNA, 18 nt, Human
gaucuaggaagacuuugg

SEQ ID NO: 2020917 - RNA, 14 nt, Human
gaucuaggaagacu

SEQ ID NO: 2020918 - RNA, 13 nt, Human
gaucuaggaagac

SEQ ID NO: 2020919 - RNA, 22 nt, Human
gauccuggguacugaaagccuu

SEQ ID NO: 2020920 - RNA, 12 nt, Human
gauccugagcca

SEQ ID NO: 2020921 - RNA, 16 nt, Human
gauccucccaggcuuc

SEQ ID NO: 2020922 - RNA, 15 nt, Human
gauccuccccuggac

SEQ ID NO: 2020923 - RNA, 17 nt, Human
gauccuccccuggacuc

SEQ ID NO: 2020924 - RNA, 18 nt, Human
gauccuccccuggacucc

SEQ ID NO: 2020925 - RNA, 16 nt, Human
gaugcagcucuuccug

SEQ ID NO: 2020926 - RNA, 16 nt, Human
gaugagaggaaaucac

SEQ ID NO: 2020927 - RNA, 20 nt, Human
gaugcagacagggggccaga

SEQ ID NO: 2020928 - RNA, 21 nt, Human
gaugcagacagggggccagaa

SEQ ID NO: 2020929 - RNA, 23 nt, Human
gaugcagacagggggccagaaca

SEQ ID NO: 2020930 - RNA, 14 nt, Human
gaugcagugcuucc

SEQ ID NO: 2020931 - RNA, 14 nt, Human
gaugccugguggca

SEQ ID NO: 2020932 - RNA, 15 nt, Human
gaugccugguggcag

SEQ ID NO: 2020933 - RNA, 16 nt, Human
gaugccugguggcagc

SEQ ID NO: 2020934 - RNA, 20 nt, Human
gaugaccuugaaugaugcca

SEQ ID NO: 2020935 - RNA, 20 nt, Human
gaugagaacagauaaagauu

SEQ ID NO: 2020936 - RNA, 23 nt, Human
gaugagaaauaaaguuucuguug

SEQ ID NO: 2020937 - RNA, 18 nt, Human
gaugaccuugaaugaugc

SEQ ID NO: 2020938 - RNA, 14 nt, Human
gaugagaggaaauc

SEQ ID NO: 2020939 - RNA, 14 nt, Human
gaugcaccagcccu

SEQ ID NO: 2020940 - RNA, 15 nt, Human
gaugcaccagcccuu

SEQ ID NO: 2020941 - RNA, 23 nt, Human
gaugcaccagcccuuagcaggga

SEQ ID NO: 2020942 - RNA, 22 nt, Human
gaucuucuguggguuucuaaag

SEQ ID NO: 2020943 - RNA, 19 nt, Human
gaucuucuuuauaauucua

SEQ ID NO: 2020944 - RNA, 17 nt, Human
gaucuuccucugcuaaa

SEQ ID NO: 2020945 - RNA, 18 nt, Human
gaucuuccucugcuaaau

SEQ ID NO: 2020946 - RNA, 15 nt, Human
gaugaaaugagguca

SEQ ID NO: 2020947 - RNA, 21 nt, Human
gaugaaaugaggucagagccu

SEQ ID NO: 2020948 - RNA, 18 nt, Human
gaugaccaauuuuaacuu

SEQ ID NO: 2020949 - RNA, 22 nt, Human
gaugaaugucaguuguuauuua

SEQ ID NO: 2020950 - RNA, 15 nt, Human
gaugaccccugccca

SEQ ID NO: 2020951 - RNA, 14 nt, Human
gaugaccccugccc

SEQ ID NO: 2020952 - RNA, 22 nt, Human
gaugaauaaauguuauagcugc

SEQ ID NO: 2020953 - RNA, 16 nt, Human
gaugaaauguaaauac

SEQ ID NO: 2020954 - RNA, 13 nt, Human
gauaucaaaggca

SEQ ID NO: 2020955 - RNA, 14 nt, Human
gaucacagccucug

SEQ ID NO: 2020956 - RNA, 16 nt, Human
gaucacauguggacuu

SEQ ID NO: 2020957 - RNA, 23 nt, Human
gaucacggcucacugcagccuca

SEQ ID NO: 2020958 - RNA, 20 nt, Human
gaucacggcucacugcagcc

SEQ ID NO: 2020959 - RNA, 14 nt, Human
gaucacugaaauaa

SEQ ID NO: 2020960 - RNA, 18 nt, Human
gaucacugaaauaaaagc

SEQ ID NO: 2020961 - RNA, 20 nt, Human
gaucacugaaauaaaagcua

SEQ ID NO: 2020962 - RNA, 14 nt, Human
gaucaggcucccag

SEQ ID NO: 2020963 - RNA, 15 nt, Human
gaucaggcucccagg

SEQ ID NO: 2020964 - RNA, 23 nt, Human
gauaguggggagacuucuuggcu

SEQ ID NO: 2020965 - RNA, 20 nt, Human
gauagugucccacggugccu

SEQ ID NO: 2020966 - RNA, 13 nt, Human
gauaggggcagag

SEQ ID NO: 2020967 - RNA, 14 nt, Human
gauauaaacagcuu

SEQ ID NO: 2020968 - RNA, 21 nt, Human
gauauagagucauuguaaugu

SEQ ID NO: 2020969 - RNA, 18 nt, Human
gauauaugcucugcaugu

SEQ ID NO: 2020970 - RNA, 17 nt, Human
gauaggaaggucauuuc

SEQ ID NO: 2020971 - RNA, 18 nt, Human
gauaggaaggucauuucc

SEQ ID NO: 2020972 - RNA, 16 nt, Human
gauacaaaagcaugug

SEQ ID NO: 2020973 - RNA, 17 nt, Human
gauaggucagugcaaau

SEQ ID NO: 2020974 - RNA, 23 nt, Human
gauaggaaggucauuuccaugua

SEQ ID NO: 2020975 - RNA, 21 nt, Human
gauaggaaggucauuuccaug

SEQ ID NO: 2020976 - RNA, 22 nt, Human
gauaggaaggucauuuccaugu

SEQ ID NO: 2020977 - RNA, 23 nt, Human
gauaauuaaccaagguagaauga

SEQ ID NO: 2020978 - RNA, 18 nt, Human
gauaauucuagcuuugag

SEQ ID NO: 2020979 - RNA, 22 nt, Human
gauaauuuuccuuuaauaugaa

SEQ ID NO: 2020980 - RNA, 17 nt, Human
gauaaccauagcauagg

SEQ ID NO: 2020981 - RNA, 20 nt, Human
gauaacagggauugauuuua

SEQ ID NO: 2020982 - RNA, 22 nt, Human
gauaacagggauugauuuuaaa

SEQ ID NO: 2020983 - RNA, 23 nt, Human
gauaacagggauugauuuuaaaa

SEQ ID NO: 2020984 - RNA, 14 nt, Human
gauaaccauagcau

SEQ ID NO: 2020985 - RNA, 13 nt, Human
gauaaguuggaaa

SEQ ID NO: 2020986 - RNA, 17 nt, Human
gauaaguuggaaacacu

SEQ ID NO: 2020987 - RNA, 18 nt, Human
gauaaguuggaaacacua

SEQ ID NO: 2020988 - RNA, 19 nt, Human
gauaaguuggaaacacuaa

SEQ ID NO: 2020989 - RNA, 22 nt, Human
gauaaguuggaaacacuaaaug

SEQ ID NO: 2020990 - RNA, 12 nt, Human
gauaauacacca

SEQ ID NO: 2020991 - RNA, 23 nt, Human
gauaauacaccacuacauucugu

SEQ ID NO: 2020992 - RNA, 24 nt, Human
gauaauacaccacuacauucuguu

SEQ ID NO: 2020993 - RNA, 22 nt, Human
gauaaauuaugguaaaauuuug

SEQ ID NO: 2020994 - RNA, 19 nt, Human
gauaacaauguuuuaacaa

SEQ ID NO: 2020995 - RNA, 22 nt, Human
gauaacaauguuuuaacaagaa

SEQ ID NO: 2020996 - RNA, 18 nt, Human
gauaaaccuagauaaaga

SEQ ID NO: 2020997 - RNA, 13 nt, Human
gaguucugguucc

SEQ ID NO: 2020998 - RNA, 13 nt, Human
gauaaacaguagu

SEQ ID NO: 2020999 - RNA, 13 nt, Human
gauaaaaucauaa

SEQ ID NO: 2021000 - RNA, 19 nt, Human
gauaaaaucauaaguauuu

SEQ ID NO: 2021001 - RNA, 23 nt, Human
gauaaaaucauaaguauuuggaa

SEQ ID NO: 2021002 - RNA, 18 nt, Human
gacuuccccaauaucuug

SEQ ID NO: 2021003 - RNA, 20 nt, Human
gacuuccccaauaucuugcu

SEQ ID NO: 2021004 - RNA, 17 nt, Human
gacuuccccaauaucuu

SEQ ID NO: 2021005 - RNA, 22 nt, Human
gacuuccugauugguuucucuu

SEQ ID NO: 2021006 - RNA, 21 nt, Human
gaguguguaauuuaaaauugu

SEQ ID NO: 2021007 - RNA, 22 nt, Human
gaguguguaauuuaaaauugug

SEQ ID NO: 2021008 - RNA, 21 nt, Human
gacuuccugauugguuucucu

SEQ ID NO: 2021009 - RNA, 22 nt, Human
gaauuuaaauagcuuuuuucuc

SEQ ID NO: 2021010 - RNA, 20 nt, Human
gaauuguuuagauuuugugu

SEQ ID NO: 2021011 - RNA, 22 nt, Human
gaauuguuuagauuuuguguuu

SEQ ID NO: 2021012 - RNA, 23 nt, Human
gaauuguguuuauaauuuuaaau

SEQ ID NO: 2021013 - RNA, 15 nt, Human
gaauuguguuuauaa

SEQ ID NO: 2021014 - RNA, 22 nt, Human
gaauuguaaggaaugauuaauu

SEQ ID NO: 2021015 - RNA, 15 nt, Human
gaauuuaucuuugau

SEQ ID NO: 2021016 - RNA, 16 nt, Human
gaauuuaucuuugaua

SEQ ID NO: 2021017 - RNA, 22 nt, Human
gaauuuaagccucaaauuugaa

SEQ ID NO: 2021018 - RNA, 20 nt, Human
gaauuuaaagaaaaaaaugu

SEQ ID NO: 2021019 - RNA, 22 nt, Human
gaauuuaaagaaaaaaauguca

SEQ ID NO: 2021020 - RNA, 21 nt, Human
gaauuuauuuuuaagaaagaa

SEQ ID NO: 2021021 - RNA, 15 nt, Human
gaauuucccaaagca

SEQ ID NO: 2021022 - RNA, 19 nt, Human
gaauugagccuaaaaauaa

SEQ ID NO: 2021023 - RNA, 14 nt, Human
gaauugaagcagga

SEQ ID NO: 2021024 - RNA, 14 nt, Human
gaauugaaaaacca

SEQ ID NO: 2021025 - RNA, 19 nt, Human
gaauucucuaguuugauua

SEQ ID NO: 2021026 - RNA, 21 nt, Human
gaaugucagugugacugaucu

SEQ ID NO: 2021027 - RNA, 20 nt, Human
gaaugucagugugacugauc

SEQ ID NO: 2021028 - RNA, 17 nt, Human
gaaugucaguuguuauu

SEQ ID NO: 2021029 - RNA, 21 nt, Human
gaaugucaguuguuauuuauu

SEQ ID NO: 2021030 - RNA, 18 nt, Human
gaauucaccacagacuuu

SEQ ID NO: 2021031 - RNA, 19 nt, Human
gaauucaccacagacuuua

SEQ ID NO: 2021032 - RNA, 17 nt, Human
gaauucucagaaucuca

SEQ ID NO: 2021033 - RNA, 17 nt, Human
gaauucucuaguuugau

SEQ ID NO: 2021034 - RNA, 18 nt, Human
gaauggcaauguuuugcu

SEQ ID NO: 2021035 - RNA, 15 nt, Human
gaauggacauuucua

SEQ ID NO: 2021036 - RNA, 14 nt, Human
gaauggugauuuua

SEQ ID NO: 2021037 - RNA, 16 nt, Human
gaauggugauuuuaaa

SEQ ID NO: 2021038 - RNA, 19 nt, Human
gaauggugauuuuaaaugu

SEQ ID NO: 2021039 - RNA, 21 nt, Human
gaauggugauuuuaaaugugu

SEQ ID NO: 2021040 - RNA, 16 nt, Human
gaauguaugcuucaua

SEQ ID NO: 2021041 - RNA, 18 nt, Human
gaauguaugcuucauaca

SEQ ID NO: 2021042 - RNA, 22 nt, Human
gaaugguuuucaaaauaaaaau

SEQ ID NO: 2021043 - RNA, 13 nt, Human
gaauguaaagcaa

SEQ ID NO: 2021044 - RNA, 21 nt, Human
gaauguaugcuucauacaggg

SEQ ID NO: 2021045 - RNA, 22 nt, Human
gaauguaagguauaucauucua

SEQ ID NO: 2021046 - RNA, 14 nt, Human
gaaugucaguguga

SEQ ID NO: 2021047 - RNA, 17 nt, Human
gaaugaagauacugaaa

SEQ ID NO: 2021048 - RNA, 18 nt, Human
gaaugaagauacugaaau

SEQ ID NO: 2021049 - RNA, 21 nt, Human
gaaugaagauacugaaauaaa

SEQ ID NO: 2021050 - RNA, 19 nt, Human
gaaugaagauacugaaaua

SEQ ID NO: 2021051 - RNA, 11 nt, Human
gaaugcagugg

SEQ ID NO: 2021052 - RNA, 14 nt, Human
gaaugcauaaaaug

SEQ ID NO: 2021053 - RNA, 14 nt, Human
gaaugaagguuuuu

SEQ ID NO: 2021054 - RNA, 21 nt, Human
gaaugaagguuuuuguaaaga

SEQ ID NO: 2021055 - RNA, 18 nt, Human
gaaugcaugcuuuccaua

SEQ ID NO: 2021056 - RNA, 21 nt, Human
gaaugcaugcuuuccauauuu

SEQ ID NO: 2021057 - RNA, 13 nt, Human
gaaugcuuuagga

SEQ ID NO: 2021058 - RNA, 22 nt, Human
gaaugaaccacaucuugcucug

SEQ ID NO: 2021059 - RNA, 18 nt, Human
gaaugaaccacaucuugc

SEQ ID NO: 2021060 - RNA, 17 nt, Human
gaaugaaccuucuggcc

SEQ ID NO: 2021061 - RNA, 16 nt, Human
gaaugaagaauucaga

SEQ ID NO: 2021062 - RNA, 15 nt, Human
gaaugaaccuucugg

SEQ ID NO: 2021063 - RNA, 23 nt, Human
gaaugaaccacaucuugcucugc

SEQ ID NO: 2021064 - RNA, 18 nt, Human
gaaucuuuaauuaaaacc

SEQ ID NO: 2021065 - RNA, 13 nt, Human
gaaucuuuaauua

SEQ ID NO: 2021066 - RNA, 16 nt, Human
gaauaaaaauuccaga

SEQ ID NO: 2021067 - RNA, 19 nt, Human
gaauaacauguaauuaagu

SEQ ID NO: 2021068 - RNA, 18 nt, Human
gaauaacauguaauuaag

SEQ ID NO: 2021069 - RNA, 20 nt, Human
gaaguuugauaaauaguguu

SEQ ID NO: 2021070 - RNA, 15 nt, Human
gaaguuugauaaaua

SEQ ID NO: 2021071 - RNA, 16 nt, Human
gaaguuugauaaauag

SEQ ID NO: 2021072 - RNA, 19 nt, Human
gaaguuugauaaauagugu

SEQ ID NO: 2021073 - RNA, 20 nt, Human
gaaguuugagaucagccugg

SEQ ID NO: 2021074 - RNA, 16 nt, Human
gaauaagcacuuuuua

SEQ ID NO: 2021075 - RNA, 17 nt, Human
gaauaagcacuuuuuaa

SEQ ID NO: 2021076 - RNA, 17 nt, Human
gaauaauacaguaucuc

SEQ ID NO: 2021077 - RNA, 20 nt, Human
gaauaagccauucugacuca

SEQ ID NO: 2021078 - RNA, 21 nt, Human
gaauacagaggcaacugcauu

SEQ ID NO: 2021079 - RNA, 17 nt, Human
gaauauuugaauguaug

SEQ ID NO: 2021080 - RNA, 15 nt, Human
gaauaccuguccccc

SEQ ID NO: 2021081 - RNA, 13 nt, Human
gaauaccuguccc

SEQ ID NO: 2021082 - RNA, 23 nt, Human
gaauagcugggacuacaggugug

SEQ ID NO: 2021083 - RNA, 22 nt, Human
gaauagcuuuaaugauaugcuu

SEQ ID NO: 2021084 - RNA, 18 nt, Human
gaauaggacuuguuuuug

SEQ ID NO: 2021085 - RNA, 19 nt, Human
gaauaggacuuguuuuugu

SEQ ID NO: 2021086 - RNA, 21 nt, Human
gaauaggacuuguuuuuguuu

SEQ ID NO: 2021087 - RNA, 20 nt, Human
gaauacucuuauaucuauau

SEQ ID NO: 2021088 - RNA, 19 nt, Human
gaauacucagggaaagcau

SEQ ID NO: 2021089 - RNA, 22 nt, Human
gaauagcugggacuacaggugu

SEQ ID NO: 2021090 - RNA, 14 nt, Human
gaagcggcuggcag

SEQ ID NO: 2021091 - RNA, 22 nt, Human
gaagggguaggauuacuaggug

SEQ ID NO: 2021092 - RNA, 19 nt, Human
gaagggggcugggacaugg

SEQ ID NO: 2021093 - RNA, 16 nt, Human
gaagggggcugggaca

SEQ ID NO: 2021094 - RNA, 22 nt, Human
gaaguaauaugcacacauuuuu

SEQ ID NO: 2021095 - RNA, 22 nt, Human
gaagguggccuuccugcuguua

SEQ ID NO: 2021096 - RNA, 18 nt, Human
gaaguacuauaauuuacc

SEQ ID NO: 2021097 - RNA, 15 nt, Human
gaaguacuggagaaa

SEQ ID NO: 2021098 - RNA, 16 nt, Human
gaaguaccuuaucaaa

SEQ ID NO: 2021099 - RNA, 12 nt, Human
gaaguagcacag

SEQ ID NO: 2021100 - RNA, 16 nt, Human
gaaguauccuucagcc

SEQ ID NO: 2021101 - RNA, 21 nt, Human
gaagucaugcuccccugugcc

SEQ ID NO: 2021102 - RNA, 14 nt, Human
gaaguauccuucag

SEQ ID NO: 2021103 - RNA, 16 nt, Human
gaaguaggggaagaau

SEQ ID NO: 2021104 - RNA, 21 nt, Human
gaaguaggggaagaauaauuu

SEQ ID NO: 2021105 - RNA, 18 nt, Human
gaaguagggguggcccga

SEQ ID NO: 2021106 - RNA, 14 nt, Human
gaaguagcuuugca

SEQ ID NO: 2021107 - RNA, 13 nt, Human
gaaguagcacagg

SEQ ID NO: 2021108 - RNA, 15 nt, Human
gaaguagcacaggcu

SEQ ID NO: 2021109 - RNA, 16 nt, Human
gaaguagcacaggcug

SEQ ID NO: 2021110 - RNA, 18 nt, Human
gaaguagcacaggcugag

SEQ ID NO: 2021111 - RNA, 20 nt, Human
gaaguuucugccgcagcccu

SEQ ID NO: 2021112 - RNA, 15 nt, Human
gaagucuuagaugua

SEQ ID NO: 2021113 - RNA, 21 nt, Human
gaaguuucugccgcagcccug

SEQ ID NO: 2021114 - RNA, 17 nt, Human
gaagaacucaugugauu

SEQ ID NO: 2021115 - RNA, 16 nt, Human
gaagaacugaaaggcu

SEQ ID NO: 2021116 - RNA, 13 nt, Human
gaagacuuuggaa

SEQ ID NO: 2021117 - RNA, 11 nt, Human
gaagacuuugg

SEQ ID NO: 2021118 - RNA, 23 nt, Human
gaacuuugaccucugcagcaaua

SEQ ID NO: 2021119 - RNA, 21 nt, Human
gaacucaucuagguaaauuac

SEQ ID NO: 2021120 - RNA, 20 nt, Human
gaacucaucuagguaaauua

SEQ ID NO: 2021121 - RNA, 21 nt, Human
gaacuuuguauaguuauguaa

SEQ ID NO: 2021122 - RNA, 12 nt, Human
gaacuuuguaua

SEQ ID NO: 2021123 - RNA, 15 nt, Human
gaacuuuguauaguu

SEQ ID NO: 2021124 - RNA, 16 nt, Human
gaagagcagcuccuuc

SEQ ID NO: 2021125 - RNA, 12 nt, Human
gaagagccccac

SEQ ID NO: 2021126 - RNA, 13 nt, Human
gaagagccccacu

SEQ ID NO: 2021127 - RNA, 15 nt, Human
gaagagccccacucu

SEQ ID NO: 2021128 - RNA, 20 nt, Human
gaagagccccacucucagag

SEQ ID NO: 2021129 - RNA, 16 nt, Human
gaagagccccacucuc

SEQ ID NO: 2021130 - RNA, 19 nt, Human
gaagagccccacucucaga

SEQ ID NO: 2021131 - RNA, 17 nt, Human
gaagagaagggcagggc

SEQ ID NO: 2021132 - RNA, 19 nt, Human
gaagagaaugcacaaacag

SEQ ID NO: 2021133 - RNA, 20 nt, Human
gaagacuuuucuuucagcca

SEQ ID NO: 2021134 - RNA, 17 nt, Human
gaagacuuuggaaagag

SEQ ID NO: 2021135 - RNA, 14 nt, Human
gaagacuuuggaaa

SEQ ID NO: 2021136 - RNA, 17 nt, Human
gaagccacccaaagcag

SEQ ID NO: 2021137 - RNA, 23 nt, Human
gaagcccuucuaccuuccugcaa

SEQ ID NO: 2021138 - RNA, 19 nt, Human
gaagcccaggaaaggcucc

SEQ ID NO: 2021139 - RNA, 16 nt, Human
gaagcccaggaaaggc

SEQ ID NO: 2021140 - RNA, 15 nt, Human
gaagcccaggaaagg

SEQ ID NO: 2021141 - RNA, 13 nt, Human
gaagcccaggaaa

SEQ ID NO: 2021142 - RNA, 22 nt, Human
gaagccagcaggcucucaggcc

SEQ ID NO: 2021143 - RNA, 21 nt, Human
gaagccagcaggcucucaggc

SEQ ID NO: 2021144 - RNA, 19 nt, Human
gaagccagcaggcucucag

SEQ ID NO: 2021145 - RNA, 20 nt, Human
gaagccagcaggcucucagg

SEQ ID NO: 2021146 - RNA, 17 nt, Human
gaagcauuuacuuugug

SEQ ID NO: 2021147 - RNA, 17 nt, Human
gaagauucuauguuaau

SEQ ID NO: 2021148 - RNA, 20 nt, Human
gaagauucuauguuaauauu

SEQ ID NO: 2021149 - RNA, 23 nt, Human
gaagauucuauguuaauauuuua

SEQ ID NO: 2021150 - RNA, 18 nt, Human
gaagcauuuacuuugugu

SEQ ID NO: 2021151 - RNA, 12 nt, Human
gaagagggcugc

SEQ ID NO: 2021152 - RNA, 20 nt, Human
gaagagguuuuaaagcuucc

SEQ ID NO: 2021153 - RNA, 20 nt, Human
gaagauaauauuaaggaaga

SEQ ID NO: 2021154 - RNA, 15 nt, Human
gaagauacugaaaua

SEQ ID NO: 2021155 - RNA, 14 nt, Human
gaagauaaguugga

SEQ ID NO: 2021156 - RNA, 14 nt, Human
gaagauacuuugua

SEQ ID NO: 2021157 - RNA, 15 nt, Human
gaagauacuuuguau

SEQ ID NO: 2021158 - RNA, 18 nt, Human
gaagauaaguuggaaaca

SEQ ID NO: 2021159 - RNA, 12 nt, Human
gaagauacuuug

SEQ ID NO: 2021160 - RNA, 13 nt, Human
gaagauacuuugu

SEQ ID NO: 2021161 - RNA, 18 nt, Human
gaagauguagaggagaaa

SEQ ID NO: 2021162 - RNA, 11 nt, Human
gaaccaaagcg

SEQ ID NO: 2021163 - RNA, 21 nt, Human
gaaccaaacccacccuuucua

SEQ ID NO: 2021164 - RNA, 22 nt, Human
gaaccaaacccacccuuucuac

SEQ ID NO: 2021165 - RNA, 14 nt, Human
gaacaucccuccug

SEQ ID NO: 2021166 - RNA, 15 nt, Human
gaacauugguucuuu

SEQ ID NO: 2021167 - RNA, 17 nt, Human
gaacauguggcuugaau

SEQ ID NO: 2021168 - RNA, 23 nt, Human
gaacauugcauauaacuuauauu

SEQ ID NO: 2021169 - RNA, 21 nt, Human
gaacauugcauauaacuuaua

SEQ ID NO: 2021170 - RNA, 21 nt, Human
gaaccuuuugagugccuuaca

SEQ ID NO: 2021171 - RNA, 19 nt, Human
gaaccuuuugagugccuua

SEQ ID NO: 2021172 - RNA, 18 nt, Human
gaaccuuuugagugccuu

SEQ ID NO: 2021173 - RNA, 18 nt, Human
gaacguuugguucaaaug

SEQ ID NO: 2021174 - RNA, 21 nt, Human
gaacguuugguucaaaugugu

SEQ ID NO: 2021175 - RNA, 13 nt, Human
gaacgccagggac

SEQ ID NO: 2021176 - RNA, 12 nt, Human
gaacgcccacuu

SEQ ID NO: 2021177 - RNA, 22 nt, Human
gaaccuuuugagugccuuacac

SEQ ID NO: 2021178 - RNA, 14 nt, Human
gaacuacugaggau

SEQ ID NO: 2021179 - RNA, 14 nt, Human
gaacauaauucuua

SEQ ID NO: 2021180 - RNA, 16 nt, Human
gaacauaauucuuauu

SEQ ID NO: 2021181 - RNA, 13 nt, Human
gaacauacaaaug

SEQ ID NO: 2021182 - RNA, 15 nt, Human
gaacauacaaaugca

SEQ ID NO: 2021183 - RNA, 17 nt, Human
gaacauacaaaugcauc

SEQ ID NO: 2021184 - RNA, 22 nt, Human
gaacauacaaaugcaucuuuga

SEQ ID NO: 2021185 - RNA, 23 nt, Human
gaacauacaaaugcaucuuugau

SEQ ID NO: 2021186 - RNA, 21 nt, Human
gaacaguguggccucuucuga

SEQ ID NO: 2021187 - RNA, 18 nt, Human
gaacagugcaccugggac

SEQ ID NO: 2021188 - RNA, 21 nt, Human
gaacagcggcuggacuuggag

SEQ ID NO: 2021189 - RNA, 16 nt, Human
gaacagugauuaccag

SEQ ID NO: 2021190 - RNA, 20 nt, Human
gaacagugauuaccagggac

SEQ ID NO: 2021191 - RNA, 15 nt, Human
gaacacucugagacu

SEQ ID NO: 2021192 - RNA, 20 nt, Human
gaaauuucacgucauaggaa

SEQ ID NO: 2021193 - RNA, 20 nt, Human
gaacagaugaccccugccca

SEQ ID NO: 2021194 - RNA, 22 nt, Human
gaacagaugaccccugcccaga

SEQ ID NO: 2021195 - RNA, 16 nt, Human
gaaauuguauuacaaa

SEQ ID NO: 2021196 - RNA, 19 nt, Human
gaaaauaguuuauuuuaaa

SEQ ID NO: 2021197 - RNA, 20 nt, Human
gaaaauaguuuauuuuaaaa

SEQ ID NO: 2021198 - RNA, 23 nt, Human
gaaaauaguuuauuuuaaaacaa

SEQ ID NO: 2021199 - RNA, 23 nt, Human
gaaaauaaaucaaugcuauaacu

SEQ ID NO: 2021200 - RNA, 19 nt, Human
gaaaauaggaacgacucua

SEQ ID NO: 2021201 - RNA, 16 nt, Human
gaaaauaguuauucag

SEQ ID NO: 2021202 - RNA, 13 nt, Human
gaaaauaguuuau

SEQ ID NO: 2021203 - RNA, 14 nt, Human
gaaaauaguuuauu

SEQ ID NO: 2021204 - RNA, 15 nt, Human
gaaaauaguuuauuu

SEQ ID NO: 2021205 - RNA, 15 nt, Human
gaaaauacuuaaaug

SEQ ID NO: 2021206 - RNA, 16 nt, Human
gaaaauacuuaaaugu

SEQ ID NO: 2021207 - RNA, 17 nt, Human
gaaaauacuuaaauguu

SEQ ID NO: 2021208 - RNA, 21 nt, Human
gaaaauacuuaaauguuaugu

SEQ ID NO: 2021209 - RNA, 14 nt, Human
gaacacucugagac

SEQ ID NO: 2021210 - RNA, 13 nt, Human
gaacacucugaga

SEQ ID NO: 2021211 - RNA, 21 nt, Human
gaaauuuauugaggaaaaaua

SEQ ID NO: 2021212 - RNA, 22 nt, Human
gaaauuuauugaggaaaaauau

SEQ ID NO: 2021213 - RNA, 11 nt, Human
gaaauuucacg

SEQ ID NO: 2021214 - RNA, 12 nt, Human
gaaauuucacgu

SEQ ID NO: 2021215 - RNA, 16 nt, Human
gaaauuucacgucaua

SEQ ID NO: 2021216 - RNA, 17 nt, Human
gaaauuuauaaacuuuu

SEQ ID NO: 2021217 - RNA, 16 nt, Human
gaaauuuauaaacuuu

SEQ ID NO: 2021218 - RNA, 18 nt, Human
gaaauuguauuacaaauc

SEQ ID NO: 2021219 - RNA, 18 nt, Human
gacuaaccccaccacacc

SEQ ID NO: 2021220 - RNA, 23 nt, Human
gacuaacuugucuuuggacccug

SEQ ID NO: 2021221 - RNA, 16 nt, Human
gacuaacuugucuuug

SEQ ID NO: 2021222 - RNA, 22 nt, Human
gacuaagaucgguuaacaaaua

SEQ ID NO: 2021223 - RNA, 23 nt, Human
gacuaagaucgguuaacaaauaa

SEQ ID NO: 2021224 - RNA, 15 nt, Human
gacguguuaugacuc

SEQ ID NO: 2021225 - RNA, 14 nt, Human
gacguguuaugacu

SEQ ID NO: 2021226 - RNA, 11 nt, Human
gacguguuaug

SEQ ID NO: 2021227 - RNA, 20 nt, Human
gaccuuucaauaggaaaaac

SEQ ID NO: 2021228 - RNA, 19 nt, Human
gaccuuucaauaggaaaaa

SEQ ID NO: 2021229 - RNA, 11 nt, Human
gaccuuucaau

SEQ ID NO: 2021230 - RNA, 22 nt, Human
gaccuuuaagagaaaugagcug

SEQ ID NO: 2021231 - RNA, 22 nt, Human
gacgcugugcugcccugcccac

SEQ ID NO: 2021232 - RNA, 21 nt, Human
gacgcugugcugcccugccca

SEQ ID NO: 2021233 - RNA, 18 nt, Human
gacgcuucacaggacagg

SEQ ID NO: 2021234 - RNA, 13 nt, Human
gacggagucccac

SEQ ID NO: 2021235 - RNA, 14 nt, Human
gacguggcaccucc

SEQ ID NO: 2021236 - RNA, 16 nt, Human
gacguggcaccuccuc

SEQ ID NO: 2021237 - RNA, 21 nt, Human
gacggcgagaaaugccucugg

SEQ ID NO: 2021238 - RNA, 22 nt, Human
gacggcacugagagagcgcagc

SEQ ID NO: 2021239 - RNA, 16 nt, Human
gaccuuccaagagccu

SEQ ID NO: 2021240 - RNA, 17 nt, Human
gaccuuccaagagccug

SEQ ID NO: 2021241 - RNA, 19 nt, Human
gaccuucacucuaagaugu

SEQ ID NO: 2021242 - RNA, 20 nt, Human
gaccuucacucuaagauguu

SEQ ID NO: 2021243 - RNA, 18 nt, Human
gaccuuccaagagccuga

SEQ ID NO: 2021244 - RNA, 22 nt, Human
gaccuucacucuaagauguuau

SEQ ID NO: 2021245 - RNA, 16 nt, Human
gaccuucgggcugugc

SEQ ID NO: 2021246 - RNA, 16 nt, Human
gaccuucuccuucacc

SEQ ID NO: 2021247 - RNA, 15 nt, Human
gaccuucuccuucac

SEQ ID NO: 2021248 - RNA, 18 nt, Human
gaccuucgggcugugccc

SEQ ID NO: 2021249 - RNA, 19 nt, Human
gaccuucgggcugugcccg

SEQ ID NO: 2021250 - RNA, 14 nt, Human
gaccuucuccuuca

SEQ ID NO: 2021251 - RNA, 21 nt, Human
gaccuucuccuucaccuuugu

SEQ ID NO: 2021252 - RNA, 20 nt, Human
gaccuucuccuucaccuuug

SEQ ID NO: 2021253 - RNA, 14 nt, Human
gaccuugaacuggg

SEQ ID NO: 2021254 - RNA, 18 nt, Human
gaccuguuaaaauuauac

SEQ ID NO: 2021255 - RNA, 14 nt, Human
gaccuuaaaugcaa

SEQ ID NO: 2021256 - RNA, 13 nt, Human
gaccuggucaggg

SEQ ID NO: 2021257 - RNA, 23 nt, Human
gacccuugccgucuaccugaggg

SEQ ID NO: 2021258 - RNA, 20 nt, Human
gacccuugccgucuaccuga

SEQ ID NO: 2021259 - RNA, 19 nt, Human
gacccuugccgucuaccug

SEQ ID NO: 2021260 - RNA, 15 nt, Human
gaccuggccugucug

SEQ ID NO: 2021261 - RNA, 16 nt, Human
gaccuggccugucugu

SEQ ID NO: 2021262 - RNA, 19 nt, Human
gaccuggggcugcugugaa

SEQ ID NO: 2021263 - RNA, 15 nt, Human
gacccuugugguccc

SEQ ID NO: 2021264 - RNA, 15 nt, Human
gacuuacuguacaug

SEQ ID NO: 2021265 - RNA, 16 nt, Human
gacuuacuguacauga

SEQ ID NO: 2021266 - RNA, 12 nt, Human
gacuuacuguac

SEQ ID NO: 2021267 - RNA, 18 nt, Human
gacuuacuguacaugaaa

SEQ ID NO: 2021268 - RNA, 23 nt, Human
gacuuacuguacaugaaaacaca

SEQ ID NO: 2021269 - RNA, 12 nt, Human
gacuuagaaucc

SEQ ID NO: 2021270 - RNA, 20 nt, Human
gacuuagaaucccuguguua

SEQ ID NO: 2021271 - RNA, 21 nt, Human
gacuuagaaucccuguguuaa

SEQ ID NO: 2021272 - RNA, 23 nt, Human
gacuuagaaucccuguguuaauu

SEQ ID NO: 2021273 - RNA, 15 nt, Human
gacuuagcugggaga

SEQ ID NO: 2021274 - RNA, 19 nt, Human
gacuuaguggacaggggag

SEQ ID NO: 2021275 - RNA, 20 nt, Human
gacuucaucccucuggggcu

SEQ ID NO: 2021276 - RNA, 12 nt, Human
gacuucaucccu

SEQ ID NO: 2021277 - RNA, 14 nt, Human
gacuucagcucugu

SEQ ID NO: 2021278 - RNA, 22 nt, Human
gacuucagggagucagcuguuu

SEQ ID NO: 2021279 - RNA, 23 nt, Human
gacuggccaagguuuggggaaga

SEQ ID NO: 2021280 - RNA, 17 nt, Human
gacuggauguaccacca

SEQ ID NO: 2021281 - RNA, 16 nt, Human
gacuggcaagaaaaga

SEQ ID NO: 2021282 - RNA, 16 nt, Human
gacugggaacagaacu

SEQ ID NO: 2021283 - RNA, 14 nt, Human
gacugcuccugagc

SEQ ID NO: 2021284 - RNA, 16 nt, Human
gacugcuccugagccc

SEQ ID NO: 2021285 - RNA, 19 nt, Human
gacugccagcucuuccuag

SEQ ID NO: 2021286 - RNA, 21 nt, Human
gacugccagcucuuccuagcu

SEQ ID NO: 2021287 - RNA, 17 nt, Human
gacugcuccugagcccc

SEQ ID NO: 2021288 - RNA, 19 nt, Human
gacugcuccugagccccca

SEQ ID NO: 2021289 - RNA, 16 nt, Human
gacugaggggagggga

SEQ ID NO: 2021290 - RNA, 18 nt, Human
gacugaguacguugugca

SEQ ID NO: 2021291 - RNA, 14 nt, Human
gacugacugaggca

SEQ ID NO: 2021292 - RNA, 15 nt, Human
gacugacugaggcag

SEQ ID NO: 2021293 - RNA, 16 nt, Human
gacugacugaggcagu

SEQ ID NO: 2021294 - RNA, 13 nt, Human
gacugagaaauuu

SEQ ID NO: 2021295 - RNA, 12 nt, Human
gacugaucucag

SEQ ID NO: 2021296 - RNA, 16 nt, Human
gacugauguuugugca

SEQ ID NO: 2021297 - RNA, 20 nt, Human
gacugccagucccccugccc

SEQ ID NO: 2021298 - RNA, 13 nt, Human
gacugccagcucu

SEQ ID NO: 2021299 - RNA, 14 nt, Human
gacugccagcucuu

SEQ ID NO: 2021300 - RNA, 15 nt, Human
gacugccagcucuuc

SEQ ID NO: 2021301 - RNA, 18 nt, Human
gacugccagcucuuccua

SEQ ID NO: 2021302 - RNA, 18 nt, Human
gacugccacaaggaagaa

SEQ ID NO: 2021303 - RNA, 19 nt, Human
gacugccacaaggaagaaa

SEQ ID NO: 2021304 - RNA, 12 nt, Human
gacugccaccuc

SEQ ID NO: 2021305 - RNA, 13 nt, Human
gacugccaccucc

SEQ ID NO: 2021306 - RNA, 14 nt, Human
gacugccaccuccc

SEQ ID NO: 2021307 - RNA, 15 nt, Human
gacugccaccucccc

SEQ ID NO: 2021308 - RNA, 16 nt, Human
gacugccaccuccccu

SEQ ID NO: 2021309 - RNA, 14 nt, Human
gacugccacaagga

SEQ ID NO: 2021310 - RNA, 21 nt, Human
gacuccugcaggcagccaggc

SEQ ID NO: 2021311 - RNA, 20 nt, Human
gacuccugcaggcagccagg

SEQ ID NO: 2021312 - RNA, 19 nt, Human
gacuccugcaggcagccag

SEQ ID NO: 2021313 - RNA, 18 nt, Human
gacuccugcaggcagcca

SEQ ID NO: 2021314 - RNA, 18 nt, Human
gacuacaggcacccacca

SEQ ID NO: 2021315 - RNA, 12 nt, Human
gacuacagggcc

SEQ ID NO: 2021316 - RNA, 13 nt, Human
gacuacaggcacc

SEQ ID NO: 2021317 - RNA, 15 nt, Human
gacuacaggcaccca

SEQ ID NO: 2021318 - RNA, 21 nt, Human
gacucuacagaggccaugggc

SEQ ID NO: 2021319 - RNA, 16 nt, Human
gacugaauuucuuuug

SEQ ID NO: 2021320 - RNA, 15 nt, Human
gacucuacagaggcc

SEQ ID NO: 2021321 - RNA, 15 nt, Human
gacucuaaagucugu

SEQ ID NO: 2021322 - RNA, 13 nt, Human
gacuacagggccg

SEQ ID NO: 2021323 - RNA, 11 nt, Human
gacugagaaau

SEQ ID NO: 2021324 - RNA, 18 nt, Human
gacucuacaugcuuguug

SEQ ID NO: 2021325 - RNA, 12 nt, Human
gacccaguggca

SEQ ID NO: 2021326 - RNA, 14 nt, Human
gacccaguggcagg

SEQ ID NO: 2021327 - RNA, 15 nt, Human
gacccaguggcaggg

SEQ ID NO: 2021328 - RNA, 16 nt, Human
gacccaguggcagggc

SEQ ID NO: 2021329 - RNA, 17 nt, Human
gacccaguggcagggca

SEQ ID NO: 2021330 - RNA, 18 nt, Human
gacccaguggcagggcac

SEQ ID NO: 2021331 - RNA, 19 nt, Human
gacccaguggcagggcaca

SEQ ID NO: 2021332 - RNA, 20 nt, Human
gacccaguggcagggcacag

SEQ ID NO: 2021333 - RNA, 22 nt, Human
gacccaguggcagggcacaggg

SEQ ID NO: 2021334 - RNA, 20 nt, Human
gacccaugcugcccugugag

SEQ ID NO: 2021335 - RNA, 19 nt, Human
gacccaugcugcccuguga

SEQ ID NO: 2021336 - RNA, 18 nt, Human
gacccaugcugcccugug

SEQ ID NO: 2021337 - RNA, 23 nt, Human
gacccaguggcagggcacagggc

SEQ ID NO: 2021338 - RNA, 13 nt, Human
gacccaugcugcc

SEQ ID NO: 2021339 - RNA, 20 nt, Human
gacccaaaaggcagaagcaa

SEQ ID NO: 2021340 - RNA, 19 nt, Human
gacccacuggacucaccuc

SEQ ID NO: 2021341 - RNA, 16 nt, Human
gaccagcccacgcuga

SEQ ID NO: 2021342 - RNA, 23 nt, Human
gaccagcccacgcugacuacagg

SEQ ID NO: 2021343 - RNA, 17 nt, Human
gaccagcagucugccug

SEQ ID NO: 2021344 - RNA, 11 nt, Human
gaccagccagg

SEQ ID NO: 2021345 - RNA, 23 nt, Human
gaccagccagggaaagacuggca

SEQ ID NO: 2021346 - RNA, 11 nt, Human
gaccagcccac

SEQ ID NO: 2021347 - RNA, 12 nt, Human
gaccagcccacg

SEQ ID NO: 2021348 - RNA, 14 nt, Human
gaccagcccacgcu

SEQ ID NO: 2021349 - RNA, 18 nt, Human
gacccaaaaggcagaagc

SEQ ID NO: 2021350 - RNA, 19 nt, Human
gacccaaaaggcagaagca

SEQ ID NO: 2021351 - RNA, 15 nt, Human
gacccccccagcuuc

SEQ ID NO: 2021352 - RNA, 12 nt, Human
gaccccagccuc

SEQ ID NO: 2021353 - RNA, 14 nt, Human
gaccccagccucaa

SEQ ID NO: 2021354 - RNA, 11 nt, Human
gaccccagaau

SEQ ID NO: 2021355 - RNA, 20 nt, Human
gacccaugggcaggagacug

SEQ ID NO: 2021356 - RNA, 17 nt, Human
gacccaugggcaggaga

SEQ ID NO: 2021357 - RNA, 18 nt, Human
gacccaugggcaggagac

SEQ ID NO: 2021358 - RNA, 14 nt, Human
gacccaugggcagg

SEQ ID NO: 2021359 - RNA, 15 nt, Human
gacccaugggcagga

SEQ ID NO: 2021360 - RNA, 16 nt, Human
gacccaugggcaggag

SEQ ID NO: 2021361 - RNA, 22 nt, Human
gacccugcccugugggccccca

SEQ ID NO: 2021362 - RNA, 20 nt, Human
gacccugcccugugggcccc

SEQ ID NO: 2021363 - RNA, 17 nt, Human
gacccugcccugugggc

SEQ ID NO: 2021364 - RNA, 16 nt, Human
gacccugaggcccaga

SEQ ID NO: 2021365 - RNA, 12 nt, Human
gacccugaggcc

SEQ ID NO: 2021366 - RNA, 11 nt, Human
gacccugaggc

SEQ ID NO: 2021367 - RNA, 12 nt, Human
gacccccuggag

SEQ ID NO: 2021368 - RNA, 10 nt, Human
gacccugagg

SEQ ID NO: 2021369 - RNA, 13 nt, Human
gaccagcacacuc

SEQ ID NO: 2021370 - RNA, 14 nt, Human
gaccagcacacucc

SEQ ID NO: 2021371 - RNA, 18 nt, Human
gaccagcacacucccgag

SEQ ID NO: 2021372 - RNA, 21 nt, Human
gaccagcaccaucucuccucc

SEQ ID NO: 2021373 - RNA, 20 nt, Human
gaccagcaccaucucuccuc

SEQ ID NO: 2021374 - RNA, 21 nt, Human
gaccagagcugccaccugccu

SEQ ID NO: 2021375 - RNA, 23 nt, Human
gaccagacaccuugacagggcac

SEQ ID NO: 2021376 - RNA, 24 nt, Human
gaccagacaccuugacagggcaca

SEQ ID NO: 2021377 - RNA, 16 nt, Human
gaccacugcagaagac

SEQ ID NO: 2021378 - RNA, 18 nt, Human
gaccacugcagaagacag

SEQ ID NO: 2021379 - RNA, 22 nt, Human
gaccagacaccuugacagggca

SEQ ID NO: 2021380 - RNA, 21 nt, Human
gaccagacaccuugacagggc

SEQ ID NO: 2021381 - RNA, 16 nt, Human
gaccacguuucuaaag

SEQ ID NO: 2021382 - RNA, 12 nt, Human
gaccaccagagg

SEQ ID NO: 2021383 - RNA, 19 nt, Human
gaccacaggugcccgccac

SEQ ID NO: 2021384 - RNA, 23 nt, Human
gaccacaggugcccgccaccaca

SEQ ID NO: 2021385 - RNA, 18 nt, Human
gaccaaggcucugaaaua

SEQ ID NO: 2021386 - RNA, 13 nt, Human
gacaucagcuggu

SEQ ID NO: 2021387 - RNA, 18 nt, Human
gaccacaaaacuuuucua

SEQ ID NO: 2021388 - RNA, 13 nt, Human
gaccaauuuuaac

SEQ ID NO: 2021389 - RNA, 14 nt, Human
gaccacacuccagc

SEQ ID NO: 2021390 - RNA, 16 nt, Human
gaccacacuccagcug

SEQ ID NO: 2021391 - RNA, 22 nt, Human
gaccacacuccagcugggauca

SEQ ID NO: 2021392 - RNA, 24 nt, Human
gacaggcaaugcuggcuguuggcu

SEQ ID NO: 2021393 - RNA, 23 nt, Human
gacaggcaaugcuggcuguuggc

SEQ ID NO: 2021394 - RNA, 20 nt, Human
gacaggcauguucucugagg

SEQ ID NO: 2021395 - RNA, 21 nt, Human
gacaggcauguucucugagga

SEQ ID NO: 2021396 - RNA, 20 nt, Human
gacaggcaagcaccuccugc

SEQ ID NO: 2021397 - RNA, 21 nt, Human
gacaggcaagcaccuccugcc

SEQ ID NO: 2021398 - RNA, 18 nt, Human
gacaggcaaugcuggcug

SEQ ID NO: 2021399 - RNA, 19 nt, Human
gacaggcaaugcuggcugu

SEQ ID NO: 2021400 - RNA, 13 nt, Human
gacaggcaagcac

SEQ ID NO: 2021401 - RNA, 22 nt, Human
gacagcagucuuaugcuuccag

SEQ ID NO: 2021402 - RNA, 23 nt, Human
gacagcagucuuaugcuuccaga

SEQ ID NO: 2021403 - RNA, 19 nt, Human
gacagcagucuuaugcuuc

SEQ ID NO: 2021404 - RNA, 17 nt, Human
gacaggcaagcaccucc

SEQ ID NO: 2021405 - RNA, 18 nt, Human
gacaggcaagcaccuccu

SEQ ID NO: 2021406 - RNA, 16 nt, Human
gacaucaacugcauca

SEQ ID NO: 2021407 - RNA, 23 nt, Human
gacaucaacugcaucaagaugug

SEQ ID NO: 2021408 - RNA, 13 nt, Human
gacaucacuggca

SEQ ID NO: 2021409 - RNA, 14 nt, Human
gacaguugugcagg

SEQ ID NO: 2021410 - RNA, 15 nt, Human
gacaggccagguggu

SEQ ID NO: 2021411 - RNA, 14 nt, Human
gacagggcauggcc

SEQ ID NO: 2021412 - RNA, 22 nt, Human
gacaggcauguucucugaggac

SEQ ID NO: 2021413 - RNA, 15 nt, Human
gacagggcauggcca

SEQ ID NO: 2021414 - RNA, 20 nt, Human
gacagggcauggccaggugg

SEQ ID NO: 2021415 - RNA, 22 nt, Human
gacagggcauggccagguggcc

SEQ ID NO: 2021416 - RNA, 18 nt, Human
gacaguucauucagggcc

SEQ ID NO: 2021417 - RNA, 19 nt, Human
gacaguucauucagggccg

SEQ ID NO: 2021418 - RNA, 16 nt, Human
gacagacagcccucca

SEQ ID NO: 2021419 - RNA, 20 nt, Human
gacagagcuacacaggggaa

SEQ ID NO: 2021420 - RNA, 12 nt, Human
gacagaggcagc

SEQ ID NO: 2021421 - RNA, 18 nt, Human
gacagagcgacagagcag

SEQ ID NO: 2021422 - RNA, 21 nt, Human
gacagagagagauacucuggg

SEQ ID NO: 2021423 - RNA, 13 nt, Human
gacagagccugcc

SEQ ID NO: 2021424 - RNA, 15 nt, Human
gacagagccugcccc

SEQ ID NO: 2021425 - RNA, 16 nt, Human
gacagagccugcccca

SEQ ID NO: 2021426 - RNA, 21 nt, Human
gacagagccugccccagcgcu

SEQ ID NO: 2021427 - RNA, 17 nt, Human
gacagagcgacagagca

SEQ ID NO: 2021428 - RNA, 13 nt, Human
gacagagggggug

SEQ ID NO: 2021429 - RNA, 23 nt, Human
gacagaggcagccccauucugcc

SEQ ID NO: 2021430 - RNA, 19 nt, Human
gacagagugagacucuguc

SEQ ID NO: 2021431 - RNA, 21 nt, Human
gacagagucucacuguugccc

SEQ ID NO: 2021432 - RNA, 16 nt, Human
gacagagugagacucu

SEQ ID NO: 2021433 - RNA, 18 nt, Human
gaauuucccaaagcagug

SEQ ID NO: 2021434 - RNA, 16 nt, Human
gaauuucccaaagcag

SEQ ID NO: 2021435 - RNA, 22 nt, Human
gaauuucccaaagcagugcaug

SEQ ID NO: 2021436 - RNA, 12 nt, Human
gaauuucacaag

SEQ ID NO: 2021437 - RNA, 22 nt, Human
gacacgaauauugcugauggug

SEQ ID NO: 2021438 - RNA, 16 nt, Human
gacacuagaagauuuu

SEQ ID NO: 2021439 - RNA, 17 nt, Human
gacagacacaggcccgg

SEQ ID NO: 2021440 - RNA, 20 nt, Human
gacagacacaggcccggcuc

SEQ ID NO: 2021441 - RNA, 22 nt, Human
gacagacacaggcccggcucca

SEQ ID NO: 2021442 - RNA, 19 nt, Human
cuugaguugauucagcucu

SEQ ID NO: 2021443 - RNA, 18 nt, Human
cuugaguugauucagcuc

SEQ ID NO: 2021444 - RNA, 20 nt, Human
cuugaguugauucagcucug

SEQ ID NO: 2021445 - RNA, 21 nt, Human
cuugaguugauucagcucugc

SEQ ID NO: 2021446 - RNA, 17 nt, Human
cuugaggggagccagga

SEQ ID NO: 2021447 - RNA, 20 nt, Human
cuugaggggagccaggaggg

SEQ ID NO: 2021448 - RNA, 15 nt, Human
cuugcaauggcagcc

SEQ ID NO: 2021449 - RNA, 16 nt, Human
cuugcaauggcagccu

SEQ ID NO: 2021450 - RNA, 17 nt, Human
cuugcaauggcagccuu

SEQ ID NO: 2021451 - RNA, 18 nt, Human
cuugcaauggcagccuug

SEQ ID NO: 2021452 - RNA, 21 nt, Human
cuugcagacucuacagaggcc

SEQ ID NO: 2021453 - RNA, 20 nt, Human
cuugcagacucuacagaggc

SEQ ID NO: 2021454 - RNA, 12 nt, Human
cuugcacauuug

SEQ ID NO: 2021455 - RNA, 13 nt, Human
cuugcacacauca

SEQ ID NO: 2021456 - RNA, 14 nt, Human
cuugcacacaucau

SEQ ID NO: 2021457 - RNA, 18 nt, Human
cuugcacacaucaucugu

SEQ ID NO: 2021458 - RNA, 19 nt, Human
cuugcacacaucaucugua

SEQ ID NO: 2021459 - RNA, 20 nt, Human
cuugcacacaucaucuguaa

SEQ ID NO: 2021460 - RNA, 23 nt, Human
cuugcacacaucaucuguaagcu

SEQ ID NO: 2021461 - RNA, 14 nt, Human
cuucuggccuccca

SEQ ID NO: 2021462 - RNA, 15 nt, Human
cuucuggccucccac

SEQ ID NO: 2021463 - RNA, 19 nt, Human
cuucuggccucccacagac

SEQ ID NO: 2021464 - RNA, 16 nt, Human
cuucuggccucccaca

SEQ ID NO: 2021465 - RNA, 17 nt, Human
cuucuggcacuuggaga

SEQ ID NO: 2021466 - RNA, 15 nt, Human
cuugagccugggagg

SEQ ID NO: 2021467 - RNA, 12 nt, Human
cuugagccuggg

SEQ ID NO: 2021468 - RNA, 15 nt, Human
cuugaggguugggcu

SEQ ID NO: 2021469 - RNA, 17 nt, Human
cuugaggguugggcugg

SEQ ID NO: 2021470 - RNA, 16 nt, Human
cuugaggggagccagg

SEQ ID NO: 2021471 - RNA, 18 nt, Human
cuugcccuggugccucac

SEQ ID NO: 2021472 - RNA, 17 nt, Human
cuugcccaugcugggcu

SEQ ID NO: 2021473 - RNA, 21 nt, Human
cuugcccaugcugggcucccg

SEQ ID NO: 2021474 - RNA, 14 nt, Human
cuugcaugaggcua

SEQ ID NO: 2021475 - RNA, 13 nt, Human
cuugcaugaggcu

SEQ ID NO: 2021476 - RNA, 17 nt, Human
cuugcaugaggcuagug

SEQ ID NO: 2021477 - RNA, 12 nt, Human
cuugccagucuu

SEQ ID NO: 2021478 - RNA, 18 nt, Human
cuugcucuugaugccugg

SEQ ID NO: 2021479 - RNA, 17 nt, Human
cuugcucuugaugccug

SEQ ID NO: 2021480 - RNA, 19 nt, Human
cuugcucuugaugccuggc

SEQ ID NO: 2021481 - RNA, 22 nt, Human
cuugcucugcugacagacacag

SEQ ID NO: 2021482 - RNA, 20 nt, Human
cuugcugcccugugcuccuc

SEQ ID NO: 2021483 - RNA, 20 nt, Human
cuuggaagcuccgcuuucua

SEQ ID NO: 2021484 - RNA, 14 nt, Human
cuuggaagcuccgc

SEQ ID NO: 2021485 - RNA, 20 nt, Human
cuugcuugauuguauggugg

SEQ ID NO: 2021486 - RNA, 17 nt, Human
cuuguagauuugauuuu

SEQ ID NO: 2021487 - RNA, 15 nt, Human
cuuguggucccaccc

SEQ ID NO: 2021488 - RNA, 14 nt, Human
cuuguucuuacuuu

SEQ ID NO: 2021489 - RNA, 12 nt, Human
cuuguucuucca

SEQ ID NO: 2021490 - RNA, 19 nt, Human
cuuguggucccaccccaca

SEQ ID NO: 2021491 - RNA, 16 nt, Human
cuuguggucccacccc

SEQ ID NO: 2021492 - RNA, 16 nt, Human
cuuguuaagauaguua

SEQ ID NO: 2021493 - RNA, 21 nt, Human
cuugugggugugagcagcacc

SEQ ID NO: 2021494 - RNA, 19 nt, Human
cuuuaccuuuuuuauacau

SEQ ID NO: 2021495 - RNA, 20 nt, Human
cuuuaccuuuuuuauacaua

SEQ ID NO: 2021496 - RNA, 12 nt, Human
cuuuagacuuga

SEQ ID NO: 2021497 - RNA, 13 nt, Human
cuuuagacuugaa

SEQ ID NO: 2021498 - RNA, 14 nt, Human
cuuuagacuugaaa

SEQ ID NO: 2021499 - RNA, 15 nt, Human
cuuuagacuugaaaa

SEQ ID NO: 2021500 - RNA, 17 nt, Human
cuuuaccuuuuuuauac

SEQ ID NO: 2021501 - RNA, 22 nt, Human
cuuuaaaaaauuaaucugggcc

SEQ ID NO: 2021502 - RNA, 22 nt, Human
cuuuaaaaaagcuauaaauuau

SEQ ID NO: 2021503 - RNA, 21 nt, Human
cuuuaaaaagcuccaaaugca

SEQ ID NO: 2021504 - RNA, 15 nt, Human
cuuuaaaaauuuacu

SEQ ID NO: 2021505 - RNA, 12 nt, Human
cuuguuucuccc

SEQ ID NO: 2021506 - RNA, 19 nt, Human
cuuuaaaaaagcuauaaau

SEQ ID NO: 2021507 - RNA, 13 nt, Human
cuuguucuuccaa

SEQ ID NO: 2021508 - RNA, 18 nt, Human
cuuguucuuccaaagcag

SEQ ID NO: 2021509 - RNA, 20 nt, Human
cuuguucuuccaaagcagag

SEQ ID NO: 2021510 - RNA, 15 nt, Human
cuuguugaauuuauu

SEQ ID NO: 2021511 - RNA, 12 nt, Human
cuuguugacaga

SEQ ID NO: 2021512 - RNA, 20 nt, Human
cuuguugccuauaagccaaa

SEQ ID NO: 2021513 - RNA, 18 nt, Human
cuugggccgagccugccu

SEQ ID NO: 2021514 - RNA, 13 nt, Human
cuugggcucugcu

SEQ ID NO: 2021515 - RNA, 14 nt, Human
cuugggcucugcug

SEQ ID NO: 2021516 - RNA, 18 nt, Human
cuugggcucugcugaguc

SEQ ID NO: 2021517 - RNA, 15 nt, Human
cuuggggccuaugca

SEQ ID NO: 2021518 - RNA, 15 nt, Human
cuugggggaaaauac

SEQ ID NO: 2021519 - RNA, 14 nt, Human
cuugguuuguaaau

SEQ ID NO: 2021520 - RNA, 15 nt, Human
cuugguuuguaaauu

SEQ ID NO: 2021521 - RNA, 13 nt, Human
cuuguaauguaac

SEQ ID NO: 2021522 - RNA, 14 nt, Human
cuuguaauguaacu

SEQ ID NO: 2021523 - RNA, 15 nt, Human
cuuguaauguaacug

SEQ ID NO: 2021524 - RNA, 20 nt, Human
cuuguaauguaacugcucuu

SEQ ID NO: 2021525 - RNA, 17 nt, Human
cuuguacuuuauuuucu

SEQ ID NO: 2021526 - RNA, 14 nt, Human
cuuguagauuugau

SEQ ID NO: 2021527 - RNA, 15 nt, Human
cuuguagauuugauu

SEQ ID NO: 2021528 - RNA, 20 nt, Human
cuugggccacugugaagaga

SEQ ID NO: 2021529 - RNA, 18 nt, Human
cuugggccacugugaaga

SEQ ID NO: 2021530 - RNA, 13 nt, Human
cuugggcaauauu

SEQ ID NO: 2021531 - RNA, 15 nt, Human
cuugggcaauauucu

SEQ ID NO: 2021532 - RNA, 19 nt, Human
cuugggcaauauucucugu

SEQ ID NO: 2021533 - RNA, 20 nt, Human
cuugggagugugguuucuuu

SEQ ID NO: 2021534 - RNA, 17 nt, Human
cuugggauccaggcccc

SEQ ID NO: 2021535 - RNA, 22 nt, Human
cuugggcaauauucucuguaca

SEQ ID NO: 2021536 - RNA, 20 nt, Human
cuugggcaauauucucugua

SEQ ID NO: 2021537 - RNA, 21 nt, Human
cuugggcaauauucucuguac

SEQ ID NO: 2021538 - RNA, 15 nt, Human
cuuggaagcuucugg

SEQ ID NO: 2021539 - RNA, 22 nt, Human
cuuggagccaauggagacuguc

SEQ ID NO: 2021540 - RNA, 14 nt, Human
cuuuuugcucuaaa

SEQ ID NO: 2021541 - RNA, 15 nt, Human
cuuuuugcucuaaaa

SEQ ID NO: 2021542 - RNA, 16 nt, Human
cuuuuugcucuaaaau

SEQ ID NO: 2021543 - RNA, 18 nt, Human
cuuuuugcucuaaaauau

SEQ ID NO: 2021544 - RNA, 14 nt, Human
cuuuuugaaauguc

SEQ ID NO: 2021545 - RNA, 13 nt, Human
cuuuuugaaucuu

SEQ ID NO: 2021546 - RNA, 15 nt, Human
cuuuuugaaucuuua

SEQ ID NO: 2021547 - RNA, 17 nt, Human
cuuuuugaaucuuuaau

SEQ ID NO: 2021548 - RNA, 18 nt, Human
cuuuuugaaucuuuaauu

SEQ ID NO: 2021549 - RNA, 21 nt, Human
cuuuuguuuuuugaaguguug

SEQ ID NO: 2021550 - RNA, 14 nt, Human
cuuuuguuuugcuu

SEQ ID NO: 2021551 - RNA, 15 nt, Human
cuuuuguuuugcuuu

SEQ ID NO: 2021552 - RNA, 13 nt, Human
cuuuuguuuuuug

SEQ ID NO: 2021553 - RNA, 17 nt, Human
cuuuuguuuuuugaagu

SEQ ID NO: 2021554 - RNA, 18 nt, Human
cuuuuguuuuuugaagug

SEQ ID NO: 2021555 - RNA, 19 nt, Human
cuuuuguuuuuugaagugu

SEQ ID NO: 2021556 - RNA, 22 nt, Human
cuuuuguucuugguuuguaaau

SEQ ID NO: 2021557 - RNA, 22 nt, Human
cuuuucuguguuuacagagaug

SEQ ID NO: 2021558 - RNA, 13 nt, Human
cuuuucuguguuu

SEQ ID NO: 2021559 - RNA, 18 nt, Human
cuuuucuguguuuacaga

SEQ ID NO: 2021560 - RNA, 15 nt, Human
cuuuucuguuugcua

SEQ ID NO: 2021561 - RNA, 21 nt, Human
cuuuguuuguugucagcugaa

SEQ ID NO: 2021562 - RNA, 17 nt, Human
cuuuguuuuacugucuu

SEQ ID NO: 2021563 - RNA, 17 nt, Human
cuuuguugugugccucu

SEQ ID NO: 2021564 - RNA, 18 nt, Human
cuuuguugugugccucua

SEQ ID NO: 2021565 - RNA, 19 nt, Human
cuuuguuuagucuuuauac

SEQ ID NO: 2021566 - RNA, 13 nt, Human
cuuuguugaaaga

SEQ ID NO: 2021567 - RNA, 16 nt, Human
cuuuguugaaagaaag

SEQ ID NO: 2021568 - RNA, 17 nt, Human
cuuuguugaacuguuag

SEQ ID NO: 2021569 - RNA, 22 nt, Human
cuuuguugaacuguuagaaugu

SEQ ID NO: 2021570 - RNA, 13 nt, Human
cuuuguugugugc

SEQ ID NO: 2021571 - RNA, 22 nt, Human
cuuuguugugugccucuagcug

SEQ ID NO: 2021572 - RNA, 16 nt, Human
cuuuuuuagaguugau

SEQ ID NO: 2021573 - RNA, 20 nt, Human
gaaaaauaucuguaagagug

SEQ ID NO: 2021574 - RNA, 12 nt, Human
gaaaaauaugug

SEQ ID NO: 2021575 - RNA, 13 nt, Human
cuuuuuuacaaag

SEQ ID NO: 2021576 - RNA, 20 nt, Human
gaaaaaucaaguauuauaaa

SEQ ID NO: 2021577 - RNA, 15 nt, Human
gaaaaauauuuaaug

SEQ ID NO: 2021578 - RNA, 16 nt, Human
gaaaaauauuuaaugu

SEQ ID NO: 2021579 - RNA, 20 nt, Human
gaaaaauauuuaauguugaa

SEQ ID NO: 2021580 - RNA, 21 nt, Human
gaaaaaucaaguauuauaaac

SEQ ID NO: 2021581 - RNA, 13 nt, Human
gaaaaauauguga

SEQ ID NO: 2021582 - RNA, 14 nt, Human
gaaaaauaugugaa

SEQ ID NO: 2021583 - RNA, 15 nt, Human
gaaaaauaugugaag

SEQ ID NO: 2021584 - RNA, 16 nt, Human
gaaaaauaugugaagg

SEQ ID NO: 2021585 - RNA, 10 nt, Human
gaaaaauauu

SEQ ID NO: 2021586 - RNA, 21 nt, Human
gaaaacacuguucucugcccu

SEQ ID NO: 2021587 - RNA, 20 nt, Human
gaaaacacuguucucugccc

SEQ ID NO: 2021588 - RNA, 16 nt, Human
gaaaacaugcuacaca

SEQ ID NO: 2021589 - RNA, 18 nt, Human
gaaaacaugcuacacacu

SEQ ID NO: 2021590 - RNA, 19 nt, Human
gaaaacacuguucucugcc

SEQ ID NO: 2021591 - RNA, 22 nt, Human
gaaaacaaaaccaaaaguuauu

SEQ ID NO: 2021592 - RNA, 18 nt, Human
gaaaaauuugaaaaugau

SEQ ID NO: 2021593 - RNA, 19 nt, Human
gaaaacaaaaccaaaaguu

SEQ ID NO: 2021594 - RNA, 18 nt, Human
gaaaaggugauaaaauca

SEQ ID NO: 2021595 - RNA, 19 nt, Human
gaaaaggugauaaaaucau

SEQ ID NO: 2021596 - RNA, 13 nt, Human
gaaaaccucuccu

SEQ ID NO: 2021597 - RNA, 15 nt, Human
gaaaaccuagaaaac

SEQ ID NO: 2021598 - RNA, 18 nt, Human
gaaaacgauuuaauuuau

SEQ ID NO: 2021599 - RNA, 17 nt, Human
gaaaacgauuuaauuua

SEQ ID NO: 2021600 - RNA, 14 nt, Human
gaaaacguggcugc

SEQ ID NO: 2021601 - RNA, 19 nt, Human
gaaaacaugcuacacacug

SEQ ID NO: 2021602 - RNA, 16 nt, Human
gaaaacauggaacagu

SEQ ID NO: 2021603 - RNA, 15 nt, Human
gaaaaccccuuccca

SEQ ID NO: 2021604 - RNA, 13 nt, Human
gaaaaccuagaaa

SEQ ID NO: 2021605 - RNA, 19 nt, Human
gaaaauaacaauaaaagac

SEQ ID NO: 2021606 - RNA, 22 nt, Human
gaaaagucaaggguaggguggg

SEQ ID NO: 2021607 - RNA, 14 nt, Human
gaaaaguaauauuu

SEQ ID NO: 2021608 - RNA, 16 nt, Human
gaaaaguaauauuuau

SEQ ID NO: 2021609 - RNA, 17 nt, Human
gaaaaguaauauuuauu

SEQ ID NO: 2021610 - RNA, 19 nt, Human
gaaaaguaauauuuauuaa

SEQ ID NO: 2021611 - RNA, 20 nt, Human
gaaaaguaauauuuauuaaa

SEQ ID NO: 2021612 - RNA, 23 nt, Human
cuuugugaggaagccgcuggggc

SEQ ID NO: 2021613 - RNA, 17 nt, Human
cuuugggccuggcuccc

SEQ ID NO: 2021614 - RNA, 16 nt, Human
cuuuggcacucugacu

SEQ ID NO: 2021615 - RNA, 23 nt, Human
cuuugggaggccaaggugggagg

SEQ ID NO: 2021616 - RNA, 15 nt, Human
cuuuguggugagaau

SEQ ID NO: 2021617 - RNA, 21 nt, Human
cuuuguucuggcucuuccagg

SEQ ID NO: 2021618 - RNA, 16 nt, Human
cuuuguucuggcucuu

SEQ ID NO: 2021619 - RNA, 19 nt, Human
cuuugugaggaagccgcug

SEQ ID NO: 2021620 - RNA, 12 nt, Human
cuuugugauuuu

SEQ ID NO: 2021621 - RNA, 13 nt, Human
cuuuguggcuucc

SEQ ID NO: 2021622 - RNA, 17 nt, Human
cuuugccaaaaagcaua

SEQ ID NO: 2021623 - RNA, 19 nt, Human
cuuugacaaagguaaauca

SEQ ID NO: 2021624 - RNA, 20 nt, Human
cuuugaauuuucauuuuaca

SEQ ID NO: 2021625 - RNA, 21 nt, Human
cuuugaauuuucauuuuacag

SEQ ID NO: 2021626 - RNA, 22 nt, Human
cuuugcauaacguauaaaagcc

SEQ ID NO: 2021627 - RNA, 19 nt, Human
cuuugacagcgcacagcug

SEQ ID NO: 2021628 - RNA, 20 nt, Human
cuuugacagcgcacagcugc

SEQ ID NO: 2021629 - RNA, 22 nt, Human
cuuugacagcgcacagcugcuc

SEQ ID NO: 2021630 - RNA, 14 nt, Human
cuuugcuugaaaga

SEQ ID NO: 2021631 - RNA, 23 nt, Human
cuuuggaaagacuuuuccaaccc

SEQ ID NO: 2021632 - RNA, 12 nt, Human
cuuuggaaagac

SEQ ID NO: 2021633 - RNA, 14 nt, Human
cuuucuucuuccca

SEQ ID NO: 2021634 - RNA, 12 nt, Human
cuuucuucuccc

SEQ ID NO: 2021635 - RNA, 13 nt, Human
cuuucuugcuccc

SEQ ID NO: 2021636 - RNA, 14 nt, Human
cuuucuugcucccu

SEQ ID NO: 2021637 - RNA, 15 nt, Human
cuuucuugcucccug

SEQ ID NO: 2021638 - RNA, 19 nt, Human
cuuucuugcucccugacug

SEQ ID NO: 2021639 - RNA, 15 nt, Human
cuuucuuuucuuucu

SEQ ID NO: 2021640 - RNA, 10 nt, Human
cuuucuuuuu

SEQ ID NO: 2021641 - RNA, 16 nt, Human
cuuugaaaauauauac

SEQ ID NO: 2021642 - RNA, 17 nt, Human
cuuugacaaagguaaau

SEQ ID NO: 2021643 - RNA, 19 nt, Human
cuuucuuuuuuuuuuuuga

SEQ ID NO: 2021644 - RNA, 14 nt, Human
cuuucugucucucu

SEQ ID NO: 2021645 - RNA, 13 nt, Human
cuuucuguguuua

SEQ ID NO: 2021646 - RNA, 19 nt, Human
cuuucuguguuuauucaaa

SEQ ID NO: 2021647 - RNA, 13 nt, Human
cuuucuguuaaaa

SEQ ID NO: 2021648 - RNA, 14 nt, Human
cuuucuguuaaaau

SEQ ID NO: 2021649 - RNA, 15 nt, Human
cuuucuguuaaaaug

SEQ ID NO: 2021650 - RNA, 16 nt, Human
cuuucuuccucugcug

SEQ ID NO: 2021651 - RNA, 16 nt, Human
cuuucuguuaaaaugc

SEQ ID NO: 2021652 - RNA, 19 nt, Human
cuuucuguuaaaaugcaug

SEQ ID NO: 2021653 - RNA, 17 nt, Human
cuuucugaucuucacua

SEQ ID NO: 2021654 - RNA, 21 nt, Human
cuuuaggcauaugcuucuuua

SEQ ID NO: 2021655 - RNA, 14 nt, Human
cuuuagcugacaga

SEQ ID NO: 2021656 - RNA, 14 nt, Human
cuuuagcuguguua

SEQ ID NO: 2021657 - RNA, 18 nt, Human
cuuuagcuuauuuuuaca

SEQ ID NO: 2021658 - RNA, 15 nt, Human
cuuuagcuuucugag

SEQ ID NO: 2021659 - RNA, 14 nt, Human
cuuuagagaagaug

SEQ ID NO: 2021660 - RNA, 20 nt, Human
cuuuagagaagauggauaug

SEQ ID NO: 2021661 - RNA, 17 nt, Human
cuuuagacuugaaaaga

SEQ ID NO: 2021662 - RNA, 21 nt, Human
cuuuagacuugaaaagagaca

SEQ ID NO: 2021663 - RNA, 19 nt, Human
cuuuccucaaaacuucaga

SEQ ID NO: 2021664 - RNA, 16 nt, Human
cuuuccucuuuggucu

SEQ ID NO: 2021665 - RNA, 13 nt, Human
cuuucugaaauaa

SEQ ID NO: 2021666 - RNA, 21 nt, Human
cuuucugagcaagaggauuuu

SEQ ID NO: 2021667 - RNA, 17 nt, Human
cuucuccaggcuguauc

SEQ ID NO: 2021668 - RNA, 16 nt, Human
cuucuccacccugcuc

SEQ ID NO: 2021669 - RNA, 14 nt, Human
cuucuccaggcugu

SEQ ID NO: 2021670 - RNA, 14 nt, Human
cuucuccacccugc

SEQ ID NO: 2021671 - RNA, 15 nt, Human
cuucuccacccugcu

SEQ ID NO: 2021672 - RNA, 22 nt, Human
cuucuccuucaccuuugucccc

SEQ ID NO: 2021673 - RNA, 20 nt, Human
cuucuccuuucacaaccuuc

SEQ ID NO: 2021674 - RNA, 22 nt, Human
cuucuccuuucacaaccuucug

SEQ ID NO: 2021675 - RNA, 14 nt, Human
cuucuccuuucaca

SEQ ID NO: 2021676 - RNA, 17 nt, Human
cuucuccuuucacaacc

SEQ ID NO: 2021677 - RNA, 11 nt, Human
cuucugcuuug

SEQ ID NO: 2021678 - RNA, 12 nt, Human
cuucugcuuugu

SEQ ID NO: 2021679 - RNA, 15 nt, Human
cuucugcuuuguugu

SEQ ID NO: 2021680 - RNA, 20 nt, Human
cuucugcuuuguugugugcc

SEQ ID NO: 2021681 - RNA, 22 nt, Human
cuucugcuuuguugugugccuc

SEQ ID NO: 2021682 - RNA, 18 nt, Human
cuucugcuucagccuccc

SEQ ID NO: 2021683 - RNA, 16 nt, Human
cuucugcuucagccuc

SEQ ID NO: 2021684 - RNA, 17 nt, Human
cuucugcuucagccucc

SEQ ID NO: 2021685 - RNA, 20 nt, Human
cuucugccauuucugagauc

SEQ ID NO: 2021686 - RNA, 21 nt, Human
cuucugccauauucuguuggc

SEQ ID NO: 2021687 - RNA, 15 nt, Human
cuucugccauauucu

SEQ ID NO: 2021688 - RNA, 17 nt, Human
cuucugccauauucugu

SEQ ID NO: 2021689 - RNA, 17 nt, Human
cuuccuugccagucuuu

SEQ ID NO: 2021690 - RNA, 18 nt, Human
cuuccuucuuugcccuuu

SEQ ID NO: 2021691 - RNA, 15 nt, Human
cuuccuucuuugccc

SEQ ID NO: 2021692 - RNA, 16 nt, Human
cuuccuucuuugcccu

SEQ ID NO: 2021693 - RNA, 14 nt, Human
cuuccuuccugcuu

SEQ ID NO: 2021694 - RNA, 14 nt, Human
cuuccuacucuucu

SEQ ID NO: 2021695 - RNA, 15 nt, Human
cuuccuacucuucuc

SEQ ID NO: 2021696 - RNA, 16 nt, Human
cuuccuacucuucucu

SEQ ID NO: 2021697 - RNA, 18 nt, Human
cuuccuacucuucucucu

SEQ ID NO: 2021698 - RNA, 19 nt, Human
cuuccuacucuucucucug

SEQ ID NO: 2021699 - RNA, 21 nt, Human
cuuccuacucuucucucugcu

SEQ ID NO: 2021700 - RNA, 22 nt, Human
cuuccuacucuucucucugcuc

SEQ ID NO: 2021701 - RNA, 23 nt, Human
cuuccuacucuucucucugcucu

SEQ ID NO: 2021702 - RNA, 14 nt, Human
cuuccuagccuugc

SEQ ID NO: 2021703 - RNA, 17 nt, Human
cuuccuagccuugcacu

SEQ ID NO: 2021704 - RNA, 20 nt, Human
cuuccuagcuggagaggagc

SEQ ID NO: 2021705 - RNA, 16 nt, Human
cuuccuaguucauccc

SEQ ID NO: 2021706 - RNA, 14 nt, Human
cuucgcuccugugu

SEQ ID NO: 2021707 - RNA, 15 nt, Human
cuucgcuccuguguc

SEQ ID NO: 2021708 - RNA, 13 nt, Human
cuucgcuccugug

SEQ ID NO: 2021709 - RNA, 14 nt, Human
cuucgggcugugcc

SEQ ID NO: 2021710 - RNA, 15 nt, Human
cuucgggcugugccc

SEQ ID NO: 2021711 - RNA, 21 nt, Human
cuucgggaggucgaggcagga

SEQ ID NO: 2021712 - RNA, 20 nt, Human
cuucgggaggucgaggcagg

SEQ ID NO: 2021713 - RNA, 18 nt, Human
cuucggccuccauccuga

SEQ ID NO: 2021714 - RNA, 19 nt, Human
cuucggccuccauccugag

SEQ ID NO: 2021715 - RNA, 17 nt, Human
cuucggccuccauccug

SEQ ID NO: 2021716 - RNA, 16 nt, Human
cuucgcuccugugucu

SEQ ID NO: 2021717 - RNA, 13 nt, Human
cuucggcauuuga

SEQ ID NO: 2021718 - RNA, 21 nt, Human
cuucuaaaacuguacuuugau

SEQ ID NO: 2021719 - RNA, 14 nt, Human
cuucuaaaacugua

SEQ ID NO: 2021720 - RNA, 18 nt, Human
cuucuaaaacuguacuuu

SEQ ID NO: 2021721 - RNA, 19 nt, Human
cuucuaaaacuguacuuug

SEQ ID NO: 2021722 - RNA, 20 nt, Human
cuucuaaaacuguacuuuga

SEQ ID NO: 2021723 - RNA, 18 nt, Human
cuuauuuuggagagauag

SEQ ID NO: 2021724 - RNA, 19 nt, Human
cuucaaaacaaacagaugc

SEQ ID NO: 2021725 - RNA, 11 nt, Human
cuucagcugac

SEQ ID NO: 2021726 - RNA, 14 nt, Human
cuucaggcucuucu

SEQ ID NO: 2021727 - RNA, 15 nt, Human
cuucaggcucuucuc

SEQ ID NO: 2021728 - RNA, 16 nt, Human
cuucaggcucuucucc

SEQ ID NO: 2021729 - RNA, 17 nt, Human
cuucaggcucuucuccu

SEQ ID NO: 2021730 - RNA, 18 nt, Human
cuucaggcucuucuccuu

SEQ ID NO: 2021731 - RNA, 15 nt, Human
cuuccaagagccuga

SEQ ID NO: 2021732 - RNA, 22 nt, Human
cuuccacaagagcccaggccuc

SEQ ID NO: 2021733 - RNA, 23 nt, Human
cuuccacaagagcccaggccucc

SEQ ID NO: 2021734 - RNA, 14 nt, Human
cuuccaagagccug

SEQ ID NO: 2021735 - RNA, 19 nt, Human
cuuccaaccauuuaucuug

SEQ ID NO: 2021736 - RNA, 21 nt, Human
cuuccaaccauuuaucuugaa

SEQ ID NO: 2021737 - RNA, 13 nt, Human
cuucauuuggaga

SEQ ID NO: 2021738 - RNA, 14 nt, Human
cuucauuuggagau

SEQ ID NO: 2021739 - RNA, 21 nt, Human
cuuccaaagcagagagcauua

SEQ ID NO: 2021740 - RNA, 12 nt, Human
cuucagugccuu

SEQ ID NO: 2021741 - RNA, 11 nt, Human
cuucagugccu

SEQ ID NO: 2021742 - RNA, 14 nt, Human
cuucagugccuuau

SEQ ID NO: 2021743 - RNA, 13 nt, Human
cuucagugccuua

SEQ ID NO: 2021744 - RNA, 18 nt, Human
cuucauuuccugugucuu

SEQ ID NO: 2021745 - RNA, 13 nt, Human
cuucccucccugc

SEQ ID NO: 2021746 - RNA, 14 nt, Human
cuucccucccugcu

SEQ ID NO: 2021747 - RNA, 16 nt, Human
cuucccucccugcugu

SEQ ID NO: 2021748 - RNA, 18 nt, Human
cuucccucccugcuguca

SEQ ID NO: 2021749 - RNA, 16 nt, Human
cuucccgcucagcccu

SEQ ID NO: 2021750 - RNA, 17 nt, Human
cuucccgcucagcccuc

SEQ ID NO: 2021751 - RNA, 15 nt, Human
cuucccgcucagccc

SEQ ID NO: 2021752 - RNA, 20 nt, Human
cuucccgccgcccagcccac

SEQ ID NO: 2021753 - RNA, 23 nt, Human
cuucccgccgcccagcccacccc

SEQ ID NO: 2021754 - RNA, 12 nt, Human
cuucccagggca

SEQ ID NO: 2021755 - RNA, 22 nt, Human
cuuccuaccacccgguccccac

SEQ ID NO: 2021756 - RNA, 23 nt, Human
cuuccuaccacccgguccccacu

SEQ ID NO: 2021757 - RNA, 15 nt, Human
cuuccagugaggcuc

SEQ ID NO: 2021758 - RNA, 13 nt, Human
cuucccacucugu

SEQ ID NO: 2021759 - RNA, 14 nt, Human
cuucccacucuucu

SEQ ID NO: 2021760 - RNA, 15 nt, Human
cuucccacucuucuc

SEQ ID NO: 2021761 - RNA, 16 nt, Human
cuucccacucuucuca

SEQ ID NO: 2021762 - RNA, 14 nt, Human
cuuccagugaggcu

SEQ ID NO: 2021763 - RNA, 24 nt, Human
cuuccaggggugggacacccugug

SEQ ID NO: 2021764 - RNA, 22 nt, Human
cuuccaggggugggacacccug

SEQ ID NO: 2021765 - RNA, 13 nt, Human
cuuccagcaggag

SEQ ID NO: 2021766 - RNA, 23 nt, Human
cuuccagcaggagggacagucuc

SEQ ID NO: 2021767 - RNA, 11 nt, Human
cuuccagcagg

SEQ ID NO: 2021768 - RNA, 12 nt, Human
cuuccagcagga

SEQ ID NO: 2021769 - RNA, 22 nt, Human
cuuaacugugguguugaggcuu

SEQ ID NO: 2021770 - RNA, 17 nt, Human
cuuaacuguauagcucu

SEQ ID NO: 2021771 - RNA, 12 nt, Human
cuuaacuucaca

SEQ ID NO: 2021772 - RNA, 14 nt, Human
cuuaacuucacaua

SEQ ID NO: 2021773 - RNA, 15 nt, Human
cuuaacuucacauau

SEQ ID NO: 2021774 - RNA, 16 nt, Human
cuuaacuucacauauu

SEQ ID NO: 2021775 - RNA, 17 nt, Human
cuuaacuucacauauug

SEQ ID NO: 2021776 - RNA, 22 nt, Human
cuuaacuucacauauugauuuc

SEQ ID NO: 2021777 - RNA, 22 nt, Human
cuuaaaugcaaccauuugaaac

SEQ ID NO: 2021778 - RNA, 12 nt, Human
cuuaaaugugaa

SEQ ID NO: 2021779 - RNA, 13 nt, Human
cuuaaaugugaau

SEQ ID NO: 2021780 - RNA, 14 nt, Human
cuuaaaugugaauu

SEQ ID NO: 2021781 - RNA, 16 nt, Human
cuuaaaugugaauuac

SEQ ID NO: 2021782 - RNA, 19 nt, Human
cuuaaaaaaaacucuuuaa

SEQ ID NO: 2021783 - RNA, 19 nt, Human
cuuaaauuaguacagcacu

SEQ ID NO: 2021784 - RNA, 17 nt, Human
cuuaaauguuauguaua

SEQ ID NO: 2021785 - RNA, 18 nt, Human
cuuaaauguuauguauau

SEQ ID NO: 2021786 - RNA, 17 nt, Human
cuuaaaugugaauuacu

SEQ ID NO: 2021787 - RNA, 19 nt, Human
cuuaaaugugaauuacuaa

SEQ ID NO: 2021788 - RNA, 22 nt, Human
cuuaaaugugaauuacuaacuu

SEQ ID NO: 2021789 - RNA, 16 nt, Human
cuuaaauguuauguau

SEQ ID NO: 2021790 - RNA, 15 nt, Human
cuuaacccagugucc

SEQ ID NO: 2021791 - RNA, 18 nt, Human
cuuaaucauuuuuuauau

SEQ ID NO: 2021792 - RNA, 22 nt, Human
cuuaaucauuuuuuauauauau

SEQ ID NO: 2021793 - RNA, 23 nt, Human
cuuaaucauuuuuuauauauaug

SEQ ID NO: 2021794 - RNA, 20 nt, Human
cuuaaugagcaauaucugcu

SEQ ID NO: 2021795 - RNA, 18 nt, Human
cuuaaugccacuaaauug

SEQ ID NO: 2021796 - RNA, 14 nt, Human
cuuaaucuaaaugg

SEQ ID NO: 2021797 - RNA, 16 nt, Human
cuuaaucuaaauggaa

SEQ ID NO: 2021798 - RNA, 14 nt, Human
cuuaauauuuuuac

SEQ ID NO: 2021799 - RNA, 15 nt, Human
cuuaauauuuuuaca

SEQ ID NO: 2021800 - RNA, 16 nt, Human
cuuaauauuuuuacau

SEQ ID NO: 2021801 - RNA, 12 nt, Human
cuuaaucauuuu

SEQ ID NO: 2021802 - RNA, 16 nt, Human
cuuaaguuuauacucu

SEQ ID NO: 2021803 - RNA, 19 nt, Human
cuuaaguuaguuccacuga

SEQ ID NO: 2021804 - RNA, 21 nt, Human
cuuaaguuaguuccacugaga

SEQ ID NO: 2021805 - RNA, 15 nt, Human
cuuaagaaauaaauc

SEQ ID NO: 2021806 - RNA, 16 nt, Human
cuuaagaacugcuuuc

SEQ ID NO: 2021807 - RNA, 11 nt, Human
cuuaagaaaaa

SEQ ID NO: 2021808 - RNA, 12 nt, Human
cuuaagaaauaa

SEQ ID NO: 2021809 - RNA, 20 nt, Human
cuuaagugaggaaaucaaag

SEQ ID NO: 2021810 - RNA, 21 nt, Human
cuuaagugaggaaaucaaagu

SEQ ID NO: 2021811 - RNA, 19 nt, Human
cuuaagugaggaaaucaaa

SEQ ID NO: 2021812 - RNA, 18 nt, Human
cuuaagugaggaaaucaa

SEQ ID NO: 2021813 - RNA, 23 nt, Human
cuguuuguuucugaaagggacgc

SEQ ID NO: 2021814 - RNA, 21 nt, Human
cuguuuguuucugaaagggac

SEQ ID NO: 2021815 - RNA, 21 nt, Human
cuguuuuauuuuaauucaguu

SEQ ID NO: 2021816 - RNA, 14 nt, Human
cuguuuucucuuga

SEQ ID NO: 2021817 - RNA, 13 nt, Human
cuguuuucucuug

SEQ ID NO: 2021818 - RNA, 14 nt, Human
cuguuuugccagcc

SEQ ID NO: 2021819 - RNA, 17 nt, Human
cuguuuugaguuccuau

SEQ ID NO: 2021820 - RNA, 17 nt, Human
cuguuuucucuugagag

SEQ ID NO: 2021821 - RNA, 18 nt, Human
cuguuuguuucugaaagg

SEQ ID NO: 2021822 - RNA, 17 nt, Human
cuguuucucagucucac

SEQ ID NO: 2021823 - RNA, 18 nt, Human
cuguuucucagucucaca

SEQ ID NO: 2021824 - RNA, 13 nt, Human
cuguuuacagugu

SEQ ID NO: 2021825 - RNA, 15 nt, Human
cuguuuacaguguuc

SEQ ID NO: 2021826 - RNA, 17 nt, Human
cugguugaugccuguga

SEQ ID NO: 2021827 - RNA, 12 nt, Human
cuguuuagauaa

SEQ ID NO: 2021828 - RNA, 18 nt, Human
cuguuuaucccuuaagaa

SEQ ID NO: 2021829 - RNA, 19 nt, Human
cuguuuaucccuuaagaau

SEQ ID NO: 2021830 - RNA, 18 nt, Human
cuuagacagucccugcca

SEQ ID NO: 2021831 - RNA, 17 nt, Human
cuuagacagucccugcc

SEQ ID NO: 2021832 - RNA, 19 nt, Human
cuuagacagucccugccaa

SEQ ID NO: 2021833 - RNA, 11 nt, Human
cuuagacaguc

SEQ ID NO: 2021834 - RNA, 21 nt, Human
cuuagaucauaguuuuauuua

SEQ ID NO: 2021835 - RNA, 22 nt, Human
cuuagaucauaguuuuauuuau

SEQ ID NO: 2021836 - RNA, 13 nt, Human
cuuagaucauagu

SEQ ID NO: 2021837 - RNA, 16 nt, Human
cuuagaucauaguuuu

SEQ ID NO: 2021838 - RNA, 17 nt, Human
cuuagaucauaguuuua

SEQ ID NO: 2021839 - RNA, 18 nt, Human
cuuagaucauaguuuuau

SEQ ID NO: 2021840 - RNA, 19 nt, Human
cuuagaucauaguuuuauu

SEQ ID NO: 2021841 - RNA, 14 nt, Human
cuuagaagguauua

SEQ ID NO: 2021842 - RNA, 21 nt, Human
cuuagaagguauuaagauuau

SEQ ID NO: 2021843 - RNA, 15 nt, Human
cuuagaaccuuucuu

SEQ ID NO: 2021844 - RNA, 17 nt, Human
cuuagaaauugcauuuc

SEQ ID NO: 2021845 - RNA, 21 nt, Human
cuuacuuuguaaauucugauu

SEQ ID NO: 2021846 - RNA, 15 nt, Human
cuuacuuuguaaauu

SEQ ID NO: 2021847 - RNA, 17 nt, Human
cuuacuuuguaaauucu

SEQ ID NO: 2021848 - RNA, 19 nt, Human
cuuacuuuguaaauucuga

SEQ ID NO: 2021849 - RNA, 20 nt, Human
cuuacuuuguaaauucugau

SEQ ID NO: 2021850 - RNA, 16 nt, Human
cuuagacagucccugc

SEQ ID NO: 2021851 - RNA, 15 nt, Human
cuuagacagucccug

SEQ ID NO: 2021852 - RNA, 14 nt, Human
cuuagacagucccu

SEQ ID NO: 2021853 - RNA, 15 nt, Human
cuuagaagucacaca

SEQ ID NO: 2021854 - RNA, 18 nt, Human
cuuacuuuccugaaaaua

SEQ ID NO: 2021855 - RNA, 11 nt, Human
cuuacuuugua

SEQ ID NO: 2021856 - RNA, 12 nt, Human
cuuacuuuguaa

SEQ ID NO: 2021857 - RNA, 14 nt, Human
cuuacuuuguaaau

SEQ ID NO: 2021858 - RNA, 16 nt, Human
cuuacuguacaugaaa

SEQ ID NO: 2021859 - RNA, 14 nt, Human
cuuaauggaugaaa

SEQ ID NO: 2021860 - RNA, 19 nt, Human
cuuaauggaugaaaucaua

SEQ ID NO: 2021861 - RNA, 19 nt, Human
cuuacuaguuucccuugca

SEQ ID NO: 2021862 - RNA, 15 nt, Human
cuuacgugaguccug

SEQ ID NO: 2021863 - RNA, 15 nt, Human
cuuauuuaaugaaag

SEQ ID NO: 2021864 - RNA, 23 nt, Human
cuuaugauagcaaauggccucau

SEQ ID NO: 2021865 - RNA, 14 nt, Human
cuuaugacuaugua

SEQ ID NO: 2021866 - RNA, 14 nt, Human
cuuaucuccaagac

SEQ ID NO: 2021867 - RNA, 13 nt, Human
cuuaucuccaaga

SEQ ID NO: 2021868 - RNA, 16 nt, Human
cuuaucuccaagacca

SEQ ID NO: 2021869 - RNA, 19 nt, Human
cuuaucaaaguagcaaaug

SEQ ID NO: 2021870 - RNA, 14 nt, Human
cuuauauuugugua

SEQ ID NO: 2021871 - RNA, 16 nt, Human
cuuaucaaaggacacc

SEQ ID NO: 2021872 - RNA, 14 nt, Human
cuuaucaaaggaca

SEQ ID NO: 2021873 - RNA, 20 nt, Human
cuuauauuuacaacacuuua

SEQ ID NO: 2021874 - RNA, 18 nt, Human
cuuauauuguaagaaaua

SEQ ID NO: 2021875 - RNA, 14 nt, Human
cuuauauuguaaga

SEQ ID NO: 2021876 - RNA, 17 nt, Human
cuuauauuguaagaaau

SEQ ID NO: 2021877 - RNA, 20 nt, Human
cuuauaaaacagaguaaucu

SEQ ID NO: 2021878 - RNA, 21 nt, Human
cuuauaaaacagaguaaucuu

SEQ ID NO: 2021879 - RNA, 17 nt, Human
cuuagguuggcaaaaag

SEQ ID NO: 2021880 - RNA, 20 nt, Human
cuuaggugauccacucgccu

SEQ ID NO: 2021881 - RNA, 17 nt, Human
cuuaggguuuucucucu

SEQ ID NO: 2021882 - RNA, 13 nt, Human
cuuauaauuuaaa

SEQ ID NO: 2021883 - RNA, 19 nt, Human
cuuauaggaauugacccac

SEQ ID NO: 2021884 - RNA, 15 nt, Human
cuuauacauuugaua

SEQ ID NO: 2021885 - RNA, 14 nt, Human
cuuauaauuuaaaa

SEQ ID NO: 2021886 - RNA, 12 nt, Human
cucuugggacau

SEQ ID NO: 2021887 - RNA, 15 nt, Human
cucuugggcaauauu

SEQ ID NO: 2021888 - RNA, 16 nt, Human
cucuugggcaauauuc

SEQ ID NO: 2021889 - RNA, 20 nt, Human
cucuugggcaauauucucug

SEQ ID NO: 2021890 - RNA, 22 nt, Human
cucuugggcaauauucucugua

SEQ ID NO: 2021891 - RNA, 14 nt, Human
cucuuggcuccacu

SEQ ID NO: 2021892 - RNA, 22 nt, Human
cucuuggagccugcagagcugc

SEQ ID NO: 2021893 - RNA, 19 nt, Human
cucuugguccugcugcagu

SEQ ID NO: 2021894 - RNA, 18 nt, Human
cucuugguccugcugcag

SEQ ID NO: 2021895 - RNA, 19 nt, Human
cucuugaacugagcuugga

SEQ ID NO: 2021896 - RNA, 13 nt, Human
cucuugacccugc

SEQ ID NO: 2021897 - RNA, 14 nt, Human
cucuugacccugca

SEQ ID NO: 2021898 - RNA, 15 nt, Human
cucuugacccugcac

SEQ ID NO: 2021899 - RNA, 16 nt, Human
cucuugacccugcacc

SEQ ID NO: 2021900 - RNA, 17 nt, Human
cucuugacccugcaccc

SEQ ID NO: 2021901 - RNA, 18 nt, Human
cucuugacccugcacccu

SEQ ID NO: 2021902 - RNA, 19 nt, Human
cucuugacccugcacccuc

SEQ ID NO: 2021903 - RNA, 21 nt, Human
cucuugacccugcacccuccu

SEQ ID NO: 2021904 - RNA, 16 nt, Human
cucuugaacugagcuu

SEQ ID NO: 2021905 - RNA, 17 nt, Human
cucuugaacugagcuug

SEQ ID NO: 2021906 - RNA, 18 nt, Human
cucuugaacuccugaccu

SEQ ID NO: 2021907 - RNA, 18 nt, Human
cucuucuggguuccuucc

SEQ ID NO: 2021908 - RNA, 16 nt, Human
cucuugaccucaggug

SEQ ID NO: 2021909 - RNA, 16 nt, Human
cucuugacucuugccu

SEQ ID NO: 2021910 - RNA, 13 nt, Human
cucuugaccucag

SEQ ID NO: 2021911 - RNA, 15 nt, Human
cucuugaccucaggu

SEQ ID NO: 2021912 - RNA, 17 nt, Human
cucuugucuuccuauuu

SEQ ID NO: 2021913 - RNA, 17 nt, Human
cucuuuccaucuacccu

SEQ ID NO: 2021914 - RNA, 11 nt, Human
cucuuucagug

SEQ ID NO: 2021915 - RNA, 15 nt, Human
cucuuucccacccag

SEQ ID NO: 2021916 - RNA, 21 nt, Human
cucuugucuuccuauuucaga

SEQ ID NO: 2021917 - RNA, 23 nt, Human
cucuugucuuccuauuucagaag

SEQ ID NO: 2021918 - RNA, 18 nt, Human
cucuuuggacacucacac

SEQ ID NO: 2021919 - RNA, 15 nt, Human
cucuuuggacacuca

SEQ ID NO: 2021920 - RNA, 17 nt, Human
cucuuucuauuguuucu

SEQ ID NO: 2021921 - RNA, 17 nt, Human
cucuuucccacccagcc

SEQ ID NO: 2021922 - RNA, 18 nt, Human
cucuuucccacccagccu

SEQ ID NO: 2021923 - RNA, 19 nt, Human
cucuuucccacccagccug

SEQ ID NO: 2021924 - RNA, 20 nt, Human
cucuuucccacccagccugg

SEQ ID NO: 2021925 - RNA, 10 nt, Human
cucuuucccu

SEQ ID NO: 2021926 - RNA, 19 nt, Human
cucuucaguuaagccuuug

SEQ ID NO: 2021927 - RNA, 20 nt, Human
cucuucaguuaagccuuugg

SEQ ID NO: 2021928 - RNA, 23 nt, Human
cucuucaguuaagccuuuggaaa

SEQ ID NO: 2021929 - RNA, 20 nt, Human
cucuuaaaagaggaaaauga

SEQ ID NO: 2021930 - RNA, 24 nt, Human
cucuuaaaacccaagugccuuagc

SEQ ID NO: 2021931 - RNA, 13 nt, Human
cucuuaaaaccca

SEQ ID NO: 2021932 - RNA, 19 nt, Human
cucuggcagcucagagagg

SEQ ID NO: 2021933 - RNA, 20 nt, Human
cucuggcagcucagagaggg

SEQ ID NO: 2021934 - RNA, 20 nt, Human
cucuguucugcacacagcac

SEQ ID NO: 2021935 - RNA, 21 nt, Human
cucuguucugcacacagcacg

SEQ ID NO: 2021936 - RNA, 19 nt, Human
cucuguucugcacacagca

SEQ ID NO: 2021937 - RNA, 18 nt, Human
cucuggcagcucagagag

SEQ ID NO: 2021938 - RNA, 17 nt, Human
cucuggcagcucagaga

SEQ ID NO: 2021939 - RNA, 15 nt, Human
cucuggagcccacug

SEQ ID NO: 2021940 - RNA, 14 nt, Human
cucuucuggaaugg

SEQ ID NO: 2021941 - RNA, 19 nt, Human
cucuucucucugcucugac

SEQ ID NO: 2021942 - RNA, 13 nt, Human
cucuucuccuuuc

SEQ ID NO: 2021943 - RNA, 15 nt, Human
cucuucuccuuucac

SEQ ID NO: 2021944 - RNA, 16 nt, Human
cucuucuccuuucaca

SEQ ID NO: 2021945 - RNA, 17 nt, Human
cucuucuccccuuccau

SEQ ID NO: 2021946 - RNA, 20 nt, Human
cucuucuccccuuccauuuc

SEQ ID NO: 2021947 - RNA, 21 nt, Human
cucuucuccccuuccauuucu

SEQ ID NO: 2021948 - RNA, 14 nt, Human
cucuucucucugcu

SEQ ID NO: 2021949 - RNA, 15 nt, Human
cucuucucucugcuc

SEQ ID NO: 2021950 - RNA, 17 nt, Human
cucuucucucugcucug

SEQ ID NO: 2021951 - RNA, 21 nt, Human
cucuuccaggcugggagagcc

SEQ ID NO: 2021952 - RNA, 22 nt, Human
cucuuccaggcugggagagccu

SEQ ID NO: 2021953 - RNA, 23 nt, Human
cucuuccaggcugggagagccuu

SEQ ID NO: 2021954 - RNA, 17 nt, Human
cucuucauauucagcuu

SEQ ID NO: 2021955 - RNA, 12 nt, Human
cucuucuccagg

SEQ ID NO: 2021956 - RNA, 19 nt, Human
cucuucuccacuggaugga

SEQ ID NO: 2021957 - RNA, 14 nt, Human
cucuucuccccuuc

SEQ ID NO: 2021958 - RNA, 16 nt, Human
cucuucuccccuucca

SEQ ID NO: 2021959 - RNA, 15 nt, Human
cucuucuccacugga

SEQ ID NO: 2021960 - RNA, 17 nt, Human
cucuucuccacuggaug

SEQ ID NO: 2021961 - RNA, 14 nt, Human
cucuucuccacugg

SEQ ID NO: 2021962 - RNA, 21 nt, Human
cucuuuggucuacacugugcu

SEQ ID NO: 2021963 - RNA, 19 nt, Human
cucuuuggucuacacugug

SEQ ID NO: 2021964 - RNA, 12 nt, Human
cucuuuggaaaa

SEQ ID NO: 2021965 - RNA, 13 nt, Human
cucuuuggaaaag

SEQ ID NO: 2021966 - RNA, 18 nt, Human
cucuuugggccuggcucc

SEQ ID NO: 2021967 - RNA, 21 nt, Human
cugaaccuggguaacuaggga

SEQ ID NO: 2021968 - RNA, 19 nt, Human
cugaaccugggaaagagau

SEQ ID NO: 2021969 - RNA, 20 nt, Human
cugaaccugggaaagagauu

SEQ ID NO: 2021970 - RNA, 21 nt, Human
cugaacuuggcgcugccccug

SEQ ID NO: 2021971 - RNA, 16 nt, Human
cugaacuuggcgcugc

SEQ ID NO: 2021972 - RNA, 15 nt, Human
cugaacuuggcgcug

SEQ ID NO: 2021973 - RNA, 13 nt, Human
cugaaccugucuu

SEQ ID NO: 2021974 - RNA, 14 nt, Human
cugaaccugucuuu

SEQ ID NO: 2021975 - RNA, 16 nt, Human
cugaaccugucuuuug

SEQ ID NO: 2021976 - RNA, 21 nt, Human
cugaagagaagggcagggcug

SEQ ID NO: 2021977 - RNA, 21 nt, Human
cugaagacucauucuucugua

SEQ ID NO: 2021978 - RNA, 16 nt, Human
cugaauacagaggcaa

SEQ ID NO: 2021979 - RNA, 16 nt, Human
cugaauaagcacuuuu

SEQ ID NO: 2021980 - RNA, 18 nt, Human
cugaauaagcacuuuuua

SEQ ID NO: 2021981 - RNA, 19 nt, Human
cugaauaagcacuuuuuaa

SEQ ID NO: 2021982 - RNA, 16 nt, Human
cugaauaccaguggag

SEQ ID NO: 2021983 - RNA, 24 nt, Human
cugaagucuuuguacagacaacaa

SEQ ID NO: 2021984 - RNA, 17 nt, Human
cugaagucacugcacag

SEQ ID NO: 2021985 - RNA, 16 nt, Human
cugaagucacugcaca

SEQ ID NO: 2021986 - RNA, 22 nt, Human
cugaagucacugcacagugcau

SEQ ID NO: 2021987 - RNA, 14 nt, Human
cugaagucacacag

SEQ ID NO: 2021988 - RNA, 15 nt, Human
cugaagucacacagu

SEQ ID NO: 2021989 - RNA, 16 nt, Human
cugaagucacacagug

SEQ ID NO: 2021990 - RNA, 22 nt, Human
cugaaugaaccuucuggccucc

SEQ ID NO: 2021991 - RNA, 20 nt, Human
cugaauucaccacagacuuu

SEQ ID NO: 2021992 - RNA, 13 nt, Human
cugaaucccugua

SEQ ID NO: 2021993 - RNA, 12 nt, Human
cugaaucuguac

SEQ ID NO: 2021994 - RNA, 14 nt, Human
cugaaucuguacag

SEQ ID NO: 2021995 - RNA, 15 nt, Human
cugaaucuguacaga

SEQ ID NO: 2021996 - RNA, 15 nt, Human
cugaaucuucugaaa

SEQ ID NO: 2021997 - RNA, 21 nt, Human
cugaauauugccauuaugcuu

SEQ ID NO: 2021998 - RNA, 17 nt, Human
cugaauccaaaagaaaa

SEQ ID NO: 2021999 - RNA, 19 nt, Human
cugaauccaaaagaaaaac

SEQ ID NO: 2022000 - RNA, 14 nt, Human
cugaauuuaaauag

SEQ ID NO: 2022001 - RNA, 18 nt, Human
cugaauuuaaauagcuuu

SEQ ID NO: 2022002 - RNA, 20 nt, Human
cugaauugagccuaaaaaua

SEQ ID NO: 2022003 - RNA, 21 nt, Human
cugaauugagccuaaaaauaa

SEQ ID NO: 2022004 - RNA, 22 nt, Human
cugaauugagccuaaaaauaaa

SEQ ID NO: 2022005 - RNA, 23 nt, Human
cugaauugagccuaaaaauaaag

SEQ ID NO: 2022006 - RNA, 21 nt, Human
cugaauuggaaugcacucaga

SEQ ID NO: 2022007 - RNA, 23 nt, Human
cugaauuuaaauagcuuuuuucu

SEQ ID NO: 2022008 - RNA, 14 nt, Human
cugaauuuaucuuu

SEQ ID NO: 2022009 - RNA, 16 nt, Human
cugaauuuaucuuuga

SEQ ID NO: 2022010 - RNA, 17 nt, Human
cugaauuuaucuuugau

SEQ ID NO: 2022011 - RNA, 19 nt, Human
cugacagacacaggcccgg

SEQ ID NO: 2022012 - RNA, 18 nt, Human
cugaauuuaucuuugaua

SEQ ID NO: 2022013 - RNA, 20 nt, Human
cugaauuuaucuuugauaac

SEQ ID NO: 2022014 - RNA, 16 nt, Human
cugacagagggaugga

SEQ ID NO: 2022015 - RNA, 11 nt, Human
cugacaggcaa

SEQ ID NO: 2022016 - RNA, 21 nt, Human
cugacagacacaggcccggcu

SEQ ID NO: 2022017 - RNA, 17 nt, Human
cugacagacagcccucc

SEQ ID NO: 2022018 - RNA, 19 nt, Human
cugacagacagcccuccau

SEQ ID NO: 2022019 - RNA, 17 nt, Human
cugacauuguuggccaa

SEQ ID NO: 2022020 - RNA, 20 nt, Human
cugacaggcaaugcuggcug

SEQ ID NO: 2022021 - RNA, 16 nt, Human
cugacaggcaaugcug

SEQ ID NO: 2022022 - RNA, 17 nt, Human
cugacaggcaaugcugg

SEQ ID NO: 2022023 - RNA, 18 nt, Human
cugacaggcaaugcuggc

SEQ ID NO: 2022024 - RNA, 19 nt, Human
cugacaggcaaugcuggcu

SEQ ID NO: 2022025 - RNA, 11 nt, Human
cugacccacug

SEQ ID NO: 2022026 - RNA, 18 nt, Human
cucucccaucacuucccu

SEQ ID NO: 2022027 - RNA, 14 nt, Human
cucucccaucacuu

SEQ ID NO: 2022028 - RNA, 20 nt, Human
cucucccaucacuucccuac

SEQ ID NO: 2022029 - RNA, 11 nt, Human
cucucccaggg

SEQ ID NO: 2022030 - RNA, 13 nt, Human
cucucccaucacu

SEQ ID NO: 2022031 - RNA, 12 nt, Human
cucuccagcagg

SEQ ID NO: 2022032 - RNA, 16 nt, Human
cucuccagcaggccca

SEQ ID NO: 2022033 - RNA, 13 nt, Human
cucuccagccccu

SEQ ID NO: 2022034 - RNA, 12 nt, Human
cucuccagcccc

SEQ ID NO: 2022035 - RNA, 22 nt, Human
cucuccauuuuggugucuuucu

SEQ ID NO: 2022036 - RNA, 16 nt, Human
cucuccacugccuucg

SEQ ID NO: 2022037 - RNA, 23 nt, Human
cucucaggccagcugcuugggcu

SEQ ID NO: 2022038 - RNA, 22 nt, Human
cucucaggccagcugcuugggc

SEQ ID NO: 2022039 - RNA, 12 nt, Human
cucuaauaauaa

SEQ ID NO: 2022040 - RNA, 13 nt, Human
cucuaauaauaaa

SEQ ID NO: 2022041 - RNA, 14 nt, Human
cucuaauaauaaau

SEQ ID NO: 2022042 - RNA, 15 nt, Human
cucuaauaauaaaua

SEQ ID NO: 2022043 - RNA, 16 nt, Human
cucuaauaauaaauag

SEQ ID NO: 2022044 - RNA, 18 nt, Human
cucuaauaauaaauaguu

SEQ ID NO: 2022045 - RNA, 18 nt, Human
cucuaaguguuugcugca

SEQ ID NO: 2022046 - RNA, 12 nt, Human
cucucucaggcc

SEQ ID NO: 2022047 - RNA, 19 nt, Human
cucucugaaggaggccacc

SEQ ID NO: 2022048 - RNA, 20 nt, Human
cucucugaaggaggccaccu

SEQ ID NO: 2022049 - RNA, 21 nt, Human
cucucugaaggaggccaccuc

SEQ ID NO: 2022050 - RNA, 17 nt, Human
cucucugaguauuuccu

SEQ ID NO: 2022051 - RNA, 16 nt, Human
cucucucacuccuuga

SEQ ID NO: 2022052 - RNA, 15 nt, Human
cucucucacuccuug

SEQ ID NO: 2022053 - RNA, 14 nt, Human
cucucucacuccuu

SEQ ID NO: 2022054 - RNA, 22 nt, Human
cucucugcaggucccuaauaaa

SEQ ID NO: 2022055 - RNA, 19 nt, Human
cucucugcaggucccuaau

SEQ ID NO: 2022056 - RNA, 17 nt, Human
cucucugcaggucccua

SEQ ID NO: 2022057 - RNA, 16 nt, Human
cucucugcaggucccu

SEQ ID NO: 2022058 - RNA, 14 nt, Human
cucucugcaggucc

SEQ ID NO: 2022059 - RNA, 13 nt, Human
cucucugcagguc

SEQ ID NO: 2022060 - RNA, 12 nt, Human
cucucugcaggu

SEQ ID NO: 2022061 - RNA, 22 nt, Human
cucuccuguaccucuugagccu

SEQ ID NO: 2022062 - RNA, 17 nt, Human
cucuccuguaccucuug

SEQ ID NO: 2022063 - RNA, 18 nt, Human
cucuccuguaccucuuga

SEQ ID NO: 2022064 - RNA, 13 nt, Human
cucuccuguaccu

SEQ ID NO: 2022065 - RNA, 14 nt, Human
cucuccuguaccuc

SEQ ID NO: 2022066 - RNA, 15 nt, Human
cucuccuguaccucu

SEQ ID NO: 2022067 - RNA, 13 nt, Human
cucuccccagcaa

SEQ ID NO: 2022068 - RNA, 20 nt, Human
cucugagacucgcgacaaug

SEQ ID NO: 2022069 - RNA, 14 nt, Human
cucucugcucugac

SEQ ID NO: 2022070 - RNA, 12 nt, Human
cucucugcccua

SEQ ID NO: 2022071 - RNA, 13 nt, Human
cucucugcccuaa

SEQ ID NO: 2022072 - RNA, 21 nt, Human
cucucugcccuaaugcgcagg

SEQ ID NO: 2022073 - RNA, 16 nt, Human
cucugagcaaaugugg

SEQ ID NO: 2022074 - RNA, 15 nt, Human
cucugagccuuggga

SEQ ID NO: 2022075 - RNA, 22 nt, Human
cucugcaagaauugaagcagga

SEQ ID NO: 2022076 - RNA, 16 nt, Human
cucugauguauuuugu

SEQ ID NO: 2022077 - RNA, 13 nt, Human
cucugauguauuu

SEQ ID NO: 2022078 - RNA, 17 nt, Human
cucugaugaagaggagu

SEQ ID NO: 2022079 - RNA, 17 nt, Human
cucugauacuuuuuuga

SEQ ID NO: 2022080 - RNA, 18 nt, Human
cucugauacuuuuuugaa

SEQ ID NO: 2022081 - RNA, 20 nt, Human
cucugauacuuuuuugaaau

SEQ ID NO: 2022082 - RNA, 22 nt, Human
cucugauacuuuuuugaaauca

SEQ ID NO: 2022083 - RNA, 10 nt, Human
cucugcacaa

SEQ ID NO: 2022084 - RNA, 16 nt, Human
cucugcaaaggaaaua

SEQ ID NO: 2022085 - RNA, 23 nt, Human
cucugcaggucccuaauaaagcu

SEQ ID NO: 2022086 - RNA, 19 nt, Human
cucugcaguacuugaugua

SEQ ID NO: 2022087 - RNA, 23 nt, Human
cucugcauacucauuaggauggc

SEQ ID NO: 2022088 - RNA, 13 nt, Human
cucuggacuuucu

SEQ ID NO: 2022089 - RNA, 21 nt, Human
cucuggacuuucucuaauaau

SEQ ID NO: 2022090 - RNA, 23 nt, Human
cucuggacuuucucuaauaauaa

SEQ ID NO: 2022091 - RNA, 12 nt, Human
cucuggagccca

SEQ ID NO: 2022092 - RNA, 14 nt, Human
cucuggacaggcau

SEQ ID NO: 2022093 - RNA, 14 nt, Human
cucuggaauuugaa

SEQ ID NO: 2022094 - RNA, 15 nt, Human
cucugcuuuggaaau

SEQ ID NO: 2022095 - RNA, 13 nt, Human
cucugccuuugcu

SEQ ID NO: 2022096 - RNA, 15 nt, Human
cucugccuuugcucu

SEQ ID NO: 2022097 - RNA, 18 nt, Human
cucugccuuugcucuggu

SEQ ID NO: 2022098 - RNA, 14 nt, Human
cucugccucugaca

SEQ ID NO: 2022099 - RNA, 15 nt, Human
cucugccuccucuuc

SEQ ID NO: 2022100 - RNA, 16 nt, Human
cucugccuccucuuca

SEQ ID NO: 2022101 - RNA, 16 nt, Human
cucugccucugacaca

SEQ ID NO: 2022102 - RNA, 23 nt, Human
cucugcccuccaagaccuucucc

SEQ ID NO: 2022103 - RNA, 16 nt, Human
cucugcccuccaagac

SEQ ID NO: 2022104 - RNA, 15 nt, Human
cucugcccuccaaga

SEQ ID NO: 2022105 - RNA, 14 nt, Human
cucugcccuccaag

SEQ ID NO: 2022106 - RNA, 12 nt, Human
cucugcccuugg

SEQ ID NO: 2022107 - RNA, 12 nt, Human
cucugcccugcg

SEQ ID NO: 2022108 - RNA, 14 nt, Human
cucugccuccucuu

SEQ ID NO: 2022109 - RNA, 23 nt, Human
cucugcccuaaugcgcaggcugg

SEQ ID NO: 2022110 - RNA, 11 nt, Human
cucugcccugc

SEQ ID NO: 2022111 - RNA, 13 nt, Human
cucugcccagcuu

SEQ ID NO: 2022112 - RNA, 14 nt, Human
cucugcccagcuuu

SEQ ID NO: 2022113 - RNA, 22 nt, Human
cucugcccagcuuuucauugcu

SEQ ID NO: 2022114 - RNA, 13 nt, Human
cucugccccagcu

SEQ ID NO: 2022115 - RNA, 15 nt, Human
cucugccccagcuug

SEQ ID NO: 2022116 - RNA, 21 nt, Human
cucugccccagcuugggcaga

SEQ ID NO: 2022117 - RNA, 21 nt, Human
cuccacucuccucuuccaggc

SEQ ID NO: 2022118 - RNA, 11 nt, Human
cuccacugccu

SEQ ID NO: 2022119 - RNA, 14 nt, Human
cuccagaccccugg

SEQ ID NO: 2022120 - RNA, 15 nt, Human
cuccagaccccuggc

SEQ ID NO: 2022121 - RNA, 17 nt, Human
cuccagaccccuggcuu

SEQ ID NO: 2022122 - RNA, 18 nt, Human
cuccagaccccuggcuuu

SEQ ID NO: 2022123 - RNA, 19 nt, Human
cuccagaccccuggcuuuu

SEQ ID NO: 2022124 - RNA, 20 nt, Human
cuccagaccccuggcuuuuc

SEQ ID NO: 2022125 - RNA, 19 nt, Human
cuccagcucaccagcccca

SEQ ID NO: 2022126 - RNA, 20 nt, Human
cuccagcucaccagccccag

SEQ ID NO: 2022127 - RNA, 14 nt, Human
cuccagcaggccca

SEQ ID NO: 2022128 - RNA, 22 nt, Human
cuccagcaggcccaugggaggc

SEQ ID NO: 2022129 - RNA, 11 nt, Human
cuccacccugc

SEQ ID NO: 2022130 - RNA, 20 nt, Human
cuccacauauuucagugagg

SEQ ID NO: 2022131 - RNA, 15 nt, Human
cuccaccugccaggg

SEQ ID NO: 2022132 - RNA, 17 nt, Human
cuccaccugccagggac

SEQ ID NO: 2022133 - RNA, 21 nt, Human
cuccaccugccagggacagag

SEQ ID NO: 2022134 - RNA, 18 nt, Human
cuccaccugccagggaca

SEQ ID NO: 2022135 - RNA, 12 nt, Human
cuccacccugcu

SEQ ID NO: 2022136 - RNA, 22 nt, Human
cucccaggcauuccccaggagg

SEQ ID NO: 2022137 - RNA, 14 nt, Human
cucccaggcgcccc

SEQ ID NO: 2022138 - RNA, 21 nt, Human
cucccaggcauuccccaggag

SEQ ID NO: 2022139 - RNA, 20 nt, Human
cucccaggcauuccccagga

SEQ ID NO: 2022140 - RNA, 19 nt, Human
cucccaggcauuccccagg

SEQ ID NO: 2022141 - RNA, 17 nt, Human
cucccaggcauucccca

SEQ ID NO: 2022142 - RNA, 17 nt, Human
cuccauugguguugaca

SEQ ID NO: 2022143 - RNA, 14 nt, Human
cuccaugugggcua

SEQ ID NO: 2022144 - RNA, 22 nt, Human
cucccaaggggcccaaauucuu

SEQ ID NO: 2022145 - RNA, 21 nt, Human
cucccaaggggcccaaauucu

SEQ ID NO: 2022146 - RNA, 15 nt, Human
cucccaggcauuccc

SEQ ID NO: 2022147 - RNA, 13 nt, Human
cuccagcuguuca

SEQ ID NO: 2022148 - RNA, 19 nt, Human
cuccagcuggguuggaaaa

SEQ ID NO: 2022149 - RNA, 23 nt, Human
cuccagccuggaaaccugucuga

SEQ ID NO: 2022150 - RNA, 19 nt, Human
cuccagcuguucagcuggu

SEQ ID NO: 2022151 - RNA, 18 nt, Human
cuccagcuguucagcugg

SEQ ID NO: 2022152 - RNA, 23 nt, Human
cuccauccugaggcuccacuugg

SEQ ID NO: 2022153 - RNA, 20 nt, Human
cuccaucgcugucaucucag

SEQ ID NO: 2022154 - RNA, 17 nt, Human
cuccaucuaaacugccc

SEQ ID NO: 2022155 - RNA, 18 nt, Human
cuccaucuaaacugcccc

SEQ ID NO: 2022156 - RNA, 13 nt, Human
cuccaucuccacu

SEQ ID NO: 2022157 - RNA, 21 nt, Human
cuccauccugaggcuccacuu

SEQ ID NO: 2022158 - RNA, 20 nt, Human
cuccauccugaggcuccacu

SEQ ID NO: 2022159 - RNA, 11 nt, Human
cuccaggcucc

SEQ ID NO: 2022160 - RNA, 12 nt, Human
cuaaaaggccca

SEQ ID NO: 2022161 - RNA, 13 nt, Human
cuaaaaggcccag

SEQ ID NO: 2022162 - RNA, 14 nt, Human
cuaaaaggcccaga

SEQ ID NO: 2022163 - RNA, 18 nt, Human
cuaaaaggcccagagaga

SEQ ID NO: 2022164 - RNA, 23 nt, Human
cuaaaaggcccagagagaagagc

SEQ ID NO: 2022165 - RNA, 12 nt, Human
cucagggucccu

SEQ ID NO: 2022166 - RNA, 12 nt, Human
cuaaaagcacac

SEQ ID NO: 2022167 - RNA, 23 nt, Human
cuaaaagguaugcaaucaaaucu

SEQ ID NO: 2022168 - RNA, 22 nt, Human
cguuuugcaagguaaaauuuua

SEQ ID NO: 2022169 - RNA, 14 nt, Human
cucagggucccugg

SEQ ID NO: 2022170 - RNA, 20 nt, Human
cucagguacuucucucuccu

SEQ ID NO: 2022171 - RNA, 17 nt, Human
cucaggucccugcaggg

SEQ ID NO: 2022172 - RNA, 18 nt, Human
cucaggucccugcagggc

SEQ ID NO: 2022173 - RNA, 23 nt, Human
cucagguggggucacucuggcag

SEQ ID NO: 2022174 - RNA, 22 nt, Human
cucagguggggucacucuggca

SEQ ID NO: 2022175 - RNA, 15 nt, Human
cucaggugucccugc

SEQ ID NO: 2022176 - RNA, 16 nt, Human
cucaggugucccugca

SEQ ID NO: 2022177 - RNA, 21 nt, Human
cucagugucuggcugcagagc

SEQ ID NO: 2022178 - RNA, 22 nt, Human
cucagugucuggcugcagagca

SEQ ID NO: 2022179 - RNA, 23 nt, Human
cucaggucccaggcuccuaugca

SEQ ID NO: 2022180 - RNA, 13 nt, Human
cucaggucugagu

SEQ ID NO: 2022181 - RNA, 17 nt, Human
cucaggugucccugcac

SEQ ID NO: 2022182 - RNA, 18 nt, Human
cucaggugucccugcacu

SEQ ID NO: 2022183 - RNA, 20 nt, Human
cucagugucuggcugcagag

SEQ ID NO: 2022184 - RNA, 14 nt, Human
cucaggugagaagc

SEQ ID NO: 2022185 - RNA, 19 nt, Human
cucaggugucccugcacuu

SEQ ID NO: 2022186 - RNA, 20 nt, Human
cucauaguaugguggcuggg

SEQ ID NO: 2022187 - RNA, 18 nt, Human
cucauaguaugguggcug

SEQ ID NO: 2022188 - RNA, 19 nt, Human
cucauaguaugguggcugg

SEQ ID NO: 2022189 - RNA, 14 nt, Human
cucauauuuucaug

SEQ ID NO: 2022190 - RNA, 12 nt, Human
cucaucauuuuu

SEQ ID NO: 2022191 - RNA, 17 nt, Human
cucauuaggauggcuag

SEQ ID NO: 2022192 - RNA, 18 nt, Human
cucauuaggauggcuagu

SEQ ID NO: 2022193 - RNA, 23 nt, Human
cucauuaggcaugguuuugggcu

SEQ ID NO: 2022194 - RNA, 14 nt, Human
cucauucagcaucu

SEQ ID NO: 2022195 - RNA, 15 nt, Human
cucauucagcaucug

SEQ ID NO: 2022196 - RNA, 21 nt, Human
cucauuagcauuuugcuaaau

SEQ ID NO: 2022197 - RNA, 17 nt, Human
cucaucuccccaucauu

SEQ ID NO: 2022198 - RNA, 21 nt, Human
cucaucuagguaaauuacagu

SEQ ID NO: 2022199 - RNA, 17 nt, Human
cucauuccagaggaagg

SEQ ID NO: 2022200 - RNA, 15 nt, Human
cucauuccagaggaa

SEQ ID NO: 2022201 - RNA, 21 nt, Human
cucauuccaccuucccaugcc

SEQ ID NO: 2022202 - RNA, 18 nt, Human
cucauuccaccuucccau

SEQ ID NO: 2022203 - RNA, 16 nt, Human
cucauucagcaucuga

SEQ ID NO: 2022204 - RNA, 13 nt, Human
cucauucuucugu

SEQ ID NO: 2022205 - RNA, 14 nt, Human
cucauucuucugua

SEQ ID NO: 2022206 - RNA, 20 nt, Human
cucauucccucgucuuuccc

SEQ ID NO: 2022207 - RNA, 21 nt, Human
cucauucccucgucuuuccca

SEQ ID NO: 2022208 - RNA, 15 nt, Human
cucauugaccugagg

SEQ ID NO: 2022209 - RNA, 13 nt, Human
cucauugaccuga

SEQ ID NO: 2022210 - RNA, 23 nt, Human
cucauucuucuguacgucugaca

SEQ ID NO: 2022211 - RNA, 16 nt, Human
cucauugaccugaggc

SEQ ID NO: 2022212 - RNA, 21 nt, Human
cuccuucaccuuuguccccac

SEQ ID NO: 2022213 - RNA, 19 nt, Human
cuccuucaccuuugucccc

SEQ ID NO: 2022214 - RNA, 16 nt, Human
cuccuucaccuuuguc

SEQ ID NO: 2022215 - RNA, 14 nt, Human
cuccuucaccuuug

SEQ ID NO: 2022216 - RNA, 14 nt, Human
cuccugugugugcg

SEQ ID NO: 2022217 - RNA, 21 nt, Human
cuccugcaggcagccaggcca

SEQ ID NO: 2022218 - RNA, 15 nt, Human
cuccugcaggcagcc

SEQ ID NO: 2022219 - RNA, 22 nt, Human
cuccugcaggcagccaggccac

SEQ ID NO: 2022220 - RNA, 15 nt, Human
cuccugugucuugca

SEQ ID NO: 2022221 - RNA, 11 nt, Human
cuccugccacc

SEQ ID NO: 2022222 - RNA, 23 nt, Human
cuccugugucuugcaauggcagc

SEQ ID NO: 2022223 - RNA, 11 nt, Human
cuccugugugu

SEQ ID NO: 2022224 - RNA, 21 nt, Human
cuccuugaaaacacuguucuc

SEQ ID NO: 2022225 - RNA, 11 nt, Human
cuccuucuucc

SEQ ID NO: 2022226 - RNA, 16 nt, Human
cucgaacuggcugcaa

SEQ ID NO: 2022227 - RNA, 15 nt, Human
cuccuugauauuugu

SEQ ID NO: 2022228 - RNA, 22 nt, Human
cuccuugauauuuguauuuauu

SEQ ID NO: 2022229 - RNA, 14 nt, Human
cuccuucuguccua

SEQ ID NO: 2022230 - RNA, 15 nt, Human
cuccuucuguccuac

SEQ ID NO: 2022231 - RNA, 20 nt, Human
cuccuucuguccuacucugu

SEQ ID NO: 2022232 - RNA, 23 nt, Human
cucggaaccugugagcugcacca

SEQ ID NO: 2022233 - RNA, 21 nt, Human
cucgcuauugucaccagggcu

SEQ ID NO: 2022234 - RNA, 19 nt, Human
cucgcuacauuuccgccac

SEQ ID NO: 2022235 - RNA, 18 nt, Human
cucggacuuagcugggag

SEQ ID NO: 2022236 - RNA, 19 nt, Human
cucggacuuagcugggaga

SEQ ID NO: 2022237 - RNA, 15 nt, Human
cucuaacaguggaca

SEQ ID NO: 2022238 - RNA, 19 nt, Human
cucuaacaguggacaaagu

SEQ ID NO: 2022239 - RNA, 13 nt, Human
cucuaaauucuuu

SEQ ID NO: 2022240 - RNA, 17 nt, Human
cucuaaauucuuucauu

SEQ ID NO: 2022241 - RNA, 22 nt, Human
cucuaaagucuguugauuaaag

SEQ ID NO: 2022242 - RNA, 23 nt, Human
cucggauccccuuccuaccaccc

SEQ ID NO: 2022243 - RNA, 18 nt, Human
cucggaucaggcucccag

SEQ ID NO: 2022244 - RNA, 15 nt, Human
cucggauccccuucc

SEQ ID NO: 2022245 - RNA, 22 nt, Human
cucggccucccaaagugcuggg

SEQ ID NO: 2022246 - RNA, 23 nt, Human
cucggccucccaaagugcuggga

SEQ ID NO: 2022247 - RNA, 20 nt, Human
cucgcccagucccagcagcc

SEQ ID NO: 2022248 - RNA, 18 nt, Human
cucgcccagucccagcag

SEQ ID NO: 2022249 - RNA, 19 nt, Human
cucgcccagucccagcagc

SEQ ID NO: 2022250 - RNA, 14 nt, Human
cucgcccaguccca

SEQ ID NO: 2022251 - RNA, 16 nt, Human
cucgcccagucccagc

SEQ ID NO: 2022252 - RNA, 14 nt, Human
cucgaugcagacag

SEQ ID NO: 2022253 - RNA, 15 nt, Human
cucgcgacaaugcaa

SEQ ID NO: 2022254 - RNA, 19 nt, Human
cucgcuauugucaccaggg

SEQ ID NO: 2022255 - RNA, 13 nt, Human
cucgcgacaaugc

SEQ ID NO: 2022256 - RNA, 19 nt, Human
cucgacauuuuauggaaag

SEQ ID NO: 2022257 - RNA, 20 nt, Human
cucgacacgugggcuccccu

SEQ ID NO: 2022258 - RNA, 22 nt, Human
cucgacacgugggcuccccucu

SEQ ID NO: 2022259 - RNA, 23 nt, Human
cucgacacgugggcuccccucuu

SEQ ID NO: 2022260 - RNA, 16 nt, Human
cucgaguuacagacaa

SEQ ID NO: 2022261 - RNA, 20 nt, Human
cucgaguuacagacaaagcg

SEQ ID NO: 2022262 - RNA, 12 nt, Human
cucgagucugag

SEQ ID NO: 2022263 - RNA, 21 nt, Human
cucgaaguugaucuccccagc

SEQ ID NO: 2022264 - RNA, 18 nt, Human
cucccaucucacacauga

SEQ ID NO: 2022265 - RNA, 15 nt, Human
cucccaucucacaca

SEQ ID NO: 2022266 - RNA, 14 nt, Human
cucccaucucacac

SEQ ID NO: 2022267 - RNA, 14 nt, Human
cucccaucacccgc

SEQ ID NO: 2022268 - RNA, 23 nt, Human
cucccuucccaccucucucacuc

SEQ ID NO: 2022269 - RNA, 10 nt, Human
cucccuuccu

SEQ ID NO: 2022270 - RNA, 12 nt, Human
cucccuucaacc

SEQ ID NO: 2022271 - RNA, 18 nt, Human
cucccuucaaccauuccc

SEQ ID NO: 2022272 - RNA, 19 nt, Human
cucccuucaaccauucccc

SEQ ID NO: 2022273 - RNA, 20 nt, Human
cucccuucaaccauucccca

SEQ ID NO: 2022274 - RNA, 13 nt, Human
cucccuuucaaca

SEQ ID NO: 2022275 - RNA, 20 nt, Human
cucccuuggauuguccccga

SEQ ID NO: 2022276 - RNA, 17 nt, Human
cucccuuggauuguccc

SEQ ID NO: 2022277 - RNA, 17 nt, Human
cucccuuucuucccuac

SEQ ID NO: 2022278 - RNA, 15 nt, Human
cuccuagggcauugu

SEQ ID NO: 2022279 - RNA, 23 nt, Human
cuccuagguagcccccucuuccc

SEQ ID NO: 2022280 - RNA, 23 nt, Human
cuccuaguagggguaccacugaa

SEQ ID NO: 2022281 - RNA, 13 nt, Human
cucccuuccucuu

SEQ ID NO: 2022282 - RNA, 14 nt, Human
cucccuuccucuuu

SEQ ID NO: 2022283 - RNA, 15 nt, Human
cucccuugaccugcu

SEQ ID NO: 2022284 - RNA, 14 nt, Human
cucccuucuguuga

SEQ ID NO: 2022285 - RNA, 17 nt, Human
cucccuugaccugcuga

SEQ ID NO: 2022286 - RNA, 16 nt, Human
cucccuucucuucaca

SEQ ID NO: 2022287 - RNA, 14 nt, Human
cuccugagccccca

SEQ ID NO: 2022288 - RNA, 17 nt, Human
cuccugagcccccagcu

SEQ ID NO: 2022289 - RNA, 19 nt, Human
cuccugagcccccagcuuc

SEQ ID NO: 2022290 - RNA, 20 nt, Human
cuccugagcccccagcuucc

SEQ ID NO: 2022291 - RNA, 21 nt, Human
cuccugagcccccagcuucca

SEQ ID NO: 2022292 - RNA, 22 nt, Human
cuccugagcccccagcuuccag

SEQ ID NO: 2022293 - RNA, 23 nt, Human
cuccugagcccccagcuuccagc

SEQ ID NO: 2022294 - RNA, 14 nt, Human
cuccugcaggcagc

SEQ ID NO: 2022295 - RNA, 13 nt, Human
cuccugcaggcag

SEQ ID NO: 2022296 - RNA, 12 nt, Human
cuccugcaggca

SEQ ID NO: 2022297 - RNA, 22 nt, Human
cuccugaguagcugggauuaca

SEQ ID NO: 2022298 - RNA, 17 nt, Human
cuccugaguagcuggga

SEQ ID NO: 2022299 - RNA, 14 nt, Human
cuccugaccucagg

SEQ ID NO: 2022300 - RNA, 14 nt, Human
cuccugaccuuagg

SEQ ID NO: 2022301 - RNA, 11 nt, Human
cuccugagccc

SEQ ID NO: 2022302 - RNA, 12 nt, Human
cuccugagcccc

SEQ ID NO: 2022303 - RNA, 13 nt, Human
cuccugagccccc

SEQ ID NO: 2022304 - RNA, 15 nt, Human
cuccugacaccccac

SEQ ID NO: 2022305 - RNA, 16 nt, Human
cuccugacaccccacu

SEQ ID NO: 2022306 - RNA, 19 nt, Human
cuccugacaccccacuuag

SEQ ID NO: 2022307 - RNA, 20 nt, Human
cuccugacaccccacuuagc

SEQ ID NO: 2022308 - RNA, 22 nt, Human
cuccucuauccugggcuuuugu

SEQ ID NO: 2022309 - RNA, 19 nt, Human
cuccucuugccacugccuc

SEQ ID NO: 2022310 - RNA, 22 nt, Human
cuccucggcuggcuguccaccc

SEQ ID NO: 2022311 - RNA, 17 nt, Human
cuccucuauccugggcu

SEQ ID NO: 2022312 - RNA, 15 nt, Human
cuccucggcuggcug

SEQ ID NO: 2022313 - RNA, 19 nt, Human
cuccucggcuggcugucca

SEQ ID NO: 2022314 - RNA, 20 nt, Human
cuccucggcuggcuguccac

SEQ ID NO: 2022315 - RNA, 21 nt, Human
cuccucggcuggcuguccacc

SEQ ID NO: 2022316 - RNA, 14 nt, Human
cuccucagaucuuc

SEQ ID NO: 2022317 - RNA, 12 nt, Human
cuccucagaucu

SEQ ID NO: 2022318 - RNA, 21 nt, Human
cuggagaggagcccugccucu

SEQ ID NO: 2022319 - RNA, 23 nt, Human
cuggagaggagcccugccucucc

SEQ ID NO: 2022320 - RNA, 17 nt, Human
cuggagaggagcccugc

SEQ ID NO: 2022321 - RNA, 18 nt, Human
cuggagaggagcccugcc

SEQ ID NO: 2022322 - RNA, 16 nt, Human
cuggagagcccagagu

SEQ ID NO: 2022323 - RNA, 17 nt, Human
cuggagagcccagaguc

SEQ ID NO: 2022324 - RNA, 23 nt, Human
cuggacuagagggaccucuccca

SEQ ID NO: 2022325 - RNA, 21 nt, Human
cuggacuagagggaccucucc

SEQ ID NO: 2022326 - RNA, 20 nt, Human
cuggacuagagggaccucuc

SEQ ID NO: 2022327 - RNA, 16 nt, Human
cuggacucaccucccc

SEQ ID NO: 2022328 - RNA, 20 nt, Human
cuggagcccacuguacuugc

SEQ ID NO: 2022329 - RNA, 17 nt, Human
cuggagcccacuguacu

SEQ ID NO: 2022330 - RNA, 16 nt, Human
cuggagcccacuguac

SEQ ID NO: 2022331 - RNA, 15 nt, Human
cuggagcccacugua

SEQ ID NO: 2022332 - RNA, 13 nt, Human
cuggagcccacug

SEQ ID NO: 2022333 - RNA, 16 nt, Human
cuggagcuagaauuug

SEQ ID NO: 2022334 - RNA, 17 nt, Human
cuggagcuagaauuuga

SEQ ID NO: 2022335 - RNA, 22 nt, Human
cuggagcuagaauuugauaugu

SEQ ID NO: 2022336 - RNA, 21 nt, Human
cuggagcccacuguacuugcu

SEQ ID NO: 2022337 - RNA, 20 nt, Human
cuggaggaccugcccggugg

SEQ ID NO: 2022338 - RNA, 15 nt, Human
cugcuuuccaaagcc

SEQ ID NO: 2022339 - RNA, 17 nt, Human
cugcuuuccaaagccaa

SEQ ID NO: 2022340 - RNA, 14 nt, Human
cugcucuuuggccu

SEQ ID NO: 2022341 - RNA, 12 nt, Human
cugcucugauga

SEQ ID NO: 2022342 - RNA, 15 nt, Human
cugcucuugggcaau

SEQ ID NO: 2022343 - RNA, 19 nt, Human
cugcucuugggcaauauuc

SEQ ID NO: 2022344 - RNA, 21 nt, Human
cugcuuugggcugcccuggug

SEQ ID NO: 2022345 - RNA, 22 nt, Human
cugcuuugggcugcccuggugc

SEQ ID NO: 2022346 - RNA, 23 nt, Human
cugcuuugggcugcccuggugcu

SEQ ID NO: 2022347 - RNA, 14 nt, Human
cugcuuugucuccu

SEQ ID NO: 2022348 - RNA, 17 nt, Human
cugcuuuguugugugcc

SEQ ID NO: 2022349 - RNA, 23 nt, Human
cugcuuuguugugugccucuagc

SEQ ID NO: 2022350 - RNA, 20 nt, Human
cugcuuuguugugugccucu

SEQ ID NO: 2022351 - RNA, 21 nt, Human
cugcuuuguugugugccucua

SEQ ID NO: 2022352 - RNA, 19 nt, Human
cugcuuugggcugcccugg

SEQ ID NO: 2022353 - RNA, 20 nt, Human
cugcuuugggcugcccuggu

SEQ ID NO: 2022354 - RNA, 18 nt, Human
cugcuuugggcugcccug

SEQ ID NO: 2022355 - RNA, 15 nt, Human
cuggaagcacagcuu

SEQ ID NO: 2022356 - RNA, 18 nt, Human
cuggaagcacagcuucau

SEQ ID NO: 2022357 - RNA, 14 nt, Human
cuggaagcagugcc

SEQ ID NO: 2022358 - RNA, 21 nt, Human
cuggaagugcuaauuuugaaa

SEQ ID NO: 2022359 - RNA, 19 nt, Human
cuggaagcagugcccaggu

SEQ ID NO: 2022360 - RNA, 20 nt, Human
cuggaagcagugcccaggug

SEQ ID NO: 2022361 - RNA, 15 nt, Human
cuggaagcagugccc

SEQ ID NO: 2022362 - RNA, 16 nt, Human
cuggaagcagugccca

SEQ ID NO: 2022363 - RNA, 17 nt, Human
cuggaagcagugcccag

SEQ ID NO: 2022364 - RNA, 18 nt, Human
cuggaagcagugcccagg

SEQ ID NO: 2022365 - RNA, 23 nt, Human
cuggaauaauccuaaacauauga

SEQ ID NO: 2022366 - RNA, 14 nt, Human
cuggaaugcagugg

SEQ ID NO: 2022367 - RNA, 15 nt, Human
cuggaaugcaguggu

SEQ ID NO: 2022368 - RNA, 17 nt, Human
cuggauuauauuaugaa

SEQ ID NO: 2022369 - RNA, 23 nt, Human
cuggauuauucaaaaugauguau

SEQ ID NO: 2022370 - RNA, 14 nt, Human
cuggauucagccuu

SEQ ID NO: 2022371 - RNA, 15 nt, Human
cuggauucagccuuc

SEQ ID NO: 2022372 - RNA, 17 nt, Human
cuggauucagccuucuu

SEQ ID NO: 2022373 - RNA, 18 nt, Human
cuggauucagccuucuuu

SEQ ID NO: 2022374 - RNA, 22 nt, Human
cuggauucagccuucuuuuucu

SEQ ID NO: 2022375 - RNA, 13 nt, Human
cuggauuaaacuu

SEQ ID NO: 2022376 - RNA, 23 nt, Human
cuggauuaaacuuaaucuaaaug

SEQ ID NO: 2022377 - RNA, 16 nt, Human
cuggauggggcugcac

SEQ ID NO: 2022378 - RNA, 15 nt, Human
cuggauguaccacca

SEQ ID NO: 2022379 - RNA, 15 nt, Human
cuggauggggcugca

SEQ ID NO: 2022380 - RNA, 21 nt, Human
cuggauggcggaagcugcuac

SEQ ID NO: 2022381 - RNA, 21 nt, Human
cuggauggaggaaaaccaagc

SEQ ID NO: 2022382 - RNA, 15 nt, Human
cuggaggcucaaauu

SEQ ID NO: 2022383 - RNA, 18 nt, Human
cuggaggcucaaauuuug

SEQ ID NO: 2022384 - RNA, 21 nt, Human
cuggaggcucaaauuuugagu

SEQ ID NO: 2022385 - RNA, 17 nt, Human
cuggaggagcugggccc

SEQ ID NO: 2022386 - RNA, 23 nt, Human
cuggcacuauaauguaagcucua

SEQ ID NO: 2022387 - RNA, 14 nt, Human
cuggcacugcuucc

SEQ ID NO: 2022388 - RNA, 13 nt, Human
cuggcacugcuuc

SEQ ID NO: 2022389 - RNA, 17 nt, Human
cuggcacagggcagugg

SEQ ID NO: 2022390 - RNA, 15 nt, Human
cuggcacagccugca

SEQ ID NO: 2022391 - RNA, 13 nt, Human
cuggcacagccug

SEQ ID NO: 2022392 - RNA, 14 nt, Human
cuggcacagccugc

SEQ ID NO: 2022393 - RNA, 12 nt, Human
cuggauuuaacu

SEQ ID NO: 2022394 - RNA, 22 nt, Human
cuggcaauggaugaacugaaag

SEQ ID NO: 2022395 - RNA, 12 nt, Human
cuggcacagccu

SEQ ID NO: 2022396 - RNA, 16 nt, Human
cuggcaaugguaguuu

SEQ ID NO: 2022397 - RNA, 21 nt, Human
cuggcaaugguaguuucugug

SEQ ID NO: 2022398 - RNA, 22 nt, Human
cuggcaaugguaguuucugugg

SEQ ID NO: 2022399 - RNA, 17 nt, Human
cuggccuagcauacgua

SEQ ID NO: 2022400 - RNA, 13 nt, Human
cuggcccacugca

SEQ ID NO: 2022401 - RNA, 12 nt, Human
cuggcccacugc

SEQ ID NO: 2022402 - RNA, 13 nt, Human
cuggccucucacu

SEQ ID NO: 2022403 - RNA, 23 nt, Human
cuggccuagcauacguacacauu

SEQ ID NO: 2022404 - RNA, 19 nt, Human
cuggccucccacagacuca

SEQ ID NO: 2022405 - RNA, 17 nt, Human
cuggccucccacagacu

SEQ ID NO: 2022406 - RNA, 22 nt, Human
cuggccucaagugauucuccug

SEQ ID NO: 2022407 - RNA, 22 nt, Human
cuggccagaugcaccagcccuu

SEQ ID NO: 2022408 - RNA, 21 nt, Human
cuggccagaugcaccagcccu

SEQ ID NO: 2022409 - RNA, 17 nt, Human
cuggccagaugcaccag

SEQ ID NO: 2022410 - RNA, 18 nt, Human
cuggccagaugcaccagc

SEQ ID NO: 2022411 - RNA, 19 nt, Human
cuggccagaugcaccagcc

SEQ ID NO: 2022412 - RNA, 20 nt, Human
cuggccagaugcaccagccc

SEQ ID NO: 2022413 - RNA, 16 nt, Human
cuggccaacgggguga

SEQ ID NO: 2022414 - RNA, 16 nt, Human
cuggccagaugcacca

SEQ ID NO: 2022415 - RNA, 16 nt, Human
cuggcacugcuuccag

SEQ ID NO: 2022416 - RNA, 15 nt, Human
cuggcacugcuucca

SEQ ID NO: 2022417 - RNA, 17 nt, Human
cuggcacugcuuccagu

SEQ ID NO: 2022418 - RNA, 20 nt, Human
cugggguggggauagggagc

SEQ ID NO: 2022419 - RNA, 13 nt, Human
cuggguagcugua

SEQ ID NO: 2022420 - RNA, 14 nt, Human
cuggguagcuguaa

SEQ ID NO: 2022421 - RNA, 15 nt, Human
cuggguagcuguaag

SEQ ID NO: 2022422 - RNA, 21 nt, Human
cuggguacuuguggacacagc

SEQ ID NO: 2022423 - RNA, 23 nt, Human
cuggguacuuguggacacagcuc

SEQ ID NO: 2022424 - RNA, 22 nt, Human
cugggguggggaccucaggccu

SEQ ID NO: 2022425 - RNA, 21 nt, Human
cugggguggggaccucaggcc

SEQ ID NO: 2022426 - RNA, 23 nt, Human
cugggguggggaccucaggccug

SEQ ID NO: 2022427 - RNA, 20 nt, Human
cuggguacuuguggacacag

SEQ ID NO: 2022428 - RNA, 19 nt, Human
cugggguggggaccucagg

SEQ ID NO: 2022429 - RNA, 18 nt, Human
cugggguggggaccucag

SEQ ID NO: 2022430 - RNA, 17 nt, Human
cugggguggggaccuca

SEQ ID NO: 2022431 - RNA, 13 nt, Human
cugggggccucag

SEQ ID NO: 2022432 - RNA, 17 nt, Human
cugggggccucagugcc

SEQ ID NO: 2022433 - RNA, 18 nt, Human
cugggggccucagugcca

SEQ ID NO: 2022434 - RNA, 18 nt, Human
cugggcuucaguggcagc

SEQ ID NO: 2022435 - RNA, 17 nt, Human
cugggcuucaguggcag

SEQ ID NO: 2022436 - RNA, 19 nt, Human
cugggcuucaguggcagcu

SEQ ID NO: 2022437 - RNA, 20 nt, Human
cugggcuucaguggcagcug

SEQ ID NO: 2022438 - RNA, 21 nt, Human
cugggcuucaguggcagcugc

SEQ ID NO: 2022439 - RNA, 22 nt, Human
cugggcuucaguggcagcugcu

SEQ ID NO: 2022440 - RNA, 13 nt, Human
cugggcuugggga

SEQ ID NO: 2022441 - RNA, 23 nt, Human
cugggcuucaguggcagcugcuu

SEQ ID NO: 2022442 - RNA, 20 nt, Human
cugggcuuggggaccagagc

SEQ ID NO: 2022443 - RNA, 17 nt, Human
cugggcuuggggaccag

SEQ ID NO: 2022444 - RNA, 21 nt, Human
cugggcuuggggaccagagcu

SEQ ID NO: 2022445 - RNA, 19 nt, Human
cugggcucccguguaucug

SEQ ID NO: 2022446 - RNA, 17 nt, Human
cugguccauagagagca

SEQ ID NO: 2022447 - RNA, 15 nt, Human
cugguccauagagag

SEQ ID NO: 2022448 - RNA, 13 nt, Human
cuggguuggaggg

SEQ ID NO: 2022449 - RNA, 13 nt, Human
cuggguuggaaaa

SEQ ID NO: 2022450 - RNA, 18 nt, Human
cuggguuggaaaacagua

SEQ ID NO: 2022451 - RNA, 19 nt, Human
cuggguucuacccaggugc

SEQ ID NO: 2022452 - RNA, 18 nt, Human
cugguccauagagagcaa

SEQ ID NO: 2022453 - RNA, 15 nt, Human
cuggucccacucagu

SEQ ID NO: 2022454 - RNA, 18 nt, Human
cuggucccacucagucca

SEQ ID NO: 2022455 - RNA, 14 nt, Human
cuggucgccuucca

SEQ ID NO: 2022456 - RNA, 19 nt, Human
cugguggcagugggagcug

SEQ ID NO: 2022457 - RNA, 23 nt, Human
cugguggcagugggagcugccug

SEQ ID NO: 2022458 - RNA, 19 nt, Human
cuggucuauaccuuaagaa

SEQ ID NO: 2022459 - RNA, 21 nt, Human
cuggucguaaacaucucagag

SEQ ID NO: 2022460 - RNA, 22 nt, Human
cuggucguaaacaucucagaga

SEQ ID NO: 2022461 - RNA, 15 nt, Human
cuggucgccuuccac

SEQ ID NO: 2022462 - RNA, 20 nt, Human
cuggucguaaacaucucaga

SEQ ID NO: 2022463 - RNA, 19 nt, Human
cuggcuugaauuggugaca

SEQ ID NO: 2022464 - RNA, 15 nt, Human
cuggcuuuucacugc

SEQ ID NO: 2022465 - RNA, 16 nt, Human
cuggcuuuucacugcu

SEQ ID NO: 2022466 - RNA, 19 nt, Human
cugggaacaccauagguca

SEQ ID NO: 2022467 - RNA, 17 nt, Human
cuggcuuuucacugcug

SEQ ID NO: 2022468 - RNA, 19 nt, Human
cuggcuuuucacugcuggc

SEQ ID NO: 2022469 - RNA, 20 nt, Human
cuggcuuuucacugcuggcu

SEQ ID NO: 2022470 - RNA, 22 nt, Human
cuggcuuuucacugcuggcugc

SEQ ID NO: 2022471 - RNA, 20 nt, Human
cuggcuguuggcugggggcc

SEQ ID NO: 2022472 - RNA, 18 nt, Human
cuggcuuacacuggcaau

SEQ ID NO: 2022473 - RNA, 14 nt, Human
cuggcuucacagau

SEQ ID NO: 2022474 - RNA, 14 nt, Human
cuggcuuacacugg

SEQ ID NO: 2022475 - RNA, 21 nt, Human
cuggcuggguggcaccagcag

SEQ ID NO: 2022476 - RNA, 22 nt, Human
cuggcuggguggcaccagcagc

SEQ ID NO: 2022477 - RNA, 19 nt, Human
cuggcuguuggcugggggc

SEQ ID NO: 2022478 - RNA, 19 nt, Human
cuggcucuuccaggcuggg

SEQ ID NO: 2022479 - RNA, 18 nt, Human
cuggcucuuccaggcugg

SEQ ID NO: 2022480 - RNA, 20 nt, Human
cuggcucuuccaggcuggga

SEQ ID NO: 2022481 - RNA, 13 nt, Human
cuggccugagcug

SEQ ID NO: 2022482 - RNA, 17 nt, Human
cuggcucuuccaggcug

SEQ ID NO: 2022483 - RNA, 15 nt, Human
cuggccucuucuaga

SEQ ID NO: 2022484 - RNA, 21 nt, Human
cuggccugaaccacaggagag

SEQ ID NO: 2022485 - RNA, 19 nt, Human
cuggccugagaggggaagc

SEQ ID NO: 2022486 - RNA, 14 nt, Human
cuggcugccuuaga

SEQ ID NO: 2022487 - RNA, 19 nt, Human
cuggcugccuuagaaccuu

SEQ ID NO: 2022488 - RNA, 12 nt, Human
cuggcugcgggg

SEQ ID NO: 2022489 - RNA, 18 nt, Human
cuggcugcggggcgggca

SEQ ID NO: 2022490 - RNA, 15 nt, Human
cuggcugggacuggg

SEQ ID NO: 2022491 - RNA, 17 nt, Human
cuggcugggacugggaa

SEQ ID NO: 2022492 - RNA, 16 nt, Human
cugggagcuuuuguag

SEQ ID NO: 2022493 - RNA, 14 nt, Human
cugggagcucugca

SEQ ID NO: 2022494 - RNA, 15 nt, Human
cugggagcucugcag

SEQ ID NO: 2022495 - RNA, 13 nt, Human
cugggagcucugc

SEQ ID NO: 2022496 - RNA, 15 nt, Human
cugggaacagaacuc

SEQ ID NO: 2022497 - RNA, 14 nt, Human
cugggaacagaacu

SEQ ID NO: 2022498 - RNA, 16 nt, Human
cugggaggcucuggag

SEQ ID NO: 2022499 - RNA, 15 nt, Human
cugggaggcucugga

SEQ ID NO: 2022500 - RNA, 14 nt, Human
cugggaggcaguga

SEQ ID NO: 2022501 - RNA, 16 nt, Human
cugggaggcagugaug

SEQ ID NO: 2022502 - RNA, 18 nt, Human
cugggaggucaaggcugc

SEQ ID NO: 2022503 - RNA, 22 nt, Human
cugggaggcucuggagcccacu

SEQ ID NO: 2022504 - RNA, 16 nt, Human
cugggagugagcuggu

SEQ ID NO: 2022505 - RNA, 13 nt, Human
cugggagugagcu

SEQ ID NO: 2022506 - RNA, 12 nt, Human
cugggagugagc

SEQ ID NO: 2022507 - RNA, 19 nt, Human
cugggauuacaggcuccug

SEQ ID NO: 2022508 - RNA, 20 nt, Human
cugggauuacaggcuccugc

SEQ ID NO: 2022509 - RNA, 21 nt, Human
cugggauuacaggcgugagcc

SEQ ID NO: 2022510 - RNA, 17 nt, Human
cugggauaggggcagag

SEQ ID NO: 2022511 - RNA, 21 nt, Human
cugggauuacaggcuccugcc

SEQ ID NO: 2022512 - RNA, 22 nt, Human
cugggauuacaggcuccugcca

SEQ ID NO: 2022513 - RNA, 23 nt, Human
cugggauuacaggcuccugccac

SEQ ID NO: 2022514 - RNA, 20 nt, Human
cugggcaaugugauaaaacc

SEQ ID NO: 2022515 - RNA, 10 nt, Human
cugggccccu

SEQ ID NO: 2022516 - RNA, 14 nt, Human
cugggcacacgcug

SEQ ID NO: 2022517 - RNA, 15 nt, Human
cugggcacacgcugc

SEQ ID NO: 2022518 - RNA, 16 nt, Human
cugggcacacgcugcu

SEQ ID NO: 2022519 - RNA, 18 nt, Human
cugggcacacgcugcucu

SEQ ID NO: 2022520 - RNA, 20 nt, Human
cugggcacacgcugcucugc

SEQ ID NO: 2022521 - RNA, 21 nt, Human
cugggcacacgcugcucugcc

SEQ ID NO: 2022522 - RNA, 17 nt, Human
cugggccccugccucuc

SEQ ID NO: 2022523 - RNA, 16 nt, Human
cugggccccugccucu

SEQ ID NO: 2022524 - RNA, 12 nt, Human
cugggccccugc

SEQ ID NO: 2022525 - RNA, 22 nt, Human
cugggcacacgcugcucugccc

SEQ ID NO: 2022526 - RNA, 14 nt, Human
cugagggcuuguag

SEQ ID NO: 2022527 - RNA, 17 nt, Human
cugagggcuuguaguuc

SEQ ID NO: 2022528 - RNA, 20 nt, Human
cugagggcuuguaguucuuu

SEQ ID NO: 2022529 - RNA, 14 nt, Human
cugaggggagacag

SEQ ID NO: 2022530 - RNA, 13 nt, Human
cugaguccgaccu

SEQ ID NO: 2022531 - RNA, 15 nt, Human
cugaggggagacaga

SEQ ID NO: 2022532 - RNA, 17 nt, Human
cugaggggagacagagc

SEQ ID NO: 2022533 - RNA, 16 nt, Human
cugagucugaaggcug

SEQ ID NO: 2022534 - RNA, 15 nt, Human
cugagucugaaggcu

SEQ ID NO: 2022535 - RNA, 14 nt, Human
cugagucugaaggc

SEQ ID NO: 2022536 - RNA, 13 nt, Human
cugagucugaagg

SEQ ID NO: 2022537 - RNA, 15 nt, Human
cugagugagagggga

SEQ ID NO: 2022538 - RNA, 16 nt, Human
cugagugagaggggag

SEQ ID NO: 2022539 - RNA, 20 nt, Human
cugagugagaggggaggcca

SEQ ID NO: 2022540 - RNA, 13 nt, Human
cugagugcaggcc

SEQ ID NO: 2022541 - RNA, 14 nt, Human
cugagugcaggccc

SEQ ID NO: 2022542 - RNA, 15 nt, Human
cugagugcaggccca

SEQ ID NO: 2022543 - RNA, 16 nt, Human
cugagugcaggcccac

SEQ ID NO: 2022544 - RNA, 17 nt, Human
cugagugcaggcccacc

SEQ ID NO: 2022545 - RNA, 20 nt, Human
cugagugcaggcccacccug

SEQ ID NO: 2022546 - RNA, 14 nt, Human
cugagugccuuuug

SEQ ID NO: 2022547 - RNA, 21 nt, Human
cugagugcaggcccacccugc

SEQ ID NO: 2022548 - RNA, 15 nt, Human
cugagugccuuuugg

SEQ ID NO: 2022549 - RNA, 16 nt, Human
cugagugccuuuuggu

SEQ ID NO: 2022550 - RNA, 22 nt, Human
cugagugggggaucacagccuc

SEQ ID NO: 2022551 - RNA, 13 nt, Human
cugauaaagauga

SEQ ID NO: 2022552 - RNA, 20 nt, Human
cugauccagcccugaguucc

SEQ ID NO: 2022553 - RNA, 21 nt, Human
cugauaaagaugagugagcau

SEQ ID NO: 2022554 - RNA, 19 nt, Human
cugauagcauaugacaaau

SEQ ID NO: 2022555 - RNA, 15 nt, Human
cugauacuuuuuuga

SEQ ID NO: 2022556 - RNA, 16 nt, Human
cugauacuuuuuugaa

SEQ ID NO: 2022557 - RNA, 22 nt, Human
cugauagcauaugacaaauguu

SEQ ID NO: 2022558 - RNA, 17 nt, Human
cugauagccccucuccc

SEQ ID NO: 2022559 - RNA, 14 nt, Human
cugaucucucguga

SEQ ID NO: 2022560 - RNA, 17 nt, Human
cugauguauuuugugag

SEQ ID NO: 2022561 - RNA, 20 nt, Human
cugauguguccucagggagc

SEQ ID NO: 2022562 - RNA, 16 nt, Human
cugauguguugccacu

SEQ ID NO: 2022563 - RNA, 16 nt, Human
cugauguucccuccgg

SEQ ID NO: 2022564 - RNA, 17 nt, Human
cugauguucccuccggu

SEQ ID NO: 2022565 - RNA, 13 nt, Human
cugauguuugugc

SEQ ID NO: 2022566 - RNA, 22 nt, Human
cugauuaguaagucuugccuau

SEQ ID NO: 2022567 - RNA, 22 nt, Human
cugauucccaagcucugcuccu

SEQ ID NO: 2022568 - RNA, 19 nt, Human
cugauucccaagcucugcu

SEQ ID NO: 2022569 - RNA, 20 nt, Human
cugauucccaagcucugcuc

SEQ ID NO: 2022570 - RNA, 17 nt, Human
cugauucccaagcucug

SEQ ID NO: 2022571 - RNA, 18 nt, Human
cugauucccaagcucugc

SEQ ID NO: 2022572 - RNA, 15 nt, Human
cugauucccaagcuc

SEQ ID NO: 2022573 - RNA, 21 nt, Human
cugcacaaagcccuuccaugu

SEQ ID NO: 2022574 - RNA, 18 nt, Human
cugcacaaagcccuucca

SEQ ID NO: 2022575 - RNA, 20 nt, Human
cugcacaaagcccuuccaug

SEQ ID NO: 2022576 - RNA, 13 nt, Human
cugcacaaagccc

SEQ ID NO: 2022577 - RNA, 22 nt, Human
cugcaccagguagaacgccagg

SEQ ID NO: 2022578 - RNA, 21 nt, Human
cugcacagugcaucucagccc

SEQ ID NO: 2022579 - RNA, 18 nt, Human
cugcacccucaggcaggu

SEQ ID NO: 2022580 - RNA, 17 nt, Human
cugcacccucaggcagg

SEQ ID NO: 2022581 - RNA, 16 nt, Human
cugcacaagcugcacc

SEQ ID NO: 2022582 - RNA, 15 nt, Human
cugcacaagcugcac

SEQ ID NO: 2022583 - RNA, 14 nt, Human
cugcacaagcugca

SEQ ID NO: 2022584 - RNA, 13 nt, Human
cugcacaagcugc

SEQ ID NO: 2022585 - RNA, 18 nt, Human
cugcacaagcugcacccu

SEQ ID NO: 2022586 - RNA, 18 nt, Human
cugcacagugcaucucag

SEQ ID NO: 2022587 - RNA, 20 nt, Human
cugcaccggcuggccuggcc

SEQ ID NO: 2022588 - RNA, 19 nt, Human
cugcaccggcuggccuggc

SEQ ID NO: 2022589 - RNA, 18 nt, Human
cugcaccggcuggccugg

SEQ ID NO: 2022590 - RNA, 17 nt, Human
cugcaccggcuggccug

SEQ ID NO: 2022591 - RNA, 14 nt, Human
cugcacuugcagac

SEQ ID NO: 2022592 - RNA, 16 nt, Human
cugcacuugcagacuc

SEQ ID NO: 2022593 - RNA, 17 nt, Human
cugcacuugcagacucu

SEQ ID NO: 2022594 - RNA, 12 nt, Human
cugcagagcugc

SEQ ID NO: 2022595 - RNA, 21 nt, Human
cugcagagcugcgggcugggu

SEQ ID NO: 2022596 - RNA, 23 nt, Human
cugcagagcugcgggcugggugu

SEQ ID NO: 2022597 - RNA, 21 nt, Human
cugcagagcaguaagggaaca

SEQ ID NO: 2022598 - RNA, 21 nt, Human
cugcagagcagugggccuggc

SEQ ID NO: 2022599 - RNA, 23 nt, Human
cugcagagcagugggccuggcca

SEQ ID NO: 2022600 - RNA, 18 nt, Human
cugcagagcagugggccu

SEQ ID NO: 2022601 - RNA, 20 nt, Human
cugcagagcaggaaacauga

SEQ ID NO: 2022602 - RNA, 13 nt, Human
cugcagaagacag

SEQ ID NO: 2022603 - RNA, 20 nt, Human
cugcagaacagcuucauguu

SEQ ID NO: 2022604 - RNA, 23 nt, Human
cugcagaagacaguauggcagcu

SEQ ID NO: 2022605 - RNA, 15 nt, Human
cugcagccaggccac

SEQ ID NO: 2022606 - RNA, 20 nt, Human
cugcagauacuacugaccag

SEQ ID NO: 2022607 - RNA, 21 nt, Human
cugcagauacuacugaccaga

SEQ ID NO: 2022608 - RNA, 16 nt, Human
cugcagccaggccacu

SEQ ID NO: 2022609 - RNA, 17 nt, Human
cugcagccaggccacug

SEQ ID NO: 2022610 - RNA, 22 nt, Human
cugcagccaggccacuggcccc

SEQ ID NO: 2022611 - RNA, 23 nt, Human
cugcagccaggccacuggccccu

SEQ ID NO: 2022612 - RNA, 11 nt, Human
cugcagccuca

SEQ ID NO: 2022613 - RNA, 22 nt, Human
cugcagccucaaccuccugggc

SEQ ID NO: 2022614 - RNA, 19 nt, Human
cugcagccucaaccuccug

SEQ ID NO: 2022615 - RNA, 20 nt, Human
cugcagccucaaccuccugg

SEQ ID NO: 2022616 - RNA, 22 nt, Human
cugcagggaguccgaaagggac

SEQ ID NO: 2022617 - RNA, 16 nt, Human
cugcagggccaagcac

SEQ ID NO: 2022618 - RNA, 15 nt, Human
cugcagggacugcca

SEQ ID NO: 2022619 - RNA, 17 nt, Human
cugcagggacugccagu

SEQ ID NO: 2022620 - RNA, 14 nt, Human
cugccucuucucua

SEQ ID NO: 2022621 - RNA, 23 nt, Human
cugccugaagucacacagugagu

SEQ ID NO: 2022622 - RNA, 13 nt, Human
cugccucuucucu

SEQ ID NO: 2022623 - RNA, 12 nt, Human
cugccucuuccu

SEQ ID NO: 2022624 - RNA, 14 nt, Human
cugccucucugcag

SEQ ID NO: 2022625 - RNA, 19 nt, Human
cugccucuccgccccugag

SEQ ID NO: 2022626 - RNA, 21 nt, Human
cugccucuccgccccugagcc

SEQ ID NO: 2022627 - RNA, 22 nt, Human
cugccucuccgccccugagccc

SEQ ID NO: 2022628 - RNA, 23 nt, Human
cugccucuccgccccugagccca

SEQ ID NO: 2022629 - RNA, 13 nt, Human
cugccucucugca

SEQ ID NO: 2022630 - RNA, 12 nt, Human
cugccucucugc

SEQ ID NO: 2022631 - RNA, 13 nt, Human
cugccugcccagg

SEQ ID NO: 2022632 - RNA, 14 nt, Human
cugccugcccaggc

SEQ ID NO: 2022633 - RNA, 15 nt, Human
cugccugcccaggcc

SEQ ID NO: 2022634 - RNA, 23 nt, Human
cugccugaggggcagccugccuu

SEQ ID NO: 2022635 - RNA, 20 nt, Human
cugccugaggggcagccugc

SEQ ID NO: 2022636 - RNA, 22 nt, Human
cugccugaggggcagccugccu

SEQ ID NO: 2022637 - RNA, 20 nt, Human
cugccugacagagggaugga

SEQ ID NO: 2022638 - RNA, 15 nt, Human
cugccuaagugcagc

SEQ ID NO: 2022639 - RNA, 13 nt, Human
cugccuauuuuaa

SEQ ID NO: 2022640 - RNA, 12 nt, Human
cugcccugggag

SEQ ID NO: 2022641 - RNA, 13 nt, Human
cugcccugggagg

SEQ ID NO: 2022642 - RNA, 11 nt, Human
cugcccuggga

SEQ ID NO: 2022643 - RNA, 15 nt, Human
cugcccugggaggca

SEQ ID NO: 2022644 - RNA, 22 nt, Human
cugcccugggaggcagugaugg

SEQ ID NO: 2022645 - RNA, 14 nt, Human
cugccucuccgccc

SEQ ID NO: 2022646 - RNA, 22 nt, Human
cugccucaggaggcaggaccuu

SEQ ID NO: 2022647 - RNA, 23 nt, Human
cugccucaggaggcaggaccuuc

SEQ ID NO: 2022648 - RNA, 14 nt, Human
cugccucagccucc

SEQ ID NO: 2022649 - RNA, 13 nt, Human
cugccucagccuc

SEQ ID NO: 2022650 - RNA, 20 nt, Human
cugcggaaugaaccacaucu

SEQ ID NO: 2022651 - RNA, 13 nt, Human
cugccuuaaguga

SEQ ID NO: 2022652 - RNA, 16 nt, Human
cugccuuaagugagga

SEQ ID NO: 2022653 - RNA, 15 nt, Human
cugcgguccacccag

SEQ ID NO: 2022654 - RNA, 21 nt, Human
cugcggaaugaaccacaucuu

SEQ ID NO: 2022655 - RNA, 17 nt, Human
cugcgguccacccagga

SEQ ID NO: 2022656 - RNA, 16 nt, Human
cugcgguccacccagg

SEQ ID NO: 2022657 - RNA, 16 nt, Human
cugcguguucucagag

SEQ ID NO: 2022658 - RNA, 17 nt, Human
cugcguguucucagagg

SEQ ID NO: 2022659 - RNA, 14 nt, Human
cugcuccagcuguu

SEQ ID NO: 2022660 - RNA, 22 nt, Human
cugcuaaauugauguugaugca

SEQ ID NO: 2022661 - RNA, 14 nt, Human
cugcuaaauugaug

SEQ ID NO: 2022662 - RNA, 17 nt, Human
cugcuaaauugauguug

SEQ ID NO: 2022663 - RNA, 18 nt, Human
cugcuaaauugauguuga

SEQ ID NO: 2022664 - RNA, 19 nt, Human
cugcuaaauugauguugau

SEQ ID NO: 2022665 - RNA, 22 nt, Human
cugcuaaggauuagucccuggc

SEQ ID NO: 2022666 - RNA, 18 nt, Human
cugcuccucuccccagca

SEQ ID NO: 2022667 - RNA, 16 nt, Human
cugcuccugagccccc

SEQ ID NO: 2022668 - RNA, 17 nt, Human
cugcuccugagccccca

SEQ ID NO: 2022669 - RNA, 18 nt, Human
cugcuccugagcccccag

SEQ ID NO: 2022670 - RNA, 20 nt, Human
cugcuccugagcccccagcu

SEQ ID NO: 2022671 - RNA, 16 nt, Human
cugcuccuucccuugc

SEQ ID NO: 2022672 - RNA, 17 nt, Human
cugcuccuucccuugcu

SEQ ID NO: 2022673 - RNA, 14 nt, Human
cugcuccuucccuu

SEQ ID NO: 2022674 - RNA, 15 nt, Human
cugcuccuguggccu

SEQ ID NO: 2022675 - RNA, 12 nt, Human
cugcuccuuccc

SEQ ID NO: 2022676 - RNA, 11 nt, Human
cugcucugacg

SEQ ID NO: 2022677 - RNA, 16 nt, Human
cugcuccucuccccag

SEQ ID NO: 2022678 - RNA, 17 nt, Human
cugcuccucuccccagc

SEQ ID NO: 2022679 - RNA, 14 nt, Human
cugcuccagcucug

SEQ ID NO: 2022680 - RNA, 19 nt, Human
cugcuccagcucuggcaug

SEQ ID NO: 2022681 - RNA, 17 nt, Human
cugcucccccuuuuccc

SEQ ID NO: 2022682 - RNA, 15 nt, Human
cugcuccagcuguuc

SEQ ID NO: 2022683 - RNA, 19 nt, Human
cugcuccccuaaagccuca

SEQ ID NO: 2022684 - RNA, 18 nt, Human
cugcucccccuuuucccu

SEQ ID NO: 2022685 - RNA, 19 nt, Human
cugcucccccuuuucccuc

SEQ ID NO: 2022686 - RNA, 22 nt, Human
cugcucccuccgggucuuccua

SEQ ID NO: 2022687 - RNA, 16 nt, Human
cugcccugcccaccug

SEQ ID NO: 2022688 - RNA, 15 nt, Human
cugcccugcccaccu

SEQ ID NO: 2022689 - RNA, 14 nt, Human
cugcccugcccacc

SEQ ID NO: 2022690 - RNA, 13 nt, Human
cugcccugcccac

SEQ ID NO: 2022691 - RNA, 22 nt, Human
cugcccuccacacccgcgcccc

SEQ ID NO: 2022692 - RNA, 11 nt, Human
cugcccggcug

SEQ ID NO: 2022693 - RNA, 23 nt, Human
cugccccugcuacugccaaccuc

SEQ ID NO: 2022694 - RNA, 19 nt, Human
cugcccuccaagaccuucu

SEQ ID NO: 2022695 - RNA, 15 nt, Human
cugcccggcugcgga

SEQ ID NO: 2022696 - RNA, 17 nt, Human
cugccccuggcagcccc

SEQ ID NO: 2022697 - RNA, 16 nt, Human
cugccccuggcagccc

SEQ ID NO: 2022698 - RNA, 15 nt, Human
cugccccuggcagcc

SEQ ID NO: 2022699 - RNA, 14 nt, Human
cugccccuggcagc

SEQ ID NO: 2022700 - RNA, 19 nt, Human
cugcccaggccugccuguu

SEQ ID NO: 2022701 - RNA, 18 nt, Human
cugcccaggccugccugu

SEQ ID NO: 2022702 - RNA, 13 nt, Human
cugcccaggcccc

SEQ ID NO: 2022703 - RNA, 19 nt, Human
cugcccaaccugcucuccu

SEQ ID NO: 2022704 - RNA, 20 nt, Human
cugcccagcuuuucauugcu

SEQ ID NO: 2022705 - RNA, 17 nt, Human
cugcccaaccugcucuc

SEQ ID NO: 2022706 - RNA, 16 nt, Human
cugccauuucugagau

SEQ ID NO: 2022707 - RNA, 23 nt, Human
cugccaugccaggaaccuguccu

SEQ ID NO: 2022708 - RNA, 19 nt, Human
cugccaggaagccagcagg

SEQ ID NO: 2022709 - RNA, 18 nt, Human
cugccaggaagccagcag

SEQ ID NO: 2022710 - RNA, 16 nt, Human
cugccaggaagccagc

SEQ ID NO: 2022711 - RNA, 15 nt, Human
cugccaggaagccag

SEQ ID NO: 2022712 - RNA, 19 nt, Human
cugccagccgagauagcca

SEQ ID NO: 2022713 - RNA, 19 nt, Human
cugccaugccagcuuaucu

SEQ ID NO: 2022714 - RNA, 22 nt, Human
cugccaggcacaggcagggcag

SEQ ID NO: 2022715 - RNA, 14 nt, Human
cugccaugccagga

SEQ ID NO: 2022716 - RNA, 16 nt, Human
cugccaugccaggaac

SEQ ID NO: 2022717 - RNA, 17 nt, Human
cugccaugccaggaacc

SEQ ID NO: 2022718 - RNA, 18 nt, Human
cugccaugccaggaaccu

SEQ ID NO: 2022719 - RNA, 22 nt, Human
cugccaugccaggaaccugucc

SEQ ID NO: 2022720 - RNA, 17 nt, Human
cugccaugccagcuuau

SEQ ID NO: 2022721 - RNA, 18 nt, Human
cugccaggcacaggcagg

SEQ ID NO: 2022722 - RNA, 19 nt, Human
cugccaggcacaggcaggg

SEQ ID NO: 2022723 - RNA, 20 nt, Human
cugccaggcacaggcagggc

SEQ ID NO: 2022724 - RNA, 21 nt, Human
cugccaggcacaggcagggca

SEQ ID NO: 2022725 - RNA, 13 nt, Human
cugccaggcacag

SEQ ID NO: 2022726 - RNA, 14 nt, Human
cugccaggcacagg

SEQ ID NO: 2022727 - RNA, 15 nt, Human
cugccaggcacaggc

SEQ ID NO: 2022728 - RNA, 16 nt, Human
cugccaggcacaggca

SEQ ID NO: 2022729 - RNA, 17 nt, Human
cugccaggcacaggcag

SEQ ID NO: 2022730 - RNA, 15 nt, Human
cugccacccugggga

SEQ ID NO: 2022731 - RNA, 16 nt, Human
cugccacccuggggag

SEQ ID NO: 2022732 - RNA, 20 nt, Human
cugccacccuggggagaaag

SEQ ID NO: 2022733 - RNA, 18 nt, Human
cugcagggcuuuaaaauu

SEQ ID NO: 2022734 - RNA, 19 nt, Human
cugcagggcuuuaaaauuc

SEQ ID NO: 2022735 - RNA, 13 nt, Human
cugccacacuuca

SEQ ID NO: 2022736 - RNA, 17 nt, Human
cugccacacuucaggcu

SEQ ID NO: 2022737 - RNA, 22 nt, Human
cugccacacuucaggcucuucu

SEQ ID NO: 2022738 - RNA, 19 nt, Human
cugccaccacgcccggcua

SEQ ID NO: 2022739 - RNA, 17 nt, Human
ccucaccuuucccaucu

SEQ ID NO: 2022740 - RNA, 16 nt, Human
ccucacgugcaaagcc

SEQ ID NO: 2022741 - RNA, 12 nt, Human
ccucaccccacu

SEQ ID NO: 2022742 - RNA, 22 nt, Human
ccucacaguccuuaccagcaga

SEQ ID NO: 2022743 - RNA, 20 nt, Human
ccucacaguccuuaccagca

SEQ ID NO: 2022744 - RNA, 15 nt, Human
ccucaccccacugug

SEQ ID NO: 2022745 - RNA, 19 nt, Human
ccuauguagacaauauaag

SEQ ID NO: 2022746 - RNA, 15 nt, Human
ccucacaggccccag

SEQ ID NO: 2022747 - RNA, 17 nt, Human
ccucacaguccuuacca

SEQ ID NO: 2022748 - RNA, 12 nt, Human
ccucaauuucaa

SEQ ID NO: 2022749 - RNA, 19 nt, Human
ccuaucaaaaagauaucaa

SEQ ID NO: 2022750 - RNA, 14 nt, Human
ccuauauuuuccug

SEQ ID NO: 2022751 - RNA, 16 nt, Human
ccuaucaaaaagauau

SEQ ID NO: 2022752 - RNA, 21 nt, Human
ccuagagagugugauguucac

SEQ ID NO: 2022753 - RNA, 17 nt, Human
ccuaucagaaguuucuc

SEQ ID NO: 2022754 - RNA, 23 nt, Human
ccgcuuucuacccagcgagcccu

SEQ ID NO: 2022755 - RNA, 22 nt, Human
ccgggaggcagagguugcagug

SEQ ID NO: 2022756 - RNA, 13 nt, Human
ccggcuggccugg

SEQ ID NO: 2022757 - RNA, 15 nt, Human
ccgggcacucagaag

SEQ ID NO: 2022758 - RNA, 12 nt, Human
ccggcuggccug

SEQ ID NO: 2022759 - RNA, 12 nt, Human
ccggcugcccuu

SEQ ID NO: 2022760 - RNA, 20 nt, Human
ccgggcacucagaagacacu

SEQ ID NO: 2022761 - RNA, 16 nt, Human
ccgggaugggagccgg

SEQ ID NO: 2022762 - RNA, 17 nt, Human
ccgggcaaacuggccgc

SEQ ID NO: 2022763 - RNA, 19 nt, Human
ccgggccuggagaacuaga

SEQ ID NO: 2022764 - RNA, 14 nt, Human
ccgugccuucagcu

SEQ ID NO: 2022765 - RNA, 15 nt, Human
ccgugccuucagcuc

SEQ ID NO: 2022766 - RNA, 16 nt, Human
ccgugccuucagcucu

SEQ ID NO: 2022767 - RNA, 17 nt, Human
ccgugccuucagcucua

SEQ ID NO: 2022768 - RNA, 21 nt, Human
ccuaaaccaaaaacugaaagu

SEQ ID NO: 2022769 - RNA, 11 nt, Human
ccuaaaaauaa

SEQ ID NO: 2022770 - RNA, 12 nt, Human
ccuaaaaauaaa

SEQ ID NO: 2022771 - RNA, 14 nt, Human
ccuaaaaauaaagc

SEQ ID NO: 2022772 - RNA, 15 nt, Human
ccuaaaaauaaagca

SEQ ID NO: 2022773 - RNA, 13 nt, Human
ccuaaaaauuggu

SEQ ID NO: 2022774 - RNA, 21 nt, Human
ccguuugauuugucacugcuu

SEQ ID NO: 2022775 - RNA, 23 nt, Human
ccguuugauuugucacugcuuca

SEQ ID NO: 2022776 - RNA, 15 nt, Human
ccguggcuucccgcu

SEQ ID NO: 2022777 - RNA, 21 nt, Human
ccguggcuucccgcucagccc

SEQ ID NO: 2022778 - RNA, 23 nt, Human
ccguggcuucccgcucagcccuc

SEQ ID NO: 2022779 - RNA, 13 nt, Human
ccuaauuccacag

SEQ ID NO: 2022780 - RNA, 16 nt, Human
ccuaaagauuuugauc

SEQ ID NO: 2022781 - RNA, 13 nt, Human
ccuaaagccucaa

SEQ ID NO: 2022782 - RNA, 19 nt, Human
ccuaaagccucaaaacaaa

SEQ ID NO: 2022783 - RNA, 12 nt, Human
ccuaaagagaua

SEQ ID NO: 2022784 - RNA, 15 nt, Human
ccuaaagauuuugau

SEQ ID NO: 2022785 - RNA, 14 nt, Human
ccuaauuccacagc

SEQ ID NO: 2022786 - RNA, 15 nt, Human
ccuaauuccacagcu

SEQ ID NO: 2022787 - RNA, 16 nt, Human
ccuaauuccacagcug

SEQ ID NO: 2022788 - RNA, 17 nt, Human
ccuaauuccacagcugc

SEQ ID NO: 2022789 - RNA, 17 nt, Human
ccuaauucuaugccugu

SEQ ID NO: 2022790 - RNA, 12 nt, Human
ccuaccugguaa

SEQ ID NO: 2022791 - RNA, 19 nt, Human
cccuuaccucggugccuuc

SEQ ID NO: 2022792 - RNA, 17 nt, Human
cccuuaccacugcucug

SEQ ID NO: 2022793 - RNA, 21 nt, Human
cccuuaccacugcucugauga

SEQ ID NO: 2022794 - RNA, 13 nt, Human
cccuuccucucca

SEQ ID NO: 2022795 - RNA, 15 nt, Human
cccuuccuccauccu

SEQ ID NO: 2022796 - RNA, 16 nt, Human
cccuuccucuccacug

SEQ ID NO: 2022797 - RNA, 17 nt, Human
cccuuccucuccacugc

SEQ ID NO: 2022798 - RNA, 20 nt, Human
cccuuccucuccacugccuu

SEQ ID NO: 2022799 - RNA, 18 nt, Human
cccuugccgucuaccuga

SEQ ID NO: 2022800 - RNA, 17 nt, Human
cccuugccgucuaccug

SEQ ID NO: 2022801 - RNA, 12 nt, Human
cccuugcagccg

SEQ ID NO: 2022802 - RNA, 22 nt, Human
cccuugccgucuaccugagggg

SEQ ID NO: 2022803 - RNA, 12 nt, Human
cccuuggcucuc

SEQ ID NO: 2022804 - RNA, 16 nt, Human
cccuuguggucccacc

SEQ ID NO: 2022805 - RNA, 14 nt, Human
cccuugugguccca

SEQ ID NO: 2022806 - RNA, 18 nt, Human
cccuuggggagcaggcuc

SEQ ID NO: 2022807 - RNA, 18 nt, Human
cccuuguggucccacccc

SEQ ID NO: 2022808 - RNA, 20 nt, Human
cccuuguggucccaccccac

SEQ ID NO: 2022809 - RNA, 20 nt, Human
cccuuugacgccaucccagc

SEQ ID NO: 2022810 - RNA, 13 nt, Human
cccuuucuuccuc

SEQ ID NO: 2022811 - RNA, 14 nt, Human
cccuuucuucuccc

SEQ ID NO: 2022812 - RNA, 17 nt, Human
cccuuucuucuccccca

SEQ ID NO: 2022813 - RNA, 21 nt, Human
cccuuucuucucccccauccu

SEQ ID NO: 2022814 - RNA, 18 nt, Human
cccuuucuacuuccaaga

SEQ ID NO: 2022815 - RNA, 12 nt, Human
cccuuucuuccu

SEQ ID NO: 2022816 - RNA, 22 nt, Human
cccuuucugggcaccggggccu

SEQ ID NO: 2022817 - RNA, 17 nt, Human
cccuuuguccuccugcu

SEQ ID NO: 2022818 - RNA, 21 nt, Human
cccuuuguccuccugcugcca

SEQ ID NO: 2022819 - RNA, 22 nt, Human
cccuuuguccuccugcugccag

SEQ ID NO: 2022820 - RNA, 13 nt, Human
cccuuuucuguuu

SEQ ID NO: 2022821 - RNA, 11 nt, Human
cccuuuuccuu

SEQ ID NO: 2022822 - RNA, 9 nt, Human
cccuuuucc

SEQ ID NO: 2022823 - RNA, 18 nt, Human
cccuuuuuuggcugcuga

SEQ ID NO: 2022824 - RNA, 17 nt, Human
cccuuuuuuggcugcug

SEQ ID NO: 2022825 - RNA, 22 nt, Human
ccgagauagccaaggccaaagg

SEQ ID NO: 2022826 - RNA, 19 nt, Human
ccgagauagccaaggccaa

SEQ ID NO: 2022827 - RNA, 18 nt, Human
ccgagauagccaaggcca

SEQ ID NO: 2022828 - RNA, 17 nt, Human
ccgagacggcacugaga

SEQ ID NO: 2022829 - RNA, 17 nt, Human
ccgagaaggaagccucc

SEQ ID NO: 2022830 - RNA, 19 nt, Human
cccuuuuuuggcugcugaa

SEQ ID NO: 2022831 - RNA, 20 nt, Human
ccgacuugugcacaggcaga

SEQ ID NO: 2022832 - RNA, 18 nt, Human
ccgacuugugcacaggca

SEQ ID NO: 2022833 - RNA, 19 nt, Human
ccgacuugugcacaggcag

SEQ ID NO: 2022834 - RNA, 17 nt, Human
ccgaggccuucucugaa

SEQ ID NO: 2022835 - RNA, 18 nt, Human
ccgagaucacgccacugc

SEQ ID NO: 2022836 - RNA, 15 nt, Human
ccgccccugagccca

SEQ ID NO: 2022837 - RNA, 16 nt, Human
ccgccccugagcccac

SEQ ID NO: 2022838 - RNA, 17 nt, Human
ccgccccugagcccacu

SEQ ID NO: 2022839 - RNA, 15 nt, Human
ccgaucgccagcaaa

SEQ ID NO: 2022840 - RNA, 17 nt, Human
ccgaugcaaacauugga

SEQ ID NO: 2022841 - RNA, 20 nt, Human
ccgaugcaaacauuggaaga

SEQ ID NO: 2022842 - RNA, 13 nt, Human
ccgccccugagcc

SEQ ID NO: 2022843 - RNA, 14 nt, Human
ccgccccugagccc

SEQ ID NO: 2022844 - RNA, 22 nt, Human
ccgagucucuucuccacuggau

SEQ ID NO: 2022845 - RNA, 19 nt, Human
ccgauccuccccuggacuc

SEQ ID NO: 2022846 - RNA, 20 nt, Human
ccgauccuccccuggacucc

SEQ ID NO: 2022847 - RNA, 22 nt, Human
ccgaguguguuucauccuuccc

SEQ ID NO: 2022848 - RNA, 23 nt, Human
ccgaguguguuucauccuuccca

SEQ ID NO: 2022849 - RNA, 20 nt, Human
ccccucagggucccuggugg

SEQ ID NO: 2022850 - RNA, 18 nt, Human
ccccucagggucccuggu

SEQ ID NO: 2022851 - RNA, 17 nt, Human
ccccucagggucccugg

SEQ ID NO: 2022852 - RNA, 19 nt, Human
ccccuaaagccucaaaaca

SEQ ID NO: 2022853 - RNA, 21 nt, Human
cccugguggcagugggagcug

SEQ ID NO: 2022854 - RNA, 21 nt, Human
cccugguuuccugcccuggga

SEQ ID NO: 2022855 - RNA, 15 nt, Human
cccugguggcagugg

SEQ ID NO: 2022856 - RNA, 16 nt, Human
cccugguggcaguggg

SEQ ID NO: 2022857 - RNA, 19 nt, Human
cccugguggcagugggagc

SEQ ID NO: 2022858 - RNA, 17 nt, Human
ccccucccccagccacu

SEQ ID NO: 2022859 - RNA, 18 nt, Human
ccccucccccagccacuc

SEQ ID NO: 2022860 - RNA, 16 nt, Human
cccugugggcccccaa

SEQ ID NO: 2022861 - RNA, 21 nt, Human
cccuguagagugggagcugag

SEQ ID NO: 2022862 - RNA, 22 nt, Human
cccugguuuccugcccugggag

SEQ ID NO: 2022863 - RNA, 23 nt, Human
cccugguuuccugcccugggagg

SEQ ID NO: 2022864 - RNA, 18 nt, Human
cccugugggcccccaaau

SEQ ID NO: 2022865 - RNA, 13 nt, Human
cccugugugaaug

SEQ ID NO: 2022866 - RNA, 13 nt, Human
cccuguguuaauu

SEQ ID NO: 2022867 - RNA, 16 nt, Human
cccuguguuaauuuaa

SEQ ID NO: 2022868 - RNA, 15 nt, Human
cccuguuuguuucug

SEQ ID NO: 2022869 - RNA, 16 nt, Human
cccuguuucagaggcu

SEQ ID NO: 2022870 - RNA, 19 nt, Human
cccuguuucagaggcucag

SEQ ID NO: 2022871 - RNA, 16 nt, Human
cccuguuuguuucuga

SEQ ID NO: 2022872 - RNA, 12 nt, Human
ccccccugucac

SEQ ID NO: 2022873 - RNA, 21 nt, Human
cccccgcugucagccauuccu

SEQ ID NO: 2022874 - RNA, 13 nt, Human
cccccucugcccu

SEQ ID NO: 2022875 - RNA, 14 nt, Human
cccccucugcccug

SEQ ID NO: 2022876 - RNA, 16 nt, Human
cccccucugcccugcg

SEQ ID NO: 2022877 - RNA, 13 nt, Human
ccccgucucaggu

SEQ ID NO: 2022878 - RNA, 21 nt, Human
ccccgucucugguuccucccc

SEQ ID NO: 2022879 - RNA, 16 nt, Human
ccccgucccccucugg

SEQ ID NO: 2022880 - RNA, 20 nt, Human
ccccgucccccucuggcucc

SEQ ID NO: 2022881 - RNA, 13 nt, Human
ccccccacuccca

SEQ ID NO: 2022882 - RNA, 12 nt, Human
ccccccagcuuc

SEQ ID NO: 2022883 - RNA, 11 nt, Human
cccccaggucu

SEQ ID NO: 2022884 - RNA, 16 nt, Human
cccccaucucuucugg

SEQ ID NO: 2022885 - RNA, 19 nt, Human
cccccagcuucacuucuga

SEQ ID NO: 2022886 - RNA, 14 nt, Human
cccccagcuuccag

SEQ ID NO: 2022887 - RNA, 18 nt, Human
cccccagcuuccagcagg

SEQ ID NO: 2022888 - RNA, 12 nt, Human
cccccagcccca

SEQ ID NO: 2022889 - RNA, 23 nt, Human
cccccaaccaaguggcucccaca

SEQ ID NO: 2022890 - RNA, 22 nt, Human
ccccaggaggccagccuugacc

SEQ ID NO: 2022891 - RNA, 21 nt, Human
ccccaggaggccagccuugac

SEQ ID NO: 2022892 - RNA, 15 nt, Human
ccccaggaggccagc

SEQ ID NO: 2022893 - RNA, 14 nt, Human
ccccaggaggccag

SEQ ID NO: 2022894 - RNA, 11 nt, Human
ccccagcuccc

SEQ ID NO: 2022895 - RNA, 10 nt, Human
ccccagcucc

SEQ ID NO: 2022896 - RNA, 18 nt, Human
ccccagcuucacuucuga

SEQ ID NO: 2022897 - RNA, 14 nt, Human
ccccagcuuccagc

SEQ ID NO: 2022898 - RNA, 16 nt, Human
ccccagcuuccagcag

SEQ ID NO: 2022899 - RNA, 17 nt, Human
ccccagcuuccagcagg

SEQ ID NO: 2022900 - RNA, 18 nt, Human
ccccagcuuccagcagga

SEQ ID NO: 2022901 - RNA, 19 nt, Human
ccccagcuuccagcaggag

SEQ ID NO: 2022902 - RNA, 21 nt, Human
ccccagcuuccagcaggaggg

SEQ ID NO: 2022903 - RNA, 21 nt, Human
ccccagcuucucagcucgcug

SEQ ID NO: 2022904 - RNA, 15 nt, Human
ccccagcuugggcag

SEQ ID NO: 2022905 - RNA, 13 nt, Human
ccccaggaggcca

SEQ ID NO: 2022906 - RNA, 20 nt, Human
ccccagcgcugacgugucag

SEQ ID NO: 2022907 - RNA, 19 nt, Human
ccccagcgagagucccugc

SEQ ID NO: 2022908 - RNA, 22 nt, Human
ccccagccucaaauccaggacc

SEQ ID NO: 2022909 - RNA, 20 nt, Human
ccccagcccuuccucugcuc

SEQ ID NO: 2022910 - RNA, 14 nt, Human
ccccacuggugaca

SEQ ID NO: 2022911 - RNA, 19 nt, Human
ccccagcccuccuuaucaa

SEQ ID NO: 2022912 - RNA, 18 nt, Human
ccccagcccuuccucugc

SEQ ID NO: 2022913 - RNA, 13 nt, Human
ccccacuggugac

SEQ ID NO: 2022914 - RNA, 12 nt, Human
ccccacugguga

SEQ ID NO: 2022915 - RNA, 20 nt, Human
ccugaggcccuucucuccag

SEQ ID NO: 2022916 - RNA, 19 nt, Human
ccugaggcccuucucucca

SEQ ID NO: 2022917 - RNA, 17 nt, Human
ccugaggcccuucucuc

SEQ ID NO: 2022918 - RNA, 16 nt, Human
ccugaggcccuucucu

SEQ ID NO: 2022919 - RNA, 22 nt, Human
ccugaggcccuucucuccagcc

SEQ ID NO: 2022920 - RNA, 21 nt, Human
ccugaggcccuucucuccagc

SEQ ID NO: 2022921 - RNA, 19 nt, Human
ccugaggcagguccccaga

SEQ ID NO: 2022922 - RNA, 23 nt, Human
ccugaggcccuucucuccagccc

SEQ ID NO: 2022923 - RNA, 16 nt, Human
ccugacaacacucauu

SEQ ID NO: 2022924 - RNA, 15 nt, Human
ccugacaacacucau

SEQ ID NO: 2022925 - RNA, 14 nt, Human
ccugacaacacuca

SEQ ID NO: 2022926 - RNA, 12 nt, Human
ccugacaacacu

SEQ ID NO: 2022927 - RNA, 14 nt, Human
ccugaggcccagag

SEQ ID NO: 2022928 - RNA, 13 nt, Human
ccugaggcccaga

SEQ ID NO: 2022929 - RNA, 18 nt, Human
ccugaggcagguccccag

SEQ ID NO: 2022930 - RNA, 12 nt, Human
ccugaggcccag

SEQ ID NO: 2022931 - RNA, 18 nt, Human
ccugaggcuccacuuggu

SEQ ID NO: 2022932 - RNA, 20 nt, Human
ccugaggcuccacuuggucu

SEQ ID NO: 2022933 - RNA, 14 nt, Human
ccugaugcuucuuc

SEQ ID NO: 2022934 - RNA, 18 nt, Human
ccugaugcuucuucagag

SEQ ID NO: 2022935 - RNA, 17 nt, Human
ccugaugcuucuucaga

SEQ ID NO: 2022936 - RNA, 23 nt, Human
ccugauugugucucuugguccug

SEQ ID NO: 2022937 - RNA, 19 nt, Human
ccugauguguccucaggga

SEQ ID NO: 2022938 - RNA, 21 nt, Human
ccugauguguccucagggagc

SEQ ID NO: 2022939 - RNA, 21 nt, Human
ccucuucccugguaagaaaaa

SEQ ID NO: 2022940 - RNA, 17 nt, Human
ccucuuaugggcugggu

SEQ ID NO: 2022941 - RNA, 22 nt, Human
ccucuuuggucuacacugugcu

SEQ ID NO: 2022942 - RNA, 11 nt, Human
ccucuuccucu

SEQ ID NO: 2022943 - RNA, 15 nt, Human
ccucuuccucccuca

SEQ ID NO: 2022944 - RNA, 16 nt, Human
ccucuuccucccucau

SEQ ID NO: 2022945 - RNA, 19 nt, Human
ccucuuccucccucauucc

SEQ ID NO: 2022946 - RNA, 10 nt, Human
ccucuuccuc

SEQ ID NO: 2022947 - RNA, 13 nt, Human
ccucuuccuccug

SEQ ID NO: 2022948 - RNA, 16 nt, Human
ccucuuccuccugaca

SEQ ID NO: 2022949 - RNA, 23 nt, Human
ccugaaagaggaaugaaguacuc

SEQ ID NO: 2022950 - RNA, 18 nt, Human
ccugaaagaggaaugaag

SEQ ID NO: 2022951 - RNA, 20 nt, Human
ccugaacaggauauucucac

SEQ ID NO: 2022952 - RNA, 17 nt, Human
ccugaacaacgagccuu

SEQ ID NO: 2022953 - RNA, 23 nt, Human
ccugaaccacaggagaggauggc

SEQ ID NO: 2022954 - RNA, 23 nt, Human
ccugaagcuaucguaaaauuaag

SEQ ID NO: 2022955 - RNA, 22 nt, Human
ccugaagcuaucguaaaauuaa

SEQ ID NO: 2022956 - RNA, 20 nt, Human
ccugaagcuaucguaaaauu

SEQ ID NO: 2022957 - RNA, 21 nt, Human
ccugaagacucauucuucugu

SEQ ID NO: 2022958 - RNA, 13 nt, Human
ccugaaggccccg

SEQ ID NO: 2022959 - RNA, 15 nt, Human
ccugaagucacacag

SEQ ID NO: 2022960 - RNA, 16 nt, Human
ccugaagucacacagu

SEQ ID NO: 2022961 - RNA, 17 nt, Human
ccugaagucacacagug

SEQ ID NO: 2022962 - RNA, 19 nt, Human
ccugaauccaaaagaaaaa

SEQ ID NO: 2022963 - RNA, 23 nt, Human
ccucuguacagagcccacgcccc

SEQ ID NO: 2022964 - RNA, 18 nt, Human
ccucuguacagagcccac

SEQ ID NO: 2022965 - RNA, 17 nt, Human
ccucuguacagagccca

SEQ ID NO: 2022966 - RNA, 16 nt, Human
ccucuguacagagccc

SEQ ID NO: 2022967 - RNA, 15 nt, Human
ccucuguacagagcc

SEQ ID NO: 2022968 - RNA, 14 nt, Human
ccucuguacagagc

SEQ ID NO: 2022969 - RNA, 17 nt, Human
ccucuguccaggcacug

SEQ ID NO: 2022970 - RNA, 14 nt, Human
ccucuuaugggcug

SEQ ID NO: 2022971 - RNA, 16 nt, Human
ccucuuaugggcuggg

SEQ ID NO: 2022972 - RNA, 15 nt, Human
ccucuuaugggcugg

SEQ ID NO: 2022973 - RNA, 14 nt, Human
ccucuuagaaaaac

SEQ ID NO: 2022974 - RNA, 21 nt, Human
ccucuguucugcacacagcac

SEQ ID NO: 2022975 - RNA, 21 nt, Human
ccucugcacuccccugcuggg

SEQ ID NO: 2022976 - RNA, 20 nt, Human
ccucugcacuccccugcugg

SEQ ID NO: 2022977 - RNA, 15 nt, Human
ccucugcacuccccu

SEQ ID NO: 2022978 - RNA, 19 nt, Human
ccucugcacuccccugcug

SEQ ID NO: 2022979 - RNA, 14 nt, Human
ccucugcacucccc

SEQ ID NO: 2022980 - RNA, 22 nt, Human
ccucugcacuccccugcugggu

SEQ ID NO: 2022981 - RNA, 16 nt, Human
ccucugcauaaauauu

SEQ ID NO: 2022982 - RNA, 19 nt, Human
ccucugcacaagcugcacc

SEQ ID NO: 2022983 - RNA, 17 nt, Human
ccucugcacaagcugca

SEQ ID NO: 2022984 - RNA, 20 nt, Human
ccucugcacaagcugcaccc

SEQ ID NO: 2022985 - RNA, 15 nt, Human
ccucugcacaagcug

SEQ ID NO: 2022986 - RNA, 11 nt, Human
ccucugcacaa

SEQ ID NO: 2022987 - RNA, 17 nt, Human
ccucugacacacagcuc

SEQ ID NO: 2022988 - RNA, 18 nt, Human
ccucugacacacagcucu

SEQ ID NO: 2022989 - RNA, 12 nt, Human
ccucugggacug

SEQ ID NO: 2022990 - RNA, 11 nt, Human
ccucugggccc

SEQ ID NO: 2022991 - RNA, 16 nt, Human
ccucuggcuccagcug

SEQ ID NO: 2022992 - RNA, 17 nt, Human
ccucuggcuccagcugg

SEQ ID NO: 2022993 - RNA, 16 nt, Human
ccucuggcucuacaca

SEQ ID NO: 2022994 - RNA, 18 nt, Human
ccuccuuaucaaaggaca

SEQ ID NO: 2022995 - RNA, 20 nt, Human
ccuccuuaucaaaggacacc

SEQ ID NO: 2022996 - RNA, 23 nt, Human
ccuccugugugugcgccuacagg

SEQ ID NO: 2022997 - RNA, 12 nt, Human
ccucucacugcc

SEQ ID NO: 2022998 - RNA, 14 nt, Human
ccucucacugccuc

SEQ ID NO: 2022999 - RNA, 12 nt, Human
ccucucccauca

SEQ ID NO: 2023000 - RNA, 12 nt, Human
ccucucccaggg

SEQ ID NO: 2023001 - RNA, 19 nt, Human
ccucuccacugccuucgau

SEQ ID NO: 2023002 - RNA, 12 nt, Human
ccucuccacugc

SEQ ID NO: 2023003 - RNA, 13 nt, Human
ccucuccacugcc

SEQ ID NO: 2023004 - RNA, 14 nt, Human
ccucuccacugccu

SEQ ID NO: 2023005 - RNA, 16 nt, Human
ccucuccacugccuuc

SEQ ID NO: 2023006 - RNA, 23 nt, Human
ccucugaaaaccaauguucucuc

SEQ ID NO: 2023007 - RNA, 16 nt, Human
ccucugacacacagcu

SEQ ID NO: 2023008 - RNA, 18 nt, Human
ccucuccccgcaguguuu

SEQ ID NO: 2023009 - RNA, 13 nt, Human
ccucucugcccua

SEQ ID NO: 2023010 - RNA, 15 nt, Human
ccucagucuggcccu

SEQ ID NO: 2023011 - RNA, 14 nt, Human
ccucagucucccuc

SEQ ID NO: 2023012 - RNA, 15 nt, Human
ccucagggucccugg

SEQ ID NO: 2023013 - RNA, 21 nt, Human
ccucagguaaucgaccugccu

SEQ ID NO: 2023014 - RNA, 16 nt, Human
ccucaggugagaagca

SEQ ID NO: 2023015 - RNA, 22 nt, Human
ccucagguaaucgaccugccuc

SEQ ID NO: 2023016 - RNA, 23 nt, Human
ccucagguaaucgaccugccucg

SEQ ID NO: 2023017 - RNA, 22 nt, Human
ccucaggugauccacccaccuc

SEQ ID NO: 2023018 - RNA, 17 nt, Human
ccucaggugauccaccc

SEQ ID NO: 2023019 - RNA, 19 nt, Human
ccucaggugauccacccac

SEQ ID NO: 2023020 - RNA, 16 nt, Human
ccucagcauccuggca

SEQ ID NO: 2023021 - RNA, 17 nt, Human
ccucagcauccuggcac

SEQ ID NO: 2023022 - RNA, 14 nt, Human
ccucagcauccugg

SEQ ID NO: 2023023 - RNA, 22 nt, Human
ccucacuaucccggcugcccuu

SEQ ID NO: 2023024 - RNA, 16 nt, Human
ccucagaaaaugagua

SEQ ID NO: 2023025 - RNA, 21 nt, Human
ccucacuaggcuucugguuga

SEQ ID NO: 2023026 - RNA, 21 nt, Human
ccucacuaucccggcugcccu

SEQ ID NO: 2023027 - RNA, 21 nt, Human
ccucaggccugggggcugggc

SEQ ID NO: 2023028 - RNA, 14 nt, Human
ccucaggccugggg

SEQ ID NO: 2023029 - RNA, 11 nt, Human
ccucaggccug

SEQ ID NO: 2023030 - RNA, 14 nt, Human
ccucagggucccug

SEQ ID NO: 2023031 - RNA, 22 nt, Human
ccuccucccacugcccacuggc

SEQ ID NO: 2023032 - RNA, 19 nt, Human
ccuccucccucccagcucc

SEQ ID NO: 2023033 - RNA, 13 nt, Human
ccucccugccagu

SEQ ID NO: 2023034 - RNA, 14 nt, Human
ccuccucccacugc

SEQ ID NO: 2023035 - RNA, 15 nt, Human
ccuccucccacugcc

SEQ ID NO: 2023036 - RNA, 16 nt, Human
ccucccucccucuuuc

SEQ ID NO: 2023037 - RNA, 15 nt, Human
ccucccucccucuuu

SEQ ID NO: 2023038 - RNA, 13 nt, Human
ccucccucccucu

SEQ ID NO: 2023039 - RNA, 16 nt, Human
ccucccggugcccaag

SEQ ID NO: 2023040 - RNA, 17 nt, Human
ccuccccucuccuuccu

SEQ ID NO: 2023041 - RNA, 17 nt, Human
ccucccggcccugccug

SEQ ID NO: 2023042 - RNA, 18 nt, Human
ccucccggcccugccugc

SEQ ID NO: 2023043 - RNA, 22 nt, Human
ccucccggcccugccugcuggu

SEQ ID NO: 2023044 - RNA, 13 nt, Human
ccucccggugccc

SEQ ID NO: 2023045 - RNA, 13 nt, Human
ccuccugccucga

SEQ ID NO: 2023046 - RNA, 22 nt, Human
ccuccugaguugaagucaugcu

SEQ ID NO: 2023047 - RNA, 14 nt, Human
ccuccuccuggacu

SEQ ID NO: 2023048 - RNA, 13 nt, Human
ccuccugugugug

SEQ ID NO: 2023049 - RNA, 18 nt, Human
ccuccuguggccugccag

SEQ ID NO: 2023050 - RNA, 15 nt, Human
ccuccugugugugcg

SEQ ID NO: 2023051 - RNA, 22 nt, Human
ccuccugugugugcgccuacag

SEQ ID NO: 2023052 - RNA, 17 nt, Human
ccuccugggaaugaagc

SEQ ID NO: 2023053 - RNA, 13 nt, Human
ccuccuggacucc

SEQ ID NO: 2023054 - RNA, 13 nt, Human
ccuccugggcuaa

SEQ ID NO: 2023055 - RNA, 23 nt, Human
ccugcgucucauacucaccucac

SEQ ID NO: 2023056 - RNA, 22 nt, Human
ccugcaaaguacagguacuuug

SEQ ID NO: 2023057 - RNA, 23 nt, Human
ccugcaaaguacagguacuuugu

SEQ ID NO: 2023058 - RNA, 20 nt, Human
ccugcaaccaaacucccauc

SEQ ID NO: 2023059 - RNA, 22 nt, Human
ccugcaaccaaacucccaucag

SEQ ID NO: 2023060 - RNA, 16 nt, Human
ccugcaaccugauugu

SEQ ID NO: 2023061 - RNA, 19 nt, Human
ccugcaacaccuuguuucc

SEQ ID NO: 2023062 - RNA, 15 nt, Human
ccugauuucuccugc

SEQ ID NO: 2023063 - RNA, 18 nt, Human
ccugcaacaccuuguuuc

SEQ ID NO: 2023064 - RNA, 19 nt, Human
ccugcaaagcccagcuuga

SEQ ID NO: 2023065 - RNA, 18 nt, Human
ccugauuuuaauugugaa

SEQ ID NO: 2023066 - RNA, 22 nt, Human
ccugcuccagcuguucagcugg

SEQ ID NO: 2023067 - RNA, 14 nt, Human
ccugcuccagcugu

SEQ ID NO: 2023068 - RNA, 13 nt, Human
ccugcuccagcug

SEQ ID NO: 2023069 - RNA, 12 nt, Human
ccugcuccagcu

SEQ ID NO: 2023070 - RNA, 17 nt, Human
ccugcuaauuccccaga

SEQ ID NO: 2023071 - RNA, 17 nt, Human
ccugcguguucucagag

SEQ ID NO: 2023072 - RNA, 20 nt, Human
ccugcuuuuuauggccugug

SEQ ID NO: 2023073 - RNA, 21 nt, Human
ccuggaaaaaaacaucagaaa

SEQ ID NO: 2023074 - RNA, 15 nt, Human
ccuggaaaccugucu

SEQ ID NO: 2023075 - RNA, 18 nt, Human
ccugcuuugggcugcccu

SEQ ID NO: 2023076 - RNA, 17 nt, Human
ccugcuuugggcugccc

SEQ ID NO: 2023077 - RNA, 15 nt, Human
ccugcuuggcccagg

SEQ ID NO: 2023078 - RNA, 12 nt, Human
ccugcuucucug

SEQ ID NO: 2023079 - RNA, 14 nt, Human
ccugcuucucugcc

SEQ ID NO: 2023080 - RNA, 15 nt, Human
ccugcuucucugccc

SEQ ID NO: 2023081 - RNA, 17 nt, Human
ccugcuucucugcccag

SEQ ID NO: 2023082 - RNA, 13 nt, Human
ccugcuuggccca

SEQ ID NO: 2023083 - RNA, 14 nt, Human
ccugcuuggcccag

SEQ ID NO: 2023084 - RNA, 13 nt, Human
ccugcugguucag

SEQ ID NO: 2023085 - RNA, 21 nt, Human
ccugcuggguguggcgcagca

SEQ ID NO: 2023086 - RNA, 22 nt, Human
ccugcucccuccgggucuuccu

SEQ ID NO: 2023087 - RNA, 15 nt, Human
ccugcuuccucagag

SEQ ID NO: 2023088 - RNA, 15 nt, Human
ccugcugucauugcu

SEQ ID NO: 2023089 - RNA, 20 nt, Human
ccugcugucauugcuucuuc

SEQ ID NO: 2023090 - RNA, 22 nt, Human
ccugcugucauugcuucuucug

SEQ ID NO: 2023091 - RNA, 19 nt, Human
ccugcugguucaggguugg

SEQ ID NO: 2023092 - RNA, 14 nt, Human
ccuggacccugugg

SEQ ID NO: 2023093 - RNA, 13 nt, Human
ccuggacccugug

SEQ ID NO: 2023094 - RNA, 20 nt, Human
ccuggacugugugcucagga

SEQ ID NO: 2023095 - RNA, 17 nt, Human
ccuggacugugugcuca

SEQ ID NO: 2023096 - RNA, 22 nt, Human
ccuggacuagagggaccucucc

SEQ ID NO: 2023097 - RNA, 15 nt, Human
ccuggacuagaggga

SEQ ID NO: 2023098 - RNA, 12 nt, Human
ccuggacucccg

SEQ ID NO: 2023099 - RNA, 17 nt, Human
ccuggacucccguguag

SEQ ID NO: 2023100 - RNA, 14 nt, Human
ccuggacuccugca

SEQ ID NO: 2023101 - RNA, 14 nt, Human
ccuggacaggccag

SEQ ID NO: 2023102 - RNA, 12 nt, Human
ccuggaccccag

SEQ ID NO: 2023103 - RNA, 13 nt, Human
ccuggaccccagc

SEQ ID NO: 2023104 - RNA, 14 nt, Human
ccuggaccccagcc

SEQ ID NO: 2023105 - RNA, 15 nt, Human
ccuggaccccagccu

SEQ ID NO: 2023106 - RNA, 16 nt, Human
ccuggaccccagccuc

SEQ ID NO: 2023107 - RNA, 17 nt, Human
ccuggaccccagccuca

SEQ ID NO: 2023108 - RNA, 17 nt, Human
ccuggcacugcuuccag

SEQ ID NO: 2023109 - RNA, 20 nt, Human
ccuggcacugcuuccaguga

SEQ ID NO: 2023110 - RNA, 17 nt, Human
ccuggcaugggaaugaa

SEQ ID NO: 2023111 - RNA, 16 nt, Human
ccuggcaugggaauga

SEQ ID NO: 2023112 - RNA, 12 nt, Human
ccuggcagccgu

SEQ ID NO: 2023113 - RNA, 18 nt, Human
ccuggcagccgugccuuc

SEQ ID NO: 2023114 - RNA, 19 nt, Human
ccuggcagccgugccuuca

SEQ ID NO: 2023115 - RNA, 14 nt, Human
ccuggcagccccug

SEQ ID NO: 2023116 - RNA, 16 nt, Human
ccuggcagccccuguu

SEQ ID NO: 2023117 - RNA, 21 nt, Human
ccuggcacugcuuccagugag

SEQ ID NO: 2023118 - RNA, 20 nt, Human
ccugggaucccucauccuca

SEQ ID NO: 2023119 - RNA, 16 nt, Human
ccugggaucccucauc

SEQ ID NO: 2023120 - RNA, 17 nt, Human
ccugggauaggggcaga

SEQ ID NO: 2023121 - RNA, 20 nt, Human
ccugggaggucaaggcugca

SEQ ID NO: 2023122 - RNA, 21 nt, Human
ccugggaggcucuggagccca

SEQ ID NO: 2023123 - RNA, 13 nt, Human
ccugggaggcucu

SEQ ID NO: 2023124 - RNA, 13 nt, Human
ccugggaggcagu

SEQ ID NO: 2023125 - RNA, 14 nt, Human
ccugggcagaagga

SEQ ID NO: 2023126 - RNA, 23 nt, Human
ccugggcacacgcugcucugccc

SEQ ID NO: 2023127 - RNA, 12 nt, Human
ccugggcagaag

SEQ ID NO: 2023128 - RNA, 15 nt, Human
ccugggcacacgcug

SEQ ID NO: 2023129 - RNA, 17 nt, Human
ccugggcacacgcugcu

SEQ ID NO: 2023130 - RNA, 18 nt, Human
ccugggcacacgcugcuc

SEQ ID NO: 2023131 - RNA, 19 nt, Human
ccugggcacacgcugcucu

SEQ ID NO: 2023132 - RNA, 18 nt, Human
ccugggauaggggcagag

SEQ ID NO: 2023133 - RNA, 23 nt, Human
ccugggauaggggcagaggaggc

SEQ ID NO: 2023134 - RNA, 16 nt, Human
ccuggccccucagggu

SEQ ID NO: 2023135 - RNA, 14 nt, Human
ccuggccccucagg

SEQ ID NO: 2023136 - RNA, 12 nt, Human
ccuggcggggug

SEQ ID NO: 2023137 - RNA, 15 nt, Human
ccuggcccccacaug

SEQ ID NO: 2023138 - RNA, 21 nt, Human
ccuggcccccacauggugaug

SEQ ID NO: 2023139 - RNA, 22 nt, Human
ccuggcagcccgcaucagcugc

SEQ ID NO: 2023140 - RNA, 18 nt, Human
ccuggcaugggaaugaau

SEQ ID NO: 2023141 - RNA, 19 nt, Human
ccugugauggggcccugcc

SEQ ID NO: 2023142 - RNA, 18 nt, Human
ccugugauggggcccugc

SEQ ID NO: 2023143 - RNA, 17 nt, Human
ccugugauggggcccug

SEQ ID NO: 2023144 - RNA, 21 nt, Human
ccugugauggggcccugccuc

SEQ ID NO: 2023145 - RNA, 20 nt, Human
ccugugauggggcccugccu

SEQ ID NO: 2023146 - RNA, 22 nt, Human
ccugugauggggcccugccucc

SEQ ID NO: 2023147 - RNA, 17 nt, Human
ccugugccucugggacu

SEQ ID NO: 2023148 - RNA, 15 nt, Human
ccugugccucuggga

SEQ ID NO: 2023149 - RNA, 19 nt, Human
ccugugccucugggacugg

SEQ ID NO: 2023150 - RNA, 14 nt, Human
ccugugccagccca

SEQ ID NO: 2023151 - RNA, 15 nt, Human
ccugugccagcccag

SEQ ID NO: 2023152 - RNA, 17 nt, Human
ccugugccagcccagag

SEQ ID NO: 2023153 - RNA, 19 nt, Human
ccugugccagcccagaggc

SEQ ID NO: 2023154 - RNA, 12 nt, Human
ccugugccaggu

SEQ ID NO: 2023155 - RNA, 14 nt, Human
ccugugccagguga

SEQ ID NO: 2023156 - RNA, 21 nt, Human
ccugugccaggugaaggaggc

SEQ ID NO: 2023157 - RNA, 22 nt, Human
ccugucaaacauuaguacuuua

SEQ ID NO: 2023158 - RNA, 18 nt, Human
ccuguccccgcacugggc

SEQ ID NO: 2023159 - RNA, 17 nt, Human
ccugucccccugacaac

SEQ ID NO: 2023160 - RNA, 16 nt, Human
ccugucccccugacaa

SEQ ID NO: 2023161 - RNA, 13 nt, Human
ccugugagcugca

SEQ ID NO: 2023162 - RNA, 14 nt, Human
ccugugagcugcac

SEQ ID NO: 2023163 - RNA, 16 nt, Human
ccugugagcugcacca

SEQ ID NO: 2023164 - RNA, 20 nt, Human
ccugugaguacuacaguccu

SEQ ID NO: 2023165 - RNA, 22 nt, Human
ccugugagcuaggaauuguguu

SEQ ID NO: 2023166 - RNA, 18 nt, Human
ccugugacuucagcucug

SEQ ID NO: 2023167 - RNA, 20 nt, Human
ccuguaauccuagcacuuug

SEQ ID NO: 2023168 - RNA, 23 nt, Human
ccuguaauuguuguuuguaugua

SEQ ID NO: 2023169 - RNA, 18 nt, Human
ccugguggcagcucaccu

SEQ ID NO: 2023170 - RNA, 17 nt, Human
ccugguggcagcucacc

SEQ ID NO: 2023171 - RNA, 16 nt, Human
ccugguggcagcucac

SEQ ID NO: 2023172 - RNA, 14 nt, Human
ccugguggcagcuc

SEQ ID NO: 2023173 - RNA, 12 nt, Human
ccugguggcagc

SEQ ID NO: 2023174 - RNA, 13 nt, Human
ccugguggcagcu

SEQ ID NO: 2023175 - RNA, 18 nt, Human
ccuggugcugccacacuu

SEQ ID NO: 2023176 - RNA, 21 nt, Human
ccuggugcugccacacuucag

SEQ ID NO: 2023177 - RNA, 15 nt, Human
ccuggugcugccaca

SEQ ID NO: 2023178 - RNA, 23 nt, Human
ccuguagagugggagcugagugg

SEQ ID NO: 2023179 - RNA, 19 nt, Human
ccuguagagugggagcuga

SEQ ID NO: 2023180 - RNA, 21 nt, Human
ccuguagagugggagcugagu

SEQ ID NO: 2023181 - RNA, 13 nt, Human
ccugucaaacauu

SEQ ID NO: 2023182 - RNA, 14 nt, Human
ccugucaaacauua

SEQ ID NO: 2023183 - RNA, 16 nt, Human
ccugucaaacauuagu

SEQ ID NO: 2023184 - RNA, 11 nt, Human
ccuuuggcuuc

SEQ ID NO: 2023185 - RNA, 13 nt, Human
ccuugacagggca

SEQ ID NO: 2023186 - RNA, 19 nt, Human
ccuuggauuguccccgacc

SEQ ID NO: 2023187 - RNA, 15 nt, Human
ccuugauauuuguau

SEQ ID NO: 2023188 - RNA, 22 nt, Human
ccuugaugaaauaacacagcag

SEQ ID NO: 2023189 - RNA, 23 nt, Human
ccuugaguugauucagcucugca

SEQ ID NO: 2023190 - RNA, 22 nt, Human
ccuugaguugauucagcucugc

SEQ ID NO: 2023191 - RNA, 21 nt, Human
ccuugaccauucuccaccugc

SEQ ID NO: 2023192 - RNA, 14 nt, Human
ccuugacaaacuuc

SEQ ID NO: 2023193 - RNA, 21 nt, Human
ccuugacaaagucaagccaca

SEQ ID NO: 2023194 - RNA, 23 nt, Human
ccuugacaaagucaagccacaug

SEQ ID NO: 2023195 - RNA, 14 nt, Human
ccuugacagggcac

SEQ ID NO: 2023196 - RNA, 14 nt, Human
ccuugacacauuac

SEQ ID NO: 2023197 - RNA, 20 nt, Human
ccuugaccauucuccaccug

SEQ ID NO: 2023198 - RNA, 19 nt, Human
ccuugaccauucuccaccu

SEQ ID NO: 2023199 - RNA, 15 nt, Human
ccuugacagggcaca

SEQ ID NO: 2023200 - RNA, 17 nt, Human
ccuugacagggcacacc

SEQ ID NO: 2023201 - RNA, 15 nt, Human
ccuugaaaacacugu

SEQ ID NO: 2023202 - RNA, 14 nt, Human
ccuucuuuuucuuc

SEQ ID NO: 2023203 - RNA, 16 nt, Human
ccuucuuuuucuucuu

SEQ ID NO: 2023204 - RNA, 16 nt, Human
ccuucuuugcccuuua

SEQ ID NO: 2023205 - RNA, 13 nt, Human
ccuucgcuccugu

SEQ ID NO: 2023206 - RNA, 14 nt, Human
ccuucgcuccugug

SEQ ID NO: 2023207 - RNA, 15 nt, Human
ccuucgcuccugugu

SEQ ID NO: 2023208 - RNA, 18 nt, Human
ccuucgcuccugugucuu

SEQ ID NO: 2023209 - RNA, 21 nt, Human
ccuugaaaacacuguucucug

SEQ ID NO: 2023210 - RNA, 19 nt, Human
ccuugaaaacacuguucuc

SEQ ID NO: 2023211 - RNA, 22 nt, Human
ccuugaaaacacuguucucugc

SEQ ID NO: 2023212 - RNA, 14 nt, Human
ccuugaacugggua

SEQ ID NO: 2023213 - RNA, 19 nt, Human
ccuugaacuuugaccucug

SEQ ID NO: 2023214 - RNA, 14 nt, Human
ccuucuuuuucugg

SEQ ID NO: 2023215 - RNA, 15 nt, Human
ccuucuuuuucugga

SEQ ID NO: 2023216 - RNA, 16 nt, Human
ccuucuuuuucuggac

SEQ ID NO: 2023217 - RNA, 21 nt, Human
ccuucuuuuucuggacucugg

SEQ ID NO: 2023218 - RNA, 23 nt, Human
ccuucuuuuucuggacucuggac

SEQ ID NO: 2023219 - RNA, 17 nt, Human
ccuugaaugaugccaug

SEQ ID NO: 2023220 - RNA, 17 nt, Human
ccuugaacuuugaccuc

SEQ ID NO: 2023221 - RNA, 16 nt, Human
ccuugaacuggguacu

SEQ ID NO: 2023222 - RNA, 19 nt, Human
ccuucagugccuuauggaa

SEQ ID NO: 2023223 - RNA, 17 nt, Human
ccuuagacagucccugc

SEQ ID NO: 2023224 - RNA, 16 nt, Human
ccuuagacagucccug

SEQ ID NO: 2023225 - RNA, 14 nt, Human
ccuuagaaccuuuc

SEQ ID NO: 2023226 - RNA, 15 nt, Human
ccuuagaaccuuucu

SEQ ID NO: 2023227 - RNA, 16 nt, Human
ccuuagaaccuuucuu

SEQ ID NO: 2023228 - RNA, 18 nt, Human
ccuuagaaccuuucuuac

SEQ ID NO: 2023229 - RNA, 19 nt, Human
ccuuagacagucccugcca

SEQ ID NO: 2023230 - RNA, 18 nt, Human
ccuuagacagucccugcc

SEQ ID NO: 2023231 - RNA, 18 nt, Human
ccuuagaagguauuaaga

SEQ ID NO: 2023232 - RNA, 21 nt, Human
ccuuagaagguauuaagauua

SEQ ID NO: 2023233 - RNA, 21 nt, Human
ccuuagacagucccugccaau

SEQ ID NO: 2023234 - RNA, 15 nt, Human
ccuucaaagcaaaug

SEQ ID NO: 2023235 - RNA, 19 nt, Human
ccuucaaagcaaaugucuu

SEQ ID NO: 2023236 - RNA, 14 nt, Human
ccuucaaccauucc

SEQ ID NO: 2023237 - RNA, 23 nt, Human
ccuucaacaaggcuugcugcaga

SEQ ID NO: 2023238 - RNA, 14 nt, Human
ccuucaacaaggcu

SEQ ID NO: 2023239 - RNA, 19 nt, Human
ccuucaacaaggcuugcug

SEQ ID NO: 2023240 - RNA, 15 nt, Human
ccuucaagcugcuuu

SEQ ID NO: 2023241 - RNA, 14 nt, Human
ccuuaccugccagg

SEQ ID NO: 2023242 - RNA, 20 nt, Human
ccuuaccucggugccuuccu

SEQ ID NO: 2023243 - RNA, 16 nt, Human
ccuuaccagcagagca

SEQ ID NO: 2023244 - RNA, 15 nt, Human
ccuuaccagcagagc

SEQ ID NO: 2023245 - RNA, 15 nt, Human
ccuguggccugccag

SEQ ID NO: 2023246 - RNA, 17 nt, Human
ccuuaccagcagagcac

SEQ ID NO: 2023247 - RNA, 14 nt, Human
ccuuaccagcagag

SEQ ID NO: 2023248 - RNA, 22 nt, Human
ccuuccaggggugggacacccu

SEQ ID NO: 2023249 - RNA, 18 nt, Human
ccuuccaggggugggaca

SEQ ID NO: 2023250 - RNA, 19 nt, Human
ccuuccaugucgccucugc

SEQ ID NO: 2023251 - RNA, 20 nt, Human
ccuuccaugucgccucugca

SEQ ID NO: 2023252 - RNA, 21 nt, Human
ccuuccaugucgccucugcau

SEQ ID NO: 2023253 - RNA, 23 nt, Human
ccuuccaugucgccucugcauuc

SEQ ID NO: 2023254 - RNA, 16 nt, Human
ccuuccagggguggga

SEQ ID NO: 2023255 - RNA, 15 nt, Human
ccuuccagggguggg

SEQ ID NO: 2023256 - RNA, 18 nt, Human
ccuuccaccugcucugcu

SEQ ID NO: 2023257 - RNA, 19 nt, Human
ccuuccaccugcucugcug

SEQ ID NO: 2023258 - RNA, 14 nt, Human
ccuuccucuuucca

SEQ ID NO: 2023259 - RNA, 12 nt, Human
ccuuccucugcu

SEQ ID NO: 2023260 - RNA, 14 nt, Human
ccuuccucugaggc

SEQ ID NO: 2023261 - RNA, 17 nt, Human
ccuuccauuucugccuu

SEQ ID NO: 2023262 - RNA, 15 nt, Human
ccuucgauacaccgg

SEQ ID NO: 2023263 - RNA, 13 nt, Human
ccuuccugcuuga

SEQ ID NO: 2023264 - RNA, 13 nt, Human
ccuuccucugcuc

SEQ ID NO: 2023265 - RNA, 20 nt, Human
ccuucgauacaccgggccug

SEQ ID NO: 2023266 - RNA, 22 nt, Human
ccuucgauacaccgggccugga

SEQ ID NO: 2023267 - RNA, 23 nt, Human
ccuucgauacaccgggccuggag

SEQ ID NO: 2023268 - RNA, 13 nt, Human
ccuucgccaccug

SEQ ID NO: 2023269 - RNA, 15 nt, Human
ccuucagugccuuau

SEQ ID NO: 2023270 - RNA, 20 nt, Human
ccuucagugccuuauggaac

SEQ ID NO: 2023271 - RNA, 17 nt, Human
ccuucaguuuuuguguu

SEQ ID NO: 2023272 - RNA, 16 nt, Human
ccuuccaccucuggga

SEQ ID NO: 2023273 - RNA, 17 nt, Human
ccuuccaccucugggag

SEQ ID NO: 2023274 - RNA, 15 nt, Human
ccuuccaccugcucu

SEQ ID NO: 2023275 - RNA, 16 nt, Human
ccuuccaccugcucug

SEQ ID NO: 2023276 - RNA, 17 nt, Human
ccuuccaccugcucugc

SEQ ID NO: 2023277 - RNA, 14 nt, Human
ccuucagugccuua

SEQ ID NO: 2023278 - RNA, 13 nt, Human
ccuucagugccuu

SEQ ID NO: 2023279 - RNA, 17 nt, Human
cguggcugcuucaagga

SEQ ID NO: 2023280 - RNA, 15 nt, Human
cguggcugcuucaag

SEQ ID NO: 2023281 - RNA, 14 nt, Human
cguggcugcuucaa

SEQ ID NO: 2023282 - RNA, 12 nt, Human
cguggcugcuuc

SEQ ID NO: 2023283 - RNA, 13 nt, Human
cgugccuucagcu

SEQ ID NO: 2023284 - RNA, 15 nt, Human
cgugccuucagcucu

SEQ ID NO: 2023285 - RNA, 16 nt, Human
cgugccuucagcucua

SEQ ID NO: 2023286 - RNA, 18 nt, Human
cgugccuucagcucuaca

SEQ ID NO: 2023287 - RNA, 12 nt, Human
cgugccuggcca

SEQ ID NO: 2023288 - RNA, 16 nt, Human
cgugccuggccacgcc

SEQ ID NO: 2023289 - RNA, 16 nt, Human
cguuuugcaagguaaa

SEQ ID NO: 2023290 - RNA, 20 nt, Human
cguuucuaugacacaugcaa

SEQ ID NO: 2023291 - RNA, 19 nt, Human
cguuucuaaaggcuaccuu

SEQ ID NO: 2023292 - RNA, 21 nt, Human
cguuucuaaaggcuaccuuug

SEQ ID NO: 2023293 - RNA, 22 nt, Human
cguuccuucaaagcaaaugucu

SEQ ID NO: 2023294 - RNA, 15 nt, Human
cguuuacucacagcc

SEQ ID NO: 2023295 - RNA, 12 nt, Human
cgugacaacacu

SEQ ID NO: 2023296 - RNA, 22 nt, Human
cgugaagauacuuuguauuguc

SEQ ID NO: 2023297 - RNA, 16 nt, Human
cgugaagauacuuugu

SEQ ID NO: 2023298 - RNA, 17 nt, Human
cgugaagauacuuugua

SEQ ID NO: 2023299 - RNA, 18 nt, Human
cgugaagauacuuuguau

SEQ ID NO: 2023300 - RNA, 19 nt, Human
cgugaagauacuuuguauu

SEQ ID NO: 2023301 - RNA, 21 nt, Human
cgugaagauacuuuguauugu

SEQ ID NO: 2023302 - RNA, 20 nt, Human
cgugcacacaccagagccca

SEQ ID NO: 2023303 - RNA, 21 nt, Human
cgugcacacaccagagcccac

SEQ ID NO: 2023304 - RNA, 19 nt, Human
cgugcauaccacuuuuguu

SEQ ID NO: 2023305 - RNA, 14 nt, Human
cgugcauaccacuu

SEQ ID NO: 2023306 - RNA, 18 nt, Human
cgugcauaccacuuuugu

SEQ ID NO: 2023307 - RNA, 22 nt, Human
cgugcacacaccagagcccacc

SEQ ID NO: 2023308 - RNA, 16 nt, Human
cgucgcccucccaggc

SEQ ID NO: 2023309 - RNA, 15 nt, Human
cgucgcccucccagg

SEQ ID NO: 2023310 - RNA, 14 nt, Human
cguccccugucccc

SEQ ID NO: 2023311 - RNA, 10 nt, Human
cguccccucc

SEQ ID NO: 2023312 - RNA, 11 nt, Human
cguccccuguc

SEQ ID NO: 2023313 - RNA, 22 nt, Human
cgucccccucuggcuccagcug

SEQ ID NO: 2023314 - RNA, 14 nt, Human
cgucuaccugaggg

SEQ ID NO: 2023315 - RNA, 17 nt, Human
cgucuaaccacagcucc

SEQ ID NO: 2023316 - RNA, 18 nt, Human
cgucuaaccacagcuccu

SEQ ID NO: 2023317 - RNA, 19 nt, Human
cgucuaaccacagcuccuu

SEQ ID NO: 2023318 - RNA, 21 nt, Human
cgucuaaccacagcuccuuuu

SEQ ID NO: 2023319 - RNA, 17 nt, Human
cgucuacagcuccccca

SEQ ID NO: 2023320 - RNA, 13 nt, Human
cgucuacagcucc

SEQ ID NO: 2023321 - RNA, 14 nt, Human
cgucuacagcuccc

SEQ ID NO: 2023322 - RNA, 17 nt, Human
cgucugcuccugcgagg

SEQ ID NO: 2023323 - RNA, 13 nt, Human
cgucugacaggca

SEQ ID NO: 2023324 - RNA, 14 nt, Human
cgucugacaggcaa

SEQ ID NO: 2023325 - RNA, 22 nt, Human
cguccacgugcguguuuucuga

SEQ ID NO: 2023326 - RNA, 14 nt, Human
cgucccccucuggc

SEQ ID NO: 2023327 - RNA, 21 nt, Human
cgucccccucuggcuccagcu

SEQ ID NO: 2023328 - RNA, 16 nt, Human
cgucaacucauauuuu

SEQ ID NO: 2023329 - RNA, 20 nt, Human
cgucaacucauauuuucaug

SEQ ID NO: 2023330 - RNA, 16 nt, Human
cgucacuaccuggcug

SEQ ID NO: 2023331 - RNA, 17 nt, Human
cgucacuuuauuucauu

SEQ ID NO: 2023332 - RNA, 15 nt, Human
cguauggcuuuauuu

SEQ ID NO: 2023333 - RNA, 22 nt, Human
cguauaugucucaggucccugc

SEQ ID NO: 2023334 - RNA, 14 nt, Human
cguauagaagucuu

SEQ ID NO: 2023335 - RNA, 16 nt, Human
cguauagaagucuuca

SEQ ID NO: 2023336 - RNA, 13 nt, Human
cguagcuugucug

SEQ ID NO: 2023337 - RNA, 18 nt, Human
cguagucggcacagccug

SEQ ID NO: 2023338 - RNA, 19 nt, Human
cguagucggcacagccugg

SEQ ID NO: 2023339 - RNA, 21 nt, Human
cguagucggcacagccugguc

SEQ ID NO: 2023340 - RNA, 15 nt, Human
cguagugcagcaggg

SEQ ID NO: 2023341 - RNA, 22 nt, Human
cguauaaaagccuguuuaagag

SEQ ID NO: 2023342 - RNA, 21 nt, Human
cguauaaaagccuguuuaaga

SEQ ID NO: 2023343 - RNA, 17 nt, Human
cguauaaaagccuguuu

SEQ ID NO: 2023344 - RNA, 16 nt, Human
cguauaaaagccuguu

SEQ ID NO: 2023345 - RNA, 23 nt, Human
cggugcuaucucccccagcccca

SEQ ID NO: 2023346 - RNA, 14 nt, Human
cggggccagcuccg

SEQ ID NO: 2023347 - RNA, 19 nt, Human
cggaaccugugagcugcac

SEQ ID NO: 2023348 - RNA, 18 nt, Human
cggaaccugugagcugca

SEQ ID NO: 2023349 - RNA, 20 nt, Human
cggaaugaaccacaucuugc

SEQ ID NO: 2023350 - RNA, 15 nt, Human
cggacagccacggcc

SEQ ID NO: 2023351 - RNA, 16 nt, Human
cggacagccacggcca

SEQ ID NO: 2023352 - RNA, 18 nt, Human
cggacagccacggccagg

SEQ ID NO: 2023353 - RNA, 17 nt, Human
cgcuauugucaccaggg

SEQ ID NO: 2023354 - RNA, 20 nt, Human
cgcuagguagagucugaggg

SEQ ID NO: 2023355 - RNA, 21 nt, Human
cgcuagguagagucugagggc

SEQ ID NO: 2023356 - RNA, 13 nt, Human
cgcuccugugucu

SEQ ID NO: 2023357 - RNA, 22 nt, Human
cgcucgaaguugaucuccccag

SEQ ID NO: 2023358 - RNA, 15 nt, Human
cggauugcaaagcaa

SEQ ID NO: 2023359 - RNA, 13 nt, Human
cggcacagccugg

SEQ ID NO: 2023360 - RNA, 16 nt, Human
cggcaauaaaagccca

SEQ ID NO: 2023361 - RNA, 17 nt, Human
cggcaauaaaagcccag

SEQ ID NO: 2023362 - RNA, 18 nt, Human
cggcaauaaaagcccagg

SEQ ID NO: 2023363 - RNA, 19 nt, Human
cggcaauaaaagcccagga

SEQ ID NO: 2023364 - RNA, 20 nt, Human
cggcaauaaaagcccaggag

SEQ ID NO: 2023365 - RNA, 22 nt, Human
cggcaauaaaagcccaggagcc

SEQ ID NO: 2023366 - RNA, 21 nt, Human
cggauccugcacugacucugg

SEQ ID NO: 2023367 - RNA, 22 nt, Human
cggauccugcacugacucugga

SEQ ID NO: 2023368 - RNA, 20 nt, Human
cggacagccacggccaggcc

SEQ ID NO: 2023369 - RNA, 18 nt, Human
cggcuggccuggccccuc

SEQ ID NO: 2023370 - RNA, 16 nt, Human
cggcuggccuggcccc

SEQ ID NO: 2023371 - RNA, 15 nt, Human
cggcuggccuggccc

SEQ ID NO: 2023372 - RNA, 15 nt, Human
cggccuuuggcuuca

SEQ ID NO: 2023373 - RNA, 20 nt, Human
cggcccauccccaggcaccu

SEQ ID NO: 2023374 - RNA, 14 nt, Human
cggccccagcuucu

SEQ ID NO: 2023375 - RNA, 19 nt, Human
cggccccagcuucucagcu

SEQ ID NO: 2023376 - RNA, 16 nt, Human
cggccuccauccugag

SEQ ID NO: 2023377 - RNA, 17 nt, Human
cggccuccauccugagg

SEQ ID NO: 2023378 - RNA, 13 nt, Human
cggccuuucccac

SEQ ID NO: 2023379 - RNA, 14 nt, Human
cggccuuucccacu

SEQ ID NO: 2023380 - RNA, 20 nt, Human
cgggaggauguucugggaca

SEQ ID NO: 2023381 - RNA, 22 nt, Human
cgggagccugaucaccugcccu

SEQ ID NO: 2023382 - RNA, 21 nt, Human
cgggagccugaucaccugccc

SEQ ID NO: 2023383 - RNA, 16 nt, Human
cgggaggucgaggcag

SEQ ID NO: 2023384 - RNA, 17 nt, Human
cgggaggucgaggcagg

SEQ ID NO: 2023385 - RNA, 22 nt, Human
cggggagggugacaguggccgc

SEQ ID NO: 2023386 - RNA, 15 nt, Human
cggggagggugacag

SEQ ID NO: 2023387 - RNA, 16 nt, Human
cgggcauggcagcccu

SEQ ID NO: 2023388 - RNA, 15 nt, Human
cgggcaugacacgaa

SEQ ID NO: 2023389 - RNA, 12 nt, Human
cgggcaugacac

SEQ ID NO: 2023390 - RNA, 15 nt, Human
cgggcaucauucucu

SEQ ID NO: 2023391 - RNA, 14 nt, Human
ccuuugacaaaggu

SEQ ID NO: 2023392 - RNA, 23 nt, Human
ccuuugacgccaucccagcccca

SEQ ID NO: 2023393 - RNA, 17 nt, Human
ccuuucuuuucuuucuu

SEQ ID NO: 2023394 - RNA, 12 nt, Human
ccuuucuguguu

SEQ ID NO: 2023395 - RNA, 11 nt, Human
ccuuucuuccu

SEQ ID NO: 2023396 - RNA, 12 nt, Human
ccuuucuuccuc

SEQ ID NO: 2023397 - RNA, 13 nt, Human
ccuuucuuccuca

SEQ ID NO: 2023398 - RNA, 15 nt, Human
ccuuucuuccucauu

SEQ ID NO: 2023399 - RNA, 19 nt, Human
ccuuucuuccucauucccu

SEQ ID NO: 2023400 - RNA, 12 nt, Human
ccuuucuucucc

SEQ ID NO: 2023401 - RNA, 17 nt, Human
ccuuucuucucccccau

SEQ ID NO: 2023402 - RNA, 15 nt, Human
ccuuugcagcucaga

SEQ ID NO: 2023403 - RNA, 16 nt, Human
ccuuugcuugaaagaa

SEQ ID NO: 2023404 - RNA, 13 nt, Human
ccuuuaagagaaa

SEQ ID NO: 2023405 - RNA, 18 nt, Human
ccuuuaaagaaacauggu

SEQ ID NO: 2023406 - RNA, 14 nt, Human
ccuuuaagagaaau

SEQ ID NO: 2023407 - RNA, 15 nt, Human
ccuuucugaucuuca

SEQ ID NO: 2023408 - RNA, 16 nt, Human
ccuuucugaucuucac

SEQ ID NO: 2023409 - RNA, 19 nt, Human
ccuuguggucccaccccac

SEQ ID NO: 2023410 - RNA, 16 nt, Human
ccuuguggucccaccc

SEQ ID NO: 2023411 - RNA, 20 nt, Human
ccuuguggucccaccccaca

SEQ ID NO: 2023412 - RNA, 14 nt, Human
ccuuggcugcaggg

SEQ ID NO: 2023413 - RNA, 12 nt, Human
ccuuggcugcag

SEQ ID NO: 2023414 - RNA, 13 nt, Human
ccuuggcugcagg

SEQ ID NO: 2023415 - RNA, 14 nt, Human
cgauccuccccugg

SEQ ID NO: 2023416 - RNA, 19 nt, Human
cgaucuggguucacugcaa

SEQ ID NO: 2023417 - RNA, 21 nt, Human
cgauugcaggagucccugcca

SEQ ID NO: 2023418 - RNA, 21 nt, Human
cgauucuucugcuucagccuc

SEQ ID NO: 2023419 - RNA, 13 nt, Human
cgauucuucugcu

SEQ ID NO: 2023420 - RNA, 19 nt, Human
cgauucuucugcuucagcc

SEQ ID NO: 2023421 - RNA, 22 nt, Human
cgcaagcaccauccccuccggc

SEQ ID NO: 2023422 - RNA, 18 nt, Human
cgcaagggaggcccagcg

SEQ ID NO: 2023423 - RNA, 23 nt, Human
cgauugcaggagucccugccauc

SEQ ID NO: 2023424 - RNA, 12 nt, Human
cgauuucuguuu

SEQ ID NO: 2023425 - RNA, 11 nt, Human
cgcaaugugac

SEQ ID NO: 2023426 - RNA, 15 nt, Human
ccuuuguauucucuc

SEQ ID NO: 2023427 - RNA, 18 nt, Human
ccuuuguauucucuccug

SEQ ID NO: 2023428 - RNA, 20 nt, Human
ccuuuguauucucuccugua

SEQ ID NO: 2023429 - RNA, 24 nt, Human
cgagcugggaccaguaccuggguc

SEQ ID NO: 2023430 - RNA, 18 nt, Human
cgaggccuucucugaagg

SEQ ID NO: 2023431 - RNA, 19 nt, Human
cgaggccuucucugaagga

SEQ ID NO: 2023432 - RNA, 13 nt, Human
cgaggacagggag

SEQ ID NO: 2023433 - RNA, 12 nt, Human
cgaggacaggga

SEQ ID NO: 2023434 - RNA, 14 nt, Human
cgcagacaggacca

SEQ ID NO: 2023435 - RNA, 13 nt, Human
cgcagacaggacc

SEQ ID NO: 2023436 - RNA, 13 nt, Human
cgcagaagcccug

SEQ ID NO: 2023437 - RNA, 15 nt, Human
cgcccccacugguga

SEQ ID NO: 2023438 - RNA, 12 nt, Human
cgcccaggcugg

SEQ ID NO: 2023439 - RNA, 19 nt, Human
cgcccaggcuggagugcaa

SEQ ID NO: 2023440 - RNA, 20 nt, Human
cgcccaggcuggagugcaau

SEQ ID NO: 2023441 - RNA, 13 nt, Human
cgcccucccaggc

SEQ ID NO: 2023442 - RNA, 12 nt, Human
cgcccucccagg

SEQ ID NO: 2023443 - RNA, 17 nt, Human
cgcgacaaugcaaacca

SEQ ID NO: 2023444 - RNA, 16 nt, Human
cgcgacaaugcaaacc

SEQ ID NO: 2023445 - RNA, 14 nt, Human
cgcuaagagggagg

SEQ ID NO: 2023446 - RNA, 16 nt, Human
cgcuaagagggaggga

SEQ ID NO: 2023447 - RNA, 15 nt, Human
cgcuaagagggaggg

SEQ ID NO: 2023448 - RNA, 21 nt, Human
cgcuaagagggagggagggcu

SEQ ID NO: 2023449 - RNA, 22 nt, Human
cgcuaacuugcuuaaaugugaa

SEQ ID NO: 2023450 - RNA, 20 nt, Human
cgcuacuaugauuuaauuug

SEQ ID NO: 2023451 - RNA, 15 nt, Human
cgcuagcacagcucc

SEQ ID NO: 2023452 - RNA, 16 nt, Human
cgcuagcacagcuccc

SEQ ID NO: 2023453 - RNA, 16 nt, Human
cgcgugcacacaccag

SEQ ID NO: 2023454 - RNA, 19 nt, Human
cgcgugcacacaccagagc

SEQ ID NO: 2023455 - RNA, 20 nt, Human
cgcgugcacacaccagagcc

SEQ ID NO: 2023456 - RNA, 21 nt, Human
cccacaaaggagagcuagcag

SEQ ID NO: 2023457 - RNA, 21 nt, Human
ccaugcuguuuucccuuugcc

SEQ ID NO: 2023458 - RNA, 16 nt, Human
ccaugcugucuggcac

SEQ ID NO: 2023459 - RNA, 18 nt, Human
ccaugcugucuggcacag

SEQ ID NO: 2023460 - RNA, 20 nt, Human
ccaugcugucuggcacagcc

SEQ ID NO: 2023461 - RNA, 21 nt, Human
ccaugcugucuggcacagccu

SEQ ID NO: 2023462 - RNA, 22 nt, Human
ccaugcugucuggcacagccug

SEQ ID NO: 2023463 - RNA, 23 nt, Human
ccaugcugucuggcacagccugc

SEQ ID NO: 2023464 - RNA, 16 nt, Human
ccauucuccaccugcc

SEQ ID NO: 2023465 - RNA, 15 nt, Human
ccauucuccaccugc

SEQ ID NO: 2023466 - RNA, 14 nt, Human
ccauggacuuuguu

SEQ ID NO: 2023467 - RNA, 13 nt, Human
ccauggacuuugu

SEQ ID NO: 2023468 - RNA, 21 nt, Human
ccauucugccugcccaggccc

SEQ ID NO: 2023469 - RNA, 14 nt, Human
ccauucuccaccug

SEQ ID NO: 2023470 - RNA, 19 nt, Human
ccauucugccugcccaggc

SEQ ID NO: 2023471 - RNA, 20 nt, Human
ccauucugccugcccaggcc

SEQ ID NO: 2023472 - RNA, 16 nt, Human
ccauucugccugccca

SEQ ID NO: 2023473 - RNA, 17 nt, Human
ccauucuccaccugcca

SEQ ID NO: 2023474 - RNA, 17 nt, Human
ccauucugccugcccag

SEQ ID NO: 2023475 - RNA, 18 nt, Human
ccauucugccugcccagg

SEQ ID NO: 2023476 - RNA, 17 nt, Human
cccaaaccaccagaagc

SEQ ID NO: 2023477 - RNA, 18 nt, Human
cccaaaccaccagaagcc

SEQ ID NO: 2023478 - RNA, 22 nt, Human
cccaaaccaccagaagcccaga

SEQ ID NO: 2023479 - RNA, 15 nt, Human
cccaaaccuuucccc

SEQ ID NO: 2023480 - RNA, 15 nt, Human
cccaaagaugcagcc

SEQ ID NO: 2023481 - RNA, 12 nt, Human
cccaaagaugca

SEQ ID NO: 2023482 - RNA, 16 nt, Human
cccaaagcagugcaug

SEQ ID NO: 2023483 - RNA, 22 nt, Human
ccauuuugggguacccacugcu

SEQ ID NO: 2023484 - RNA, 18 nt, Human
ccauuuuggugucuuucu

SEQ ID NO: 2023485 - RNA, 19 nt, Human
ccauuuuggugucuuucuc

SEQ ID NO: 2023486 - RNA, 23 nt, Human
ccauuuuggauucuuauggacaa

SEQ ID NO: 2023487 - RNA, 20 nt, Human
ccauuuugggguacccacug

SEQ ID NO: 2023488 - RNA, 13 nt, Human
cccaaaaggcaga

SEQ ID NO: 2023489 - RNA, 20 nt, Human
ccauuuuggugucuuucucu

SEQ ID NO: 2023490 - RNA, 21 nt, Human
ccauuuuggugucuuucucuu

SEQ ID NO: 2023491 - RNA, 22 nt, Human
ccauuuuggugucuuucucuuu

SEQ ID NO: 2023492 - RNA, 18 nt, Human
cccaaaaggcagaagcaa

SEQ ID NO: 2023493 - RNA, 20 nt, Human
ccauccucuguacagagccc

SEQ ID NO: 2023494 - RNA, 19 nt, Human
ccagugaggcucugcccuu

SEQ ID NO: 2023495 - RNA, 18 nt, Human
ccagugaggcucugcccu

SEQ ID NO: 2023496 - RNA, 17 nt, Human
ccagugaggcucugccc

SEQ ID NO: 2023497 - RNA, 20 nt, Human
ccagugaggcucugcccuug

SEQ ID NO: 2023498 - RNA, 12 nt, Human
ccauacuaauua

SEQ ID NO: 2023499 - RNA, 13 nt, Human
ccauacuaauuau

SEQ ID NO: 2023500 - RNA, 23 nt, Human
ccauacuaauuauacccccugca

SEQ ID NO: 2023501 - RNA, 14 nt, Human
ccauagugacuuuu

SEQ ID NO: 2023502 - RNA, 19 nt, Human
ccauauccauagugacuuu

SEQ ID NO: 2023503 - RNA, 19 nt, Human
ccauaguuaaagaagacau

SEQ ID NO: 2023504 - RNA, 17 nt, Human
ccauaguuacuguaaaa

SEQ ID NO: 2023505 - RNA, 18 nt, Human
ccauaguuacuguaaaau

SEQ ID NO: 2023506 - RNA, 18 nt, Human
ccauaguugacaguucca

SEQ ID NO: 2023507 - RNA, 13 nt, Human
ccauauagaaagc

SEQ ID NO: 2023508 - RNA, 18 nt, Human
ccauaucaaaagacacag

SEQ ID NO: 2023509 - RNA, 21 nt, Human
ccauaucaaaagacacagggg

SEQ ID NO: 2023510 - RNA, 13 nt, Human
ccaucaccagaca

SEQ ID NO: 2023511 - RNA, 19 nt, Human
ccauccucuguacagagcc

SEQ ID NO: 2023512 - RNA, 12 nt, Human
ccauccucugua

SEQ ID NO: 2023513 - RNA, 16 nt, Human
ccauccuccuccuucc

SEQ ID NO: 2023514 - RNA, 18 nt, Human
ccauccuccuccuuccua

SEQ ID NO: 2023515 - RNA, 22 nt, Human
ccaucugcugucuuuucuuugc

SEQ ID NO: 2023516 - RNA, 12 nt, Human
ccaucuggagag

SEQ ID NO: 2023517 - RNA, 19 nt, Human
ccaucuggagagcccagag

SEQ ID NO: 2023518 - RNA, 19 nt, Human
ccaucuccuuucucuggua

SEQ ID NO: 2023519 - RNA, 22 nt, Human
ccaucauugaaaucuuuuugcu

SEQ ID NO: 2023520 - RNA, 12 nt, Human
ccaucagcccaa

SEQ ID NO: 2023521 - RNA, 13 nt, Human
ccaucauuucugg

SEQ ID NO: 2023522 - RNA, 12 nt, Human
ccaucauuucug

SEQ ID NO: 2023523 - RNA, 21 nt, Human
ccauccaccguccccucccag

SEQ ID NO: 2023524 - RNA, 12 nt, Human
ccaugccagccg

SEQ ID NO: 2023525 - RNA, 14 nt, Human
ccaugccaggaacc

SEQ ID NO: 2023526 - RNA, 15 nt, Human
ccaugccaggaaccu

SEQ ID NO: 2023527 - RNA, 13 nt, Human
ccaugcugcccug

SEQ ID NO: 2023528 - RNA, 11 nt, Human
ccaugcugccc

SEQ ID NO: 2023529 - RNA, 14 nt, Human
ccaugcugcccugu

SEQ ID NO: 2023530 - RNA, 18 nt, Human
ccaugauguuuuccauga

SEQ ID NO: 2023531 - RNA, 21 nt, Human
ccaugauuaaccacuucagcu

SEQ ID NO: 2023532 - RNA, 19 nt, Human
ccaugauuaaccacuucag

SEQ ID NO: 2023533 - RNA, 14 nt, Human
ccaugaagauguag

SEQ ID NO: 2023534 - RNA, 22 nt, Human
ccaucuggagagcccagagucc

SEQ ID NO: 2023535 - RNA, 15 nt, Human
ccaguagcaggcccg

SEQ ID NO: 2023536 - RNA, 23 nt, Human
ccaguagcugggaccacaggugc

SEQ ID NO: 2023537 - RNA, 15 nt, Human
ccaguacauucucag

SEQ ID NO: 2023538 - RNA, 17 nt, Human
ccaguacauucucaguu

SEQ ID NO: 2023539 - RNA, 19 nt, Human
ccaguacauucucaguuuu

SEQ ID NO: 2023540 - RNA, 22 nt, Human
ccaguacauucucaguuuuucu

SEQ ID NO: 2023541 - RNA, 19 nt, Human
ccaguaccuggguccccag

SEQ ID NO: 2023542 - RNA, 23 nt, Human
ccaguaccuggguccccagcccu

SEQ ID NO: 2023543 - RNA, 20 nt, Human
ccagugaaaucaguuacucu

SEQ ID NO: 2023544 - RNA, 14 nt, Human
ccagguucagcuug

SEQ ID NO: 2023545 - RNA, 22 nt, Human
ccagguggugggcauucucucu

SEQ ID NO: 2023546 - RNA, 12 nt, Human
ccaguaacacag

SEQ ID NO: 2023547 - RNA, 20 nt, Human
ccaguaacacaggccacccu

SEQ ID NO: 2023548 - RNA, 17 nt, Human
ccaguacaagaucucag

SEQ ID NO: 2023549 - RNA, 21 nt, Human
ccaguaagaucacuguuuaga

SEQ ID NO: 2023550 - RNA, 14 nt, Human
ccaguaagaucacu

SEQ ID NO: 2023551 - RNA, 15 nt, Human
ccaguaagaucacug

SEQ ID NO: 2023552 - RNA, 16 nt, Human
ccaguaagaucacugu

SEQ ID NO: 2023553 - RNA, 17 nt, Human
ccaguaagaucacuguu

SEQ ID NO: 2023554 - RNA, 12 nt, Human
ccaguaagauca

SEQ ID NO: 2023555 - RNA, 19 nt, Human
ccaggugcuaggaacacuc

SEQ ID NO: 2023556 - RNA, 16 nt, Human
ccaggugaaggaggcu

SEQ ID NO: 2023557 - RNA, 20 nt, Human
ccaggugaaggaggcuccag

SEQ ID NO: 2023558 - RNA, 21 nt, Human
ccaggugaaggaggcuccagg

SEQ ID NO: 2023559 - RNA, 23 nt, Human
ccaggucuaccccucccggcccu

SEQ ID NO: 2023560 - RNA, 22 nt, Human
ccaggucccuuucauuugcuau

SEQ ID NO: 2023561 - RNA, 12 nt, Human
ccaggccccucc

SEQ ID NO: 2023562 - RNA, 16 nt, Human
ccaggccccucccucu

SEQ ID NO: 2023563 - RNA, 18 nt, Human
ccaggccccucccucucc

SEQ ID NO: 2023564 - RNA, 20 nt, Human
ccaggcuguaucccaugagc

SEQ ID NO: 2023565 - RNA, 19 nt, Human
ccaggcuggucucaaacuc

SEQ ID NO: 2023566 - RNA, 21 nt, Human
ccaggcuggucucgaacuccu

SEQ ID NO: 2023567 - RNA, 13 nt, Human
ccaggccccugcc

SEQ ID NO: 2023568 - RNA, 15 nt, Human
ccaggccccccuguc

SEQ ID NO: 2023569 - RNA, 16 nt, Human
ccaggccccccuguca

SEQ ID NO: 2023570 - RNA, 12 nt, Human
ccagggaagggg

SEQ ID NO: 2023571 - RNA, 19 nt, Human
ccaggcuuuuuuaucaugu

SEQ ID NO: 2023572 - RNA, 12 nt, Human
ccaggcuuucua

SEQ ID NO: 2023573 - RNA, 19 nt, Human
ccaggcuuucuagaaagaa

SEQ ID NO: 2023574 - RNA, 18 nt, Human
ccaggcuuuguacagagu

SEQ ID NO: 2023575 - RNA, 13 nt, Human
ccagggccaaaag

SEQ ID NO: 2023576 - RNA, 16 nt, Human
ccaggagcagccacau

SEQ ID NO: 2023577 - RNA, 15 nt, Human
ccaggagcagccaca

SEQ ID NO: 2023578 - RNA, 15 nt, Human
ccaggagccccgagg

SEQ ID NO: 2023579 - RNA, 13 nt, Human
ccaggaggccagc

SEQ ID NO: 2023580 - RNA, 14 nt, Human
ccaggaggccagcc

SEQ ID NO: 2023581 - RNA, 12 nt, Human
ccaggaggccag

SEQ ID NO: 2023582 - RNA, 13 nt, Human
ccaggagcccauu

SEQ ID NO: 2023583 - RNA, 11 nt, Human
ccaggagccca

SEQ ID NO: 2023584 - RNA, 12 nt, Human
ccaggagcccau

SEQ ID NO: 2023585 - RNA, 14 nt, Human
ccaggagccuccug

SEQ ID NO: 2023586 - RNA, 13 nt, Human
ccaggagccuccu

SEQ ID NO: 2023587 - RNA, 18 nt, Human
ccaggagccuccugcccu

SEQ ID NO: 2023588 - RNA, 19 nt, Human
ccaggagccuccugcccuu

SEQ ID NO: 2023589 - RNA, 22 nt, Human
ccaggcauuccccaggaggcca

SEQ ID NO: 2023590 - RNA, 23 nt, Human
ccaggcauuccccaggaggccag

SEQ ID NO: 2023591 - RNA, 24 nt, Human
ccaggcauuccccaggaggccagc

SEQ ID NO: 2023592 - RNA, 13 nt, Human
ccaggcauggugg

SEQ ID NO: 2023593 - RNA, 14 nt, Human
ccaggcauucccca

SEQ ID NO: 2023594 - RNA, 12 nt, Human
ccagcugccucc

SEQ ID NO: 2023595 - RNA, 18 nt, Human
ccagcugccuaggauuca

SEQ ID NO: 2023596 - RNA, 22 nt, Human
ccagcucugguccauagagagc

SEQ ID NO: 2023597 - RNA, 21 nt, Human
ccagcucugguccauagagag

SEQ ID NO: 2023598 - RNA, 17 nt, Human
ccagcucugguccauag

SEQ ID NO: 2023599 - RNA, 14 nt, Human
ccagcucuggucca

SEQ ID NO: 2023600 - RNA, 23 nt, Human
ccagcugcuugggcuucauccuc

SEQ ID NO: 2023601 - RNA, 23 nt, Human
ccagcugcugagccgcagagaag

SEQ ID NO: 2023602 - RNA, 20 nt, Human
ccagcugcuugggcuucauc

SEQ ID NO: 2023603 - RNA, 14 nt, Human
ccagcugcugagcc

SEQ ID NO: 2023604 - RNA, 15 nt, Human
ccagcugcugagccg

SEQ ID NO: 2023605 - RNA, 16 nt, Human
ccagcugcugagccgc

SEQ ID NO: 2023606 - RNA, 17 nt, Human
ccagcugcugagccgca

SEQ ID NO: 2023607 - RNA, 18 nt, Human
ccagcugcugagccgcag

SEQ ID NO: 2023608 - RNA, 19 nt, Human
ccagcugcugagccgcaga

SEQ ID NO: 2023609 - RNA, 20 nt, Human
ccagccuugaccauucucca

SEQ ID NO: 2023610 - RNA, 19 nt, Human
ccagccuugaccauucucc

SEQ ID NO: 2023611 - RNA, 21 nt, Human
ccagagcauuccagucaggcu

SEQ ID NO: 2023612 - RNA, 23 nt, Human
ccagagcauuccagucaggcucu

SEQ ID NO: 2023613 - RNA, 22 nt, Human
ccagagcccaccuuggcucaag

SEQ ID NO: 2023614 - RNA, 16 nt, Human
ccagagcccaccuugg

SEQ ID NO: 2023615 - RNA, 18 nt, Human
ccagagcauuccagucag

SEQ ID NO: 2023616 - RNA, 19 nt, Human
ccagagcauuccagucagg

SEQ ID NO: 2023617 - RNA, 13 nt, Human
ccagcucuggucc

SEQ ID NO: 2023618 - RNA, 12 nt, Human
ccagcucugguc

SEQ ID NO: 2023619 - RNA, 11 nt, Human
ccagcucuggu

SEQ ID NO: 2023620 - RNA, 22 nt, Human
ccagccuugaccauucuccacc

SEQ ID NO: 2023621 - RNA, 14 nt, Human
ccagcgagcccugg

SEQ ID NO: 2023622 - RNA, 15 nt, Human
ccagcgagcccuggu

SEQ ID NO: 2023623 - RNA, 16 nt, Human
ccagcgagcccuggug

SEQ ID NO: 2023624 - RNA, 22 nt, Human
ccaggaaguagcacaggcugag

SEQ ID NO: 2023625 - RNA, 20 nt, Human
ccaggaagccagcaggcucu

SEQ ID NO: 2023626 - RNA, 22 nt, Human
ccaggaagccagcaggcucuca

SEQ ID NO: 2023627 - RNA, 16 nt, Human
ccaggaaguagcacag

SEQ ID NO: 2023628 - RNA, 18 nt, Human
ccaggaaguagcacaggc

SEQ ID NO: 2023629 - RNA, 19 nt, Human
ccaggaaguagcacaggcu

SEQ ID NO: 2023630 - RNA, 21 nt, Human
ccaggaaguagcacaggcuga

SEQ ID NO: 2023631 - RNA, 23 nt, Human
ccagcuggggccaggcugggucg

SEQ ID NO: 2023632 - RNA, 22 nt, Human
ccagcuggggccaggcuggguc

SEQ ID NO: 2023633 - RNA, 21 nt, Human
ccagcuggggccaggcugggu

SEQ ID NO: 2023634 - RNA, 20 nt, Human
ccagcuggggccaggcuggg

SEQ ID NO: 2023635 - RNA, 19 nt, Human
ccagcuggggccaggcugg

SEQ ID NO: 2023636 - RNA, 18 nt, Human
ccagcuggggccaggcug

SEQ ID NO: 2023637 - RNA, 17 nt, Human
ccagcuggggccaggcu

SEQ ID NO: 2023638 - RNA, 20 nt, Human
ccaggacaggagaugcugug

SEQ ID NO: 2023639 - RNA, 22 nt, Human
ccccucagggucccugguggca

SEQ ID NO: 2023640 - RNA, 17 nt, Human
ccccaggaggccagccu

SEQ ID NO: 2023641 - RNA, 14 nt, Human
cccaugggcaggag

SEQ ID NO: 2023642 - RNA, 16 nt, Human
cccaugggcaggagac

SEQ ID NO: 2023643 - RNA, 23 nt, Human
cccauggccggcuuucaggagcu

SEQ ID NO: 2023644 - RNA, 16 nt, Human
cccaugggaggcugga

SEQ ID NO: 2023645 - RNA, 14 nt, Human
cccauggaccaugc

SEQ ID NO: 2023646 - RNA, 18 nt, Human
cccaugcugcccugugag

SEQ ID NO: 2023647 - RNA, 17 nt, Human
cccaugcugcccuguga

SEQ ID NO: 2023648 - RNA, 16 nt, Human
cccaugcugcccugug

SEQ ID NO: 2023649 - RNA, 15 nt, Human
cccaugcugcccugu

SEQ ID NO: 2023650 - RNA, 13 nt, Human
cccaguggcaggg

SEQ ID NO: 2023651 - RNA, 14 nt, Human
cccaguggcagggc

SEQ ID NO: 2023652 - RNA, 15 nt, Human
cccaguggcagggca

SEQ ID NO: 2023653 - RNA, 16 nt, Human
cccaguggcagggcac

SEQ ID NO: 2023654 - RNA, 17 nt, Human
cccaguggcagggcaca

SEQ ID NO: 2023655 - RNA, 20 nt, Human
cccaguggcagggcacaggg

SEQ ID NO: 2023656 - RNA, 22 nt, Human
cccaguggcagggcacagggcc

SEQ ID NO: 2023657 - RNA, 23 nt, Human
cccaguggcagggcacagggccu

SEQ ID NO: 2023658 - RNA, 17 nt, Human
cccagugccgagaagga

SEQ ID NO: 2023659 - RNA, 18 nt, Human
cccagugccgagaaggaa

SEQ ID NO: 2023660 - RNA, 15 nt, Human
cccagugcccacagg

SEQ ID NO: 2023661 - RNA, 20 nt, Human
cccagugcccacaggaucag

SEQ ID NO: 2023662 - RNA, 22 nt, Human
ccccaaauggaaaugggcagag

SEQ ID NO: 2023663 - RNA, 13 nt, Human
cccauucugccug

SEQ ID NO: 2023664 - RNA, 20 nt, Human
ccccacccaagggccuggcc

SEQ ID NO: 2023665 - RNA, 14 nt, Human
ccccacccaagggc

SEQ ID NO: 2023666 - RNA, 13 nt, Human
ccccaagccuggc

SEQ ID NO: 2023667 - RNA, 14 nt, Human
ccccaagccuggca

SEQ ID NO: 2023668 - RNA, 13 nt, Human
ccccaagcgcccu

SEQ ID NO: 2023669 - RNA, 13 nt, Human
ccccaccaucugc

SEQ ID NO: 2023670 - RNA, 14 nt, Human
ccccaccaucugcu

SEQ ID NO: 2023671 - RNA, 15 nt, Human
ccccaccaucugcug

SEQ ID NO: 2023672 - RNA, 18 nt, Human
ccccaccaucugcugucu

SEQ ID NO: 2023673 - RNA, 19 nt, Human
ccccaccaucugcugucuu

SEQ ID NO: 2023674 - RNA, 17 nt, Human
ccccaagcgcccuggcc

SEQ ID NO: 2023675 - RNA, 23 nt, Human
cccaggcauuccccaggaggcca

SEQ ID NO: 2023676 - RNA, 22 nt, Human
cccaggcauuccccaggaggcc

SEQ ID NO: 2023677 - RNA, 21 nt, Human
cccaggcauuccccaggaggc

SEQ ID NO: 2023678 - RNA, 20 nt, Human
cccaggcauuccccaggagg

SEQ ID NO: 2023679 - RNA, 17 nt, Human
cccaggcaggucuugaa

SEQ ID NO: 2023680 - RNA, 11 nt, Human
cccaggccccu

SEQ ID NO: 2023681 - RNA, 16 nt, Human
cccaggccccugccac

SEQ ID NO: 2023682 - RNA, 18 nt, Human
cccaggccccugccaccc

SEQ ID NO: 2023683 - RNA, 21 nt, Human
cccaggccccugccacccugg

SEQ ID NO: 2023684 - RNA, 22 nt, Human
cccaggccccugccacccuggg

SEQ ID NO: 2023685 - RNA, 11 nt, Human
cccaggcaggu

SEQ ID NO: 2023686 - RNA, 13 nt, Human
cccaggcaggucu

SEQ ID NO: 2023687 - RNA, 15 nt, Human
cccaggauauauuuu

SEQ ID NO: 2023688 - RNA, 17 nt, Human
cccaggauauauuuuau

SEQ ID NO: 2023689 - RNA, 10 nt, Human
cccaggaggg

SEQ ID NO: 2023690 - RNA, 22 nt, Human
cccaggaggccagccuugacca

SEQ ID NO: 2023691 - RNA, 13 nt, Human
cccaggaggccag

SEQ ID NO: 2023692 - RNA, 21 nt, Human
cccaggagccccgaggccuuc

SEQ ID NO: 2023693 - RNA, 19 nt, Human
cccaggagccugcccagcc

SEQ ID NO: 2023694 - RNA, 17 nt, Human
cccaggagccugcccag

SEQ ID NO: 2023695 - RNA, 19 nt, Human
cccaggaggacucccugcu

SEQ ID NO: 2023696 - RNA, 18 nt, Human
cccaggagccccgaggcc

SEQ ID NO: 2023697 - RNA, 18 nt, Human
cccaggccuccuacagcu

SEQ ID NO: 2023698 - RNA, 17 nt, Human
cccaggccuccuacagc

SEQ ID NO: 2023699 - RNA, 15 nt, Human
cccaggccugccugu

SEQ ID NO: 2023700 - RNA, 16 nt, Human
cccaggccugccuguu

SEQ ID NO: 2023701 - RNA, 18 nt, Human
cccaggcgccccuucccc

SEQ ID NO: 2023702 - RNA, 14 nt, Human
cccaggcugagccu

SEQ ID NO: 2023703 - RNA, 22 nt, Human
cccagggggcuuccugagggga

SEQ ID NO: 2023704 - RNA, 19 nt, Human
cccagggugagguggcaug

SEQ ID NO: 2023705 - RNA, 13 nt, Human
cccagugcccaca

SEQ ID NO: 2023706 - RNA, 20 nt, Human
cccagucuggaaugcagugg

SEQ ID NO: 2023707 - RNA, 21 nt, Human
cccagucaauuacauguuugg

SEQ ID NO: 2023708 - RNA, 13 nt, Human
cccagucccagca

SEQ ID NO: 2023709 - RNA, 14 nt, Human
cccagucccagcag

SEQ ID NO: 2023710 - RNA, 15 nt, Human
cccagucccagcagc

SEQ ID NO: 2023711 - RNA, 17 nt, Human
cccagucccagcagcca

SEQ ID NO: 2023712 - RNA, 19 nt, Human
cccagucccagcagccagc

SEQ ID NO: 2023713 - RNA, 22 nt, Human
cccaggugcuaggaacacuccu

SEQ ID NO: 2023714 - RNA, 23 nt, Human
cccaggugcuaggaacacuccuu

SEQ ID NO: 2023715 - RNA, 14 nt, Human
cccagguggcugug

SEQ ID NO: 2023716 - RNA, 15 nt, Human
cccagguggcugugg

SEQ ID NO: 2023717 - RNA, 18 nt, Human
cccagccccuucugaccc

SEQ ID NO: 2023718 - RNA, 19 nt, Human
cccagcccuuccucugcuc

SEQ ID NO: 2023719 - RNA, 12 nt, Human
cccagccugcua

SEQ ID NO: 2023720 - RNA, 16 nt, Human
cccagccucuuucccu

SEQ ID NO: 2023721 - RNA, 23 nt, Human
cccagccucaaauccaggacccu

SEQ ID NO: 2023722 - RNA, 15 nt, Human
cccagccucuuuccc

SEQ ID NO: 2023723 - RNA, 21 nt, Human
cccagccucaaauccaggacc

SEQ ID NO: 2023724 - RNA, 19 nt, Human
cccagcaagugagagcugg

SEQ ID NO: 2023725 - RNA, 20 nt, Human
cccagcaagugagagcuggg

SEQ ID NO: 2023726 - RNA, 21 nt, Human
cccagcaagugagagcugggu

SEQ ID NO: 2023727 - RNA, 22 nt, Human
cccagcaagugagagcugggug

SEQ ID NO: 2023728 - RNA, 23 nt, Human
cccagcaagugagagcugggugu

SEQ ID NO: 2023729 - RNA, 23 nt, Human
cccagauugcaacaggcugggcu

SEQ ID NO: 2023730 - RNA, 11 nt, Human
cccagccccuu

SEQ ID NO: 2023731 - RNA, 22 nt, Human
cccagcuaccucaaccaaugcc

SEQ ID NO: 2023732 - RNA, 14 nt, Human
cccagcuaccucaa

SEQ ID NO: 2023733 - RNA, 20 nt, Human
cccagcgugaagccagggcc

SEQ ID NO: 2023734 - RNA, 14 nt, Human
cccagcuccacccc

SEQ ID NO: 2023735 - RNA, 16 nt, Human
cccagcgagggcccca

SEQ ID NO: 2023736 - RNA, 21 nt, Human
cccagcgcugacgugucagga

SEQ ID NO: 2023737 - RNA, 19 nt, Human
cccagcgagcccugguggc

SEQ ID NO: 2023738 - RNA, 23 nt, Human
cccagcgagcccugguggcagug

SEQ ID NO: 2023739 - RNA, 17 nt, Human
cccagcgagcccuggug

SEQ ID NO: 2023740 - RNA, 18 nt, Human
cccagcgagcccuggugg

SEQ ID NO: 2023741 - RNA, 15 nt, Human
cccagcgagcccugg

SEQ ID NO: 2023742 - RNA, 18 nt, Human
cccagagggccugcaagg

SEQ ID NO: 2023743 - RNA, 20 nt, Human
cccagagggccugcaaggga

SEQ ID NO: 2023744 - RNA, 15 nt, Human
cccagagucccccca

SEQ ID NO: 2023745 - RNA, 20 nt, Human
cccagaguccccccacuccc

SEQ ID NO: 2023746 - RNA, 20 nt, Human
cccagauugcaacaggcugg

SEQ ID NO: 2023747 - RNA, 23 nt, Human
cccagauggcuggaaggggucca

SEQ ID NO: 2023748 - RNA, 14 nt, Human
cccagaucagccag

SEQ ID NO: 2023749 - RNA, 15 nt, Human
cccagaucagccaga

SEQ ID NO: 2023750 - RNA, 19 nt, Human
cccagaucagccagaagcc

SEQ ID NO: 2023751 - RNA, 21 nt, Human
cccagauugcaacaggcuggg

SEQ ID NO: 2023752 - RNA, 22 nt, Human
cccagauugcaacaggcugggc

SEQ ID NO: 2023753 - RNA, 16 nt, Human
cccagcaagugagagc

SEQ ID NO: 2023754 - RNA, 18 nt, Human
cccagcaagugagagcug

SEQ ID NO: 2023755 - RNA, 20 nt, Human
cccaaucccagcuaccucaa

SEQ ID NO: 2023756 - RNA, 17 nt, Human
cccaauaccccauggac

SEQ ID NO: 2023757 - RNA, 21 nt, Human
cccaaguuuugugaaauuuuu

SEQ ID NO: 2023758 - RNA, 16 nt, Human
cccaauaccccaugga

SEQ ID NO: 2023759 - RNA, 17 nt, Human
cccaaguuuugugaaau

SEQ ID NO: 2023760 - RNA, 19 nt, Human
cccaaguuuugugaaauuu

SEQ ID NO: 2023761 - RNA, 19 nt, Human
cccaaucccagcuaccuca

SEQ ID NO: 2023762 - RNA, 16 nt, Human
cccaauccaucagugc

SEQ ID NO: 2023763 - RNA, 23 nt, Human
cccaaugcacuuuguucuggcuc

SEQ ID NO: 2023764 - RNA, 19 nt, Human
cccaagggccuggccugag

SEQ ID NO: 2023765 - RNA, 18 nt, Human
cccaagggccuggccuga

SEQ ID NO: 2023766 - RNA, 23 nt, Human
cccaagggccuggccugagcugg

SEQ ID NO: 2023767 - RNA, 13 nt, Human
cccaacacgggua

SEQ ID NO: 2023768 - RNA, 17 nt, Human
cccaagggccuggccug

SEQ ID NO: 2023769 - RNA, 13 nt, Human
cccaacacaaaga

SEQ ID NO: 2023770 - RNA, 13 nt, Human
cccaaauuuaauu

SEQ ID NO: 2023771 - RNA, 21 nt, Human
cccaaauugucaccugcuucu

SEQ ID NO: 2023772 - RNA, 17 nt, Human
cccaaaugugugcccag

SEQ ID NO: 2023773 - RNA, 18 nt, Human
cccaaaugugugcccagc

SEQ ID NO: 2023774 - RNA, 19 nt, Human
cccaaaugugugcccagcu

SEQ ID NO: 2023775 - RNA, 23 nt, Human
cccaaauggaaaugggcagagca

SEQ ID NO: 2023776 - RNA, 15 nt, Human
ccaccccacacacgc

SEQ ID NO: 2023777 - RNA, 14 nt, Human
ccacgguguucugu

SEQ ID NO: 2023778 - RNA, 16 nt, Human
ccacggccuccuuucc

SEQ ID NO: 2023779 - RNA, 23 nt, Human
ccacggccaggccagagggagug

SEQ ID NO: 2023780 - RNA, 18 nt, Human
ccacgcuggagugcagug

SEQ ID NO: 2023781 - RNA, 19 nt, Human
ccacgcuggagugcaguga

SEQ ID NO: 2023782 - RNA, 16 nt, Human
ccacggccaggccaga

SEQ ID NO: 2023783 - RNA, 18 nt, Human
ccacggccaggccagagg

SEQ ID NO: 2023784 - RNA, 15 nt, Human
ccacccccacccaag

SEQ ID NO: 2023785 - RNA, 13 nt, Human
ccaccccauggcc

SEQ ID NO: 2023786 - RNA, 16 nt, Human
ccacgcuggagugcag

SEQ ID NO: 2023787 - RNA, 16 nt, Human
ccacuacauucuguua

SEQ ID NO: 2023788 - RNA, 17 nt, Human
ccacuacauucuguuaa

SEQ ID NO: 2023789 - RNA, 15 nt, Human
ccacuagacccacug

SEQ ID NO: 2023790 - RNA, 17 nt, Human
ccacuagacccacugga

SEQ ID NO: 2023791 - RNA, 11 nt, Human
ccacuacauuc

SEQ ID NO: 2023792 - RNA, 15 nt, Human
ccacuacauucuguu

SEQ ID NO: 2023793 - RNA, 14 nt, Human
ccacuacauucugu

SEQ ID NO: 2023794 - RNA, 18 nt, Human
ccacucaguccauagcag

SEQ ID NO: 2023795 - RNA, 20 nt, Human
ccacuccagaccccuggcuu

SEQ ID NO: 2023796 - RNA, 21 nt, Human
ccacuccagaccccuggcuuu

SEQ ID NO: 2023797 - RNA, 22 nt, Human
ccacuccagaccccuggcuuuu

SEQ ID NO: 2023798 - RNA, 17 nt, Human
ccagacagacaacacug

SEQ ID NO: 2023799 - RNA, 14 nt, Human
ccagaccccuggcu

SEQ ID NO: 2023800 - RNA, 15 nt, Human
ccagaccccuggcuu

SEQ ID NO: 2023801 - RNA, 16 nt, Human
ccagaccccuggcuuu

SEQ ID NO: 2023802 - RNA, 17 nt, Human
ccagaccccuggcuuuu

SEQ ID NO: 2023803 - RNA, 19 nt, Human
ccagaauuucccaaagcag

SEQ ID NO: 2023804 - RNA, 12 nt, Human
ccagaauuuccc

SEQ ID NO: 2023805 - RNA, 16 nt, Human
ccagaaugcuuuagga

SEQ ID NO: 2023806 - RNA, 23 nt, Human
ccagaauggucuuucuaaugugu

SEQ ID NO: 2023807 - RNA, 13 nt, Human
ccagaauuucaaa

SEQ ID NO: 2023808 - RNA, 14 nt, Human
ccagaauuauuuuu

SEQ ID NO: 2023809 - RNA, 21 nt, Human
ccagaauuucccaaagcagug

SEQ ID NO: 2023810 - RNA, 18 nt, Human
ccagaauuucccaaagca

SEQ ID NO: 2023811 - RNA, 21 nt, Human
ccagacaccuugacagggcac

SEQ ID NO: 2023812 - RNA, 15 nt, Human
ccagacaagcuguug

SEQ ID NO: 2023813 - RNA, 23 nt, Human
ccagacaagcuguugaccaggca

SEQ ID NO: 2023814 - RNA, 12 nt, Human
ccagacacaaac

SEQ ID NO: 2023815 - RNA, 18 nt, Human
ccagacacaaacugccaa

SEQ ID NO: 2023816 - RNA, 12 nt, Human
ccagaagcccag

SEQ ID NO: 2023817 - RNA, 13 nt, Human
ccagaagcccaga

SEQ ID NO: 2023818 - RNA, 20 nt, Human
ccagaagccacccaaagcag

SEQ ID NO: 2023819 - RNA, 22 nt, Human
ccagaagauagcuucaccccaa

SEQ ID NO: 2023820 - RNA, 14 nt, Human
ccagaagcccagaa

SEQ ID NO: 2023821 - RNA, 22 nt, Human
ccagaaguuugagaucagccug

SEQ ID NO: 2023822 - RNA, 22 nt, Human
ccagaauaaacuggcagcucag

SEQ ID NO: 2023823 - RNA, 23 nt, Human
ccagaaguuugagaucagccugg

SEQ ID NO: 2023824 - RNA, 24 nt, Human
ccagaaacuguucccaccugcugg

SEQ ID NO: 2023825 - RNA, 18 nt, Human
ccagaaaugucccuuucu

SEQ ID NO: 2023826 - RNA, 22 nt, Human
ccagaaaugucccuuucuucuc

SEQ ID NO: 2023827 - RNA, 14 nt, Human
ccacuucagcugac

SEQ ID NO: 2023828 - RNA, 13 nt, Human
ccacuucagcuga

SEQ ID NO: 2023829 - RNA, 21 nt, Human
ccacuuagaaauugcauuucc

SEQ ID NO: 2023830 - RNA, 20 nt, Human
ccacuuagccuuucuuuucu

SEQ ID NO: 2023831 - RNA, 15 nt, Human
ccacuucaaaacaaa

SEQ ID NO: 2023832 - RNA, 14 nt, Human
ccacuucaaaacaa

SEQ ID NO: 2023833 - RNA, 13 nt, Human
ccacugcagaaga

SEQ ID NO: 2023834 - RNA, 18 nt, Human
ccacugcagaagacagua

SEQ ID NO: 2023835 - RNA, 22 nt, Human
ccacucccagcaucgcacucug

SEQ ID NO: 2023836 - RNA, 19 nt, Human
ccacuuagaaauugcauuu

SEQ ID NO: 2023837 - RNA, 17 nt, Human
ccacccccacccaaggg

SEQ ID NO: 2023838 - RNA, 23 nt, Human
ccacccaggagccccgaggccuu

SEQ ID NO: 2023839 - RNA, 17 nt, Human
ccacccaagcaggaggc

SEQ ID NO: 2023840 - RNA, 21 nt, Human
ccacccaggagccccgaggcc

SEQ ID NO: 2023841 - RNA, 16 nt, Human
ccacccaaagcagugg

SEQ ID NO: 2023842 - RNA, 15 nt, Human
ccacccaagcaggag

SEQ ID NO: 2023843 - RNA, 13 nt, Human
ccacccaaagcag

SEQ ID NO: 2023844 - RNA, 16 nt, Human
ccaauauucauagcag

SEQ ID NO: 2023845 - RNA, 22 nt, Human
ccaauaugugauuuuuuuuccc

SEQ ID NO: 2023846 - RNA, 19 nt, Human
ccacacauuucacugucug

SEQ ID NO: 2023847 - RNA, 20 nt, Human
ccacacauuucacugucugu

SEQ ID NO: 2023848 - RNA, 20 nt, Human
ccacacagacuugggcaggg

SEQ ID NO: 2023849 - RNA, 13 nt, Human
ccacaccagcccc

SEQ ID NO: 2023850 - RNA, 14 nt, Human
ccacaccagcccca

SEQ ID NO: 2023851 - RNA, 20 nt, Human
ccacacccagcccacuucug

SEQ ID NO: 2023852 - RNA, 15 nt, Human
ccacacccagcccac

SEQ ID NO: 2023853 - RNA, 16 nt, Human
ccacacccucacugcu

SEQ ID NO: 2023854 - RNA, 21 nt, Human
ccacacccagcccacuucugc

SEQ ID NO: 2023855 - RNA, 22 nt, Human
ccacacccagcccacuucugcc

SEQ ID NO: 2023856 - RNA, 22 nt, Human
ccacacguaaugaaacuuggau

SEQ ID NO: 2023857 - RNA, 14 nt, Human
ccacagcugcucaa

SEQ ID NO: 2023858 - RNA, 12 nt, Human
ccacacuccagc

SEQ ID NO: 2023859 - RNA, 23 nt, Human
ccacaggcccuuccucuccacug

SEQ ID NO: 2023860 - RNA, 18 nt, Human
ccacaggcaugucccaug

SEQ ID NO: 2023861 - RNA, 17 nt, Human
ccacaggcccuuccucu

SEQ ID NO: 2023862 - RNA, 18 nt, Human
ccacaggcccuuccucuc

SEQ ID NO: 2023863 - RNA, 19 nt, Human
ccacaggcccuuccucucc

SEQ ID NO: 2023864 - RNA, 22 nt, Human
ccacaggcccuuccucuccacu

SEQ ID NO: 2023865 - RNA, 16 nt, Human
ccacaggcauguccca

SEQ ID NO: 2023866 - RNA, 15 nt, Human
ccacaggcccuuccu

SEQ ID NO: 2023867 - RNA, 16 nt, Human
ccacaggcccuuccuc

SEQ ID NO: 2023868 - RNA, 16 nt, Human
ccacaggaucagucug

SEQ ID NO: 2023869 - RNA, 21 nt, Human
ccaccaacauacucccaucug

SEQ ID NO: 2023870 - RNA, 21 nt, Human
ccaccaagccuggucagccca

SEQ ID NO: 2023871 - RNA, 15 nt, Human
ccaccaacccucaga

SEQ ID NO: 2023872 - RNA, 20 nt, Human
ccacaucuugcucugcugac

SEQ ID NO: 2023873 - RNA, 19 nt, Human
ccacaucuugcucugcuga

SEQ ID NO: 2023874 - RNA, 18 nt, Human
ccacaucuugcucugcug

SEQ ID NO: 2023875 - RNA, 17 nt, Human
ccacaucuugcucugcu

SEQ ID NO: 2023876 - RNA, 16 nt, Human
ccacauuccugaugcu

SEQ ID NO: 2023877 - RNA, 16 nt, Human
ccacaugugcacaugc

SEQ ID NO: 2023878 - RNA, 21 nt, Human
ccacauccggggccagcuccg

SEQ ID NO: 2023879 - RNA, 14 nt, Human
ccacaucccucucu

SEQ ID NO: 2023880 - RNA, 21 nt, Human
ccacaucccucucugcuggac

SEQ ID NO: 2023881 - RNA, 12 nt, Human
ccacauccacag

SEQ ID NO: 2023882 - RNA, 16 nt, Human
ccacauccacagucuc

SEQ ID NO: 2023883 - RNA, 21 nt, Human
ccacaguguaccauuaaaaua

SEQ ID NO: 2023884 - RNA, 19 nt, Human
ccacagucucccccacccu

SEQ ID NO: 2023885 - RNA, 14 nt, Human
ccacaggugcccgc

SEQ ID NO: 2023886 - RNA, 18 nt, Human
ccacagguaauuucuccu

SEQ ID NO: 2023887 - RNA, 16 nt, Human
ccaagaggcugcagcc

SEQ ID NO: 2023888 - RNA, 21 nt, Human
ccaagagguuuggcuccugcc

SEQ ID NO: 2023889 - RNA, 22 nt, Human
ccaagagguuuggcuccugccc

SEQ ID NO: 2023890 - RNA, 23 nt, Human
ccaagagguuuggcuccugccca

SEQ ID NO: 2023891 - RNA, 21 nt, Human
ccaagaguggccccaccuggc

SEQ ID NO: 2023892 - RNA, 13 nt, Human
ccaagaguggccc

SEQ ID NO: 2023893 - RNA, 15 nt, Human
ccaagaguggcccca

SEQ ID NO: 2023894 - RNA, 16 nt, Human
ccaagaguggccccac

SEQ ID NO: 2023895 - RNA, 18 nt, Human
ccaagaguggccccaccu

SEQ ID NO: 2023896 - RNA, 19 nt, Human
ccaagaguggccccaccug

SEQ ID NO: 2023897 - RNA, 20 nt, Human
ccaagaguggccccaccugg

SEQ ID NO: 2023898 - RNA, 14 nt, Human
ccaagaggcugcag

SEQ ID NO: 2023899 - RNA, 15 nt, Human
ccaagaggcugcagc

SEQ ID NO: 2023900 - RNA, 21 nt, Human
ccaagacuuauuuucacaugu

SEQ ID NO: 2023901 - RNA, 20 nt, Human
ccaagaagcccaggaaaggc

SEQ ID NO: 2023902 - RNA, 19 nt, Human
ccaagaagcccaggaaagg

SEQ ID NO: 2023903 - RNA, 19 nt, Human
ccaagaauagaugcugacu

SEQ ID NO: 2023904 - RNA, 20 nt, Human
ccaagaauagaugcugacug

SEQ ID NO: 2023905 - RNA, 17 nt, Human
ccaagaaguuuaaggaa

SEQ ID NO: 2023906 - RNA, 17 nt, Human
ccaaccccucgcccagu

SEQ ID NO: 2023907 - RNA, 18 nt, Human
ccaaccccucgcccaguc

SEQ ID NO: 2023908 - RNA, 22 nt, Human
ccaaccccucgcccagucccag

SEQ ID NO: 2023909 - RNA, 12 nt, Human
ccaacccucauc

SEQ ID NO: 2023910 - RNA, 15 nt, Human
ccaagaagcccagga

SEQ ID NO: 2023911 - RNA, 14 nt, Human
ccaacccucagagc

SEQ ID NO: 2023912 - RNA, 15 nt, Human
ccaacccucagagcc

SEQ ID NO: 2023913 - RNA, 23 nt, Human
ccaaaggaagcacaugccucucu

SEQ ID NO: 2023914 - RNA, 15 nt, Human
ccaaaggaagcacau

SEQ ID NO: 2023915 - RNA, 21 nt, Human
ccaaagcuaggccuggccaga

SEQ ID NO: 2023916 - RNA, 16 nt, Human
ccaaagcuaggccugg

SEQ ID NO: 2023917 - RNA, 17 nt, Human
ccaaagcuaggccuggc

SEQ ID NO: 2023918 - RNA, 17 nt, Human
ccaaagcgaauuuuaaa

SEQ ID NO: 2023919 - RNA, 15 nt, Human
ccaaagcuaggccug

SEQ ID NO: 2023920 - RNA, 20 nt, Human
ccaaacucaccugccccuca

SEQ ID NO: 2023921 - RNA, 17 nt, Human
ccaaacagugcuguuuc

SEQ ID NO: 2023922 - RNA, 14 nt, Human
ccaaagccaaugug

SEQ ID NO: 2023923 - RNA, 12 nt, Human
ccaaacauuaau

SEQ ID NO: 2023924 - RNA, 19 nt, Human
ccaaagcaguggagcccag

SEQ ID NO: 2023925 - RNA, 23 nt, Human
ccaaagcaguggagcccaggagu

SEQ ID NO: 2023926 - RNA, 22 nt, Human
ccaaagccuccuccagccgcca

SEQ ID NO: 2023927 - RNA, 17 nt, Human
ccaaagccuccuccagc

SEQ ID NO: 2023928 - RNA, 19 nt, Human
ccaaagcagugcaugcugu

SEQ ID NO: 2023929 - RNA, 23 nt, Human
ccaaagcagugcaugcugucccu

SEQ ID NO: 2023930 - RNA, 19 nt, Human
ccaaagccaaagcuaggcc

SEQ ID NO: 2023931 - RNA, 20 nt, Human
ccaacagccacucagaaaag

SEQ ID NO: 2023932 - RNA, 16 nt, Human
ccaacauacucccauc

SEQ ID NO: 2023933 - RNA, 20 nt, Human
ccaacauacucccaucugug

SEQ ID NO: 2023934 - RNA, 19 nt, Human
ccaacauacucccaucugu

SEQ ID NO: 2023935 - RNA, 18 nt, Human
ccaacauacucccaucug

SEQ ID NO: 2023936 - RNA, 17 nt, Human
ccaacauacucccaucu

SEQ ID NO: 2023937 - RNA, 22 nt, Human
ccaacauacucccaucugugaa

SEQ ID NO: 2023938 - RNA, 21 nt, Human
ccaacauacucccaucuguga

SEQ ID NO: 2023939 - RNA, 13 nt, Human
ccaacaucaacau

SEQ ID NO: 2023940 - RNA, 17 nt, Human
ccaacaggggcuccaug

SEQ ID NO: 2023941 - RNA, 20 nt, Human
ccaacagguagcauagcucu

SEQ ID NO: 2023942 - RNA, 20 nt, Human
ccaaccaaguggcucccaca

SEQ ID NO: 2023943 - RNA, 21 nt, Human
ccaaccacacuugucggcucc

SEQ ID NO: 2023944 - RNA, 20 nt, Human
ccaaaguacacuguuucaaa

SEQ ID NO: 2023945 - RNA, 15 nt, Human
ccaaaguacacuguu

SEQ ID NO: 2023946 - RNA, 18 nt, Human
ccaaaguacacuguuuca

SEQ ID NO: 2023947 - RNA, 19 nt, Human
ccaacaagaauaaaggcag

SEQ ID NO: 2023948 - RNA, 21 nt, Human
ccaacaagaauaaaggcagcu

SEQ ID NO: 2023949 - RNA, 17 nt, Human
ccaaggccaaaggaagc

SEQ ID NO: 2023950 - RNA, 22 nt, Human
ccaagcucccaggcauucccca

SEQ ID NO: 2023951 - RNA, 16 nt, Human
ccaagcucccaggcau

SEQ ID NO: 2023952 - RNA, 15 nt, Human
ccaagcucccaggca

SEQ ID NO: 2023953 - RNA, 14 nt, Human
ccaagcucccaggc

SEQ ID NO: 2023954 - RNA, 17 nt, Human
ccaagcgcccuggcccc

SEQ ID NO: 2023955 - RNA, 22 nt, Human
ccaagcgcccuggcccccacau

SEQ ID NO: 2023956 - RNA, 13 nt, Human
ccaagcgcccugg

SEQ ID NO: 2023957 - RNA, 14 nt, Human
ccaagcgcccuggc

SEQ ID NO: 2023958 - RNA, 16 nt, Human
ccaagcgcccuggccc

SEQ ID NO: 2023959 - RNA, 19 nt, Human
ccaagccuggucagcccaa

SEQ ID NO: 2023960 - RNA, 20 nt, Human
ccaagccuggucagcccaaa

SEQ ID NO: 2023961 - RNA, 19 nt, Human
ccaagccuuggcucuaccc

SEQ ID NO: 2023962 - RNA, 15 nt, Human
ccaagccuggcaagg

SEQ ID NO: 2023963 - RNA, 13 nt, Human
ccaagccguggcu

SEQ ID NO: 2023964 - RNA, 22 nt, Human
ccaagccuacuuuugccauuga

SEQ ID NO: 2023965 - RNA, 21 nt, Human
ccaaggccaaaggaagcacau

SEQ ID NO: 2023966 - RNA, 18 nt, Human
ccaaggccaaaggaagca

SEQ ID NO: 2023967 - RNA, 16 nt, Human
ccaaggccaggccuug

SEQ ID NO: 2023968 - RNA, 15 nt, Human
ccaagggccuggccu

SEQ ID NO: 2023969 - RNA, 18 nt, Human
ccaagggccuggccugag

SEQ ID NO: 2023970 - RNA, 16 nt, Human
ccaagggccuggccug

SEQ ID NO: 2023971 - RNA, 19 nt, Human
ccaagggccuggccugagc

SEQ ID NO: 2023972 - RNA, 22 nt, Human
ccaaggggaauguuugccucug

SEQ ID NO: 2023973 - RNA, 19 nt, Human
ccaagggguccccuccagg

SEQ ID NO: 2023974 - RNA, 20 nt, Human
ccaagguagaaugaccuugu

SEQ ID NO: 2023975 - RNA, 23 nt, Human
ccaagguuuggggaagaacgaag

SEQ ID NO: 2023976 - RNA, 13 nt, Human
ccaaggugggagg

SEQ ID NO: 2023977 - RNA, 18 nt, Human
ccaaggugggaggauugc

SEQ ID NO: 2023978 - RNA, 14 nt, Human
ccaaguacacugag

SEQ ID NO: 2023979 - RNA, 20 nt, Human
ccaagucaagugaaaaagga

SEQ ID NO: 2023980 - RNA, 22 nt, Human
ccaauaguuguugauuggcagg

SEQ ID NO: 2023981 - RNA, 14 nt, Human
ccaauaccccaugg

SEQ ID NO: 2023982 - RNA, 16 nt, Human
ccaauaccccauggac

SEQ ID NO: 2023983 - RNA, 17 nt, Human
ccaauaccccauggacc

SEQ ID NO: 2023984 - RNA, 12 nt, Human
ccaaguuuugug

SEQ ID NO: 2023985 - RNA, 16 nt, Human
ccaaguuuugugaaau

SEQ ID NO: 2023986 - RNA, 17 nt, Human
ccaaguuuugugaaauu

SEQ ID NO: 2023987 - RNA, 22 nt, Human
ccaaguuuugugaaauuuuuca

SEQ ID NO: 2023988 - RNA, 21 nt, Human
ccaaguccgcagaagcccuga

SEQ ID NO: 2023989 - RNA, 15 nt, Human
cacccaagggccugg

SEQ ID NO: 2023990 - RNA, 14 nt, Human
cacccaagggccug

SEQ ID NO: 2023991 - RNA, 15 nt, Human
cauuguagagcuucu

SEQ ID NO: 2023992 - RNA, 23 nt, Human
cauugccccaaauggauuccugu

SEQ ID NO: 2023993 - RNA, 22 nt, Human
cauugccccaaauggauuccug

SEQ ID NO: 2023994 - RNA, 16 nt, Human
cauuguagagcuucug

SEQ ID NO: 2023995 - RNA, 17 nt, Human
cauuguagagcuucugg

SEQ ID NO: 2023996 - RNA, 19 nt, Human
cauuguagagcuucuggca

SEQ ID NO: 2023997 - RNA, 21 nt, Human
cauuguagagcuucuggcacu

SEQ ID NO: 2023998 - RNA, 16 nt, Human
cauuguccagagcugc

SEQ ID NO: 2023999 - RNA, 18 nt, Human
cauuguccagagcugcuu

SEQ ID NO: 2024000 - RNA, 20 nt, Human
cauuguccagagcugcuucc

SEQ ID NO: 2024001 - RNA, 22 nt, Human
cauuguccagagcugcuucccc

SEQ ID NO: 2024002 - RNA, 19 nt, Human
cauugucccugaagagaag

SEQ ID NO: 2024003 - RNA, 14 nt, Human
cauuguccagagcu

SEQ ID NO: 2024004 - RNA, 15 nt, Human
cauuguccagagcug

SEQ ID NO: 2024005 - RNA, 23 nt, Human
cauuguauucagaguugaugguu

SEQ ID NO: 2024006 - RNA, 15 nt, Human
cauuguaucugucuu

SEQ ID NO: 2024007 - RNA, 16 nt, Human
cauuguaucugucuuu

SEQ ID NO: 2024008 - RNA, 17 nt, Human
cauuguaucugucuuuc

SEQ ID NO: 2024009 - RNA, 18 nt, Human
cauuguaucugucuuucc

SEQ ID NO: 2024010 - RNA, 18 nt, Human
cauuguuggccaaagcca

SEQ ID NO: 2024011 - RNA, 17 nt, Human
cauuguuggacauuugg

SEQ ID NO: 2024012 - RNA, 17 nt, Human
cauuguuggccaaagcc

SEQ ID NO: 2024013 - RNA, 16 nt, Human
cauuucuaauuccugu

SEQ ID NO: 2024014 - RNA, 18 nt, Human
cauuucuaauuccuguuu

SEQ ID NO: 2024015 - RNA, 12 nt, Human
cauuuccugugu

SEQ ID NO: 2024016 - RNA, 13 nt, Human
cauuuccuguguc

SEQ ID NO: 2024017 - RNA, 20 nt, Human
cauuuaaaacauuaaaauau

SEQ ID NO: 2024018 - RNA, 12 nt, Human
cauuuaaaagau

SEQ ID NO: 2024019 - RNA, 15 nt, Human
cauuuaaaagauaca

SEQ ID NO: 2024020 - RNA, 16 nt, Human
cauuuaaaagauacag

SEQ ID NO: 2024021 - RNA, 21 nt, Human
cauuuaaaacauuaaaauaua

SEQ ID NO: 2024022 - RNA, 13 nt, Human
cauuuaaaagaca

SEQ ID NO: 2024023 - RNA, 17 nt, Human
cauuuagggaguauucu

SEQ ID NO: 2024024 - RNA, 20 nt, Human
cauuuagggaguauucuaau

SEQ ID NO: 2024025 - RNA, 21 nt, Human
cauuuagggaguauucuaaua

SEQ ID NO: 2024026 - RNA, 17 nt, Human
cauuuaggccaugggac

SEQ ID NO: 2024027 - RNA, 15 nt, Human
cauuuccuaaauaua

SEQ ID NO: 2024028 - RNA, 13 nt, Human
cauuuccugacag

SEQ ID NO: 2024029 - RNA, 20 nt, Human
cauuuccugacagaaggacu

SEQ ID NO: 2024030 - RNA, 22 nt, Human
cauuugaaaauuuugauguuuu

SEQ ID NO: 2024031 - RNA, 20 nt, Human
cauuugaaaauuuugauguu

SEQ ID NO: 2024032 - RNA, 19 nt, Human
cauuugaaaccccuguagg

SEQ ID NO: 2024033 - RNA, 21 nt, Human
cauuugaaaccccuguaggcc

SEQ ID NO: 2024034 - RNA, 14 nt, Human
cauuugcuccuuuc

SEQ ID NO: 2024035 - RNA, 13 nt, Human
cauuugcuccuuu

SEQ ID NO: 2024036 - RNA, 17 nt, Human
cauuuguuugaacugau

SEQ ID NO: 2024037 - RNA, 13 nt, Human
cauuugcugaaua

SEQ ID NO: 2024038 - RNA, 20 nt, Human
cauuuguuugaacugauaaa

SEQ ID NO: 2024039 - RNA, 22 nt, Human
cauuuguuugaacugauaaaga

SEQ ID NO: 2024040 - RNA, 20 nt, Human
cauuugagcagggcucagcg

SEQ ID NO: 2024041 - RNA, 17 nt, Human
cauuugagcagggcuca

SEQ ID NO: 2024042 - RNA, 18 nt, Human
cauuugagcagggcucag

SEQ ID NO: 2024043 - RNA, 18 nt, Human
cauuuguuugguuauagu

SEQ ID NO: 2024044 - RNA, 16 nt, Human
cauuuuagcuaauuua

SEQ ID NO: 2024045 - RNA, 19 nt, Human
cauuuuagggguagcauuu

SEQ ID NO: 2024046 - RNA, 12 nt, Human
cauuuuguaaua

SEQ ID NO: 2024047 - RNA, 13 nt, Human
cauuuuguaauaa

SEQ ID NO: 2024048 - RNA, 16 nt, Human
cauuuuguaauaauaa

SEQ ID NO: 2024049 - RNA, 18 nt, Human
cauuuuguguugaagagc

SEQ ID NO: 2024050 - RNA, 21 nt, Human
cauuuuguguugaagagcagc

SEQ ID NO: 2024051 - RNA, 21 nt, Human
cauuuuucaaaaaguaaaaag

SEQ ID NO: 2024052 - RNA, 17 nt, Human
ccaaacucaccugcccc

SEQ ID NO: 2024053 - RNA, 19 nt, Human
ccaaacauccuacaagaca

SEQ ID NO: 2024054 - RNA, 20 nt, Human
ccaaacauccuacaagacac

SEQ ID NO: 2024055 - RNA, 16 nt, Human
ccaaacaggcccuccu

SEQ ID NO: 2024056 - RNA, 18 nt, Human
ccaaacaggcccuccucc

SEQ ID NO: 2024057 - RNA, 13 nt, Human
gauccuucacauu

SEQ ID NO: 2024058 - RNA, 19 nt, Human
gagggacccuccaccaccu

SEQ ID NO: 2024059 - RNA, 19 nt, Human
gagugcaggcccacccugc

SEQ ID NO: 2024060 - RNA, 19 nt, Human
gauaaaagacagugaaaga

SEQ ID NO: 2024061 - RNA, 15 nt, Human
gagagaaauauuuua

SEQ ID NO: 2024062 - RNA, 17 nt, Human
gagaggccucgacccac

SEQ ID NO: 2024063 - RNA, 19 nt, Human
gagccgggccuugucgcag

SEQ ID NO: 2024064 - RNA, 23 nt, Human
gacauggcucccccuccaccugc

SEQ ID NO: 2024065 - RNA, 16 nt, Human
gaccagagcugccacc

SEQ ID NO: 2024066 - RNA, 22 nt, Human
gaccagcuuggcucaggcugag

SEQ ID NO: 2024067 - RNA, 14 nt, Human
gaaaauuaguuccc

SEQ ID NO: 2024068 - RNA, 14 nt, Human
gaccccugaccccu

SEQ ID NO: 2024069 - RNA, 13 nt, Human
gaccucaggugau

SEQ ID NO: 2024070 - RNA, 17 nt, Human
gacgauggugaggagau

SEQ ID NO: 2024071 - RNA, 17 nt, Human
gacgcaccagcccagaa

SEQ ID NO: 2024072 - RNA, 14 nt, Human
gacuggaaggacca

SEQ ID NO: 2024073 - RNA, 21 nt, Human
cuggcucagguggggucacuc

SEQ ID NO: 2024074 - RNA, 20 nt, Human
cugggaggucaaggcugcag

SEQ ID NO: 2024075 - RNA, 18 nt, Human
cuugaguucucaacugag

SEQ ID NO: 2024076 - RNA, 19 nt, Human
cugugcgaucccacccgug

SEQ ID NO: 2024077 - RNA, 19 nt, Human
cuggggccaggcugggucg

SEQ ID NO: 2024078 - RNA, 16 nt, Human
gaugcuaucaguuuua

SEQ ID NO: 2024079 - RNA, 16 nt, Human
gcacagggccuggccc

SEQ ID NO: 2024080 - RNA, 14 nt, Human
gaugauuucagaaa

SEQ ID NO: 2024081 - RNA, 17 nt, Human
gcacucagaagacacug

SEQ ID NO: 2024082 - RNA, 24 nt, Human
gcagcccgggucaucuguaccucu

SEQ ID NO: 2024083 - RNA, 19 nt, Human
gcaggcccacccugcuugg

SEQ ID NO: 2024084 - RNA, 16 nt, Human
gcaucacaugaacuug

SEQ ID NO: 2024085 - RNA, 17 nt, Human
gcaucaguguuuuucaa

SEQ ID NO: 2024086 - RNA, 17 nt, Human
gcauugucuauuuuucu

SEQ ID NO: 2024087 - RNA, 16 nt, Human
gccaguaacacaggcc

SEQ ID NO: 2024088 - RNA, 17 nt, Human
gcccaggccuccuacag

SEQ ID NO: 2024089 - RNA, 12 nt, Human
gcccaggcucca

SEQ ID NO: 2024090 - RNA, 21 nt, Human
gcccagggcuuuaaaaagaau

SEQ ID NO: 2024091 - RNA, 15 nt, Human
gccggccuccagaac

SEQ ID NO: 2024092 - RNA, 15 nt, Human
gcccucccugccccu

SEQ ID NO: 2024093 - RNA, 22 nt, Human
gcccuccucccucccagcucca

SEQ ID NO: 2024094 - RNA, 15 nt, Human
gcccugcccaccugg

SEQ ID NO: 2024095 - RNA, 12 nt, Human
gcacacgcugcu

SEQ ID NO: 2024096 - RNA, 15 nt, Human
gauccaagcaaaugg

SEQ ID NO: 2024097 - RNA, 16 nt, Human
gauuugagauuuuuau

SEQ ID NO: 2024098 - RNA, 21 nt, Human
gauuugauuuuuuuuuuuaau

SEQ ID NO: 2024099 - RNA, 13 nt, Human
gcaauauauuuug

SEQ ID NO: 2024100 - RNA, 15 nt, Human
gcagaaccauuuuug

SEQ ID NO: 2024101 - RNA, 14 nt, Human
gcagaguauuuuug

SEQ ID NO: 2024102 - RNA, 17 nt, Human
gagcucccucugcccca

SEQ ID NO: 2024103 - RNA, 11 nt, Human
gaggccuccgg

SEQ ID NO: 2024104 - RNA, 17 nt, Human
gaggcucuggagcccac

SEQ ID NO: 2024105 - RNA, 21 nt, Human
gaguagcugggacuacaggca

SEQ ID NO: 2024106 - RNA, 15 nt, Human
gaggacaauuuccag

SEQ ID NO: 2024107 - RNA, 21 nt, Human
gagucucgcucuguugcccag

SEQ ID NO: 2024108 - RNA, 19 nt, Human
gaugugccugcuucagccu

SEQ ID NO: 2024109 - RNA, 23 nt, Human
gauuccagcacaaccuucaagcu

SEQ ID NO: 2024110 - RNA, 17 nt, Human
gagacagacuagaaguu

SEQ ID NO: 2024111 - RNA, 16 nt, Human
gagaccugugugccag

SEQ ID NO: 2024112 - RNA, 14 nt, Human
gagcauuacaggca

SEQ ID NO: 2024113 - RNA, 14 nt, Human
gacgcuucacagga

SEQ ID NO: 2024114 - RNA, 11 nt, Human
gacuccugcag

SEQ ID NO: 2024115 - RNA, 22 nt, Human
gacucuuuuccaaacacaggca

SEQ ID NO: 2024116 - RNA, 20 nt, Human
gacaagcuguugaccaggca

SEQ ID NO: 2024117 - RNA, 19 nt, Human
gaagauuauauauauuuuu

SEQ ID NO: 2024118 - RNA, 18 nt, Human
gaauggaagguggagaag

SEQ ID NO: 2024119 - RNA, 18 nt, Human
gaauuauaauuaguuccu

SEQ ID NO: 2024120 - RNA, 16 nt, Human
gacagaaggcuccugc

SEQ ID NO: 2024121 - RNA, 19 nt, Human
gacagccuggcacagggca

SEQ ID NO: 2024122 - RNA, 17 nt, Human
cuuauaucuauauuuua

SEQ ID NO: 2024123 - RNA, 14 nt, Human
gaacaaauuuacag

SEQ ID NO: 2024124 - RNA, 21 nt, Human
gaaccaccugccuauauuuuu

SEQ ID NO: 2024125 - RNA, 15 nt, Human
gaacuccugaccuca

SEQ ID NO: 2024126 - RNA, 14 nt, Human
gaacuccugaccuu

SEQ ID NO: 2024127 - RNA, 22 nt, Human
uucaccuacauuugagaauuau

SEQ ID NO: 2024128 - RNA, 23 nt, Human
uuccacaaguuaaauaaaucaua

SEQ ID NO: 2024129 - RNA, 16 nt, Human
uuccuaauccucuagg

SEQ ID NO: 2024130 - RNA, 20 nt, Human
uuacagucucagcaacaaca

SEQ ID NO: 2024131 - RNA, 21 nt, Human
uuauagaagaaugcaugcuuu

SEQ ID NO: 2024132 - RNA, 13 nt, Human
uuaugccugcuuu

SEQ ID NO: 2024133 - RNA, 21 nt, Human
uguccucccaccccugccccc

SEQ ID NO: 2024134 - RNA, 20 nt, Human
ugggcgugagaccugccccu

SEQ ID NO: 2024135 - RNA, 21 nt, Human
ugggucucucuugccccaccu

SEQ ID NO: 2024136 - RNA, 13 nt, Human
uguggccccaccc

SEQ ID NO: 2024137 - RNA, 23 nt, Human
uuaaaacaugcccccuggaaagg

SEQ ID NO: 2024138 - RNA, 23 nt, Human
uuagaauuaguggcacuugcuuu

SEQ ID NO: 2024139 - RNA, 16 nt, Human
uuagaugugcugcuuu

SEQ ID NO: 2024140 - RNA, 15 nt, Human
uuagcaguuugcuuu

SEQ ID NO: 2024141 - RNA, 22 nt, Human
ggucuccgaaaugcugucuuuc

SEQ ID NO: 2024142 - RNA, 17 nt, Human
gggugcugggccccugc

SEQ ID NO: 2024143 - RNA, 21 nt, Human
gggccgcuccgcuccccugcu

SEQ ID NO: 2024144 - RNA, 16 nt, Human
gggcgugagaccugcc

SEQ ID NO: 2024145 - RNA, 19 nt, Human
ggauucacaccccaccugc

SEQ ID NO: 2024146 - RNA, 16 nt, Human
ggcagggcacagggcc

SEQ ID NO: 2024147 - RNA, 11 nt, Human
ggaucucuuuu

SEQ ID NO: 2024148 - RNA, 12 nt, Human
ggaugccaccuc

SEQ ID NO: 2024149 - RNA, 23 nt, Human
ggagggagaagaaagaaagaagu

SEQ ID NO: 2024150 - RNA, 18 nt, Human
ggcugccccgccuggagg

SEQ ID NO: 2024151 - RNA, 19 nt, Human
ggcuggaagggguccagcc

SEQ ID NO: 2024152 - RNA, 13 nt, Human
ggccuccauccug

SEQ ID NO: 2024153 - RNA, 13 nt, Human
ggacugccaccuc

SEQ ID NO: 2024154 - RNA, 21 nt, Human
ggacuuuguuaguuucuccaa

SEQ ID NO: 2024155 - RNA, 11 nt, Human
ggagaaaguac

SEQ ID NO: 2024156 - RNA, 20 nt, Human
ggacauccccugcuggccgg

SEQ ID NO: 2024157 - RNA, 17 nt, Human
ggaccagagcugccacc

SEQ ID NO: 2024158 - RNA, 16 nt, Human
ggacccuccaaggcca

SEQ ID NO: 2024159 - RNA, 22 nt, Human
ggaagucucaaauaauauuuuu

SEQ ID NO: 2024160 - RNA, 12 nt, Human
ggaaauauuuua

SEQ ID NO: 2024161 - RNA, 20 nt, Human
ggaaauguuuucauauuuuu

SEQ ID NO: 2024162 - RNA, 13 nt, Human
gcugccugccccu

SEQ ID NO: 2024163 - RNA, 16 nt, Human
gcuuuacuauuuuuau

SEQ ID NO: 2024164 - RNA, 15 nt, Human
gcugcagcugggagc

SEQ ID NO: 2024165 - RNA, 16 nt, Human
gcucccucacucucag

SEQ ID NO: 2024166 - RNA, 16 nt, Human
gcuccgucuccugcgg

SEQ ID NO: 2024167 - RNA, 18 nt, Human
gcuccgucuccugcgggc

SEQ ID NO: 2024168 - RNA, 20 nt, Human
gcuaaauucuccacauuuug

SEQ ID NO: 2024169 - RNA, 16 nt, Human
gcuauaauaaagaagu

SEQ ID NO: 2024170 - RNA, 12 nt, Human
gggcuccccucu

SEQ ID NO: 2024171 - RNA, 12 nt, Human
gcgcggcugcuu

SEQ ID NO: 2024172 - RNA, 19 nt, Human
ggccgagccugccuccugc

SEQ ID NO: 2024173 - RNA, 21 nt, Human
ggcugcagccugcgccaccgc

SEQ ID NO: 2024174 - RNA, 13 nt, Human
ggcuccugccccc

SEQ ID NO: 2024175 - RNA, 19 nt, Human
ggccagcaccaucucuuua

SEQ ID NO: 2024176 - RNA, 15 nt, Human
ggccagcccuggagg

SEQ ID NO: 2024177 - RNA, 16 nt, Human
ggcccccgggaggacg

SEQ ID NO: 2024178 - RNA, 20 nt, Human
ggccaaacucaccugccccu

SEQ ID NO: 2024179 - RNA, 20 nt, Human
ggagagagaccacacgcagu

SEQ ID NO: 2024180 - RNA, 15 nt, Human
ggagccuccugcccu

SEQ ID NO: 2024181 - RNA, 21 nt, Human
ggaagaucccuuuguccacaa

SEQ ID NO: 2024182 - RNA, 15 nt, Human
ggacucaaugcacug

SEQ ID NO: 2024183 - RNA, 11 nt, Human
ggacugccacc

SEQ ID NO: 2024184 - RNA, 13 nt, Human
ggagaaaggaccc

SEQ ID NO: 2024185 - RNA, 16 nt, Human
gcuuuguauuuuuaau

SEQ ID NO: 2024186 - RNA, 16 nt, Human
gcuuuuuuuuuuuaau

SEQ ID NO: 2024187 - RNA, 23 nt, Human
ggaaugaacuuauuaauauuuuu

SEQ ID NO: 2024188 - RNA, 22 nt, Human
ggacaaccuuggcuuggcccug

SEQ ID NO: 2024189 - RNA, 20 nt, Human
ggacagccugagucaccugc

SEQ ID NO: 2024190 - RNA, 13 nt, Human
ggacaggugccag

SEQ ID NO: 2024191 - RNA, 21 nt, Human
ggacccugccaggcacaggca

SEQ ID NO: 2024192 - RNA, 15 nt, Human
gcugagccuggacaa

SEQ ID NO: 2024193 - RNA, 20 nt, Human
gcugcucugugaccagggac

SEQ ID NO: 2024194 - RNA, 16 nt, Human
gcuggcggccugcagc

SEQ ID NO: 2024195 - RNA, 14 nt, Human
gcuugcuucaaccc

SEQ ID NO: 2024196 - RNA, 20 nt, Human
gcuuuccauauuuuuuuccu

SEQ ID NO: 2024197 - RNA, 15 nt, Human
gcuggguuggaaaac

SEQ ID NO: 2024198 - RNA, 14 nt, Human
gugcuugucccugu

SEQ ID NO: 2024199 - RNA, 16 nt, Human
guggacuguucccuga

SEQ ID NO: 2024200 - RNA, 14 nt, Human
gugggcaaaagagu

SEQ ID NO: 2024201 - RNA, 19 nt, Human
gugugauccaguuuuucau

SEQ ID NO: 2024202 - RNA, 22 nt, Human
guuaaaaacagauuuggaaaga

SEQ ID NO: 2024203 - RNA, 21 nt, Human
guuaagagaggucuggaaagu

SEQ ID NO: 2024204 - RNA, 13 nt, Human
guauguccuuggu

SEQ ID NO: 2024205 - RNA, 15 nt, Human
gucucccccacccuu

SEQ ID NO: 2024206 - RNA, 17 nt, Human
gugaaaagaauagaagc

SEQ ID NO: 2024207 - RNA, 19 nt, Human
gugcagcgcggcgccgccc

SEQ ID NO: 2024208 - RNA, 23 nt, Human
gguugaagggcaguguucccugg

SEQ ID NO: 2024209 - RNA, 21 nt, Human
guaucaaauacauuuaaaaca

SEQ ID NO: 2024210 - RNA, 20 nt, Human
guacacucugagugaaagga

SEQ ID NO: 2024211 - RNA, 16 nt, Human
guacuuauaaagaagg

SEQ ID NO: 2024212 - RNA, 17 nt, Human
gucguaguuacucucag

SEQ ID NO: 2024213 - RNA, 12 nt, Human
gucagucuugac

SEQ ID NO: 2024214 - RNA, 15 nt, Human
gucaucuuugaguuu

SEQ ID NO: 2024215 - RNA, 19 nt, Human
uacacacacacgcgugcac

SEQ ID NO: 2024216 - RNA, 22 nt, Human
uacacacugcauguuugugauu

SEQ ID NO: 2024217 - RNA, 13 nt, Human
uaauacuguuauu

SEQ ID NO: 2024218 - RNA, 12 nt, Human
uaaccagcagaa

SEQ ID NO: 2024219 - RNA, 18 nt, Human
guuuauuuguuuuuccag

SEQ ID NO: 2024220 - RNA, 18 nt, Human
guuugaaaauauuuucau

SEQ ID NO: 2024221 - RNA, 19 nt, Human
guuuugugaaauuuuucau

SEQ ID NO: 2024222 - RNA, 21 nt, Human
guggcuuggacucuuucccau

SEQ ID NO: 2024223 - RNA, 18 nt, Human
guuaucagucucucuuuc

SEQ ID NO: 2024224 - RNA, 15 nt, Human
guuauguauauuuua

SEQ ID NO: 2024225 - RNA, 20 nt, Human
guuggcaauuguuucaacca

SEQ ID NO: 2024226 - RNA, 16 nt, Human
ucaacucccugccccc

SEQ ID NO: 2024227 - RNA, 14 nt, Human
ucaagaacuuguuu

SEQ ID NO: 2024228 - RNA, 13 nt, Human
uaguuaaagaaga

SEQ ID NO: 2024229 - RNA, 16 nt, Human
uaguucaaucuggauu

SEQ ID NO: 2024230 - RNA, 16 nt, Human
uaucaggauuuuucaa

SEQ ID NO: 2024231 - RNA, 17 nt, Human
uccugcaggccaggcca

SEQ ID NO: 2024232 - RNA, 16 nt, Human
uccugccaccacgccc

SEQ ID NO: 2024233 - RNA, 21 nt, Human
uccucaauuauuauucacauu

SEQ ID NO: 2024234 - RNA, 23 nt, Human
uccucuguacagagcccacgccc

SEQ ID NO: 2024235 - RNA, 15 nt, Human
ucccaucuuccaagg

SEQ ID NO: 2024236 - RNA, 20 nt, Human
ucacugcagccuccgcuucc

SEQ ID NO: 2024237 - RNA, 19 nt, Human
uccacagucucccccaccc

SEQ ID NO: 2024238 - RNA, 19 nt, Human
ucucuggccuucggccucc

SEQ ID NO: 2024239 - RNA, 22 nt, Human
ucugaaacugggcuccugcuuu

SEQ ID NO: 2024240 - RNA, 19 nt, Human
ucuucagagacuccugcag

SEQ ID NO: 2024241 - RNA, 22 nt, Human
ugccccucaacucuccuccaga

SEQ ID NO: 2024242 - RNA, 16 nt, Human
ugcagugcuuccaagg

SEQ ID NO: 2024243 - RNA, 17 nt, Human
ugcacaaauucaugugc

SEQ ID NO: 2024244 - RNA, 15 nt, Human
ugcacacucaugugc

SEQ ID NO: 2024245 - RNA, 14 nt, Human
ugaccauucuccac

SEQ ID NO: 2024246 - RNA, 20 nt, Human
ugacuauuauauuuccaaga

SEQ ID NO: 2024247 - RNA, 20 nt, Human
ugaacacaugguuggaaaga

SEQ ID NO: 2024248 - RNA, 15 nt, Human
ugaaccgaugagaaa

SEQ ID NO: 2024249 - RNA, 23 nt, Human
uggcccccgggaggacgggaccc

SEQ ID NO: 2024250 - RNA, 23 nt, Human
uggaccaugcugucuggcacagc

SEQ ID NO: 2024251 - RNA, 21 nt, Human
ugcugcaguugccagucaccc

SEQ ID NO: 2024252 - RNA, 20 nt, Human
ugcuuuggaaaacccagaua

SEQ ID NO: 2024253 - RNA, 18 nt, Human
uggcugcagccugcgcca

SEQ ID NO: 2024254 - RNA, 21 nt, Human
acuuuuauaaacuuuaccuuu

SEQ ID NO: 2024255 - RNA, 16 nt, Human
agaaauacagacugga

SEQ ID NO: 2024256 - RNA, 18 nt, Human
agacaauagcauuagaaa

SEQ ID NO: 2024257 - RNA, 14 nt, Human
agacagugaaagaa

SEQ ID NO: 2024258 - RNA, 16 nt, Human
agagcugugcaucagc

SEQ ID NO: 2024259 - RNA, 21 nt, Human
agacucgauagugguggugaa

SEQ ID NO: 2024260 - RNA, 18 nt, Human
agacuuggaaaugggaga

SEQ ID NO: 2024261 - RNA, 20 nt, Human
agagagacacagcugcagag

SEQ ID NO: 2024262 - RNA, 23 nt, Human
agcccaaccucuuccuccugaca

SEQ ID NO: 2024263 - RNA, 13 nt, Human
agcccaccccucu

SEQ ID NO: 2024264 - RNA, 22 nt, Human
agcccacgcugacuacagggcc

SEQ ID NO: 2024265 - RNA, 22 nt, Human
agaucuaaaaauaacuguaauu

SEQ ID NO: 2024266 - RNA, 20 nt, Human
agauucugaccuuaaaugca

SEQ ID NO: 2024267 - RNA, 15 nt, Human
agaacucaugugauu

SEQ ID NO: 2024268 - RNA, 16 nt, Human
agcaugacccagguca

SEQ ID NO: 2024269 - RNA, 13 nt, Human
agcucuccccuca

SEQ ID NO: 2024270 - RNA, 22 nt, Human
agcucugcagagcaggaaacau

SEQ ID NO: 2024271 - RNA, 20 nt, Human
aggacccugccaggcacagg

SEQ ID NO: 2024272 - RNA, 22 nt, Human
agccuccaauuuuuuaagugaa

SEQ ID NO: 2024273 - RNA, 19 nt, Human
aggccacuggccccugaga

SEQ ID NO: 2024274 - RNA, 14 nt, Human
aggcugggucgccc

SEQ ID NO: 2024275 - RNA, 20 nt, Human
aguuucugucguuaaaaaca

SEQ ID NO: 2024276 - RNA, 17 nt, Human
aguuuuguuuaaaagga

SEQ ID NO: 2024277 - RNA, 20 nt, Human
aggccuggccuuggagaacg

SEQ ID NO: 2024278 - RNA, 12 nt, Human
aguucauacuug

SEQ ID NO: 2024279 - RNA, 20 nt, Human
agugccccgucuacagcucc

SEQ ID NO: 2024280 - RNA, 15 nt, Human
aguggaugccacagc

SEQ ID NO: 2024281 - RNA, 16 nt, Human
aguggcagggcacagg

SEQ ID NO: 2024282 - RNA, 18 nt, Human
aguaaccacagaaaagca

SEQ ID NO: 2024283 - RNA, 18 nt, Human
agacaggugcgaaaggau

SEQ ID NO: 2024284 - RNA, 17 nt, Human
agagcugcuuccccguc

SEQ ID NO: 2024285 - RNA, 12 nt, Human
agaggcugcagc

SEQ ID NO: 2024286 - RNA, 20 nt, Human
agaaaaaaaaaaagaaagaa

SEQ ID NO: 2024287 - RNA, 14 nt, Human
agaauagaagcuaa

SEQ ID NO: 2024288 - RNA, 15 nt, Human
acuaagaggcaaacc

SEQ ID NO: 2024289 - RNA, 17 nt, Human
acucugugucccccguc

SEQ ID NO: 2024290 - RNA, 15 nt, Human
acuuggggggcugag

SEQ ID NO: 2024291 - RNA, 21 nt, Human
acaucucuauuccccacccuc

SEQ ID NO: 2024292 - RNA, 20 nt, Human
acauuauaaaugucucuuua

SEQ ID NO: 2024293 - RNA, 23 nt, Human
accaccaucaccagacaggugcg

SEQ ID NO: 2024294 - RNA, 20 nt, Human
accagcaccaucucuccucc

SEQ ID NO: 2024295 - RNA, 15 nt, Human
accagcuuggcucag

SEQ ID NO: 2024296 - RNA, 22 nt, Human
acaccauuggaccccacccagc

SEQ ID NO: 2024297 - RNA, 18 nt, Human
acaccuuguuucccucuc

SEQ ID NO: 2024298 - RNA, 13 nt, Human
acagcccaccugg

SEQ ID NO: 2024299 - RNA, 20 nt, Human
aaaggcccagccaccgaagc

SEQ ID NO: 2024300 - RNA, 19 nt, Human
acguuaugauaguguccca

SEQ ID NO: 2024301 - RNA, 18 nt, Human
aacaaagugcuaaaggaa

SEQ ID NO: 2024302 - RNA, 15 nt, Human
acuuggccucacccu

SEQ ID NO: 2024303 - RNA, 17 nt, Human
cccaccccauggccggc

SEQ ID NO: 2024304 - RNA, 18 nt, Human
uuugaccucugcagcaau

SEQ ID NO: 2024305 - RNA, 14 nt, Human
ccccaccuggcccu

SEQ ID NO: 2024306 - RNA, 15 nt, Human
ccgccuggaggagau

SEQ ID NO: 2024307 - RNA, 21 nt, Human
ccgcuccugcggaggaggugu

SEQ ID NO: 2024308 - RNA, 14 nt, Human
ccggcuccaggcuc

SEQ ID NO: 2024309 - RNA, 16 nt, Human
cccgccagccgcuccc

SEQ ID NO: 2024310 - RNA, 20 nt, Human
uuucaacgcagcccugcuuu

SEQ ID NO: 2024311 - RNA, 12 nt, Human
ccugcccaggcc

SEQ ID NO: 2024312 - RNA, 18 nt, Human
ccucugaccccugccugu

SEQ ID NO: 2024313 - RNA, 21 nt, Human
ccucaaccugcuguccuccag

SEQ ID NO: 2024314 - RNA, 23 nt, Human
ccuccugcuugcgggggccgccu

SEQ ID NO: 2024315 - RNA, 13 nt, Human
ccugcgaggcuau

SEQ ID NO: 2024316 - RNA, 18 nt, Human
ccugcuugaguucccaga

SEQ ID NO: 2024317 - RNA, 20 nt, Human
ccugucaagcaaucaagaaa

SEQ ID NO: 2024318 - RNA, 14 nt, Human
ccuguccugccugu

SEQ ID NO: 2024319 - RNA, 17 nt, Human
ccugugauggggcccug

SEQ ID NO: 2024320 - RNA, 18 nt, Human
ccuucucuccagccccug

SEQ ID NO: 2024321 - RNA, 16 nt, Human
cgcuccaacuccaaca

SEQ ID NO: 2024322 - RNA, 13 nt, Human
cgcucucuggccu

SEQ ID NO: 2024323 - RNA, 19 nt, Human
cgccagauucuuuccugag

SEQ ID NO: 2024324 - RNA, 20 nt, Human
cgcgucgcccucccaggcuc

SEQ ID NO: 2024325 - RNA, 21 nt, Human
ccuuuuugcuugaagcaaaca

SEQ ID NO: 2024326 - RNA, 12 nt, Human
ugcagacaggca

SEQ ID NO: 2024327 - RNA, 13 nt, Human
uuaaaacacaaca

SEQ ID NO: 2024328 - RNA, 12 nt, Human
uuagacugcuuu

SEQ ID NO: 2024329 - RNA, 16 nt, Human
uguccucacugcccca

SEQ ID NO: 2024330 - RNA, 23 nt, Human
ugugacaucucuauuccccaccc

SEQ ID NO: 2024331 - RNA, 17 nt, Human
uggcagcugccacgccg

SEQ ID NO: 2024332 - RNA, 15 nt, Human
uggccuucggcccca

SEQ ID NO: 2024333 - RNA, 14 nt, Human
uggcugggcugcuc

SEQ ID NO: 2024334 - RNA, 20 nt, Human
ugccaguaccagccccaccc

SEQ ID NO: 2024335 - RNA, 17 nt, Human
uggacucaccuccccca

SEQ ID NO: 2024336 - RNA, 15 nt, Human
ugcucuggacaggca

SEQ ID NO: 2024337 - RNA, 12 nt, Human
ccaucaaguacc

SEQ ID NO: 2024338 - RNA, 15 nt, Human
ccauggcuucccaga

SEQ ID NO: 2024339 - RNA, 20 nt, Human
cccaaaaacaaaucgcagcc

SEQ ID NO: 2024340 - RNA, 18 nt, Human
cccaauaucuugcuugaa

SEQ ID NO: 2024341 - RNA, 14 nt, Human
cccacaaaggagag

SEQ ID NO: 2024342 - RNA, 15 nt, Human
uuguaucuggaaaga

SEQ ID NO: 2024343 - RNA, 17 nt, Human
uucuagcauggcugcca

SEQ ID NO: 2024344 - RNA, 23 nt, Human
uugcugaauacagaggcaacugc

SEQ ID NO: 2024345 - RNA, 18 nt, Human
uuaggaaagaaaaaaagu

SEQ ID NO: 2024346 - RNA, 18 nt, Human
uuaggcauaugcuucuuu

SEQ ID NO: 2024347 - RNA, 23 nt, Human
uuauuauggcacaucagcacgau

SEQ ID NO: 2024348 - RNA, 12 nt, Human
uuauuggaaagg

SEQ ID NO: 2024349 - RNA, 23 nt, Human
gcucuggagcccacuguacuugc

SEQ ID NO: 2024350 - RNA, 16 nt, Human
gcugcguuuccugugc

SEQ ID NO: 2024351 - RNA, 12 nt, Human
gcuggacgucca

SEQ ID NO: 2024352 - RNA, 15 nt, Human
gcugggacugggaac

SEQ ID NO: 2024353 - RNA, 22 nt, Human
gcuucucugcccagcuuuucau

SEQ ID NO: 2024354 - RNA, 21 nt, Human
gcuucugccacugcugggcuc

SEQ ID NO: 2024355 - RNA, 15 nt, Human
gcuuugcuguuucau

SEQ ID NO: 2024356 - RNA, 15 nt, Human
gcuuuuaguuuuucu

SEQ ID NO: 2024357 - RNA, 10 nt, Human
gcgcuucacu

SEQ ID NO: 2024358 - RNA, 20 nt, Human
cgccagcucccgccagccgc

SEQ ID NO: 2024359 - RNA, 12 nt, Human
cgccuguccugc

SEQ ID NO: 2024360 - RNA, 11 nt, Human
cggccaccugc

SEQ ID NO: 2024361 - RNA, 18 nt, Human
cggccuggcgcuccgacu

SEQ ID NO: 2024362 - RNA, 19 nt, Human
ccuuccuaccacccggucc

SEQ ID NO: 2024363 - RNA, 17 nt, Human
gcuaaauauauauuuua

SEQ ID NO: 2024364 - RNA, 19 nt, Human
gcucccaggcauuccccag

SEQ ID NO: 2024365 - RNA, 19 nt, Human
ccuuuccuauaugaugauu

SEQ ID NO: 2024366 - RNA, 23 nt, Human
cgaagcaugaacagugcaccugg

SEQ ID NO: 2024367 - RNA, 18 nt, Human
ccgggcugggagcucugc

SEQ ID NO: 2024368 - RNA, 21 nt, Human
ccugcccacaagucccagcgc

SEQ ID NO: 2024369 - RNA, 12 nt, Human
ccugcuccagcu

SEQ ID NO: 2024370 - RNA, 12 nt, Human
ccuccuccagcc

SEQ ID NO: 2024371 - RNA, 17 nt, Human
cccagugagcauccacg

SEQ ID NO: 2024372 - RNA, 19 nt, Human
ccgccccucugaccccugc

SEQ ID NO: 2024373 - RNA, 14 nt, Human
cccccaacccccca

SEQ ID NO: 2024374 - RNA, 12 nt, Human
ccccugaccuca

SEQ ID NO: 2024375 - RNA, 21 nt, Human
cccggcuaugggggcacugag

SEQ ID NO: 2024376 - RNA, 17 nt, Human
cccugaggugagcauca

SEQ ID NO: 2024377 - RNA, 11 nt, Human
guaucucuuug

SEQ ID NO: 2024378 - RNA, 13 nt, Human
guauguuuuucag

SEQ ID NO: 2024379 - RNA, 19 nt, Human
guauucucuuuucaagaag

SEQ ID NO: 2024380 - RNA, 21 nt, Human
gguuccagcaauucuccugcc

SEQ ID NO: 2024381 - RNA, 17 nt, Human
gggaguggccacagaaa

SEQ ID NO: 2024382 - RNA, 22 nt, Human
ggucgccuguccugccuguggg

SEQ ID NO: 2024383 - RNA, 19 nt, Human
ggucuugguuccagccugc

SEQ ID NO: 2024384 - RNA, 11 nt, Human
uugcaacaaca

SEQ ID NO: 2024385 - RNA, 12 nt, Human
gucacugcacgu

SEQ ID NO: 2024386 - RNA, 23 nt, Human
uugaagggaaguugcuggaaaga

SEQ ID NO: 2024387 - RNA, 15 nt, Human
ggaccggcugccccg

SEQ ID NO: 2024388 - RNA, 15 nt, Human
ggacugugugcucag

SEQ ID NO: 2024389 - RNA, 14 nt, Human
ggacuguucuuuug

SEQ ID NO: 2024390 - RNA, 22 nt, Human
ggaucaaaccccgaccaccugc

SEQ ID NO: 2024391 - RNA, 20 nt, Human
ggcccagcaccacccuccuu

SEQ ID NO: 2024392 - RNA, 21 nt, Human
ggcacaggcagggcaggacca

SEQ ID NO: 2024393 - RNA, 15 nt, Human
ggcaccucacaggcc

SEQ ID NO: 2024394 - RNA, 16 nt, Human
ggcacuuugacagcgc

SEQ ID NO: 2024395 - RNA, 20 nt, Human
ggcugaagcuguguccucau

SEQ ID NO: 2024396 - RNA, 19 nt, Human
ggcucacugcauccuccgc

SEQ ID NO: 2024397 - RNA, 22 nt, Human
ggcuccgacuugugcacaggca

SEQ ID NO: 2024398 - RNA, 14 nt, Human
ggcccucuccugcc

SEQ ID NO: 2024399 - RNA, 18 nt, Human
ggcgugagccaccgugcc

SEQ ID NO: 2024400 - RNA, 21 nt, Human
ggcuaauuagcauggccacau

SEQ ID NO: 2024401 - RNA, 22 nt, Human
ggcugggcucccuucccaccuc

SEQ ID NO: 2024402 - RNA, 15 nt, Human
ggcugcagccugcgc

SEQ ID NO: 2024403 - RNA, 20 nt, Human
ggcugcucauguuggggcuc

SEQ ID NO: 2024404 - RNA, 23 nt, Human
gguauaaaggcauugauauuuua

SEQ ID NO: 2024405 - RNA, 22 nt, Human
gcaggcccacccugcuuggccc

SEQ ID NO: 2024406 - RNA, 19 nt, Human
gguuuccauggcuucccag

SEQ ID NO: 2024407 - RNA, 21 nt, Human
ggucucucuugccccaccugg

SEQ ID NO: 2024408 - RNA, 16 nt, Human
gccaccaacagccacu

SEQ ID NO: 2024409 - RNA, 16 nt, Human
gcauuugguuuuucac

SEQ ID NO: 2024410 - RNA, 19 nt, Human
gccaaacucaccugccccu

SEQ ID NO: 2024411 - RNA, 17 nt, Human
gccccaggcugcggcuu

SEQ ID NO: 2024412 - RNA, 13 nt, Human
gccuggccacgcc

SEQ ID NO: 2024413 - RNA, 22 nt, Human
gcccacgcuggagugcagugag

SEQ ID NO: 2024414 - RNA, 23 nt, Human
gcccagaauaaacuggcagcuca

SEQ ID NO: 2024415 - RNA, 14 nt, Human
gccaggcacaggca

SEQ ID NO: 2024416 - RNA, 15 nt, Human
gccccugcacuccag

SEQ ID NO: 2024417 - RNA, 12 nt, Human
gccccugccucu

SEQ ID NO: 2024418 - RNA, 22 nt, Human
gcuggaccaaagcagcugcagc

SEQ ID NO: 2024419 - RNA, 22 nt, Human
gcuaagaauuuuuuauuuuuug

SEQ ID NO: 2024420 - RNA, 14 nt, Human
gccuccauccugag

SEQ ID NO: 2024421 - RNA, 16 nt, Human
gcuguggguuuuuaau

SEQ ID NO: 2024422 - RNA, 16 nt, Human
gcucccgcuccugcgg

SEQ ID NO: 2024423 - RNA, 18 nt, Human
gcuccucucacuucccag

SEQ ID NO: 2024424 - RNA, 21 nt, Human
gccuggcugcagccugcgcca

SEQ ID NO: 2024425 - RNA, 13 nt, Human
gcggccuggcgcu

SEQ ID NO: 2024426 - RNA, 13 nt, Human
gcgugguggacau

SEQ ID NO: 2024427 - RNA, 23 nt, Human
ucagcaaggcgcuaacuugcuua

SEQ ID NO: 2024428 - RNA, 13 nt, Human
uauauuucccuga

SEQ ID NO: 2024429 - RNA, 14 nt, Human
gggugucugccccc

SEQ ID NO: 2024430 - RNA, 13 nt, Human
gguagguugggag

SEQ ID NO: 2024431 - RNA, 22 nt, Human
gguccgaguguguuucauccuu

SEQ ID NO: 2024432 - RNA, 18 nt, Human
gguccccagacuccacca

SEQ ID NO: 2024433 - RNA, 15 nt, Human
ucccaccccauccuc

SEQ ID NO: 2024434 - RNA, 11 nt, Human
uccccccaccu

SEQ ID NO: 2024435 - RNA, 14 nt, Human
uacuacaguccucc

SEQ ID NO: 2024436 - RNA, 22 nt, Human
uagacuuuuccaauaugugauu

SEQ ID NO: 2024437 - RNA, 12 nt, Human
uacaguguuccg

SEQ ID NO: 2024438 - RNA, 20 nt, Human
uagcugcauuugucuggccu

SEQ ID NO: 2024439 - RNA, 13 nt, Human
uagucucuugauu

SEQ ID NO: 2024440 - RNA, 19 nt, Human
uacaaaaccacuggaaagu

SEQ ID NO: 2024441 - RNA, 22 nt, Human
gugaacacauaaauauauuuuu

SEQ ID NO: 2024442 - RNA, 20 nt, Human
gugacuauuauauuuccaag

SEQ ID NO: 2024443 - RNA, 14 nt, Human
guggccccacccuu

SEQ ID NO: 2024444 - RNA, 16 nt, Human
guguuuuguugaguuu

SEQ ID NO: 2024445 - RNA, 15 nt, Human
guuaggucucaauac

SEQ ID NO: 2024446 - RNA, 19 nt, Human
guuuguuuuuuguuuuucu

SEQ ID NO: 2024447 - RNA, 16 nt, Human
gucugcauuggaaaga

SEQ ID NO: 2024448 - RNA, 14 nt, Human
uaaaaccugggauu

SEQ ID NO: 2024449 - RNA, 22 nt, Human
guuggaguuugagguuggaaaa

SEQ ID NO: 2024450 - RNA, 23 nt, Human
gcuuccugaggggagacagagca

SEQ ID NO: 2024451 - RNA, 17 nt, Human
gcuugcauauauuucau

SEQ ID NO: 2024452 - RNA, 16 nt, Human
gcuuuuaccuuuuucu

SEQ ID NO: 2024453 - RNA, 22 nt, Human
ggaaagacuggacucuaaaguc

SEQ ID NO: 2024454 - RNA, 17 nt, Human
ggaagacuuuggaaaga

SEQ ID NO: 2024455 - RNA, 14 nt, Human
ggaagaucccuuug

SEQ ID NO: 2024456 - RNA, 19 nt, Human
ggacugccagucccccugc

SEQ ID NO: 2024457 - RNA, 14 nt, Human
ggagcccugccucu

SEQ ID NO: 2024458 - RNA, 12 nt, Human
ggaggccaccuc

SEQ ID NO: 2024459 - RNA, 20 nt, Human
ggauacaggcuggaaaguaa

SEQ ID NO: 2024460 - RNA, 13 nt, Human
ggagcaagggcag

SEQ ID NO: 2024461 - RNA, 16 nt, Human
ggccacguucuuacua

SEQ ID NO: 2024462 - RNA, 22 nt, Human
ggccacuuggauccauuuccag

SEQ ID NO: 2024463 - RNA, 24 nt, Human
ggcccagcgcggacauccccugcu

SEQ ID NO: 2024464 - RNA, 17 nt, Human
ggcccauggggaggacg

SEQ ID NO: 2024465 - RNA, 22 nt, Human
ggccccaauaccccauggacca

SEQ ID NO: 2024466 - RNA, 19 nt, Human
ggccuccauccugaggcuc

SEQ ID NO: 2024467 - RNA, 12 nt, Human
ggccuuucccac

SEQ ID NO: 2024468 - RNA, 14 nt, Human
ggcucccacaggcc

SEQ ID NO: 2024469 - RNA, 13 nt, Human
gguuucuguuggc

SEQ ID NO: 2024470 - RNA, 18 nt, Human
ggcugcuucugccacugc

SEQ ID NO: 2024471 - RNA, 15 nt, Human
ggauugggccccugc

SEQ ID NO: 2024472 - RNA, 18 nt, Human
guagagcggagaaaggaa

SEQ ID NO: 2024473 - RNA, 17 nt, Human
guacacccaugaaagaa

SEQ ID NO: 2024474 - RNA, 17 nt, Human
ggcagauggccuggagg

SEQ ID NO: 2024475 - RNA, 17 nt, Human
guccacugguucuucuu

SEQ ID NO: 2024476 - RNA, 22 nt, Human
gucccaccuuggcugcagggag

SEQ ID NO: 2024477 - RNA, 14 nt, Human
gucaguauccaggc

SEQ ID NO: 2024478 - RNA, 20 nt, Human
guccaaaauuuaagucucca

SEQ ID NO: 2024479 - RNA, 16 nt, Human
gugcaaaaggcuugca

SEQ ID NO: 2024480 - RNA, 19 nt, Human
gugcccugcucgguggcag

SEQ ID NO: 2024481 - RNA, 22 nt, Human
uaaucaacauggcuacuugcuu

SEQ ID NO: 2024482 - RNA, 15 nt, Human
uagacuccaacaaca

SEQ ID NO: 2024483 - RNA, 17 nt, Human
guuuucauauuuuucaa

SEQ ID NO: 2024484 - RNA, 16 nt, Human
guuuucccuccuugga

SEQ ID NO: 2024485 - RNA, 23 nt, Human
uaaaagaaaaagaaaaaaaaagu

SEQ ID NO: 2024486 - RNA, 19 nt, Human
uaacagcaguuucagguag

SEQ ID NO: 2024487 - RNA, 20 nt, Human
guguuaaccaugguggggac

SEQ ID NO: 2024488 - RNA, 13 nt, Human
guaguuuuuucaa

SEQ ID NO: 2024489 - RNA, 15 nt, Human
guauacguuuuucag

SEQ ID NO: 2024490 - RNA, 22 nt, Human
guggcuguggaauaggaacgcu

SEQ ID NO: 2024491 - RNA, 23 nt, Human
guguauggguguuggugaacuug

SEQ ID NO: 2024492 - RNA, 21 nt, Human
gugccuuuugccauccccuca

SEQ ID NO: 2024493 - RNA, 13 nt, Human
gugcuguuucccg

SEQ ID NO: 2024494 - RNA, 21 nt, Human
guaagucuugccuauauuuuc

SEQ ID NO: 2024495 - RNA, 14 nt, Human
guaccaagaaagga

SEQ ID NO: 2024496 - RNA, 17 nt, Human
guacggacauaaaagca

SEQ ID NO: 2024497 - RNA, 14 nt, Human
gguuuauucacugu

SEQ ID NO: 2024498 - RNA, 16 nt, Human
gucgggcagcugcagg

SEQ ID NO: 2024499 - RNA, 13 nt, Human
gucuggcugcaga

SEQ ID NO: 2024500 - RNA, 19 nt, Human
gugaaaaucuacacuccag

SEQ ID NO: 2024501 - RNA, 20 nt, Human
gugaaauuuuucauauuuua

SEQ ID NO: 2024502 - RNA, 13 nt, Human
gucacacagugag

SEQ ID NO: 2024503 - RNA, 21 nt, Human
gucccacucaguccauagcag

SEQ ID NO: 2024504 - RNA, 21 nt, Human
gucccagaaugccuccugcag

SEQ ID NO: 2024505 - RNA, 21 nt, Human
guccuacucugugucaggugg

SEQ ID NO: 2024506 - RNA, 16 nt, Human
ucuuccccaccaaccc

SEQ ID NO: 2024507 - RNA, 15 nt, Human
ucuuuucugaaucuu

SEQ ID NO: 2024508 - RNA, 21 nt, Human
ugaaacugacuugcugugacu

SEQ ID NO: 2024509 - RNA, 12 nt, Human
ucagaaagaagu

SEQ ID NO: 2024510 - RNA, 18 nt, Human
ucacgaguucaggagauc

SEQ ID NO: 2024511 - RNA, 15 nt, Human
ucgggcugugcccgg

SEQ ID NO: 2024512 - RNA, 14 nt, Human
ucuaaacugccccc

SEQ ID NO: 2024513 - RNA, 16 nt, Human
ucuaaauaaaagaagu

SEQ ID NO: 2024514 - RNA, 15 nt, Human
ugagccaccacgccc

SEQ ID NO: 2024515 - RNA, 20 nt, Human
ugauaaauuugacuguuauu

SEQ ID NO: 2024516 - RNA, 19 nt, Human
ugcccaggcuggcgugcag

SEQ ID NO: 2024517 - RNA, 17 nt, Human
ugcccuggugcugccac

SEQ ID NO: 2024518 - RNA, 13 nt, Human
ugcacaaaaugua

SEQ ID NO: 2024519 - RNA, 21 nt, Human
ugcacaugcacgugugugcac

SEQ ID NO: 2024520 - RNA, 21 nt, Human
ugcagcucucaugcugccccu

SEQ ID NO: 2024521 - RNA, 24 nt, Human
ugggauuacaggcuccugccacca

SEQ ID NO: 2024522 - RNA, 16 nt, Human
ugugaagacuugccuu

SEQ ID NO: 2024523 - RNA, 18 nt, Human
ugucuuuccacuccuccu

SEQ ID NO: 2024524 - RNA, 22 nt, Human
uuaaaaaaaaaaaaaaaaaaga

SEQ ID NO: 2024525 - RNA, 17 nt, Human
uuaccagugccuuaaac

SEQ ID NO: 2024526 - RNA, 17 nt, Human
uggguguggucuccacu

SEQ ID NO: 2024527 - RNA, 16 nt, Human
uggucagcccaaacca

SEQ ID NO: 2024528 - RNA, 20 nt, Human
uggccuucggccuccauccu

SEQ ID NO: 2024529 - RNA, 13 nt, Human
uggcgcugccccu

SEQ ID NO: 2024530 - RNA, 17 nt, Human
uggcucccccuccaccu

SEQ ID NO: 2024531 - RNA, 17 nt, Human
uggcaaacucuccacca

SEQ ID NO: 2024532 - RNA, 15 nt, Human
uggccagguggccac

SEQ ID NO: 2024533 - RNA, 15 nt, Human
ugcugacuguacucc

SEQ ID NO: 2024534 - RNA, 15 nt, Human
uggacucugcccuca

SEQ ID NO: 2024535 - RNA, 20 nt, Human
uccugcaggcagccaggcca

SEQ ID NO: 2024536 - RNA, 16 nt, Human
ucagugagccaagauc

SEQ ID NO: 2024537 - RNA, 12 nt, Human
ucgcaucagcgc

SEQ ID NO: 2024538 - RNA, 18 nt, Human
ucuacuucuggagucuau

SEQ ID NO: 2024539 - RNA, 17 nt, Human
ucuccaagaccagagau

SEQ ID NO: 2024540 - RNA, 14 nt, Human
ucucugccauccuu

SEQ ID NO: 2024541 - RNA, 14 nt, Human
uucaaacggccuca

SEQ ID NO: 2024542 - RNA, 13 nt, Human
uuccuccauccuc

SEQ ID NO: 2024543 - RNA, 16 nt, Human
uugccauuaaaaugua

SEQ ID NO: 2024544 - RNA, 17 nt, Human
ucuuucccaucuccccu

SEQ ID NO: 2024545 - RNA, 21 nt, Human
ugaacuauguuuagugugauu

SEQ ID NO: 2024546 - RNA, 20 nt, Human
cgcuguuggggcugcucaug

SEQ ID NO: 2024547 - RNA, 20 nt, Human
cgggccuugucgcagcgcag

SEQ ID NO: 2024548 - RNA, 16 nt, Human
cgguccacccaggagc

SEQ ID NO: 2024549 - RNA, 16 nt, Human
cggucuugacagcuca

SEQ ID NO: 2024550 - RNA, 20 nt, Human
cgugguggacaugcacagcu

SEQ ID NO: 2024551 - RNA, 18 nt, Human
cguguaggaaccugcaca

SEQ ID NO: 2024552 - RNA, 22 nt, Human
cgugaacaggugggugucugcg

SEQ ID NO: 2024553 - RNA, 14 nt, Human
cuaaccacagcucc

SEQ ID NO: 2024554 - RNA, 17 nt, Human
cuuucugggguuuuucu

SEQ ID NO: 2024555 - RNA, 17 nt, Human
gaaaggauuucucuuua

SEQ ID NO: 2024556 - RNA, 21 nt, Human
gaaauguuacagcauauuuua

SEQ ID NO: 2024557 - RNA, 13 nt, Human
gaacagucucuug

SEQ ID NO: 2024558 - RNA, 20 nt, Human
gaaccaggcaacuugggaac

SEQ ID NO: 2024559 - RNA, 20 nt, Human
gacaaggaccgucuccugcg

SEQ ID NO: 2024560 - RNA, 22 nt, Human
gacacaguucaauucucauuug

SEQ ID NO: 2024561 - RNA, 18 nt, Human
gacaccauuggaccccac

SEQ ID NO: 2024562 - RNA, 19 nt, Human
gacauuguagagcuucugg

SEQ ID NO: 2024563 - RNA, 23 nt, Human
gaagaauuuacuuuggaaaguag

SEQ ID NO: 2024564 - RNA, 11 nt, Human
cugaggacaag

SEQ ID NO: 2024565 - RNA, 14 nt, Human
cugcagccuggagc

SEQ ID NO: 2024566 - RNA, 19 nt, Human
cucuuuuuauuuaguuccu

SEQ ID NO: 2024567 - RNA, 20 nt, Human
cuccuucaacaaggcuugcu

SEQ ID NO: 2024568 - RNA, 14 nt, Human
cuccuuggagacag

SEQ ID NO: 2024569 - RNA, 23 nt, Human
cucgaugcagacagggggccaga

SEQ ID NO: 2024570 - RNA, 23 nt, Human
cuguaauuccagcacuuugggag

SEQ ID NO: 2024571 - RNA, 16 nt, Human
cucauccccucacuug

SEQ ID NO: 2024572 - RNA, 16 nt, Human
cugccuaaggcugaac

SEQ ID NO: 2024573 - RNA, 20 nt, Human
cugcucaguguuucauauuc

SEQ ID NO: 2024574 - RNA, 16 nt, Human
cugcugcuucauguuu

SEQ ID NO: 2024575 - RNA, 18 nt, Human
cuguacgucugacaggca

SEQ ID NO: 2024576 - RNA, 18 nt, Human
uuugaaaaacugcucaua

SEQ ID NO: 2024577 - RNA, 16 nt, Human
uuugaaacauugcuuu

SEQ ID NO: 2024578 - RNA, 11 nt, Human
uuuuuuuucau

SEQ ID NO: 2024579 - RNA, 15 nt, Human
uugugugccucuagc

SEQ ID NO: 2024580 - RNA, 16 nt, Human
uuguacagacaacaaa

SEQ ID NO: 2024581 - RNA, 23 nt, Human
gccuggcugcagccugcgccacc

SEQ ID NO: 2024582 - RNA, 13 nt, Human
uuccuuuucccag

SEQ ID NO: 2024583 - RNA, 14 nt, Human
uucugucguuaaaa

SEQ ID NO: 2024584 - RNA, 17 nt, Human
uucuucaaccagcagau

SEQ ID NO: 2024585 - RNA, 15 nt, Human
gccacccuucuucag

SEQ ID NO: 2024586 - RNA, 20 nt, Human
gccuccauccugaggcucca

SEQ ID NO: 2024587 - RNA, 17 nt, Human
gccuccuguggccugcc

SEQ ID NO: 2024588 - RNA, 15 nt, Human
gccccucugaccccu

SEQ ID NO: 2024589 - RNA, 15 nt, Human
gccgcagcccugcag

SEQ ID NO: 2024590 - RNA, 14 nt, Human
gccgugaccccugc

SEQ ID NO: 2024591 - RNA, 18 nt, Human
gccuagccucacgcuccu

SEQ ID NO: 2024592 - RNA, 22 nt, Human
gccacagaaaauucuucuccac

SEQ ID NO: 2024593 - RNA, 16 nt, Human
gccaagaggcugcagc

SEQ ID NO: 2024594 - RNA, 19 nt, Human
gcagcccucggcgcuccgg

SEQ ID NO: 2024595 - RNA, 19 nt, Human
gcaggaccuucgggcugug

SEQ ID NO: 2024596 - RNA, 22 nt, Human
gcaagcuaauucuuugaccugu

SEQ ID NO: 2024597 - RNA, 18 nt, Human
gcacccucaggcaggugg

SEQ ID NO: 2024598 - RNA, 14 nt, Human
gcacaaacagaggc

SEQ ID NO: 2024599 - RNA, 21 nt, Human
gcaccaaggaaaaagcagaga

SEQ ID NO: 2024600 - RNA, 17 nt, Human
gcaguuaugugaccuca

SEQ ID NO: 2024601 - RNA, 17 nt, Human
gcaucaagaugugacau

SEQ ID NO: 2024602 - RNA, 13 nt, Human
gcaugggcuugcu

SEQ ID NO: 2024603 - RNA, 13 nt, Human
gcauggugguugg

SEQ ID NO: 2024604 - RNA, 19 nt, Human
gcauuggggauguuuuucu

SEQ ID NO: 2024605 - RNA, 19 nt, Human
gcauuuguguguuacaaug

SEQ ID NO: 2024606 - RNA, 13 nt, Human
gaggcuccaggca

SEQ ID NO: 2024607 - RNA, 16 nt, Human
gaguggccccaccugg

SEQ ID NO: 2024608 - RNA, 24 nt, Human
gagcauuccagucaggcucucugg

SEQ ID NO: 2024609 - RNA, 20 nt, Human
gagcccccagcuuccagcag

SEQ ID NO: 2024610 - RNA, 13 nt, Human
gaccucaggugag

SEQ ID NO: 2024611 - RNA, 14 nt, Human
gacgcagaccccac

SEQ ID NO: 2024612 - RNA, 22 nt, Human
gacuccagcuggguuggaaaac

SEQ ID NO: 2024613 - RNA, 16 nt, Human
gacuucugccagcaua

SEQ ID NO: 2024614 - RNA, 18 nt, Human
aaaagcaucuaugugaga

SEQ ID NO: 2024615 - RNA, 19 nt, Human
aaacuuucuuaauauuuuu

SEQ ID NO: 2024616 - RNA, 21 nt, Human
acaaacuucuuucacucacau

SEQ ID NO: 2024617 - RNA, 22 nt, Human
acaacgagccuuuucacccuuc

SEQ ID NO: 2024618 - RNA, 20 nt, Human
aauuauauaguuacccaaau

SEQ ID NO: 2024619 - RNA, 16 nt, Human
acacucaaaagcuggg

SEQ ID NO: 2024620 - RNA, 14 nt, Human
acagccccuccucc

SEQ ID NO: 2024621 - RNA, 22 nt, Human
acagccugagucaccugcagaa

SEQ ID NO: 2024622 - RNA, 14 nt, Human
aaggcuagaaccac

SEQ ID NO: 2024623 - RNA, 14 nt, Human
aaauuaaagcugaa

SEQ ID NO: 2024624 - RNA, 15 nt, Human
aacauuggcuccugu

SEQ ID NO: 2024625 - RNA, 18 nt, Human
aaccugcaggcguucucu

SEQ ID NO: 2024626 - RNA, 23 nt, Human
aagagcuaggcagggugucugcc

SEQ ID NO: 2024627 - RNA, 13 nt, Human
aaguucugcagau

SEQ ID NO: 2024628 - RNA, 18 nt, Human
aauaaaauuaaagcugaa

SEQ ID NO: 2024629 - RNA, 12 nt, Human
aacucaacaugg

SEQ ID NO: 2024630 - RNA, 11 nt, Human
aagauauuuua

SEQ ID NO: 2024631 - RNA, 21 nt, Human
aagauuuaggccaaucagaag

SEQ ID NO: 2024632 - RNA, 15 nt, Human
acccacccuccuuuc

SEQ ID NO: 2024633 - RNA, 11 nt, Human
accaaccuggg

SEQ ID NO: 2024634 - RNA, 13 nt, Human
accacgcccggcu

SEQ ID NO: 2024635 - RNA, 12 nt, Human
acacacagcucu

SEQ ID NO: 2024636 - RNA, 14 nt, Human
acacagcucuucuc

SEQ ID NO: 2024637 - RNA, 13 nt, Human
acacccacaggca

SEQ ID NO: 2024638 - RNA, 20 nt, Human
acaugccagccacugugaua

SEQ ID NO: 2024639 - RNA, 13 nt, Human
acaugccucucuc

SEQ ID NO: 2024640 - RNA, 22 nt, Human
accuaccccucccuccuggagg

SEQ ID NO: 2024641 - RNA, 23 nt, Human
accugcucugugcccacccucca

SEQ ID NO: 2024642 - RNA, 10 nt, Human
acccaccugc

SEQ ID NO: 2024643 - RNA, 18 nt, Human
acccaggguaaucuguac

SEQ ID NO: 2024644 - RNA, 15 nt, Human
acucugccuccucuu

SEQ ID NO: 2024645 - RNA, 20 nt, Human
agaaagcuuuguugaaagaa

SEQ ID NO: 2024646 - RNA, 21 nt, Human
uucccaacacggguaaaucua

SEQ ID NO: 2024647 - RNA, 15 nt, Human
uuccccacguuaaag

SEQ ID NO: 2024648 - RNA, 18 nt, Human
uuauauuccucuugcauu

SEQ ID NO: 2024649 - RNA, 22 nt, Human
uuaaaucauacuccuaugcuuu

SEQ ID NO: 2024650 - RNA, 15 nt, Human
uuccgugucuggcca

SEQ ID NO: 2024651 - RNA, 14 nt, Human
ugccaccucugcag

SEQ ID NO: 2024652 - RNA, 19 nt, Human
ucuuccaggcccccaaccc

SEQ ID NO: 2024653 - RNA, 15 nt, Human
ugacuagaaucgaca

SEQ ID NO: 2024654 - RNA, 23 nt, Human
ugccuaggauucacaccccaccu

SEQ ID NO: 2024655 - RNA, 15 nt, Human
ugaucucucgugauu

SEQ ID NO: 2024656 - RNA, 23 nt, Human
ucuguggguuucuaaagcugcca

SEQ ID NO: 2024657 - RNA, 17 nt, Human
ugacagagccugcccca

SEQ ID NO: 2024658 - RNA, 23 nt, Human
ugggcugcccuggugcugccaca

SEQ ID NO: 2024659 - RNA, 18 nt, Human
ugggucucucuugcccca

SEQ ID NO: 2024660 - RNA, 21 nt, Human
uggcuguuaaucuuucaaagu

SEQ ID NO: 2024661 - RNA, 22 nt, Human
uggcccgucaagugcugccccu

SEQ ID NO: 2024662 - RNA, 16 nt, Human
uggccugacuccccca

SEQ ID NO: 2024663 - RNA, 18 nt, Human
uggagaggcccggccucu

SEQ ID NO: 2024664 - RNA, 22 nt, Human
uggauuuccagccaaagccucc

SEQ ID NO: 2024665 - RNA, 17 nt, Human
uuacaaaugauugcuuu

SEQ ID NO: 2024666 - RNA, 14 nt, Human
uguuggggcugcuc

SEQ ID NO: 2024667 - RNA, 21 nt, Human
uguguguccaaaacugccuca

SEQ ID NO: 2024668 - RNA, 12 nt, Human
ugucggcugcuu

SEQ ID NO: 2024669 - RNA, 12 nt, Human
gaaaauauuuuc

SEQ ID NO: 2024670 - RNA, 12 nt, Human
cuggagcucugc

SEQ ID NO: 2024671 - RNA, 23 nt, Human
cuggagcugccucucucauccac

SEQ ID NO: 2024672 - RNA, 15 nt, Human
cuuuagaaaaaauga

SEQ ID NO: 2024673 - RNA, 14 nt, Human
cuuugaauuuucau

SEQ ID NO: 2024674 - RNA, 17 nt, Human
cugccaggcacaggcag

SEQ ID NO: 2024675 - RNA, 21 nt, Human
cugccaugccaggaaccuguc

SEQ ID NO: 2024676 - RNA, 17 nt, Human
cugccccaggcugcggc

SEQ ID NO: 2024677 - RNA, 22 nt, Human
cugccccucaacucuccuccag

SEQ ID NO: 2024678 - RNA, 18 nt, Human
cugccugaagucacacag

SEQ ID NO: 2024679 - RNA, 12 nt, Human
cugcaucaguuc

SEQ ID NO: 2024680 - RNA, 19 nt, Human
cucucaggcauggaugaau

SEQ ID NO: 2024681 - RNA, 22 nt, Human
cugaaaggcaguagucauuuuc

SEQ ID NO: 2024682 - RNA, 23 nt, Human
cggggcacccgccggaugcgcag

SEQ ID NO: 2024683 - RNA, 14 nt, Human
cgggggcucaagcu

SEQ ID NO: 2024684 - RNA, 16 nt, Human
cgucaucugguccugg

SEQ ID NO: 2024685 - RNA, 17 nt, Human
cgugccuggccacgccc

SEQ ID NO: 2024686 - RNA, 23 nt, Human
cgugguugaguggggggaacgcc

SEQ ID NO: 2024687 - RNA, 19 nt, Human
cgugugggacccgccgcgg

SEQ ID NO: 2024688 - RNA, 15 nt, Human
cuaaacaaaaaaagg

SEQ ID NO: 2024689 - RNA, 12 nt, Human
cgccagcagaca

SEQ ID NO: 2024690 - RNA, 15 nt, Human
cucugauucugucaa

SEQ ID NO: 2024691 - RNA, 14 nt, Human
cuaagcaggcgcaa

SEQ ID NO: 2024692 - RNA, 19 nt, Human
cucucucuaaggaggaugu

SEQ ID NO: 2024693 - RNA, 14 nt, Human
cucugaggcugaaa

SEQ ID NO: 2024694 - RNA, 14 nt, Human
cucgcccggaaccc

SEQ ID NO: 2024695 - RNA, 19 nt, Human
cuccugccaccacgcccgg

SEQ ID NO: 2024696 - RNA, 21 nt, Human
cuccugccaccacgcccggcu

SEQ ID NO: 2024697 - RNA, 22 nt, Human
cucaaccaaugccaaaaaaaga

SEQ ID NO: 2024698 - RNA, 14 nt, Human
cucaccagaauuau

SEQ ID NO: 2024699 - RNA, 21 nt, Human
cucacgccuguaauuccagca

SEQ ID NO: 2024700 - RNA, 16 nt, Human
cucacuuuuucauuuc

SEQ ID NO: 2024701 - RNA, 14 nt, Human
ccgccgugaccccu

SEQ ID NO: 2024702 - RNA, 16 nt, Human
ccgccgugaccccugc

SEQ ID NO: 2024703 - RNA, 19 nt, Human
cuucuggcacuuggagacu

SEQ ID NO: 2024704 - RNA, 15 nt, Human
ccuauucuccucauc

SEQ ID NO: 2024705 - RNA, 20 nt, Human
ccucaagcuaugugagcuca

SEQ ID NO: 2024706 - RNA, 17 nt, Human
ccgcggggcacccgccg

SEQ ID NO: 2024707 - RNA, 19 nt, Human
ccgcggggcacccgccgga

SEQ ID NO: 2024708 - RNA, 13 nt, Human
ccggacuccucuc

SEQ ID NO: 2024709 - RNA, 19 nt, Human
ccggucuuugauccgcagc

SEQ ID NO: 2024710 - RNA, 13 nt, Human
ccgucuccugcgg

SEQ ID NO: 2024711 - RNA, 13 nt, Human
cgccuguccucac

SEQ ID NO: 2024712 - RNA, 23 nt, Human
cgcgcugcgugugggacccgccg

SEQ ID NO: 2024713 - RNA, 14 nt, Human
cgcggccucaaccc

SEQ ID NO: 2024714 - RNA, 22 nt, Human
ccuucugacccaugcugcccug

SEQ ID NO: 2024715 - RNA, 17 nt, Human
cgaaaucccugcucacu

SEQ ID NO: 2024716 - RNA, 15 nt, Human
cgaccugccucggcc

SEQ ID NO: 2024717 - RNA, 22 nt, Human
cgcagcaggggccagacccugc

SEQ ID NO: 2024718 - RNA, 17 nt, Human
cagcccucccugccccu

SEQ ID NO: 2024719 - RNA, 20 nt, Human
cccauuuaaaaaaaaucccu

SEQ ID NO: 2024720 - RNA, 16 nt, Human
cccagucccgccccuc

SEQ ID NO: 2024721 - RNA, 13 nt, Human
cccacuggccggc

SEQ ID NO: 2024722 - RNA, 16 nt, Human
cccaggcugagccuca

SEQ ID NO: 2024723 - RNA, 10 nt, Human
ccaugucgua

SEQ ID NO: 2024724 - RNA, 18 nt, Human
ccagugagacagcucugc

SEQ ID NO: 2024725 - RNA, 16 nt, Human
ccauacacacgcugcc

SEQ ID NO: 2024726 - RNA, 13 nt, Human
ccuuccugggcac

SEQ ID NO: 2024727 - RNA, 16 nt, Human
ccuccgccucccgggu

SEQ ID NO: 2024728 - RNA, 15 nt, Human
ccucucucauccacu

SEQ ID NO: 2024729 - RNA, 15 nt, Human
ccugcaggccaggcc

SEQ ID NO: 2024730 - RNA, 14 nt, Human
ccuacugaggauau

SEQ ID NO: 2024731 - RNA, 16 nt, Human
cccugccucuccgccc

SEQ ID NO: 2024732 - RNA, 19 nt, Human
ccaccuccuaaaaggccca

SEQ ID NO: 2024733 - RNA, 22 nt, Human
ccaccugccagggacagagggg

SEQ ID NO: 2024734 - RNA, 22 nt, Human
ccagcgggaauggcagcugcca

SEQ ID NO: 2024735 - RNA, 12 nt, Human
ccaggagccucc

SEQ ID NO: 2024736 - RNA, 22 nt, Human
ccaacgagcagugccgcguggc

SEQ ID NO: 2024737 - RNA, 16 nt, Human
ccaagcaggacaugga

SEQ ID NO: 2024738 - RNA, 13 nt, Human
caggcgcaaggga

SEQ ID NO: 2024739 - RNA, 19 nt, Human
caggcgcuagcacagcucc

SEQ ID NO: 2024740 - RNA, 19 nt, Human
cagcugggagcuggcccgu

SEQ ID NO: 2024741 - RNA, 14 nt, Human
cagcuggggccagg

SEQ ID NO: 2024742 - RNA, 18 nt, Human
cagugucuggcugcagag

SEQ ID NO: 2024743 - RNA, 14 nt, Human
caguuguaucagca

SEQ ID NO: 2024744 - RNA, 17 nt, Human
caucuuucugcuccuga

SEQ ID NO: 2024745 - RNA, 21 nt, Human
caugaggaacaaggcaaggcu

SEQ ID NO: 2024746 - RNA, 23 nt, Human
caucaacuaaaguuguacuuuaa

SEQ ID NO: 2024747 - RNA, 15 nt, Human
caucagugccccguc

SEQ ID NO: 2024748 - RNA, 14 nt, Human
cugccggcgguggc

SEQ ID NO: 2024749 - RNA, 13 nt, Human
cugcucuccagcc

SEQ ID NO: 2024750 - RNA, 17 nt, Human
cugggcugcucucacau

SEQ ID NO: 2024751 - RNA, 14 nt, Human
cugguccucacacu

SEQ ID NO: 2024752 - RNA, 23 nt, Human
cuguaaucccagcuauuugggag

SEQ ID NO: 2024753 - RNA, 17 nt, Human
cuguugaugggaugauu

SEQ ID NO: 2024754 - RNA, 19 nt, Human
cuuaagaauuccaaaaaaa

SEQ ID NO: 2024755 - RNA, 20 nt, Human
cuuaaguacuguagaaaaga

SEQ ID NO: 2024756 - RNA, 13 nt, Human
cucugucgcccag

SEQ ID NO: 2024757 - RNA, 21 nt, Human
cuccacacacacaaaaaaaga

SEQ ID NO: 2024758 - RNA, 17 nt, Human
cugagacaaucauguac

SEQ ID NO: 2024759 - RNA, 16 nt, Human
cugagccuugggaccc

SEQ ID NO: 2024760 - RNA, 18 nt, Human
cugcaccgggccacagag

SEQ ID NO: 2024761 - RNA, 13 nt, Human
cugcacuccagcc

SEQ ID NO: 2024762 - RNA, 13 nt, Human
cggggacagcucc

SEQ ID NO: 2024763 - RNA, 19 nt, Human
cgggccacagagaaaguac

SEQ ID NO: 2024764 - RNA, 14 nt, Human
ccuguaaucccagc

SEQ ID NO: 2024765 - RNA, 18 nt, Human
cgcagcccugcagagggc

SEQ ID NO: 2024766 - RNA, 16 nt, Human
cgcccagucccagcag

SEQ ID NO: 2024767 - RNA, 16 nt, Human
cgcggggcacccgccg

SEQ ID NO: 2024768 - RNA, 15 nt, Human
cuccucuccccagca

SEQ ID NO: 2024769 - RNA, 20 nt, Human
cuaacaaaguuuucaugugc

SEQ ID NO: 2024770 - RNA, 16 nt, Human
cucacccaacaauccc

SEQ ID NO: 2024771 - RNA, 21 nt, Human
cucagcggggacagcuccuuc

SEQ ID NO: 2024772 - RNA, 22 nt, Human
cuauggucuuauauuuacaaca

SEQ ID NO: 2024773 - RNA, 18 nt, Human
cuaagauguuauauuuuu

SEQ ID NO: 2024774 - RNA, 22 nt, Human
cuaauccggaaaucagcaaacu

SEQ ID NO: 2024775 - RNA, 13 nt, Human
cagugcccagggc

SEQ ID NO: 2024776 - RNA, 22 nt, Human
cagacucucucugggaggccau

SEQ ID NO: 2024777 - RNA, 20 nt, Human
cauucagauaugauucaaau

SEQ ID NO: 2024778 - RNA, 19 nt, Human
cagggagcaagggcaggga

SEQ ID NO: 2024779 - RNA, 16 nt, Human
cagggcagcacacggc

SEQ ID NO: 2024780 - RNA, 16 nt, Human
caguauugagcugccu

SEQ ID NO: 2024781 - RNA, 19 nt, Human
caggcccaaagccucgaca

SEQ ID NO: 2024782 - RNA, 13 nt, Human
caggccugcgaga

SEQ ID NO: 2024783 - RNA, 17 nt, Human
cagcagaugcuguuuaa

SEQ ID NO: 2024784 - RNA, 16 nt, Human
cagaguccccccacuc

SEQ ID NO: 2024785 - RNA, 11 nt, Human
cagauauuuuu

SEQ ID NO: 2024786 - RNA, 23 nt, Human
cagaaaugacuuuuugaaaguaa

SEQ ID NO: 2024787 - RNA, 22 nt, Human
cagacauucuaauuauauuuua

SEQ ID NO: 2024788 - RNA, 16 nt, Human
cacugccccaggcugc

SEQ ID NO: 2024789 - RNA, 19 nt, Human
cacugccucuuccucccuc

SEQ ID NO: 2024790 - RNA, 21 nt, Human
cacauccggggccagcuccgg

SEQ ID NO: 2024791 - RNA, 22 nt, Human
caccagcuguguccggcccagu

SEQ ID NO: 2024792 - RNA, 22 nt, Human
cacccucuggcugaggagcugu

SEQ ID NO: 2024793 - RNA, 18 nt, Human
cacaaaaguuucucuuuu

SEQ ID NO: 2024794 - RNA, 16 nt, Human
cacagauuugagcuca

SEQ ID NO: 2024795 - RNA, 18 nt, Human
caaccccuggaccccagc

SEQ ID NO: 2024796 - RNA, 14 nt, Human
caauacagcaaacc

SEQ ID NO: 2024797 - RNA, 15 nt, Human
caaaaguagaacuuu

SEQ ID NO: 2024798 - RNA, 17 nt, Human
caagcucugcuccucuc

SEQ ID NO: 2024799 - RNA, 20 nt, Human
caagggaaaauaaaaaaaga

SEQ ID NO: 2024800 - RNA, 15 nt, Human
ccauuaggcuccuga

SEQ ID NO: 2024801 - RNA, 17 nt, Human
augauucauauauuuua

SEQ ID NO: 2024802 - RNA, 18 nt, Human
auuaaaaugaugaaggaa

SEQ ID NO: 2024803 - RNA, 19 nt, Human
auuaaauuuuuuuguauga

SEQ ID NO: 2024804 - RNA, 19 nt, Human
auuacucaaaguaaaagcg

SEQ ID NO: 2024805 - RNA, 14 nt, Human
auuauguuaaaaca

SEQ ID NO: 2024806 - RNA, 18 nt, Human
auuccagguggcaucagu

SEQ ID NO: 2024807 - RNA, 20 nt, Human
auucuucccaacuugccuuu

SEQ ID NO: 2024808 - RNA, 20 nt, Human
auugcugcuugaggcaacuc

SEQ ID NO: 2024809 - RNA, 15 nt, Human
auuuaagccucaaau

SEQ ID NO: 2024810 - RNA, 17 nt, Human
auuuacggaacucaaau

SEQ ID NO: 2024811 - RNA, 15 nt, Human
auuugucuggccuuu

SEQ ID NO: 2024812 - RNA, 22 nt, Human
cauauaauagguuugaaaguac

SEQ ID NO: 2024813 - RNA, 14 nt, Human
cagggccuggccca

SEQ ID NO: 2024814 - RNA, 16 nt, Human
caguauuuguggggag

SEQ ID NO: 2024815 - RNA, 14 nt, Human
cauccggggccagc

SEQ ID NO: 2024816 - RNA, 13 nt, Human
ccaccuucacauu

SEQ ID NO: 2024817 - RNA, 12 nt, Human
ccagagcugcca

SEQ ID NO: 2024818 - RNA, 16 nt, Human
ccagaggucuggcccu

SEQ ID NO: 2024819 - RNA, 20 nt, Human
ccaacuccugauucauguug

SEQ ID NO: 2024820 - RNA, 13 nt, Human
ccacaagagccca

SEQ ID NO: 2024821 - RNA, 23 nt, Human
ccaucugugaaaggaaagaggga

SEQ ID NO: 2024822 - RNA, 18 nt, Human
ccauggagggggcuugca

SEQ ID NO: 2024823 - RNA, 21 nt, Human
ccagccuccaagcuccaucuc

SEQ ID NO: 2024824 - RNA, 14 nt, Human
cagcccuggagggu

SEQ ID NO: 2024825 - RNA, 14 nt, Human
cagcugaaccuggg

SEQ ID NO: 2024826 - RNA, 23 nt, Human
caggaaaguggcaccugucugcu

SEQ ID NO: 2024827 - RNA, 14 nt, Human
caggauauauuuua

SEQ ID NO: 2024828 - RNA, 13 nt, Human
caggccugacucu

SEQ ID NO: 2024829 - RNA, 19 nt, Human
cagagaaugacagcaaaca

SEQ ID NO: 2024830 - RNA, 16 nt, Human
cagcaaacagaucacu

SEQ ID NO: 2024831 - RNA, 19 nt, Human
cagcagacaucagaacaca

SEQ ID NO: 2024832 - RNA, 18 nt, Human
auuuggcauuccccacuu

SEQ ID NO: 2024833 - RNA, 20 nt, Human
caagugcugccccugccugu

SEQ ID NO: 2024834 - RNA, 22 nt, Human
cacauuuuuuaaaugcaccugg

SEQ ID NO: 2024835 - RNA, 21 nt, Human
caccuaccaccacgcccggcu

SEQ ID NO: 2024836 - RNA, 21 nt, Human
cacgcuccuuucugaucuuca

SEQ ID NO: 2024837 - RNA, 19 nt, Human
cacguguggaccccugcgg

SEQ ID NO: 2024838 - RNA, 20 nt, Human
cacugccccaggcugcggcu

SEQ ID NO: 2024839 - RNA, 16 nt, Human
cacaguucucuccuuc

SEQ ID NO: 2024840 - RNA, 13 nt, Human
ccaaguccgcaga

SEQ ID NO: 2024841 - RNA, 12 nt, Human
ccaauugaguuu

SEQ ID NO: 2024842 - RNA, 17 nt, Human
ccaccccgcaagcacca

SEQ ID NO: 2024843 - RNA, 19 nt, Human
ccaucaaauugaucugcag

SEQ ID NO: 2024844 - RNA, 15 nt, Human
cccgcaggacauggc

SEQ ID NO: 2024845 - RNA, 13 nt, Human
cccgcuaagaggg

SEQ ID NO: 2024846 - RNA, 20 nt, Human
ccccaggucuuccaaguaca

SEQ ID NO: 2024847 - RNA, 16 nt, Human
cccccauuuccucggg

SEQ ID NO: 2024848 - RNA, 15 nt, Human
ccggguccgcggggc

SEQ ID NO: 2024849 - RNA, 14 nt, Human
ccgugcccugcucg

SEQ ID NO: 2024850 - RNA, 23 nt, Human
cagcccagaagugcagaacugca

SEQ ID NO: 2024851 - RNA, 20 nt, Human
cagaguccacggagcucgcg

SEQ ID NO: 2024852 - RNA, 16 nt, Human
cagaucauuaucagcc

SEQ ID NO: 2024853 - RNA, 21 nt, Human
cacuugugacuuuugcuuuaa

SEQ ID NO: 2024854 - RNA, 14 nt, Human
caagucccagcgcg

SEQ ID NO: 2024855 - RNA, 17 nt, Human
caagucccagcgcggcu

SEQ ID NO: 2024856 - RNA, 15 nt, Human
ccuaccaccacgccc

SEQ ID NO: 2024857 - RNA, 17 nt, Human
caacccaccugcgucuc

SEQ ID NO: 2024858 - RNA, 17 nt, Human
cacacccgcgccccgcg

SEQ ID NO: 2024859 - RNA, 22 nt, Human
cacaucaagcgaugaaacugga

SEQ ID NO: 2024860 - RNA, 16 nt, Human
caccaagccuggucag

SEQ ID NO: 2024861 - RNA, 21 nt, Human
caccuccacauaccuggcccu

SEQ ID NO: 2024862 - RNA, 18 nt, Human
cacagacaggaccccugc

SEQ ID NO: 2024863 - RNA, 16 nt, Human
cacucaggccugcgag

SEQ ID NO: 2024864 - RNA, 13 nt, Human
cacugaaccuggg

SEQ ID NO: 2024865 - RNA, 12 nt, Human
cacugcuccugu

SEQ ID NO: 2024866 - RNA, 17 nt, Human
ccaccucuuccuggccg

SEQ ID NO: 2024867 - RNA, 18 nt, Human
ccacggcuggagcugccu

SEQ ID NO: 2024868 - RNA, 15 nt, Human
ccaggccagcugccu

SEQ ID NO: 2024869 - RNA, 20 nt, Human
ccagcccuuucagcugcagc

SEQ ID NO: 2024870 - RNA, 15 nt, Human
caaauguggcuccug

SEQ ID NO: 2024871 - RNA, 14 nt, Human
caccgccuccuaca

SEQ ID NO: 2024872 - RNA, 17 nt, Human
caccggggccucggacu

SEQ ID NO: 2024873 - RNA, 23 nt, Human
cacgcccccacuggugacauguc

SEQ ID NO: 2024874 - RNA, 15 nt, Human
cacggccagccccgc

SEQ ID NO: 2024875 - RNA, 16 nt, Human
cacgguggcucacgcc

SEQ ID NO: 2024876 - RNA, 16 nt, Human
cacguccucgcucccg

SEQ ID NO: 2024877 - RNA, 18 nt, Human
cacuccauggagucugga

SEQ ID NO: 2024878 - RNA, 15 nt, Human
caccccaccugcgcu

SEQ ID NO: 2024879 - RNA, 10 nt, Human
caccccacug

SEQ ID NO: 2024880 - RNA, 19 nt, Human
caagagguuuggcuccugc

SEQ ID NO: 2024881 - RNA, 22 nt, Human
caagcugguggcucugugugcu

SEQ ID NO: 2024882 - RNA, 23 nt, Human
caagucaagugaaaaaggaggaa

SEQ ID NO: 2024883 - RNA, 17 nt, Human
caggccagggggccagu

SEQ ID NO: 2024884 - RNA, 17 nt, Human
caggcccaggcuccaga

SEQ ID NO: 2024885 - RNA, 19 nt, Human
caggaugcccacggcugga

SEQ ID NO: 2024886 - RNA, 19 nt, Human
cagauuuggaaagacugga

SEQ ID NO: 2024887 - RNA, 22 nt, Human
cagcccugcuuugggcugcccu

SEQ ID NO: 2024888 - RNA, 22 nt, Human
cagccgcuccccagcccugccg

SEQ ID NO: 2024889 - RNA, 18 nt, Human
cagaacagcuucauguuc

SEQ ID NO: 2024890 - RNA, 12 nt, Human
cagaauauuuua

SEQ ID NO: 2024891 - RNA, 14 nt, Human
caggugggaggugu

SEQ ID NO: 2024892 - RNA, 21 nt, Human
cagucauuuugcagaggcuau

SEQ ID NO: 2024893 - RNA, 11 nt, Human
cagugucugcu

SEQ ID NO: 2024894 - RNA, 18 nt, Human
cauauuuuuuuccuuaca

SEQ ID NO: 2024895 - RNA, 14 nt, Human
auuuccuuaaagca

SEQ ID NO: 2024896 - RNA, 17 nt, Human
caaacucaccugccccu

SEQ ID NO: 2024897 - RNA, 13 nt, Human
auuuuaagccuuu

SEQ ID NO: 2024898 - RNA, 13 nt, Human
auuuuuaaaagcc

SEQ ID NO: 2024899 - RNA, 17 nt, Human
caaauccaggacccugc

SEQ ID NO: 2024900 - RNA, 12 nt, Human
agaaagaaagaa

SEQ ID NO: 2024901 - RNA, 22 nt, Human
agacccaagcugccuccccucu

SEQ ID NO: 2024902 - RNA, 14 nt, Human
agacccccuggaga

SEQ ID NO: 2024903 - RNA, 16 nt, Human
agacucccaagcugga

SEQ ID NO: 2024904 - RNA, 15 nt, Human
agcauuguaaaagca

SEQ ID NO: 2024905 - RNA, 18 nt, Human
agcacacucauccccuca

SEQ ID NO: 2024906 - RNA, 22 nt, Human
agcagaauguucuggaaaugaa

SEQ ID NO: 2024907 - RNA, 20 nt, Human
agauauuuugcuuugugauu

SEQ ID NO: 2024908 - RNA, 16 nt, Human
agaugggacaggauca

SEQ ID NO: 2024909 - RNA, 19 nt, Human
aggggccaauucguucucu

SEQ ID NO: 2024910 - RNA, 20 nt, Human
aggagcccagcguccacucu

SEQ ID NO: 2024911 - RNA, 19 nt, Human
aggaucucuugagccuggg

SEQ ID NO: 2024912 - RNA, 17 nt, Human
aggccuggccuuggaga

SEQ ID NO: 2024913 - RNA, 20 nt, Human
agcccgcaucagcugcucag

SEQ ID NO: 2024914 - RNA, 15 nt, Human
agcccgggaaaggag

SEQ ID NO: 2024915 - RNA, 23 nt, Human
aggaaaugguauccagaauggaa

SEQ ID NO: 2024916 - RNA, 14 nt, Human
aguauuauaccuuu

SEQ ID NO: 2024917 - RNA, 23 nt, Human
aucaagagagguuaauaaaggaa

SEQ ID NO: 2024918 - RNA, 21 nt, Human
auaaucaagagccuuaaaaca

SEQ ID NO: 2024919 - RNA, 18 nt, Human
auaaucuggacuccucug

SEQ ID NO: 2024920 - RNA, 18 nt, Human
auacagggaugguguuca

SEQ ID NO: 2024921 - RNA, 15 nt, Human
aguuucuuagacuuu

SEQ ID NO: 2024922 - RNA, 14 nt, Human
aguuuuauaaaaga

SEQ ID NO: 2024923 - RNA, 15 nt, Human
auguauguguuuaga

SEQ ID NO: 2024924 - RNA, 14 nt, Human
augucaaacgugaa

SEQ ID NO: 2024925 - RNA, 21 nt, Human
caaacuuuacuauggcccugg

SEQ ID NO: 2024926 - RNA, 20 nt, Human
caaagccaccaacagccacu

SEQ ID NO: 2024927 - RNA, 18 nt, Human
caagaaggaaagauuuug

SEQ ID NO: 2024928 - RNA, 22 nt, Human
caagauuuaugagaaauauuug

SEQ ID NO: 2024929 - RNA, 16 nt, Human
caagcgcccuggcccc

SEQ ID NO: 2024930 - RNA, 14 nt, Human
caaaucugucugcu

SEQ ID NO: 2024931 - RNA, 17 nt, Human
caaauggauauauuuuc

SEQ ID NO: 2024932 - RNA, 21 nt, Human
caaauguaauguggcuucugg

SEQ ID NO: 2024933 - RNA, 14 nt, Human
caacucauauuuuc

SEQ ID NO: 2024934 - RNA, 19 nt, Human
augcuauaacuauguugau

SEQ ID NO: 2024935 - RNA, 14 nt, Human
auggggaggacaaa

SEQ ID NO: 2024936 - RNA, 23 nt, Human
auuacaguuuuguuuaaaaggaa

SEQ ID NO: 2024937 - RNA, 21 nt, Human
aaucuuuaauuaaaaccuggg

SEQ ID NO: 2024938 - RNA, 23 nt, Human
acaccuuagccugcccuccuuuc

SEQ ID NO: 2024939 - RNA, 18 nt, Human
acacuucaggcucuucuc

SEQ ID NO: 2024940 - RNA, 21 nt, Human
accacugcacuccagccuggg

SEQ ID NO: 2024941 - RNA, 16 nt, Human
accaggaggcggcagu

SEQ ID NO: 2024942 - RNA, 18 nt, Human
accaucugcugucuuuuc

SEQ ID NO: 2024943 - RNA, 14 nt, Human
acccaccugcgucu

SEQ ID NO: 2024944 - RNA, 15 nt, Human
acccgguccccacuu

SEQ ID NO: 2024945 - RNA, 14 nt, Human
acagcucugcauac

SEQ ID NO: 2024946 - RNA, 15 nt, Human
accugaagcuagacg

SEQ ID NO: 2024947 - RNA, 23 nt, Human
accuggcugaggcgccacccuuc

SEQ ID NO: 2024948 - RNA, 22 nt, Human
accgacggccagccgcugcgcu

SEQ ID NO: 2024949 - RNA, 19 nt, Human
accgccuccuacagcccac

SEQ ID NO: 2024950 - RNA, 18 nt, Human
accggguuccagcaccac

SEQ ID NO: 2024951 - RNA, 17 nt, Human
accuaaccagggccaga

SEQ ID NO: 2024952 - RNA, 16 nt, Human
acguguggaccccugc

SEQ ID NO: 2024953 - RNA, 22 nt, Human
ucucuugccucagcuuccccag

SEQ ID NO: 2024954 - RNA, 19 nt, Human
ucugaggagccugcaacau

SEQ ID NO: 2024955 - RNA, 17 nt, Human
ucuggccucccacagac

SEQ ID NO: 2024956 - RNA, 14 nt, Human
ucuggggcuguuca

SEQ ID NO: 2024957 - RNA, 21 nt, Human
ucaaaugaugugccugcuuca

SEQ ID NO: 2024958 - RNA, 20 nt, Human
uccaagccucauguccacug

SEQ ID NO: 2024959 - RNA, 19 nt, Human
uccacacccucacugcugu

SEQ ID NO: 2024960 - RNA, 14 nt, Human
ucucagugucaaug

SEQ ID NO: 2024961 - RNA, 14 nt, Human
ucucccccauccua

SEQ ID NO: 2024962 - RNA, 21 nt, Human
uaaaagaaaauaaaaaaaaga

SEQ ID NO: 2024963 - RNA, 15 nt, Human
uaaaauguaucaaca

SEQ ID NO: 2024964 - RNA, 19 nt, Human
uaaagaauaggacuuguuu

SEQ ID NO: 2024965 - RNA, 21 nt, Human
uaaauaaugugaaacuggauu

SEQ ID NO: 2024966 - RNA, 19 nt, Human
uaaggaaucuuucugcuuu

SEQ ID NO: 2024967 - RNA, 13 nt, Human
guuugguuuuuau

SEQ ID NO: 2024968 - RNA, 20 nt, Human
guuuuccacuaauuuugcau

SEQ ID NO: 2024969 - RNA, 17 nt, Human
uagguuugcaagccucc

SEQ ID NO: 2024970 - RNA, 20 nt, Human
uaugcaaucaaaucugcuuu

SEQ ID NO: 2024971 - RNA, 21 nt, Human
ucacccaacaaucccaaggcc

SEQ ID NO: 2024972 - RNA, 23 nt, Human
ucaggccacauggcuaaagaagg

SEQ ID NO: 2024973 - RNA, 22 nt, Human
ucauguugguguuggcaucagu

SEQ ID NO: 2024974 - RNA, 13 nt, Human
uccauccugaggc

SEQ ID NO: 2024975 - RNA, 23 nt, Human
uccaugucgccucugcauucagg

SEQ ID NO: 2024976 - RNA, 13 nt, Human
ucgggccccaccu

SEQ ID NO: 2024977 - RNA, 20 nt, Human
ucuaaauaucccuuggacau

SEQ ID NO: 2024978 - RNA, 21 nt, Human
ucccgcgcuccccgcgccccg

SEQ ID NO: 2024979 - RNA, 23 nt, Human
uccgacugcccucugaggccucc

SEQ ID NO: 2024980 - RNA, 23 nt, Human
guuuagaauugaagguuuuugau

SEQ ID NO: 2024981 - RNA, 19 nt, Human
guuucuaaaggcuaccuuu

SEQ ID NO: 2024982 - RNA, 15 nt, Human
guucauuucauccuu

SEQ ID NO: 2024983 - RNA, 22 nt, Human
guucuaaaaucuuauuuuucaa

SEQ ID NO: 2024984 - RNA, 17 nt, Human
gugcuguuacaguuuuc

SEQ ID NO: 2024985 - RNA, 14 nt, Human
guggacacagcucu

SEQ ID NO: 2024986 - RNA, 19 nt, Human
guuaucugguuuuaaaaga

SEQ ID NO: 2024987 - RNA, 17 nt, Human
gucuauuucaucagaac

SEQ ID NO: 2024988 - RNA, 22 nt, Human
gucgggaugucauguccuccag

SEQ ID NO: 2024989 - RNA, 21 nt, Human
gucucuuuaaugucacaggca

SEQ ID NO: 2024990 - RNA, 20 nt, Human
gugcacuuggggcacaggga

SEQ ID NO: 2024991 - RNA, 16 nt, Human
guccccucccagggag

SEQ ID NO: 2024992 - RNA, 17 nt, Human
gucccugaaaccuagua

SEQ ID NO: 2024993 - RNA, 22 nt, Human
guccugccuaaggcugaacuug

SEQ ID NO: 2024994 - RNA, 9 nt, Human
aaaaaaaga

SEQ ID NO: 2024995 - RNA, 15 nt, Human
agaacuuuguauagu

SEQ ID NO: 2024996 - RNA, 19 nt, Human
agacaaucauguacagaaa

SEQ ID NO: 2024997 - RNA, 17 nt, Human
agacaaugugaaaagaa

SEQ ID NO: 2024998 - RNA, 14 nt, Human
agacaugaagggaa

SEQ ID NO: 2024999 - RNA, 17 nt, Human
agacuaucaaacagaaa

SEQ ID NO: 2025000 - RNA, 16 nt, Human
aguccauugaaaggga

SEQ ID NO: 2025001 - RNA, 21 nt, Human
aggcuaggggguuggaggugg

SEQ ID NO: 2025002 - RNA, 11 nt, Human
agggaccagaa

SEQ ID NO: 2025003 - RNA, 16 nt, Human
agggagcaccugguga

SEQ ID NO: 2025004 - RNA, 14 nt, Human
agggaugaggcaac

SEQ ID NO: 2025005 - RNA, 15 nt, Human
agggaugcauggaga

SEQ ID NO: 2025006 - RNA, 16 nt, Human
agcaucacuuaaaaca

SEQ ID NO: 2025007 - RNA, 12 nt, Human
aggcaggaggau

SEQ ID NO: 2025008 - RNA, 22 nt, Human
aggccaugggacagggaggacg

SEQ ID NO: 2025009 - RNA, 16 nt, Human
aggcccauuccccucg

SEQ ID NO: 2025010 - RNA, 18 nt, Human
aggccugcagccuggagc

SEQ ID NO: 2025011 - RNA, 21 nt, Human
aagccuuucauuuugcuuuaa

SEQ ID NO: 2025012 - RNA, 21 nt, Human
agaugccacuaccccuugauu

SEQ ID NO: 2025013 - RNA, 21 nt, Human
agcaaaggagauuggaaggaa

SEQ ID NO: 2025014 - RNA, 22 nt, Human
agcacacugcuugugaaaggaa

SEQ ID NO: 2025015 - RNA, 19 nt, Human
agcacgaauguuccccuca

SEQ ID NO: 2025016 - RNA, 16 nt, Human
aucccacuuuugccag

SEQ ID NO: 2025017 - RNA, 16 nt, Human
auaggaauugacccac

SEQ ID NO: 2025018 - RNA, 16 nt, Human
aguuuauuuuaaaaca

SEQ ID NO: 2025019 - RNA, 18 nt, Human
agugucugcuggagacau

SEQ ID NO: 2025020 - RNA, 19 nt, Human
aguuaaaagcacaaaggaa

SEQ ID NO: 2025021 - RNA, 16 nt, Human
aguuuaauugaaagaa

SEQ ID NO: 2025022 - RNA, 19 nt, Human
auggccagguggccacucc

SEQ ID NO: 2025023 - RNA, 20 nt, Human
auggugugaccacugcagaa

SEQ ID NO: 2025024 - RNA, 17 nt, Human
auguccccagccccucu

SEQ ID NO: 2025025 - RNA, 15 nt, Human
augaaagacucaaaa

SEQ ID NO: 2025026 - RNA, 14 nt, Human
augcaauccuuaca

SEQ ID NO: 2025027 - RNA, 19 nt, Human
auguuaaguugauggugau

SEQ ID NO: 2025028 - RNA, 21 nt, Human
aacgugaugugcucaucagaa

SEQ ID NO: 2025029 - RNA, 18 nt, Human
aacucugcaugguccccu

SEQ ID NO: 2025030 - RNA, 14 nt, Human
aagcaccccuucau

SEQ ID NO: 2025031 - RNA, 19 nt, Human
accugcccaaccugcucuc

SEQ ID NO: 2025032 - RNA, 22 nt, Human
accugccccucaacucuccucc

SEQ ID NO: 2025033 - RNA, 22 nt, Human
accccugcagauagcaccgguc

SEQ ID NO: 2025034 - RNA, 14 nt, Human
accccugcggcagg

SEQ ID NO: 2025035 - RNA, 14 nt, Human
acccugaaagcccu

SEQ ID NO: 2025036 - RNA, 23 nt, Human
acucucuuggcugucacccgauc

SEQ ID NO: 2025037 - RNA, 23 nt, Human
acucugccuccucuucaacugac

SEQ ID NO: 2025038 - RNA, 21 nt, Human
accucccuuuccaaaugccca

SEQ ID NO: 2025039 - RNA, 12 nt, Human
acacgcuccuuc

SEQ ID NO: 2025040 - RNA, 16 nt, Human
acaggcccuuccucuc

SEQ ID NO: 2025041 - RNA, 21 nt, Human
acaggcuccugccaccacgcc

SEQ ID NO: 2025042 - RNA, 21 nt, Human
acaggugugagccaccacgcc

SEQ ID NO: 2025043 - RNA, 17 nt, Human
aaugaagauacugaaau

SEQ ID NO: 2025044 - RNA, 19 nt, Human
aaugacagcaaacagauca

SEQ ID NO: 2025045 - RNA, 16 nt, Human
aaaaacaaagagcguu

SEQ ID NO: 2025046 - RNA, 21 nt, Human
aaaaacaaagagcguugaagu

SEQ ID NO: 2025047 - RNA, 14 nt, Human
acuuggucugugag

SEQ ID NO: 2025048 - RNA, 19 nt, Human
augaucccugcuuaaaaga

SEQ ID NO: 2025049 - RNA, 16 nt, Human
augaggaaggaacagc

SEQ ID NO: 2025050 - RNA, 17 nt, Human
auaccaaggaacaggaa

SEQ ID NO: 2025051 - RNA, 21 nt, Human
agugccgagaaggaagccucc

SEQ ID NO: 2025052 - RNA, 21 nt, Human
auaggcaccuaccaccacgcc

SEQ ID NO: 2025053 - RNA, 17 nt, Human
aucaugaagcguggaga

SEQ ID NO: 2025054 - RNA, 19 nt, Human
augcccuggauccaucagg

SEQ ID NO: 2025055 - RNA, 17 nt, Human
augguaggaacugcugg

SEQ ID NO: 2025056 - RNA, 14 nt, Human
auguggcguggaga

SEQ ID NO: 2025057 - RNA, 16 nt, Human
agggcagcacacggcc

SEQ ID NO: 2025058 - RNA, 13 nt, Human
aguagcacaggcu

SEQ ID NO: 2025059 - RNA, 14 nt, Human
agucccgccccucu

SEQ ID NO: 2025060 - RNA, 23 nt, Human
aguuaagagaaaugagcuugacc

SEQ ID NO: 2025061 - RNA, 23 nt, Human
aguuugcauuucagaaagccuuu

SEQ ID NO: 2025062 - RNA, 15 nt, Human
auaaaagacaaggaa

SEQ ID NO: 2025063 - RNA, 14 nt, Human
agcugcucugugac

SEQ ID NO: 2025064 - RNA, 20 nt, Human
aggagcccauuuggagggcc

SEQ ID NO: 2025065 - RNA, 13 nt, Human
aggagccugcaac

SEQ ID NO: 2025066 - RNA, 20 nt, Human
aggccggcgccuuccccucg

SEQ ID NO: 2025067 - RNA, 17 nt, Human
agccaaggccaaaggaa

SEQ ID NO: 2025068 - RNA, 20 nt, Human
agcagaacagugauuaccag

SEQ ID NO: 2025069 - RNA, 15 nt, Human
agcaccauccccucc

SEQ ID NO: 2025070 - RNA, 23 nt, Human
agcacccauccaccguccccucc

SEQ ID NO: 2025071 - RNA, 16 nt, Human
gcacuggauguggccc

SEQ ID NO: 2025072 - RNA, 22 nt, Human
gccugcgccaccgcccagagac

SEQ ID NO: 2025073 - RNA, 22 nt, Human
gccuugaccauucuccaccugc

SEQ ID NO: 2025074 - RNA, 22 nt, Human
gccuugggauccaggccccucc

SEQ ID NO: 2025075 - RNA, 18 nt, Human
gcgaaaucccugcucacu

SEQ ID NO: 2025076 - RNA, 12 nt, Human
gcgaauauuuug

SEQ ID NO: 2025077 - RNA, 21 nt, Human
gccugaggagcccagcgucca

SEQ ID NO: 2025078 - RNA, 15 nt, Human
gccugauuuguuccu

SEQ ID NO: 2025079 - RNA, 16 nt, Human
gccaggcugggucgcc

SEQ ID NO: 2025080 - RNA, 15 nt, Human
gccgccuguggacag

SEQ ID NO: 2025081 - RNA, 22 nt, Human
gccggucgggggggacccucca

SEQ ID NO: 2025082 - RNA, 12 nt, Human
gccgugaacuuu

SEQ ID NO: 2025083 - RNA, 17 nt, Human
gccgugaccccugcaga

SEQ ID NO: 2025084 - RNA, 16 nt, Human
gccuccuuuccccucc

SEQ ID NO: 2025085 - RNA, 22 nt, Human
gccccaccuggcugaggcgcca

SEQ ID NO: 2025086 - RNA, 13 nt, Human
gccccacucucag

SEQ ID NO: 2025087 - RNA, 16 nt, Human
gaugccagggacccac

SEQ ID NO: 2025088 - RNA, 23 nt, Human
gcaaaagaguguaaaauauuuua

SEQ ID NO: 2025089 - RNA, 16 nt, Human
gcaagcuaauucuuug

SEQ ID NO: 2025090 - RNA, 19 nt, Human
gcaaguuuuccauauuuuu

SEQ ID NO: 2025091 - RNA, 19 nt, Human
gcacaaccuucaagcugcu

SEQ ID NO: 2025092 - RNA, 11 nt, Human
gcauaguuccc

SEQ ID NO: 2025093 - RNA, 12 nt, Human
gcagauauuuug

SEQ ID NO: 2025094 - RNA, 19 nt, Human
gcauggaaaaguuucccag

SEQ ID NO: 2025095 - RNA, 18 nt, Human
gagugugauccaguuuuu

SEQ ID NO: 2025096 - RNA, 16 nt, Human
gauaaauuauuuccag

SEQ ID NO: 2025097 - RNA, 24 nt, Human
gagucagucgccuuucagcaggca

SEQ ID NO: 2025098 - RNA, 21 nt, Human
gauacaccgggccuggagaac

SEQ ID NO: 2025099 - RNA, 20 nt, Human
gaucccuucuuacuuaaccu

SEQ ID NO: 2025100 - RNA, 20 nt, Human
gaucgugcuggcgcuguugg

SEQ ID NO: 2025101 - RNA, 19 nt, Human
gagaaaagaaaaaaaaaga

SEQ ID NO: 2025102 - RNA, 14 nt, Human
gagaaucacaggcu

SEQ ID NO: 2025103 - RNA, 15 nt, Human
gagaaugcacaaaca

SEQ ID NO: 2025104 - RNA, 15 nt, Human
gagccugcaacaugc

SEQ ID NO: 2025105 - RNA, 12 nt, Human
gagccugcagag

SEQ ID NO: 2025106 - RNA, 23 nt, Human
gagauccuuguguuuaucagaaa

SEQ ID NO: 2025107 - RNA, 14 nt, Human
gagccaauggagac

SEQ ID NO: 2025108 - RNA, 15 nt, Human
gaagcccuucuaccu

SEQ ID NO: 2025109 - RNA, 22 nt, Human
gaccugggaauuuucaacaugg

SEQ ID NO: 2025110 - RNA, 18 nt, Human
gacuacucccccaggugg

SEQ ID NO: 2025111 - RNA, 13 nt, Human
gacugagucuccc

SEQ ID NO: 2025112 - RNA, 15 nt, Human
gaaguagcacaggcu

SEQ ID NO: 2025113 - RNA, 20 nt, Human
gacaccuuucagucucuuuu

SEQ ID NO: 2025114 - RNA, 20 nt, Human
gacacuaauggggcggugag

SEQ ID NO: 2025115 - RNA, 14 nt, Human
gacagacacaggcc

SEQ ID NO: 2025116 - RNA, 14 nt, Human
cuugauaaagaaga

SEQ ID NO: 2025117 - RNA, 18 nt, Human
cuucugccagcauaauac

SEQ ID NO: 2025118 - RNA, 18 nt, Human
cugcccugguuuccugcc

SEQ ID NO: 2025119 - RNA, 12 nt, Human
cuucagcucugu

SEQ ID NO: 2025120 - RNA, 20 nt, Human
cuuuauuuuuuugaacucuu

SEQ ID NO: 2025121 - RNA, 22 nt, Human
gaaagcagggacuugaacccau

SEQ ID NO: 2025122 - RNA, 14 nt, Human
cuuuuuuuuuucau

SEQ ID NO: 2025123 - RNA, 17 nt, Human
cugccucugacacacag

SEQ ID NO: 2025124 - RNA, 19 nt, Human
cugcgugugggacccgccg

SEQ ID NO: 2025125 - RNA, 16 nt, Human
cuguucagcuccagcu

SEQ ID NO: 2025126 - RNA, 21 nt, Human
cuggcaagcaagccugggagc

SEQ ID NO: 2025127 - RNA, 13 nt, Human
cuggccgggagcc

SEQ ID NO: 2025128 - RNA, 16 nt, Human
cuggccucugcacucc

SEQ ID NO: 2025129 - RNA, 12 nt, Human
cugggacauggg

SEQ ID NO: 2025130 - RNA, 19 nt, Human
cugggcugacugggccagg

SEQ ID NO: 2025131 - RNA, 18 nt, Human
cucugccccagccagcgc

SEQ ID NO: 2025132 - RNA, 21 nt, Human
cucugcccuaaugcgcaggcu

SEQ ID NO: 2025133 - RNA, 23 nt, Human
cucccgccuccaaccccucgccc

SEQ ID NO: 2025134 - RNA, 18 nt, Human
cuccugccucagucuccc

SEQ ID NO: 2025135 - RNA, 14 nt, Human
cucagccucccgag

SEQ ID NO: 2025136 - RNA, 16 nt, Human
cuaugauuuggaaaau

SEQ ID NO: 2025137 - RNA, 23 nt, Human
cgugacccaaaaaagucaagaac

SEQ ID NO: 2025138 - RNA, 14 nt, Human
cgugcacacaccag

SEQ ID NO: 2025139 - RNA, 16 nt, Human
cgugcauguguguuca

SEQ ID NO: 2025140 - RNA, 20 nt, Human herpesvirus 5
ucguacgacgucugcucaaa

SEQ ID NO: 2025141 - RNA, 18 nt, Human herpesvirus 5
uaacaugucucuguuuuu

SEQ ID NO: 2025142 - RNA, 19 nt, Human herpesvirus 5
ggcaaagaguccaucugcu

SEQ ID NO: 2025143 - RNA, 13 nt, Human herpesvirus 5
uauguaguccgua

SEQ ID NO: 2025144 - RNA, 14 nt, Human herpesvirus 5
cgcaagggcugcuc

SEQ ID NO: 2025145 - RNA, 17 nt, Human herpesvirus 5
ucuuugccggcucuccu

SEQ ID NO: 2025146 - RNA, 18 nt, Human herpesvirus 5
cagggugagaaagaggag

SEQ ID NO: 2025147 - RNA, 18 nt, Human herpesvirus 5
ccuacggaccgcagcacc

SEQ ID NO: 2025148 - RNA, 18 nt, Human herpesvirus 5
acgcaggugaggcucucg

SEQ ID NO: 2025149 - RNA, 19 nt, Human herpesvirus 5
ucccgcugugcuggccgcc

SEQ ID NO: 2025150 - RNA, 16 nt, Human herpesvirus 5
gcagcaccucuuucca

SEQ ID NO: 2025151 - RNA, 15 nt, Human herpesvirus 5
cugauguaccugcag

SEQ ID NO: 2025152 - RNA, 15 nt, Human herpesvirus 5
ccuuuugcuggcugg

SEQ ID NO: 2025153 - RNA, 21 nt, Human herpesvirus 5
ccaggcgcguaaaacucccca

SEQ ID NO: 2025154 - RNA, 23 nt, Human herpesvirus 5
acuacucuguguugcuacaggga

SEQ ID NO: 2025155 - RNA, 22 nt, Human herpesvirus 5
aaccgugcccguuuucacagca

SEQ ID NO: 2025156 - RNA, 17 nt, Human herpesvirus 5
gcccugcugacgcuguu

SEQ ID NO: 2025157 - RNA, 19 nt, Human herpesvirus 5
ucggugacaucaccgccuc

SEQ ID NO: 2025158 - RNA, 21 nt, Human herpesvirus 5
gugucuagcuggcggccucuu

SEQ ID NO: 2025159 - RNA, 22 nt, Human herpesvirus 5
cucgaccuccgacccgaagaau

SEQ ID NO: 2025160 - RNA, 18 nt, Human herpesvirus 5
ccagccccgucaaaacac

SEQ ID NO: 2025161 - RNA, 14 nt, Human herpesvirus 5
gugccauggaccug

SEQ ID NO: 2025162 - RNA, 16 nt, Human herpesvirus 5
gauacuaucgggggag

SEQ ID NO: 2025163 - RNA, 15 nt, Human herpesvirus 5
ugccggaacccuucc

SEQ ID NO: 2025164 - RNA, 15 nt, Human herpesvirus 5
ccaggcuuaacacua

SEQ ID NO: 2025165 - RNA, 18 nt, Human herpesvirus 5
ccagcgccaccauagcca

SEQ ID NO: 2025166 - RNA, 18 nt, Human herpesvirus 5
aauugcgggcccugcuga

SEQ ID NO: 2025167 - RNA, 16 nt, Human herpesvirus 5
cucacccggcugcugg

SEQ ID NO: 2025168 - RNA, 14 nt, Human herpesvirus 5
ugcuuagcugcaca

SEQ ID NO: 2025169 - RNA, 17 nt, Human herpesvirus 5
gaggguggugacuuaca

SEQ ID NO: 2025170 - RNA, 23 nt, Human herpesvirus 5
cgggcucaccgcaguugcugccu

SEQ ID NO: 2025171 - RNA, 16 nt, Human herpesvirus 5
guccacacaccgcuuu

SEQ ID NO: 2025172 - RNA, 17 nt, Human herpesvirus 5
gcagcauucaccuccag

SEQ ID NO: 2025173 - RNA, 20 nt, Human herpesvirus 5
ucuagacucacuuuauugaa

SEQ ID NO: 2025174 - RNA, 20 nt, Human herpesvirus 5
cuaucaccaaacaacaccac

SEQ ID NO: 2025175 - RNA, 20 nt, Human herpesvirus 5
caucggugccggccagguag

SEQ ID NO: 2025176 - RNA, 17 nt, Human herpesvirus 5
cgaggagccaaacugcg

SEQ ID NO: 2025177 - RNA, 20 nt, Human herpesvirus 5
caguauuucuagagcacuga

SEQ ID NO: 2025178 - RNA, 23 nt, Human herpesvirus 5
caggacccguacugcgacggcag

SEQ ID NO: 2025179 - RNA, 22 nt, Human herpesvirus 5
gcccgcuucaacgccugcacca

SEQ ID NO: 2025180 - RNA, 14 nt, Human herpesvirus 5
gcagagccaccagg

SEQ ID NO: 2025181 - RNA, 14 nt, Human herpesvirus 5
ccuggccccggcca

SEQ ID NO: 2025182 - RNA, 16 nt, Human herpesvirus 5
agacagccuuacagcu

SEQ ID NO: 2025183 - RNA, 14 nt, Human herpesvirus 5
gcaccgcgacagcu

SEQ ID NO: 2025184 - RNA, 18 nt, Human herpesvirus 5
ccacucgcaccggcagca

SEQ ID NO: 2025185 - RNA, 13 nt, Human herpesvirus 5
caccaagaaacac

SEQ ID NO: 2025186 - RNA, 21 nt, Human herpesvirus 5
uaucuuuguagccucaagaau

SEQ ID NO: 2025187 - RNA, 12 nt, Human herpesvirus 5
aauccggcggcg

SEQ ID NO: 2025188 - RNA, 22 nt, Human herpesvirus 5
cugucagcgccgggugcgcgac

SEQ ID NO: 2025189 - RNA, 12 nt, Human herpesvirus 5
caccugcugccg

SEQ ID NO: 2025190 - RNA, 16 nt, Human herpesvirus 5
agcgucugcgccuuuu

SEQ ID NO: 2025191 - RNA, 14 nt, Human herpesvirus 5
cgaacgcgacuggc

SEQ ID NO: 2025192 - RNA, 17 nt, Human herpesvirus 5
ucaccacgcagcaggcu

SEQ ID NO: 2025193 - RNA, 22 nt, Human herpesvirus 5
cuugucgucauucgggccagga

SEQ ID NO: 2025194 - RNA, 13 nt, Human herpesvirus 5
gcccaggguacgg

SEQ ID NO: 2025195 - RNA, 20 nt, Human herpesvirus 5
gauucaggacgaggagccaa

SEQ ID NO: 2025196 - RNA, 16 nt, Human herpesvirus 5
uguuuuauugacgaag

SEQ ID NO: 2025197 - RNA, 21 nt, Human herpesvirus 5
guucuuccgagucgugucgcu

SEQ ID NO: 2025198 - RNA, 22 nt, Human herpesvirus 5
aaguauauaacgccgaucaugu

SEQ ID NO: 2025199 - RNA, 16 nt, Human herpesvirus 5
gugaaggccguggaga

SEQ ID NO: 2025200 - RNA, 14 nt, Human herpesvirus 5
ggcauagugccagc

SEQ ID NO: 2025201 - RNA, 19 nt, Human herpesvirus 5
caccguuuucaugcccguc

SEQ ID NO: 2025202 - RNA, 18 nt, Human herpesvirus 5
cgagcaccccgaacugga

SEQ ID NO: 2025203 - RNA, 20 nt, Human herpesvirus 5
ccccggcagcggucucaucu

SEQ ID NO: 2025204 - RNA, 18 nt, Human herpesvirus 5
gcacuuccuguacacauc

SEQ ID NO: 2025205 - RNA, 15 nt, Human herpesvirus 5
cguauacgcgcugga

SEQ ID NO: 2025206 - RNA, 17 nt, Human herpesvirus 5
guuccacggccagcgcc

SEQ ID NO: 2025207 - RNA, 13 nt, Human herpesvirus 5
cgccgcucagguc

SEQ ID NO: 2025208 - RNA, 16 nt, Human herpesvirus 5
cucacccgaguccugg

SEQ ID NO: 2025209 - RNA, 18 nt, Human herpesvirus 5
gcggccgcagugggccca

SEQ ID NO: 2025210 - RNA, 18 nt, Human herpesvirus 5
cacggagcacgggcugcu

SEQ ID NO: 2025211 - RNA, 16 nt, Human herpesvirus 5
acccgccggagcccgg

SEQ ID NO: 2025212 - RNA, 13 nt, Human herpesvirus 5
cuacgcgaccagc

SEQ ID NO: 2025213 - RNA, 14 nt, Human herpesvirus 5
acggaccgcagcac

SEQ ID NO: 2025214 - RNA, 23 nt, Human herpesvirus 5
augauccuuguacagauguaaau

SEQ ID NO: 2025215 - RNA, 20 nt, Human herpesvirus 5
gcucaccgcaguugcugccu

SEQ ID NO: 2025216 - RNA, 16 nt, Human herpesvirus 5
gcgcccacuggaguug

SEQ ID NO: 2025217 - RNA, 17 nt, Human herpesvirus 5
gcgcgguuucgccgccg

SEQ ID NO: 2025218 - RNA, 14 nt, Human herpesvirus 5
cagcugcaggcagg

SEQ ID NO: 2025219 - RNA, 14 nt, Human herpesvirus 5
cuaugagggccugc

SEQ ID NO: 2025220 - RNA, 14 nt, Human herpesvirus 5
cgccgcaacagcgg

SEQ ID NO: 2025221 - RNA, 18 nt, Human herpesvirus 5
ugaugggugagggucgug

SEQ ID NO: 2025222 - RNA, 12 nt, Human herpesvirus 5
acgccaccgccg

SEQ ID NO: 2025223 - RNA, 20 nt, Human herpesvirus 5
ucaacgacgagaugaaggaa

SEQ ID NO: 2025224 - RNA, 18 nt, Human herpesvirus 5
cggccgugguggccgugc

SEQ ID NO: 2025225 - RNA, 23 nt, Human herpesvirus 5
gacgagcucuugcgaggcuuuga

SEQ ID NO: 2025226 - RNA, 23 nt, Human herpesvirus 5
uucugucgccgacuaaauucaug

SEQ ID NO: 2025227 - RNA, 20 nt, Human herpesvirus 5
gucaugggcgacuuucaggg

SEQ ID NO: 2025228 - RNA, 17 nt, Human herpesvirus 5
cagcuggcaacgugcca

SEQ ID NO: 2025229 - RNA, 17 nt, Human herpesvirus 5
ugcuuacccuucaauuu

SEQ ID NO: 2025230 - RNA, 16 nt, Human herpesvirus 5
ucugggaugugcagca

SEQ ID NO: 2025231 - RNA, 13 nt, Human herpesvirus 5
aaagcuaacauuc

SEQ ID NO: 2025232 - RNA, 21 nt, Human herpesvirus 5
uuucaugucuuacaaaucaca

SEQ ID NO: 2025233 - RNA, 18 nt, Human herpesvirus 5
cgucggcgguccuccagc

SEQ ID NO: 2025234 - RNA, 17 nt, Human herpesvirus 5
acggcauagugccagcc

SEQ ID NO: 2025235 - RNA, 23 nt, Human herpesvirus 5
uggggacgagcaccggcgccugc

SEQ ID NO: 2025236 - RNA, 16 nt, Human herpesvirus 5
gugaggcgcuccguca

SEQ ID NO: 2025237 - RNA, 22 nt, Human herpesvirus 5
ugaagccgucagucauagagcc

SEQ ID NO: 2025238 - RNA, 14 nt, Human herpesvirus 5
augaugcaaauaaa

SEQ ID NO: 2025239 - RNA, 17 nt, Human herpesvirus 5
uacagauacgcaaugca

SEQ ID NO: 2025240 - RNA, 18 nt, Human herpesvirus 5
ucucacgaucgcuggugu

SEQ ID NO: 2025241 - RNA, 18 nt, Human herpesvirus 5
ugcgcgaauggcuggugu

SEQ ID NO: 2025242 - RNA, 19 nt, Human herpesvirus 5
caugugcaaaaacuugucc

SEQ ID NO: 2025243 - RNA, 21 nt, Human herpesvirus 5
gucggcugccuguuccugcug

SEQ ID NO: 2025244 - RNA, 15 nt, Human herpesvirus 5
cugcguaagcaccgu

SEQ ID NO: 2025245 - RNA, 15 nt, Human herpesvirus 5
gacggugacgagcgc

SEQ ID NO: 2025246 - RNA, 12 nt, Human herpesvirus 5
gucgcguccggg

SEQ ID NO: 2025247 - RNA, 18 nt, Human herpesvirus 5
guaccuagcuacuuugga

SEQ ID NO: 2025248 - RNA, 23 nt, Human herpesvirus 5
uuaacuauuccuccguguucuua

SEQ ID NO: 2025249 - RNA, 16 nt, Human herpesvirus 5
cccggucggucuuccu

SEQ ID NO: 2025250 - RNA, 15 nt, Human herpesvirus 5
auacgcaguguuguu

SEQ ID NO: 2025251 - RNA, 14 nt, Human herpesvirus 5
caggccgcgcaggc

SEQ ID NO: 2025252 - RNA, 14 nt, Human herpesvirus 5
ccacggugcuuuuc

SEQ ID NO: 2025253 - RNA, 23 nt, Human herpesvirus 5
gucgcaucaucaacagcagcaac

SEQ ID NO: 2025254 - RNA, 17 nt, Human herpesvirus 5
ggaggacucagagccac

SEQ ID NO: 2025255 - RNA, 15 nt, Human herpesvirus 5
agccggcuccgccgu

SEQ ID NO: 2025256 - RNA, 19 nt, Human herpesvirus 5
uccacugccaacccagcag

SEQ ID NO: 2025257 - RNA, 21 nt, Human herpesvirus 5
ggacgauauaaagaggcacgg

SEQ ID NO: 2025258 - RNA, 15 nt, Human herpesvirus 5
gacaggcggccagcu

SEQ ID NO: 2025259 - RNA, 13 nt, Human herpesvirus 5
ccgcagaaggcca

SEQ ID NO: 2025260 - RNA, 12 nt, Human herpesvirus 5
uugguggacucg

SEQ ID NO: 2025261 - RNA, 22 nt, Human herpesvirus 5
gggcgcaucacccgccucaugg

SEQ ID NO: 2025262 - RNA, 21 nt, Human herpesvirus 5
gaacugucgucgccggaagga

SEQ ID NO: 2025263 - RNA, 23 nt, Human herpesvirus 5
gcaggaggugggguggcucuugc

SEQ ID NO: 2025264 - RNA, 22 nt, Human herpesvirus 5
cgguggucgaugcugaucacgu

SEQ ID NO: 2025265 - RNA, 16 nt, Human herpesvirus 5
acaagcgggacgaaaa

SEQ ID NO: 2025266 - RNA, 22 nt, Human herpesvirus 5
gaauccuaaucgcauccugcau

SEQ ID NO: 2025267 - RNA, 13 nt, Human herpesvirus 5
ucacuagacagau

SEQ ID NO: 2025268 - RNA, 17 nt, Human herpesvirus 5
cagccucgucgugcccg

SEQ ID NO: 2025269 - RNA, 23 nt, Human herpesvirus 5
aguggaugcgcgaagcugcgcag

SEQ ID NO: 2025270 - RNA, 13 nt, Human herpesvirus 5
aacguaacagcaa

SEQ ID NO: 2025271 - RNA, 13 nt, Human herpesvirus 5
gugccgcgccgcc

SEQ ID NO: 2025272 - RNA, 22 nt, Human herpesvirus 5
ggaacugguuuucggacagagc

SEQ ID NO: 2025273 - RNA, 20 nt, Human herpesvirus 5
ccugggaacgcgcgcacggc

SEQ ID NO: 2025274 - RNA, 23 nt, Human herpesvirus 5
caguagcggguaauaaaaacaau

SEQ ID NO: 2025275 - RNA, 16 nt, Human herpesvirus 5
guaaucuuccauaaua

SEQ ID NO: 2025276 - RNA, 23 nt, Human herpesvirus 5
ggaccauuuccaugugcagcugg

SEQ ID NO: 2025277 - RNA, 21 nt, Human herpesvirus 5
accucaguggaccgucaauuu

SEQ ID NO: 2025278 - RNA, 17 nt, Human herpesvirus 5
cuaccuggcuggcgcag

SEQ ID NO: 2025279 - RNA, 13 nt, Human herpesvirus 5
uuucuuuccucgg

SEQ ID NO: 2025280 - RNA, 15 nt, Human herpesvirus 5
gcuaguuagacaggc

SEQ ID NO: 2025281 - RNA, 19 nt, Human herpesvirus 5
accucguuguccucuccuc

SEQ ID NO: 2025282 - RNA, 17 nt, Human herpesvirus 5
gucagucagaaguggau

SEQ ID NO: 2025283 - RNA, 18 nt, Human herpesvirus 5
gccaccauagccacuacc

SEQ ID NO: 2025284 - RNA, 14 nt, Human herpesvirus 5
cggcagccacggag

SEQ ID NO: 2025285 - RNA, 16 nt, Human herpesvirus 5
ccgaugcuccgcgacc

SEQ ID NO: 2025286 - RNA, 19 nt, Human herpesvirus 5
agccuuaggaacagggaag

SEQ ID NO: 2025287 - RNA, 14 nt, Human herpesvirus 5
cgcuguguggcgug

SEQ ID NO: 2025288 - RNA, 15 nt, Human herpesvirus 5
ggcgguccuccagca

SEQ ID NO: 2025289 - RNA, 16 nt, Human herpesvirus 5
uaccucggccuuuuca

SEQ ID NO: 2025290 - RNA, 22 nt, Human herpesvirus 5
caccuggacgggggggaccggg

SEQ ID NO: 2025291 - RNA, 16 nt, Human herpesvirus 5
gucgcgauuugcuuga

SEQ ID NO: 2025292 - RNA, 19 nt, Human herpesvirus 5
cgggaaacauguccccauc

SEQ ID NO: 2025293 - RNA, 20 nt, Human herpesvirus 5
gcguccucguguggcaaguu

SEQ ID NO: 2025294 - RNA, 22 nt, Human herpesvirus 5
cugcuuuuuugucuccugugga

SEQ ID NO: 2025295 - RNA, 13 nt, Human herpesvirus 5
ggcaccggcagcc

SEQ ID NO: 2025296 - RNA, 19 nt, Human herpesvirus 5
cucgucggccugggcugcu

SEQ ID NO: 2025297 - RNA, 12 nt, Human herpesvirus 5
cucugcugcugg

SEQ ID NO: 2025298 - RNA, 23 nt, Human herpesvirus 5
augggcuucccuccugcagcugc

SEQ ID NO: 2025299 - RNA, 21 nt, Human herpesvirus 5
gccuucgcaaugucucaggca

SEQ ID NO: 2025300 - RNA, 22 nt, Human herpesvirus 5
gccgucucuucgcgccccucug

SEQ ID NO: 2025301 - RNA, 17 nt, Human herpesvirus 5
cagcggaaaaugccgcc

SEQ ID NO: 2025302 - RNA, 20 nt, Human herpesvirus 5
ucgcagccuccucgcuggga

SEQ ID NO: 2025303 - RNA, 23 nt, Human herpesvirus 5
ggccaacaagagaaagacccauc

SEQ ID NO: 2025304 - RNA, 20 nt, Human herpesvirus 5
cuccacggccuccgacgagc

SEQ ID NO: 2025305 - RNA, 17 nt, Human herpesvirus 5
cuuuggcgugcccagcc

SEQ ID NO: 2025306 - RNA, 15 nt, Human herpesvirus 5
ucucggagccgccga

SEQ ID NO: 2025307 - RNA, 24 nt, Human herpesvirus 5
gauuuucaugaauccacaggcugc

SEQ ID NO: 2025308 - RNA, 14 nt, Human herpesvirus 5
cugggcugggugca

SEQ ID NO: 2025309 - RNA, 13 nt, Human herpesvirus 5
gagagucugaaac

SEQ ID NO: 2025310 - RNA, 12 nt, Human herpesvirus 5
ggcugccggucu

SEQ ID NO: 2025311 - RNA, 14 nt, Human herpesvirus 5
cgcagcgccagccu

SEQ ID NO: 2025312 - RNA, 11 nt, Human herpesvirus 5
guugcgccgca

SEQ ID NO: 2025313 - RNA, 18 nt, Human herpesvirus 5
gacgugauuuacgagguc

SEQ ID NO: 2025314 - RNA, 14 nt, Human herpesvirus 5
cugggucgccaggu

SEQ ID NO: 2025315 - RNA, 23 nt, Human herpesvirus 5
ggaucuggcguuugaagcgcggu

SEQ ID NO: 2025316 - RNA, 15 nt, Human herpesvirus 5
ucuggcccuccgcca

SEQ ID NO: 2025317 - RNA, 13 nt, Human herpesvirus 5
aguauagcaugca

SEQ ID NO: 2025318 - RNA, 23 nt, Human herpesvirus 5
cgauagagauggcgauauuggaa

SEQ ID NO: 2025319 - RNA, 14 nt, Human herpesvirus 5
aggccuccagcgcc

SEQ ID NO: 2025320 - RNA, 16 nt, Human herpesvirus 5
acgcccuguaugagcu

SEQ ID NO: 2025321 - RNA, 17 nt, Human herpesvirus 5
uguuggugccccaggau

SEQ ID NO: 2025322 - RNA, 21 nt, Human herpesvirus 5
gcucgaccaggagguguugag

SEQ ID NO: 2025323 - RNA, 14 nt, Human herpesvirus 5
cgaauggcuggugu

SEQ ID NO: 2025324 - RNA, 14 nt, Human herpesvirus 5
aaucuccugagaca

SEQ ID NO: 2025325 - RNA, 22 nt, Human herpesvirus 5
uggcauauagccaauaaagaga

SEQ ID NO: 2025326 - RNA, 13 nt, Human herpesvirus 5
aauugggaaagag

SEQ ID NO: 2025327 - RNA, 15 nt, Human herpesvirus 5
uccacuccaucacac

SEQ ID NO: 2025328 - RNA, 18 nt, Human herpesvirus 5
agcgccgcggcaccagag

SEQ ID NO: 2025329 - RNA, 12 nt, Human herpesvirus 5
accuugucuccc

SEQ ID NO: 2025330 - RNA, 12 nt, Human herpesvirus 5
acaccgcugcgg

SEQ ID NO: 2025331 - RNA, 21 nt, Human herpesvirus 5
cacggcaucaugcugggcgac

SEQ ID NO: 2025332 - RNA, 16 nt, Human herpesvirus 5
cggcgugacacagcac

SEQ ID NO: 2025333 - RNA, 15 nt, Human herpesvirus 5
ccccgucgcccgagg

SEQ ID NO: 2025334 - RNA, 23 nt, Human herpesvirus 5
acacagaagaaaaaaacacaucg

SEQ ID NO: 2025335 - RNA, 12 nt, Human herpesvirus 5
uuaaaguaaaua

SEQ ID NO: 2025336 - RNA, 13 nt, Human herpesvirus 5
ccgucacugccac

SEQ ID NO: 2025337 - RNA, 20 nt, Human herpesvirus 5
acccgcgucccuggggcugc

SEQ ID NO: 2025338 - RNA, 22 nt, Human herpesvirus 5
ggcccaugagguagaagggcug

SEQ ID NO: 2025339 - RNA, 17 nt, Human herpesvirus 5
agcuauauagccggugu

SEQ ID NO: 2025340 - RNA, 18 nt, Human herpesvirus 5
ggcgcuguacauucugcu

SEQ ID NO: 2025341 - RNA, 16 nt, Human herpesvirus 5
gcuauaagacagccuu

SEQ ID NO: 2025342 - RNA, 14 nt, Human herpesvirus 5
gaugugcagggaca

SEQ ID NO: 2025343 - RNA, 23 nt, Human herpesvirus 5
gugaccacgucaccgugccccac

SEQ ID NO: 2025344 - RNA, 22 nt, Human herpesvirus 5
gacgccaucauggaagagggcg

SEQ ID NO: 2025345 - RNA, 23 nt, Human herpesvirus 5
uguucgagaaugccucuacuugg

SEQ ID NO: 2025346 - RNA, 14 nt, Human herpesvirus 5
cgguuugaccacac

SEQ ID NO: 2025347 - RNA, 18 nt, Human herpesvirus 5
ccagagacagagaccgcc

SEQ ID NO: 2025348 - RNA, 21 nt, Human herpesvirus 5
acaacaccguguaaggaaaac

SEQ ID NO: 2025349 - RNA, 15 nt, Human herpesvirus 5
uggcccucgcagugc

SEQ ID NO: 2025350 - RNA, 17 nt, Human herpesvirus 5
uggccucgauccauccu

SEQ ID NO: 2025351 - RNA, 13 nt, Human herpesvirus 5
gagcaggcucgcg

SEQ ID NO: 2025352 - RNA, 21 nt, Human herpesvirus 5
cauugcccuucuggagcacac

SEQ ID NO: 2025353 - RNA, 23 nt, Human herpesvirus 5
aggucguagugcggcgugcugca

SEQ ID NO: 2025354 - RNA, 14 nt, Human herpesvirus 5
auggcgacggacgu

SEQ ID NO: 2025355 - RNA, 20 nt, Human herpesvirus 5
ugacgucccuuuuacuagua

SEQ ID NO: 2025356 - RNA, 18 nt, Human herpesvirus 5
caagacgcgccucucgga

SEQ ID NO: 2025357 - RNA, 13 nt, Human herpesvirus 5
gcgcaggccgccg

SEQ ID NO: 2025358 - RNA, 13 nt, Human herpesvirus 5
cacggcugcugau

SEQ ID NO: 2025359 - RNA, 19 nt, Human herpesvirus 5
uguguccgcccgagcaggu

SEQ ID NO: 2025360 - RNA, 14 nt, Human herpesvirus 5
cccuauccuccauc

SEQ ID NO: 2025361 - RNA, 20 nt, Human herpesvirus 5
ccgaaggcuacacgcuuuuc

SEQ ID NO: 2025362 - RNA, 17 nt, Human herpesvirus 5
gugcgggugccgggaca

SEQ ID NO: 2025363 - RNA, 15 nt, Human herpesvirus 5
cccagggucaguugc

SEQ ID NO: 2025364 - RNA, 23 nt, Human herpesvirus 5
auacuuguuucauuuucuuucua

SEQ ID NO: 2025365 - RNA, 16 nt, Human herpesvirus 5
gguguggcggcagcgg

SEQ ID NO: 2025366 - RNA, 15 nt, Human herpesvirus 5
uagcgaucgcaugcu

SEQ ID NO: 2025367 - RNA, 13 nt, Human herpesvirus 5
gcuuaucugccuc

SEQ ID NO: 2025368 - RNA, 17 nt, Human herpesvirus 5
aggaauuggcaggaaag

SEQ ID NO: 2025369 - RNA, 20 nt, Human herpesvirus 5
gucgcaagggcugcucggcg

SEQ ID NO: 2025370 - RNA, 14 nt, Human herpesvirus 5
gucgccuuccagcu

SEQ ID NO: 2025371 - RNA, 16 nt, Human herpesvirus 5
aggcggcucgcuggaa

SEQ ID NO: 2025372 - RNA, 15 nt, Human herpesvirus 5
ucgcgccuccuccug

SEQ ID NO: 2025373 - RNA, 13 nt, Human herpesvirus 5
ccucagucugccu

SEQ ID NO: 2025374 - RNA, 15 nt, Human herpesvirus 5
uacagggugccgcca

SEQ ID NO: 2025375 - RNA, 20 nt, Human herpesvirus 5
cuagacaggguaacagccuu

SEQ ID NO: 2025376 - RNA, 22 nt, Human herpesvirus 5
ucguuaccacaacggccgccga

SEQ ID NO: 2025377 - RNA, 20 nt, Human herpesvirus 5
gagcacgggcugcuggucuc

SEQ ID NO: 2025378 - RNA, 17 nt, Human herpesvirus 5
cagcagcuggugcauca

SEQ ID NO: 2025379 - RNA, 21 nt, Human herpesvirus 5
ggccgccgcucaagccgcggu

SEQ ID NO: 2025380 - RNA, 23 nt, Human herpesvirus 5
cuaccaauaaagauaaucugcca

SEQ ID NO: 2025381 - RNA, 15 nt, Human herpesvirus 5
cgaaggcuacucuau

SEQ ID NO: 2025382 - RNA, 14 nt, Human herpesvirus 5
cgcggcgguggccg

SEQ ID NO: 2025383 - RNA, 14 nt, Human herpesvirus 5
gcgcggcggcagcu

SEQ ID NO: 2025384 - RNA, 17 nt, Human herpesvirus 5
ggccugguauacgaggc

SEQ ID NO: 2025385 - RNA, 17 nt, Human herpesvirus 5
accacgucgaccaggug

SEQ ID NO: 2025386 - RNA, 17 nt, Human herpesvirus 5
cugguauaaccagucau

SEQ ID NO: 2025387 - RNA, 22 nt, Human herpesvirus 5
aagaccauuaacaauuccacgc

SEQ ID NO: 2025388 - RNA, 12 nt, Human herpesvirus 5
cgucaaaacaca

SEQ ID NO: 2025389 - RNA, 15 nt, Human herpesvirus 5
cuaccuagagaggcu

SEQ ID NO: 2025390 - RNA, 13 nt, Human herpesvirus 5
ccgaagaccucac

SEQ ID NO: 2025391 - RNA, 12 nt, Human herpesvirus 5
agccggcagcug

SEQ ID NO: 2025392 - RNA, 20 nt, Human herpesvirus 5
gccuuccccgaugugcaggg

SEQ ID NO: 2025393 - RNA, 15 nt, Human herpesvirus 5
agaacaagcgguggu

SEQ ID NO: 2025394 - RNA, 14 nt, Human herpesvirus 5
ggcagcgggccugu

SEQ ID NO: 2025395 - RNA, 18 nt, Human herpesvirus 5
caacaguuaucagcaaua

SEQ ID NO: 2025396 - RNA, 12 nt, Human herpesvirus 5
gccgcggcagca

SEQ ID NO: 2025397 - RNA, 22 nt, Human herpesvirus 5
auacaucuccgucucuggucuc

SEQ ID NO: 2025398 - RNA, 19 nt, Human herpesvirus 5
ggcgacaagcuguggcugc

SEQ ID NO: 2025399 - RNA, 18 nt, Human herpesvirus 5
cccgguugcggccccgua

SEQ ID NO: 2025400 - RNA, 16 nt, Human herpesvirus 5
cagcaucgcgugcgcc

SEQ ID NO: 2025401 - RNA, 14 nt, Human herpesvirus 5
ccaguacagcgccg

SEQ ID NO: 2025402 - RNA, 18 nt, Human herpesvirus 5
cacggccagcuccacgcu

SEQ ID NO: 2025403 - RNA, 14 nt, Human herpesvirus 5
cgcuggcgggccga

SEQ ID NO: 2025404 - RNA, 14 nt, Human herpesvirus 5
ggcgcgcaucgccg

SEQ ID NO: 2025405 - RNA, 16 nt, Human herpesvirus 5
ucaguccauugucagu

SEQ ID NO: 2025406 - RNA, 19 nt, Human herpesvirus 5
auacccagcuggggaagua

SEQ ID NO: 2025407 - RNA, 22 nt, Human herpesvirus 5
acgcggguccauuggagccgcc

SEQ ID NO: 2025408 - RNA, 12 nt, Human herpesvirus 5
ccaugagccuca

SEQ ID NO: 2025409 - RNA, 15 nt, Human herpesvirus 5
cauggagacaguuuc

SEQ ID NO: 2025410 - RNA, 20 nt, Human herpesvirus 5
cccgcgucccuggggcugcu

SEQ ID NO: 2025411 - RNA, 15 nt, Human herpesvirus 5
cugccgcagcugcug

SEQ ID NO: 2025412 - RNA, 19 nt, Human herpesvirus 5
aacaugaaucuuccccucu

SEQ ID NO: 2025413 - RNA, 12 nt, Human herpesvirus 5
caggcuaaagaa

SEQ ID NO: 2025414 - RNA, 12 nt, Human herpesvirus 5
uaacuguagcac

SEQ ID NO: 2025415 - RNA, 14 nt, Human herpesvirus 5
gcgcucggucagcu

SEQ ID NO: 2025416 - RNA, 14 nt, Human herpesvirus 5
cuaccgugccaccu

SEQ ID NO: 2025417 - RNA, 21 nt, Human herpesvirus 5
cgauggcaaggugcugcaccu

SEQ ID NO: 2025418 - RNA, 21 nt, Human herpesvirus 5
cuucggaaucgggcccgccgg

SEQ ID NO: 2025419 - RNA, 15 nt, Human herpesvirus 5
ccucgcccaggcugu

SEQ ID NO: 2025420 - RNA, 15 nt, Human herpesvirus 5
uucgcgccccucugc

SEQ ID NO: 2025421 - RNA, 18 nt, Human herpesvirus 5
gccaacuccgugcuguug

SEQ ID NO: 2025422 - RNA, 22 nt, Human herpesvirus 5
ucagccucuguguucccaacac

SEQ ID NO: 2025423 - RNA, 20 nt, Human herpesvirus 5
cucguuucgccggcgcgcca

SEQ ID NO: 2025424 - RNA, 13 nt, Human herpesvirus 5
gcguaccaacaua

SEQ ID NO: 2025425 - RNA, 19 nt, Human herpesvirus 5
ggcugagacaggacgaggc

SEQ ID NO: 2025426 - RNA, 20 nt, Human herpesvirus 5
ccgugcccguuuucacagca

SEQ ID NO: 2025427 - RNA, 17 nt, Human herpesvirus 5
ccguccugcagaccgag

SEQ ID NO: 2025428 - RNA, 20 nt, Human herpesvirus 5
ggcggcagccacggaggaga

SEQ ID NO: 2025429 - RNA, 14 nt, Human herpesvirus 5
ccgccccagcagac

SEQ ID NO: 2025430 - RNA, 23 nt, Human herpesvirus 5
caccguugucggaggaacccugc

SEQ ID NO: 2025431 - RNA, 13 nt, Human herpesvirus 5
gcaagggcugcuc

SEQ ID NO: 2025432 - RNA, 15 nt, Human herpesvirus 5
gaaauccggcggcgc

SEQ ID NO: 2025433 - RNA, 13 nt, Human herpesvirus 5
cgcagccaccggc

SEQ ID NO: 2025434 - RNA, 17 nt, Human herpesvirus 5
ccggcagcacaccugcc

SEQ ID NO: 2025435 - RNA, 14 nt, Human herpesvirus 5
ggcucacgccggca

SEQ ID NO: 2025436 - RNA, 15 nt, Human herpesvirus 5
cugcggcgacuggcg

SEQ ID NO: 2025437 - RNA, 19 nt, Human herpesvirus 5
cucgagcuuauugagcgca

SEQ ID NO: 2025438 - RNA, 18 nt, Human herpesvirus 5
uaagcgcgaccggcagca

SEQ ID NO: 2025439 - RNA, 13 nt, Human herpesvirus 5
cugccuguuccug

SEQ ID NO: 2025440 - RNA, 14 nt, Human herpesvirus 5
cauauuuguuuuca

SEQ ID NO: 2025441 - RNA, 12 nt, Human herpesvirus 5
ggcugaucugca

SEQ ID NO: 2025442 - RNA, 16 nt, Human herpesvirus 5
ggggcugcgucgccug

SEQ ID NO: 2025443 - RNA, 20 nt, Human herpesvirus 5
aucacgggacccgccgccgc

SEQ ID NO: 2025444 - RNA, 23 nt, Human herpesvirus 5
ggccgacggugguuuccgcgccc

SEQ ID NO: 2025445 - RNA, 12 nt, Human herpesvirus 5
cacaugcugcuu

SEQ ID NO: 2025446 - RNA, 19 nt, Human herpesvirus 5
agaauacuggaagcugcug

SEQ ID NO: 2025447 - RNA, 14 nt, Human herpesvirus 5
cgugaaacagcagc

SEQ ID NO: 2025448 - RNA, 22 nt, Human herpesvirus 5
cugaagccgccgucgagccacu

SEQ ID NO: 2025449 - RNA, 19 nt, Human herpesvirus 5
aaauuagugucgauacuuu

SEQ ID NO: 2025450 - RNA, 21 nt, Human herpesvirus 5
ugaacgagucgcucaucguca

SEQ ID NO: 2025451 - RNA, 22 nt, Human herpesvirus 5
ggcucguguggcagcuggcuug

SEQ ID NO: 2025452 - RNA, 23 nt, Human herpesvirus 5
gcugcaccucaacaagggcuggc

SEQ ID NO: 2025453 - RNA, 18 nt, Human herpesvirus 5
uaaagauaaucugccaau

SEQ ID NO: 2025454 - RNA, 14 nt, Human herpesvirus 5
ucccucgcgccgcc

SEQ ID NO: 2025455 - RNA, 14 nt, Human herpesvirus 5
acggaaaagcagug

SEQ ID NO: 2025456 - RNA, 22 nt, Human herpesvirus 5
aaucuguguguucugugauaac

SEQ ID NO: 2025457 - RNA, 18 nt, Human herpesvirus 5
gcauacaaugugcugcau

SEQ ID NO: 2025458 - RNA, 17 nt, Human herpesvirus 5
ggcucguguggcagcug

SEQ ID NO: 2025459 - RNA, 21 nt, Human herpesvirus 5
ucggcugccuguuccugcugc

SEQ ID NO: 2025460 - RNA, 19 nt, Human herpesvirus 5
cacuuuccacggcgccggu

SEQ ID NO: 2025461 - RNA, 22 nt, Human herpesvirus 5
cuggggcccuucgugggcaaga

SEQ ID NO: 2025462 - RNA, 17 nt, Human herpesvirus 5
aggacaaaaaguacacu

SEQ ID NO: 2025463 - RNA, 17 nt, Human herpesvirus 5
caucuuucagcuggcuu

SEQ ID NO: 2025464 - RNA, 16 nt, Human herpesvirus 5
ucauguucucccagga

SEQ ID NO: 2025465 - RNA, 15 nt, Human herpesvirus 5
uaugccgucuucacu

SEQ ID NO: 2025466 - RNA, 23 nt, Human herpesvirus 5
acacgcgcuacgaaacuuuucug

SEQ ID NO: 2025467 - RNA, 13 nt, Human herpesvirus 5
ugcagcugcgccu

SEQ ID NO: 2025468 - RNA, 18 nt, Human herpesvirus 5
cgacguaccagcugucca

SEQ ID NO: 2025469 - RNA, 16 nt, Human herpesvirus 5
ucuaccccgccgccgu

SEQ ID NO: 2025470 - RNA, 11 nt, Human herpesvirus 5
cgcuuucacac

SEQ ID NO: 2025471 - RNA, 17 nt, Human herpesvirus 5
aguaaccuggagcagcg

SEQ ID NO: 2025472 - RNA, 18 nt, Human herpesvirus 5
gaccgcagguuagcggcg

SEQ ID NO: 2025473 - RNA, 16 nt, Human herpesvirus 5
gcccgucgcgcacggc

SEQ ID NO: 2025474 - RNA, 15 nt, Human herpesvirus 5
gauuccagaacuuug

SEQ ID NO: 2025475 - RNA, 23 nt, Human herpesvirus 5
uugaaacgcgagaugaacuguuc

SEQ ID NO: 2025476 - RNA, 19 nt, Human herpesvirus 5
cuacgcuccuacgacaaca

SEQ ID NO: 2025477 - RNA, 14 nt, Human herpesvirus 5
ucgacgauaugucg

SEQ ID NO: 2025478 - RNA, 17 nt, Human herpesvirus 5
aaaauacuggacuuuug

SEQ ID NO: 2025479 - RNA, 17 nt, Human herpesvirus 5
auaaacgucacggaagu

SEQ ID NO: 2025480 - RNA, 14 nt, Human herpesvirus 5
auauaagaaaagac

SEQ ID NO: 2025481 - RNA, 17 nt, Human herpesvirus 5
acccugggcuauaugca

SEQ ID NO: 2025482 - RNA, 24 nt, Human herpesvirus 5
auacgacgauguuuuuugaaucau

SEQ ID NO: 2025483 - RNA, 16 nt, Human herpesvirus 5
cuucagaaucuauaaa

SEQ ID NO: 2025484 - RNA, 12 nt, Human herpesvirus 5
ccaggugaccag

SEQ ID NO: 2025485 - RNA, 18 nt, Human herpesvirus 5
cgccaccauagccacuac

SEQ ID NO: 2025486 - RNA, 19 nt, Human herpesvirus 5
agcuacgcgaccagcugcu

SEQ ID NO: 2025487 - RNA, 14 nt, Human herpesvirus 5
gagacgagcucuug

SEQ ID NO: 2025488 - RNA, 12 nt, Human herpesvirus 5
ggcgucggagag

SEQ ID NO: 2025489 - RNA, 18 nt, Human herpesvirus 5
gacugcggcgacuggcga

SEQ ID NO: 2025490 - RNA, 12 nt, Human herpesvirus 5
acuagcacagag

SEQ ID NO: 2025491 - RNA, 16 nt, Human herpesvirus 5
guugagagugguggga

SEQ ID NO: 2025492 - RNA, 20 nt, Human herpesvirus 5
gcgucuuuauuuacgaggua

SEQ ID NO: 2025493 - RNA, 15 nt, Human herpesvirus 5
ggaagaagaagaaca

SEQ ID NO: 2025494 - RNA, 16 nt, Human herpesvirus 5
ggcucuccuccucucc

SEQ ID NO: 2025495 - RNA, 17 nt, Human herpesvirus 5
ugcaccucgaccuccga

SEQ ID NO: 2025496 - RNA, 13 nt, Human herpesvirus 5
ccucugccugggc

SEQ ID NO: 2025497 - RNA, 16 nt, Human herpesvirus 5
gcgguuauggcuccgc

SEQ ID NO: 2025498 - RNA, 22 nt, Human herpesvirus 5
cuggggucaaaagccuggguac

SEQ ID NO: 2025499 - RNA, 18 nt, Human herpesvirus 5
aagucuacgaucgcugga

SEQ ID NO: 2025500 - RNA, 19 nt, Human herpesvirus 5
cagcgugcaccugcugccg

SEQ ID NO: 2025501 - RNA, 15 nt, Human herpesvirus 5
ggucagcuugaggcu

SEQ ID NO: 2025502 - RNA, 15 nt, Human herpesvirus 5
gggaugaugauaagu

SEQ ID NO: 2025503 - RNA, 23 nt, Human herpesvirus 5
gugcgacugcggcgacuggcgag

SEQ ID NO: 2025504 - RNA, 17 nt, Human herpesvirus 5
ucaccgcaguugcugcc

SEQ ID NO: 2025505 - RNA, 17 nt, Human herpesvirus 5
acgcgucgaugccuguu

SEQ ID NO: 2025506 - RNA, 15 nt, Human herpesvirus 5
guuuaugagaaaagg

SEQ ID NO: 2025507 - RNA, 23 nt, Human herpesvirus 5
uuccccugggaauucaugcugua

SEQ ID NO: 2025508 - RNA, 21 nt, Human herpesvirus 5
ugcacaucaauaaacuuuuuu

SEQ ID NO: 2025509 - RNA, 23 nt, Human herpesvirus 5
agcggcagccaccgcgaggccac

SEQ ID NO: 2025510 - RNA, 20 nt, Human herpesvirus 5
agguauuccgaaaccuguau

SEQ ID NO: 2025511 - RNA, 15 nt, Human herpesvirus 5
ggugcaucaucuggu

SEQ ID NO: 2025512 - RNA, 21 nt, Human herpesvirus 5
uccguccucgucgccuuccag

SEQ ID NO: 2025513 - RNA, 16 nt, Human herpesvirus 5
cucuguggacccugcg

SEQ ID NO: 2025514 - RNA, 22 nt, Human herpesvirus 5
ggcucuugcgcuucugcagcuc

SEQ ID NO: 2025515 - RNA, 22 nt, Human herpesvirus 5
cccaccgccgcuuucucaucuc

SEQ ID NO: 2025516 - RNA, 21 nt, Human herpesvirus 5
acccgggcaacgcguggcccu

SEQ ID NO: 2025517 - RNA, 16 nt, Human herpesvirus 5
ggcgugcaucugccga

SEQ ID NO: 2025518 - RNA, 13 nt, Human herpesvirus 5
ccagagacagaga

SEQ ID NO: 2025519 - RNA, 20 nt, Human herpesvirus 5
gcgacacacguucgacaugg

SEQ ID NO: 2025520 - RNA, 18 nt, Human herpesvirus 5
ccacgguuuaccacaggc

SEQ ID NO: 2025521 - RNA, 21 nt, Human herpesvirus 5
gucucgcgucuucgcgagguc

SEQ ID NO: 2025522 - RNA, 18 nt, Human herpesvirus 5
caaagaaaaaaaaaagga

SEQ ID NO: 2025523 - RNA, 14 nt, Human herpesvirus 5
accuggaucugccc

SEQ ID NO: 2025524 - RNA, 22 nt, Human herpesvirus 5
aaaccgucgaaaacaaccacac

SEQ ID NO: 2025525 - RNA, 19 nt, Human herpesvirus 5
acacgccuugcaccugggu

SEQ ID NO: 2025526 - RNA, 16 nt, Human herpesvirus 5
cacucgcaccggcagc

SEQ ID NO: 2025527 - RNA, 15 nt, Human herpesvirus 5
cgacguaccagcugu

SEQ ID NO: 2025528 - RNA, 13 nt, Human herpesvirus 5
cgcugcccgacca

SEQ ID NO: 2025529 - RNA, 17 nt, Human herpesvirus 5
ggccagcgccugguacu

SEQ ID NO: 2025530 - RNA, 23 nt, Human herpesvirus 5
ugccuuuuuaauaaagucugggu

SEQ ID NO: 2025531 - RNA, 14 nt, Human herpesvirus 5
acugggacgaggag

SEQ ID NO: 2025532 - RNA, 20 nt, Human herpesvirus 5
aaccagauacaacgucaugc

SEQ ID NO: 2025533 - RNA, 17 nt, Human herpesvirus 5
cgccugguugcugccgc

SEQ ID NO: 2025534 - RNA, 14 nt, Human herpesvirus 5
ucaccaccaucagc

SEQ ID NO: 2025535 - RNA, 17 nt, Human herpesvirus 5
ggagcugcugcucggcg

SEQ ID NO: 2025536 - RNA, 21 nt, Human herpesvirus 5
cucgcugccgcagcugcugga

SEQ ID NO: 2025537 - RNA, 21 nt, Human herpesvirus 5
gacccgcagucuggcuugggu

SEQ ID NO: 2025538 - RNA, 23 nt, Human herpesvirus 5
caugaaucuuccccucugcugcu

SEQ ID NO: 2025539 - RNA, 16 nt, Human herpesvirus 5
ccacguagguuucugu

SEQ ID NO: 2025540 - RNA, 14 nt, Human herpesvirus 5
cacaaccuguggug

SEQ ID NO: 2025541 - RNA, 20 nt, Human herpesvirus 5
cagcacauuagacacacggg

SEQ ID NO: 2025542 - RNA, 18 nt, Human herpesvirus 5
gcacgggcucgggugacg

SEQ ID NO: 2025543 - RNA, 22 nt, Human herpesvirus 5
gccgucucgucacacggcaaca

SEQ ID NO: 2025544 - RNA, 16 nt, Human herpesvirus 5
cuggccgauccacggg

SEQ ID NO: 2025545 - RNA, 21 nt, Human herpesvirus 5
uguggcccgaagauguacaca

SEQ ID NO: 2025546 - RNA, 10 nt, Human herpesvirus 5
uaauguacca

SEQ ID NO: 2025547 - RNA, 16 nt, Human herpesvirus 5
cauccugcccaccgcc

SEQ ID NO: 2025548 - RNA, 14 nt, Human herpesvirus 5
cgguggugacuggg

SEQ ID NO: 2025549 - RNA, 18 nt, Human herpesvirus 5
caaguacagcggcucgcc

SEQ ID NO: 2025550 - RNA, 14 nt, Human herpesvirus 5
caccacucccacca

SEQ ID NO: 2025551 - RNA, 13 nt, Human herpesvirus 5
agccaucacagcg

SEQ ID NO: 2025552 - RNA, 16 nt, Human herpesvirus 5
cuguucuuccaccagc

SEQ ID NO: 2025553 - RNA, 15 nt, Human herpesvirus 5
ucaaucacccacaga

SEQ ID NO: 2025554 - RNA, 20 nt, Human herpesvirus 5
cgccgugcucuuggcgccgc

SEQ ID NO: 2025555 - RNA, 14 nt, Human herpesvirus 5
cggcaagagccgga

SEQ ID NO: 2025556 - RNA, 15 nt, Human herpesvirus 5
aucgcagccuccucg

SEQ ID NO: 2025557 - RNA, 18 nt, Human herpesvirus 5
cggguccauuggagccgc

SEQ ID NO: 2025558 - RNA, 23 nt, Human herpesvirus 5
cacgcggaugagcgugcugcucu

SEQ ID NO: 2025559 - RNA, 15 nt, Human herpesvirus 5
cgucugacgcugucu

SEQ ID NO: 2025560 - RNA, 13 nt, Human herpesvirus 5
ggccgcgcaggcc

SEQ ID NO: 2025561 - RNA, 18 nt, Human herpesvirus 5
gaccacaagcucagcauc

SEQ ID NO: 2025562 - RNA, 17 nt, Human herpesvirus 5
cguccagcuucugguag

SEQ ID NO: 2025563 - RNA, 13 nt, Human herpesvirus 5
gggaacacaucgc

SEQ ID NO: 2025564 - RNA, 15 nt, Human herpesvirus 5
ugggcgguggcggcc

SEQ ID NO: 2025565 - RNA, 21 nt, Human herpesvirus 5
ucuuggguagcuucucucugg

SEQ ID NO: 2025566 - RNA, 17 nt, Human herpesvirus 5
caauuuuuucgcugcca

SEQ ID NO: 2025567 - RNA, 15 nt, Human herpesvirus 5
ucgcauccugcauca

SEQ ID NO: 2025568 - RNA, 15 nt, Human herpesvirus 5
uucucccgacgucac

SEQ ID NO: 2025569 - RNA, 20 nt, Human herpesvirus 5
ucaccaccuugucuccccgg

SEQ ID NO: 2025570 - RNA, 11 nt, Human herpesvirus 5
gcccgagcagg

SEQ ID NO: 2025571 - RNA, 18 nt, Human herpesvirus 5
auacuggaagcugcuggu

SEQ ID NO: 2025572 - RNA, 22 nt, Human herpesvirus 5
ucacgggcucguguggcagcug

SEQ ID NO: 2025573 - RNA, 13 nt, Human herpesvirus 5
ccgauucagaucu

SEQ ID NO: 2025574 - RNA, 16 nt, Human herpesvirus 5
cacggccagcuccacg

SEQ ID NO: 2025575 - RNA, 19 nt, Human herpesvirus 5
acaaauagcagugacuggg

SEQ ID NO: 2025576 - RNA, 18 nt, Human herpesvirus 5
ucaccaaggcgagccacu

SEQ ID NO: 2025577 - RNA, 12 nt, Human herpesvirus 5
uacaucauacaa

SEQ ID NO: 2025578 - RNA, 20 nt, Human herpesvirus 5
gaguaccgcauuacugggac

SEQ ID NO: 2025579 - RNA, 18 nt, Human herpesvirus 5
gcaccugucgucgacaug

SEQ ID NO: 2025580 - RNA, 21 nt, Human herpesvirus 5
aagcuucggccggcugcugca

SEQ ID NO: 2025581 - RNA, 20 nt, Human herpesvirus 5
cuuuaacccaaaaccaugcu

SEQ ID NO: 2025582 - RNA, 18 nt, Human herpesvirus 5
ggggcccguuuugcauaa

SEQ ID NO: 2025583 - RNA, 20 nt, Human herpesvirus 5
ggaaaaagguugggagaugc

SEQ ID NO: 2025584 - RNA, 19 nt, Human herpesvirus 5
gaugaacuguuccacggcc

SEQ ID NO: 2025585 - RNA, 22 nt, Human herpesvirus 5
cccccgggauccaagagacccg

SEQ ID NO: 2025586 - RNA, 14 nt, Human herpesvirus 5
gugcuuuucaucua

SEQ ID NO: 2025587 - RNA, 12 nt, Human herpesvirus 5
ccacggccagcg

SEQ ID NO: 2025588 - RNA, 20 nt, Human herpesvirus 5
ggacggugaugaugcugcug

SEQ ID NO: 2025589 - RNA, 20 nt, Human herpesvirus 5
cguggcguaggaguggcgcc

SEQ ID NO: 2025590 - RNA, 16 nt, Human herpesvirus 5
aggguagaaacgugag

SEQ ID NO: 2025591 - RNA, 16 nt, Human herpesvirus 5
caucuguuuuugcugc

SEQ ID NO: 2025592 - RNA, 16 nt, Human herpesvirus 5
ccacgcucgagggcuc

SEQ ID NO: 2025593 - RNA, 16 nt, Human herpesvirus 5
gcugcaugagaacacg

SEQ ID NO: 2025594 - RNA, 15 nt, Human herpesvirus 5
guuaaaaaaaccacg

SEQ ID NO: 2025595 - RNA, 14 nt, Human herpesvirus 5
gccucucauguucu

SEQ ID NO: 2025596 - RNA, 23 nt, Human herpesvirus 5
ggaucuacucaucggcauguucg

SEQ ID NO: 2025597 - RNA, 19 nt, Human herpesvirus 5
cccgaggcacgucggggcu

SEQ ID NO: 2025598 - RNA, 14 nt, Human herpesvirus 5
ccuccugcagcugc

SEQ ID NO: 2025599 - RNA, 16 nt, Human herpesvirus 5
ggagcguaccagggaa

SEQ ID NO: 2025600 - RNA, 19 nt, Human herpesvirus 5
caccacuuugaccacccug

SEQ ID NO: 2025601 - RNA, 14 nt, Human herpesvirus 5
acuauuguauacuc

SEQ ID NO: 2025602 - RNA, 15 nt, Human herpesvirus 5
gcugggucagugcca

SEQ ID NO: 2025603 - RNA, 13 nt, Human herpesvirus 5
gggccaacgguac

SEQ ID NO: 2025604 - RNA, 13 nt, Human herpesvirus 5
acaucauacugac

SEQ ID NO: 2025605 - RNA, 14 nt, Human herpesvirus 5
cgcaaaucuacaac

SEQ ID NO: 2025606 - RNA, 23 nt, Human herpesvirus 5
caccccuuuuggugugugucuau

SEQ ID NO: 2025607 - RNA, 16 nt, Human herpesvirus 5
ccgucgccggccgacg

SEQ ID NO: 2025608 - RNA, 19 nt, Human herpesvirus 5
cccugcugacgcuguugag

SEQ ID NO: 2025609 - RNA, 23 nt, Human herpesvirus 5
acaucaacaguuuacgaguacaa

SEQ ID NO: 2025610 - RNA, 22 nt, Human herpesvirus 5
cuggguuaccccucgcugggcu

SEQ ID NO: 2025611 - RNA, 13 nt, Human herpesvirus 5
gccgccuccgcgg

SEQ ID NO: 2025612 - RNA, 22 nt, Human herpesvirus 5
uacagcaccccccucacgcuug

SEQ ID NO: 2025613 - RNA, 18 nt, Human herpesvirus 5
acgcgcccgacagcugca

SEQ ID NO: 2025614 - RNA, 16 nt, Human herpesvirus 5
ucgcacaaagaagucu

SEQ ID NO: 2025615 - RNA, 21 nt, Human herpesvirus 5
aggccaccgggacggccuggg

SEQ ID NO: 2025616 - RNA, 19 nt, Human herpesvirus 5
gcacgcgauuggccagcac

SEQ ID NO: 2025617 - RNA, 18 nt, Human herpesvirus 5
gccagcguccgcgccugc

SEQ ID NO: 2025618 - RNA, 15 nt, Human herpesvirus 5
uagugcgcgccgccg

SEQ ID NO: 2025619 - RNA, 22 nt, Human herpesvirus 5
ccaaggaaccaccguagcacug

SEQ ID NO: 2025620 - RNA, 12 nt, Human herpesvirus 5
ggccgccucuuc

SEQ ID NO: 2025621 - RNA, 20 nt, Human herpesvirus 5
gacaacggccgccgcagcca

SEQ ID NO: 2025622 - RNA, 15 nt, Human herpesvirus 5
cauguucggcuccgu

SEQ ID NO: 2025623 - RNA, 15 nt, Human herpesvirus 5
gacuggucuggcccg

SEQ ID NO: 2025624 - RNA, 15 nt, Human herpesvirus 5
gucccuggccccggc

SEQ ID NO: 2025625 - RNA, 13 nt, Human herpesvirus 5
gccagcugccacc

SEQ ID NO: 2025626 - RNA, 23 nt, Human herpesvirus 5
aaugccaugcggauccagcugcu

SEQ ID NO: 2025627 - RNA, 16 nt, Human herpesvirus 5
gugcagggacagugcg

SEQ ID NO: 2025628 - RNA, 14 nt, Human herpesvirus 5
cucauaauaaagcu

SEQ ID NO: 2025629 - RNA, 13 nt, Human herpesvirus 5
aaucaagccuguu

SEQ ID NO: 2025630 - RNA, 17 nt, Human herpesvirus 5
cgcaucacccgccucau

SEQ ID NO: 2025631 - RNA, 16 nt, Human herpesvirus 5
gaaacacgguuucuuc

SEQ ID NO: 2025632 - RNA, 21 nt, Human herpesvirus 5
gaucgugggugguagaacuga

SEQ ID NO: 2025633 - RNA, 13 nt, Human herpesvirus 5
guccagccagcau

SEQ ID NO: 2025634 - RNA, 18 nt, Human herpesvirus 5
cagcgccagcggccuggc

SEQ ID NO: 2025635 - RNA, 17 nt, Human herpesvirus 5
cacggcaucaugcuggg

SEQ ID NO: 2025636 - RNA, 15 nt, Human herpesvirus 5
ugccaccgacaugga

SEQ ID NO: 2025637 - RNA, 23 nt, Human herpesvirus 5
acaagacggcuauccagcagcug

SEQ ID NO: 2025638 - RNA, 16 nt, Human herpesvirus 5
uguuccuauugggaag

SEQ ID NO: 2025639 - RNA, 14 nt, Human herpesvirus 5
gcgagcgcucggcg

SEQ ID NO: 2025640 - RNA, 18 nt, Human herpesvirus 5
aacagcagcaacagcagc

SEQ ID NO: 2025641 - RNA, 23 nt, Human herpesvirus 5
cccgccggagcccggucugagcu

SEQ ID NO: 2025642 - RNA, 22 nt, Human herpesvirus 5
cgcgcaggccgccgccgcucag

SEQ ID NO: 2025643 - RNA, 14 nt, Human herpesvirus 5
gacugcagcccacc

SEQ ID NO: 2025644 - RNA, 18 nt, Human herpesvirus 5
ggacugacacagcuccug

SEQ ID NO: 2025645 - RNA, 13 nt, Human herpesvirus 5
ucaucaacagcag

SEQ ID NO: 2025646 - RNA, 16 nt, Human herpesvirus 5
gacccagcgacagauc

SEQ ID NO: 2025647 - RNA, 22 nt, Human herpesvirus 5
gugaucggccgcggugcgcugc

SEQ ID NO: 2025648 - RNA, 14 nt, Human herpesvirus 5
gcugcaccaggagg

SEQ ID NO: 2025649 - RNA, 16 nt, Human herpesvirus 5
uucuuccucucaguca

SEQ ID NO: 2025650 - RNA, 22 nt, Human herpesvirus 5
caucaggaucuggugcaggcca

SEQ ID NO: 2025651 - RNA, 19 nt, Human herpesvirus 5
caucgugguagcgccgcga

SEQ ID NO: 2025652 - RNA, 18 nt, Human herpesvirus 5
gguggaaaucccucaccc

SEQ ID NO: 2025653 - RNA, 22 nt, Human herpesvirus 5
uacgaccuguuuaccucaugcg

SEQ ID NO: 2025654 - RNA, 19 nt, Human herpesvirus 5
gacgauuuuaugcgccgcc

SEQ ID NO: 2025655 - RNA, 15 nt, Human herpesvirus 5
uuuuucuacgugucu

SEQ ID NO: 2025656 - RNA, 15 nt, Human herpesvirus 5
aucugccacuuuucu

SEQ ID NO: 2025657 - RNA, 20 nt, Human herpesvirus 5
accugcucaaaguacuuguc

SEQ ID NO: 2025658 - RNA, 21 nt, Human herpesvirus 5
cauaaacuguuccgcccugcu

SEQ ID NO: 2025659 - RNA, 20 nt, Human herpesvirus 5
guuucagcuggcaacgugcc

SEQ ID NO: 2025660 - RNA, 21 nt, Human herpesvirus 5
guuggucacugacgugcagga

SEQ ID NO: 2025661 - RNA, 21 nt, Human herpesvirus 5
gcucagcuugaugguguagga

SEQ ID NO: 2025662 - RNA, 15 nt, Human herpesvirus 5
auucagaaccaugua

SEQ ID NO: 2025663 - RNA, 15 nt, Human herpesvirus 5
cccucgcugggcuac

SEQ ID NO: 2025664 - RNA, 23 nt, Human herpesvirus 5
ucccaugcaacuucuucuacuca

SEQ ID NO: 2025665 - RNA, 14 nt, Human herpesvirus 5
cggccgcagaaggc

SEQ ID NO: 2025666 - RNA, 19 nt, Human herpesvirus 5
cccguggacgacuggcuca

SEQ ID NO: 2025667 - RNA, 14 nt, Human herpesvirus 5
agagagucugaaac

SEQ ID NO: 2025668 - RNA, 19 nt, Human herpesvirus 5
cuggagaacaauaaagcgu

SEQ ID NO: 2025669 - RNA, 12 nt, Human herpesvirus 5
gugcgcgccgcc

SEQ ID NO: 2025670 - RNA, 12 nt, Human herpesvirus 5
aucacccacaga

SEQ ID NO: 2025671 - RNA, 14 nt, Human herpesvirus 5
gacgaugcuuuccu

SEQ ID NO: 2025672 - RNA, 15 nt, Human herpesvirus 5
ccccgaacuggagcu

SEQ ID NO: 2025673 - RNA, 21 nt, Human herpesvirus 5
acgcagcgggaaaccgcgucg

SEQ ID NO: 2025674 - RNA, 22 nt, Human herpesvirus 5
aauugcgaagccagcuacagcc

SEQ ID NO: 2025675 - RNA, 16 nt, Human herpesvirus 5
cuguuacgagaagaaa

SEQ ID NO: 2025676 - RNA, 16 nt, Human herpesvirus 5
cuccaagucuggugcg

SEQ ID NO: 2025677 - RNA, 20 nt, Human herpesvirus 5
uagcaauaaucccuguaauu

SEQ ID NO: 2025678 - RNA, 20 nt, Human herpesvirus 5
ggccgucgcaagggcugcuc

SEQ ID NO: 2025679 - RNA, 16 nt, Human herpesvirus 5
ccgacaaccugcugca

SEQ ID NO: 2025680 - RNA, 16 nt, Human herpesvirus 5
aggccacccacccggu

SEQ ID NO: 2025681 - RNA, 22 nt, Human herpesvirus 5
uacaagacggcuauccagcagc

SEQ ID NO: 2025682 - RNA, 17 nt, Human herpesvirus 5
cccgccgcacgcgcuua

SEQ ID NO: 2025683 - RNA, 15 nt, Human herpesvirus 5
ucagaccgcaacaac

SEQ ID NO: 2025684 - RNA, 16 nt, Human herpesvirus 5
ugaugucggauccggc

SEQ ID NO: 2025685 - RNA, 20 nt, Human herpesvirus 5
ccuuagcuuucuugacuggc

SEQ ID NO: 2025686 - RNA, 21 nt, Human herpesvirus 5
uauggacaauuccccucgccu

SEQ ID NO: 2025687 - RNA, 22 nt, Human herpesvirus 5
ucacgcgcggaacccacaaagg

SEQ ID NO: 2025688 - RNA, 21 nt, Human herpesvirus 5
cagaucgucuacggcuccaca

SEQ ID NO: 2025689 - RNA, 15 nt, Human herpesvirus 5
caggacgaggcaggg

SEQ ID NO: 2025690 - RNA, 20 nt, Human herpesvirus 5
acccggcugcacguggccug

SEQ ID NO: 2025691 - RNA, 20 nt, Human herpesvirus 5
gaucagcgaggccgaagccg

SEQ ID NO: 2025692 - RNA, 13 nt, Human herpesvirus 5
acaacacuacccu

SEQ ID NO: 2025693 - RNA, 11 nt, Human herpesvirus 5
uguauacugug

SEQ ID NO: 2025694 - RNA, 17 nt, Human herpesvirus 5
uguugccgcuggacuga

SEQ ID NO: 2025695 - RNA, 14 nt, Human herpesvirus 5
cguggaaggcaccg

SEQ ID NO: 2025696 - RNA, 19 nt, Human herpesvirus 5
cgccuaccuuagaccgaca

SEQ ID NO: 2025697 - RNA, 19 nt, Human herpesvirus 5
augugugggaccuggucaa

SEQ ID NO: 2025698 - RNA, 16 nt, Human herpesvirus 5
gagcuaucuguguccg

SEQ ID NO: 2025699 - RNA, 22 nt, Human herpesvirus 5
acuucgcuagucaauaaagaaa

SEQ ID NO: 2025700 - RNA, 18 nt, Human herpesvirus 5
ggcgcagucgcgagcuga

SEQ ID NO: 2025701 - RNA, 10 nt, Human herpesvirus 5
acgguuugac

SEQ ID NO: 2025702 - RNA, 21 nt, Human herpesvirus 5
guuucuggaacaagaaacaca

SEQ ID NO: 2025703 - RNA, 23 nt, Human herpesvirus 5
gcugauacuaucgggggagauga

SEQ ID NO: 2025704 - RNA, 19 nt, Human herpesvirus 5
ccgaccgggaaaccacgcc

SEQ ID NO: 2025705 - RNA, 20 nt, Human herpesvirus 5
cuguuugaauaccguaaaca

SEQ ID NO: 2025706 - RNA, 24 nt, Human herpesvirus 5
cccggucggucuuccugcugcgca

SEQ ID NO: 2025707 - RNA, 20 nt, Human herpesvirus 5
caccgagacgugcgaccugg

SEQ ID NO: 2025708 - RNA, 14 nt, Human herpesvirus 5
uggacaacuuuucc

SEQ ID NO: 2025709 - RNA, 15 nt, Human herpesvirus 5
cacgccgcgcgaacg

SEQ ID NO: 2025710 - RNA, 12 nt, Human herpesvirus 5
ggccgacgaggc

SEQ ID NO: 2025711 - RNA, 15 nt, Human herpesvirus 5
aggcacgucggggcu

SEQ ID NO: 2025712 - RNA, 18 nt, Human herpesvirus 5
ccgcgguucuauccccga

SEQ ID NO: 2025713 - RNA, 19 nt, Human herpesvirus 5
ccaugagguagaagggcug

SEQ ID NO: 2025714 - RNA, 20 nt, Human herpesvirus 5
accacccgacugcagcccac

SEQ ID NO: 2025715 - RNA, 18 nt, Human herpesvirus 5
gacggcagcgucacagag

SEQ ID NO: 2025716 - RNA, 12 nt, Human herpesvirus 5
ucgccgccggga

SEQ ID NO: 2025717 - RNA, 18 nt, Human herpesvirus 5
ggucacugacgugcagga

SEQ ID NO: 2025718 - RNA, 14 nt, Human herpesvirus 5
guauauucaaucau

SEQ ID NO: 2025719 - RNA, 18 nt, Human herpesvirus 5
ccacgucuucaaaguagc

SEQ ID NO: 2025720 - RNA, 17 nt, Human herpesvirus 5
gacccacggucugcgug

SEQ ID NO: 2025721 - RNA, 12 nt, Human herpesvirus 5
aacccagcagcc

SEQ ID NO: 2025722 - RNA, 12 nt, Human herpesvirus 5
ggcggccucuuu

SEQ ID NO: 2025723 - RNA, 14 nt, Human herpesvirus 5
cacagcagcaccag

SEQ ID NO: 2025724 - RNA, 12 nt, Human herpesvirus 5
gcgcacgccaaa

SEQ ID NO: 2025725 - RNA, 13 nt, Human herpesvirus 5
ucacuaucuucaa

SEQ ID NO: 2025726 - RNA, 24 nt, Human herpesvirus 5
gccaccacccgacugcagcccacc

SEQ ID NO: 2025727 - RNA, 19 nt, Human herpesvirus 5
gugaucgugggccaggacc

SEQ ID NO: 2025728 - RNA, 14 nt, Human herpesvirus 5
cgaggacgcgcuuc

SEQ ID NO: 2025729 - RNA, 15 nt, Human herpesvirus 5
ggccauggagcugca

SEQ ID NO: 2025730 - RNA, 14 nt, Human herpesvirus 5
gaaucagcagugag

SEQ ID NO: 2025731 - RNA, 17 nt, Human herpesvirus 5
gauaacaaacaaugaca

SEQ ID NO: 2025732 - RNA, 22 nt, Human herpesvirus 5
cucucugugagcuuuuuucccc

SEQ ID NO: 2025733 - RNA, 14 nt, Human herpesvirus 5
ggccaugagcggca

SEQ ID NO: 2025734 - RNA, 18 nt, Human herpesvirus 5
gacgagaugaaggaacgc

SEQ ID NO: 2025735 - RNA, 21 nt, Human herpesvirus 5
ucuacgugucugggccacagg

SEQ ID NO: 2025736 - RNA, 21 nt, Human herpesvirus 5
ugguucaaaaaguucaccgua

SEQ ID NO: 2025737 - RNA, 21 nt, Human herpesvirus 5
gacacguagaucccacuggca

SEQ ID NO: 2025738 - RNA, 20 nt, Human herpesvirus 5
cacuuuuaacagcucaugcc

SEQ ID NO: 2025739 - RNA, 17 nt, Human herpesvirus 5
caacaaauaccaacacu

SEQ ID NO: 2025740 - RNA, 21 nt, Human herpesvirus 5
cggcuaucuguacugcaagac

SEQ ID NO: 2025741 - RNA, 22 nt, Human herpesvirus 5
ugucacggaacauguccuggcg

SEQ ID NO: 2025742 - RNA, 13 nt, Human herpesvirus 5
cugcgcgacacgg

SEQ ID NO: 2025743 - RNA, 16 nt, Human herpesvirus 5
uucaaagggagcccca

SEQ ID NO: 2025744 - RNA, 13 nt, Human herpesvirus 5
cagcaccaugccg

SEQ ID NO: 2025745 - RNA, 20 nt, Human herpesvirus 5
cagcaacaguauuccccgcu

SEQ ID NO: 2025746 - RNA, 19 nt, Human herpesvirus 5
ucaaccauuggcaacauca

SEQ ID NO: 2025747 - RNA, 23 nt, Human herpesvirus 5
cucgccuauacuauguguaugau

SEQ ID NO: 2025748 - RNA, 23 nt, Human herpesvirus 5
cuccgugcggcccccagaggccc

SEQ ID NO: 2025749 - RNA, 15 nt, Human herpesvirus 5
cagcgaacgacgcag

SEQ ID NO: 2025750 - RNA, 23 nt, Human herpesvirus 5
gcgcugguggccgaacagcagcu

SEQ ID NO: 2025751 - RNA, 14 nt, Human herpesvirus 5
ccacagcgccaggc

SEQ ID NO: 2025752 - RNA, 21 nt, Human herpesvirus 5
cuguuaacccccgacgagcag

SEQ ID NO: 2025753 - RNA, 18 nt, Human herpesvirus 5
cgacucgcugccgcagcu

SEQ ID NO: 2025754 - RNA, 16 nt, Human herpesvirus 5
aggaccguacacgcac

SEQ ID NO: 2025755 - RNA, 13 nt, Human herpesvirus 5
cggcgccugguug

SEQ ID NO: 2025756 - RNA, 22 nt, Human herpesvirus 5
cauugagaaagcuaacauuccc

SEQ ID NO: 2025757 - RNA, 12 nt, Human herpesvirus 5
ccuccacugcca

SEQ ID NO: 2025758 - RNA, 14 nt, Human herpesvirus 5
cggcggcagcuugg

SEQ ID NO: 2025759 - RNA, 14 nt, Human herpesvirus 5
ccgcagugggccca

SEQ ID NO: 2025760 - RNA, 21 nt, Human herpesvirus 5
agcacagagacaccaauugcu

SEQ ID NO: 2025761 - RNA, 23 nt, Human herpesvirus 5
accagggaggagggguuaagagg

SEQ ID NO: 2025762 - RNA, 23 nt, Human herpesvirus 5
gacaguagcggguaauaaaaaca

SEQ ID NO: 2025763 - RNA, 14 nt, Human herpesvirus 5
acgacccaccgccg

SEQ ID NO: 2025764 - RNA, 17 nt, Human herpesvirus 5
caugucgcgacagagag

SEQ ID NO: 2025765 - RNA, 21 nt, Human herpesvirus 5
cgucacuagaucaccacccug

SEQ ID NO: 2025766 - RNA, 21 nt, Human herpesvirus 5
gagcacgucuagcaggcccag

SEQ ID NO: 2025767 - RNA, 23 nt, Human herpesvirus 5
cugguuuuugcccccucccuucu

SEQ ID NO: 2025768 - RNA, 22 nt, Human herpesvirus 5
cugccaccgacauggagcccac

SEQ ID NO: 2025769 - RNA, 16 nt, Human herpesvirus 5
cucgaccggcggcugc

SEQ ID NO: 2025770 - RNA, 17 nt, Human herpesvirus 5
caggggcuggacguggu

SEQ ID NO: 2025771 - RNA, 23 nt, Human herpesvirus 5
cucgugugcuguugaccugggua

SEQ ID NO: 2025772 - RNA, 18 nt, Human herpesvirus 5
acgucugcguguguguuu

SEQ ID NO: 2025773 - RNA, 21 nt, Human herpesvirus 5
auuuaucaauacaaugacacu

SEQ ID NO: 2025774 - RNA, 17 nt, Human herpesvirus 5
ccagcggccgcaguggg

SEQ ID NO: 2025775 - RNA, 18 nt, Human herpesvirus 5
auccugggacaccacggu

SEQ ID NO: 2025776 - RNA, 18 nt, Human herpesvirus 5
cggagcacgggcugcugg

SEQ ID NO: 2025777 - RNA, 18 nt, Human herpesvirus 5
gaggaggaugggggggac

SEQ ID NO: 2025778 - RNA, 13 nt, Human herpesvirus 5
agaccgacagcgg

SEQ ID NO: 2025779 - RNA, 12 nt, Human herpesvirus 5
gcaugucgccca

SEQ ID NO: 2025780 - RNA, 23 nt, Human herpesvirus 5
ccuuccccacccaguagacagac

SEQ ID NO: 2025781 - RNA, 15 nt, Human herpesvirus 5
ugaugaugcugcuga

SEQ ID NO: 2025782 - RNA, 13 nt, Human herpesvirus 5
cgcggcaccagga

SEQ ID NO: 2025783 - RNA, 17 nt, Human herpesvirus 5
ugcgcgauacauugccc

SEQ ID NO: 2025784 - RNA, 14 nt, Human herpesvirus 5
gaagcuguuuuguu

SEQ ID NO: 2025785 - RNA, 23 nt, Human herpesvirus 5
guccacccaucccgagcacucca

SEQ ID NO: 2025786 - RNA, 22 nt, Human herpesvirus 5
uguuugggaacuuugccgucau

SEQ ID NO: 2025787 - RNA, 13 nt, Human herpesvirus 5
gugugggaccugg

SEQ ID NO: 2025788 - RNA, 16 nt, Human herpesvirus 5
acauccgucagccucg

SEQ ID NO: 2025789 - RNA, 23 nt, Human herpesvirus 5
gugucucuaaacgccaccugcaa

SEQ ID NO: 2025790 - RNA, 18 nt, Human herpesvirus 5
gcccgucggcugccuguu

SEQ ID NO: 2025791 - RNA, 21 nt, Human herpesvirus 5
aggcaaagaaaaaaaaaagga

SEQ ID NO: 2025792 - RNA, 13 nt, Human herpesvirus 5
gggaugacgggga

SEQ ID NO: 2025793 - RNA, 17 nt, Human herpesvirus 5
cguugaugcggcgcgua

SEQ ID NO: 2025794 - RNA, 17 nt, Human herpesvirus 5
ggugacgucgguggugg

SEQ ID NO: 2025795 - RNA, 13 nt, Human herpesvirus 5
cauguccagccug

SEQ ID NO: 2025796 - RNA, 22 nt, Human herpesvirus 5
aacgccuggcgugaucacgccu

SEQ ID NO: 2025797 - RNA, 21 nt, Human herpesvirus 5
gcaccacgucgauucccaucu

SEQ ID NO: 2025798 - RNA, 14 nt, Human herpesvirus 5
ugagcgacagcagc

SEQ ID NO: 2025799 - RNA, 22 nt, Human herpesvirus 5
uguuugacauuuuuucggccgc

SEQ ID NO: 2025800 - RNA, 22 nt, Human herpesvirus 5
aaaacggacgggaaaggcuaac

SEQ ID NO: 2025801 - RNA, 16 nt, Human herpesvirus 5
gaaccagcugguaccu

SEQ ID NO: 2025802 - RNA, 13 nt, Human herpesvirus 5
ccaugugcauggg

SEQ ID NO: 2025803 - RNA, 20 nt, Human herpesvirus 5
gccuguugugguggcuggga

SEQ ID NO: 2025804 - RNA, 17 nt, Human herpesvirus 5
ccccgcaaacucccacu

SEQ ID NO: 2025805 - RNA, 11 nt, Human herpesvirus 5
ucccucagccu

SEQ ID NO: 2025806 - RNA, 13 nt, Human herpesvirus 5
gcgcuugucgcca

SEQ ID NO: 2025807 - RNA, 21 nt, Human herpesvirus 5
uggaggucuaucacgggcucg

SEQ ID NO: 2025808 - RNA, 14 nt, Human herpesvirus 5
uauacaacaggugu

SEQ ID NO: 2025809 - RNA, 22 nt, Human herpesvirus 5
cccacaaaggguaucuggggag

SEQ ID NO: 2025810 - RNA, 22 nt, Human herpesvirus 5
ccacggccuuauguggcugcgc

SEQ ID NO: 2025811 - RNA, 16 nt, Human herpesvirus 5
gacgggacggcggcgc

SEQ ID NO: 2025812 - RNA, 13 nt, Human herpesvirus 5
guggagggcgcgc

SEQ ID NO: 2025813 - RNA, 14 nt, Human herpesvirus 5
accaaggaaccacc

SEQ ID NO: 2025814 - RNA, 18 nt, Human herpesvirus 5
cgcagcgguggcuggaga

SEQ ID NO: 2025815 - RNA, 18 nt, Human herpesvirus 5
ugauacaucgcauaugac

SEQ ID NO: 2025816 - RNA, 15 nt, Human herpesvirus 5
gaggcuguggccagc

SEQ ID NO: 2025817 - RNA, 14 nt, Human herpesvirus 5
uguucgugguuggc

SEQ ID NO: 2025818 - RNA, 16 nt, Human herpesvirus 5
gccuuggcgcucugga

SEQ ID NO: 2025819 - RNA, 16 nt, Human herpesvirus 5
ggaaacauguccccau

SEQ ID NO: 2025820 - RNA, 19 nt, Human herpesvirus 5
gcggguccauuggagccgc

SEQ ID NO: 2025821 - RNA, 21 nt, Human herpesvirus 5
cccaucgucccccuuucucua

SEQ ID NO: 2025822 - RNA, 13 nt, Human herpesvirus 5
agugggccagccc

SEQ ID NO: 2025823 - RNA, 10 nt, Human herpesvirus 5
augcgccgcc

SEQ ID NO: 2025824 - RNA, 21 nt, Human herpesvirus 5
acucgcugccgcagcugcugg

SEQ ID NO: 2025825 - RNA, 13 nt, Human herpesvirus 5
ccgcugcacggca

SEQ ID NO: 2025826 - RNA, 23 nt, Human herpesvirus 5
accucguuguccucuccuccuuc

SEQ ID NO: 2025827 - RNA, 11 nt, Human herpesvirus 5
uccugcugcua

SEQ ID NO: 2025828 - RNA, 13 nt, Human herpesvirus 5
acaaacaaugaca

SEQ ID NO: 2025829 - RNA, 13 nt, Human herpesvirus 5
gugccucugaaag

SEQ ID NO: 2025830 - RNA, 20 nt, Human herpesvirus 5
gugugaagcgguggaaacca

SEQ ID NO: 2025831 - RNA, 21 nt, Human herpesvirus 5
ucugauaccgggcgccgggac

SEQ ID NO: 2025832 - RNA, 15 nt, Human herpesvirus 5
cgugcguagcuguau

SEQ ID NO: 2025833 - RNA, 16 nt, Human herpesvirus 5
gcaagaugggcaccgu

SEQ ID NO: 2025834 - RNA, 19 nt, Human herpesvirus 5
accacucccaccacgguuu

SEQ ID NO: 2025835 - RNA, 14 nt, Human herpesvirus 5
ugcgaggcuuugau

SEQ ID NO: 2025836 - RNA, 14 nt, Human herpesvirus 5
caaguugguggugg

SEQ ID NO: 2025837 - RNA, 18 nt, Human herpesvirus 5
ccgcuuaacaacgugucc

SEQ ID NO: 2025838 - RNA, 20 nt, Human herpesvirus 5
cucagcgacgucccgcgcgg

SEQ ID NO: 2025839 - RNA, 16 nt, Human herpesvirus 5
gucaccaucgugccgc

SEQ ID NO: 2025840 - RNA, 15 nt, Human herpesvirus 5
cugaucgccuggagc

SEQ ID NO: 2025841 - RNA, 18 nt, Human herpesvirus 5
aagaccaagagcaugcug

SEQ ID NO: 2025842 - RNA, 20 nt, Human herpesvirus 5
caucaggaucuggugcaggc

SEQ ID NO: 2025843 - RNA, 19 nt, Human herpesvirus 5
guaccgucuccaccacagu

SEQ ID NO: 2025844 - RNA, 18 nt, Human herpesvirus 5
ccggcguuggggaucuac

SEQ ID NO: 2025845 - RNA, 21 nt, Human herpesvirus 5
cacuaaauuguuauugccagu

SEQ ID NO: 2025846 - RNA, 20 nt, Human herpesvirus 5
caacucuaucgcgacagaca

SEQ ID NO: 2025847 - RNA, 14 nt, Human herpesvirus 5
ccgcgcccacugga

SEQ ID NO: 2025848 - RNA, 20 nt, Human herpesvirus 5
gacgcagugcguggccgcac

SEQ ID NO: 2025849 - RNA, 21 nt, Human herpesvirus 5
cugucguggugacugagcaca

SEQ ID NO: 2025850 - RNA, 21 nt, Human herpesvirus 5
agcuuuuuaauaaaaaacaag

SEQ ID NO: 2025851 - RNA, 20 nt, Human herpesvirus 5
cagccaccgcgaggccaccc

SEQ ID NO: 2025852 - RNA, 17 nt, Human herpesvirus 5
gccgcggugcaggccgc

SEQ ID NO: 2025853 - RNA, 12 nt, Human herpesvirus 5
aaaucuaccuga

SEQ ID NO: 2025854 - RNA, 14 nt, Human herpesvirus 5
ugucaaaaaucacu

SEQ ID NO: 2025855 - RNA, 19 nt, Human herpesvirus 5
cgggacagcgugccggcga

SEQ ID NO: 2025856 - RNA, 16 nt, Human herpesvirus 5
cgacuggauccgcuuc

SEQ ID NO: 2025857 - RNA, 16 nt, Human herpesvirus 5
ucccucagccucugug

SEQ ID NO: 2025858 - RNA, 18 nt, Human herpesvirus 5
aagggcgcgggcggccag

SEQ ID NO: 2025859 - RNA, 19 nt, Human herpesvirus 5
cgcacccuaaaacaccgug

SEQ ID NO: 2025860 - RNA, 18 nt, Human herpesvirus 5
cgcuucaacgccugcacc

SEQ ID NO: 2025861 - RNA, 20 nt, Human herpesvirus 5
gcucguguggcagcuggcuu

SEQ ID NO: 2025862 - RNA, 17 nt, Human herpesvirus 5
caugucccuacucacca

SEQ ID NO: 2025863 - RNA, 16 nt, Human herpesvirus 5
gcgucagcggccgccg

SEQ ID NO: 2025864 - RNA, 17 nt, Human herpesvirus 5
gcgggccgaccgccgcc

SEQ ID NO: 2025865 - RNA, 18 nt, Human herpesvirus 5
acacucuggcccugcugu

SEQ ID NO: 2025866 - RNA, 15 nt, Human herpesvirus 5
gcgggaacuggccug

SEQ ID NO: 2025867 - RNA, 19 nt, Human herpesvirus 5
ucacgggacccgccgccgc

SEQ ID NO: 2025868 - RNA, 17 nt, Human herpesvirus 5
cgagaugaaggaacgca

SEQ ID NO: 2025869 - RNA, 20 nt, Human herpesvirus 5
gaagaggacgaagugacgga

SEQ ID NO: 2025870 - RNA, 15 nt, Human herpesvirus 5
ggugcucgaccagga

SEQ ID NO: 2025871 - RNA, 18 nt, Human herpesvirus 5
gcggucgcggguggccgg

SEQ ID NO: 2025872 - RNA, 14 nt, Human herpesvirus 5
gccuggcggcgggu

SEQ ID NO: 2025873 - RNA, 17 nt, Human herpesvirus 5
gguguuucuccgugugu

SEQ ID NO: 2025874 - RNA, 18 nt, Human herpesvirus 5
acccgcggccguacccgc

SEQ ID NO: 2025875 - RNA, 19 nt, Human herpesvirus 5
ugcugauuacaaugauggc

SEQ ID NO: 2025876 - RNA, 15 nt, Human herpesvirus 5
acauguaucucacca

SEQ ID NO: 2025877 - RNA, 15 nt, Human herpesvirus 5
cuaaagcccccacga

SEQ ID NO: 2025878 - RNA, 14 nt, Human herpesvirus 5
ggcggcugaucugc

SEQ ID NO: 2025879 - RNA, 15 nt, Human herpesvirus 5
gcaucuccucgccca

SEQ ID NO: 2025880 - RNA, 14 nt, Human herpesvirus 5
gacauggacucuug

SEQ ID NO: 2025881 - RNA, 18 nt, Human herpesvirus 5
guucgcccugucugcagc

SEQ ID NO: 2025882 - RNA, 15 nt, Human herpesvirus 5
uggaggccaacaucu

SEQ ID NO: 2025883 - RNA, 15 nt, Human herpesvirus 5
cggcggcggugguga

SEQ ID NO: 2025884 - RNA, 14 nt, Human herpesvirus 5
cgcggcgugaccac

SEQ ID NO: 2025885 - RNA, 15 nt, Human herpesvirus 5
ccgccggccacgagc

SEQ ID NO: 2025886 - RNA, 11 nt, Human herpesvirus 5
ugcgcgccgcc

SEQ ID NO: 2025887 - RNA, 13 nt, Human herpesvirus 5
ggcuucgaacauc

SEQ ID NO: 2025888 - RNA, 19 nt, Human herpesvirus 5
acuuuguggggcugcucaa

SEQ ID NO: 2025889 - RNA, 18 nt, Human herpesvirus 5
uaaugugucgcuauacac

SEQ ID NO: 2025890 - RNA, 19 nt, Human herpesvirus 5
agaggaagucgaucuggaa

SEQ ID NO: 2025891 - RNA, 13 nt, Human herpesvirus 5
acgucaacgguuu

SEQ ID NO: 2025892 - RNA, 16 nt, Human herpesvirus 5
uuggugaaggccgugg

SEQ ID NO: 2025893 - RNA, 19 nt, Human herpesvirus 5
guagcuuuuuuuauacauc

SEQ ID NO: 2025894 - RNA, 20 nt, Human herpesvirus 5
cuggaggacgcgcuggcugu

SEQ ID NO: 2025895 - RNA, 14 nt, Human herpesvirus 5
gcugagcgugugga

SEQ ID NO: 2025896 - RNA, 13 nt, Human herpesvirus 5
gaccaugggcuac

SEQ ID NO: 2025897 - RNA, 15 nt, Human herpesvirus 5
ucaacgccugcacca

SEQ ID NO: 2025898 - RNA, 19 nt, Human herpesvirus 5
ucggccggcugcugcacca

SEQ ID NO: 2025899 - RNA, 20 nt, Human herpesvirus 5
gccaccgucccucagcgacg

SEQ ID NO: 2025900 - RNA, 15 nt, Human herpesvirus 5
caguaaccuggagca

SEQ ID NO: 2025901 - RNA, 20 nt, Human herpesvirus 5
acuggagagacuuucaauga

SEQ ID NO: 2025902 - RNA, 16 nt, Human herpesvirus 5
ccgacaaggcgcggcg

SEQ ID NO: 2025903 - RNA, 20 nt, Human herpesvirus 5
cggcucaccacgcagcaggc

SEQ ID NO: 2025904 - RNA, 12 nt, Human herpesvirus 5
aagaugauacau

SEQ ID NO: 2025905 - RNA, 13 nt, Human herpesvirus 5
accauccucaccc

SEQ ID NO: 2025906 - RNA, 23 nt, Human herpesvirus 5
cgcucacagucuaucccuauggc

SEQ ID NO: 2025907 - RNA, 20 nt, Human herpesvirus 5
ccgucaaggccgccucuucu

SEQ ID NO: 2025908 - RNA, 21 nt, Human herpesvirus 5
aucucgccguacggcaacgag

SEQ ID NO: 2025909 - RNA, 15 nt, Human herpesvirus 5
gaaacaaacgucacu

SEQ ID NO: 2025910 - RNA, 17 nt, Human herpesvirus 5
ugcgcucuugggcgaca

SEQ ID NO: 2025911 - RNA, 14 nt, Human herpesvirus 5
cguggacgacuggc

SEQ ID NO: 2025912 - RNA, 20 nt, Human herpesvirus 5
cucagccucuguguucccaa

SEQ ID NO: 2025913 - RNA, 18 nt, Human herpesvirus 5
acgcgcucuucacacacu

SEQ ID NO: 2025914 - RNA, 12 nt, Human herpesvirus 5
cuccacaaccug

SEQ ID NO: 2025915 - RNA, 13 nt, Human herpesvirus 5
cgucuucugaagc

SEQ ID NO: 2025916 - RNA, 14 nt, Human herpesvirus 5
ccagaacucucugc

SEQ ID NO: 2025917 - RNA, 18 nt, Human herpesvirus 5
cugcggacgccgacggcc

SEQ ID NO: 2025918 - RNA, 18 nt, Human herpesvirus 5
gcccguucuccccgugga

SEQ ID NO: 2025919 - RNA, 17 nt, Human herpesvirus 5
caagaucguacccacca

SEQ ID NO: 2025920 - RNA, 16 nt, Human herpesvirus 5
aucuccgucacgccuc

SEQ ID NO: 2025921 - RNA, 18 nt, Human herpesvirus 5
gaccgcaacgugcugcug

SEQ ID NO: 2025922 - RNA, 15 nt, Human herpesvirus 5
gaccguuguccccgc

SEQ ID NO: 2025923 - RNA, 14 nt, Human herpesvirus 5
gcgacccagcgaca

SEQ ID NO: 2025924 - RNA, 15 nt, Human herpesvirus 5
ccguuuucacagcag

SEQ ID NO: 2025925 - RNA, 16 nt, Human herpesvirus 5
aacgggugggcugggg

SEQ ID NO: 2025926 - RNA, 23 nt, Human herpesvirus 5
cccaucucaacgucaacgguuuc

SEQ ID NO: 2025927 - RNA, 19 nt, Human herpesvirus 5
uguacaaucucacgguuaa

SEQ ID NO: 2025928 - RNA, 19 nt, Human herpesvirus 5
ccuggacggcuacaugugu

SEQ ID NO: 2025929 - RNA, 20 nt, Human herpesvirus 5
caaucgacugccuaacugua

SEQ ID NO: 2025930 - RNA, 20 nt, Human herpesvirus 5
acgcacuuuuuauucuuggu

SEQ ID NO: 2025931 - RNA, 18 nt, Human herpesvirus 5
acaccugagacuggucug

SEQ ID NO: 2025932 - RNA, 22 nt, Human herpesvirus 5
cacugacaagucguuucagccc

SEQ ID NO: 2025933 - RNA, 12 nt, Human herpesvirus 5
cggagucauuau

SEQ ID NO: 2025934 - RNA, 23 nt, Human herpesvirus 5
guuccaccaggcucugcgccguc

SEQ ID NO: 2025935 - RNA, 16 nt, Human herpesvirus 5
gcccgaggcggaggag

SEQ ID NO: 2025936 - RNA, 18 nt, Human herpesvirus 5
gcacgcgcuagccuuucu

SEQ ID NO: 2025937 - RNA, 12 nt, Human herpesvirus 5
acguccccccgc

SEQ ID NO: 2025938 - RNA, 19 nt, Human herpesvirus 5
cucgggaggacucagagcc

SEQ ID NO: 2025939 - RNA, 18 nt, Human herpesvirus 5
ugcgggugccgggacagc

SEQ ID NO: 2025940 - RNA, 16 nt, Human herpesvirus 5
cauguuuuaggaauga

SEQ ID NO: 2025941 - RNA, 19 nt, Human herpesvirus 5
cacacaucugucaccucac

SEQ ID NO: 2025942 - RNA, 15 nt, Human herpesvirus 5
ccacgggccgcgcuc

SEQ ID NO: 2025943 - RNA, 17 nt, Human herpesvirus 5
accgucgccgucacugc

SEQ ID NO: 2025944 - RNA, 19 nt, Human herpesvirus 5
ggcaauugcaugucgccca

SEQ ID NO: 2025945 - RNA, 19 nt, Human herpesvirus 5
ggccgccucuucuggcccu

SEQ ID NO: 2025946 - RNA, 15 nt, Human herpesvirus 5
gccuucagcgucuca

SEQ ID NO: 2025947 - RNA, 16 nt, Human herpesvirus 5
ccgcuuuucagaccgc

SEQ ID NO: 2025948 - RNA, 17 nt, Human herpesvirus 5
accccauacacgguuuc

SEQ ID NO: 2025949 - RNA, 13 nt, Human herpesvirus 5
gcaucacccgccu

SEQ ID NO: 2025950 - RNA, 18 nt, Human herpesvirus 5
caccguguucucccgacg

SEQ ID NO: 2025951 - RNA, 22 nt, Human herpesvirus 5
cuucgcgccccucugcguucac

SEQ ID NO: 2025952 - RNA, 14 nt, Human herpesvirus 5
uacuacuaccaaua

SEQ ID NO: 2025953 - RNA, 12 nt, Human herpesvirus 5
aaacagcagcuc

SEQ ID NO: 2025954 - RNA, 21 nt, Human herpesvirus 5
cucggccuugcgcucccugcu

SEQ ID NO: 2025955 - RNA, 18 nt, Human herpesvirus 5
ucaccaucgugccgcucc

SEQ ID NO: 2025956 - RNA, 16 nt, Human herpesvirus 5
ggucaugaaguuguug

SEQ ID NO: 2025957 - RNA, 14 nt, Human herpesvirus 5
caccugagacuggu

SEQ ID NO: 2025958 - RNA, 14 nt, Human herpesvirus 5
ccagggagacuuag

SEQ ID NO: 2025959 - RNA, 18 nt, Human herpesvirus 5
ggcgccgggacucuggug

SEQ ID NO: 2025960 - RNA, 20 nt, Human herpesvirus 5
gaaaccguacuaagucuccc

SEQ ID NO: 2025961 - RNA, 14 nt, Human herpesvirus 5
ggcaacugcugccu

SEQ ID NO: 2025962 - RNA, 15 nt, Human herpesvirus 5
ucacacuuaagaaaa

SEQ ID NO: 2025963 - RNA, 16 nt, Human herpesvirus 5
ggcccgaacgcugcuu

SEQ ID NO: 2025964 - RNA, 18 nt, Human herpesvirus 5
aggccuccagcgccuccu

SEQ ID NO: 2025965 - RNA, 11 nt, Human herpesvirus 5
cucagagccac

SEQ ID NO: 2025966 - RNA, 20 nt, Human herpesvirus 5
cgcacuuuuuuuacuaguau

SEQ ID NO: 2025967 - RNA, 20 nt, Human herpesvirus 5
cgcgucgcaaacgcugcuug

SEQ ID NO: 2025968 - RNA, 22 nt, Human herpesvirus 5
ccucuucuuugccggcucuccu

SEQ ID NO: 2025969 - RNA, 17 nt, Human herpesvirus 5
cugagcguguggaggac

SEQ ID NO: 2025970 - RNA, 14 nt, Human herpesvirus 5
cagacugcccuuga

SEQ ID NO: 2025971 - RNA, 19 nt, Human herpesvirus 5
gcgccgggcgccacggcca

SEQ ID NO: 2025972 - RNA, 15 nt, Human herpesvirus 5
uuagcggucuguuca

SEQ ID NO: 2025973 - RNA, 13 nt, Human herpesvirus 5
ccugcagcugcac

SEQ ID NO: 2025974 - RNA, 21 nt, Human herpesvirus 5
cugggagugguggcggcagcc

SEQ ID NO: 2025975 - RNA, 14 nt, Human herpesvirus 5
uaagccggcagcug

SEQ ID NO: 2025976 - RNA, 16 nt, Human herpesvirus 5
acaucccaagcacgcc

SEQ ID NO: 2025977 - RNA, 19 nt, Human herpesvirus 5
aaucacuuuuaacagcuca

SEQ ID NO: 2025978 - RNA, 21 nt, Human herpesvirus 5
ccgucuggagguggccugcau

SEQ ID NO: 2025979 - RNA, 22 nt, Human herpesvirus 5
ucaagaucguacccaccaccuc

SEQ ID NO: 2025980 - RNA, 22 nt, Human herpesvirus 5
cugcaagucccuggccccggcc

SEQ ID NO: 2025981 - RNA, 21 nt, Human herpesvirus 5
uucagucagagagucugaaac

SEQ ID NO: 2025982 - RNA, 21 nt, Human herpesvirus 5
cguuggacgcuuaucgggcgc

SEQ ID NO: 2025983 - RNA, 15 nt, Human herpesvirus 5
ggcugaucgcggccu

SEQ ID NO: 2025984 - RNA, 22 nt, Human herpesvirus 5
gucgccuuccagcuuaccgcca

SEQ ID NO: 2025985 - RNA, 12 nt, Human herpesvirus 5
gcgggugcauga

SEQ ID NO: 2025986 - RNA, 13 nt, Human herpesvirus 5
gacugacacagcu

SEQ ID NO: 2025987 - RNA, 23 nt, Human herpesvirus 5
agcaggcuaaagaagaccaugac

SEQ ID NO: 2025988 - RNA, 23 nt, Human herpesvirus 5
gccuccguccucgucgccuucca

SEQ ID NO: 2025989 - RNA, 21 nt, Human herpesvirus 5
ucacacuaagaauaaagaaaa

SEQ ID NO: 2025990 - RNA, 13 nt, Human herpesvirus 5
gcacgggcugcug

SEQ ID NO: 2025991 - RNA, 23 nt, Human herpesvirus 5
caacauacaguacaacaguuauc

SEQ ID NO: 2025992 - RNA, 19 nt, Human herpesvirus 5
gacacacguucgacaugga

SEQ ID NO: 2025993 - RNA, 15 nt, Human herpesvirus 5
uggacugggacgagg

SEQ ID NO: 2025994 - RNA, 15 nt, Human herpesvirus 5
cggcccccuaccugc

SEQ ID NO: 2025995 - RNA, 21 nt, Human herpesvirus 5
guguucccaacacgucccccc

SEQ ID NO: 2025996 - RNA, 15 nt, Human herpesvirus 5
aucuuaccacaguug

SEQ ID NO: 2025997 - RNA, 20 nt, Human herpesvirus 5
acucgcugccgcagcugcug

SEQ ID NO: 2025998 - RNA, 22 nt, Human herpesvirus 5
agcuuaccgccaccgucgcccu

SEQ ID NO: 2025999 - RNA, 14 nt, Human herpesvirus 5
cggucuuccugcug

SEQ ID NO: 2026000 - RNA, 12 nt, Human herpesvirus 5
cucgcuggaagc

SEQ ID NO: 2026001 - RNA, 16 nt, Human herpesvirus 5
gcucucuauccggugg

SEQ ID NO: 2026002 - RNA, 12 nt, Human herpesvirus 5
ugaucugucauc

SEQ ID NO: 2026003 - RNA, 16 nt, Human herpesvirus 5
gcuugcuccucuucca

SEQ ID NO: 2026004 - RNA, 18 nt, Human herpesvirus 5
ugcccuauccgcgcggcu

SEQ ID NO: 2026005 - RNA, 12 nt, Human herpesvirus 5
gguggcggccuu

SEQ ID NO: 2026006 - RNA, 19 nt, Human herpesvirus 5
gaacgacgacucagggcug

SEQ ID NO: 2026007 - RNA, 14 nt, Human herpesvirus 5
gugcaaugccucau

SEQ ID NO: 2026008 - RNA, 17 nt, Human herpesvirus 5
uuaccaacguaacagca

SEQ ID NO: 2026009 - RNA, 21 nt, Human herpesvirus 5
gcccgaagccgcgcgagcgug

SEQ ID NO: 2026010 - RNA, 15 nt, Human herpesvirus 5
agagaaagagcagcg

SEQ ID NO: 2026011 - RNA, 13 nt, Human herpesvirus 5
gcaugauuagcaa

SEQ ID NO: 2026012 - RNA, 20 nt, Human herpesvirus 5
accauccgaagcuacagccg

SEQ ID NO: 2026013 - RNA, 19 nt, Human herpesvirus 5
caggcacgucauugacagc

SEQ ID NO: 2026014 - RNA, 19 nt, Human herpesvirus 5
uuccgcguuuggucgccug

SEQ ID NO: 2026015 - RNA, 14 nt, Human herpesvirus 5
gccgucgcaagggc

SEQ ID NO: 2026016 - RNA, 22 nt, Human herpesvirus 5
cauggagacaguuuccacgcag

SEQ ID NO: 2026017 - RNA, 16 nt, Human herpesvirus 5
cuauugcuuagcugca

SEQ ID NO: 2026018 - RNA, 15 nt, Human herpesvirus 5
gguacgccaguagcc

SEQ ID NO: 2026019 - RNA, 23 nt, Human herpesvirus 5
ccaucaggugacauccucgccca

SEQ ID NO: 2026020 - RNA, 12 nt, Human herpesvirus 5
cguaccagcugu

SEQ ID NO: 2026021 - RNA, 20 nt, Human herpesvirus 5
acagcgccgacgugcuucgc

SEQ ID NO: 2026022 - RNA, 17 nt, Human herpesvirus 5
cgccgacgaagaagaac

SEQ ID NO: 2026023 - RNA, 15 nt, Human herpesvirus 5
cgccgaggcuacugc

SEQ ID NO: 2026024 - RNA, 15 nt, Human herpesvirus 5
ugagacaggacgagg

SEQ ID NO: 2026025 - RNA, 18 nt, Human herpesvirus 5
auauuuuccauaaaucua

SEQ ID NO: 2026026 - RNA, 21 nt, Human herpesvirus 5
cggauggcuuuugcgucgccc

SEQ ID NO: 2026027 - RNA, 18 nt, Human herpesvirus 5
gugcgcguccacagcgug

SEQ ID NO: 2026028 - RNA, 21 nt, Human herpesvirus 5
ugcggcgcagacgucggcggu

SEQ ID NO: 2026029 - RNA, 15 nt, Human herpesvirus 5
cugcugcccacggaa

SEQ ID NO: 2026030 - RNA, 14 nt, Human herpesvirus 5
gcagcgugcugugc

SEQ ID NO: 2026031 - RNA, 13 nt, Human herpesvirus 5
ggaaugcggucag

SEQ ID NO: 2026032 - RNA, 14 nt, Human herpesvirus 5
cagcgguggcugga

SEQ ID NO: 2026033 - RNA, 13 nt, Human herpesvirus 5
guggggcugcuca

SEQ ID NO: 2026034 - RNA, 17 nt, Human herpesvirus 5
ucacuaucuucaaccuc

SEQ ID NO: 2026035 - RNA, 17 nt, Human herpesvirus 5
acaugcuauaagacagc

SEQ ID NO: 2026036 - RNA, 15 nt, Human herpesvirus 5
cuccaucaugaagga

SEQ ID NO: 2026037 - RNA, 14 nt, Human herpesvirus 5
acacgacacuagcc

SEQ ID NO: 2026038 - RNA, 16 nt, Human herpesvirus 5
aagaaaaaaugguguu

SEQ ID NO: 2026039 - RNA, 22 nt, Human herpesvirus 5
ccggggugguggugcugcugcu

SEQ ID NO: 2026040 - RNA, 23 nt, Human herpesvirus 5
augcaugcuaagaugaacgggug

SEQ ID NO: 2026041 - RNA, 14 nt, Human herpesvirus 5
uccgugccagcugg

SEQ ID NO: 2026042 - RNA, 17 nt, Human herpesvirus 5
caccuggacuucaaugu

SEQ ID NO: 2026043 - RNA, 14 nt, Human herpesvirus 5
cuccgucaauaaaa

SEQ ID NO: 2026044 - RNA, 13 nt, Human herpesvirus 5
uguguguuucuua

SEQ ID NO: 2026045 - RNA, 13 nt, Human herpesvirus 5
ggauugggcggac

SEQ ID NO: 2026046 - RNA, 16 nt, Human herpesvirus 5
ucugucguacuguccu

SEQ ID NO: 2026047 - RNA, 13 nt, Human herpesvirus 5
gcgacuccuggac

SEQ ID NO: 2026048 - RNA, 23 nt, Human herpesvirus 5
uaggcggcgcagcgccagccuua

SEQ ID NO: 2026049 - RNA, 15 nt, Human herpesvirus 5
acuauuguauacucu

SEQ ID NO: 2026050 - RNA, 16 nt, Human herpesvirus 5
gcagaacgaucccuuu

SEQ ID NO: 2026051 - RNA, 13 nt, Human herpesvirus 5
gcagucuggcuug

SEQ ID NO: 2026052 - RNA, 20 nt, Human herpesvirus 5
caccgcgccgggacccacgg

SEQ ID NO: 2026053 - RNA, 22 nt, Human herpesvirus 5
gagacccgcgucccuggggcug

SEQ ID NO: 2026054 - RNA, 14 nt, Human herpesvirus 5
auguaguugcagag

SEQ ID NO: 2026055 - RNA, 18 nt, Human herpesvirus 5
acuacagaauugauuuca

SEQ ID NO: 2026056 - RNA, 13 nt, Human herpesvirus 5
cagcgggcuuugc

SEQ ID NO: 2026057 - RNA, 22 nt, Human herpesvirus 5
uagugacgugucgggaaaggag

SEQ ID NO: 2026058 - RNA, 21 nt, Human herpesvirus 5
uacugcauccaucacaucacc

SEQ ID NO: 2026059 - RNA, 14 nt, Human herpesvirus 5
aauggaagccauac

SEQ ID NO: 2026060 - RNA, 21 nt, Human herpesvirus 5
gaucacgccuugcgcggccgu

SEQ ID NO: 2026061 - RNA, 16 nt, Human herpesvirus 5
ucccgugugugggggg

SEQ ID NO: 2026062 - RNA, 22 nt, Human herpesvirus 5
cuccgugcggcccccagaggcc

SEQ ID NO: 2026063 - RNA, 15 nt, Human herpesvirus 5
accaucuggcgcaga

SEQ ID NO: 2026064 - RNA, 21 nt, Human herpesvirus 5
guuauccggcgucgcuggcgc

SEQ ID NO: 2026065 - RNA, 14 nt, Human herpesvirus 5
gggagacggccugg

SEQ ID NO: 2026066 - RNA, 18 nt, Human herpesvirus 5
uuaccaacguaacagcaa

SEQ ID NO: 2026067 - RNA, 14 nt, Human herpesvirus 5
uccccgugugaugu

SEQ ID NO: 2026068 - RNA, 18 nt, Human herpesvirus 5
gguggcgaggugugagga

SEQ ID NO: 2026069 - RNA, 15 nt, Human herpesvirus 5
gugccuucggccagc

SEQ ID NO: 2026070 - RNA, 12 nt, Human herpesvirus 5
gucagacacagc

SEQ ID NO: 2026071 - RNA, 13 nt, Human herpesvirus 5
gacacccgcggcc

SEQ ID NO: 2026072 - RNA, 18 nt, Human herpesvirus 5
uggcgcaaaagcaccaug

SEQ ID NO: 2026073 - RNA, 15 nt, Human herpesvirus 5
uggagcaacgggcgg

SEQ ID NO: 2026074 - RNA, 20 nt, Human herpesvirus 5
agcggcggacuuggcagcgg

SEQ ID NO: 2026075 - RNA, 23 nt, Human herpesvirus 5
ucggagcacgggcgaaacgucag

SEQ ID NO: 2026076 - RNA, 14 nt, Human herpesvirus 5
gaaaaucugugugu

SEQ ID NO: 2026077 - RNA, 20 nt, Human herpesvirus 5
gugaucggccgcggugcgcu

SEQ ID NO: 2026078 - RNA, 21 nt, Human herpesvirus 5
gcggaggaggugaccuggcug

SEQ ID NO: 2026079 - RNA, 21 nt, Human herpesvirus 5
cagcggucguaagcggcagca

SEQ ID NO: 2026080 - RNA, 16 nt, Human herpesvirus 5
aaaacuaaaagaccua

SEQ ID NO: 2026081 - RNA, 14 nt, Human herpesvirus 5
gaccgaagacgccg

SEQ ID NO: 2026082 - RNA, 17 nt, Human herpesvirus 5
aggauccaaggccucca

SEQ ID NO: 2026083 - RNA, 16 nt, Human herpesvirus 5
ugucgcgacagagagg

SEQ ID NO: 2026084 - RNA, 22 nt, Human herpesvirus 5
uguacuaccgcgcccacuggag

SEQ ID NO: 2026085 - RNA, 22 nt, Human herpesvirus 5
cagguaggauuccaagccgcag

SEQ ID NO: 2026086 - RNA, 12 nt, Human herpesvirus 5
ccgagaaaggga

SEQ ID NO: 2026087 - RNA, 21 nt, Human herpesvirus 5
ccuaaguccaacaucguggua

SEQ ID NO: 2026088 - RNA, 22 nt, Human herpesvirus 5
gcucgccuuccccgaugugcag

SEQ ID NO: 2026089 - RNA, 22 nt, Human herpesvirus 5
acauuccccaccuucccucuag

SEQ ID NO: 2026090 - RNA, 23 nt, Human herpesvirus 5
acguugcuaggucccuuaacugu

SEQ ID NO: 2026091 - RNA, 15 nt, Human herpesvirus 5
agagccaugaagcgg

SEQ ID NO: 2026092 - RNA, 17 nt, Human herpesvirus 5
gcuacgcggcgcccgcg

SEQ ID NO: 2026093 - RNA, 12 nt, Human herpesvirus 5
cccgcuagaaug

SEQ ID NO: 2026094 - RNA, 19 nt, Human herpesvirus 5
aaucaccgucgagaaaacu

SEQ ID NO: 2026095 - RNA, 11 nt, Human herpesvirus 5
cacacgcagac

SEQ ID NO: 2026096 - RNA, 16 nt, Human herpesvirus 5
cuacgaaacuuuucug

SEQ ID NO: 2026097 - RNA, 20 nt, Human herpesvirus 5
cggcguguacagcuaccuca

SEQ ID NO: 2026098 - RNA, 13 nt, Human herpesvirus 5
cguggugcgcugc

SEQ ID NO: 2026099 - RNA, 16 nt, Human herpesvirus 5
cgcgcaucgccugcac

SEQ ID NO: 2026100 - RNA, 16 nt, Human herpesvirus 5
cggcgccgucagagca

SEQ ID NO: 2026101 - RNA, 18 nt, Human herpesvirus 5
ccacccgacugcagccca

SEQ ID NO: 2026102 - RNA, 18 nt, Human herpesvirus 5
ggcgguggucggcugccg

SEQ ID NO: 2026103 - RNA, 14 nt, Human herpesvirus 5
gcccauuguuuccu

SEQ ID NO: 2026104 - RNA, 12 nt, Human herpesvirus 5
gcgcgccccggc

SEQ ID NO: 2026105 - RNA, 17 nt, Human herpesvirus 5
gcuggcgguauggcugc

SEQ ID NO: 2026106 - RNA, 12 nt, Human herpesvirus 5
cgacgacccacc

SEQ ID NO: 2026107 - RNA, 13 nt, Human herpesvirus 5
ccacacacaucug

SEQ ID NO: 2026108 - RNA, 12 nt, Human herpesvirus 5
cacagcagcacc

SEQ ID NO: 2026109 - RNA, 18 nt, Human herpesvirus 5
gacaauacgcguaagaua

SEQ ID NO: 2026110 - RNA, 19 nt, Human herpesvirus 5
ccuggacacucuggcccug

SEQ ID NO: 2026111 - RNA, 16 nt, Human herpesvirus 5
cgagacuaucuacaac

SEQ ID NO: 2026112 - RNA, 19 nt, Human herpesvirus 5
gucgugccuucggccagcg

SEQ ID NO: 2026113 - RNA, 17 nt, Human herpesvirus 5
cauggcggcggccacgg

SEQ ID NO: 2026114 - RNA, 14 nt, Human herpesvirus 5
auuaaaaaaaaaac

SEQ ID NO: 2026115 - RNA, 14 nt, Human herpesvirus 5
cuguauuauauaca

SEQ ID NO: 2026116 - RNA, 22 nt, Human herpesvirus 5
gccaaacgcgugcgggugcaug

SEQ ID NO: 2026117 - RNA, 13 nt, Human herpesvirus 5
gcaggcuaaagaa

SEQ ID NO: 2026118 - RNA, 22 nt, Human herpesvirus 5
cuuuauucagaaagcaccagaa

SEQ ID NO: 2026119 - RNA, 14 nt, Human herpesvirus 5
ucgcgagcugagcu

SEQ ID NO: 2026120 - RNA, 18 nt, Human herpesvirus 5
guuacgccggaggccgcc

SEQ ID NO: 2026121 - RNA, 13 nt, Human herpesvirus 5
gucagucuauucu

SEQ ID NO: 2026122 - RNA, 13 nt, Human herpesvirus 5
ggcugacagucga

SEQ ID NO: 2026123 - RNA, 15 nt, Human herpesvirus 5
gguuguuucuccguc

SEQ ID NO: 2026124 - RNA, 18 nt, Human herpesvirus 5
ugcagggacagugcgcca

SEQ ID NO: 2026125 - RNA, 16 nt, Human herpesvirus 5
cgugggcuacuuugac

SEQ ID NO: 2026126 - RNA, 18 nt, Human herpesvirus 5
gcugcgaagaugcuaucc

SEQ ID NO: 2026127 - RNA, 15 nt, Human herpesvirus 5
cccagggcugcucca

SEQ ID NO: 2026128 - RNA, 16 nt, Human herpesvirus 5
ccacggcgucuuccuc

SEQ ID NO: 2026129 - RNA, 16 nt, Human herpesvirus 5
uucaauaaaaaccacc

SEQ ID NO: 2026130 - RNA, 21 nt, Human herpesvirus 5
gucucgggcucgcucggccuc

SEQ ID NO: 2026131 - RNA, 14 nt, Human herpesvirus 5
aaccugcugcacuu

SEQ ID NO: 2026132 - RNA, 14 nt, Human herpesvirus 5
gccccaucgggccc

SEQ ID NO: 2026133 - RNA, 16 nt, Human herpesvirus 5
cacagaccacgugccu

SEQ ID NO: 2026134 - RNA, 20 nt, Human herpesvirus 5
cuuuaggcggcgcagcgcca

SEQ ID NO: 2026135 - RNA, 15 nt, Human herpesvirus 5
cuggacgccugggcg

SEQ ID NO: 2026136 - RNA, 20 nt, Human herpesvirus 5
gacacaugcacaauacgaua

SEQ ID NO: 2026137 - RNA, 22 nt, Human herpesvirus 5
uaaaaugugcgaauuaggcaac

SEQ ID NO: 2026138 - RNA, 14 nt, Human herpesvirus 5
cauuuucuuucuag

SEQ ID NO: 2026139 - RNA, 15 nt, Human herpesvirus 5
gcaccaguuggccac

SEQ ID NO: 2026140 - RNA, 15 nt, Human herpesvirus 5
cuacuaccuccccua

SEQ ID NO: 2026141 - RNA, 22 nt, Human herpesvirus 5
cuggaaauucaauaaaaaccac

SEQ ID NO: 2026142 - RNA, 15 nt, Human herpesvirus 5
gccccaucauggccc

SEQ ID NO: 2026143 - RNA, 17 nt, Human herpesvirus 5
cucggugugcgacgcca

SEQ ID NO: 2026144 - RNA, 12 nt, Human herpesvirus 5
gggagccccauc

SEQ ID NO: 2026145 - RNA, 17 nt, Human herpesvirus 5
cggucccgacauggaga

SEQ ID NO: 2026146 - RNA, 15 nt, Human herpesvirus 5
acugcauccaucaca

SEQ ID NO: 2026147 - RNA, 16 nt, Human herpesvirus 5
gagcagccggagcccg

SEQ ID NO: 2026148 - RNA, 23 nt, Human herpesvirus 5
auuuugcgagagaugggccgcgg

SEQ ID NO: 2026149 - RNA, 21 nt, Human herpesvirus 5
ggccaacaagagaaagaccca

SEQ ID NO: 2026150 - RNA, 16 nt, Human herpesvirus 5
aaccaccgugucuccg

SEQ ID NO: 2026151 - RNA, 15 nt, Human herpesvirus 5
ggugaaggccgugga

SEQ ID NO: 2026152 - RNA, 16 nt, Human herpesvirus 5
aauauugcuucguaua

SEQ ID NO: 2026153 - RNA, 19 nt, Human herpesvirus 5
gcucggucagcuugaggcu

SEQ ID NO: 2026154 - RNA, 17 nt, Human herpesvirus 5
gcuacguaggccuccuc

SEQ ID NO: 2026155 - RNA, 23 nt, Human herpesvirus 5
gcagcccauccucguggaaggca

SEQ ID NO: 2026156 - RNA, 21 nt, Human herpesvirus 5
ccacggcgggucguuggcucc

SEQ ID NO: 2026157 - RNA, 15 nt, Human herpesvirus 5
cguuaucagaaagcu

SEQ ID NO: 2026158 - RNA, 13 nt, Human herpesvirus 5
gcgacggagagga

SEQ ID NO: 2026159 - RNA, 19 nt, Human herpesvirus 5
ccgccgucgcgccuuccuc

SEQ ID NO: 2026160 - RNA, 23 nt, Human herpesvirus 5
gaccacguagucgcgcgcgaagg

SEQ ID NO: 2026161 - RNA, 17 nt, Human herpesvirus 5
accagacauccaauuac

SEQ ID NO: 2026162 - RNA, 18 nt, Human herpesvirus 5
gggcagcagcggcggcua

SEQ ID NO: 2026163 - RNA, 18 nt, Human herpesvirus 5
ugcggcgcuucgagggcu

SEQ ID NO: 2026164 - RNA, 13 nt, Human herpesvirus 5
ugauccaggaggu

SEQ ID NO: 2026165 - RNA, 15 nt, Human herpesvirus 5
ggacacgguagacga

SEQ ID NO: 2026166 - RNA, 17 nt, Human herpesvirus 5
caacggccgccgcagcc

SEQ ID NO: 2026167 - RNA, 19 nt, Human herpesvirus 5
guuggcucccgcugugcug

SEQ ID NO: 2026168 - RNA, 13 nt, Human herpesvirus 5
cuucugcagcucc

SEQ ID NO: 2026169 - RNA, 13 nt, Human herpesvirus 5
cagugacugggua

SEQ ID NO: 2026170 - RNA, 14 nt, Human herpesvirus 5
gagagggucuuucu

SEQ ID NO: 2026171 - RNA, 15 nt, Human herpesvirus 5
auggacugucugcac

SEQ ID NO: 2026172 - RNA, 16 nt, Human herpesvirus 5
cauacacguugcuuuc

SEQ ID NO: 2026173 - RNA, 16 nt, Human herpesvirus 5
acgacguuuaaaguaa

SEQ ID NO: 2026174 - RNA, 17 nt, Human herpesvirus 5
gaucuugacgcugcugg

SEQ ID NO: 2026175 - RNA, 18 nt, Human herpesvirus 5
gcggcccuucaacggcac

SEQ ID NO: 2026176 - RNA, 19 nt, Human herpesvirus 5
gaucaucuguuuuugcugc

SEQ ID NO: 2026177 - RNA, 13 nt, Human herpesvirus 5
gugccagcuggcg

SEQ ID NO: 2026178 - RNA, 24 nt, Human herpesvirus 5
acgcgacuaugagggccugcggcg

SEQ ID NO: 2026179 - RNA, 18 nt, Human herpesvirus 5
ggcugccuguuccugcug

SEQ ID NO: 2026180 - RNA, 13 nt, Human herpesvirus 5
cgucggcugccug

SEQ ID NO: 2026181 - RNA, 23 nt, Human herpesvirus 5
ggaucggacacuuuaggcggcgc

SEQ ID NO: 2026182 - RNA, 18 nt, Human herpesvirus 5
aaccgcaugggaaaguac

SEQ ID NO: 2026183 - RNA, 15 nt, Human herpesvirus 5
ccucggccucuuccu

SEQ ID NO: 2026184 - RNA, 14 nt, Human herpesvirus 5
uccuccucccucgc

SEQ ID NO: 2026185 - RNA, 16 nt, Human herpesvirus 5
ugcugcugagacugag

SEQ ID NO: 2026186 - RNA, 13 nt, Human herpesvirus 5
ugcuccucuucca

SEQ ID NO: 2026187 - RNA, 18 nt, Human herpesvirus 5
guggggcugcucaacuuu

SEQ ID NO: 2026188 - RNA, 19 nt, Human herpesvirus 5
ccacgguuuguggcaaggc

SEQ ID NO: 2026189 - RNA, 17 nt, Human herpesvirus 5
cuuucucaucucagccu

SEQ ID NO: 2026190 - RNA, 20 nt, Human herpesvirus 5
acgagcaucgcaacaacagc

SEQ ID NO: 2026191 - RNA, 12 nt, Human herpesvirus 5
ggucggcugccg

SEQ ID NO: 2026192 - RNA, 21 nt, Human herpesvirus 5
ggagguccuuuggguccagcc

SEQ ID NO: 2026193 - RNA, 13 nt, Human herpesvirus 5
ugcaccugggugg

SEQ ID NO: 2026194 - RNA, 15 nt, Human herpesvirus 5
guauaacuaacgugu

SEQ ID NO: 2026195 - RNA, 16 nt, Human herpesvirus 5
augcucaagacagaca

SEQ ID NO: 2026196 - RNA, 17 nt, Human herpesvirus 5
cacguguggaagacaug

SEQ ID NO: 2026197 - RNA, 15 nt, Human herpesvirus 5
gauggccgacgaggc

SEQ ID NO: 2026198 - RNA, 13 nt, Human herpesvirus 5
aaguguugaccac

SEQ ID NO: 2026199 - RNA, 14 nt, Human herpesvirus 5
ggcgguggcugcgc

SEQ ID NO: 2026200 - RNA, 15 nt, Human herpesvirus 5
acgucccgcgcggau

SEQ ID NO: 2026201 - RNA, 19 nt, Human herpesvirus 5
ggcccugcugacgcuguug

SEQ ID NO: 2026202 - RNA, 21 nt, Human herpesvirus 5
cccuagcaacgcgacuacggu

SEQ ID NO: 2026203 - RNA, 23 nt, Human herpesvirus 5
gggaggacgaaccgcgacaacac

SEQ ID NO: 2026204 - RNA, 12 nt, Human herpesvirus 5
gcgucaaagcuc

SEQ ID NO: 2026205 - RNA, 14 nt, Human herpesvirus 5
ccgcuuccucagcu

SEQ ID NO: 2026206 - RNA, 16 nt, Human herpesvirus 5
gauguacgcgugccug

SEQ ID NO: 2026207 - RNA, 19 nt, Human herpesvirus 5
cgcacuuuuuuuacuagua

SEQ ID NO: 2026208 - RNA, 20 nt, Human herpesvirus 5
gacacagcagcaccaggcga

SEQ ID NO: 2026209 - RNA, 11 nt, Human herpesvirus 5
auucugacacg

SEQ ID NO: 2026210 - RNA, 12 nt, Human herpesvirus 5
uaucuggggagg

SEQ ID NO: 2026211 - RNA, 17 nt, Human herpesvirus 5
aaaaucggugguggugu

SEQ ID NO: 2026212 - RNA, 19 nt, Human herpesvirus 5
cccugugggcccaugacgc

SEQ ID NO: 2026213 - RNA, 18 nt, Human herpesvirus 5
uguauggaggucacuguc

SEQ ID NO: 2026214 - RNA, 18 nt, Human herpesvirus 5
aggcggcguggacuggga

SEQ ID NO: 2026215 - RNA, 17 nt, Human herpesvirus 5
gccgaacagcagcucuu

SEQ ID NO: 2026216 - RNA, 22 nt, Human herpesvirus 5
caucaguuucugcggcguaccu

SEQ ID NO: 2026217 - RNA, 15 nt, Human herpesvirus 5
agcacucggcgcugu

SEQ ID NO: 2026218 - RNA, 21 nt, Human herpesvirus 5
guugcguguuacgcggccgcc

SEQ ID NO: 2026219 - RNA, 16 nt, Human herpesvirus 5
ucuggucuucccuaca

SEQ ID NO: 2026220 - RNA, 23 nt, Human herpesvirus 5
guggcucuugcgcuucugcagcu

SEQ ID NO: 2026221 - RNA, 12 nt, Human herpesvirus 5
acgguggugugc

SEQ ID NO: 2026222 - RNA, 14 nt, Human herpesvirus 5
uccccugacccucc

SEQ ID NO: 2026223 - RNA, 19 nt, Human herpesvirus 5
cgagcuuauugagcgcagc

SEQ ID NO: 2026224 - RNA, 18 nt, Human herpesvirus 5
gugcccgaagaggacgaa

SEQ ID NO: 2026225 - RNA, 14 nt, Human herpesvirus 5
augaggaagcgggg

SEQ ID NO: 2026226 - RNA, 13 nt, Human herpesvirus 5
ugcagcugcacca

SEQ ID NO: 2026227 - RNA, 16 nt, Human herpesvirus 5
gcugcacgaccugcac

SEQ ID NO: 2026228 - RNA, 23 nt, Human herpesvirus 5
cuacgguggcgcgacggugaugc

SEQ ID NO: 2026229 - RNA, 22 nt, Human herpesvirus 5
gucucuguuuuuuuuuguuaac

SEQ ID NO: 2026230 - RNA, 15 nt, Human herpesvirus 5
gucccgugugugggg

SEQ ID NO: 2026231 - RNA, 17 nt, Human herpesvirus 5
cccgggccgccugagga

SEQ ID NO: 2026232 - RNA, 17 nt, Human herpesvirus 5
cucgggugcaccgcggc

SEQ ID NO: 2026233 - RNA, 21 nt, Human herpesvirus 5
ugagacccgcgucccuggggc

SEQ ID NO: 2026234 - RNA, 17 nt, Human herpesvirus 5
cgucaggaaucugggag

SEQ ID NO: 2026235 - RNA, 22 nt, Human herpesvirus 5
ugccggucuacagacugggcga

SEQ ID NO: 2026236 - RNA, 21 nt, Human herpesvirus 5
gcugacgcggacgaggaacag

SEQ ID NO: 2026237 - RNA, 22 nt, Human herpesvirus 5
cgaugugugggaccuggucaag

SEQ ID NO: 2026238 - RNA, 19 nt, Human herpesvirus 5
acuaacguguccgcggaca

SEQ ID NO: 2026239 - RNA, 17 nt, Human herpesvirus 5
guccuagcacgucagug

SEQ ID NO: 2026240 - RNA, 13 nt, Human herpesvirus 5
aaccuggagcagc

SEQ ID NO: 2026241 - RNA, 12 nt, Human herpesvirus 5
cacuagccgggc

SEQ ID NO: 2026242 - RNA, 19 nt, Human herpesvirus 5
cguggugacugagcacagc

SEQ ID NO: 2026243 - RNA, 20 nt, Human herpesvirus 5
cuaguaaaagggacgucaaa

SEQ ID NO: 2026244 - RNA, 23 nt, Human herpesvirus 5
gguguacgugcgguaacuggcag

SEQ ID NO: 2026245 - RNA, 21 nt, Human herpesvirus 5
cgaguacacguuaccgucgcc

SEQ ID NO: 2026246 - RNA, 21 nt, Human herpesvirus 5
aaaggauggacguacuggacc

SEQ ID NO: 2026247 - RNA, 12 nt, Human herpesvirus 5
agcuucggccgg

SEQ ID NO: 2026248 - RNA, 16 nt, Human herpesvirus 5
acuacaacagcggguc

SEQ ID NO: 2026249 - RNA, 15 nt, Human herpesvirus 5
ggcgcuucgagggcu

SEQ ID NO: 2026250 - RNA, 13 nt, Human herpesvirus 5
cucacgggaaggc

SEQ ID NO: 2026251 - RNA, 22 nt, Human herpesvirus 5
gggggaaccuacggcggcgguc

SEQ ID NO: 2026252 - RNA, 17 nt, Human herpesvirus 5
gguguuaaggauucuga

SEQ ID NO: 2026253 - RNA, 15 nt, Human herpesvirus 5
aaaguagguacuaac

SEQ ID NO: 2026254 - RNA, 17 nt, Human herpesvirus 5
gcgguggucgaugcuga

SEQ ID NO: 2026255 - RNA, 18 nt, Human herpesvirus 5
gcgcuuuugaccgcgagc

SEQ ID NO: 2026256 - RNA, 21 nt, Human herpesvirus 5
uugagaguggugggaaugcac

SEQ ID NO: 2026257 - RNA, 20 nt, Human herpesvirus 5
cagauauccacaacgacaaa

SEQ ID NO: 2026258 - RNA, 16 nt, Human herpesvirus 5
cacagcgucuggccag

SEQ ID NO: 2026259 - RNA, 18 nt, Human herpesvirus 5
gcucaggucgcccaggcu

SEQ ID NO: 2026260 - RNA, 17 nt, Human herpesvirus 5
uagcgcuugcggcacag

SEQ ID NO: 2026261 - RNA, 14 nt, Human herpesvirus 5
ccgcccaaacaucu

SEQ ID NO: 2026262 - RNA, 18 nt, Human herpesvirus 5
ccggcguggcggccgacg

SEQ ID NO: 2026263 - RNA, 23 nt, Human herpesvirus 5
uugggacacugggcguuguugag

SEQ ID NO: 2026264 - RNA, 18 nt, Human herpesvirus 5
uggauccgcuuccucagc

SEQ ID NO: 2026265 - RNA, 14 nt, Human herpesvirus 5
gcgcguuauaagca

SEQ ID NO: 2026266 - RNA, 18 nt, Human herpesvirus 5
cggcgguacugaagccgc

SEQ ID NO: 2026267 - RNA, 15 nt, Human herpesvirus 5
gcgcggaguccuggg

SEQ ID NO: 2026268 - RNA, 18 nt, Human herpesvirus 5
aaacaccguguggugguu

SEQ ID NO: 2026269 - RNA, 21 nt, Human herpesvirus 5
accgcgcccacuggaguugcu

SEQ ID NO: 2026270 - RNA, 17 nt, Human herpesvirus 5
cugucaucacgguacac

SEQ ID NO: 2026271 - RNA, 21 nt, Human herpesvirus 5
ugcccuuuacggugcugcguc

SEQ ID NO: 2026272 - RNA, 13 nt, Human herpesvirus 5
ccuaugaggacga

SEQ ID NO: 2026273 - RNA, 13 nt, Human herpesvirus 5
ccaugcagaccua

SEQ ID NO: 2026274 - RNA, 16 nt, Human herpesvirus 5
cgugaaacagcagcuc

SEQ ID NO: 2026275 - RNA, 18 nt, Human herpesvirus 5
acagcggcgacagacggc

SEQ ID NO: 2026276 - RNA, 22 nt, Human herpesvirus 5
cgacuggggucaaaagccuggg

SEQ ID NO: 2026277 - RNA, 18 nt, Human herpesvirus 5
agacaggcggccagcuuc

SEQ ID NO: 2026278 - RNA, 17 nt, Human herpesvirus 5
ccucaccgaccagcacu

SEQ ID NO: 2026279 - RNA, 19 nt, Human herpesvirus 5
aaucuuccccucugcugcu

SEQ ID NO: 2026280 - RNA, 23 nt, Human herpesvirus 5
cgcggaacgagagcgguccgccc

SEQ ID NO: 2026281 - RNA, 19 nt, Human herpesvirus 5
cucaaaacaucaccaccau

SEQ ID NO: 2026282 - RNA, 15 nt, Human herpesvirus 5
uaccgaggcgccgcc

SEQ ID NO: 2026283 - RNA, 20 nt, Human herpesvirus 5
agaccgcaacaacagcagca

SEQ ID NO: 2026284 - RNA, 14 nt, Human herpesvirus 5
aucaaugaagacuu

SEQ ID NO: 2026285 - RNA, 13 nt, Human herpesvirus 5
ucccaucuucuaa

SEQ ID NO: 2026286 - RNA, 20 nt, Human herpesvirus 5
gcgacgauaggucgaaagcc

SEQ ID NO: 2026287 - RNA, 21 nt, Human herpesvirus 5
agcagcaaugucguaguacaa

SEQ ID NO: 2026288 - RNA, 13 nt, Human herpesvirus 5
uaagcaccguggg

SEQ ID NO: 2026289 - RNA, 14 nt, Human herpesvirus 5
auccuuggaagagg

SEQ ID NO: 2026290 - RNA, 17 nt, Human herpesvirus 5
aucauaugcuaauauau

SEQ ID NO: 2026291 - RNA, 20 nt, Human herpesvirus 5
cuuuccauucuuccgugucc

SEQ ID NO: 2026292 - RNA, 21 nt, Human herpesvirus 5
gccugggaacgcgcgcacggc

SEQ ID NO: 2026293 - RNA, 15 nt, Human herpesvirus 5
cggguggagaugagg

SEQ ID NO: 2026294 - RNA, 15 nt, Human herpesvirus 5
gagcgccuucugcua

SEQ ID NO: 2026295 - RNA, 20 nt, Human herpesvirus 5
uccaucggcagauccggcaa

SEQ ID NO: 2026296 - RNA, 21 nt, Human herpesvirus 5
cuagcgacggcggccauggag

SEQ ID NO: 2026297 - RNA, 13 nt, Human herpesvirus 5
caguguagauuua

SEQ ID NO: 2026298 - RNA, 14 nt, Human herpesvirus 5
ccgggcggcuuugc

SEQ ID NO: 2026299 - RNA, 22 nt, Human herpesvirus 5
uucuacggaguuuucccucagc

SEQ ID NO: 2026300 - RNA, 22 nt, Human herpesvirus 5
gacaaacacuaccgucgccacc

SEQ ID NO: 2026301 - RNA, 15 nt, Human herpesvirus 5
cucugcuacuggccc

SEQ ID NO: 2026302 - RNA, 17 nt, Human herpesvirus 5
ucguauucgucauuugu

SEQ ID NO: 2026303 - RNA, 16 nt, Human herpesvirus 5
ucgacgcaucugucau

SEQ ID NO: 2026304 - RNA, 22 nt, Human herpesvirus 5
acuuuguagugcgcgccgccga

SEQ ID NO: 2026305 - RNA, 18 nt, Human herpesvirus 5
aacuuugccgucaugccu

SEQ ID NO: 2026306 - RNA, 15 nt, Human herpesvirus 5
aucugucaccucaca

SEQ ID NO: 2026307 - RNA, 23 nt, Human herpesvirus 5
gucccuuuuacuaguauccacgu

SEQ ID NO: 2026308 - RNA, 14 nt, Human herpesvirus 5
cccugcggcgccgu

SEQ ID NO: 2026309 - RNA, 18 nt, Human herpesvirus 5
uucaauaaaaaccaccgu

SEQ ID NO: 2026310 - RNA, 13 nt, Human herpesvirus 5
caacaauaaagcu

SEQ ID NO: 2026311 - RNA, 20 nt, Human herpesvirus 5
gcccugcugacgcuguugag

SEQ ID NO: 2026312 - RNA, 20 nt, Human herpesvirus 5
ggcgacgcgguuaagggaga

SEQ ID NO: 2026313 - RNA, 23 nt, Human herpesvirus 5
gaguuggugcagcugcgccugga

SEQ ID NO: 2026314 - RNA, 18 nt, Human herpesvirus 5
caggugacauccucgccc

SEQ ID NO: 2026315 - RNA, 22 nt, Human herpesvirus 5
ggcguggcggccgacggcagcg

SEQ ID NO: 2026316 - RNA, 14 nt, Human herpesvirus 5
aagaccgcugccuc

SEQ ID NO: 2026317 - RNA, 19 nt, Human herpesvirus 5
ggcuggcgacccgcagucu

SEQ ID NO: 2026318 - RNA, 16 nt, Human herpesvirus 5
cauacagcaacaccau

SEQ ID NO: 2026319 - RNA, 17 nt, Human herpesvirus 5
cgccucuucuggcccuc

SEQ ID NO: 2026320 - RNA, 23 nt, Human herpesvirus 5
gccucaaaaagcagguggaggac

SEQ ID NO: 2026321 - RNA, 18 nt, Human herpesvirus 5
ggccgauccacgggccgc

SEQ ID NO: 2026322 - RNA, 16 nt, Human herpesvirus 5
gaaugaaccuuguaau

SEQ ID NO: 2026323 - RNA, 23 nt, Human herpesvirus 5
cacagcggaaaaugccgccgcca

SEQ ID NO: 2026324 - RNA, 19 nt, Human herpesvirus 5
ccuacgacaacaucccucc

SEQ ID NO: 2026325 - RNA, 23 nt, Human herpesvirus 5
aucugucaccucacaagcgucaa

SEQ ID NO: 2026326 - RNA, 19 nt, Human herpesvirus 5
gcagccguuuccagagaac

SEQ ID NO: 2026327 - RNA, 20 nt, Human herpesvirus 5
ugaaacgcuuuaagcugcuc

SEQ ID NO: 2026328 - RNA, 20 nt, Human herpesvirus 5
gccgggaaagacgggcgaca

SEQ ID NO: 2026329 - RNA, 13 nt, Human herpesvirus 5
gcagcgggccugu

SEQ ID NO: 2026330 - RNA, 20 nt, Human herpesvirus 5
gccaacuccgugccagcugg

SEQ ID NO: 2026331 - RNA, 23 nt, Human herpesvirus 5
ccugugugaucugggcagcggcu

SEQ ID NO: 2026332 - RNA, 17 nt, Human herpesvirus 5
acuauuguauacucuau

SEQ ID NO: 2026333 - RNA, 18 nt, Human herpesvirus 5
uagacaggguaacagccu

SEQ ID NO: 2026334 - RNA, 16 nt, Human herpesvirus 5
uccgcgugcuccacca

SEQ ID NO: 2026335 - RNA, 13 nt, Human herpesvirus 5
uugacgcugcugg

SEQ ID NO: 2026336 - RNA, 13 nt, Human herpesvirus 5
agacgggccuggu

SEQ ID NO: 2026337 - RNA, 14 nt, Human herpesvirus 5
acuuuggcucuuuc

SEQ ID NO: 2026338 - RNA, 23 nt, Human herpesvirus 5
cucagcggcguguacagcuaccu

SEQ ID NO: 2026339 - RNA, 16 nt, Human herpesvirus 5
uugguaucuacaucag

SEQ ID NO: 2026340 - RNA, 16 nt, Human herpesvirus 5
cuggcccaaagaccgc

SEQ ID NO: 2026341 - RNA, 20 nt, Human herpesvirus 5
auugacgcgguuuaucauga

SEQ ID NO: 2026342 - RNA, 15 nt, Human herpesvirus 5
gagcuggccagcaaa

SEQ ID NO: 2026343 - RNA, 20 nt, Human herpesvirus 5
aguggggcaacugcugccuc

SEQ ID NO: 2026344 - RNA, 13 nt, Human herpesvirus 5
cuggaucugcccu

SEQ ID NO: 2026345 - RNA, 13 nt, Human herpesvirus 5
gaaaaguggcaga

SEQ ID NO: 2026346 - RNA, 19 nt, Human herpesvirus 5
cacuaauuuauccaagaua

SEQ ID NO: 2026347 - RNA, 19 nt, Human herpesvirus 5
cguggcccuggucuggccc

SEQ ID NO: 2026348 - RNA, 18 nt, Human herpesvirus 5
agcagccaccgacacagc

SEQ ID NO: 2026349 - RNA, 23 nt, Human herpesvirus 5
cugcagcacgcgauuggccagca

SEQ ID NO: 2026350 - RNA, 12 nt, Human herpesvirus 5
cacgcucgcucu

SEQ ID NO: 2026351 - RNA, 20 nt, Human herpesvirus 5
aaagugauuauaucuuucua

SEQ ID NO: 2026352 - RNA, 16 nt, Human herpesvirus 5
aaagagccauguuaug

SEQ ID NO: 2026353 - RNA, 19 nt, Human herpesvirus 5
cccgccaccaugcauccca

SEQ ID NO: 2026354 - RNA, 17 nt, Human herpesvirus 5
aaaaaucgauauuugaa

SEQ ID NO: 2026355 - RNA, 23 nt, Human herpesvirus 5
gcucagcggcguguacagcuacc

SEQ ID NO: 2026356 - RNA, 20 nt, Human herpesvirus 5
cgaguggggcaacugcugcc

SEQ ID NO: 2026357 - RNA, 18 nt, Human herpesvirus 5
ggucauguucucccagga

SEQ ID NO: 2026358 - RNA, 16 nt, Human herpesvirus 5
aucacgaaaggcaccg

SEQ ID NO: 2026359 - RNA, 16 nt, Human herpesvirus 5
cgguggugacugggga

SEQ ID NO: 2026360 - RNA, 22 nt, Human herpesvirus 5
cagccaccgcgaggccacccac

SEQ ID NO: 2026361 - RNA, 17 nt, Human herpesvirus 5
agcugcuuucuuuuugc

SEQ ID NO: 2026362 - RNA, 14 nt, Human herpesvirus 5
cgcaggccgccgcc

SEQ ID NO: 2026363 - RNA, 13 nt, Human herpesvirus 5
cgcguccgggcuu

SEQ ID NO: 2026364 - RNA, 16 nt, Human herpesvirus 5
uaaaaacaacgucccc

SEQ ID NO: 2026365 - RNA, 15 nt, Human herpesvirus 5
ccgcaagcgccgcca

SEQ ID NO: 2026366 - RNA, 15 nt, Human herpesvirus 5
cugucggggcgcaga

SEQ ID NO: 2026367 - RNA, 18 nt, Human herpesvirus 5
uccggcgucgcuggcgcu

SEQ ID NO: 2026368 - RNA, 13 nt, Human herpesvirus 5
uggauacuaguaa

SEQ ID NO: 2026369 - RNA, 17 nt, Human herpesvirus 5
ucacuuuauugaaaucu

SEQ ID NO: 2026370 - RNA, 17 nt, Human herpesvirus 5
ucuugauacagggcgaa

SEQ ID NO: 2026371 - RNA, 17 nt, Human herpesvirus 5
ccccucugcugcugguu

SEQ ID NO: 2026372 - RNA, 12 nt, Human herpesvirus 5
cccucaugacgc

SEQ ID NO: 2026373 - RNA, 13 nt, Human herpesvirus 5
gcuugcuggcuug

SEQ ID NO: 2026374 - RNA, 15 nt, Human herpesvirus 5
ggccuacggcugcau

SEQ ID NO: 2026375 - RNA, 12 nt, Human herpesvirus 5
uggggaugauga

SEQ ID NO: 2026376 - RNA, 12 nt, Human herpesvirus 5
ugaaccuucccc

SEQ ID NO: 2026377 - RNA, 20 nt, Human herpesvirus 5
agcgugcucagcugguggcu

SEQ ID NO: 2026378 - RNA, 19 nt, Human herpesvirus 5
gcacaccuuuaagguacgg

SEQ ID NO: 2026379 - RNA, 17 nt, Human herpesvirus 5
uugcugacgcuggaaac

SEQ ID NO: 2026380 - RNA, 17 nt, Human herpesvirus 5
cuggaagcagcaauguc

SEQ ID NO: 2026381 - RNA, 18 nt, Human herpesvirus 5
caugaggcgguggcugcg

SEQ ID NO: 2026382 - RNA, 19 nt, Human herpesvirus 5
gugacccgccccccggcag

SEQ ID NO: 2026383 - RNA, 13 nt, Human herpesvirus 5
acggcgguuugaa

SEQ ID NO: 2026384 - RNA, 23 nt, Human herpesvirus 5
cggagcccggucugagcuccgac

SEQ ID NO: 2026385 - RNA, 19 nt, Human herpesvirus 5
gacggcgguacugaagccg

SEQ ID NO: 2026386 - RNA, 19 nt, Human herpesvirus 5
cccgucgugcucuugacgg

SEQ ID NO: 2026387 - RNA, 23 nt, Human herpesvirus 5
gcucacgucacuacucugggaua

SEQ ID NO: 2026388 - RNA, 15 nt, Human herpesvirus 5
acuccgugcuguugg

SEQ ID NO: 2026389 - RNA, 15 nt, Human herpesvirus 5
aauaaagagaguugu

SEQ ID NO: 2026390 - RNA, 16 nt, Human herpesvirus 5
accgcaguugcugccu

SEQ ID NO: 2026391 - RNA, 22 nt, Human herpesvirus 5
gauccaaggccuccagcgccuc

SEQ ID NO: 2026392 - RNA, 15 nt, Human herpesvirus 5
gaccugcacgacauc

SEQ ID NO: 2026393 - RNA, 19 nt, Human herpesvirus 5
gccgcgugccugggaacgc

SEQ ID NO: 2026394 - RNA, 16 nt, Human herpesvirus 5
cccugacacguaauac

SEQ ID NO: 2026395 - RNA, 12 nt, Human herpesvirus 5
uggggggugagg

SEQ ID NO: 2026396 - RNA, 12 nt, Human herpesvirus 5
caggcgcgcaga

SEQ ID NO: 2026397 - RNA, 23 nt, Human herpesvirus 5
cugauuaaccauaucgugaacca

SEQ ID NO: 2026398 - RNA, 14 nt, Human herpesvirus 5
uuguugccgcugga

SEQ ID NO: 2026399 - RNA, 22 nt, Human herpesvirus 5
gaaagaggacguucgcucgggc

SEQ ID NO: 2026400 - RNA, 21 nt, Human herpesvirus 5
gcaacuaucaccaaacaacac

SEQ ID NO: 2026401 - RNA, 18 nt, Human herpesvirus 5
acgacggcgguuucagcu

SEQ ID NO: 2026402 - RNA, 19 nt, Human herpesvirus 5
cgacguuucgcgaggacaa

SEQ ID NO: 2026403 - RNA, 22 nt, Human herpesvirus 5
ucgccuuccagcuuaccgccac

SEQ ID NO: 2026404 - RNA, 20 nt, Human herpesvirus 5
ugcagaccgaggcgcuggac

SEQ ID NO: 2026405 - RNA, 12 nt, Human herpesvirus 5
acuuucaaugau

SEQ ID NO: 2026406 - RNA, 24 nt, Human herpesvirus 5
cacgcggcguacgucaccgcgcua

SEQ ID NO: 2026407 - RNA, 15 nt, Human herpesvirus 5
cgcguagccuccucc

SEQ ID NO: 2026408 - RNA, 17 nt, Human herpesvirus 5
ggguggcgaagcgggaa

SEQ ID NO: 2026409 - RNA, 20 nt, Human herpesvirus 5
augccggccucaucuguaaa

SEQ ID NO: 2026410 - RNA, 14 nt, Human herpesvirus 5
gguccgcccgccga

SEQ ID NO: 2026411 - RNA, 13 nt, Human herpesvirus 5
cugugccugucau

SEQ ID NO: 2026412 - RNA, 17 nt, Human herpesvirus 5
ugaagcggaugauucgc

SEQ ID NO: 2026413 - RNA, 13 nt, Human herpesvirus 5
gcggcgguggccg

SEQ ID NO: 2026414 - RNA, 12 nt, Human herpesvirus 5
gucucuacggca

SEQ ID NO: 2026415 - RNA, 12 nt, Human herpesvirus 5
auuugaagccag

SEQ ID NO: 2026416 - RNA, 15 nt, Human herpesvirus 5
aggguaucuggggag

SEQ ID NO: 2026417 - RNA, 21 nt, Human herpesvirus 5
ucaaacagcacauuagacaca

SEQ ID NO: 2026418 - RNA, 15 nt, Human herpesvirus 5
acaggcuaugggaag

SEQ ID NO: 2026419 - RNA, 19 nt, Human herpesvirus 5
uacccgccccagcagacca

SEQ ID NO: 2026420 - RNA, 12 nt, Human herpesvirus 5
ccgggaucacga

SEQ ID NO: 2026421 - RNA, 19 nt, Human herpesvirus 5
cgaggacaaccgcauccug

SEQ ID NO: 2026422 - RNA, 20 nt, Human herpesvirus 5
uagacauuccccaccuuccc

SEQ ID NO: 2026423 - RNA, 21 nt, Human herpesvirus 5
gugacauccucgcccaggcug

SEQ ID NO: 2026424 - RNA, 13 nt, Human herpesvirus 5
cuggaggcucugu

SEQ ID NO: 2026425 - RNA, 23 nt, Human herpesvirus 5
gucggugauuucuugcuugcccg

SEQ ID NO: 2026426 - RNA, 15 nt, Human herpesvirus 5
gcuaauuauugccau

SEQ ID NO: 2026427 - RNA, 15 nt, Human herpesvirus 5
acacaccgcuuuggu

SEQ ID NO: 2026428 - RNA, 16 nt, Human herpesvirus 5
acagguagguggccau

SEQ ID NO: 2026429 - RNA, 13 nt, Human herpesvirus 5
uggaagcugcugg

SEQ ID NO: 2026430 - RNA, 17 nt, Human herpesvirus 5
auuauucuuggaugcua

SEQ ID NO: 2026431 - RNA, 16 nt, Human herpesvirus 5
gcggcguggacuggga

SEQ ID NO: 2026432 - RNA, 18 nt, Human herpesvirus 5
cgaugguauuacgcccga

SEQ ID NO: 2026433 - RNA, 20 nt, Human herpesvirus 5
gucaggacuggaagugucac

SEQ ID NO: 2026434 - RNA, 18 nt, Human herpesvirus 5
ccgcucaggucgcccagg

SEQ ID NO: 2026435 - RNA, 22 nt, Human herpesvirus 5
uggaaaugcccgccaccaugca

SEQ ID NO: 2026436 - RNA, 14 nt, Human herpesvirus 5
cagcacauuagaca

SEQ ID NO: 2026437 - RNA, 15 nt, Human herpesvirus 5
ccaagccgcagcgcg

SEQ ID NO: 2026438 - RNA, 19 nt, Human herpesvirus 5
agacacgcgcuucuggucg

SEQ ID NO: 2026439 - RNA, 19 nt, Human herpesvirus 5
cucgccgcagaccauccuc

SEQ ID NO: 2026440 - RNA, 18 nt, Human herpesvirus 5
cgucccuggggcugcugc

SEQ ID NO: 2026441 - RNA, 17 nt, Human herpesvirus 5
ugucagcgccgggugcg

SEQ ID NO: 2026442 - RNA, 20 nt, Human herpesvirus 5
cucaccgugcucgugcccau

SEQ ID NO: 2026443 - RNA, 11 nt, Human herpesvirus 5
cuuuuugcaaa

SEQ ID NO: 2026444 - RNA, 16 nt, Human herpesvirus 5
auccuuuucaugcuca

SEQ ID NO: 2026445 - RNA, 15 nt, Human herpesvirus 5
ugcgugucgcugggc

SEQ ID NO: 2026446 - RNA, 12 nt, Human herpesvirus 5
cgaugauacauc

SEQ ID NO: 2026447 - RNA, 22 nt, Human herpesvirus 5
caucaucaacagcagcaacagc

SEQ ID NO: 2026448 - RNA, 14 nt, Human herpesvirus 5
cgcgugcuccacca

SEQ ID NO: 2026449 - RNA, 12 nt, Human herpesvirus 5
cgcucacagucu

SEQ ID NO: 2026450 - RNA, 19 nt, Human herpesvirus 5
cugcacgaccugcuccagu

SEQ ID NO: 2026451 - RNA, 22 nt, Human herpesvirus 5
cugcggcguaccuacggaccgc

SEQ ID NO: 2026452 - RNA, 12 nt, Human herpesvirus 5
aaggcacacggu

SEQ ID NO: 2026453 - RNA, 18 nt, Human herpesvirus 5
gcagaaaagccggcucca

SEQ ID NO: 2026454 - RNA, 18 nt, Human herpesvirus 5
uggucauguucucccagg

SEQ ID NO: 2026455 - RNA, 17 nt, Human herpesvirus 5
ggcucacguagcaggcc

SEQ ID NO: 2026456 - RNA, 15 nt, Human herpesvirus 5
cuccacgucuucaaa

SEQ ID NO: 2026457 - RNA, 16 nt, Human herpesvirus 5
ucguguccggacccca

SEQ ID NO: 2026458 - RNA, 17 nt, Human herpesvirus 5
cgccgaucauguccgag

SEQ ID NO: 2026459 - RNA, 22 nt, Human herpesvirus 5
gagccccaucauggcccaagga

SEQ ID NO: 2026460 - RNA, 12 nt, Human herpesvirus 5
gcgcagcgggcu

SEQ ID NO: 2026461 - RNA, 19 nt, Human herpesvirus 5
aaaagggacgucaaagcuc

SEQ ID NO: 2026462 - RNA, 12 nt, Human herpesvirus 5
cuccucugccug

SEQ ID NO: 2026463 - RNA, 23 nt, Human herpesvirus 5
guaaugccaugcggauccagcug

SEQ ID NO: 2026464 - RNA, 23 nt, Human herpesvirus 5
guaagguuuugcucuaaaaacac

SEQ ID NO: 2026465 - RNA, 23 nt, Human herpesvirus 5
uccaggcggagaugaggacgacg

SEQ ID NO: 2026466 - RNA, 13 nt, Human herpesvirus 5
cuggauacaagcu

SEQ ID NO: 2026467 - RNA, 16 nt, Human herpesvirus 5
cgagucggauggcuuu

SEQ ID NO: 2026468 - RNA, 18 nt, Human herpesvirus 5
gugcucgggcgugugggu

SEQ ID NO: 2026469 - RNA, 12 nt, Human herpesvirus 5
cugcuccagaag

SEQ ID NO: 2026470 - RNA, 17 nt, Human herpesvirus 5
cuguggaauacccagcu

SEQ ID NO: 2026471 - RNA, 14 nt, Human herpesvirus 5
ggaacggagcagcc

SEQ ID NO: 2026472 - RNA, 21 nt, Human herpesvirus 5
gacucagggcugggauccgcc

SEQ ID NO: 2026473 - RNA, 21 nt, Human herpesvirus 5
cgacagaugcggcgguuacac

SEQ ID NO: 2026474 - RNA, 14 nt, Human herpesvirus 5
guauccacgucacu

SEQ ID NO: 2026475 - RNA, 16 nt, Human herpesvirus 5
augccucuacaucacu

SEQ ID NO: 2026476 - RNA, 14 nt, Human herpesvirus 5
ugucugcagccggu

SEQ ID NO: 2026477 - RNA, 21 nt, Human herpesvirus 5
aggcucgcaaagacgugccac

SEQ ID NO: 2026478 - RNA, 12 nt, Human herpesvirus 5
cagcccagggau

SEQ ID NO: 2026479 - RNA, 20 nt, Human herpesvirus 5
cgcuggaggacgcgcuggcu

SEQ ID NO: 2026480 - RNA, 23 nt, Human herpesvirus 5
cgggccgcgugccugggaacgcg

SEQ ID NO: 2026481 - RNA, 22 nt, Human herpesvirus 5
gcacaccuauggcgccgugggu

SEQ ID NO: 2026482 - RNA, 14 nt, Human herpesvirus 5
ugcccugugggccc

SEQ ID NO: 2026483 - RNA, 20 nt, Human herpesvirus 5
ucgggcgcaucacccgccuc

SEQ ID NO: 2026484 - RNA, 22 nt, Human herpesvirus 5
cucgcuuacgucuacagcaugg

SEQ ID NO: 2026485 - RNA, 17 nt, Human herpesvirus 5
cugaucacguuguccuu

SEQ ID NO: 2026486 - RNA, 20 nt, Human herpesvirus 5
cuuuagccaggugaccagca

SEQ ID NO: 2026487 - RNA, 11 nt, Human herpesvirus 5
cccguggccca

SEQ ID NO: 2026488 - RNA, 12 nt, Human herpesvirus 5
ucccucagccuc

SEQ ID NO: 2026489 - RNA, 20 nt, Human herpesvirus 5
aaugcuaguuuguagaggcu

SEQ ID NO: 2026490 - RNA, 12 nt, Human herpesvirus 5
caugaacaaaaa

SEQ ID NO: 2026491 - RNA, 19 nt, Human herpesvirus 5
agucauuaugauuuccucc

SEQ ID NO: 2026492 - RNA, 18 nt, Human herpesvirus 5
ccgucacgacgcuccguc

SEQ ID NO: 2026493 - RNA, 22 nt, Human herpesvirus 5
cacgggcucguguggcagcugg

SEQ ID NO: 2026494 - RNA, 18 nt, Human herpesvirus 5
cugggcgcccccaccccc

SEQ ID NO: 2026495 - RNA, 13 nt, Human herpesvirus 5
gcgagcugggcga

SEQ ID NO: 2026496 - RNA, 21 nt, Human herpesvirus 5
ccgugacgucgcggcaccagg

SEQ ID NO: 2026497 - RNA, 19 nt, Human herpesvirus 5
ggacucuuuaaccgagcug

SEQ ID NO: 2026498 - RNA, 15 nt, Human herpesvirus 5
uaagauauaaagaau

SEQ ID NO: 2026499 - RNA, 16 nt, Human herpesvirus 5
gccgcgugccugggaa

SEQ ID NO: 2026500 - RNA, 18 nt, Human herpesvirus 5
gcgccguuuugcuguccu

SEQ ID NO: 2026501 - RNA, 23 nt, Human herpesvirus 5
ugcgggcaggcggguugcagcuu

SEQ ID NO: 2026502 - RNA, 18 nt, Human herpesvirus 5
cacgcugacaacccacuc

SEQ ID NO: 2026503 - RNA, 22 nt, Human herpesvirus 5
uuuaagguacgggucuaccaaa

SEQ ID NO: 2026504 - RNA, 16 nt, Human herpesvirus 5
ugcgcgccuccguccu

SEQ ID NO: 2026505 - RNA, 17 nt, Human herpesvirus 5
ucccuccugcagcugca

SEQ ID NO: 2026506 - RNA, 15 nt, Human herpesvirus 5
accaccuccugggua

SEQ ID NO: 2026507 - RNA, 19 nt, Human herpesvirus 5
uauaaagaaaccacgcguc

SEQ ID NO: 2026508 - RNA, 13 nt, Human herpesvirus 5
ccgugccacggaa

SEQ ID NO: 2026509 - RNA, 19 nt, Human herpesvirus 5
agccuccggaacccucugg

SEQ ID NO: 2026510 - RNA, 17 nt, Human herpesvirus 5
cggcaacuucuugguga

SEQ ID NO: 2026511 - RNA, 21 nt, Human herpesvirus 5
gaagucgaacuauaccgggcg

SEQ ID NO: 2026512 - RNA, 11 nt, Human herpesvirus 5
ugaccugggua

SEQ ID NO: 2026513 - RNA, 17 nt, Human herpesvirus 5
ugaggggcggcaugccg

SEQ ID NO: 2026514 - RNA, 15 nt, Human herpesvirus 5
aaaagggacgucaaa

SEQ ID NO: 2026515 - RNA, 17 nt, Human herpesvirus 5
cgacagucuccuccuga

SEQ ID NO: 2026516 - RNA, 14 nt, Human herpesvirus 5
uugacgcugcuggc

SEQ ID NO: 2026517 - RNA, 17 nt, Human herpesvirus 5
ccacguccacucagaca

SEQ ID NO: 2026518 - RNA, 14 nt, Human herpesvirus 5
gcgucuuccuccuc

SEQ ID NO: 2026519 - RNA, 16 nt, Human herpesvirus 5
cugggcgcccccaccc

SEQ ID NO: 2026520 - RNA, 23 nt, Human herpesvirus 5
gcgagcgggcaaucaaugcgucu

SEQ ID NO: 2026521 - RNA, 20 nt, Human herpesvirus 5
acguguuucaaacagcacau

SEQ ID NO: 2026522 - RNA, 20 nt, Human herpesvirus 5
cagggcugggauccgccgcc

SEQ ID NO: 2026523 - RNA, 13 nt, Human herpesvirus 5
ucuauauucugca

SEQ ID NO: 2026524 - RNA, 22 nt, Human herpesvirus 5
gccgucagcgucgucguccgug

SEQ ID NO: 2026525 - RNA, 19 nt, Human herpesvirus 5
gucgguaccgucuccacca

SEQ ID NO: 2026526 - RNA, 19 nt, Human herpesvirus 5
ccgaacuauguggcuccgc

SEQ ID NO: 2026527 - RNA, 11 nt, Human herpesvirus 5
uaacagccuuc

SEQ ID NO: 2026528 - RNA, 21 nt, Human herpesvirus 5
cgcugcuuucgcacgcaccug

SEQ ID NO: 2026529 - RNA, 19 nt, Human herpesvirus 5
cggcagcccauccucgugg

SEQ ID NO: 2026530 - RNA, 22 nt, Human herpesvirus 5
ccuccgaacgcucgugagcaac

SEQ ID NO: 2026531 - RNA, 19 nt, Human herpesvirus 5
gucccagcagggcgcgccg

SEQ ID NO: 2026532 - RNA, 21 nt, Human herpesvirus 5
ugagauucaggacgaggagcc

SEQ ID NO: 2026533 - RNA, 20 nt, Human herpesvirus 5
uugagcaggguaaaaaccac

SEQ ID NO: 2026534 - RNA, 20 nt, Human herpesvirus 5
cucaacgacuuucuggagca

SEQ ID NO: 2026535 - RNA, 22 nt, Human herpesvirus 5
auuaucaucaaucacccacaga

SEQ ID NO: 2026536 - RNA, 21 nt, Human herpesvirus 5
cagcuuuugcacggaucacga

SEQ ID NO: 2026537 - RNA, 17 nt, Human herpesvirus 5
cgacugcagcccaccgc

SEQ ID NO: 2026538 - RNA, 16 nt, Human herpesvirus 5
gacgcgcuggacucuu

SEQ ID NO: 2026539 - RNA, 17 nt, Human herpesvirus 5
cggccuugcgcucccug

SEQ ID NO: 2026540 - RNA, 16 nt, Human herpesvirus 5
ugcugcacgggcucga

SEQ ID NO: 2026541 - RNA, 13 nt, Human herpesvirus 5
acaaugucacugu

SEQ ID NO: 2026542 - RNA, 17 nt, Human herpesvirus 5
caaggccgccucuucug

SEQ ID NO: 2026543 - RNA, 13 nt, Human herpesvirus 5
guucaauaaucuc

SEQ ID NO: 2026544 - RNA, 16 nt, Human herpesvirus 5
uagcggcucgggcugg

SEQ ID NO: 2026545 - RNA, 20 nt, Human herpesvirus 5
gugucuacggauugcugacg

SEQ ID NO: 2026546 - RNA, 18 nt, Human herpesvirus 5
acaaggucguucuccucg

SEQ ID NO: 2026547 - RNA, 23 nt, Human herpesvirus 5
cugucguguuccagaccagcgcc

SEQ ID NO: 2026548 - RNA, 17 nt, Human herpesvirus 5
ggcccguucgaaggcua

SEQ ID NO: 2026549 - RNA, 12 nt, Human herpesvirus 5
gccgccgccucc

SEQ ID NO: 2026550 - RNA, 17 nt, Human herpesvirus 5
gcuguugaccuggguag

SEQ ID NO: 2026551 - RNA, 22 nt, Human herpesvirus 5
ugcaauacagaagggaauuugu

SEQ ID NO: 2026552 - RNA, 16 nt, Human herpesvirus 5
gacacgcgcuucuggu

SEQ ID NO: 2026553 - RNA, 23 nt, Human herpesvirus 5
cguacgcgagaccugaaaguuua

SEQ ID NO: 2026554 - RNA, 23 nt, Human herpesvirus 5
ccaugcugagcaaguacacgcgc

SEQ ID NO: 2026555 - RNA, 23 nt, Human herpesvirus 5
ugaacggcgcuacgucggccaac

SEQ ID NO: 2026556 - RNA, 12 nt, Human herpesvirus 5
cagggcugcucc

SEQ ID NO: 2026557 - RNA, 14 nt, Human herpesvirus 5
uuaugauugucugc

SEQ ID NO: 2026558 - RNA, 15 nt, Human herpesvirus 5
guggcugggcucacg

SEQ ID NO: 2026559 - RNA, 17 nt, Human herpesvirus 5
accugauuucuuuguua

SEQ ID NO: 2026560 - RNA, 22 nt, Human herpesvirus 5
ggcuucccuccugcagcugcac

SEQ ID NO: 2026561 - RNA, 13 nt, Human herpesvirus 5
acguaggccuccu

SEQ ID NO: 2026562 - RNA, 19 nt, Human herpesvirus 5
cuuguucucgaccacguag

SEQ ID NO: 2026563 - RNA, 13 nt, Human herpesvirus 5
cugccgcagcugc

SEQ ID NO: 2026564 - RNA, 20 nt, Human herpesvirus 5
ugaacaccagaugcucccgg

SEQ ID NO: 2026565 - RNA, 22 nt, Human herpesvirus 5
agcguaaauccccgugugaugu

SEQ ID NO: 2026566 - RNA, 22 nt, Human herpesvirus 5
uccggcaagaugcucgggauac

SEQ ID NO: 2026567 - RNA, 14 nt, Human herpesvirus 5
ggcucguguggcag

SEQ ID NO: 2026568 - RNA, 23 nt, Human herpesvirus 5
gacuaacccugggcuauaugcau

SEQ ID NO: 2026569 - RNA, 18 nt, Human herpesvirus 5
gcagcccauccucgugga

SEQ ID NO: 2026570 - RNA, 22 nt, Human herpesvirus 5
uugcuggcuuggcucgccuucc

SEQ ID NO: 2026571 - RNA, 20 nt, Human herpesvirus 5
aacagccuguggcaccgccu

SEQ ID NO: 2026572 - RNA, 16 nt, Human herpesvirus 5
gcuggagcuaucugug

SEQ ID NO: 2026573 - RNA, 14 nt, Human herpesvirus 5
auaaguaccagaca

SEQ ID NO: 2026574 - RNA, 17 nt, Human herpesvirus 5
agcacauuagacacacg

SEQ ID NO: 2026575 - RNA, 15 nt, Human herpesvirus 5
cguggaggcagcggg

SEQ ID NO: 2026576 - RNA, 14 nt, Human herpesvirus 5
augucgcccagaaa

SEQ ID NO: 2026577 - RNA, 18 nt, Human herpesvirus 5
cgcguacggacgagugga

SEQ ID NO: 2026578 - RNA, 20 nt, Human herpesvirus 5
cgccguggguuggcagcugg

SEQ ID NO: 2026579 - RNA, 13 nt, Human herpesvirus 5
ggacccguacugc

SEQ ID NO: 2026580 - RNA, 19 nt, Human herpesvirus 5
uccccgcaaacucccacuc

SEQ ID NO: 2026581 - RNA, 13 nt, Human herpesvirus 5
uaagcuguguacu

SEQ ID NO: 2026582 - RNA, 20 nt, Human herpesvirus 5
cgucugagccggggugccgc

SEQ ID NO: 2026583 - RNA, 14 nt, Human herpesvirus 5
gacugguggugaga

SEQ ID NO: 2026584 - RNA, 11 nt, Human herpesvirus 5
gcuggugucuc

SEQ ID NO: 2026585 - RNA, 23 nt, Human herpesvirus 5
cgcgcggucauauagccuccggc

SEQ ID NO: 2026586 - RNA, 20 nt, Human herpesvirus 5
gaugaacgggugggcugggg

SEQ ID NO: 2026587 - RNA, 18 nt, Human herpesvirus 5
auaaucgccguuucguaa

SEQ ID NO: 2026588 - RNA, 19 nt, Human herpesvirus 5
aggaccauuuccaugugca

SEQ ID NO: 2026589 - RNA, 12 nt, Human herpesvirus 5
guggcuggagaa

SEQ ID NO: 2026590 - RNA, 19 nt, Human herpesvirus 5
ccgcacgaccgcgacgagg

SEQ ID NO: 2026591 - RNA, 21 nt, Human herpesvirus 5
ccuguuggcuuacugccugcc

SEQ ID NO: 2026592 - RNA, 18 nt, Human herpesvirus 5
ccggauaucugcggggau

SEQ ID NO: 2026593 - RNA, 23 nt, Human herpesvirus 5
caggcuuaacacuagccaucaca

SEQ ID NO: 2026594 - RNA, 19 nt, Human herpesvirus 5
gccgcuccaucgcagccac

SEQ ID NO: 2026595 - RNA, 13 nt, Human herpesvirus 5
aguccauacagca

SEQ ID NO: 2026596 - RNA, 14 nt, Human herpesvirus 5
ccaaggccuccagc

SEQ ID NO: 2026597 - RNA, 17 nt, Human herpesvirus 5
agaaugccucuacuugg

SEQ ID NO: 2026598 - RNA, 17 nt, Human herpesvirus 5
gaaugauuuggcugggu

SEQ ID NO: 2026599 - RNA, 23 nt, Human herpesvirus 5
ggucgacugcguggggugcugga

SEQ ID NO: 2026600 - RNA, 13 nt, Human herpesvirus 5
cagcccagggauc

SEQ ID NO: 2026601 - RNA, 13 nt, Human herpesvirus 5
guccagucacauu

SEQ ID NO: 2026602 - RNA, 19 nt, Human herpesvirus 5
acgucauucguguugacag

SEQ ID NO: 2026603 - RNA, 17 nt, Human herpesvirus 5
cgggcguuggccugugg

SEQ ID NO: 2026604 - RNA, 14 nt, Human herpesvirus 5
ggacgaaagugggg

SEQ ID NO: 2026605 - RNA, 24 nt, Human herpesvirus 5
auacuaauauccgcguuaucagaa

SEQ ID NO: 2026606 - RNA, 22 nt, Human herpesvirus 5
cuacacuuggugcucgaccagg

SEQ ID NO: 2026607 - RNA, 15 nt, Human herpesvirus 5
cggccgucuccacca

SEQ ID NO: 2026608 - RNA, 20 nt, Human herpesvirus 5
cagauucaguaaccuggagc

SEQ ID NO: 2026609 - RNA, 23 nt, Human herpesvirus 5
ggcagauucaguaaccuggagca

SEQ ID NO: 2026610 - RNA, 13 nt, Human herpesvirus 5
ccgccgaagccug

SEQ ID NO: 2026611 - RNA, 15 nt, Human herpesvirus 5
gcacgcgauuggcca

SEQ ID NO: 2026612 - RNA, 22 nt, Human herpesvirus 5
uguuggaacccaucgaggaggc

SEQ ID NO: 2026613 - RNA, 23 nt, Human herpesvirus 5
uugcaacgcgcccgacagcugca

SEQ ID NO: 2026614 - RNA, 14 nt, Human herpesvirus 5
cugucaucuaccua

SEQ ID NO: 2026615 - RNA, 23 nt, Human herpesvirus 5
ucgagcgcgcucuugaggcgcuc

SEQ ID NO: 2026616 - RNA, 11 nt, Human herpesvirus 5
uccuucaucuc

SEQ ID NO: 2026617 - RNA, 19 nt, Human herpesvirus 5
cuccaggcggagaugagga

SEQ ID NO: 2026618 - RNA, 22 nt, Human herpesvirus 5
cacgcugcuauaagaaggccau

SEQ ID NO: 2026619 - RNA, 14 nt, Human herpesvirus 5
cgggcccugcugac

SEQ ID NO: 2026620 - RNA, 19 nt, Human herpesvirus 5
guugcguugggccgagccc

SEQ ID NO: 2026621 - RNA, 16 nt, Human herpesvirus 5
cggcuugggcagcagc

SEQ ID NO: 2026622 - RNA, 14 nt, Human herpesvirus 5
ccucuccuccuucu

SEQ ID NO: 2026623 - RNA, 14 nt, Human herpesvirus 5
cuaccucaugacgc

SEQ ID NO: 2026624 - RNA, 21 nt, Human herpesvirus 5
ccuggguagcaaguccuccaa

SEQ ID NO: 2026625 - RNA, 16 nt, Human herpesvirus 5
gcuacgaaacuuuucu

SEQ ID NO: 2026626 - RNA, 20 nt, Human herpesvirus 5
cggaggagacgagagaaccu

SEQ ID NO: 2026627 - RNA, 22 nt, Human herpesvirus 5
ucaaauuuuaucuuggauaaau

SEQ ID NO: 2026628 - RNA, 18 nt, Human herpesvirus 5
cgggcucugggaagcugc

SEQ ID NO: 2026629 - RNA, 12 nt, Human herpesvirus 5
gaccggcagcac

SEQ ID NO: 2026630 - RNA, 15 nt, Human herpesvirus 5
uggguauccccgauu

SEQ ID NO: 2026631 - RNA, 16 nt, Human herpesvirus 5
gcgugccgaauacaaa

SEQ ID NO: 2026632 - RNA, 16 nt, Human herpesvirus 5
uacccgccccagcaga

SEQ ID NO: 2026633 - RNA, 21 nt, Human herpesvirus 5
guaugccgcgucugcuggaag

SEQ ID NO: 2026634 - RNA, 19 nt, Human herpesvirus 5
cucgaccggcggcugcugu

SEQ ID NO: 2026635 - RNA, 20 nt, Human herpesvirus 5
gguggagaugaggcggcgug

SEQ ID NO: 2026636 - RNA, 18 nt, Human herpesvirus 5
ccgcagucuggcuugggu

SEQ ID NO: 2026637 - RNA, 21 nt, Human herpesvirus 5
caacggccgccgcagccacga

SEQ ID NO: 2026638 - RNA, 19 nt, Human herpesvirus 5
accgugcccguuuucacag

SEQ ID NO: 2026639 - RNA, 13 nt, Human herpesvirus 5
cugcgcgggcagc

SEQ ID NO: 2026640 - RNA, 18 nt, Human herpesvirus 5
ggcaauagcgcacacgag

SEQ ID NO: 2026641 - RNA, 20 nt, Human herpesvirus 5
acaugcccagcaucuccucg

SEQ ID NO: 2026642 - RNA, 14 nt, Human herpesvirus 5
cucgcgcccgcaga

SEQ ID NO: 2026643 - RNA, 21 nt, Human herpesvirus 5
agcggcgugauugcaaagccg

SEQ ID NO: 2026644 - RNA, 14 nt, Human herpesvirus 5
ucucccucugcugu

SEQ ID NO: 2026645 - RNA, 20 nt, Human herpesvirus 5
cacagcuccugaaugagcuc

SEQ ID NO: 2026646 - RNA, 12 nt, Human herpesvirus 5
guuuuuauucau

SEQ ID NO: 2026647 - RNA, 22 nt, Human herpesvirus 5
aaaguaccacauuuuuugacag

SEQ ID NO: 2026648 - RNA, 23 nt, Human herpesvirus 5
gucacuggagaacaauaaagcgu

SEQ ID NO: 2026649 - RNA, 11 nt, Human herpesvirus 5
ucuuaagaaac

SEQ ID NO: 2026650 - RNA, 20 nt, Human herpesvirus 5
uucgauucucuauacacaua

SEQ ID NO: 2026651 - RNA, 19 nt, Human herpesvirus 5
ccguuaccaguaccaccgc

SEQ ID NO: 2026652 - RNA, 18 nt, Human herpesvirus 5
uaagacagaaugaaccuu

SEQ ID NO: 2026653 - RNA, 18 nt, Human herpesvirus 5
ccgguguuggccaccaug

SEQ ID NO: 2026654 - RNA, 16 nt, Human herpesvirus 5
accgcggcaccuacca

SEQ ID NO: 2026655 - RNA, 13 nt, Human herpesvirus 5
ugcuggcggccgu

SEQ ID NO: 2026656 - RNA, 20 nt, Human herpesvirus 5
ggacaaccgcauccugccca

SEQ ID NO: 2026657 - RNA, 17 nt, Human herpesvirus 5
cggcaagccgagcggga

SEQ ID NO: 2026658 - RNA, 23 nt, Human herpesvirus 5
ggacaugauggaaaugcccgcca

SEQ ID NO: 2026659 - RNA, 22 nt, Human herpesvirus 5
cugcuuacccuucaauuuccac

SEQ ID NO: 2026660 - RNA, 14 nt, Human herpesvirus 5
uacacgucccccug

SEQ ID NO: 2026661 - RNA, 20 nt, Human herpesvirus 5
cagguggaggacaguauuua

SEQ ID NO: 2026662 - RNA, 23 nt, Human herpesvirus 5
cgcaaaucuacaacggccccugu

SEQ ID NO: 2026663 - RNA, 14 nt, Human herpesvirus 5
gccuguggauagau

SEQ ID NO: 2026664 - RNA, 16 nt, Human herpesvirus 5
agcguccgcuggaaau

SEQ ID NO: 2026665 - RNA, 21 nt, Human herpesvirus 5
gggaucauuuucuuggccgug

SEQ ID NO: 2026666 - RNA, 20 nt, Human herpesvirus 5
ugcccguuuucacagcagcc

SEQ ID NO: 2026667 - RNA, 18 nt, Human herpesvirus 5
acucaacauguuagcuuu

SEQ ID NO: 2026668 - RNA, 21 nt, Human herpesvirus 5
cggcggcuugggcagcagcgg

SEQ ID NO: 2026669 - RNA, 23 nt, Human herpesvirus 5
aggaccauuuccaugugcagcug

SEQ ID NO: 2026670 - RNA, 13 nt, Human herpesvirus 5
uaccgcuacaacg

SEQ ID NO: 2026671 - RNA, 13 nt, Human herpesvirus 5
agcacugacaggg

SEQ ID NO: 2026672 - RNA, 17 nt, Human herpesvirus 5
gcaucuucgacuuucug

SEQ ID NO: 2026673 - RNA, 14 nt, Human herpesvirus 5
uggagacaguuucc

SEQ ID NO: 2026674 - RNA, 13 nt, Human herpesvirus 5
gauaggcaccugg

SEQ ID NO: 2026675 - RNA, 18 nt, Human herpesvirus 5
guuggcucccgcugugcu

SEQ ID NO: 2026676 - RNA, 21 nt, Human herpesvirus 5
cgccacgcucgcucugacgcc

SEQ ID NO: 2026677 - RNA, 18 nt, Human herpesvirus 5
aagcugcggcggcuuggg

SEQ ID NO: 2026678 - RNA, 16 nt, Human herpesvirus 5
ccuuggcgcucuggau

SEQ ID NO: 2026679 - RNA, 13 nt, Human herpesvirus 5
cggccgccgcagc

SEQ ID NO: 2026680 - RNA, 16 nt, Human herpesvirus 5
guacaccgcuggagcu

SEQ ID NO: 2026681 - RNA, 19 nt, Human herpesvirus 5
ugccgcguggcgcugcaca

SEQ ID NO: 2026682 - RNA, 18 nt, Human herpesvirus 5
cuucggccggcugcugca

SEQ ID NO: 2026683 - RNA, 15 nt, Human herpesvirus 5
aucuuucagcuggcu

SEQ ID NO: 2026684 - RNA, 15 nt, Human herpesvirus 5
agcgugcugcucugc

SEQ ID NO: 2026685 - RNA, 18 nt, Human herpesvirus 5
uccagcggccgcaguggg

SEQ ID NO: 2026686 - RNA, 21 nt, Human herpesvirus 5
cggggugguggugcugcugcu

SEQ ID NO: 2026687 - RNA, 17 nt, Human herpesvirus 5
ucgugaaacagcagcuc

SEQ ID NO: 2026688 - RNA, 18 nt, Human herpesvirus 5
caacaacgguagaugagc

SEQ ID NO: 2026689 - RNA, 18 nt, Human herpesvirus 5
guagcgggcugucacauc

SEQ ID NO: 2026690 - RNA, 23 nt, Human herpesvirus 5
aguugcaacgcgcccgacagcug

SEQ ID NO: 2026691 - RNA, 18 nt, Human herpesvirus 5
guaaauaaaauguuuuua

SEQ ID NO: 2026692 - RNA, 12 nt, Human herpesvirus 5
gcgccuccuggu

SEQ ID NO: 2026693 - RNA, 17 nt, Human herpesvirus 5
cgugcucaagaggugag

SEQ ID NO: 2026694 - RNA, 16 nt, Human herpesvirus 5
caacagcagccaccga

SEQ ID NO: 2026695 - RNA, 14 nt, Human herpesvirus 5
cacucacgcggccg

SEQ ID NO: 2026696 - RNA, 21 nt, Human herpesvirus 5
cucagguuccccgagagggug

SEQ ID NO: 2026697 - RNA, 18 nt, Human herpesvirus 5
cacaucacccaacacugc

SEQ ID NO: 2026698 - RNA, 15 nt, Human herpesvirus 5
gaguggugaggagcg

SEQ ID NO: 2026699 - RNA, 16 nt, Human herpesvirus 5
acccaguagacagaca

SEQ ID NO: 2026700 - RNA, 12 nt, Human herpesvirus 5
cgcguccacggg

SEQ ID NO: 2026701 - RNA, 15 nt, Human herpesvirus 5
gucgcuuagccacca

SEQ ID NO: 2026702 - RNA, 13 nt, Human herpesvirus 5
aucacagaacaca

SEQ ID NO: 2026703 - RNA, 15 nt, Human herpesvirus 5
uguuacgugcccugu

SEQ ID NO: 2026704 - RNA, 16 nt, Human herpesvirus 5
caacaagagaaagacc

SEQ ID NO: 2026705 - RNA, 21 nt, Human herpesvirus 5
cgcacggaaaagcaguggcag

SEQ ID NO: 2026706 - RNA, 19 nt, Human herpesvirus 5
caagugccugcacgaccug

SEQ ID NO: 2026707 - RNA, 16 nt, Human herpesvirus 5
gcggcagccacggagg

SEQ ID NO: 2026708 - RNA, 17 nt, Human herpesvirus 5
aagcgccgugcucuugg

SEQ ID NO: 2026709 - RNA, 22 nt, Human herpesvirus 5
aaggccgccucuucuggcccuc

SEQ ID NO: 2026710 - RNA, 20 nt, Human herpesvirus 5
gccaugcggauccagcugcu

SEQ ID NO: 2026711 - RNA, 14 nt, Human herpesvirus 5
cgccugguugcugc

SEQ ID NO: 2026712 - RNA, 16 nt, Human herpesvirus 5
cccacuggaguugcuc

SEQ ID NO: 2026713 - RNA, 12 nt, Human herpesvirus 5
gcuacagggagu

SEQ ID NO: 2026714 - RNA, 19 nt, Human herpesvirus 5
gguacuucaguaugaaagu

SEQ ID NO: 2026715 - RNA, 14 nt, Human herpesvirus 5
gaagccauacuucu

SEQ ID NO: 2026716 - RNA, 17 nt, Human herpesvirus 5
ccccgggccaccagccg

SEQ ID NO: 2026717 - RNA, 14 nt, Human herpesvirus 5
ucucaacgacuuuc

SEQ ID NO: 2026718 - RNA, 16 nt, Human herpesvirus 5
agcacguacaccgcug

SEQ ID NO: 2026719 - RNA, 14 nt, Human herpesvirus 5
uacuaccuccccua

SEQ ID NO: 2026720 - RNA, 19 nt, Human herpesvirus 5
cacgagcaugaacugccac

SEQ ID NO: 2026721 - RNA, 19 nt, Human herpesvirus 5
gccuggagcgaguggggca

SEQ ID NO: 2026722 - RNA, 14 nt, Human herpesvirus 5
cagcggauugggua

SEQ ID NO: 2026723 - RNA, 17 nt, Human herpesvirus 5
cggaggagucugucgac

SEQ ID NO: 2026724 - RNA, 13 nt, Human herpesvirus 5
aucaacagcagca

SEQ ID NO: 2026725 - RNA, 23 nt, Human herpesvirus 5
aaacgcgagaugaacuguuccac

SEQ ID NO: 2026726 - RNA, 21 nt, Human herpesvirus 5
gcuacgcgaccagcugcugga

SEQ ID NO: 2026727 - RNA, 20 nt, Human herpesvirus 5
gguggcucuugcgcuucugc

SEQ ID NO: 2026728 - RNA, 17 nt, Human herpesvirus 5
uuugauaaccuaccugg

SEQ ID NO: 2026729 - RNA, 13 nt, Human herpesvirus 5
ccaauaacauguc

SEQ ID NO: 2026730 - RNA, 15 nt, Human herpesvirus 5
ugaaaccuaccuggg

SEQ ID NO: 2026731 - RNA, 13 nt, Human herpesvirus 5
cggguugcagcuu

SEQ ID NO: 2026732 - RNA, 12 nt, Human herpesvirus 5
aucagccgccgc

SEQ ID NO: 2026733 - RNA, 22 nt, Human herpesvirus 5
gauaccgggcgccgggacucug

SEQ ID NO: 2026734 - RNA, 13 nt, Human herpesvirus 5
ggacuuggcagcg

SEQ ID NO: 2026735 - RNA, 23 nt, Human herpesvirus 5
aaacauuuuauuuacaucuguac

SEQ ID NO: 2026736 - RNA, 21 nt, Human herpesvirus 5
ugcggauacgccgccgggcgc

SEQ ID NO: 2026737 - RNA, 19 nt, Human herpesvirus 5
aaaacaugcacauaaacaa

SEQ ID NO: 2026738 - RNA, 17 nt, Human herpesvirus 5
gauggccaucacgggca

SEQ ID NO: 2026739 - RNA, 19 nt, Human herpesvirus 5
ggcaccgcgacagcuaccg

SEQ ID NO: 2026740 - RNA, 14 nt, Human herpesvirus 5
ugggcuggggugcg

SEQ ID NO: 2026741 - RNA, 16 nt, Human herpesvirus 5
augaggcgguggcugc

SEQ ID NO: 2026742 - RNA, 17 nt, Human herpesvirus 5
ggaaauacaugaugaau

SEQ ID NO: 2026743 - RNA, 18 nt, Human herpesvirus 5
cgguggaauucgcugggc

SEQ ID NO: 2026744 - RNA, 16 nt, Human herpesvirus 5
cgcgccacacgcugag

SEQ ID NO: 2026745 - RNA, 19 nt, Human herpesvirus 5
augcgugucgccugccgaa

SEQ ID NO: 2026746 - RNA, 18 nt, Human herpesvirus 5
ccgacgccggguuggcac

SEQ ID NO: 2026747 - RNA, 13 nt, Human herpesvirus 5
cagcgcgugcgca

SEQ ID NO: 2026748 - RNA, 16 nt, Human herpesvirus 5
ggugaugaugcugcug

SEQ ID NO: 2026749 - RNA, 23 nt, Human herpesvirus 5
guggcugcacacggagcacgggc

SEQ ID NO: 2026750 - RNA, 21 nt, Human herpesvirus 5
cauugaacgcgguacaugugc

SEQ ID NO: 2026751 - RNA, 13 nt, Human herpesvirus 5
uggagcccacgcc

SEQ ID NO: 2026752 - RNA, 17 nt, Human herpesvirus 5
cugagcgcgcucagcua

SEQ ID NO: 2026753 - RNA, 16 nt, Human herpesvirus 5
ugacggcgacaucacg

SEQ ID NO: 2026754 - RNA, 17 nt, Human herpesvirus 5
cggaguggugagcgggu

SEQ ID NO: 2026755 - RNA, 22 nt, Human herpesvirus 5
acuggggucaaaagccugggua

SEQ ID NO: 2026756 - RNA, 16 nt, Human herpesvirus 5
cuaacucgcguuuaua

SEQ ID NO: 2026757 - RNA, 22 nt, Human herpesvirus 5
cagguaaaaacaacguguguga

SEQ ID NO: 2026758 - RNA, 13 nt, Human herpesvirus 5
ccgucaccaccgc

SEQ ID NO: 2026759 - RNA, 22 nt, Human herpesvirus 5
ccuggguacuuaugaggagcgc

SEQ ID NO: 2026760 - RNA, 20 nt, Human herpesvirus 5
ccagcuaucaggccagcugc

SEQ ID NO: 2026761 - RNA, 13 nt, Human herpesvirus 5
uggaaguaacauc

SEQ ID NO: 2026762 - RNA, 21 nt, Human herpesvirus 5
uugcccgcacgccccggggcg

SEQ ID NO: 2026763 - RNA, 22 nt, Human herpesvirus 5
gcucgcuuagacauuccccacc

SEQ ID NO: 2026764 - RNA, 22 nt, Human herpesvirus 5
uuuaaacgucguuguguucuua

SEQ ID NO: 2026765 - RNA, 17 nt, Human herpesvirus 5
uaccuggaggagauggc

SEQ ID NO: 2026766 - RNA, 12 nt, Human herpesvirus 5
agauagagaaac

SEQ ID NO: 2026767 - RNA, 16 nt, Human herpesvirus 5
accuggcuggcgcagu

SEQ ID NO: 2026768 - RNA, 20 nt, Human herpesvirus 5
uuggaacccaucgaggaggc

SEQ ID NO: 2026769 - RNA, 18 nt, Human herpesvirus 5
agucucuuucucugcuuc

SEQ ID NO: 2026770 - RNA, 12 nt, Human herpesvirus 5
ggcuucccuccu

SEQ ID NO: 2026771 - RNA, 15 nt, Human herpesvirus 5
gaagcugcgcaggcc

SEQ ID NO: 2026772 - RNA, 13 nt, Human herpesvirus 5
agucgaucuggaa

SEQ ID NO: 2026773 - RNA, 21 nt, Human herpesvirus 5
guggugaucgugggccaggac

SEQ ID NO: 2026774 - RNA, 21 nt, Human herpesvirus 5
gauccaguugcaccucgaccu

SEQ ID NO: 2026775 - RNA, 19 nt, Human herpesvirus 5
gggccggcccucggggugc

SEQ ID NO: 2026776 - RNA, 22 nt, Human herpesvirus 5
gccgcucaagccgcggugcagg

SEQ ID NO: 2026777 - RNA, 14 nt, Human herpesvirus 5
gagacccggcuggc

SEQ ID NO: 2026778 - RNA, 18 nt, Human herpesvirus 5
ccgccucggaucuacuca

SEQ ID NO: 2026779 - RNA, 22 nt, Human herpesvirus 5
caacuuaaccacaagaaacgcu

SEQ ID NO: 2026780 - RNA, 15 nt, Human herpesvirus 5
uauuuuucagcucac

SEQ ID NO: 2026781 - RNA, 22 nt, Human herpesvirus 5
cagcugguggcucaugccgcca

SEQ ID NO: 2026782 - RNA, 20 nt, Human herpesvirus 5
ccggcggcgccgucagagca

SEQ ID NO: 2026783 - RNA, 18 nt, Human herpesvirus 5
guuaaggauucugagggc

SEQ ID NO: 2026784 - RNA, 14 nt, Human herpesvirus 5
cugaaggacacggu

SEQ ID NO: 2026785 - RNA, 21 nt, Human herpesvirus 5
ccgucuggacaccggaaugca

SEQ ID NO: 2026786 - RNA, 21 nt, Human herpesvirus 5
cagccaaggugcgggagacua

SEQ ID NO: 2026787 - RNA, 14 nt, Human herpesvirus 5
gcacgggcugcugg

SEQ ID NO: 2026788 - RNA, 13 nt, Human herpesvirus 5
cggccgcggugcg

SEQ ID NO: 2026789 - RNA, 17 nt, Human herpesvirus 5
cccuggggcugcugcug

SEQ ID NO: 2026790 - RNA, 16 nt, Human herpesvirus 5
ucuaccuccugcagga

SEQ ID NO: 2026791 - RNA, 12 nt, Human herpesvirus 5
ggagcccacgcc

SEQ ID NO: 2026792 - RNA, 19 nt, Human herpesvirus 5
ggggcgcagaaacuuuucc

SEQ ID NO: 2026793 - RNA, 17 nt, Human herpesvirus 5
cagcagggcgcgccggc

SEQ ID NO: 2026794 - RNA, 17 nt, Human herpesvirus 5
gucgccgucacugccac

SEQ ID NO: 2026795 - RNA, 21 nt, Human herpesvirus 5
cgcgucccaccccccgggcca

SEQ ID NO: 2026796 - RNA, 14 nt, Human herpesvirus 5
caugcaucccacca

SEQ ID NO: 2026797 - RNA, 13 nt, Human herpesvirus 5
gcaguugcugccu

SEQ ID NO: 2026798 - RNA, 18 nt, Human herpesvirus 5
gcagcgugcaccugcugc

SEQ ID NO: 2026799 - RNA, 15 nt, Human herpesvirus 5
aguggucuuucacau

SEQ ID NO: 2026800 - RNA, 16 nt, Human herpesvirus 5
aaccauugagaaagcu

SEQ ID NO: 2026801 - RNA, 14 nt, Human herpesvirus 5
gccguccaugucgc

SEQ ID NO: 2026802 - RNA, 19 nt, Human herpesvirus 5
caccgucaccacucccacc

SEQ ID NO: 2026803 - RNA, 18 nt, Human herpesvirus 5
cuggccgagacggcguga

SEQ ID NO: 2026804 - RNA, 22 nt, Human herpesvirus 5
ucggcacgcuggcgggccgacc

SEQ ID NO: 2026805 - RNA, 15 nt, Human herpesvirus 5
ggcuuacugccugcc

SEQ ID NO: 2026806 - RNA, 22 nt, Human herpesvirus 5
cuauuucgcgauccgcucacca

SEQ ID NO: 2026807 - RNA, 14 nt, Human herpesvirus 5
ugacgaggagcuuc

SEQ ID NO: 2026808 - RNA, 13 nt, Human herpesvirus 5
aagggugugacug

SEQ ID NO: 2026809 - RNA, 20 nt, Human herpesvirus 5
ucaguguacacgcgcccaga

SEQ ID NO: 2026810 - RNA, 12 nt, Human herpesvirus 5
ccgacgccgggu

SEQ ID NO: 2026811 - RNA, 19 nt, Human herpesvirus 5
caagacgcugaauugcacg

SEQ ID NO: 2026812 - RNA, 14 nt, Human herpesvirus 5
acagaaugaaccuu

SEQ ID NO: 2026813 - RNA, 17 nt, Human herpesvirus 5
uuccgaagaugccgugu

SEQ ID NO: 2026814 - RNA, 15 nt, Human herpesvirus 5
uuacauaaaaccacc

SEQ ID NO: 2026815 - RNA, 15 nt, Human herpesvirus 5
cuaccauccuuuuca

SEQ ID NO: 2026816 - RNA, 15 nt, Human herpesvirus 5
ggaagagggaagcac

SEQ ID NO: 2026817 - RNA, 18 nt, Human herpesvirus 5
auggaccgucgaggaggu

SEQ ID NO: 2026818 - RNA, 22 nt, Human herpesvirus 5
ccuauuagccccacaugcugcu

SEQ ID NO: 2026819 - RNA, 16 nt, Human herpesvirus 5
gucacuacucugggau

SEQ ID NO: 2026820 - RNA, 14 nt, Human herpesvirus 5
guacaccgcuggag

SEQ ID NO: 2026821 - RNA, 14 nt, Human herpesvirus 5
gcgguaacuggcag

SEQ ID NO: 2026822 - RNA, 21 nt, Human herpesvirus 5
gacgaguaggcgcgcacccga

SEQ ID NO: 2026823 - RNA, 18 nt, Human herpesvirus 5
cccgauaaucggcucuca

SEQ ID NO: 2026824 - RNA, 14 nt, Human herpesvirus 5
uguuuuuuccuucc

SEQ ID NO: 2026825 - RNA, 14 nt, Human herpesvirus 5
gggccagcccgagu

SEQ ID NO: 2026826 - RNA, 18 nt, Human herpesvirus 5
cacacugggagacggccu

SEQ ID NO: 2026827 - RNA, 15 nt, Human herpesvirus 5
ggcuccacacgcauc

SEQ ID NO: 2026828 - RNA, 15 nt, Human herpesvirus 5
acgaucgcuggaaag

SEQ ID NO: 2026829 - RNA, 21 nt, Human herpesvirus 5
cgugcgauuuggaccuggagg

SEQ ID NO: 2026830 - RNA, 20 nt, Human herpesvirus 5
gccuguggauagauuucugc

SEQ ID NO: 2026831 - RNA, 17 nt, Human herpesvirus 5
ccgcuuuucagaccgca

SEQ ID NO: 2026832 - RNA, 20 nt, Human herpesvirus 5
ugcucgaaauguugacccag

SEQ ID NO: 2026833 - RNA, 23 nt, Human herpesvirus 5
gaccuguuuaccucaugcggcaa

SEQ ID NO: 2026834 - RNA, 15 nt, Human herpesvirus 5
accgacauggagccc

SEQ ID NO: 2026835 - RNA, 23 nt, Human herpesvirus 5
gcaacgcguggcccuggucuggc

SEQ ID NO: 2026836 - RNA, 14 nt, Human herpesvirus 5
gaacuuugcugcua

SEQ ID NO: 2026837 - RNA, 15 nt, Human herpesvirus 5
cagccaccggcgcag

SEQ ID NO: 2026838 - RNA, 21 nt, Human herpesvirus 5
aacuauuccuccguguucuua

SEQ ID NO: 2026839 - RNA, 17 nt, Human herpesvirus 5
cuggcgguauggcugcg

SEQ ID NO: 2026840 - RNA, 21 nt, Human herpesvirus 5
acagagacaccaauugcuuua

SEQ ID NO: 2026841 - RNA, 13 nt, Human herpesvirus 5
ucaucucagccuc

SEQ ID NO: 2026842 - RNA, 16 nt, Human herpesvirus 5
agcugcuggacgacgu

SEQ ID NO: 2026843 - RNA, 18 nt, Human herpesvirus 5
agugucucuaaacgccac

SEQ ID NO: 2026844 - RNA, 15 nt, Human herpesvirus 5
cguacggcaacgagc

SEQ ID NO: 2026845 - RNA, 20 nt, Human herpesvirus 5
ccgugguggccgugcugggc

SEQ ID NO: 2026846 - RNA, 20 nt, Human herpesvirus 5
accaugcaggcgcaggaggc

SEQ ID NO: 2026847 - RNA, 18 nt, Human herpesvirus 5
caacugcaccagcaacca

SEQ ID NO: 2026848 - RNA, 16 nt, Human herpesvirus 5
cucguguggcagcugg

SEQ ID NO: 2026849 - RNA, 18 nt, Human herpesvirus 5
cgcccgggccgccugagg

SEQ ID NO: 2026850 - RNA, 13 nt, Human herpesvirus 5
gcuucgcgacugg

SEQ ID NO: 2026851 - RNA, 21 nt, Human herpesvirus 5
aucugcaccucgaugaagccu

SEQ ID NO: 2026852 - RNA, 22 nt, Human herpesvirus 5
ugaggcggcguggacugggacg

SEQ ID NO: 2026853 - RNA, 16 nt, Human herpesvirus 5
gcuuacugccugccgc

SEQ ID NO: 2026854 - RNA, 19 nt, Human herpesvirus 5
ccuguuggcuuacugccug

SEQ ID NO: 2026855 - RNA, 21 nt, Human herpesvirus 5
gaccagccaccgucccucagc

SEQ ID NO: 2026856 - RNA, 18 nt, Human herpesvirus 5
ccgacgacgacagucucc

SEQ ID NO: 2026857 - RNA, 13 nt, Human herpesvirus 5
cgcgagcgggcaa

SEQ ID NO: 2026858 - RNA, 23 nt, Human herpesvirus 5
ggcccaaagaccgcugccucguu

SEQ ID NO: 2026859 - RNA, 14 nt, Human herpesvirus 5
ugucucuacgcucc

SEQ ID NO: 2026860 - RNA, 16 nt, Human herpesvirus 5
cagcaugggcgacacc

SEQ ID NO: 2026861 - RNA, 19 nt, Human herpesvirus 5
cagguucugaaucugcucc

SEQ ID NO: 2026862 - RNA, 23 nt, Human herpesvirus 5
auggcuuggcgcagcgggcuuug

SEQ ID NO: 2026863 - RNA, 19 nt, Human herpesvirus 5
gguucugaaucugcuccag

SEQ ID NO: 2026864 - RNA, 14 nt, Human herpesvirus 5
aucgucggcagagg

SEQ ID NO: 2026865 - RNA, 16 nt, Human herpesvirus 5
ucagcaugguggccaa

SEQ ID NO: 2026866 - RNA, 14 nt, Human herpesvirus 5
guagccgaugcuga

SEQ ID NO: 2026867 - RNA, 18 nt, Human herpesvirus 5
uucgccaagaugcugcgg

SEQ ID NO: 2026868 - RNA, 13 nt, Human herpesvirus 5
gugguaccugcaa

SEQ ID NO: 2026869 - RNA, 20 nt, Human herpesvirus 5
acacucuuuugccgcaccgc

SEQ ID NO: 2026870 - RNA, 17 nt, Human herpesvirus 5
gcauccugcccaccgcc

SEQ ID NO: 2026871 - RNA, 19 nt, Human herpesvirus 5
ucuugacguuuauaaaccg

SEQ ID NO: 2026872 - RNA, 12 nt, Human herpesvirus 5
aaauaccaacac

SEQ ID NO: 2026873 - RNA, 16 nt, Human herpesvirus 5
cgcgguuucgccgccg

SEQ ID NO: 2026874 - RNA, 15 nt, Human herpesvirus 5
agugacguggauacu

SEQ ID NO: 2026875 - RNA, 21 nt, Human herpesvirus 5
cgcuuuucagaccgcaacaac

SEQ ID NO: 2026876 - RNA, 14 nt, Human herpesvirus 5
auucguaggcagcg

SEQ ID NO: 2026877 - RNA, 15 nt, Human herpesvirus 5
cuggaagcugcuggu

SEQ ID NO: 2026878 - RNA, 10 nt, Human herpesvirus 5
auaacgugac

SEQ ID NO: 2026879 - RNA, 17 nt, Human herpesvirus 5
uucaacaaauaccaaca

SEQ ID NO: 2026880 - RNA, 17 nt, Human herpesvirus 5
ccaagccaugcagcacg

SEQ ID NO: 2026881 - RNA, 17 nt, Human herpesvirus 5
cguaauguagacagcgc

SEQ ID NO: 2026882 - RNA, 18 nt, Human herpesvirus 5
cacgucgauucccaucuc

SEQ ID NO: 2026883 - RNA, 18 nt, Human herpesvirus 5
cgucacgccucuguucag

SEQ ID NO: 2026884 - RNA, 14 nt, Human herpesvirus 5
accacgcagcaggc

SEQ ID NO: 2026885 - RNA, 13 nt, Human herpesvirus 5
gguuucagcuggc

SEQ ID NO: 2026886 - RNA, 15 nt, Human herpesvirus 5
caaagucaacaugua

SEQ ID NO: 2026887 - RNA, 22 nt, Human herpesvirus 5
ccggcggggaaaauaccgaggc

SEQ ID NO: 2026888 - RNA, 16 nt, Human herpesvirus 5
uuuaauguaccaagaa

SEQ ID NO: 2026889 - RNA, 12 nt, Human herpesvirus 5
gguaacagccuu

SEQ ID NO: 2026890 - RNA, 16 nt, Human herpesvirus 5
aaccuacgugcaacgc

SEQ ID NO: 2026891 - RNA, 13 nt, Human herpesvirus 5
ccacggcugcuga

SEQ ID NO: 2026892 - RNA, 21 nt, Human herpesvirus 5
cggcacgccguugccacgagc

SEQ ID NO: 2026893 - RNA, 12 nt, Human herpesvirus 5
gcacgacaugac

SEQ ID NO: 2026894 - RNA, 17 nt, Human herpesvirus 5
acguagaaaaagaggaa

SEQ ID NO: 2026895 - RNA, 17 nt, Human herpesvirus 5
cguuaccaguaccaccg

SEQ ID NO: 2026896 - RNA, 22 nt, Human herpesvirus 5
aaggccguggagaugcaggagg

SEQ ID NO: 2026897 - RNA, 20 nt, Human herpesvirus 5
uccuuggaagagggaagcac

SEQ ID NO: 2026898 - RNA, 12 nt, Human herpesvirus 5
gacgccgugggc

SEQ ID NO: 2026899 - RNA, 20 nt, Human herpesvirus 5
gaccggugguacugcugugg

SEQ ID NO: 2026900 - RNA, 20 nt, Human herpesvirus 5
caguucacggggagaagaaa

SEQ ID NO: 2026901 - RNA, 15 nt, Human herpesvirus 5
acugggccucggcgu

SEQ ID NO: 2026902 - RNA, 16 nt, Human herpesvirus 5
ugcaccucgaccuccg

SEQ ID NO: 2026903 - RNA, 19 nt, Human herpesvirus 5
caccgucgccgucacugcc

SEQ ID NO: 2026904 - RNA, 18 nt, Human herpesvirus 5
gccuguggauagauuucu

SEQ ID NO: 2026905 - RNA, 15 nt, Human herpesvirus 5
caauaaagagaguug

SEQ ID NO: 2026906 - RNA, 15 nt, Human herpesvirus 5
caucugccgaaacac

SEQ ID NO: 2026907 - RNA, 12 nt, Human herpesvirus 5
ucuucuggcccu

SEQ ID NO: 2026908 - RNA, 18 nt, Human herpesvirus 5
cugccuauguaaggcggc

SEQ ID NO: 2026909 - RNA, 23 nt, Human herpesvirus 5
cagucagacccacuaccuggagg

SEQ ID NO: 2026910 - RNA, 17 nt, Human herpesvirus 5
cucgaccggcggcugcu

SEQ ID NO: 2026911 - RNA, 21 nt, Human herpesvirus 5
agaccaagagcaugcuguggg

SEQ ID NO: 2026912 - RNA, 19 nt, Human herpesvirus 5
cacgucggggcugugucgc

SEQ ID NO: 2026913 - RNA, 16 nt, Human herpesvirus 5
gacacagcagcaccag

SEQ ID NO: 2026914 - RNA, 21 nt, Human herpesvirus 5
uacggcagaaaagccggcucc

SEQ ID NO: 2026915 - RNA, 13 nt, Human herpesvirus 5
aacggggugggag

SEQ ID NO: 2026916 - RNA, 23 nt, Human herpesvirus 5
cgucgugagcagcgugcaccugc

SEQ ID NO: 2026917 - RNA, 18 nt, Human herpesvirus 5
augaaguuguugaucugc

SEQ ID NO: 2026918 - RNA, 22 nt, Human herpesvirus 5
cgggacgauauaaagaggcacg

SEQ ID NO: 2026919 - RNA, 21 nt, Human herpesvirus 5
gccaacuccgugccagcuggc

SEQ ID NO: 2026920 - RNA, 17 nt, Human herpesvirus 5
cagccucgggugcaccg

SEQ ID NO: 2026921 - RNA, 14 nt, Human herpesvirus 5
cgcuccaucgcagc

SEQ ID NO: 2026922 - RNA, 13 nt, Human herpesvirus 5
ggaaacgacagua

SEQ ID NO: 2026923 - RNA, 13 nt, Human herpesvirus 5
cggaccgcagcac

SEQ ID NO: 2026924 - RNA, 13 nt, Human herpesvirus 5
gcugcaggcaggu

SEQ ID NO: 2026925 - RNA, 17 nt, Human herpesvirus 5
aggugcugcaccucaac

SEQ ID NO: 2026926 - RNA, 14 nt, Human herpesvirus 5
uacccacauuuugc

SEQ ID NO: 2026927 - RNA, 19 nt, Human herpesvirus 5
cggagcacgggcugcuggu

SEQ ID NO: 2026928 - RNA, 20 nt, Human herpesvirus 5
cgcggaaaccgagacggagg

SEQ ID NO: 2026929 - RNA, 20 nt, Human herpesvirus 5
gcgccguggguuggcagcug

SEQ ID NO: 2026930 - RNA, 22 nt, Human herpesvirus 5
uugccggugccgaugagauaaa

SEQ ID NO: 2026931 - RNA, 17 nt, Human herpesvirus 5
cccgcgucccuggggcu

SEQ ID NO: 2026932 - RNA, 15 nt, Human herpesvirus 5
ggggaaaaucacgaa

SEQ ID NO: 2026933 - RNA, 21 nt, Human herpesvirus 5
caguacaacaguuaucagcaa

SEQ ID NO: 2026934 - RNA, 19 nt, Human herpesvirus 5
auagcaugcauaagaagcc

SEQ ID NO: 2026935 - RNA, 19 nt, Human herpesvirus 5
aaccgcgcaaaaccacgcg

SEQ ID NO: 2026936 - RNA, 14 nt, Human herpesvirus 5
ccgaggcgccgcca

SEQ ID NO: 2026937 - RNA, 14 nt, Human herpesvirus 5
auaaaaacacagag

SEQ ID NO: 2026938 - RNA, 19 nt, Human herpesvirus 5
gcucaggccacccgccgga

SEQ ID NO: 2026939 - RNA, 16 nt, Human herpesvirus 5
gcccuauccgcgcggc

SEQ ID NO: 2026940 - RNA, 23 nt, Human herpesvirus 5
gcgacgagcgcugcgaagaugcu

SEQ ID NO: 2026941 - RNA, 13 nt, Human herpesvirus 5
acaaccugcugca

SEQ ID NO: 2026942 - RNA, 19 nt, Human herpesvirus 5
cgacgccggguuggcacga

SEQ ID NO: 2026943 - RNA, 16 nt, Human herpesvirus 5
aacgccgagcucuguc

SEQ ID NO: 2026944 - RNA, 17 nt, Human herpesvirus 5
uccccggugugucuauu

SEQ ID NO: 2026945 - RNA, 17 nt, Human herpesvirus 5
acaggacgaggcagggu

SEQ ID NO: 2026946 - RNA, 16 nt, Human herpesvirus 5
ugcugaugugccagcc

SEQ ID NO: 2026947 - RNA, 12 nt, Human herpesvirus 5
ggaugaccuggc

SEQ ID NO: 2026948 - RNA, 14 nt, Human herpesvirus 5
gguggugugugggg

SEQ ID NO: 2026949 - RNA, 21 nt, Human herpesvirus 5
cucagccucgucgugcccguc

SEQ ID NO: 2026950 - RNA, 14 nt, Human herpesvirus 5
cgcgagcuggccag

SEQ ID NO: 2026951 - RNA, 19 nt, Human herpesvirus 5
cuacgcgugcacgcgcugc

SEQ ID NO: 2026952 - RNA, 23 nt, Human herpesvirus 5
cacagguagguggccaugaugac

SEQ ID NO: 2026953 - RNA, 20 nt, Human herpesvirus 5
ugcuuauucuagcccucugg

SEQ ID NO: 2026954 - RNA, 16 nt, Human herpesvirus 5
uggccgaacagcagcu

SEQ ID NO: 2026955 - RNA, 17 nt, Human herpesvirus 5
gugaucugggcagcggc

SEQ ID NO: 2026956 - RNA, 16 nt, Human herpesvirus 5
gcgcccgacagcugca

SEQ ID NO: 2026957 - RNA, 21 nt, Human herpesvirus 5
accauuaacaauuccacgccg

SEQ ID NO: 2026958 - RNA, 14 nt, Human herpesvirus 5
ggugcgcgcagaag

SEQ ID NO: 2026959 - RNA, 11 nt, Human herpesvirus 5
auauguagcac

SEQ ID NO: 2026960 - RNA, 18 nt, Human herpesvirus 5
aaccgucgaaaacaacca

SEQ ID NO: 2026961 - RNA, 15 nt, Human herpesvirus 5
gccgccgcucaagcc

SEQ ID NO: 2026962 - RNA, 18 nt, Human herpesvirus 5
agaguagugguggggcug

SEQ ID NO: 2026963 - RNA, 14 nt, Human herpesvirus 5
ggccggcugcugca

SEQ ID NO: 2026964 - RNA, 17 nt, Human herpesvirus 5
uagcuuuuuuuauacau

SEQ ID NO: 2026965 - RNA, 15 nt, Human herpesvirus 5
cugaaucugcuccag

SEQ ID NO: 2026966 - RNA, 22 nt, Human herpesvirus 5
cgccgucggugcgcccaucugc

SEQ ID NO: 2026967 - RNA, 23 nt, Human herpesvirus 5
auaaaauaauaagccggcagcug

SEQ ID NO: 2026968 - RNA, 15 nt, Human herpesvirus 5
ugagacgaggccgcc

SEQ ID NO: 2026969 - RNA, 14 nt, Human herpesvirus 5
caaugggcuucccu

SEQ ID NO: 2026970 - RNA, 18 nt, Human herpesvirus 5
ucgcaucaucaacagcag

SEQ ID NO: 2026971 - RNA, 19 nt, Human herpesvirus 5
ccucgucggccugggcugc

SEQ ID NO: 2026972 - RNA, 20 nt, Human herpesvirus 5
cucgaccggcggcugcuguu

SEQ ID NO: 2026973 - RNA, 22 nt, Human herpesvirus 5
guacaauaaacuguugauuuug

SEQ ID NO: 2026974 - RNA, 17 nt, Human herpesvirus 5
auugcccuucuggagca

SEQ ID NO: 2026975 - RNA, 12 nt, Human herpesvirus 5
ucuuccuccucg

SEQ ID NO: 2026976 - RNA, 19 nt, Human herpesvirus 5
cuggcgacccgcagucugg

SEQ ID NO: 2026977 - RNA, 15 nt, Human herpesvirus 5
cguggccuguggccc

SEQ ID NO: 2026978 - RNA, 20 nt, Human herpesvirus 5
cuaucuucaaccucacguua

SEQ ID NO: 2026979 - RNA, 18 nt, Human herpesvirus 5
acacguaaaguagcuggu

SEQ ID NO: 2026980 - RNA, 20 nt, Human herpesvirus 5
cguaaaaagaauggccaugu

SEQ ID NO: 2026981 - RNA, 22 nt, Human herpesvirus 5
gugagauacauguucauaaacu

SEQ ID NO: 2026982 - RNA, 14 nt, Human herpesvirus 5
agcgccguccugca

SEQ ID NO: 2026983 - RNA, 18 nt, Human herpesvirus 5
ggugcucgaccaggaggu

SEQ ID NO: 2026984 - RNA, 20 nt, Human herpesvirus 5
cacaucggugccggccaggu

SEQ ID NO: 2026985 - RNA, 20 nt, Human herpesvirus 5
gcagcccaaguucagcagca

SEQ ID NO: 2026986 - RNA, 23 nt, Human herpesvirus 5
agacaaccaaaacgucaggaauc

SEQ ID NO: 2026987 - RNA, 23 nt, Human herpesvirus 5
ggaucacgacgacgcgcccccca

SEQ ID NO: 2026988 - RNA, 23 nt, Human herpesvirus 5
ggaaacagcguccacaguuuccg

SEQ ID NO: 2026989 - RNA, 14 nt, Human herpesvirus 5
aggucgaaagccac

SEQ ID NO: 2026990 - RNA, 21 nt, Human herpesvirus 5
cgcggagguuugucuggcggc

SEQ ID NO: 2026991 - RNA, 14 nt, Human herpesvirus 5
gaagaagagauggc

SEQ ID NO: 2026992 - RNA, 23 nt, Human herpesvirus 5
gccgcgauucgucugacgcugcu

SEQ ID NO: 2026993 - RNA, 12 nt, Human herpesvirus 5
ccgacgagcagg

SEQ ID NO: 2026994 - RNA, 21 nt, Human herpesvirus 5
gcaccgcgacagcuaccgagg

SEQ ID NO: 2026995 - RNA, 15 nt, Human herpesvirus 5
ucgcucgcuuuggag

SEQ ID NO: 2026996 - RNA, 17 nt, Human herpesvirus 5
gccugcgacguuggcuc

SEQ ID NO: 2026997 - RNA, 23 nt, Human herpesvirus 5
ugaaucuuccccucugcugcugg

SEQ ID NO: 2026998 - RNA, 20 nt, Human herpesvirus 5
gcgagaccgauuccagaacu

SEQ ID NO: 2026999 - RNA, 20 nt, Human herpesvirus 5
aggccaacaucuucugcacu

SEQ ID NO: 2027000 - RNA, 17 nt, Human herpesvirus 5
ccaagagcaugcugugg

SEQ ID NO: 2027001 - RNA, 19 nt, Human herpesvirus 5
ggaaauacaugaugaaugu

SEQ ID NO: 2027002 - RNA, 21 nt, Human herpesvirus 5
gcauacggggaggagacacag

SEQ ID NO: 2027003 - RNA, 22 nt, Human herpesvirus 5
gagauucaggacgaggagccaa

SEQ ID NO: 2027004 - RNA, 16 nt, Human herpesvirus 5
ucccacaggagucucu

SEQ ID NO: 2027005 - RNA, 17 nt, Human herpesvirus 5
gauucaguaaccuggag

SEQ ID NO: 2027006 - RNA, 22 nt, Human herpesvirus 5
uaugugcucccgacccacgguc

SEQ ID NO: 2027007 - RNA, 14 nt, Human herpesvirus 5
acucuggcccugcu

SEQ ID NO: 2027008 - RNA, 20 nt, Human herpesvirus 5
gcugucuguuugucugugcg

SEQ ID NO: 2027009 - RNA, 14 nt, Human herpesvirus 5
cggccugcucgcac

SEQ ID NO: 2027010 - RNA, 15 nt, Human herpesvirus 5
ccaaggccuccagcg

SEQ ID NO: 2027011 - RNA, 22 nt, Human herpesvirus 5
gccaccaugcaucccaccacgg

SEQ ID NO: 2027012 - RNA, 15 nt, Human herpesvirus 5
uucgaguccugcugu

SEQ ID NO: 2027013 - RNA, 21 nt, Human herpesvirus 5
acgguuaccuucuugcccacg

SEQ ID NO: 2027014 - RNA, 19 nt, Human herpesvirus 5
cgagcguugcgcucgcgcu

SEQ ID NO: 2027015 - RNA, 14 nt, Human herpesvirus 5
aaacaguacggaca

SEQ ID NO: 2027016 - RNA, 15 nt, Human herpesvirus 5
cgcgucuuagacgcg

SEQ ID NO: 2027017 - RNA, 18 nt, Human herpesvirus 5
ucgcgugccgaauacaaa

SEQ ID NO: 2027018 - RNA, 23 nt, Human herpesvirus 5
cguggcggccgacggcagcgugc

SEQ ID NO: 2027019 - RNA, 22 nt, Human herpesvirus 5
gcauguuggugccccaggauga

SEQ ID NO: 2027020 - RNA, 14 nt, Human herpesvirus 5
uccaugugcagcug

SEQ ID NO: 2027021 - RNA, 13 nt, Human herpesvirus 5
caucgucaaagcc

SEQ ID NO: 2027022 - RNA, 18 nt, Human herpesvirus 5
cgacuuuuuucugugaga

SEQ ID NO: 2027023 - RNA, 21 nt, Human herpesvirus 5
uccuccaacucgaccugccgc

SEQ ID NO: 2027024 - RNA, 12 nt, Human herpesvirus 5
aacgugugguga

SEQ ID NO: 2027025 - RNA, 14 nt, Human herpesvirus 5
gcagcggagguggg

SEQ ID NO: 2027026 - RNA, 20 nt, Human herpesvirus 5
agaaugcaacgcuuucagga

SEQ ID NO: 2027027 - RNA, 21 nt, Human herpesvirus 5
guuuucccucagccucugugu

SEQ ID NO: 2027028 - RNA, 14 nt, Human herpesvirus 5
auaauauucuauau

SEQ ID NO: 2027029 - RNA, 16 nt, Human herpesvirus 5
uggcucgggucggcug

SEQ ID NO: 2027030 - RNA, 13 nt, Human herpesvirus 5
acacggggauuuu

SEQ ID NO: 2027031 - RNA, 12 nt, Human herpesvirus 5
uuguccuccucg

SEQ ID NO: 2027032 - RNA, 15 nt, Human herpesvirus 5
cagcgcggcggcagc

SEQ ID NO: 2027033 - RNA, 18 nt, Human herpesvirus 5
cauguucucccaggacca

SEQ ID NO: 2027034 - RNA, 15 nt, Human herpesvirus 5
cucaggccacccgcc

SEQ ID NO: 2027035 - RNA, 18 nt, Human herpesvirus 5
aacaaugacuaacccugg

SEQ ID NO: 2027036 - RNA, 21 nt, Human herpesvirus 5
cuaagagauccugggacacca

SEQ ID NO: 2027037 - RNA, 21 nt, Human herpesvirus 5
guaacagccuucccuuguaag

SEQ ID NO: 2027038 - RNA, 13 nt, Human herpesvirus 5
ucuacugcaacug

SEQ ID NO: 2027039 - RNA, 17 nt, Human herpesvirus 5
cuacgaugcgagccacg

SEQ ID NO: 2027040 - RNA, 12 nt, Human herpesvirus 5
gucgccaccugg

SEQ ID NO: 2027041 - RNA, 18 nt, Human herpesvirus 5
uaacaauuuuucuuuuuc

SEQ ID NO: 2027042 - RNA, 19 nt, Human herpesvirus 5
cgcuacaacgcgcgccuga

SEQ ID NO: 2027043 - RNA, 20 nt, Human herpesvirus 5
augggcgguggucggcugcc

SEQ ID NO: 2027044 - RNA, 16 nt, Human herpesvirus 5
gggcugagacaggacg

SEQ ID NO: 2027045 - RNA, 14 nt, Human herpesvirus 5
gaggaggccgcacu

SEQ ID NO: 2027046 - RNA, 12 nt, Human herpesvirus 5
gcgacagacauc

SEQ ID NO: 2027047 - RNA, 21 nt, Human herpesvirus 5
ccucgcugggcuacaagugca

SEQ ID NO: 2027048 - RNA, 17 nt, Human herpesvirus 5
ggcccgcuggcucggcg

SEQ ID NO: 2027049 - RNA, 18 nt, Human herpesvirus 5
aguugcaaaagaagcugc

SEQ ID NO: 2027050 - RNA, 23 nt, Human herpesvirus 5
ugcugcugguuuuugcccccucc

SEQ ID NO: 2027051 - RNA, 14 nt, Human herpesvirus 5
acgggccgcgcucc

SEQ ID NO: 2027052 - RNA, 20 nt, Human herpesvirus 5
uauugggaagggugugacug

SEQ ID NO: 2027053 - RNA, 17 nt, Human herpesvirus 5
uguagcgggcugucaca

SEQ ID NO: 2027054 - RNA, 23 nt, Human herpesvirus 5
gcgaccgucuggagguggccugc

SEQ ID NO: 2027055 - RNA, 15 nt, Human herpesvirus 5
aaguccccccacgga

SEQ ID NO: 2027056 - RNA, 20 nt, Human herpesvirus 5
cgguauggcugcgcgccucc

SEQ ID NO: 2027057 - RNA, 15 nt, Human herpesvirus 5
cuguugaccugggua

SEQ ID NO: 2027058 - RNA, 16 nt, Human herpesvirus 5
ucgcgguggcggccgc

SEQ ID NO: 2027059 - RNA, 11 nt, Human herpesvirus 5
auaagcaccgu

SEQ ID NO: 2027060 - RNA, 17 nt, Human herpesvirus 5
agcaugcugugggccca

SEQ ID NO: 2027061 - RNA, 23 nt, Human herpesvirus 5
gccagugauaaguaccagacauc

SEQ ID NO: 2027062 - RNA, 18 nt, Human herpesvirus 5
acuuuuacaugaacaaaa

SEQ ID NO: 2027063 - RNA, 13 nt, Human herpesvirus 5
ccuuggcgcucug

SEQ ID NO: 2027064 - RNA, 16 nt, Human herpesvirus 5
ggcaacucgagauggu

SEQ ID NO: 2027065 - RNA, 23 nt, Human herpesvirus 5
gcgucguguaauccacgacucgc

SEQ ID NO: 2027066 - RNA, 19 nt, Human herpesvirus 5
gcggcgugauugcaaagcc

SEQ ID NO: 2027067 - RNA, 17 nt, Human herpesvirus 5
accggcgccugcugcuc

SEQ ID NO: 2027068 - RNA, 16 nt, Human herpesvirus 5
gcguucgcccugucug

SEQ ID NO: 2027069 - RNA, 17 nt, Human herpesvirus 5
cuccaucuauuggcaga

SEQ ID NO: 2027070 - RNA, 11 nt, Human herpesvirus 5
gguugcagcuu

SEQ ID NO: 2027071 - RNA, 11 nt, Human herpesvirus 5
ccgcagccacg

SEQ ID NO: 2027072 - RNA, 18 nt, Human herpesvirus 5
cgcaacaacagcagcaac

SEQ ID NO: 2027073 - RNA, 16 nt, Human herpesvirus 5
gcaucgccugcaccuc

SEQ ID NO: 2027074 - RNA, 21 nt, Human herpesvirus 5
augucauuguuguuuacugaa

SEQ ID NO: 2027075 - RNA, 19 nt, Human herpesvirus 5
auauauggaguuuguguaa

SEQ ID NO: 2027076 - RNA, 19 nt, Human herpesvirus 5
ugagccggaaaaaccgcag

SEQ ID NO: 2027077 - RNA, 22 nt, Human herpesvirus 5
caaaucuccgcggcgguggccg

SEQ ID NO: 2027078 - RNA, 20 nt, Human herpesvirus 5
cugcggcggcuugggcagca

SEQ ID NO: 2027079 - RNA, 23 nt, Human herpesvirus 5
ggcugacgcggacgaggaacagc

SEQ ID NO: 2027080 - RNA, 19 nt, Human herpesvirus 5
cguaagcggcagcaugggc

SEQ ID NO: 2027081 - RNA, 17 nt, Human herpesvirus 5
cuccuccgcgaacggcg

SEQ ID NO: 2027082 - RNA, 19 nt, Human herpesvirus 5
gccugaggaaggggaggag

SEQ ID NO: 2027083 - RNA, 12 nt, Human herpesvirus 5
ugaugcugcuga

SEQ ID NO: 2027084 - RNA, 18 nt, Human herpesvirus 5
ugggauaccgcccgcaug

SEQ ID NO: 2027085 - RNA, 16 nt, Human herpesvirus 5
cagcgucacagagggc

SEQ ID NO: 2027086 - RNA, 18 nt, Human herpesvirus 5
ucaauaaucuccugagac

SEQ ID NO: 2027087 - RNA, 20 nt, Human herpesvirus 5
uuuuaucgucucaauaaaag

SEQ ID NO: 2027088 - RNA, 16 nt, Human herpesvirus 5
uggaacaagaaacaca

SEQ ID NO: 2027089 - RNA, 14 nt, Human herpesvirus 5
aggaggcaaauaua

SEQ ID NO: 2027090 - RNA, 15 nt, Human herpesvirus 5
accaccgagacgugc

SEQ ID NO: 2027091 - RNA, 21 nt, Human herpesvirus 5
ggcgcuguucuggauguauau

SEQ ID NO: 2027092 - RNA, 12 nt, Human herpesvirus 5
gcugcgcaggcc

SEQ ID NO: 2027093 - RNA, 16 nt, Human herpesvirus 5
agacccacuaccugga

SEQ ID NO: 2027094 - RNA, 19 nt, Human herpesvirus 5
gaacgcuacuucccccucc

SEQ ID NO: 2027095 - RNA, 23 nt, Human herpesvirus 5
cugacuucuacggaguuuucccu

SEQ ID NO: 2027096 - RNA, 18 nt, Human herpesvirus 5
ugacuaccuuguuuuuua

SEQ ID NO: 2027097 - RNA, 23 nt, Human herpesvirus 5
gcguauguuaucaucauggagcu

SEQ ID NO: 2027098 - RNA, 14 nt, Human herpesvirus 5
cggcucgccgcaga

SEQ ID NO: 2027099 - RNA, 23 nt, Human herpesvirus 5
cuuucuugacuggccggacggca

SEQ ID NO: 2027100 - RNA, 15 nt, Human herpesvirus 5
cagccccgucaaaac

SEQ ID NO: 2027101 - RNA, 14 nt, Human herpesvirus 5
gaugugcagcaucg

SEQ ID NO: 2027102 - RNA, 14 nt, Human herpesvirus 5
cuggcaacgugcca

SEQ ID NO: 2027103 - RNA, 15 nt, Human herpesvirus 5
ugguaggaggcgcgc

SEQ ID NO: 2027104 - RNA, 15 nt, Human herpesvirus 5
acgcgcgucggccgc

SEQ ID NO: 2027105 - RNA, 20 nt, Human herpesvirus 5
cauccucguggaaggcaccg

SEQ ID NO: 2027106 - RNA, 15 nt, Human herpesvirus 5
uaauuguccuucucc

SEQ ID NO: 2027107 - RNA, 17 nt, Human herpesvirus 5
aaggccaugagcggcag

SEQ ID NO: 2027108 - RNA, 15 nt, Human herpesvirus 5
ggcuggcgugcuguu

SEQ ID NO: 2027109 - RNA, 18 nt, Human herpesvirus 5
cagcaccccgcgucacuu

SEQ ID NO: 2027110 - RNA, 16 nt, Human herpesvirus 5
ccuacucaccaaagcc

SEQ ID NO: 2027111 - RNA, 17 nt, Human herpesvirus 5
ccugcgacggcgggugg

SEQ ID NO: 2027112 - RNA, 22 nt, Human herpesvirus 5
cgccagcgcggucgccaccugg

SEQ ID NO: 2027113 - RNA, 17 nt, Human herpesvirus 5
gcgacguaccagcuguc

SEQ ID NO: 2027114 - RNA, 16 nt, Human herpesvirus 5
gagccacggcuuggac

SEQ ID NO: 2027115 - RNA, 22 nt, Human herpesvirus 5
agaaaguuguccgcgggcaauu

SEQ ID NO: 2027116 - RNA, 22 nt, Human herpesvirus 5
cggugucuccucgcgaggcuga

SEQ ID NO: 2027117 - RNA, 14 nt, Human herpesvirus 5
ccaaaaccaugcua

SEQ ID NO: 2027118 - RNA, 22 nt, Human herpesvirus 5
gccuccgaacgcucgugagcaa

SEQ ID NO: 2027119 - RNA, 14 nt, Human herpesvirus 5
aggccguggagaug

SEQ ID NO: 2027120 - RNA, 15 nt, Human herpesvirus 5
ucuguucuuccacca

SEQ ID NO: 2027121 - RNA, 13 nt, Human herpesvirus 5
cggugcaggccgc

SEQ ID NO: 2027122 - RNA, 13 nt, Human herpesvirus 5
ucugccucuuccu

SEQ ID NO: 2027123 - RNA, 16 nt, Human herpesvirus 5
gcccgucggcugccug

SEQ ID NO: 2027124 - RNA, 12 nt, Human herpesvirus 5
cgugggccagga

SEQ ID NO: 2027125 - RNA, 17 nt, Human herpesvirus 5
caguugggaccgcagcg

SEQ ID NO: 2027126 - RNA, 21 nt, Human herpesvirus 5
gccucgauccauccuggggaa

SEQ ID NO: 2027127 - RNA, 22 nt, Human herpesvirus 5
gcccgacgugauuuacgagguc

SEQ ID NO: 2027128 - RNA, 16 nt, Human herpesvirus 5
auauaaauugggaaag

SEQ ID NO: 2027129 - RNA, 15 nt, Human herpesvirus 5
uccuucaugauggag

SEQ ID NO: 2027130 - RNA, 17 nt, Human herpesvirus 5
agaaaccgcauguguug

SEQ ID NO: 2027131 - RNA, 10 nt, Human herpesvirus 5
gucacuuccc

SEQ ID NO: 2027132 - RNA, 21 nt, Human herpesvirus 5
acguguuucaaacagcacauu

SEQ ID NO: 2027133 - RNA, 13 nt, Human herpesvirus 5
cugggccacaggg

SEQ ID NO: 2027134 - RNA, 14 nt, Human herpesvirus 5
cugcgggucauggg

SEQ ID NO: 2027135 - RNA, 21 nt, Human herpesvirus 5
acgaugugagagccaccuugg

SEQ ID NO: 2027136 - RNA, 20 nt, Human herpesvirus 5
cggcggcuguucgacagcgg

SEQ ID NO: 2027137 - RNA, 12 nt, Human herpesvirus 5
gauaagcgcuuu

SEQ ID NO: 2027138 - RNA, 18 nt, Human herpesvirus 5
cggaggacgcagaauaaa

SEQ ID NO: 2027139 - RNA, 15 nt, Human herpesvirus 5
cuagcuacuuuggaa

SEQ ID NO: 2027140 - RNA, 18 nt, Human herpesvirus 5
gcacgcgauuggccagca

SEQ ID NO: 2027141 - RNA, 15 nt, Human herpesvirus 5
gugcuacgagaucag

SEQ ID NO: 2027142 - RNA, 13 nt, Human herpesvirus 5
cugcacgcucugu

SEQ ID NO: 2027143 - RNA, 13 nt, Human herpesvirus 5
aggaguggcugcu

SEQ ID NO: 2027144 - RNA, 23 nt, Human herpesvirus 5
caaguauuuaugacggacacgga

SEQ ID NO: 2027145 - RNA, 19 nt, Human herpesvirus 5
gcgccgccaacgcgagcug

SEQ ID NO: 2027146 - RNA, 15 nt, Human herpesvirus 5
ugagaagcacggaga

SEQ ID NO: 2027147 - RNA, 12 nt, Human herpesvirus 5
guaccuacggac

SEQ ID NO: 2027148 - RNA, 14 nt, Human herpesvirus 5
agaaugcugcucag

SEQ ID NO: 2027149 - RNA, 19 nt, Human herpesvirus 5
cgcggccugcugcgcaaua

SEQ ID NO: 2027150 - RNA, 21 nt, Human herpesvirus 5
aggaaccaccguagcacugcg

SEQ ID NO: 2027151 - RNA, 21 nt, Human herpesvirus 5
caaacgcgugcgggugcauga

SEQ ID NO: 2027152 - RNA, 15 nt, Human herpesvirus 5
gugucagacacagcc

SEQ ID NO: 2027153 - RNA, 15 nt, Human herpesvirus 5
augagcgugcugcuc

SEQ ID NO: 2027154 - RNA, 13 nt, Human herpesvirus 5
ccgacaaccugcu

SEQ ID NO: 2027155 - RNA, 15 nt, Human herpesvirus 5
gcugguuuccccugc

SEQ ID NO: 2027156 - RNA, 14 nt, Human herpesvirus 5
cgcccgcgccucac

SEQ ID NO: 2027157 - RNA, 17 nt, Human herpesvirus 5
ccgcugugcuggccgcc

SEQ ID NO: 2027158 - RNA, 15 nt, Human herpesvirus 5
gcaccaugccggagc

SEQ ID NO: 2027159 - RNA, 22 nt, Human herpesvirus 5
gcuggaaguggaagcggugcug

SEQ ID NO: 2027160 - RNA, 15 nt, Human herpesvirus 5
cgcaggagcugcugc

SEQ ID NO: 2027161 - RNA, 16 nt, Human herpesvirus 5
ugagccggggugccgc

SEQ ID NO: 2027162 - RNA, 13 nt, Human herpesvirus 5
uccucgucgccuu

SEQ ID NO: 2027163 - RNA, 24 nt, Human herpesvirus 5
ggaaugucagaugacgagcgccgg

SEQ ID NO: 2027164 - RNA, 16 nt, Human herpesvirus 5
agccaccgacacagca

SEQ ID NO: 2027165 - RNA, 14 nt, Human herpesvirus 5
gaacucagaggcca

SEQ ID NO: 2027166 - RNA, 14 nt, Human herpesvirus 5
caacggcuggagga

SEQ ID NO: 2027167 - RNA, 17 nt, Human herpesvirus 5
cucaagucgcguccggg

SEQ ID NO: 2027168 - RNA, 15 nt, Human herpesvirus 5
uucggcucuccuccg

SEQ ID NO: 2027169 - RNA, 15 nt, Human herpesvirus 5
uuaugaagcugaaca

SEQ ID NO: 2027170 - RNA, 16 nt, Human herpesvirus 5
uaaagaaucuaggaac

SEQ ID NO: 2027171 - RNA, 17 nt, Human herpesvirus 5
uaacccaaaaccaugcu

SEQ ID NO: 2027172 - RNA, 14 nt, Human herpesvirus 5
cgcggcgcguuguc

SEQ ID NO: 2027173 - RNA, 15 nt, Human herpesvirus 5
auugcgggcccugcu

SEQ ID NO: 2027174 - RNA, 16 nt, Human herpesvirus 5
cgggccucggcuuggc

SEQ ID NO: 2027175 - RNA, 15 nt, Human herpesvirus 5
guggagagggaaggu

SEQ ID NO: 2027176 - RNA, 22 nt, Human herpesvirus 5
uguuggccaccaugcugagcaa

SEQ ID NO: 2027177 - RNA, 14 nt, Human herpesvirus 5
agauucuaaagcca

SEQ ID NO: 2027178 - RNA, 16 nt, Human herpesvirus 5
gccgcgcgagcgugcg

SEQ ID NO: 2027179 - RNA, 19 nt, Human herpesvirus 5
cggcuaacaaagcccgggc

SEQ ID NO: 2027180 - RNA, 21 nt, Human herpesvirus 5
aagugcgucuacgaccaaagc

SEQ ID NO: 2027181 - RNA, 12 nt, Human herpesvirus 5
augcgagcgggg

SEQ ID NO: 2027182 - RNA, 17 nt, Human herpesvirus 5
ggugcgggugccgggac

SEQ ID NO: 2027183 - RNA, 22 nt, Human herpesvirus 5
ucccgcauagccucuacaaacu

SEQ ID NO: 2027184 - RNA, 15 nt, Human herpesvirus 5
gcgaccgucuggagg

SEQ ID NO: 2027185 - RNA, 18 nt, Human herpesvirus 5
cuucggucucgggcucgc

SEQ ID NO: 2027186 - RNA, 18 nt, Human herpesvirus 5
gccccucacgucaguguu

SEQ ID NO: 2027187 - RNA, 14 nt, Human herpesvirus 5
gcagcucgcgcugg

SEQ ID NO: 2027188 - RNA, 13 nt, Human herpesvirus 5
gucggcugccugu

SEQ ID NO: 2027189 - RNA, 12 nt, Human herpesvirus 5
ggcguucugcuc

SEQ ID NO: 2027190 - RNA, 21 nt, Human herpesvirus 5
ugcacccccgauaugggccgc

SEQ ID NO: 2027191 - RNA, 13 nt, Human herpesvirus 5
agaagcacggaga

SEQ ID NO: 2027192 - RNA, 15 nt, Human herpesvirus 5
ucaccacucccacca

SEQ ID NO: 2027193 - RNA, 13 nt, Human herpesvirus 5
cgcgcccacugga

SEQ ID NO: 2027194 - RNA, 20 nt, Human herpesvirus 5
guaccuagcuacuuuggaau

SEQ ID NO: 2027195 - RNA, 19 nt, Human herpesvirus 5
gcgcagcgccagccuuagc

SEQ ID NO: 2027196 - RNA, 14 nt, Human herpesvirus 5
aaaccgagcaagca

SEQ ID NO: 2027197 - RNA, 13 nt, Human herpesvirus 5
gauaaacgucacg

SEQ ID NO: 2027198 - RNA, 12 nt, Human herpesvirus 5
cggucuguucag

SEQ ID NO: 2027199 - RNA, 16 nt, Human herpesvirus 5
uaagcgcgaccggcag

SEQ ID NO: 2027200 - RNA, 14 nt, Human herpesvirus 5
gcugcgcaggccgc

SEQ ID NO: 2027201 - RNA, 19 nt, Human herpesvirus 5
uacagccuugagaaccugc

SEQ ID NO: 2027202 - RNA, 12 nt, Human herpesvirus 5
uaaaaaggcaau

SEQ ID NO: 2027203 - RNA, 14 nt, Human herpesvirus 5
caggagcugcugcu

SEQ ID NO: 2027204 - RNA, 20 nt, Human herpesvirus 5
aaagccgacaaccugcugca

SEQ ID NO: 2027205 - RNA, 19 nt, Human herpesvirus 5
cuuuuggugcgccacguag

SEQ ID NO: 2027206 - RNA, 14 nt, Human herpesvirus 5
agccugccgccggc

SEQ ID NO: 2027207 - RNA, 14 nt, Human herpesvirus 5
caaaagccugggua

SEQ ID NO: 2027208 - RNA, 15 nt, Human herpesvirus 5
gugacgucaaucaaa

SEQ ID NO: 2027209 - RNA, 15 nt, Human herpesvirus 5
cucguucccagcgcg

SEQ ID NO: 2027210 - RNA, 19 nt, Human herpesvirus 5
ccgccgaagccuggggcac

SEQ ID NO: 2027211 - RNA, 16 nt, Human herpesvirus 5
ugugcuuaagcagaaa

SEQ ID NO: 2027212 - RNA, 20 nt, Human herpesvirus 5
accaugugcaaaaacuuguc

SEQ ID NO: 2027213 - RNA, 15 nt, Human herpesvirus 5
acagcucaugccucu

SEQ ID NO: 2027214 - RNA, 20 nt, Human herpesvirus 5
cguuauguuucgaaaacuug

SEQ ID NO: 2027215 - RNA, 19 nt, Human herpesvirus 5
cgcggcaacucgagauggu

SEQ ID NO: 2027216 - RNA, 18 nt, Human herpesvirus 5
ggugcgggagacuagguc

SEQ ID NO: 2027217 - RNA, 21 nt, Human herpesvirus 5
ggcgauacgccggugcugccg

SEQ ID NO: 2027218 - RNA, 21 nt, Human herpesvirus 5
aguuguggcaaagagccaugu

SEQ ID NO: 2027219 - RNA, 12 nt, Human herpesvirus 5
gucgcagccccc

SEQ ID NO: 2027220 - RNA, 13 nt, Human herpesvirus 5
auaaccuaccugg

SEQ ID NO: 2027221 - RNA, 19 nt, Human herpesvirus 5
ccagcuuaccgccaccguc

SEQ ID NO: 2027222 - RNA, 18 nt, Human herpesvirus 5
ccaucuagacucacuuua

SEQ ID NO: 2027223 - RNA, 17 nt, Human herpesvirus 5
cgcggcgacaagcugug

SEQ ID NO: 2027224 - RNA, 15 nt, Human herpesvirus 5
uccagcacaaaaaac

SEQ ID NO: 2027225 - RNA, 22 nt, Human herpesvirus 5
cuaccuagaugcuagcaauaau

SEQ ID NO: 2027226 - RNA, 14 nt, Human herpesvirus 5
ucaccugcagcgcu

SEQ ID NO: 2027227 - RNA, 23 nt, Human herpesvirus 5
acgacccaccgccgcuuucucau

SEQ ID NO: 2027228 - RNA, 13 nt, Human herpesvirus 5
cacaugggcccgu

SEQ ID NO: 2027229 - RNA, 18 nt, Human herpesvirus 5
cgggcucaccgcaguugc

SEQ ID NO: 2027230 - RNA, 13 nt, Human herpesvirus 5
ggcgguccuccag

SEQ ID NO: 2027231 - RNA, 15 nt, Human herpesvirus 5
caacgucaugcauuc

SEQ ID NO: 2027232 - RNA, 19 nt, Human herpesvirus 5
uaccagacgcgauggcccg

SEQ ID NO: 2027233 - RNA, 24 nt, Human herpesvirus 5
aacgacagugucggugugguagcu

SEQ ID NO: 2027234 - RNA, 22 nt, Human herpesvirus 5
gaggucgcgcguacggacgagu

SEQ ID NO: 2027235 - RNA, 14 nt, Human herpesvirus 5
cagaggacggagga

SEQ ID NO: 2027236 - RNA, 15 nt, Human herpesvirus 5
uccuuaucugggugc

SEQ ID NO: 2027237 - RNA, 15 nt, Human herpesvirus 5
cgaggaggccgcacu

SEQ ID NO: 2027238 - RNA, 16 nt, Human herpesvirus 5
cuaacuagccuucccg

SEQ ID NO: 2027239 - RNA, 22 nt, Human herpesvirus 5
acguacgacugcgcggccugcu

SEQ ID NO: 2027240 - RNA, 14 nt, Human herpesvirus 5
aaaacauaagaaua

SEQ ID NO: 2027241 - RNA, 20 nt, Human herpesvirus 5
ucagcuggcuuucagcuucg

SEQ ID NO: 2027242 - RNA, 19 nt, Human herpesvirus 5
gccgccgucgcgccuuccu

SEQ ID NO: 2027243 - RNA, 20 nt, Human herpesvirus 5
aucugggagguggcugggcu

SEQ ID NO: 2027244 - RNA, 15 nt, Human herpesvirus 5
cccgggccgccgcca

SEQ ID NO: 2027245 - RNA, 20 nt, Human herpesvirus 5
guguacgccaucuucaucuu

SEQ ID NO: 2027246 - RNA, 21 nt, Human herpesvirus 5
gcuccgcgucgcuucgccgcc

SEQ ID NO: 2027247 - RNA, 15 nt, Human herpesvirus 5
ggagaaaagagauga

SEQ ID NO: 2027248 - RNA, 21 nt, Human herpesvirus 5
ccgccgaagcuucgcgcgccg

SEQ ID NO: 2027249 - RNA, 22 nt, Human herpesvirus 5
caaggagcgacguaccagcugu

SEQ ID NO: 2027250 - RNA, 14 nt, Human herpesvirus 5
gccgaucaugugcu

SEQ ID NO: 2027251 - RNA, 22 nt, Human herpesvirus 5
uuccaugacgcgccucauggcg

SEQ ID NO: 2027252 - RNA, 19 nt, Human herpesvirus 5
gugcaucgcuucgagguug

SEQ ID NO: 2027253 - RNA, 12 nt, Human herpesvirus 5
ucacccgccuca

SEQ ID NO: 2027254 - RNA, 17 nt, Human herpesvirus 5
gcacuugucauuaaaca

SEQ ID NO: 2027255 - RNA, 18 nt, Human herpesvirus 5
acgcaguugagcggggua

SEQ ID NO: 2027256 - RNA, 22 nt, Human herpesvirus 5
gacgucggugguggcuguaggc

SEQ ID NO: 2027257 - RNA, 23 nt, Human herpesvirus 5
guaucugagcggcggcgugaccg

SEQ ID NO: 2027258 - RNA, 12 nt, Human herpesvirus 5
ccggaggagcgu

SEQ ID NO: 2027259 - RNA, 15 nt, Human herpesvirus 5
gcuugcuccucuucc

SEQ ID NO: 2027260 - RNA, 20 nt, Human herpesvirus 5
cuccagcagcagcuggugca

SEQ ID NO: 2027261 - RNA, 17 nt, Human herpesvirus 5
agccggucaucuccgag

SEQ ID NO: 2027262 - RNA, 17 nt, Human herpesvirus 5
gacaucccccugcacgu

SEQ ID NO: 2027263 - RNA, 20 nt, Human herpesvirus 5
caaccauuggcaacaucacc

SEQ ID NO: 2027264 - RNA, 17 nt, Human herpesvirus 5
ugcaaaguuauccuguu

SEQ ID NO: 2027265 - RNA, 21 nt, Human herpesvirus 5
cggcgaauggaucaucuguuu

SEQ ID NO: 2027266 - RNA, 16 nt, Human herpesvirus 5
cgacguggccuccucg

SEQ ID NO: 2027267 - RNA, 23 nt, Human herpesvirus 5
ccagcuaucaggccagcugcguc

SEQ ID NO: 2027268 - RNA, 20 nt, Human herpesvirus 5
agcgccaggcggcugaucug

SEQ ID NO: 2027269 - RNA, 16 nt, Human herpesvirus 5
cgagaugguguacccg

SEQ ID NO: 2027270 - RNA, 20 nt, Human herpesvirus 5
ugacgucgcggcaccaggaa

SEQ ID NO: 2027271 - RNA, 15 nt, Human herpesvirus 5
uuccauaauaaaagu

SEQ ID NO: 2027272 - RNA, 20 nt, Human herpesvirus 5
cuacucacaauggaagccau

SEQ ID NO: 2027273 - RNA, 16 nt, Human herpesvirus 5
auacgcuagcagaaga

SEQ ID NO: 2027274 - RNA, 15 nt, Human herpesvirus 5
cucggaucugcggcu

SEQ ID NO: 2027275 - RNA, 20 nt, Human herpesvirus 5
gucggcaagccgagcgggag

SEQ ID NO: 2027276 - RNA, 15 nt, Human herpesvirus 5
cuccgcuugcugcga

SEQ ID NO: 2027277 - RNA, 13 nt, Human herpesvirus 5
ugcucucuuagug

SEQ ID NO: 2027278 - RNA, 14 nt, Human herpesvirus 5
gcgucacagagggc

SEQ ID NO: 2027279 - RNA, 13 nt, Human herpesvirus 5
acagcggcucgcc

SEQ ID NO: 2027280 - RNA, 17 nt, Human herpesvirus 5
agcgacgucaacggugg

SEQ ID NO: 2027281 - RNA, 19 nt, Human herpesvirus 5
ugaacaccuuuuugcugca

SEQ ID NO: 2027282 - RNA, 22 nt, Human herpesvirus 5
uccgguggcgcguagccaccug

SEQ ID NO: 2027283 - RNA, 13 nt, Human herpesvirus 5
ccaaggcgagcca

SEQ ID NO: 2027284 - RNA, 15 nt, Human herpesvirus 5
uagcgcuccuggauc

SEQ ID NO: 2027285 - RNA, 19 nt, Human herpesvirus 5
cuggggcugcugcugcacg

SEQ ID NO: 2027286 - RNA, 11 nt, Human herpesvirus 5
cuuugcugcua

SEQ ID NO: 2027287 - RNA, 16 nt, Human herpesvirus 5
uaaccgagcugaagga

SEQ ID NO: 2027288 - RNA, 19 nt, Human herpesvirus 5
uccaccacggcugcugauc

SEQ ID NO: 2027289 - RNA, 21 nt, Human herpesvirus 5
gcucagcugguggcucaugcc

SEQ ID NO: 2027290 - RNA, 23 nt, Human herpesvirus 5
gaacugguuuucggacagagcag

SEQ ID NO: 2027291 - RNA, 14 nt, Human herpesvirus 5
cgugacgcagucug

SEQ ID NO: 2027292 - RNA, 15 nt, Human herpesvirus 5
guagaucccacuggc

SEQ ID NO: 2027293 - RNA, 18 nt, Human herpesvirus 5
agucgcgccuugggacac

SEQ ID NO: 2027294 - RNA, 23 nt, Human herpesvirus 5
ugaggagcucacccggcugcugg

SEQ ID NO: 2027295 - RNA, 22 nt, Human herpesvirus 5
gguugaaacgcuuuaagcugcu

SEQ ID NO: 2027296 - RNA, 22 nt, Human herpesvirus 5
gccgcaaugggcuucccuccug

SEQ ID NO: 2027297 - RNA, 16 nt, Human herpesvirus 5
uggacaugauggaaau

SEQ ID NO: 2027298 - RNA, 19 nt, Human herpesvirus 5
acagcaacaacagucgcag

SEQ ID NO: 2027299 - RNA, 20 nt, Human herpesvirus 5
ccugcagcgcuacgugcgcg

SEQ ID NO: 2027300 - RNA, 14 nt, Human herpesvirus 5
ccggcguggcggcc

SEQ ID NO: 2027301 - RNA, 21 nt, Human herpesvirus 5
uggagaaaccgccguucggcu

SEQ ID NO: 2027302 - RNA, 20 nt, Human herpesvirus 5
cuggugagauacauguucau

SEQ ID NO: 2027303 - RNA, 16 nt, Human herpesvirus 5
uaucuggggaggaggu

SEQ ID NO: 2027304 - RNA, 11 nt, Human herpesvirus 5
gagcaggccau

SEQ ID NO: 2027305 - RNA, 20 nt, Human herpesvirus 5
acaucuccgucucuggucuc

SEQ ID NO: 2027306 - RNA, 13 nt, Human herpesvirus 5
cgccgcgcccguc

SEQ ID NO: 2027307 - RNA, 19 nt, Human herpesvirus 5
gcagcugcuggagcgcggc

SEQ ID NO: 2027308 - RNA, 17 nt, Human herpesvirus 5
cgcuaaaggugcaugac

SEQ ID NO: 2027309 - RNA, 15 nt, Human herpesvirus 5
cuccucugccugggc

SEQ ID NO: 2027310 - RNA, 23 nt, Human herpesvirus 5
ccagccccgucaaaacacacgcg

SEQ ID NO: 2027311 - RNA, 13 nt, Human herpesvirus 5
agcacaccugccu

SEQ ID NO: 2027312 - RNA, 19 nt, Human herpesvirus 5
gcaccccgaacuggagcuc

SEQ ID NO: 2027313 - RNA, 22 nt, Human herpesvirus 5
ugggcugugguucauguuucug

SEQ ID NO: 2027314 - RNA, 22 nt, Human herpesvirus 5
gauucugagggccgauggcugc

SEQ ID NO: 2027315 - RNA, 24 nt, Human herpesvirus 5
guaacacacggccagcuccacgcu

SEQ ID NO: 2027316 - RNA, 22 nt, Human herpesvirus 5
gaaaacguacgugaucacggac

SEQ ID NO: 2027317 - RNA, 18 nt, Human herpesvirus 5
auuuuaugcgccgccagc

SEQ ID NO: 2027318 - RNA, 18 nt, Human herpesvirus 5
aaacauuuguugagucau

SEQ ID NO: 2027319 - RNA, 17 nt, Human herpesvirus 5
aucgacugccuaacugu

SEQ ID NO: 2027320 - RNA, 15 nt, Human herpesvirus 5
aggcgccgcaaacau

SEQ ID NO: 2027321 - RNA, 14 nt, Human herpesvirus 5
gcgccugcugcucg

SEQ ID NO: 2027322 - RNA, 16 nt, Human herpesvirus 5
agcccguggcccagga

SEQ ID NO: 2027323 - RNA, 17 nt, Human herpesvirus 5
acgccaacuccgugcca

SEQ ID NO: 2027324 - RNA, 19 nt, Human herpesvirus 5
gccagcgcgagcgcucggc

SEQ ID NO: 2027325 - RNA, 19 nt, Human herpesvirus 5
agccuucccuuguaagaca

SEQ ID NO: 2027326 - RNA, 13 nt, Human herpesvirus 5
gcccgucggcugc

SEQ ID NO: 2027327 - RNA, 18 nt, Human herpesvirus 5
uuaucugccucuuccucg

SEQ ID NO: 2027328 - RNA, 18 nt, Human herpesvirus 5
ugguagcuagugcagccu

SEQ ID NO: 2027329 - RNA, 16 nt, Human herpesvirus 5
agagaaacccccaccc

SEQ ID NO: 2027330 - RNA, 13 nt, Human herpesvirus 5
cggacgggcagga

SEQ ID NO: 2027331 - RNA, 17 nt, Human herpesvirus 5
cgguaccgucuccacca

SEQ ID NO: 2027332 - RNA, 12 nt, Human herpesvirus 5
ucgcgagcccca

SEQ ID NO: 2027333 - RNA, 16 nt, Human herpesvirus 5
gccaacaugcccagca

SEQ ID NO: 2027334 - RNA, 17 nt, Human herpesvirus 5
gaggucuaucacgggcu

SEQ ID NO: 2027335 - RNA, 13 nt, Human herpesvirus 5
agccgagcgggag

SEQ ID NO: 2027336 - RNA, 22 nt, Human herpesvirus 5
cgcuggccgauccacgggccgc

SEQ ID NO: 2027337 - RNA, 20 nt, Human herpesvirus 5
ucuguaaaagcugcaugaaa

SEQ ID NO: 2027338 - RNA, 15 nt, Human herpesvirus 5
auguuacacauuacu

SEQ ID NO: 2027339 - RNA, 15 nt, Human herpesvirus 5
gaugaauuguuacca

SEQ ID NO: 2027340 - RNA, 12 nt, Human herpesvirus 5
gcaacauguguu

SEQ ID NO: 2027341 - RNA, 20 nt, Human herpesvirus 5
gcgagcggcggacuuggcag

SEQ ID NO: 2027342 - RNA, 13 nt, Human herpesvirus 5
auuuagaaacacc

SEQ ID NO: 2027343 - RNA, 23 nt, Human herpesvirus 5
aaaauaugggaauuccccugccu

SEQ ID NO: 2027344 - RNA, 14 nt, Human herpesvirus 5
gaccgaggcgcugg

SEQ ID NO: 2027345 - RNA, 14 nt, Human herpesvirus 5
aaaucuacacugaa

SEQ ID NO: 2027346 - RNA, 14 nt, Human herpesvirus 5
cuugucgccaugcu

SEQ ID NO: 2027347 - RNA, 22 nt, Human herpesvirus 5
cacuuuaggcggcgcagcgcca

SEQ ID NO: 2027348 - RNA, 16 nt, Human herpesvirus 5
ccuccgucgcggccag

SEQ ID NO: 2027349 - RNA, 15 nt, Human herpesvirus 5
ggugucuagcuggcg

SEQ ID NO: 2027350 - RNA, 14 nt, Human herpesvirus 5
gacccgccgccgcc

SEQ ID NO: 2027351 - RNA, 22 nt, Human herpesvirus 5
agaccgaugugugggaccuggu

SEQ ID NO: 2027352 - RNA, 20 nt, Human herpesvirus 5
aguggucuuucacaucgcca

SEQ ID NO: 2027353 - RNA, 15 nt, Human herpesvirus 5
uaaugcauuaucauc

SEQ ID NO: 2027354 - RNA, 13 nt, Human herpesvirus 5
gaagcugcgcagg

SEQ ID NO: 2027355 - RNA, 22 nt, Human herpesvirus 5
gcaacaacagucgcagcccccg

SEQ ID NO: 2027356 - RNA, 18 nt, Human herpesvirus 5
gucggccgaucgcgccgc

SEQ ID NO: 2027357 - RNA, 14 nt, Human herpesvirus 5
cugcgugcuccgau

SEQ ID NO: 2027358 - RNA, 13 nt, Human herpesvirus 5
cugucaccaccac

SEQ ID NO: 2027359 - RNA, 20 nt, Human herpesvirus 5
cgcccucagcgugcucagcu

SEQ ID NO: 2027360 - RNA, 21 nt, Human herpesvirus 5
caggaggcugugcgcgccggc

SEQ ID NO: 2027361 - RNA, 19 nt, Human herpesvirus 5
cacggucugcuugcuggcu

SEQ ID NO: 2027362 - RNA, 11 nt, Human herpesvirus 5
ucguccagcag

SEQ ID NO: 2027363 - RNA, 13 nt, Human herpesvirus 5
uaaggagcucuga

SEQ ID NO: 2027364 - RNA, 16 nt, Human herpesvirus 5
cccgcacacuggcugg

SEQ ID NO: 2027365 - RNA, 13 nt, Human herpesvirus 5
gggcgauucugug

SEQ ID NO: 2027366 - RNA, 15 nt, Human herpesvirus 5
gugcugggucagugc

SEQ ID NO: 2027367 - RNA, 23 nt, Human herpesvirus 5
accggccuccgacgacgccgagg

SEQ ID NO: 2027368 - RNA, 21 nt, Human herpesvirus 5
ugcacggcaucaugcugggcg

SEQ ID NO: 2027369 - RNA, 22 nt, Human herpesvirus 5
ggaaugcggucaguuggggagu

SEQ ID NO: 2027370 - RNA, 13 nt, Human herpesvirus 5
ccucgcgccgccc

SEQ ID NO: 2027371 - RNA, 21 nt, Human herpesvirus 5
cagcuaccgccgcaacagcgg

SEQ ID NO: 2027372 - RNA, 17 nt, Human herpesvirus 5
cgucgauucccaucuca

SEQ ID NO: 2027373 - RNA, 14 nt, Human herpesvirus 5
ccguuuugcugucc

SEQ ID NO: 2027374 - RNA, 16 nt, Human herpesvirus 5
ccugugguagaaugcu

SEQ ID NO: 2027375 - RNA, 19 nt, Human herpesvirus 5
ccacaagaaacgcuggaaa

SEQ ID NO: 2027376 - RNA, 16 nt, Human herpesvirus 5
gcgagagaugggccgc

SEQ ID NO: 2027377 - RNA, 13 nt, Human herpesvirus 5
gaguccuggucuu

SEQ ID NO: 2027378 - RNA, 17 nt, Human herpesvirus 5
agcagccgacacagcgg

SEQ ID NO: 2027379 - RNA, 17 nt, Human herpesvirus 5
gucaugccuuggcgcuc

SEQ ID NO: 2027380 - RNA, 16 nt, Human herpesvirus 5
cgggagucuaccuccu

SEQ ID NO: 2027381 - RNA, 12 nt, Human herpesvirus 5
ucgcgcgucacu

SEQ ID NO: 2027382 - RNA, 17 nt, Human herpesvirus 5
uccuccucuuccucagu

SEQ ID NO: 2027383 - RNA, 21 nt, Human herpesvirus 5
gguaucucacaccgucagcug

SEQ ID NO: 2027384 - RNA, 15 nt, Human herpesvirus 5
cugcacguggccugg

SEQ ID NO: 2027385 - RNA, 13 nt, Human herpesvirus 5
uagcgcucaaagg

SEQ ID NO: 2027386 - RNA, 18 nt, Human herpesvirus 5
gccgcucauaaugccguc

SEQ ID NO: 2027387 - RNA, 17 nt, Human herpesvirus 5
ucagaccgcaacaacag

SEQ ID NO: 2027388 - RNA, 23 nt, Human herpesvirus 5
gcaagacuacaugcuauaagaca

SEQ ID NO: 2027389 - RNA, 18 nt, Human herpesvirus 5
caugcuauaagacagccu

SEQ ID NO: 2027390 - RNA, 22 nt, Human herpesvirus 5
gaucgccgucacuaaggaccga

SEQ ID NO: 2027391 - RNA, 22 nt, Human herpesvirus 5
ggcggcgaucgcagccuccucg

SEQ ID NO: 2027392 - RNA, 16 nt, Human herpesvirus 5
aucuggcggccgccgg

SEQ ID NO: 2027393 - RNA, 16 nt, Human herpesvirus 5
acugggagacggccug

SEQ ID NO: 2027394 - RNA, 19 nt, Human herpesvirus 5
ucgcgcaucgccugcaccu

SEQ ID NO: 2027395 - RNA, 17 nt, Human herpesvirus 5
uccacgucuucaaagua

SEQ ID NO: 2027396 - RNA, 15 nt, Human herpesvirus 5
guucgucucugccuc

SEQ ID NO: 2027397 - RNA, 20 nt, Human herpesvirus 5
cagcggccgccggugcuucu

SEQ ID NO: 2027398 - RNA, 14 nt, Human herpesvirus 5
caauuccccucgcc

SEQ ID NO: 2027399 - RNA, 22 nt, Human herpesvirus 5
cggcgguggagggcgcgcggca

SEQ ID NO: 2027400 - RNA, 22 nt, Human herpesvirus 5
acuggacucgguuucgcuguag

SEQ ID NO: 2027401 - RNA, 19 nt, Human herpesvirus 5
gucauguucucccaggacc

SEQ ID NO: 2027402 - RNA, 14 nt, Human herpesvirus 5
ggcgcccgcgacgu

SEQ ID NO: 2027403 - RNA, 23 nt, Human herpesvirus 5
acaaugugcugcaugagaacacg

SEQ ID NO: 2027404 - RNA, 20 nt, Human herpesvirus 5
gcuccaagugcaagcgccgc

SEQ ID NO: 2027405 - RNA, 22 nt, Human herpesvirus 5
ggcuguucacgcggaggacagc

SEQ ID NO: 2027406 - RNA, 18 nt, Human herpesvirus 5
ugcuucuaccaccuuugu

SEQ ID NO: 2027407 - RNA, 21 nt, Human herpesvirus 5
uccccgcaaacucccacuccu

SEQ ID NO: 2027408 - RNA, 16 nt, Human herpesvirus 5
gcgaauaagcgcgacc

SEQ ID NO: 2027409 - RNA, 19 nt, Human herpesvirus 5
aggccgagacgcugcgcua

SEQ ID NO: 2027410 - RNA, 23 nt, Human herpesvirus 5
agaggaggaugggggggaccggg

SEQ ID NO: 2027411 - RNA, 22 nt, Human herpesvirus 5
ucacgaucgcuggugucucugc

SEQ ID NO: 2027412 - RNA, 15 nt, Human herpesvirus 5
uggcguccgggcucg

SEQ ID NO: 2027413 - RNA, 17 nt, Human herpesvirus 5
gaggagcgccggggaga

SEQ ID NO: 2027414 - RNA, 11 nt, Human herpesvirus 5
agauuucuguc

SEQ ID NO: 2027415 - RNA, 22 nt, Human herpesvirus 5
ggccgacggcagcgugcugugc

SEQ ID NO: 2027416 - RNA, 19 nt, Human herpesvirus 5
acgcuguugagcucggaca

SEQ ID NO: 2027417 - RNA, 17 nt, Human herpesvirus 5
agcuacgcgaccagcug

SEQ ID NO: 2027418 - RNA, 14 nt, Human herpesvirus 5
accucucgggccga

SEQ ID NO: 2027419 - RNA, 16 nt, Human herpesvirus 5
agcccuacuuuguguu

SEQ ID NO: 2027420 - RNA, 16 nt, Human herpesvirus 5
gaccgauuccagaacu

SEQ ID NO: 2027421 - RNA, 13 nt, Human herpesvirus 5
cgcuccucgagcc

SEQ ID NO: 2027422 - RNA, 13 nt, Human herpesvirus 5
uggcuuggcgcag

SEQ ID NO: 2027423 - RNA, 17 nt, Human herpesvirus 5
gcagaagaauguugcga

SEQ ID NO: 2027424 - RNA, 19 nt, Human herpesvirus 5
gaugaacguggugaggggc

SEQ ID NO: 2027425 - RNA, 18 nt, Human herpesvirus 5
cgcaucgccugcaccucg

SEQ ID NO: 2027426 - RNA, 20 nt, Human herpesvirus 5
cauaaguuuacgggaggaau

SEQ ID NO: 2027427 - RNA, 18 nt, Human herpesvirus 5
ccauuuucagcgacgacc

SEQ ID NO: 2027428 - RNA, 14 nt, Human herpesvirus 5
cugcuugcuggcuu

SEQ ID NO: 2027429 - RNA, 17 nt, Human herpesvirus 5
gucgccgccgucaccac

SEQ ID NO: 2027430 - RNA, 14 nt, Human herpesvirus 5
aucugucguacugu

SEQ ID NO: 2027431 - RNA, 18 nt, Human herpesvirus 5
guggaugagggcucuuca

SEQ ID NO: 2027432 - RNA, 21 nt, Human herpesvirus 5
cgguuucgcuguagcuguggu

SEQ ID NO: 2027433 - RNA, 23 nt, Human herpesvirus 5
ggaccggggugguggugcugcug

SEQ ID NO: 2027434 - RNA, 13 nt, Human herpesvirus 5
gcgcucccugcuc

SEQ ID NO: 2027435 - RNA, 16 nt, Human herpesvirus 5
agcucguccacacgcc

SEQ ID NO: 2027436 - RNA, 17 nt, Human herpesvirus 5
cccccacggaucucgcg

SEQ ID NO: 2027437 - RNA, 21 nt, Human herpesvirus 5
acuaccagcugggccuacacc

SEQ ID NO: 2027438 - RNA, 23 nt, Human herpesvirus 5
ggaccugaccugucagaaggcag

SEQ ID NO: 2027439 - RNA, 22 nt, Human herpesvirus 5
cggccgcccguguccgugauga

SEQ ID NO: 2027440 - RNA, 20 nt, Human herpesvirus 5
acgaagaugccgauguguga

SEQ ID NO: 2027441 - RNA, 20 nt, Human herpesvirus 5
gaccaagcuaguagcggccg

SEQ ID NO: 2027442 - RNA, 15 nt, Human herpesvirus 5
cgccggacgagcugg

SEQ ID NO: 2027443 - RNA, 18 nt, Human herpesvirus 5
aggaggccgagacgcugc

SEQ ID NO: 2027444 - RNA, 22 nt, Human herpesvirus 5
ggaacuuugccgucaugccuug

SEQ ID NO: 2027445 - RNA, 18 nt, Human herpesvirus 5
cacucuggcccugcugua

SEQ ID NO: 2027446 - RNA, 20 nt, Human herpesvirus 5
cugcgcgccuaccugacgcc

SEQ ID NO: 2027447 - RNA, 20 nt, Human herpesvirus 5
cugcgaggaccguacacgca

SEQ ID NO: 2027448 - RNA, 12 nt, Human herpesvirus 5
gaugcaggaggu

SEQ ID NO: 2027449 - RNA, 13 nt, Human herpesvirus 5
cuauguggcuccg

SEQ ID NO: 2027450 - RNA, 20 nt, Human herpesvirus 5
ugcaugucgcccagaaagaa

SEQ ID NO: 2027451 - RNA, 15 nt, Human herpesvirus 5
guuaucuucccugag

SEQ ID NO: 2027452 - RNA, 18 nt, Human herpesvirus 5
gacugcguggggugcugg

SEQ ID NO: 2027453 - RNA, 20 nt, Human herpesvirus 5
uguugcacgggcucggguga

SEQ ID NO: 2027454 - RNA, 14 nt, Human herpesvirus 5
gugggccggggccc

SEQ ID NO: 2027455 - RNA, 15 nt, Human herpesvirus 5
cugucauccacuugg

SEQ ID NO: 2027456 - RNA, 18 nt, Human herpesvirus 5
gccgcggugcaggccgcg

SEQ ID NO: 2027457 - RNA, 22 nt, Human herpesvirus 5
uuccccgccccaucaccucgcc

SEQ ID NO: 2027458 - RNA, 18 nt, Human herpesvirus 5
gaccggggugguggugcu

SEQ ID NO: 2027459 - RNA, 21 nt, Human herpesvirus 5
gcucgugcgugucgcugggcu

SEQ ID NO: 2027460 - RNA, 22 nt, Human herpesvirus 5
ugaggcgcucgugaaacagcag

SEQ ID NO: 2027461 - RNA, 17 nt, Human herpesvirus 5
cacgguacaaaccucua

SEQ ID NO: 2027462 - RNA, 16 nt, Human herpesvirus 5
ccgauccacgggccgc

SEQ ID NO: 2027463 - RNA, 15 nt, Human herpesvirus 5
cuaagaggauacauc

SEQ ID NO: 2027464 - RNA, 15 nt, Human herpesvirus 5
gccgacgaggccggc

SEQ ID NO: 2027465 - RNA, 11 nt, Human herpesvirus 5
acggccgccgc

SEQ ID NO: 2027466 - RNA, 20 nt, Human herpesvirus 5
uccacgggccgcgcuccagg

SEQ ID NO: 2027467 - RNA, 20 nt, Human herpesvirus 5
cgcaaugggcuucccuccug

SEQ ID NO: 2027468 - RNA, 14 nt, Human herpesvirus 5
gcgucccuggggcu

SEQ ID NO: 2027469 - RNA, 14 nt, Human herpesvirus 5
agcuucucucuggu

SEQ ID NO: 2027470 - RNA, 12 nt, Human herpesvirus 5
guggcugggcuc

SEQ ID NO: 2027471 - RNA, 21 nt, Human herpesvirus 5
ccgacccugcguccccgcacg

SEQ ID NO: 2027472 - RNA, 23 nt, Human herpesvirus 5
guccuccagcagcagcuggugca

SEQ ID NO: 2027473 - RNA, 23 nt, Human herpesvirus 5
gucugcaacaugcggcugugucg

SEQ ID NO: 2027474 - RNA, 17 nt, Human herpesvirus 5
guacggcaacgagcagg

SEQ ID NO: 2027475 - RNA, 20 nt, Human herpesvirus 5
acgggaggcugaucgcggcc

SEQ ID NO: 2027476 - RNA, 18 nt, Human herpesvirus 5
gcugccuguuccugcugc

SEQ ID NO: 2027477 - RNA, 18 nt, Human herpesvirus 5
cugugaaacgccaacucc

SEQ ID NO: 2027478 - RNA, 21 nt, Human herpesvirus 5
gaggaaugcauguggaagcug

SEQ ID NO: 2027479 - RNA, 14 nt, Human herpesvirus 5
acggcgaccgucug

SEQ ID NO: 2027480 - RNA, 14 nt, Human herpesvirus 5
gcagcaacagcccc

SEQ ID NO: 2027481 - RNA, 10 nt, Human herpesvirus 5
agacacaccg

SEQ ID NO: 2027482 - RNA, 22 nt, Human herpesvirus 5
cgcuacaacgcgcgccugaccc

SEQ ID NO: 2027483 - RNA, 15 nt, Human herpesvirus 5
gaccgcgacgagguc

SEQ ID NO: 2027484 - RNA, 13 nt, Human herpesvirus 5
gcuuugacgcacu

SEQ ID NO: 2027485 - RNA, 20 nt, Human herpesvirus 5
gcacaucggugccggccagg

SEQ ID NO: 2027486 - RNA, 14 nt, Human herpesvirus 5
gccgcggugcaggc

SEQ ID NO: 2027487 - RNA, 14 nt, Human herpesvirus 5
gugcucgugcccau

SEQ ID NO: 2027488 - RNA, 23 nt, Human herpesvirus 5
accuggguagcaaguccuccaac

SEQ ID NO: 2027489 - RNA, 13 nt, Human herpesvirus 5
gaccagcugcugg

SEQ ID NO: 2027490 - RNA, 13 nt, Human herpesvirus 5
uggccuacggcug

SEQ ID NO: 2027491 - RNA, 19 nt, Human herpesvirus 5
uucgagucggauggcuuuu

SEQ ID NO: 2027492 - RNA, 16 nt, Human herpesvirus 5
ccagcugcuucuggua

SEQ ID NO: 2027493 - RNA, 19 nt, Human herpesvirus 5
acaucugucaccucacaag

SEQ ID NO: 2027494 - RNA, 22 nt, Human herpesvirus 5
augucuuugggcgggcucuggg

SEQ ID NO: 2027495 - RNA, 22 nt, Human herpesvirus 5
gacgcgccucucggagccgccg

SEQ ID NO: 2027496 - RNA, 17 nt, Human herpesvirus 5
cgaugugaguuucugug

SEQ ID NO: 2027497 - RNA, 15 nt, Human herpesvirus 5
gugccucauuuguau

SEQ ID NO: 2027498 - RNA, 14 nt, Human herpesvirus 5
guagcaacuggcaa

SEQ ID NO: 2027499 - RNA, 17 nt, Human herpesvirus 5
augcuucaugucguccc

SEQ ID NO: 2027500 - RNA, 18 nt, Human herpesvirus 5
cacauuuuuugacagaug

SEQ ID NO: 2027501 - RNA, 13 nt, Human herpesvirus 5
ggccacgagccag

SEQ ID NO: 2027502 - RNA, 19 nt, Human herpesvirus 5
gacaacggcuggaaaugga

SEQ ID NO: 2027503 - RNA, 16 nt, Human herpesvirus 5
uuucgugcguggaaaa

SEQ ID NO: 2027504 - RNA, 13 nt, Human herpesvirus 5
cgccgucacuucc

SEQ ID NO: 2027505 - RNA, 17 nt, Human herpesvirus 5
auaagccggcagcugcu

SEQ ID NO: 2027506 - RNA, 21 nt, Human herpesvirus 5
cucgcgacgagggucugcgcg

SEQ ID NO: 2027507 - RNA, 22 nt, Human herpesvirus 5
cggaagcuuuggucgccugcac

SEQ ID NO: 2027508 - RNA, 13 nt, Human herpesvirus 5
caucauggcccaa

SEQ ID NO: 2027509 - RNA, 16 nt, Human herpesvirus 5
cucguaaacuuaugaa

SEQ ID NO: 2027510 - RNA, 14 nt, Human herpesvirus 5
guuccggcggcgug

SEQ ID NO: 2027511 - RNA, 23 nt, Human herpesvirus 5
uugaggcgcucgugaaacagcag

SEQ ID NO: 2027512 - RNA, 20 nt, Human herpesvirus 5
cgguuuaccacaggcgccgc

SEQ ID NO: 2027513 - RNA, 12 nt, Human herpesvirus 5
ucaaaguucaaa

SEQ ID NO: 2027514 - RNA, 15 nt, Human herpesvirus 5
auuggcaggaaagac

SEQ ID NO: 2027515 - RNA, 15 nt, Human herpesvirus 5
gcagggaauuuugaa

SEQ ID NO: 2027516 - RNA, 15 nt, Human herpesvirus 5
cgggcacggaccgca

SEQ ID NO: 2027517 - RNA, 15 nt, Human herpesvirus 5
cgaagcggcuguggc

SEQ ID NO: 2027518 - RNA, 23 nt, Human herpesvirus 5
cagccccgaagguuagcgccgcg

SEQ ID NO: 2027519 - RNA, 22 nt, Human herpesvirus 5
ccucgucgugcccgucggcugc

SEQ ID NO: 2027520 - RNA, 13 nt, Human herpesvirus 5
cccucgcugggcu

SEQ ID NO: 2027521 - RNA, 16 nt, Human herpesvirus 5
cucugcguugccacgc

SEQ ID NO: 2027522 - RNA, 19 nt, Human herpesvirus 5
cucggaacgacgacucagg

SEQ ID NO: 2027523 - RNA, 22 nt, Human herpesvirus 5
ugagaaccgcacggaguaauca

SEQ ID NO: 2027524 - RNA, 15 nt, Human herpesvirus 5
gcacgucagugguga

SEQ ID NO: 2027525 - RNA, 17 nt, Human herpesvirus 5
uuagacacacgggggcg

SEQ ID NO: 2027526 - RNA, 21 nt, Human herpesvirus 5
ugccgcacgcgcuagccuuuc

SEQ ID NO: 2027527 - RNA, 21 nt, Human herpesvirus 5
aggcgcuggacgccaucaugg

SEQ ID NO: 2027528 - RNA, 23 nt, Human herpesvirus 5
uauugagcaggguaaaaaccacg

SEQ ID NO: 2027529 - RNA, 13 nt, Human herpesvirus 5
cggcgcagcacca

SEQ ID NO: 2027530 - RNA, 20 nt, Human herpesvirus 5
ucuccaucaggaucuggugc

SEQ ID NO: 2027531 - RNA, 22 nt, Human herpesvirus 5
gagacaggacgaggcaggguga

SEQ ID NO: 2027532 - RNA, 19 nt, Human herpesvirus 5
cugcuauaagaaggccaug

SEQ ID NO: 2027533 - RNA, 22 nt, Human herpesvirus 5
gacacagcggaaaaugccgccg

SEQ ID NO: 2027534 - RNA, 18 nt, Human herpesvirus 5
uuucggauguuuacccuu

SEQ ID NO: 2027535 - RNA, 19 nt, Human herpesvirus 5
gggcauacgcgauaucugg

SEQ ID NO: 2027536 - RNA, 14 nt, Human herpesvirus 5
uccuuaucugggug

SEQ ID NO: 2027537 - RNA, 21 nt, Human herpesvirus 5
cggcgcguuguccucgcaccg

SEQ ID NO: 2027538 - RNA, 13 nt, Human herpesvirus 5
gccgacggcggcg

SEQ ID NO: 2027539 - RNA, 14 nt, Human herpesvirus 5
cguguuaucacaga

SEQ ID NO: 2027540 - RNA, 16 nt, Human herpesvirus 5
acaccguuuguggugu

SEQ ID NO: 2027541 - RNA, 12 nt, Human herpesvirus 5
uggcccugcugu

SEQ ID NO: 2027542 - RNA, 22 nt, Human herpesvirus 5
acgagugacgacgacgcugcuu

SEQ ID NO: 2027543 - RNA, 23 nt, Human herpesvirus 5
gccugcacgaccugcuccaguac

SEQ ID NO: 2027544 - RNA, 17 nt, Human herpesvirus 5
aggacagcaaggccgcc

SEQ ID NO: 2027545 - RNA, 13 nt, Human herpesvirus 5
gcggcaccaggaa

SEQ ID NO: 2027546 - RNA, 16 nt, Human herpesvirus 5
cgugucgggaaaggag

SEQ ID NO: 2027547 - RNA, 16 nt, Human herpesvirus 5
gucugcgacuccugga

SEQ ID NO: 2027548 - RNA, 14 nt, Human herpesvirus 5
caauaaaaaccacc

SEQ ID NO: 2027549 - RNA, 17 nt, Human herpesvirus 5
acgucguuuuggagcug

SEQ ID NO: 2027550 - RNA, 17 nt, Human herpesvirus 5
uccgcggacacccgcgg

SEQ ID NO: 2027551 - RNA, 14 nt, Human herpesvirus 5
uuucgguuccaacu

SEQ ID NO: 2027552 - RNA, 16 nt, Human herpesvirus 5
gccugcacgaccugcu

SEQ ID NO: 2027553 - RNA, 21 nt, Human herpesvirus 5
gugcucagcggcguguacagc

SEQ ID NO: 2027554 - RNA, 15 nt, Human herpesvirus 5
gcuuacugccugccg

SEQ ID NO: 2027555 - RNA, 13 nt, Human herpesvirus 5
gcugcgucgccug

SEQ ID NO: 2027556 - RNA, 18 nt, Human herpesvirus 5
uccggcggcgccgucaga

SEQ ID NO: 2027557 - RNA, 15 nt, Human herpesvirus 5
cgcacacuggcugga

SEQ ID NO: 2027558 - RNA, 16 nt, Human herpesvirus 5
gcaagugccugcacga

SEQ ID NO: 2027559 - RNA, 13 nt, Human herpesvirus 5
cggcugucauggg

SEQ ID NO: 2027560 - RNA, 15 nt, Human herpesvirus 5
ugcaacgccuggcgu

SEQ ID NO: 2027561 - RNA, 19 nt, Human herpesvirus 5
gcuuagacauuccccaccu

SEQ ID NO: 2027562 - RNA, 23 nt, Human herpesvirus 5
uucuucugucucgucgacgucau

SEQ ID NO: 2027563 - RNA, 16 nt, Human herpesvirus 5
aggcugugcgcgccgg

SEQ ID NO: 2027564 - RNA, 15 nt, Human herpesvirus 5
aucuucgacuuucug

SEQ ID NO: 2027565 - RNA, 20 nt, Human herpesvirus 5
uuccugcgcgccuaccugac

SEQ ID NO: 2027566 - RNA, 20 nt, Human herpesvirus 5
cagcggccgcagugggccca

SEQ ID NO: 2027567 - RNA, 13 nt, Human herpesvirus 5
cuguuccugcugc

SEQ ID NO: 2027568 - RNA, 19 nt, Human herpesvirus 5
cggugcgcugcagccggag

SEQ ID NO: 2027569 - RNA, 23 nt, Human herpesvirus 5
aggcggcgaggcgaaacuggugc

SEQ ID NO: 2027570 - RNA, 17 nt, Human herpesvirus 5
agagccaccuuggugga

SEQ ID NO: 2027571 - RNA, 21 nt, Human herpesvirus 5
acgcugcgucgcagucagacc

SEQ ID NO: 2027572 - RNA, 12 nt, Human herpesvirus 5
agcaccgccggc

SEQ ID NO: 2027573 - RNA, 17 nt, Human herpesvirus 5
cuggacccacaagcgcc

SEQ ID NO: 2027574 - RNA, 15 nt, Human herpesvirus 5
acuuuacauaaaacc

SEQ ID NO: 2027575 - RNA, 15 nt, Human herpesvirus 5
agggaagccgcgucc

SEQ ID NO: 2027576 - RNA, 12 nt, Human herpesvirus 5
cggccuuucuag

SEQ ID NO: 2027577 - RNA, 21 nt, Human herpesvirus 5
cgucugcacgccccggagugc

SEQ ID NO: 2027578 - RNA, 23 nt, Human herpesvirus 5
cccagcagggcgcgccggcgcca

SEQ ID NO: 2027579 - RNA, 23 nt, Human herpesvirus 5
cggucugcuugcuggcuuggcuc

SEQ ID NO: 2027580 - RNA, 17 nt, Human herpesvirus 5
caucaucaacagcagca

SEQ ID NO: 2027581 - RNA, 18 nt, Human herpesvirus 5
ggucugcuugcuggcuug

SEQ ID NO: 2027582 - RNA, 17 nt, Human herpesvirus 5
agcuggugaucggccgc

SEQ ID NO: 2027583 - RNA, 13 nt, Human herpesvirus 5
aagacgggccugg

SEQ ID NO: 2027584 - RNA, 17 nt, Human herpesvirus 5
guaaaagcugcaugaaa

SEQ ID NO: 2027585 - RNA, 18 nt, Human herpesvirus 5
agccagcuacagccacga

SEQ ID NO: 2027586 - RNA, 17 nt, Human herpesvirus 5
gccgacaaccugcugca

SEQ ID NO: 2027587 - RNA, 19 nt, Human herpesvirus 5
gcgccgucucuucgcgccc

SEQ ID NO: 2027588 - RNA, 13 nt, Human herpesvirus 5
cacagcagcacca

SEQ ID NO: 2027589 - RNA, 16 nt, Human herpesvirus 5
ccgcagcggcuuugug

SEQ ID NO: 2027590 - RNA, 17 nt, Human herpesvirus 5
ucagacccacuaccugg

SEQ ID NO: 2027591 - RNA, 11 nt, Human herpesvirus 5
uuauucaucau

SEQ ID NO: 2027592 - RNA, 23 nt, Human herpesvirus 5
cuuugacgucccuuuuacuagua

SEQ ID NO: 2027593 - RNA, 21 nt, Human herpesvirus 5
ggucaugaguuggugcagcug

SEQ ID NO: 2027594 - RNA, 16 nt, Human herpesvirus 5
agcacgucagugguga

SEQ ID NO: 2027595 - RNA, 18 nt, Human herpesvirus 5
gucggcgcccgggccgcc

SEQ ID NO: 2027596 - RNA, 20 nt, Human herpesvirus 5
uaugcaugucgcgacagaga

SEQ ID NO: 2027597 - RNA, 20 nt, Human herpesvirus 5
ggugugguagcuagugcagc

SEQ ID NO: 2027598 - RNA, 13 nt, Human herpesvirus 5
uuaugauucugca

SEQ ID NO: 2027599 - RNA, 13 nt, Human herpesvirus 5
ccccccaugccgg

SEQ ID NO: 2027600 - RNA, 11 nt, Human herpesvirus 5
auauacacaug

SEQ ID NO: 2027601 - RNA, 16 nt, Human herpesvirus 5
guccgucaugcuggca

SEQ ID NO: 2027602 - RNA, 13 nt, Human herpesvirus 5
gcccucgcagugc

SEQ ID NO: 2027603 - RNA, 16 nt, Human herpesvirus 5
guggauuugggcgugg

SEQ ID NO: 2027604 - RNA, 17 nt, Human herpesvirus 5
agggccgauggcugccc

SEQ ID NO: 2027605 - RNA, 16 nt, Human herpesvirus 5
ucgcgccuuccuccuc

SEQ ID NO: 2027606 - RNA, 14 nt, Human herpesvirus 5
accgcaacucggug

SEQ ID NO: 2027607 - RNA, 10 nt, Human herpesvirus 5
acaaaacaac

SEQ ID NO: 2027608 - RNA, 14 nt, Human herpesvirus 5
guggccgugcuggg

SEQ ID NO: 2027609 - RNA, 21 nt, Human herpesvirus 5
cuucauggcuuggcgcagcgg

SEQ ID NO: 2027610 - RNA, 23 nt, Human herpesvirus 5
ccagcggccgcagugggcccacg

SEQ ID NO: 2027611 - RNA, 21 nt, Human herpesvirus 5
ccuccgcgaacggcgacggca

SEQ ID NO: 2027612 - RNA, 19 nt, Human herpesvirus 5
ugcccgaccacgacacggu

SEQ ID NO: 2027613 - RNA, 15 nt, Human herpesvirus 5
guuguacauggguag

SEQ ID NO: 2027614 - RNA, 15 nt, Human herpesvirus 5
gcccgggccgccgcc

SEQ ID NO: 2027615 - RNA, 19 nt, Human herpesvirus 5
acucuauguuauacucugu

SEQ ID NO: 2027616 - RNA, 14 nt, Human herpesvirus 5
acagcguccacagu

SEQ ID NO: 2027617 - RNA, 16 nt, Human herpesvirus 5
gcagaaguuguugcaa

SEQ ID NO: 2027618 - RNA, 23 nt, Human herpesvirus 5
gucugcauguuggugccccagga

SEQ ID NO: 2027619 - RNA, 16 nt, Human herpesvirus 5
cagcacauuagacaca

SEQ ID NO: 2027620 - RNA, 19 nt, Human herpesvirus 5
ugcgggaacuggccuggcg

SEQ ID NO: 2027621 - RNA, 20 nt, Human herpesvirus 5
guuuuugucaggacuggaag

SEQ ID NO: 2027622 - RNA, 16 nt, Human herpesvirus 5
agacgugcgaccugga

SEQ ID NO: 2027623 - RNA, 18 nt, Human herpesvirus 5
guucagguggaugagggc

SEQ ID NO: 2027624 - RNA, 16 nt, Human herpesvirus 5
cgcguccagcuucugg

SEQ ID NO: 2027625 - RNA, 14 nt, Human herpesvirus 5
caaaagaagcugcc

SEQ ID NO: 2027626 - RNA, 16 nt, Human herpesvirus 5
ugcgcuucugcagcuc

SEQ ID NO: 2027627 - RNA, 15 nt, Human herpesvirus 5
gauaaccuaccuggu

SEQ ID NO: 2027628 - RNA, 15 nt, Human herpesvirus 5
ucggaggaacccugc

SEQ ID NO: 2027629 - RNA, 20 nt, Human herpesvirus 5
acggcguuuuggcgcccccc

SEQ ID NO: 2027630 - RNA, 14 nt, Human herpesvirus 5
guggccgcacaccu

SEQ ID NO: 2027631 - RNA, 13 nt, Human herpesvirus 5
gccuugcaccugg

SEQ ID NO: 2027632 - RNA, 12 nt, Human herpesvirus 5
uggggugggcgc

SEQ ID NO: 2027633 - RNA, 12 nt, Human herpesvirus 5
agcacaccugcc

SEQ ID NO: 2027634 - RNA, 20 nt, Human herpesvirus 5
aaucuaggaacacugaaaac

SEQ ID NO: 2027635 - RNA, 14 nt, Human herpesvirus 5
uagcccucugggcc

SEQ ID NO: 2027636 - RNA, 20 nt, Human herpesvirus 5
ucuuugcuuaucugccucuu

SEQ ID NO: 2027637 - RNA, 20 nt, Human herpesvirus 5
gauaagacggacuguuucau

SEQ ID NO: 2027638 - RNA, 21 nt, Human herpesvirus 5
ccgcgaucgaggcggcggcga

SEQ ID NO: 2027639 - RNA, 13 nt, Human herpesvirus 5
cgacgacucaggg

SEQ ID NO: 2027640 - RNA, 14 nt, Human herpesvirus 5
gccgcgcuccaggc

SEQ ID NO: 2027641 - RNA, 15 nt, Human herpesvirus 5
uacaagaaccacguu

SEQ ID NO: 2027642 - RNA, 19 nt, Human herpesvirus 5
ccgcgucgcuucgccgcca

SEQ ID NO: 2027643 - RNA, 18 nt, Human herpesvirus 5
gccggggaagccuccgga

SEQ ID NO: 2027644 - RNA, 16 nt, Human herpesvirus 5
gcugauaagacggacu

SEQ ID NO: 2027645 - RNA, 19 nt, Human herpesvirus 5
gcugcuuuggagcacggga

SEQ ID NO: 2027646 - RNA, 14 nt, Human herpesvirus 5
acaaccugcugcac

SEQ ID NO: 2027647 - RNA, 14 nt, Human herpesvirus 5
cgccggaggcugug

SEQ ID NO: 2027648 - RNA, 20 nt, Human herpesvirus 5
ccagacugcccuugaaugua

SEQ ID NO: 2027649 - RNA, 19 nt, Human herpesvirus 5
cugggauaccgcccgcaug

SEQ ID NO: 2027650 - RNA, 17 nt, Human herpesvirus 5
cacuauauuaucuuuua

SEQ ID NO: 2027651 - RNA, 22 nt, Human herpesvirus 5
acggccucugggcugagacagg

SEQ ID NO: 2027652 - RNA, 13 nt, Human herpesvirus 5
ucacacugggaga

SEQ ID NO: 2027653 - RNA, 23 nt, Human herpesvirus 5
gcucacagucuaucccuauggca

SEQ ID NO: 2027654 - RNA, 17 nt, Human herpesvirus 5
ucgcagccacgcgcugg

SEQ ID NO: 2027655 - RNA, 17 nt, Human herpesvirus 5
cugccucgaugcgccuc

SEQ ID NO: 2027656 - RNA, 15 nt, Human herpesvirus 5
auuacaguaacgcag

SEQ ID NO: 2027657 - RNA, 16 nt, Human herpesvirus 5
cucgggcuggcgugcu

SEQ ID NO: 2027658 - RNA, 17 nt, Human herpesvirus 5
gauccaguuucaccaag

SEQ ID NO: 2027659 - RNA, 17 nt, Human herpesvirus 5
guuguccucuccuccuu

SEQ ID NO: 2027660 - RNA, 12 nt, Human herpesvirus 5
agcccaccgccc

SEQ ID NO: 2027661 - RNA, 22 nt, Human herpesvirus 5
gccccgaagguuagcgccgcgg

SEQ ID NO: 2027662 - RNA, 22 nt, Human herpesvirus 5
aaauacagggaaugggaaaaac

SEQ ID NO: 2027663 - RNA, 18 nt, Human herpesvirus 5
gucccagcagggcgcgcc

SEQ ID NO: 2027664 - RNA, 12 nt, Human herpesvirus 5
guggcaaagagc

SEQ ID NO: 2027665 - RNA, 14 nt, Human herpesvirus 5
caacgcuuuggaaa

SEQ ID NO: 2027666 - RNA, 13 nt, Human herpesvirus 5
cgaagaagaacaa

SEQ ID NO: 2027667 - RNA, 16 nt, Human herpesvirus 5
acgucaccgugcccca

SEQ ID NO: 2027668 - RNA, 15 nt, Human herpesvirus 5
cagcauggacugucu

SEQ ID NO: 2027669 - RNA, 21 nt, Human herpesvirus 5
aagcgcggagguuugucuggc

SEQ ID NO: 2027670 - RNA, 12 nt, Human herpesvirus 5
acacauugcuga

SEQ ID NO: 2027671 - RNA, 15 nt, Human herpesvirus 5
cucugucggcgccgc

SEQ ID NO: 2027672 - RNA, 18 nt, Human herpesvirus 5
gccggaaacaccgcgagu

SEQ ID NO: 2027673 - RNA, 18 nt, Human herpesvirus 5
cugcaacugcaccagcaa

SEQ ID NO: 2027674 - RNA, 14 nt, Human herpesvirus 5
aucgugggccagga

SEQ ID NO: 2027675 - RNA, 11 nt, Human herpesvirus 5
aucacgugcca

SEQ ID NO: 2027676 - RNA, 13 nt, Human herpesvirus 5
auccgcaccuguc

SEQ ID NO: 2027677 - RNA, 18 nt, Human herpesvirus 5
cgugacgcagucugcccu

SEQ ID NO: 2027678 - RNA, 14 nt, Human herpesvirus 5
accucuuugagcac

SEQ ID NO: 2027679 - RNA, 15 nt, Human herpesvirus 5
gucucuucgcgcccc

SEQ ID NO: 2027680 - RNA, 18 nt, Human herpesvirus 5
guggcgcugcacaccuau

SEQ ID NO: 2027681 - RNA, 15 nt, Human herpesvirus 5
cugggcuacaagugc

SEQ ID NO: 2027682 - RNA, 15 nt, Human herpesvirus 5
cucgcacggccugug

SEQ ID NO: 2027683 - RNA, 14 nt, Human herpesvirus 5
aacuagccuucccg

SEQ ID NO: 2027684 - RNA, 19 nt, Human herpesvirus 5
cagcgccagcggccuggcc

SEQ ID NO: 2027685 - RNA, 14 nt, Human herpesvirus 5
caccaaagaugaag

SEQ ID NO: 2027686 - RNA, 18 nt, Human herpesvirus 5
gcagccguuuccagagaa

SEQ ID NO: 2027687 - RNA, 20 nt, Human herpesvirus 5
cguuagagaaagagcagcgc

SEQ ID NO: 2027688 - RNA, 23 nt, Human herpesvirus 5
gcggucaugaguuggugcagcug

SEQ ID NO: 2027689 - RNA, 15 nt, Human herpesvirus 5
caccgaugccggccu

SEQ ID NO: 2027690 - RNA, 19 nt, Human herpesvirus 5
gcguuguuugggaacuuug

SEQ ID NO: 2027691 - RNA, 15 nt, Human herpesvirus 5
ugaaccuccgcccuu

SEQ ID NO: 2027692 - RNA, 15 nt, Human herpesvirus 5
cgcgcagcgcgcuuu

SEQ ID NO: 2027693 - RNA, 20 nt, Human herpesvirus 5
ccgugacacuuuggcucuuu

SEQ ID NO: 2027694 - RNA, 21 nt, Human herpesvirus 5
uucuugcaagaggaaugcaug

SEQ ID NO: 2027695 - RNA, 22 nt, Human herpesvirus 5
cgaccacgacacggugcugcug

SEQ ID NO: 2027696 - RNA, 14 nt, Human herpesvirus 5
uaugagaaaaggga

SEQ ID NO: 2027697 - RNA, 12 nt, Human herpesvirus 5
ggacgaugagcc

SEQ ID NO: 2027698 - RNA, 21 nt, Human herpesvirus 5
gcguggucaacgcuuuggaaa

SEQ ID NO: 2027699 - RNA, 17 nt, Human herpesvirus 5
ucggggcgcagaaacuu

SEQ ID NO: 2027700 - RNA, 15 nt, Human herpesvirus 5
ggccacccacccggu

SEQ ID NO: 2027701 - RNA, 20 nt, Human herpesvirus 5
ugucagucucugaaggacag

SEQ ID NO: 2027702 - RNA, 16 nt, Human herpesvirus 5
cacccgaguccugguc

SEQ ID NO: 2027703 - RNA, 16 nt, Human herpesvirus 5
acagcguccacaguuu

SEQ ID NO: 2027704 - RNA, 23 nt, Human herpesvirus 5
gaguuggccucgauccauccugg

SEQ ID NO: 2027705 - RNA, 19 nt, Human herpesvirus 5
gaccuugcugaugugccag

SEQ ID NO: 2027706 - RNA, 22 nt, Human herpesvirus 5
ggcgcaucacccgccucaugga

SEQ ID NO: 2027707 - RNA, 13 nt, Human herpesvirus 5
ucuacgcuguacu

SEQ ID NO: 2027708 - RNA, 16 nt, Human herpesvirus 5
ugcgccuuccagucca

SEQ ID NO: 2027709 - RNA, 17 nt, Human herpesvirus 5
acggcgucuuccuccuc

SEQ ID NO: 2027710 - RNA, 14 nt, Human herpesvirus 5
cgcacgcuggagga

SEQ ID NO: 2027711 - RNA, 14 nt, Human herpesvirus 5
ucagguggaugagg

SEQ ID NO: 2027712 - RNA, 20 nt, Human herpesvirus 5
uccacgacucgcacggccug

SEQ ID NO: 2027713 - RNA, 15 nt, Human herpesvirus 5
uaauguaccaagaau

SEQ ID NO: 2027714 - RNA, 14 nt, Human herpesvirus 5
cgccgcgacaacgg

SEQ ID NO: 2027715 - RNA, 15 nt, Human herpesvirus 5
ugaauauacagacuu

SEQ ID NO: 2027716 - RNA, 22 nt, Human herpesvirus 5
aauaaucccuguaauuauucca

SEQ ID NO: 2027717 - RNA, 12 nt, Human herpesvirus 5
guuucaaaccca

SEQ ID NO: 2027718 - RNA, 18 nt, Human herpesvirus 5
cuuacgucuacagcaugg

SEQ ID NO: 2027719 - RNA, 13 nt, Human herpesvirus 5
gacgucaaugaca

SEQ ID NO: 2027720 - RNA, 16 nt, Human herpesvirus 5
cguuaagcguugagcc

SEQ ID NO: 2027721 - RNA, 19 nt, Human herpesvirus 5
gugcaccugcugccgccac

SEQ ID NO: 2027722 - RNA, 14 nt, Human herpesvirus 5
uaguuguugcagaa

SEQ ID NO: 2027723 - RNA, 16 nt, Human herpesvirus 5
aggaagucgaucugga

SEQ ID NO: 2027724 - RNA, 21 nt, Human herpesvirus 5
ugguaguugauacgcuagcag

SEQ ID NO: 2027725 - RNA, 21 nt, Human herpesvirus 5
gacaugguuuggccguguccu

SEQ ID NO: 2027726 - RNA, 22 nt, Human herpesvirus 5
ccaaagccgccgccgaagccug

SEQ ID NO: 2027727 - RNA, 16 nt, Human herpesvirus 5
cgguccaguggcaggc

SEQ ID NO: 2027728 - RNA, 13 nt, Human herpesvirus 5
gcgccgccuggag

SEQ ID NO: 2027729 - RNA, 17 nt, Human herpesvirus 5
ucaauaaagaaaaccac

SEQ ID NO: 2027730 - RNA, 19 nt, Human herpesvirus 5
gcugcuauaagaaggccau

SEQ ID NO: 2027731 - RNA, 20 nt, Human herpesvirus 5
cuuccauaauaaaaguaaaa

SEQ ID NO: 2027732 - RNA, 13 nt, Human herpesvirus 5
ggaggacuuuuuc

SEQ ID NO: 2027733 - RNA, 20 nt, Human herpesvirus 5
cucaagaggaccguuaagcu

SEQ ID NO: 2027734 - RNA, 21 nt, Human herpesvirus 5
gcgacauuuugggucagcggc

SEQ ID NO: 2027735 - RNA, 21 nt, Human herpesvirus 5
gcgcccgcgccucacgcugca

SEQ ID NO: 2027736 - RNA, 17 nt, Human herpesvirus 5
cggcuaccaugcgcaac

SEQ ID NO: 2027737 - RNA, 15 nt, Human herpesvirus 5
agguaugccgcgucu

SEQ ID NO: 2027738 - RNA, 22 nt, Human herpesvirus 5
ccaccgucgcccucagcgugcu

SEQ ID NO: 2027739 - RNA, 16 nt, Human herpesvirus 5
cgucugcgacuccugg

SEQ ID NO: 2027740 - RNA, 19 nt, Human herpesvirus 5
gcugccgcucagcgagcuc

SEQ ID NO: 2027741 - RNA, 16 nt, Human herpesvirus 5
gaagacaccuggaaag

SEQ ID NO: 2027742 - RNA, 14 nt, Human herpesvirus 5
cggugauuucuugc

SEQ ID NO: 2027743 - RNA, 17 nt, Human herpesvirus 5
gacuuagaaucucuugc

SEQ ID NO: 2027744 - RNA, 20 nt, Human herpesvirus 5
caacgcgcccgacagcugca

SEQ ID NO: 2027745 - RNA, 17 nt, Human herpesvirus 5
accgucgcccucagcgu

SEQ ID NO: 2027746 - RNA, 12 nt, Human herpesvirus 5
cacuuucucugg

SEQ ID NO: 2027747 - RNA, 18 nt, Human herpesvirus 5
ugcacgggcucgggugac

SEQ ID NO: 2027748 - RNA, 14 nt, Human herpesvirus 5
guaagcggcagcau

SEQ ID NO: 2027749 - RNA, 16 nt, Human herpesvirus 5
ccgccacgcugcuuca

SEQ ID NO: 2027750 - RNA, 18 nt, Human herpesvirus 5
ucccuccugcagcugcac

SEQ ID NO: 2027751 - RNA, 14 nt, Human herpesvirus 5
ugaagcggagugca

SEQ ID NO: 2027752 - RNA, 12 nt, Human herpesvirus 5
ccuucucccccu

SEQ ID NO: 2027753 - RNA, 19 nt, Human herpesvirus 5
gugcggcccccagaggccc

SEQ ID NO: 2027754 - RNA, 19 nt, Human herpesvirus 5
cgggcaacgcguggcccug

SEQ ID NO: 2027755 - RNA, 16 nt, Human herpesvirus 5
gaguaccccacgcaua

SEQ ID NO: 2027756 - RNA, 19 nt, Human herpesvirus 5
cuacgugcgcgccacggcg

SEQ ID NO: 2027757 - RNA, 12 nt, Human herpesvirus 5
cagcuggcuugu

SEQ ID NO: 2027758 - RNA, 17 nt, Human herpesvirus 5
aaaagugcgucaaagcu

SEQ ID NO: 2027759 - RNA, 15 nt, Human herpesvirus 5
cggccggcugcugca

SEQ ID NO: 2027760 - RNA, 14 nt, Human herpesvirus 5
cgcuuagccaccac

SEQ ID NO: 2027761 - RNA, 19 nt, Human herpesvirus 5
acaugcccagcaucuccuc

SEQ ID NO: 2027762 - RNA, 14 nt, Human herpesvirus 5
cgagcaggccaugg

SEQ ID NO: 2027763 - RNA, 19 nt, Human herpesvirus 5
cguguuucaaacagcacau

SEQ ID NO: 2027764 - RNA, 24 nt, Human herpesvirus 5
caaggcuccgaaaccgagcaagca

SEQ ID NO: 2027765 - RNA, 12 nt, Human herpesvirus 5
cguggcgcacac

SEQ ID NO: 2027766 - RNA, 14 nt, Human herpesvirus 5
ugggucccggcgcg

SEQ ID NO: 2027767 - RNA, 21 nt, Human herpesvirus 5
gccaugagcggcaggaaggcc

SEQ ID NO: 2027768 - RNA, 14 nt, Human herpesvirus 5
auguggaaaucacc

SEQ ID NO: 2027769 - RNA, 21 nt, Human herpesvirus 5
caaagcccgggccgccgccag

SEQ ID NO: 2027770 - RNA, 21 nt, Human herpesvirus 5
cucgugugcuguugaccuggg

SEQ ID NO: 2027771 - RNA, 19 nt, Human herpesvirus 5
uguuaucaucauggagcua

SEQ ID NO: 2027772 - RNA, 21 nt, Human herpesvirus 5
cacguagaucccacuggcaau

SEQ ID NO: 2027773 - RNA, 12 nt, Human herpesvirus 5
cgcacgacuggc

SEQ ID NO: 2027774 - RNA, 12 nt, Human herpesvirus 5
augaugcugcug

SEQ ID NO: 2027775 - RNA, 19 nt, Human herpesvirus 5
acgccgcgacaacggccgc

SEQ ID NO: 2027776 - RNA, 21 nt, Human herpesvirus 5
acacguaauacucgcgucacg

SEQ ID NO: 2027777 - RNA, 17 nt, Human herpesvirus 5
cuagacucacuuuauug

SEQ ID NO: 2027778 - RNA, 17 nt, Human herpesvirus 5
gacucuaacacccaggc

SEQ ID NO: 2027779 - RNA, 14 nt, Human herpesvirus 5
gucaggacuggaag

SEQ ID NO: 2027780 - RNA, 18 nt, Human herpesvirus 5
cgugauucguaggcagcg

SEQ ID NO: 2027781 - RNA, 18 nt, Human herpesvirus 5
agacugcgguuaacccua

SEQ ID NO: 2027782 - RNA, 20 nt, Human herpesvirus 5
gccaccaggugccggcgacu

SEQ ID NO: 2027783 - RNA, 12 nt, Human herpesvirus 5
aacaacagcagc

SEQ ID NO: 2027784 - RNA, 19 nt, Human herpesvirus 5
acgaucuuuaguccggagg

SEQ ID NO: 2027785 - RNA, 17 nt, Human herpesvirus 5
gacauggcgacuuuccg

SEQ ID NO: 2027786 - RNA, 22 nt, Human herpesvirus 5
gagccacucggccauaagaaag

SEQ ID NO: 2027787 - RNA, 15 nt, Human herpesvirus 5
gccgcagaaggccau

SEQ ID NO: 2027788 - RNA, 18 nt, Human herpesvirus 5
acgaugcuuuccuggaca

SEQ ID NO: 2027789 - RNA, 12 nt, Human herpesvirus 5
gcgcuggacucu

SEQ ID NO: 2027790 - RNA, 20 nt, Human herpesvirus 5
ccgcauccugcccaccgccu

SEQ ID NO: 2027791 - RNA, 15 nt, Human herpesvirus 5
ucauucguguugaca

SEQ ID NO: 2027792 - RNA, 23 nt, Human herpesvirus 5
aucacgugugugcguuuucuagu

SEQ ID NO: 2027793 - RNA, 22 nt, Human herpesvirus 5
acgugguuuuuuuaacagugug

SEQ ID NO: 2027794 - RNA, 19 nt, Human herpesvirus 5
cugucaugggucugcgcuu

SEQ ID NO: 2027795 - RNA, 14 nt, Human herpesvirus 5
cuacggcggaccgc

SEQ ID NO: 2027796 - RNA, 13 nt, Human herpesvirus 5
gaaaagagaugau

SEQ ID NO: 2027797 - RNA, 21 nt, Human herpesvirus 5
caccaguuccugcgcgccuac

SEQ ID NO: 2027798 - RNA, 22 nt, Human herpesvirus 5
acgccugcgacguuggcucucg

SEQ ID NO: 2027799 - RNA, 23 nt, Human herpesvirus 5
aaacucccacuccuguuggcuua

SEQ ID NO: 2027800 - RNA, 11 nt, Human herpesvirus 5
caacagcagca

SEQ ID NO: 2027801 - RNA, 20 nt, Human herpesvirus 5
uucccucuagagacagacga

SEQ ID NO: 2027802 - RNA, 15 nt, Human herpesvirus 5
cucugggaagcugcg

SEQ ID NO: 2027803 - RNA, 22 nt, Human herpesvirus 5
gagguccuuuggguccagccag

SEQ ID NO: 2027804 - RNA, 21 nt, Human herpesvirus 5
ccacaagcgccgucacuuccc

SEQ ID NO: 2027805 - RNA, 15 nt, Human herpesvirus 5
acaacggcuggaaau

SEQ ID NO: 2027806 - RNA, 21 nt, Human herpesvirus 5
ccacgcgucgaccccaaccuu

SEQ ID NO: 2027807 - RNA, 17 nt, Human herpesvirus 5
gccgcccucccucaaca

SEQ ID NO: 2027808 - RNA, 22 nt, Human herpesvirus 5
ccgagauaucagaggccaccca

SEQ ID NO: 2027809 - RNA, 13 nt, Human herpesvirus 5
cgcguagccaccu

SEQ ID NO: 2027810 - RNA, 20 nt, Human herpesvirus 5
caguccauugucaguauuuu

SEQ ID NO: 2027811 - RNA, 12 nt, Human herpesvirus 5
cccgcacacugg

SEQ ID NO: 2027812 - RNA, 23 nt, Human herpesvirus 5
cgucggcugccuguuccugcugc

SEQ ID NO: 2027813 - RNA, 11 nt, Human herpesvirus 5
cgaguuguagu

SEQ ID NO: 2027814 - RNA, 14 nt, Human herpesvirus 5
guauaaacuggggc

SEQ ID NO: 2027815 - RNA, 15 nt, Human herpesvirus 5
cucugcaacgccugg

SEQ ID NO: 2027816 - RNA, 20 nt, Human herpesvirus 5
gaggucugggaugugcagca

SEQ ID NO: 2027817 - RNA, 15 nt, Human herpesvirus 5
ugguggcucaugccg

SEQ ID NO: 2027818 - RNA, 14 nt, Human herpesvirus 5
aggccagcugccac

SEQ ID NO: 2027819 - RNA, 13 nt, Human herpesvirus 5
caguagacagaca

SEQ ID NO: 2027820 - RNA, 21 nt, Human herpesvirus 5
agcacgucuagcaggcccagg

SEQ ID NO: 2027821 - RNA, 15 nt, Human herpesvirus 5
cgcaagggcugcucg

SEQ ID NO: 2027822 - RNA, 15 nt, Human herpesvirus 5
cuuacaucucacgga

SEQ ID NO: 2027823 - RNA, 13 nt, Human herpesvirus 5
ucagcagcaccuc

SEQ ID NO: 2027824 - RNA, 20 nt, Human herpesvirus 5
acuagcgaaguacacaguuu

SEQ ID NO: 2027825 - RNA, 13 nt, Human herpesvirus 5
caaccgcgagcgg

SEQ ID NO: 2027826 - RNA, 20 nt, Human herpesvirus 5
cgaggcucucuauccggugg

SEQ ID NO: 2027827 - RNA, 12 nt, Human herpesvirus 5
ccuucuugccca

SEQ ID NO: 2027828 - RNA, 16 nt, Human herpesvirus 5
gcgggagacuaggucg

SEQ ID NO: 2027829 - RNA, 14 nt, Human herpesvirus 5
aaaagaagcugccc

SEQ ID NO: 2027830 - RNA, 14 nt, Human herpesvirus 5
uuucaacaaauacc

SEQ ID NO: 2027831 - RNA, 14 nt, Human herpesvirus 5
acggagcacgggcu

SEQ ID NO: 2027832 - RNA, 16 nt, Human herpesvirus 5
gguaacuggcagagcc

SEQ ID NO: 2027833 - RNA, 21 nt, Human herpesvirus 5
gucaagggucacggugccaug

SEQ ID NO: 2027834 - RNA, 21 nt, Human herpesvirus 5
ucagaccgcaacaacagcagc

SEQ ID NO: 2027835 - RNA, 16 nt, Human herpesvirus 5
cuuaacgcgcaagugc

SEQ ID NO: 2027836 - RNA, 15 nt, Human herpesvirus 5
cuugacgcugcuggc

SEQ ID NO: 2027837 - RNA, 15 nt, Human herpesvirus 5
aucgcgagcugggcg

SEQ ID NO: 2027838 - RNA, 19 nt, Human herpesvirus 5
aaacucccacuccuguugg

SEQ ID NO: 2027839 - RNA, 15 nt, Human herpesvirus 5
auggccgacgaggcc

SEQ ID NO: 2027840 - RNA, 14 nt, Human herpesvirus 5
gagugcaucucgag

SEQ ID NO: 2027841 - RNA, 16 nt, Human herpesvirus 5
ugggcgcgcuggagcu

SEQ ID NO: 2027842 - RNA, 21 nt, Human herpesvirus 5
guacgcgcuaaaggugcauga

SEQ ID NO: 2027843 - RNA, 14 nt, Human herpesvirus 5
aaagaccgcugccu

SEQ ID NO: 2027844 - RNA, 19 nt, Human herpesvirus 5
ucuugcgcuucugcagcuc

SEQ ID NO: 2027845 - RNA, 13 nt, Human herpesvirus 5
gcugauccgcagg

SEQ ID NO: 2027846 - RNA, 20 nt, Human herpesvirus 5
ggcgccgggacucuggugcu

SEQ ID NO: 2027847 - RNA, 18 nt, Human herpesvirus 5
ucaauacaucauaugcua

SEQ ID NO: 2027848 - RNA, 15 nt, Human herpesvirus 5
ccucuagagacagac

SEQ ID NO: 2027849 - RNA, 16 nt, Human herpesvirus 5
cacccgcaccagacuu

SEQ ID NO: 2027850 - RNA, 14 nt, Human herpesvirus 5
aacaaacaaugaca

SEQ ID NO: 2027851 - RNA, 21 nt, Human herpesvirus 5
aaagcgucaaucagacuuucg

SEQ ID NO: 2027852 - RNA, 16 nt, Human herpesvirus 5
augcagcacauuguau

SEQ ID NO: 2027853 - RNA, 13 nt, Human herpesvirus 5
cucucggucggcg

SEQ ID NO: 2027854 - RNA, 16 nt, Human herpesvirus 5
gacgcuucauauuagu

SEQ ID NO: 2027855 - RNA, 23 nt, Human herpesvirus 5
cgccguuugcccgaagcggcugu

SEQ ID NO: 2027856 - RNA, 18 nt, Human herpesvirus 5
cucagcggcguguacagc

SEQ ID NO: 2027857 - RNA, 14 nt, Human herpesvirus 5
uugcuuuugcauau

SEQ ID NO: 2027858 - RNA, 20 nt, Human herpesvirus 5
cuugcgcucggucagcuuga

SEQ ID NO: 2027859 - RNA, 21 nt, Human herpesvirus 5
gcgcccaaaccgcaggagcug

SEQ ID NO: 2027860 - RNA, 21 nt, Human herpesvirus 5
gcacauuagacacacgggggc

SEQ ID NO: 2027861 - RNA, 22 nt, Human herpesvirus 5
gcucggcgcccaaaccgcagga

SEQ ID NO: 2027862 - RNA, 17 nt, Human herpesvirus 5
gcugcuguugugggugc

SEQ ID NO: 2027863 - RNA, 22 nt, Human herpesvirus 5
ggccucuaucugcgccaguacg

SEQ ID NO: 2027864 - RNA, 17 nt, Human herpesvirus 5
ucaaacaccgcugcggc

SEQ ID NO: 2027865 - RNA, 19 nt, Human herpesvirus 5
cggcugccggucuacagac

SEQ ID NO: 2027866 - RNA, 22 nt, Human herpesvirus 5
ggcaggcggguugcagcuuuug

SEQ ID NO: 2027867 - RNA, 15 nt, Human herpesvirus 5
uuguugagcauaugu

SEQ ID NO: 2027868 - RNA, 22 nt, Human herpesvirus 5
ggaucaauugcgggcccugcug

SEQ ID NO: 2027869 - RNA, 21 nt, Human herpesvirus 5
gucaugucuccgaacucagag

SEQ ID NO: 2027870 - RNA, 20 nt, Human herpesvirus 5
cugacccuccccccaucccg

SEQ ID NO: 2027871 - RNA, 21 nt, Human herpesvirus 5
ugucaaggaacgcguguuuug

SEQ ID NO: 2027872 - RNA, 20 nt, Human herpesvirus 5
ucccucaccgaccagcacuc

SEQ ID NO: 2027873 - RNA, 13 nt, Human herpesvirus 5
cccgcgucccugg

SEQ ID NO: 2027874 - RNA, 18 nt, Human herpesvirus 5
aguuguagucgcgguggc

SEQ ID NO: 2027875 - RNA, 21 nt, Human herpesvirus 5
gggaucuaccagcccagggau

SEQ ID NO: 2027876 - RNA, 14 nt, Human herpesvirus 5
gcgcggccugcugc

SEQ ID NO: 2027877 - RNA, 13 nt, Human herpesvirus 5
gcucaucgucacg

SEQ ID NO: 2027878 - RNA, 18 nt, Human herpesvirus 5
uuauuguguucuccugcc

SEQ ID NO: 2027879 - RNA, 18 nt, Human herpesvirus 5
ccuccggaacccucuggc

SEQ ID NO: 2027880 - RNA, 12 nt, Human herpesvirus 5
cggcucucaggc

SEQ ID NO: 2027881 - RNA, 17 nt, Human herpesvirus 5
cuccccggugugucuau

SEQ ID NO: 2027882 - RNA, 20 nt, Human herpesvirus 5
cgcaucugcaagucccuggc

SEQ ID NO: 2027883 - RNA, 21 nt, Human herpesvirus 5
uaaccacgucgaccaggugcu

SEQ ID NO: 2027884 - RNA, 14 nt, Human herpesvirus 5
ccuccagcagcagc

SEQ ID NO: 2027885 - RNA, 21 nt, Human herpesvirus 5
cuuccguguccccugccaccu

SEQ ID NO: 2027886 - RNA, 13 nt, Human herpesvirus 5
gagaccggcggac

SEQ ID NO: 2027887 - RNA, 17 nt, Human herpesvirus 5
uggggaaguacaauauc

SEQ ID NO: 2027888 - RNA, 12 nt, Human herpesvirus 5
cuuauguuucug

SEQ ID NO: 2027889 - RNA, 18 nt, Human herpesvirus 5
caugaugcaaauaaagau

SEQ ID NO: 2027890 - RNA, 22 nt, Human herpesvirus 5
uuggacgaugcuuuccuggaca

SEQ ID NO: 2027891 - RNA, 23 nt, Human herpesvirus 5
aaagucuacgaucgcuggaaaga

SEQ ID NO: 2027892 - RNA, 15 nt, Human herpesvirus 5
gacggaguuggccuc

SEQ ID NO: 2027893 - RNA, 15 nt, Human herpesvirus 5
agacccacuaccugg

SEQ ID NO: 2027894 - RNA, 18 nt, Human herpesvirus 5
caccacacgucgugagca

SEQ ID NO: 2027895 - RNA, 12 nt, Human herpesvirus 5
ggaagcugcugg

SEQ ID NO: 2027896 - RNA, 21 nt, Human herpesvirus 5
ucagccucuguguucccaaca

SEQ ID NO: 2027897 - RNA, 12 nt, Human herpesvirus 5
ugccuguuccug

SEQ ID NO: 2027898 - RNA, 13 nt, Human herpesvirus 5
caggcggagauga

SEQ ID NO: 2027899 - RNA, 17 nt, Human herpesvirus 5
cgccgauagaggcgaca

SEQ ID NO: 2027900 - RNA, 15 nt, Human herpesvirus 5
caccgacacagcagc

SEQ ID NO: 2027901 - RNA, 16 nt, Human herpesvirus 5
gccgcugccgcucagc

SEQ ID NO: 2027902 - RNA, 19 nt, Human herpesvirus 5
gcuacgguggugugugggg

SEQ ID NO: 2027903 - RNA, 21 nt, Human herpesvirus 5
aagauagagaaaccgcaugug

SEQ ID NO: 2027904 - RNA, 18 nt, Human herpesvirus 5
caguguuggaucagacuc

SEQ ID NO: 2027905 - RNA, 16 nt, Human herpesvirus 5
ccucggugcccgcaca

SEQ ID NO: 2027906 - RNA, 17 nt, Human herpesvirus 5
caccugagacuggucug

SEQ ID NO: 2027907 - RNA, 19 nt, Human herpesvirus 5
gcgacguggaggagaccau

SEQ ID NO: 2027908 - RNA, 12 nt, Human herpesvirus 5
caucaggugaca

SEQ ID NO: 2027909 - RNA, 21 nt, Human herpesvirus 5
cggcugccuguuccugcugcu

SEQ ID NO: 2027910 - RNA, 20 nt, Human herpesvirus 5
gugcuaccagcugcaggcag

SEQ ID NO: 2027911 - RNA, 17 nt, Human herpesvirus 5
ggcggacuuggcagcgg

SEQ ID NO: 2027912 - RNA, 13 nt, Human herpesvirus 5
cuagagacagacg

SEQ ID NO: 2027913 - RNA, 14 nt, Human herpesvirus 5
ugggcgacaugcac

SEQ ID NO: 2027914 - RNA, 18 nt, Human herpesvirus 5
cauagcguaaauccccgu

SEQ ID NO: 2027915 - RNA, 23 nt, Human herpesvirus 5
acucgcugccgcagcugcuggag

SEQ ID NO: 2027916 - RNA, 17 nt, Human herpesvirus 5
ggcauacaaugugcugc

SEQ ID NO: 2027917 - RNA, 23 nt, Human herpesvirus 5
cgccgaggcuacugcugcuucug

SEQ ID NO: 2027918 - RNA, 14 nt, Human herpesvirus 5
ccaccauagccacu

SEQ ID NO: 2027919 - RNA, 18 nt, Human herpesvirus 5
ccgagcgggaggcgguga

SEQ ID NO: 2027920 - RNA, 18 nt, Human herpesvirus 5
ggugcuauggcugcucaa

SEQ ID NO: 2027921 - RNA, 18 nt, Human herpesvirus 5
ucccacaggagucucugg

SEQ ID NO: 2027922 - RNA, 15 nt, Human herpesvirus 5
uccgcuuccucagcu

SEQ ID NO: 2027923 - RNA, 22 nt, Human herpesvirus 5
cugcccuuuacggugcugcguc

SEQ ID NO: 2027924 - RNA, 16 nt, Human herpesvirus 5
gucggcgccccacagc

SEQ ID NO: 2027925 - RNA, 11 nt, Human herpesvirus 5
cgcgagcuggg

SEQ ID NO: 2027926 - RNA, 18 nt, Human herpesvirus 5
ccauacuuuuacaugaac

SEQ ID NO: 2027927 - RNA, 13 nt, Human herpesvirus 5
cuacgagcugggc

SEQ ID NO: 2027928 - RNA, 21 nt, Human herpesvirus 5
cgccagcguccgcgccugcac

SEQ ID NO: 2027929 - RNA, 14 nt, Human herpesvirus 5
cucaccaaagccgc

SEQ ID NO: 2027930 - RNA, 15 nt, Human herpesvirus 5
cgacaaccugcugca

SEQ ID NO: 2027931 - RNA, 22 nt, Human herpesvirus 5
gccgucacugccaccgacaugg

SEQ ID NO: 2027932 - RNA, 18 nt, Human herpesvirus 5
ccgcgucagcggccgccg

SEQ ID NO: 2027933 - RNA, 20 nt, Human herpesvirus 5
cuaccuuguaccaacugagc

SEQ ID NO: 2027934 - RNA, 12 nt, Human herpesvirus 5
aaacagcacauu

SEQ ID NO: 2027935 - RNA, 21 nt, Human herpesvirus 5
aggguucguacgcuucggcac

SEQ ID NO: 2027936 - RNA, 17 nt, Human herpesvirus 5
ucagcggcacgccgccg

SEQ ID NO: 2027937 - RNA, 19 nt, Human herpesvirus 5
uagacaucacaguucacca

SEQ ID NO: 2027938 - RNA, 12 nt, Human herpesvirus 5
gcacccgacggc

SEQ ID NO: 2027939 - RNA, 17 nt, Human herpesvirus 5
uuauuuacaucuguaca

SEQ ID NO: 2027940 - RNA, 19 nt, Human herpesvirus 5
uguccccgcaaacucccac

SEQ ID NO: 2027941 - RNA, 22 nt, Human herpesvirus 5
gcccgaggaucuggcggccgcc

SEQ ID NO: 2027942 - RNA, 16 nt, Human herpesvirus 5
gccacgcguacuggcu

SEQ ID NO: 2027943 - RNA, 23 nt, Human herpesvirus 5
gacucuuuaaccgagcugaagga

SEQ ID NO: 2027944 - RNA, 15 nt, Human herpesvirus 5
guauaaagauucacu

SEQ ID NO: 2027945 - RNA, 22 nt, Human herpesvirus 5
cugaguucacgcgcggaaccca

SEQ ID NO: 2027946 - RNA, 17 nt, Human herpesvirus 5
ucaccaaagccgccgcc

SEQ ID NO: 2027947 - RNA, 17 nt, Human herpesvirus 5
guuccucauucaaccug

SEQ ID NO: 2027948 - RNA, 20 nt, Human herpesvirus 5
agacgauuuuaugcgccgcc

SEQ ID NO: 2027949 - RNA, 18 nt, Human herpesvirus 5
guaacuggcagagccacg

SEQ ID NO: 2027950 - RNA, 18 nt, Human herpesvirus 5
acgccgucaaggccgccu

SEQ ID NO: 2027951 - RNA, 18 nt, Human herpesvirus 5
gcaucgcaacaacagcaa

SEQ ID NO: 2027952 - RNA, 22 nt, Human herpesvirus 5
aaagcacaauacacaugugguu

SEQ ID NO: 2027953 - RNA, 23 nt, Human herpesvirus 5
ggacggcuacauguguccgggca

SEQ ID NO: 2027954 - RNA, 15 nt, Human herpesvirus 5
auaagaaaagacaau

SEQ ID NO: 2027955 - RNA, 17 nt, Human herpesvirus 5
cuucucgaucuuuugga

SEQ ID NO: 2027956 - RNA, 16 nt, Human herpesvirus 5
augaauuccucuauug

SEQ ID NO: 2027957 - RNA, 18 nt, Human herpesvirus 5
acuggaccacguuguccg

SEQ ID NO: 2027958 - RNA, 13 nt, Human herpesvirus 5
gcagaaugaacaa

SEQ ID NO: 2027959 - RNA, 16 nt, Human herpesvirus 5
aggucguggaggcagc

SEQ ID NO: 2027960 - RNA, 17 nt, Human herpesvirus 5
gugcccgucggcugccu

SEQ ID NO: 2027961 - RNA, 13 nt, Human herpesvirus 5
gguggcggcagcc

SEQ ID NO: 2027962 - RNA, 14 nt, Human herpesvirus 5
gaagggugugacug

SEQ ID NO: 2027963 - RNA, 14 nt, Human herpesvirus 5
guucuguaaucuuc

SEQ ID NO: 2027964 - RNA, 19 nt, Human herpesvirus 5
cacagagucgccaguccau

SEQ ID NO: 2027965 - RNA, 15 nt, Human herpesvirus 5
caugcgguguuuccg

SEQ ID NO: 2027966 - RNA, 22 nt, Human herpesvirus 5
cauauguagcacucaacauguu

SEQ ID NO: 2027967 - RNA, 18 nt, Human herpesvirus 5
gcggcucgggcuggcgug

SEQ ID NO: 2027968 - RNA, 17 nt, Human herpesvirus 5
ucgguguuaaggauucu

SEQ ID NO: 2027969 - RNA, 16 nt, Human herpesvirus 5
agaguuguggcaaaga

SEQ ID NO: 2027970 - RNA, 23 nt, Human herpesvirus 5
gcggaggauccaaggccuccagc

SEQ ID NO: 2027971 - RNA, 23 nt, Human herpesvirus 5
auaaaaugcuguauuauauacaa

SEQ ID NO: 2027972 - RNA, 17 nt, Human herpesvirus 5
gcccucagcgugcucag

SEQ ID NO: 2027973 - RNA, 15 nt, Human herpesvirus 5
gccgcgccgccugga

SEQ ID NO: 2027974 - RNA, 19 nt, Human herpesvirus 5
ugucgcugcguccagcguc

SEQ ID NO: 2027975 - RNA, 18 nt, Human herpesvirus 5
gucuccaagucuggugcg

SEQ ID NO: 2027976 - RNA, 14 nt, Human herpesvirus 5
ugguggucuacaag

SEQ ID NO: 2027977 - RNA, 15 nt, Human herpesvirus 5
uggccgagcuaugcg

SEQ ID NO: 2027978 - RNA, 13 nt, Human herpesvirus 5
acuacgaagauau

SEQ ID NO: 2027979 - RNA, 22 nt, Human herpesvirus 5
gaaggcggcucgcuggaagccg

SEQ ID NO: 2027980 - RNA, 23 nt, Human herpesvirus 5
cuggaaggcguggaugagguacu

SEQ ID NO: 2027981 - RNA, 20 nt, Human herpesvirus 5
cucagguuccccgagagggu

SEQ ID NO: 2027982 - RNA, 15 nt, Human herpesvirus 5
cacgccggccugagc

SEQ ID NO: 2027983 - RNA, 20 nt, Human herpesvirus 5
caauggaagccauacuucuc

SEQ ID NO: 2027984 - RNA, 24 nt, Human herpesvirus 5
cuguaguacuaccguuaacuauuc

SEQ ID NO: 2027985 - RNA, 21 nt, Human herpesvirus 5
cggcuguggcuucucuggaga

SEQ ID NO: 2027986 - RNA, 13 nt, Human herpesvirus 5
ccaucuucaucuu

SEQ ID NO: 2027987 - RNA, 16 nt, Human herpesvirus 5
gcggucagaaaaagaa

SEQ ID NO: 2027988 - RNA, 14 nt, Human herpesvirus 5
aauacagaguccgu

SEQ ID NO: 2027989 - RNA, 14 nt, Human herpesvirus 5
gccaguugcuguug

SEQ ID NO: 2027990 - RNA, 17 nt, Human herpesvirus 5
cgugcgguaacuggcag

SEQ ID NO: 2027991 - RNA, 16 nt, Human herpesvirus 5
ugagacugguggugag

SEQ ID NO: 2027992 - RNA, 16 nt, Human herpesvirus 5
ucucaccgugcucgug

SEQ ID NO: 2027993 - RNA, 17 nt, Human herpesvirus 5
caauuuuucuuuuuccu

SEQ ID NO: 2027994 - RNA, 19 nt, Human herpesvirus 5
accgacgacgacagucucc

SEQ ID NO: 2027995 - RNA, 23 nt, Human herpesvirus 5
cgcugauacuaucgggggagaug

SEQ ID NO: 2027996 - RNA, 15 nt, Human herpesvirus 5
cuguggaauacccag

SEQ ID NO: 2027997 - RNA, 21 nt, Human herpesvirus 5
cuacuucacgugcggcugugu

SEQ ID NO: 2027998 - RNA, 20 nt, Human herpesvirus 5
guccggccgucgcaagggcu

SEQ ID NO: 2027999 - RNA, 13 nt, Human herpesvirus 5
gaucccacuggca

SEQ ID NO: 2028000 - RNA, 21 nt, Human herpesvirus 5
ccaaagaugaagacacccugc

SEQ ID NO: 2028001 - RNA, 19 nt, Human herpesvirus 5
gccgccgaagccuggggca

SEQ ID NO: 2028002 - RNA, 11 nt, Human herpesvirus 5
gggaagggugu

SEQ ID NO: 2028003 - RNA, 13 nt, Human herpesvirus 5
gcaaugacaugga

SEQ ID NO: 2028004 - RNA, 21 nt, Human herpesvirus 5
cggcccucucgcgcccgcaga

SEQ ID NO: 2028005 - RNA, 15 nt, Human herpesvirus 5
aagaacgugguuguu

SEQ ID NO: 2028006 - RNA, 20 nt, Human herpesvirus 5
gacggcuuuccaagcugucg

SEQ ID NO: 2028007 - RNA, 13 nt, Human herpesvirus 5
gcguccacgggcu

SEQ ID NO: 2028008 - RNA, 24 nt, Human herpesvirus 5
ccucgcucggaacgacgacucagg

SEQ ID NO: 2028009 - RNA, 21 nt, Human herpesvirus 5
aacugcugccucgaugcgccu

SEQ ID NO: 2028010 - RNA, 20 nt, Human herpesvirus 5
ggaagcgcugauguaccugc

SEQ ID NO: 2028011 - RNA, 14 nt, Human herpesvirus 5
gugaucugggcagc

SEQ ID NO: 2028012 - RNA, 17 nt, Human herpesvirus 5
cuagacgaagaggacac

SEQ ID NO: 2028013 - RNA, 18 nt, Human herpesvirus 5
aauaaaagcacuucagaa

SEQ ID NO: 2028014 - RNA, 13 nt, Human herpesvirus 5
cucuauacacaua

SEQ ID NO: 2028015 - RNA, 19 nt, Human herpesvirus 5
uaaggagcaaaaccgggua

SEQ ID NO: 2028016 - RNA, 14 nt, Human herpesvirus 5
gccuguggcaccgc

SEQ ID NO: 2028017 - RNA, 16 nt, Human herpesvirus 5
ccgcgucccuggggcu

SEQ ID NO: 2028018 - RNA, 17 nt, Human herpesvirus 5
gcuuaucugccucuucc

SEQ ID NO: 2028019 - RNA, 19 nt, Human herpesvirus 5
ccuauaaaaccgugcccgu

SEQ ID NO: 2028020 - RNA, 13 nt, Human herpesvirus 5
caaaguucaaagu

SEQ ID NO: 2028021 - RNA, 18 nt, Human herpesvirus 5
ugcaaagucaacauguag

SEQ ID NO: 2028022 - RNA, 18 nt, Human herpesvirus 5
cccccuaccugcgcgaua

SEQ ID NO: 2028023 - RNA, 14 nt, Human herpesvirus 5
ugacgcggacgagg

SEQ ID NO: 2028024 - RNA, 23 nt, Human herpesvirus 5
cagacgucggcgguccuccagca

SEQ ID NO: 2028025 - RNA, 14 nt, Human herpesvirus 5
cuuauucuagcccu

SEQ ID NO: 2028026 - RNA, 15 nt, Human herpesvirus 5
acaacagucgcagcc

SEQ ID NO: 2028027 - RNA, 17 nt, Human herpesvirus 5
cccugguauccaacuuc

SEQ ID NO: 2028028 - RNA, 20 nt, Human herpesvirus 5
cugcugugguguugccuucu

SEQ ID NO: 2028029 - RNA, 14 nt, Human herpesvirus 5
uuggcaacaucacc

SEQ ID NO: 2028030 - RNA, 15 nt, Human herpesvirus 5
gucaggacuggaagu

SEQ ID NO: 2028031 - RNA, 23 nt, Human herpesvirus 5
gaccagcaguaugacgugcgaug

SEQ ID NO: 2028032 - RNA, 20 nt, Human herpesvirus 5
gcaccugugugaucugggca

SEQ ID NO: 2028033 - RNA, 14 nt, Human herpesvirus 5
gagcaccggcgccu

SEQ ID NO: 2028034 - RNA, 20 nt, Human herpesvirus 5
ucucugaaggacaguguauu

SEQ ID NO: 2028035 - RNA, 19 nt, Human herpesvirus 5
ccacgcugacaacccacuc

SEQ ID NO: 2028036 - RNA, 21 nt, Human herpesvirus 5
gcggcaccagagacagagacc

SEQ ID NO: 2028037 - RNA, 21 nt, Human herpesvirus 5
cuuuuacggguaaugcaugcu

SEQ ID NO: 2028038 - RNA, 16 nt, Human herpesvirus 5
cucugcuucuuuucug

SEQ ID NO: 2028039 - RNA, 19 nt, Human herpesvirus 5
caacuaucaccaaacaaca

SEQ ID NO: 2028040 - RNA, 21 nt, Human herpesvirus 5
caguagcgguaccagacgcgg

SEQ ID NO: 2028041 - RNA, 15 nt, Human herpesvirus 5
cuuuauuugcaucau

SEQ ID NO: 2028042 - RNA, 13 nt, Human herpesvirus 5
aauaaaaaacagc

SEQ ID NO: 2028043 - RNA, 13 nt, Human herpesvirus 5
agcauacggggag

SEQ ID NO: 2028044 - RNA, 14 nt, Human herpesvirus 5
gagacacuugaaua

SEQ ID NO: 2028045 - RNA, 18 nt, Human herpesvirus 5
gucaacaucaucagcgcc

SEQ ID NO: 2028046 - RNA, 24 nt, Human herpesvirus 5
ugccgccgccaacgccgagcucug

SEQ ID NO: 2028047 - RNA, 13 nt, Human herpesvirus 5
auuguuucuuauu

SEQ ID NO: 2028048 - RNA, 11 nt, Human herpesvirus 5
cggguguccca

SEQ ID NO: 2028049 - RNA, 13 nt, Human herpesvirus 5
ucauggacccgcc

SEQ ID NO: 2028050 - RNA, 15 nt, Human herpesvirus 5
ugcuguccucguccg

SEQ ID NO: 2028051 - RNA, 18 nt, Human herpesvirus 5
acauuuuuugacagauga

SEQ ID NO: 2028052 - RNA, 19 nt, Human herpesvirus 5
cacccccgauaugggccgc

SEQ ID NO: 2028053 - RNA, 18 nt, Human herpesvirus 5
acgauacacccugucacc

SEQ ID NO: 2028054 - RNA, 14 nt, Human herpesvirus 5
caguaccaccgcug

SEQ ID NO: 2028055 - RNA, 22 nt, Human herpesvirus 5
ccgccccagcagaccagccacc

SEQ ID NO: 2028056 - RNA, 15 nt, Human herpesvirus 5
gccgucacugccacc

SEQ ID NO: 2028057 - RNA, 16 nt, Human herpesvirus 5
guaccaucuggcgcag

SEQ ID NO: 2028058 - RNA, 15 nt, Human herpesvirus 5
ucagcuugcccgacc

SEQ ID NO: 2028059 - RNA, 14 nt, Human herpesvirus 5
gguggcugggcuca

SEQ ID NO: 2028060 - RNA, 15 nt, Human herpesvirus 5
gcggacuuggcagcg

SEQ ID NO: 2028061 - RNA, 15 nt, Human herpesvirus 5
gcccgccacugcccg

SEQ ID NO: 2028062 - RNA, 17 nt, Human herpesvirus 5
gcaacggaccgcugucg

SEQ ID NO: 2028063 - RNA, 16 nt, Human herpesvirus 5
ccgcggaggugcuggc

SEQ ID NO: 2028064 - RNA, 22 nt, Human herpesvirus 5
cuguggaauacccagcugggga

SEQ ID NO: 2028065 - RNA, 18 nt, Human herpesvirus 5
acaggcucgucgugggcu

SEQ ID NO: 2028066 - RNA, 20 nt, Human herpesvirus 5
uggacacucuggcccugcug

SEQ ID NO: 2028067 - RNA, 17 nt, Human herpesvirus 5
agcgccguccugcagac

SEQ ID NO: 2028068 - RNA, 20 nt, Human herpesvirus 5
cgggucucuuugacacgagc

SEQ ID NO: 2028069 - RNA, 17 nt, Human herpesvirus 5
cgcugccgcagcugcug

SEQ ID NO: 2028070 - RNA, 17 nt, Human herpesvirus 5
cacccaggccgcggggu

SEQ ID NO: 2028071 - RNA, 17 nt, Human herpesvirus 5
cugcacgaccugcucca

SEQ ID NO: 2028072 - RNA, 16 nt, Human herpesvirus 5
caagcuuuagccaggu

SEQ ID NO: 2028073 - RNA, 16 nt, Human herpesvirus 5
aacucuuuccccgccc

SEQ ID NO: 2028074 - RNA, 23 nt, Human herpesvirus 5
gucaaggccgccucuucuggccc

SEQ ID NO: 2028075 - RNA, 20 nt, Human herpesvirus 5
guucgugauucguaggcagc

SEQ ID NO: 2028076 - RNA, 15 nt, Human herpesvirus 5
gcgccgccgacucgc

SEQ ID NO: 2028077 - RNA, 15 nt, Human herpesvirus 5
ccguuuugcuguccu

SEQ ID NO: 2028078 - RNA, 13 nt, Human herpesvirus 5
aagucacaggaaa

SEQ ID NO: 2028079 - RNA, 16 nt, Human herpesvirus 5
guuucccccacccgcc

SEQ ID NO: 2028080 - RNA, 18 nt, Human herpesvirus 5
aucucggcauaguggugu

SEQ ID NO: 2028081 - RNA, 22 nt, Human herpesvirus 5
cucaaagcagaccaaguacgac

SEQ ID NO: 2028082 - RNA, 13 nt, Human herpesvirus 5
gcucaacuuucua

SEQ ID NO: 2028083 - RNA, 12 nt, Human herpesvirus 5
uuucucaucuca

SEQ ID NO: 2028084 - RNA, 17 nt, Human herpesvirus 5
ggcucaucaccaacgug

SEQ ID NO: 2028085 - RNA, 16 nt, Human herpesvirus 5
uaaucgacaggaggcu

SEQ ID NO: 2028086 - RNA, 14 nt, Human herpesvirus 5
accgcaaaggccac

SEQ ID NO: 2028087 - RNA, 14 nt, Human herpesvirus 5
cgauauaggugaca

SEQ ID NO: 2028088 - RNA, 22 nt, Human herpesvirus 5
ccaguuucaccaaggcgagcca

SEQ ID NO: 2028089 - RNA, 16 nt, Human herpesvirus 5
uccuccuucuuccucg

SEQ ID NO: 2028090 - RNA, 18 nt, Human herpesvirus 5
gacacagcgccgcgcugg

SEQ ID NO: 2028091 - RNA, 21 nt, Human herpesvirus 5
cacuacguugggucugcgcug

SEQ ID NO: 2028092 - RNA, 20 nt, Human herpesvirus 5
aaucuuccauaauaaaagua

SEQ ID NO: 2028093 - RNA, 23 nt, Human herpesvirus 5
cucagggcugggauccgccgcca

SEQ ID NO: 2028094 - RNA, 21 nt, Human herpesvirus 5
cagcuucuuucucaccgugcu

SEQ ID NO: 2028095 - RNA, 20 nt, Human herpesvirus 5
ugacacauagcguaccccug

SEQ ID NO: 2028096 - RNA, 14 nt, Human herpesvirus 5
caaaaccggguaca

SEQ ID NO: 2028097 - RNA, 16 nt, Human herpesvirus 5
agccccaagcgguacg

SEQ ID NO: 2028098 - RNA, 18 nt, Human herpesvirus 5
ccguagcuagugcucggc

SEQ ID NO: 2028099 - RNA, 19 nt, Human herpesvirus 5
ucugcgguacgcgcacgcc

SEQ ID NO: 2028100 - RNA, 21 nt, Human herpesvirus 5
guaaacuuaugaauccggcug

SEQ ID NO: 2028101 - RNA, 16 nt, Human herpesvirus 5
ugcgccgucucuucgc

SEQ ID NO: 2028102 - RNA, 16 nt, Human herpesvirus 5
accacgguuaccuucu

SEQ ID NO: 2028103 - RNA, 17 nt, Human herpesvirus 5
auaaucggcucucaggc

SEQ ID NO: 2028104 - RNA, 20 nt, Human herpesvirus 5
ggcucaccacgcagcaggcu

SEQ ID NO: 2028105 - RNA, 15 nt, Human herpesvirus 5
ccgcagugggcccac

SEQ ID NO: 2028106 - RNA, 14 nt, Human herpesvirus 5
gccgcagcugcugg

SEQ ID NO: 2028107 - RNA, 17 nt, Human herpesvirus 5
gacgcgccgggcggcuu

SEQ ID NO: 2028108 - RNA, 19 nt, Human herpesvirus 5
cucgucaaucuugcguugc

SEQ ID NO: 2028109 - RNA, 23 nt, Human herpesvirus 5
gccacguucuugcguccuucauc

SEQ ID NO: 2028110 - RNA, 18 nt, Human herpesvirus 5
caugucuuacaaaucaca

SEQ ID NO: 2028111 - RNA, 22 nt, Human herpesvirus 5
uccacuuccgugauagccacga

SEQ ID NO: 2028112 - RNA, 17 nt, Human herpesvirus 5
acaaauaccaacacuau

SEQ ID NO: 2028113 - RNA, 22 nt, Human herpesvirus 5
caggaggaaaaaaaaacuagac

SEQ ID NO: 2028114 - RNA, 22 nt, Human herpesvirus 5
cucguuguacgcauuacacagg

SEQ ID NO: 2028115 - RNA, 14 nt, Human herpesvirus 5
agaguuacaugcaa

SEQ ID NO: 2028116 - RNA, 15 nt, Human herpesvirus 5
ccuggacgccugggc

SEQ ID NO: 2028117 - RNA, 20 nt, Human herpesvirus 5
cuacgaucgcuggaaagaca

SEQ ID NO: 2028118 - RNA, 21 nt, Human herpesvirus 5
uagcuagugcagccuuaggaa

SEQ ID NO: 2028119 - RNA, 14 nt, Human herpesvirus 5
cccuccuuuucccc

SEQ ID NO: 2028120 - RNA, 18 nt, Human herpesvirus 5
gccugcacgaccugcucc

SEQ ID NO: 2028121 - RNA, 13 nt, Human herpesvirus 5
caccgacccugcg

SEQ ID NO: 2028122 - RNA, 17 nt, Human herpesvirus 5
agcgucucuugcggcgc

SEQ ID NO: 2028123 - RNA, 14 nt, Human herpesvirus 5
gcggguggagauga

SEQ ID NO: 2028124 - RNA, 19 nt, Human herpesvirus 5
gugcaucuacguggucggg

SEQ ID NO: 2028125 - RNA, 21 nt, Human herpesvirus 5
cacugccaacccagcagccgg

SEQ ID NO: 2028126 - RNA, 14 nt, Human herpesvirus 5
caugugcagcuggu

SEQ ID NO: 2028127 - RNA, 17 nt, Human herpesvirus 5
cugcuauaagaaggcca

SEQ ID NO: 2028128 - RNA, 15 nt, Human herpesvirus 5
ccacaaccuguggaa

SEQ ID NO: 2028129 - RNA, 14 nt, Human herpesvirus 5
agaucgucuacggc

SEQ ID NO: 2028130 - RNA, 19 nt, Human herpesvirus 5
ugaaucgcgagcugggcga

SEQ ID NO: 2028131 - RNA, 21 nt, Human herpesvirus 5
agaacuuuguagugcgcgccg

SEQ ID NO: 2028132 - RNA, 16 nt, Human herpesvirus 5
gugauuuaucugccac

SEQ ID NO: 2028133 - RNA, 20 nt, Human herpesvirus 5
cuuccccacccaguagacag

SEQ ID NO: 2028134 - RNA, 19 nt, Human herpesvirus 5
cggugacgucggugguggc

SEQ ID NO: 2028135 - RNA, 23 nt, Human herpesvirus 5
cgcugguggccgaacagcagcuc

SEQ ID NO: 2028136 - RNA, 21 nt, Human herpesvirus 5
gguccuccagcagcagcuggu

SEQ ID NO: 2028137 - RNA, 22 nt, Human herpesvirus 5
acuuuccucgccaccacuacca

SEQ ID NO: 2028138 - RNA, 21 nt, Human herpesvirus 5
gcgccaguugucgcaggucca

SEQ ID NO: 2028139 - RNA, 21 nt, Human herpesvirus 5
cauggacauaaaaaagagaca

SEQ ID NO: 2028140 - RNA, 20 nt, Human herpesvirus 5
cagcgugcucagcugguggc

SEQ ID NO: 2028141 - RNA, 15 nt, Human herpesvirus 5
cucuugcgaggcuuu

SEQ ID NO: 2028142 - RNA, 14 nt, Human herpesvirus 5
cgaccgucuggagg

SEQ ID NO: 2028143 - RNA, 12 nt, Human herpesvirus 5
cggccgccgacg

SEQ ID NO: 2028144 - RNA, 20 nt, Human herpesvirus 5
guucaacacuuucucuggau

SEQ ID NO: 2028145 - RNA, 16 nt, Human herpesvirus 5
agggcgcgccggcgcc

SEQ ID NO: 2028146 - RNA, 21 nt, Human herpesvirus 5
cgagcuggacaaguacagcgg

SEQ ID NO: 2028147 - RNA, 17 nt, Human herpesvirus 5
ggcucuugcgcuucugc

SEQ ID NO: 2028148 - RNA, 18 nt, Human herpesvirus 5
agcugcuuuucgggccgc

SEQ ID NO: 2028149 - RNA, 19 nt, Human herpesvirus 5
accgcgaguaucgggccgu

SEQ ID NO: 2028150 - RNA, 17 nt, Human herpesvirus 5
acggaguuuucccucag

SEQ ID NO: 2028151 - RNA, 23 nt, Human herpesvirus 5
ggacacguagaucccacuggcaa

SEQ ID NO: 2028152 - RNA, 21 nt, Human herpesvirus 5
ggagcucacccggcugcuggc

SEQ ID NO: 2028153 - RNA, 22 nt, Human herpesvirus 5
agcguucaacacuuucucugga

SEQ ID NO: 2028154 - RNA, 21 nt, Human herpesvirus 5
cgcccgaggcggaggagccgg

SEQ ID NO: 2028155 - RNA, 20 nt, Human herpesvirus 5
acagccgggcguuggccugu

SEQ ID NO: 2028156 - RNA, 14 nt, Human herpesvirus 5
gccgcgggguacgg

SEQ ID NO: 2028157 - RNA, 22 nt, Human herpesvirus 5
cagagccaccaggugccggcga

SEQ ID NO: 2028158 - RNA, 23 nt, Human herpesvirus 5
ucccgacaggcucgucgugggcu

SEQ ID NO: 2028159 - RNA, 15 nt, Human herpesvirus 5
ucacgaggaccauuu

SEQ ID NO: 2028160 - RNA, 16 nt, Human herpesvirus 5
gucaaucagacuuucg

SEQ ID NO: 2028161 - RNA, 16 nt, Human herpesvirus 5
cacacugcuacccugc

SEQ ID NO: 2028162 - RNA, 20 nt, Human herpesvirus 5
cgacggcuuuccaagcuguc

SEQ ID NO: 2028163 - RNA, 15 nt, Human herpesvirus 5
acaguuuccacgcag

SEQ ID NO: 2028164 - RNA, 15 nt, Human herpesvirus 5
cgugcaacgccacca

SEQ ID NO: 2028165 - RNA, 23 nt, Human herpesvirus 5
gcaugacggugacuauguguacu

SEQ ID NO: 2028166 - RNA, 17 nt, Human herpesvirus 5
cggaucggacaucauac

SEQ ID NO: 2028167 - RNA, 22 nt, Human herpesvirus 5
cgcggaugagcgugcugcucug

SEQ ID NO: 2028168 - RNA, 16 nt, Human herpesvirus 5
cgccgccuccgcggcc

SEQ ID NO: 2028169 - RNA, 16 nt, Human herpesvirus 5
ggucagcggcacgccg

SEQ ID NO: 2028170 - RNA, 20 nt, Human herpesvirus 5
gcuucucucuggucuucccu

SEQ ID NO: 2028171 - RNA, 14 nt, Human herpesvirus 5
aaauacagaguccg

SEQ ID NO: 2028172 - RNA, 22 nt, Human herpesvirus 5
uugaccacacucgugacgucaa

SEQ ID NO: 2028173 - RNA, 20 nt, Human herpesvirus 5
gacgcgcguggccgcgcugg

SEQ ID NO: 2028174 - RNA, 13 nt, Human herpesvirus 5
cgucguuagccag

SEQ ID NO: 2028175 - RNA, 12 nt, Human herpesvirus 5
guggaaggcacc

SEQ ID NO: 2028176 - RNA, 17 nt, Human herpesvirus 5
cucacagucuaucccua

SEQ ID NO: 2028177 - RNA, 15 nt, Human herpesvirus 5
gcuguugaccugggu

SEQ ID NO: 2028178 - RNA, 18 nt, Human herpesvirus 5
gccuuaucgugcuaggca

SEQ ID NO: 2028179 - RNA, 17 nt, Human herpesvirus 5
ucccaugcaacuucuuc

SEQ ID NO: 2028180 - RNA, 17 nt, Human herpesvirus 5
guaccuaaagcccccac

SEQ ID NO: 2028181 - RNA, 18 nt, Human herpesvirus 5
cgcaccgguuggagcagc

SEQ ID NO: 2028182 - RNA, 17 nt, Human herpesvirus 5
gauuuucgcgcucuugu

SEQ ID NO: 2028183 - RNA, 16 nt, Human herpesvirus 5
gaaucucuugcgcccu

SEQ ID NO: 2028184 - RNA, 14 nt, Human herpesvirus 5
cugcggccggccgc

SEQ ID NO: 2028185 - RNA, 15 nt, Human herpesvirus 5
gcacgaccugcucca

SEQ ID NO: 2028186 - RNA, 15 nt, Human herpesvirus 5
gaguccuggucuuuc

SEQ ID NO: 2028187 - RNA, 16 nt, Human herpesvirus 5
ucaacaaacagcucuu

SEQ ID NO: 2028188 - RNA, 15 nt, Human herpesvirus 5
cgucgccuuccagcu

SEQ ID NO: 2028189 - RNA, 19 nt, Human herpesvirus 5
ugacgugcucaagagguga

SEQ ID NO: 2028190 - RNA, 15 nt, Human herpesvirus 5
gaaugcuaguuugua

SEQ ID NO: 2028191 - RNA, 20 nt, Human herpesvirus 5
ccaucgucccccuuucucua

SEQ ID NO: 2028192 - RNA, 15 nt, Human herpesvirus 5
ccccucugcugcugg

SEQ ID NO: 2028193 - RNA, 16 nt, Human herpesvirus 5
cgagcauggaucacgc

SEQ ID NO: 2028194 - RNA, 11 nt, Human herpesvirus 5
ugggugcaaug

SEQ ID NO: 2028195 - RNA, 18 nt, Human herpesvirus 5
ggcgguggccgucuuggg

SEQ ID NO: 2028196 - RNA, 14 nt, Human herpesvirus 5
cagcagccaccgac

SEQ ID NO: 2028197 - RNA, 23 nt, Human herpesvirus 5
gccgauucguaaucgacaggagg

SEQ ID NO: 2028198 - RNA, 22 nt, Human herpesvirus 5
caggccgccgcucaagccgcgg

SEQ ID NO: 2028199 - RNA, 22 nt, Human herpesvirus 5
gacgggaugcacagcgucuggc

SEQ ID NO: 2028200 - RNA, 22 nt, Human herpesvirus 5
cgcugauggccuacggcugcau

SEQ ID NO: 2028201 - RNA, 13 nt, Human herpesvirus 5
aacuuugcugcua

SEQ ID NO: 2028202 - RNA, 17 nt, Human herpesvirus 5
gccguugcggccgccgc

SEQ ID NO: 2028203 - RNA, 12 nt, Human herpesvirus 5
ggcagcuggcuu

SEQ ID NO: 2028204 - RNA, 16 nt, Human herpesvirus 5
gcaagggcugcucggc

SEQ ID NO: 2028205 - RNA, 23 nt, Human herpesvirus 5
uggcgcggucugcgugaugccug

SEQ ID NO: 2028206 - RNA, 16 nt, Human herpesvirus 5
gcgacagcagcaucag

SEQ ID NO: 2028207 - RNA, 18 nt, Human herpesvirus 5
ccuccagcagcagcuggu

SEQ ID NO: 2028208 - RNA, 11 nt, Human herpesvirus 5
acacagcagca

SEQ ID NO: 2028209 - RNA, 20 nt, Human herpesvirus 5
ucacgacgacgcgcccccca

SEQ ID NO: 2028210 - RNA, 21 nt, Human herpesvirus 5
guccaccucugcuacuggccc

SEQ ID NO: 2028211 - RNA, 15 nt, Human herpesvirus 5
aucgaccguuguccc

SEQ ID NO: 2028212 - RNA, 13 nt, Human herpesvirus 5
uauuuuacaggua

SEQ ID NO: 2028213 - RNA, 16 nt, Human herpesvirus 5
gggugccgccacgguu

SEQ ID NO: 2028214 - RNA, 20 nt, Human herpesvirus 5
cucagucaccgaguccauca

SEQ ID NO: 2028215 - RNA, 19 nt, Human herpesvirus 5
gccgcagccguugguggaa

SEQ ID NO: 2028216 - RNA, 17 nt, Human herpesvirus 5
cuuggccgaccugugcg

SEQ ID NO: 2028217 - RNA, 22 nt, Human herpesvirus 5
cgccaugaggcgguggcugcgc

SEQ ID NO: 2028218 - RNA, 10 nt, Human herpesvirus 5
aggccgccgc

SEQ ID NO: 2028219 - RNA, 22 nt, Human herpesvirus 5
ggaugcgcgaagcugcgcaggc

SEQ ID NO: 2028220 - RNA, 14 nt, Human herpesvirus 5
acggcgucuuccuc

SEQ ID NO: 2028221 - RNA, 17 nt, Human herpesvirus 5
gaucuggaaggcgugga

SEQ ID NO: 2028222 - RNA, 14 nt, Human herpesvirus 5
acccacgaccauuu

SEQ ID NO: 2028223 - RNA, 14 nt, Human herpesvirus 5
caaucacccacaga

SEQ ID NO: 2028224 - RNA, 13 nt, Human herpesvirus 5
cgccaccgguggc

SEQ ID NO: 2028225 - RNA, 22 nt, Human herpesvirus 5
ccggccccacgcugacaaccca

SEQ ID NO: 2028226 - RNA, 17 nt, Human herpesvirus 5
ugaaucgaugucaagga

SEQ ID NO: 2028227 - RNA, 12 nt, Human herpesvirus 5
aaacaacaccac

SEQ ID NO: 2028228 - RNA, 17 nt, Human herpesvirus 5
accacccgacugcagcc

SEQ ID NO: 2028229 - RNA, 21 nt, Human herpesvirus 5
ccgucgaggagguaguccccu

SEQ ID NO: 2028230 - RNA, 17 nt, Human herpesvirus 5
gacgacguggccuccuc

SEQ ID NO: 2028231 - RNA, 13 nt, Human herpesvirus 5
acucagaggccac

SEQ ID NO: 2028232 - RNA, 20 nt, Human herpesvirus 5
aaacgccaccugcaaaguua

SEQ ID NO: 2028233 - RNA, 19 nt, Human herpesvirus 5
agucagacccacuaccugg

SEQ ID NO: 2028234 - RNA, 16 nt, Human herpesvirus 5
cgcaugucgucucauc

SEQ ID NO: 2028235 - RNA, 18 nt, Human herpesvirus 5
cacgccguugccacgagc

SEQ ID NO: 2028236 - RNA, 18 nt, Human herpesvirus 5
ccuuccgcgugcuccacc

SEQ ID NO: 2028237 - RNA, 13 nt, Human herpesvirus 5
caacuuaaccaca

SEQ ID NO: 2028238 - RNA, 23 nt, Human herpesvirus 5
aagauaaucugccaaucgcaccu

SEQ ID NO: 2028239 - RNA, 18 nt, Human herpesvirus 5
aaccguaguugucggcgc

SEQ ID NO: 2028240 - RNA, 14 nt, Human herpesvirus 5
aucugggugcaaug

SEQ ID NO: 2028241 - RNA, 17 nt, Human herpesvirus 5
cgagcgggaggcgguga

SEQ ID NO: 2028242 - RNA, 16 nt, Human herpesvirus 5
gccgcggugcaggccg

SEQ ID NO: 2028243 - RNA, 14 nt, Human herpesvirus 5
aagagguuggugug

SEQ ID NO: 2028244 - RNA, 17 nt, Human herpesvirus 5
uuccgauccuuggaaga

SEQ ID NO: 2028245 - RNA, 20 nt, Human herpesvirus 5
acccugcguccccgcacgac

SEQ ID NO: 2028246 - RNA, 18 nt, Human herpesvirus 5
cagcugguggcucaugcc

SEQ ID NO: 2028247 - RNA, 22 nt, Human herpesvirus 5
guagccaccuguuggaacccau

SEQ ID NO: 2028248 - RNA, 20 nt, Human herpesvirus 5
cggccaguacggccucuggg

SEQ ID NO: 2028249 - RNA, 12 nt, Human herpesvirus 5
ugcagcccaccg

SEQ ID NO: 2028250 - RNA, 20 nt, Human herpesvirus 5
uugauuucaacaaauaccaa

SEQ ID NO: 2028251 - RNA, 17 nt, Human herpesvirus 5
acaagcgccgucacuuc

SEQ ID NO: 2028252 - RNA, 19 nt, Human herpesvirus 5
gaagggcgcgggcggccag

SEQ ID NO: 2028253 - RNA, 23 nt, Human herpesvirus 5
acggggcuggguggagagggaag

SEQ ID NO: 2028254 - RNA, 15 nt, Human herpesvirus 5
auuaugcaggagacg

SEQ ID NO: 2028255 - RNA, 17 nt, Human herpesvirus 5
cuccuccgagccaaaag

SEQ ID NO: 2028256 - RNA, 12 nt, Human herpesvirus 5
cggcccugugcu

SEQ ID NO: 2028257 - RNA, 15 nt, Human herpesvirus 5
gucugacgcugcucc

SEQ ID NO: 2028258 - RNA, 21 nt, Human herpesvirus 5
ggcuggugucacuagacagau

SEQ ID NO: 2028259 - RNA, 22 nt, Human herpesvirus 5
caguacggcuuucugcggaaug

SEQ ID NO: 2028260 - RNA, 12 nt, Human herpesvirus 5
uggggcugcugc

SEQ ID NO: 2028261 - RNA, 21 nt, Human herpesvirus 5
uccacagagccgcguggcugu

SEQ ID NO: 2028262 - RNA, 18 nt, Human herpesvirus 5
cugcacgaccugcuccag

SEQ ID NO: 2028263 - RNA, 22 nt, Human herpesvirus 5
cuggaccggugguacugcugug

SEQ ID NO: 2028264 - RNA, 19 nt, Human herpesvirus 5
ucgauggggucguggcuca

SEQ ID NO: 2028265 - RNA, 17 nt, Human herpesvirus 5
gugauccaggagguggu

SEQ ID NO: 2028266 - RNA, 17 nt, Human herpesvirus 5
ggcgacaagcuguggcu

SEQ ID NO: 2028267 - RNA, 12 nt, Human herpesvirus 5
cacuacucuggg

SEQ ID NO: 2028268 - RNA, 12 nt, Human herpesvirus 5
acgucaggaauc

SEQ ID NO: 2028269 - RNA, 14 nt, Human herpesvirus 5
gagaccgucgccac

SEQ ID NO: 2028270 - RNA, 18 nt, Human herpesvirus 5
acgccgucacgcagguga

SEQ ID NO: 2028271 - RNA, 22 nt, Human herpesvirus 5
gcugcucaaugccaccaugaac

SEQ ID NO: 2028272 - RNA, 21 nt, Human herpesvirus 5
acaacggccgccgcagccacg

SEQ ID NO: 2028273 - RNA, 16 nt, Human herpesvirus 5
ggcggcgauggucaug

SEQ ID NO: 2028274 - RNA, 20 nt, Human herpesvirus 5
accacgacacggugcugcug

SEQ ID NO: 2028275 - RNA, 17 nt, Human herpesvirus 5
uuucgaguccguccucg

SEQ ID NO: 2028276 - RNA, 23 nt, Human herpesvirus 5
ugacgacggcgugguauccacgc

SEQ ID NO: 2028277 - RNA, 13 nt, Human herpesvirus 5
cguggagaccacc

SEQ ID NO: 2028278 - RNA, 22 nt, Human herpesvirus 5
cgggcugcuggucuccauggcc

SEQ ID NO: 2028279 - RNA, 16 nt, Human herpesvirus 5
ugcgacgccaugcuca

SEQ ID NO: 2028280 - RNA, 12 nt, Human herpesvirus 5
agcucagcaucg

SEQ ID NO: 2028281 - RNA, 17 nt, Human herpesvirus 5
cucuggcccugcuguac

SEQ ID NO: 2028282 - RNA, 15 nt, Human herpesvirus 5
gucuucugaagccgu

SEQ ID NO: 2028283 - RNA, 20 nt, Human herpesvirus 5
cacggcggcggccugcucgc

SEQ ID NO: 2028284 - RNA, 20 nt, Human herpesvirus 5
ucugugaugaacgacacaug

SEQ ID NO: 2028285 - RNA, 21 nt, Human herpesvirus 5
ccgcugccgcucagcgagcuc

SEQ ID NO: 2028286 - RNA, 19 nt, Human herpesvirus 5
cggcacgccgccgaagcuu

SEQ ID NO: 2028287 - RNA, 20 nt, Human herpesvirus 5
gcucgaaauguugacccagg

SEQ ID NO: 2028288 - RNA, 20 nt, Human herpesvirus 5
gcuucuuucucaccgugcuc

SEQ ID NO: 2028289 - RNA, 21 nt, Human herpesvirus 5
gagcggcucgccgccgcgcca

SEQ ID NO: 2028290 - RNA, 14 nt, Human herpesvirus 5
gacauggauaacga

SEQ ID NO: 2028291 - RNA, 13 nt, Human herpesvirus 5
aagccggcagcug

SEQ ID NO: 2028292 - RNA, 14 nt, Human herpesvirus 5
acagcaaggccgcc

SEQ ID NO: 2028293 - RNA, 17 nt, Human herpesvirus 5
ccgcuccaucgcagcca

SEQ ID NO: 2028294 - RNA, 17 nt, Human herpesvirus 5
agcugucagccucucac

SEQ ID NO: 2028295 - RNA, 19 nt, Human herpesvirus 5
ugcggcggcuugggcagca

SEQ ID NO: 2028296 - RNA, 19 nt, Human herpesvirus 5
ggaucuuauucgcuuugaa

SEQ ID NO: 2028297 - RNA, 20 nt, Human herpesvirus 5
ucgucaaggcucgcaaagac

SEQ ID NO: 2028298 - RNA, 19 nt, Human herpesvirus 5
gaccaagagcaugcugugg

SEQ ID NO: 2028299 - RNA, 20 nt, Human herpesvirus 5
cgugcgacgcgacuaugagg

SEQ ID NO: 2028300 - RNA, 21 nt, Human herpesvirus 5
uucagaccgcaacaacagcag

SEQ ID NO: 2028301 - RNA, 20 nt, Human herpesvirus 5
ggagccaaacugcgagcagc

SEQ ID NO: 2028302 - RNA, 20 nt, Human herpesvirus 5
gcgacaccguaucagcuacc

SEQ ID NO: 2028303 - RNA, 13 nt, Human herpesvirus 5
cuaugaggacgac

SEQ ID NO: 2028304 - RNA, 13 nt, Human herpesvirus 5
gcagcccaccgcc

SEQ ID NO: 2028305 - RNA, 15 nt, Human herpesvirus 5
caacgcguggcccug

SEQ ID NO: 2028306 - RNA, 21 nt, Human herpesvirus 5
ucaacgguggaauucgcuggg

SEQ ID NO: 2028307 - RNA, 15 nt, Human herpesvirus 5
gcaucgcaacaacag

SEQ ID NO: 2028308 - RNA, 19 nt, Human herpesvirus 5
ccaacuccgugccagcugg

SEQ ID NO: 2028309 - RNA, 15 nt, Human herpesvirus 5
gucgcgcggucgccg

SEQ ID NO: 2028310 - RNA, 21 nt, Human herpesvirus 5
accggggugguggugcugcug

SEQ ID NO: 2028311 - RNA, 20 nt, Human herpesvirus 5
cgggcaaagaguccaucugc

SEQ ID NO: 2028312 - RNA, 22 nt, Human herpesvirus 5
ggucaacgcguccagcuucugg

SEQ ID NO: 2028313 - RNA, 14 nt, Human herpesvirus 5
cggcuugcaaaacu

SEQ ID NO: 2028314 - RNA, 16 nt, Human herpesvirus 5
gcguccgggcuuuccu

SEQ ID NO: 2028315 - RNA, 18 nt, Human herpesvirus 5
ccacggcgucuuccuccu

SEQ ID NO: 2028316 - RNA, 22 nt, Human herpesvirus 5
ggacagagcagccguuuccaga

SEQ ID NO: 2028317 - RNA, 12 nt, Human herpesvirus 5
cacgacuggcca

SEQ ID NO: 2028318 - RNA, 14 nt, Human herpesvirus 5
accagcccagggau

SEQ ID NO: 2028319 - RNA, 12 nt, Human herpesvirus 5
aacguucuguaa

SEQ ID NO: 2028320 - RNA, 18 nt, Human herpesvirus 5
ccggccguuacgccgacg

SEQ ID NO: 2028321 - RNA, 14 nt, Human herpesvirus 5
ggcgcguagccacc

SEQ ID NO: 2028322 - RNA, 13 nt, Human herpesvirus 5
aguugagcggggu

SEQ ID NO: 2028323 - RNA, 19 nt, Human herpesvirus 5
cuuuuacaugaacaaaaaa

SEQ ID NO: 2028324 - RNA, 15 nt, Human herpesvirus 5
uacaccgcuggagcu

SEQ ID NO: 2028325 - RNA, 17 nt, Human herpesvirus 5
cgccgcucaggucgccc

SEQ ID NO: 2028326 - RNA, 20 nt, Human herpesvirus 5
accgccguucggcucuccuc

SEQ ID NO: 2028327 - RNA, 17 nt, Human herpesvirus 5
cggcucgccgccgcgcc

SEQ ID NO: 2028328 - RNA, 14 nt, Human herpesvirus 5
cccuuccaugacgc

SEQ ID NO: 2028329 - RNA, 14 nt, Human herpesvirus 5
cucuagagacagac

SEQ ID NO: 2028330 - RNA, 15 nt, Human herpesvirus 5
cgcggugcaggccgc

SEQ ID NO: 2028331 - RNA, 16 nt, Human herpesvirus 5
cuaggaacacugaaaa

SEQ ID NO: 2028332 - RNA, 12 nt, Human herpesvirus 5
ucccucugcugu

SEQ ID NO: 2028333 - RNA, 17 nt, Human herpesvirus 5
augcgcgucgaccuuga

SEQ ID NO: 2028334 - RNA, 15 nt, Human herpesvirus 5
agaaaaaaaagagag

SEQ ID NO: 2028335 - RNA, 15 nt, Human herpesvirus 5
gcggcggacaggccu

SEQ ID NO: 2028336 - RNA, 18 nt, Human herpesvirus 5
cagccacgcgcugguggc

SEQ ID NO: 2028337 - RNA, 17 nt, Human herpesvirus 5
aaaguccgucaugcugg

SEQ ID NO: 2028338 - RNA, 23 nt, Human herpesvirus 5
uccccacccaguagacagacagg

SEQ ID NO: 2028339 - RNA, 18 nt, Human herpesvirus 5
agaacgaucccuuuaucc

SEQ ID NO: 2028340 - RNA, 17 nt, Human herpesvirus 5
ggaaugguaaagacauc

SEQ ID NO: 2028341 - RNA, 18 nt, Human herpesvirus 5
cgcgcaucgccugcaccu

SEQ ID NO: 2028342 - RNA, 19 nt, Human herpesvirus 5
cugcggcggcuugggcagc

SEQ ID NO: 2028343 - RNA, 13 nt, Human herpesvirus 5
cuacucugggaua

SEQ ID NO: 2028344 - RNA, 22 nt, Human herpesvirus 5
ccaccgaagccguauuccguuu

SEQ ID NO: 2028345 - RNA, 19 nt, Human herpesvirus 5
ccaugagcggcaggaaggc

SEQ ID NO: 2028346 - RNA, 19 nt, Human herpesvirus 5
caggaucuggugcaggcca

SEQ ID NO: 2028347 - RNA, 19 nt, Human herpesvirus 5
cuucaucuuucagcuggcu

SEQ ID NO: 2028348 - RNA, 21 nt, Human herpesvirus 5
gaccgcaacaacagcagcaac

SEQ ID NO: 2028349 - RNA, 14 nt, Human herpesvirus 5
uaucgcgacagaca

SEQ ID NO: 2028350 - RNA, 12 nt, Human herpesvirus 5
gcaacugcugcc

SEQ ID NO: 2028351 - RNA, 18 nt, Human herpesvirus 5
uuggcggucgggucuguc

SEQ ID NO: 2028352 - RNA, 16 nt, Human herpesvirus 5
cggugagacccgcguc

SEQ ID NO: 2028353 - RNA, 22 nt, Human herpesvirus 5
ccugcagaccgaggcgcuggac

SEQ ID NO: 2028354 - RNA, 13 nt, Human herpesvirus 5
gcucagucgccua

SEQ ID NO: 2028355 - RNA, 14 nt, Human herpesvirus 5
ugcguguccagaua

SEQ ID NO: 2028356 - RNA, 17 nt, Human herpesvirus 5
gucccagccccagagcg

SEQ ID NO: 2028357 - RNA, 18 nt, Human herpesvirus 5
guuuuuagcgcgugaccu

SEQ ID NO: 2028358 - RNA, 16 nt, Human herpesvirus 5
cuccagcagcagcugg

SEQ ID NO: 2028359 - RNA, 14 nt, Human herpesvirus 5
uucagaaccaugua

SEQ ID NO: 2028360 - RNA, 18 nt, Human herpesvirus 5
cagaucuaccaugucuuu

SEQ ID NO: 2028361 - RNA, 21 nt, Human herpesvirus 5
uagcgcguuuguugcgcggcg

SEQ ID NO: 2028362 - RNA, 22 nt, Human herpesvirus 5
gcgcaggccgccgccgcucagg

SEQ ID NO: 2028363 - RNA, 15 nt, Human herpesvirus 5
cggcagcgccagcgg

SEQ ID NO: 2028364 - RNA, 12 nt, Human herpesvirus 5
gcuucgccgcca

SEQ ID NO: 2028365 - RNA, 18 nt, Human herpesvirus 5
uaccuucuugcccacgcc

SEQ ID NO: 2028366 - RNA, 17 nt, Human herpesvirus 5
uaccuagcuacuuugga

SEQ ID NO: 2028367 - RNA, 17 nt, Human herpesvirus 5
gcugccgcucagcgagc

SEQ ID NO: 2028368 - RNA, 17 nt, Human herpesvirus 5
accgguuggagcagcuc

SEQ ID NO: 2028369 - RNA, 15 nt, Human herpesvirus 5
gcacgggcugcuggu

SEQ ID NO: 2028370 - RNA, 15 nt, Human herpesvirus 5
gcguggauggucaua

SEQ ID NO: 2028371 - RNA, 20 nt, Human herpesvirus 5
cgugcucgggcgugugggug

SEQ ID NO: 2028372 - RNA, 13 nt, Human herpesvirus 5
cacucuggcccug

SEQ ID NO: 2028373 - RNA, 19 nt, Human herpesvirus 5
gcagcaucgcguugcucag

SEQ ID NO: 2028374 - RNA, 18 nt, Human herpesvirus 5
aaaagugcgucaaagcuc

SEQ ID NO: 2028375 - RNA, 20 nt, Human herpesvirus 5
cucuugcgcccucucggugu

SEQ ID NO: 2028376 - RNA, 21 nt, Human herpesvirus 5
gugcugccgggcggcuuugcc

SEQ ID NO: 2028377 - RNA, 23 nt, Human herpesvirus 5
ugguguacgugcgguaacuggca

SEQ ID NO: 2028378 - RNA, 20 nt, Human herpesvirus 5
caugcgggaacuggccuggc

SEQ ID NO: 2028379 - RNA, 11 nt, Human herpesvirus 5
acagcagcucg

SEQ ID NO: 2028380 - RNA, 13 nt, Human herpesvirus 5
cgugacacuuugg

SEQ ID NO: 2028381 - RNA, 10 nt, Human herpesvirus 5
guauccacgu

SEQ ID NO: 2028382 - RNA, 22 nt, Human herpesvirus 5
aaggcggaggagagaacggaag

SEQ ID NO: 2028383 - RNA, 15 nt, Human herpesvirus 5
acuggaagcugcugg

SEQ ID NO: 2028384 - RNA, 11 nt, Human herpesvirus 5
aucucagccuc

SEQ ID NO: 2028385 - RNA, 19 nt, Human herpesvirus 5
caugagucgccgacgguca

SEQ ID NO: 2028386 - RNA, 16 nt, Human herpesvirus 5
uauaucuuucuacaag

SEQ ID NO: 2028387 - RNA, 23 nt, Human herpesvirus 5
ccucauggcggcggccacggccu

SEQ ID NO: 2028388 - RNA, 16 nt, Human herpesvirus 5
gcagcaacagcagcca

SEQ ID NO: 2028389 - RNA, 23 nt, Human herpesvirus 5
uugaagauuuccgcuacauuugu

SEQ ID NO: 2028390 - RNA, 16 nt, Human herpesvirus 5
gcggugcaggccgcgc

SEQ ID NO: 2028391 - RNA, 17 nt, Human herpesvirus 5
gacgaggccggcggcgg

SEQ ID NO: 2028392 - RNA, 12 nt, Human herpesvirus 5
cgcgcaggcagc

SEQ ID NO: 2028393 - RNA, 16 nt, Human herpesvirus 5
ccgcgucgcuucgccg

SEQ ID NO: 2028394 - RNA, 18 nt, Human herpesvirus 5
gggcgcaucacccgccuc

SEQ ID NO: 2028395 - RNA, 14 nt, Human herpesvirus 5
cccaagccaaaaac

SEQ ID NO: 2028396 - RNA, 15 nt, Human herpesvirus 5
uacuaacgucacauu

SEQ ID NO: 2028397 - RNA, 14 nt, Human herpesvirus 5
cggcuugggcagca

SEQ ID NO: 2028398 - RNA, 18 nt, Human herpesvirus 5
ccacuauguccuccgcac

SEQ ID NO: 2028399 - RNA, 22 nt, Human herpesvirus 5
cgccuccucgucggccugggcu

SEQ ID NO: 2028400 - RNA, 23 nt, Human herpesvirus 5
cguagaauacuggaagcugcugg

SEQ ID NO: 2028401 - RNA, 14 nt, Human herpesvirus 5
acgacauauguuuu

SEQ ID NO: 2028402 - RNA, 16 nt, Human herpesvirus 5
gucuacgaucgcugga

SEQ ID NO: 2028403 - RNA, 19 nt, Human herpesvirus 5
ucgacggcgguacugaagc

SEQ ID NO: 2028404 - RNA, 23 nt, Human herpesvirus 5
ggucgccgaggcuacugcugcuu

SEQ ID NO: 2028405 - RNA, 14 nt, Human herpesvirus 5
cugcagcugcacca

SEQ ID NO: 2028406 - RNA, 23 nt, Human herpesvirus 5
caguugcuguugcucuaccgcga

SEQ ID NO: 2028407 - RNA, 18 nt, Human herpesvirus 5
cuccucgucggccugggc

SEQ ID NO: 2028408 - RNA, 15 nt, Human herpesvirus 5
ggcagcacaccugcc

SEQ ID NO: 2028409 - RNA, 12 nt, Human herpesvirus 5
augucuccaagu

SEQ ID NO: 2028410 - RNA, 24 nt, Human herpesvirus 5
cugucagcgccgggugcgcgacac

SEQ ID NO: 2028411 - RNA, 17 nt, Human herpesvirus 5
gcugguggcucaugccg

SEQ ID NO: 2028412 - RNA, 23 nt, Human herpesvirus 5
caucgaagguaacuucagugggc

SEQ ID NO: 2028413 - RNA, 19 nt, Human herpesvirus 5
cuguccgggauggaucgca

SEQ ID NO: 2028414 - RNA, 14 nt, Human herpesvirus 5
accgcgacgagguc

SEQ ID NO: 2028415 - RNA, 15 nt, Human herpesvirus 5
cguuugcgccagugg

SEQ ID NO: 2028416 - RNA, 12 nt, Human herpesvirus 5
caguagacagac

SEQ ID NO: 2028417 - RNA, 15 nt, Human herpesvirus 5
uacaaguauguggaa

SEQ ID NO: 2028418 - RNA, 21 nt, Human herpesvirus 5
cucagggcugggauccgccgc

SEQ ID NO: 2028419 - RNA, 22 nt, Human herpesvirus 5
gugcucagcggcguguacagcu

SEQ ID NO: 2028420 - RNA, 22 nt, Human herpesvirus 5
guggugguuguacgaguacacg

SEQ ID NO: 2028421 - RNA, 19 nt, Human herpesvirus 5
uagagcauuaagcauaguc

SEQ ID NO: 2028422 - RNA, 13 nt, Human herpesvirus 5
auauaaagaaucu

SEQ ID NO: 2028423 - RNA, 16 nt, Human herpesvirus 5
guccgcggugucuccu

SEQ ID NO: 2028424 - RNA, 14 nt, Human herpesvirus 5
cugcugaaacugcg

SEQ ID NO: 2028425 - RNA, 17 nt, Human herpesvirus 5
ucuacuccgaauaacaa

SEQ ID NO: 2028426 - RNA, 17 nt, Human herpesvirus 5
uugaguaacgaggaggc

SEQ ID NO: 2028427 - RNA, 17 nt, Human herpesvirus 5
ugcucggcggccacggc

SEQ ID NO: 2028428 - RNA, 13 nt, Human herpesvirus 5
gacucgcucucgu

SEQ ID NO: 2028429 - RNA, 11 nt, Human herpesvirus 5
guagcuucucu

SEQ ID NO: 2028430 - RNA, 13 nt, Human herpesvirus 5
aggacgaguggcu

SEQ ID NO: 2028431 - RNA, 19 nt, Human herpesvirus 5
cccugaguuccgucagcac

SEQ ID NO: 2028432 - RNA, 13 nt, Human herpesvirus 5
gcuguaugggcag

SEQ ID NO: 2028433 - RNA, 16 nt, Human herpesvirus 5
cgcccgguaggucagc

SEQ ID NO: 2028434 - RNA, 19 nt, Human herpesvirus 5
augugccucauuuguauuu

SEQ ID NO: 2028435 - RNA, 18 nt, Human herpesvirus 5
cggcagccaccgcgaggc

SEQ ID NO: 2028436 - RNA, 20 nt, Human herpesvirus 5
acaccacgguuuaccacagg

SEQ ID NO: 2028437 - RNA, 16 nt, Human herpesvirus 5
acuuguccuugcgcgc

SEQ ID NO: 2028438 - RNA, 14 nt, Human herpesvirus 5
gauguaguugcaga

SEQ ID NO: 2028439 - RNA, 20 nt, Human herpesvirus 5
gauacauugcccuucuggag

SEQ ID NO: 2028440 - RNA, 21 nt, Human herpesvirus 5
auggccaacagccuguggcac

SEQ ID NO: 2028441 - RNA, 14 nt, Human herpesvirus 5
cgaggaacgagggc

SEQ ID NO: 2028442 - RNA, 16 nt, Human herpesvirus 5
aguauacuaaacucug

SEQ ID NO: 2028443 - RNA, 17 nt, Human herpesvirus 5
auggggucguggcucag

SEQ ID NO: 2028444 - RNA, 14 nt, Human herpesvirus 5
ucgcgagccccauc

SEQ ID NO: 2028445 - RNA, 17 nt, Human herpesvirus 5
ccggugguacugcugug

SEQ ID NO: 2028446 - RNA, 18 nt, Human herpesvirus 5
auagcaagccagauacua

SEQ ID NO: 2028447 - RNA, 19 nt, Human herpesvirus 5
gaaggccaugagcggcagg

SEQ ID NO: 2028448 - RNA, 12 nt, Human herpesvirus 5
acccguacugcg

SEQ ID NO: 2028449 - RNA, 22 nt, Human herpesvirus 5
cgugacggauaagcgcuuucug

SEQ ID NO: 2028450 - RNA, 19 nt, Human herpesvirus 5
guucuaucaaugguggaaa

SEQ ID NO: 2028451 - RNA, 14 nt, Human herpesvirus 5
ugaagguaaagccc

SEQ ID NO: 2028452 - RNA, 13 nt, Human herpesvirus 5
ccaagccgcagcg

SEQ ID NO: 2028453 - RNA, 16 nt, Human herpesvirus 5
ccggcgggcggcugcc

SEQ ID NO: 2028454 - RNA, 17 nt, Human herpesvirus 5
gcuuaaagaugucgaug

SEQ ID NO: 2028455 - RNA, 22 nt, Human herpesvirus 5
ugguuuuugcuuccgagcugug

SEQ ID NO: 2028456 - RNA, 14 nt, Human herpesvirus 5
guauccacgucaca

SEQ ID NO: 2028457 - RNA, 22 nt, Human herpesvirus 5
cuacaugcuauaagacagccuu

SEQ ID NO: 2028458 - RNA, 19 nt, Human herpesvirus 5
gaucgcggccuucagcguc

SEQ ID NO: 2028459 - RNA, 16 nt, Human herpesvirus 5
ucgcuucgccgccacc

SEQ ID NO: 2028460 - RNA, 15 nt, Human herpesvirus 5
ucuugcgcccucucg

SEQ ID NO: 2028461 - RNA, 19 nt, Human herpesvirus 5
ugcuggccgagacggcgug

SEQ ID NO: 2028462 - RNA, 20 nt, Human herpesvirus 5
guggacggguuucagcgucc

SEQ ID NO: 2028463 - RNA, 21 nt, Human herpesvirus 5
cuguacuacgacgggacggcg

SEQ ID NO: 2028464 - RNA, 12 nt, Human herpesvirus 5
acccggcugcug

SEQ ID NO: 2028465 - RNA, 15 nt, Human herpesvirus 5
ugguguuguagcaac

SEQ ID NO: 2028466 - RNA, 18 nt, Human herpesvirus 5
aggugcgccgcagcggcu

SEQ ID NO: 2028467 - RNA, 22 nt, Human herpesvirus 5
uggaacggucuuuauauauaca

SEQ ID NO: 2028468 - RNA, 12 nt, Human herpesvirus 5
gcaccggcagcc

SEQ ID NO: 2028469 - RNA, 23 nt, Human herpesvirus 5
ucuuuucgaugaaccuccgcccu

SEQ ID NO: 2028470 - RNA, 17 nt, Human herpesvirus 5
ccacuacuaccuccccu

SEQ ID NO: 2028471 - RNA, 20 nt, Human herpesvirus 5
ggcgcggucccgugauggag

SEQ ID NO: 2028472 - RNA, 17 nt, Human herpesvirus 5
cauuccccaccuucccu

SEQ ID NO: 2028473 - RNA, 15 nt, Human herpesvirus 5
aguaggcgcgcaccc

SEQ ID NO: 2028474 - RNA, 14 nt, Human herpesvirus 5
uuuccaaagccgac

SEQ ID NO: 2028475 - RNA, 16 nt, Human herpesvirus 5
uacagguggagauucu

SEQ ID NO: 2028476 - RNA, 20 nt, Human herpesvirus 5
guaucgggccgucgcuugcc

SEQ ID NO: 2028477 - RNA, 20 nt, Human herpesvirus 5
caguagcaccggccccacgc

SEQ ID NO: 2028478 - RNA, 20 nt, Human herpesvirus 5
ccuugcugaugugccagccg

SEQ ID NO: 2028479 - RNA, 12 nt, Human herpesvirus 5
acagcaaugaca

SEQ ID NO: 2028480 - RNA, 14 nt, Human herpesvirus 5
cugcgcgggcagcc

SEQ ID NO: 2028481 - RNA, 19 nt, Human herpesvirus 5
guguugccgacggcggcgc

SEQ ID NO: 2028482 - RNA, 21 nt, Human herpesvirus 5
ucagcuuuuuuuuuuguagua

SEQ ID NO: 2028483 - RNA, 14 nt, Human herpesvirus 5
ggcaggccgugggg

SEQ ID NO: 2028484 - RNA, 16 nt, Human herpesvirus 5
acccacgaccauuucc

SEQ ID NO: 2028485 - RNA, 11 nt, Human herpesvirus 5
gccgaaacacc

SEQ ID NO: 2028486 - RNA, 16 nt, Human herpesvirus 5
uacuaucguaauguag

SEQ ID NO: 2028487 - RNA, 16 nt, Human herpesvirus 5
gcuucccuccugcagc

SEQ ID NO: 2028488 - RNA, 13 nt, Human herpesvirus 5
caggccgcaaagc

SEQ ID NO: 2028489 - RNA, 18 nt, Human herpesvirus 5
ccgcaggagcugcuuuuc

SEQ ID NO: 2028490 - RNA, 16 nt, Human herpesvirus 5
cuguucgacagcggca

SEQ ID NO: 2028491 - RNA, 22 nt, Human herpesvirus 5
ggcgcuguacggcagcggggag

SEQ ID NO: 2028492 - RNA, 17 nt, Human herpesvirus 5
auacaucgcauaugacg

SEQ ID NO: 2028493 - RNA, 17 nt, Human herpesvirus 5
uauauucaaucauuacu

SEQ ID NO: 2028494 - RNA, 19 nt, Human herpesvirus 5
guuggaucagacucacguc

SEQ ID NO: 2028495 - RNA, 20 nt, Human herpesvirus 5
auauggaguuuguguaaugc

SEQ ID NO: 2028496 - RNA, 19 nt, Human herpesvirus 5
cucgugaaacagcagcucg

SEQ ID NO: 2028497 - RNA, 12 nt, Human herpesvirus 5
acauaaaaccac

SEQ ID NO: 2028498 - RNA, 19 nt, Human herpesvirus 5
uuaacccccgacgagcagg

SEQ ID NO: 2028499 - RNA, 14 nt, Human herpesvirus 5
ugcugccgggcggc

SEQ ID NO: 2028500 - RNA, 22 nt, Human herpesvirus 5
gccccccaccuacgagcaggcc

SEQ ID NO: 2028501 - RNA, 21 nt, Human herpesvirus 5
gugccguugcuuuggcggcag

SEQ ID NO: 2028502 - RNA, 17 nt, Human herpesvirus 5
uuuaacaagucacuaua

SEQ ID NO: 2028503 - RNA, 23 nt, Human herpesvirus 5
ccggcggcugcuguugcacgggc

SEQ ID NO: 2028504 - RNA, 14 nt, Human herpesvirus 5
gaccgcgagcggcg

SEQ ID NO: 2028505 - RNA, 20 nt, Human herpesvirus 5
ccgcuuucucaucucagccu

SEQ ID NO: 2028506 - RNA, 23 nt, Human herpesvirus 5
aaccgcgggccgcccaaacaucu

SEQ ID NO: 2028507 - RNA, 21 nt, Human herpesvirus 5
cuggucuucccuacagcgacu

SEQ ID NO: 2028508 - RNA, 23 nt, Human herpesvirus 5
guuacccugguauccaacuucac

SEQ ID NO: 2028509 - RNA, 23 nt, Human herpesvirus 5
ccgucaacacggucauguuucuc

SEQ ID NO: 2028510 - RNA, 17 nt, Human herpesvirus 5
cuuccccucugcugcug

SEQ ID NO: 2028511 - RNA, 19 nt, Human herpesvirus 5
gcaccggcgccugcugcuc

SEQ ID NO: 2028512 - RNA, 22 nt, Human herpesvirus 5
gucucuccaguccauauguugu

SEQ ID NO: 2028513 - RNA, 16 nt, Human herpesvirus 5
gucccuggggcugcug

SEQ ID NO: 2028514 - RNA, 18 nt, Human herpesvirus 5
gucuacagacugggcgac

SEQ ID NO: 2028515 - RNA, 15 nt, Human herpesvirus 5
cuuuggguccagcca

SEQ ID NO: 2028516 - RNA, 14 nt, Human herpesvirus 5
cuccguccucgucg

SEQ ID NO: 2028517 - RNA, 17 nt, Human herpesvirus 5
cagcaccaguuggccac

SEQ ID NO: 2028518 - RNA, 13 nt, Human herpesvirus 5
ucagccgugagaa

SEQ ID NO: 2028519 - RNA, 14 nt, Human herpesvirus 5
cgcauaaagggugg

SEQ ID NO: 2028520 - RNA, 13 nt, Human herpesvirus 5
acaacuuuuccau

SEQ ID NO: 2028521 - RNA, 15 nt, Human herpesvirus 5
cagugcgucgcuguu

SEQ ID NO: 2028522 - RNA, 17 nt, Human herpesvirus 5
ggcucaaacaccgcugc

SEQ ID NO: 2028523 - RNA, 17 nt, Human herpesvirus 5
cggaggugcuggcggcc

SEQ ID NO: 2028524 - RNA, 22 nt, Human herpesvirus 5
ugugguagcuagugcagccuua

SEQ ID NO: 2028525 - RNA, 20 nt, Human herpesvirus 5
guaaagagagucacacuuaa

SEQ ID NO: 2028526 - RNA, 17 nt, Human herpesvirus 5
gcgcucgcccccgguuu

SEQ ID NO: 2028527 - RNA, 19 nt, Human herpesvirus 5
acaggacaccgcaacucgg

SEQ ID NO: 2028528 - RNA, 12 nt, Human herpesvirus 5
aacgugccaggc

SEQ ID NO: 2028529 - RNA, 16 nt, Human herpesvirus 5
cggcgccggcgccugg

SEQ ID NO: 2028530 - RNA, 18 nt, Human herpesvirus 5
acacgccuugcaccuggg

SEQ ID NO: 2028531 - RNA, 20 nt, Human herpesvirus 5
caggacuuuuuaauggccaa

SEQ ID NO: 2028532 - RNA, 20 nt, Human herpesvirus 5
cacugugacguuagagaaag

SEQ ID NO: 2028533 - RNA, 18 nt, Human herpesvirus 5
gcgucccuggggcugcug

SEQ ID NO: 2028534 - RNA, 18 nt, Human herpesvirus 5
guggccgaacagcagcuc

SEQ ID NO: 2028535 - RNA, 14 nt, Human herpesvirus 5
caccguaccugcau

SEQ ID NO: 2028536 - RNA, 18 nt, Human herpesvirus 5
uacgugcgcgccacggcg

SEQ ID NO: 2028537 - RNA, 15 nt, Human herpesvirus 5
cgggacccgccgccg

SEQ ID NO: 2028538 - RNA, 21 nt, Human herpesvirus 5
guccauagugcgccaagccau

SEQ ID NO: 2028539 - RNA, 13 nt, Human herpesvirus 5
gcuacaugugucc

SEQ ID NO: 2028540 - RNA, 17 nt, Human herpesvirus 5
ccgucacugccaccgac

SEQ ID NO: 2028541 - RNA, 14 nt, Human herpesvirus 5
augauccugugguc

SEQ ID NO: 2028542 - RNA, 23 nt, Human herpesvirus 5
ggaaugugcuuucccggcauggg

SEQ ID NO: 2028543 - RNA, 15 nt, Human herpesvirus 5
cggucagaaaaagaa

SEQ ID NO: 2028544 - RNA, 19 nt, Human herpesvirus 5
auaaaacgccaugaugaca

SEQ ID NO: 2028545 - RNA, 14 nt, Human herpesvirus 5
cuaccagcugggcc

SEQ ID NO: 2028546 - RNA, 17 nt, Human herpesvirus 5
gaaaaaggguuucaagu

SEQ ID NO: 2028547 - RNA, 12 nt, Human herpesvirus 5
ucgucugcaugu

SEQ ID NO: 2028548 - RNA, 22 nt, Human herpesvirus 5
acacgcgcuacgaaacuuuucu

SEQ ID NO: 2028549 - RNA, 22 nt, Human herpesvirus 5
cgucuccaccaaucaagccugu

SEQ ID NO: 2028550 - RNA, 20 nt, Human herpesvirus 5
cgcagugcgccgagcggccg

SEQ ID NO: 2028551 - RNA, 18 nt, Human herpesvirus 5
gccaccgucgcccucagc

SEQ ID NO: 2028552 - RNA, 18 nt, Human herpesvirus 5
aucuuccccucugcugcu

SEQ ID NO: 2028553 - RNA, 11 nt, Human herpesvirus 5
auccaggaggu

SEQ ID NO: 2028554 - RNA, 22 nt, Human herpesvirus 5
uuaaagaugucgauggaggucu

SEQ ID NO: 2028555 - RNA, 19 nt, Human herpesvirus 5
ucagcgacgucccgcgcgg

SEQ ID NO: 2028556 - RNA, 12 nt, Human herpesvirus 5
uugucccggggg

SEQ ID NO: 2028557 - RNA, 18 nt, Human herpesvirus 5
gcugacgcggacgaggaa

SEQ ID NO: 2028558 - RNA, 12 nt, Human herpesvirus 5
ccccuaccuaga

SEQ ID NO: 2028559 - RNA, 20 nt, Human herpesvirus 5
aguaugaaagucccgugugu

SEQ ID NO: 2028560 - RNA, 15 nt, Human herpesvirus 5
ccacgucaccgugcc

SEQ ID NO: 2028561 - RNA, 20 nt, Human herpesvirus 5
cccaguagacagacaggaca

SEQ ID NO: 2028562 - RNA, 14 nt, Human herpesvirus 5
ccaugugcagcugg

SEQ ID NO: 2028563 - RNA, 17 nt, Human herpesvirus 5
cacgcugauggccuacg

SEQ ID NO: 2028564 - RNA, 14 nt, Human herpesvirus 5
gaaaacuuguuuua

SEQ ID NO: 2028565 - RNA, 15 nt, Human herpesvirus 5
aggaaugcaugugga

SEQ ID NO: 2028566 - RNA, 18 nt, Human herpesvirus 5
gaacuggccuggcggcgg

SEQ ID NO: 2028567 - RNA, 18 nt, Human herpesvirus 5
cugccuguuccugcugcu

SEQ ID NO: 2028568 - RNA, 16 nt, Human herpesvirus 5
gcagccggaggagcag

SEQ ID NO: 2028569 - RNA, 20 nt, Human herpesvirus 5
uuggugcucgaccaggaggu

SEQ ID NO: 2028570 - RNA, 16 nt, Human herpesvirus 5
agcugcgcaggccgcc

SEQ ID NO: 2028571 - RNA, 13 nt, Human herpesvirus 5
gaguugcugugca

SEQ ID NO: 2028572 - RNA, 14 nt, Human herpesvirus 5
agccgcagcgcgga

SEQ ID NO: 2028573 - RNA, 18 nt, Human herpesvirus 5
aaucagcagugaguacac

SEQ ID NO: 2028574 - RNA, 13 nt, Human herpesvirus 5
aaugcauuaucau

SEQ ID NO: 2028575 - RNA, 16 nt, Human herpesvirus 5
gccccacaugcugcuu

SEQ ID NO: 2028576 - RNA, 21 nt, Human herpesvirus 5
agccgcggccgcugccgccgc

SEQ ID NO: 2028577 - RNA, 23 nt, Human herpesvirus 5
uugacgaagaugccgauguguga

SEQ ID NO: 2028578 - RNA, 21 nt, Human herpesvirus 5
cacgugugugcguuuucuagu

SEQ ID NO: 2028579 - RNA, 14 nt, Human herpesvirus 5
cgcgauccgcucac

SEQ ID NO: 2028580 - RNA, 14 nt, Human herpesvirus 5
uucgucgagcaccc

SEQ ID NO: 2028581 - RNA, 16 nt, Human herpesvirus 5
gaaaguuggcugcgcc

SEQ ID NO: 2028582 - RNA, 14 nt, Human herpesvirus 5
cacgggugucccau

SEQ ID NO: 2028583 - RNA, 15 nt, Human herpesvirus 5
acacuacagcuugca

SEQ ID NO: 2028584 - RNA, 20 nt, Human herpesvirus 5
ccgaggagauccaguuacac

SEQ ID NO: 2028585 - RNA, 16 nt, Human herpesvirus 5
agccaccgucccucag

SEQ ID NO: 2028586 - RNA, 20 nt, Human herpesvirus 5
gugcgguaacuggcagagcc

SEQ ID NO: 2028587 - RNA, 13 nt, Human herpesvirus 5
auggcuggugugu

SEQ ID NO: 2028588 - RNA, 13 nt, Human herpesvirus 5
ucuuaugaagcug

SEQ ID NO: 2028589 - RNA, 22 nt, Human herpesvirus 5
uacaugcuauaagacagccuua

SEQ ID NO: 2028590 - RNA, 15 nt, Human herpesvirus 5
uuacaaugucacugu

SEQ ID NO: 2028591 - RNA, 12 nt, Human herpesvirus 5
aucauggagcua

SEQ ID NO: 2028592 - RNA, 13 nt, Human herpesvirus 5
ggcggaggagccg

SEQ ID NO: 2028593 - RNA, 15 nt, Human herpesvirus 5
acggccucugggcug

SEQ ID NO: 2028594 - RNA, 22 nt, Human herpesvirus 5
gaaugaaccuuguaaugcuuau

SEQ ID NO: 2028595 - RNA, 13 nt, Human herpesvirus 5
caugaagcggaug

SEQ ID NO: 2028596 - RNA, 14 nt, Human herpesvirus 5
gccuggacgccugg

SEQ ID NO: 2028597 - RNA, 21 nt, Human herpesvirus 5
cuccuguuggcuuacugccug

SEQ ID NO: 2028598 - RNA, 15 nt, Human herpesvirus 5
gcagcaacagcagcc

SEQ ID NO: 2028599 - RNA, 18 nt, Human herpesvirus 5
gucuacgaucgcuggaaa

SEQ ID NO: 2028600 - RNA, 23 nt, Human herpesvirus 5
gacucggguguccuacaaaggaa

SEQ ID NO: 2028601 - RNA, 18 nt, Human herpesvirus 5
cccuccgacuuccuccuc

SEQ ID NO: 2028602 - RNA, 19 nt, Human herpesvirus 5
acggcgguuucagcuggca

SEQ ID NO: 2028603 - RNA, 21 nt, Human herpesvirus 5
ccgacucgcugccgcagcugc

SEQ ID NO: 2028604 - RNA, 12 nt, Human herpesvirus 5
aacuuugcugcu

SEQ ID NO: 2028605 - RNA, 18 nt, Human herpesvirus 5
cggcggccacggccugcg

SEQ ID NO: 2028606 - RNA, 14 nt, Human herpesvirus 5
aagcugucagccuc

SEQ ID NO: 2028607 - RNA, 13 nt, Human herpesvirus 5
gaugcgcacggcc

SEQ ID NO: 2028608 - RNA, 15 nt, Human herpesvirus 5
cgugcccgaagagga

SEQ ID NO: 2028609 - RNA, 22 nt, Human herpesvirus 5
cuacucacguugguguuguagc

SEQ ID NO: 2028610 - RNA, 20 nt, Human herpesvirus 5
ugaccuggguagcaaguccu

SEQ ID NO: 2028611 - RNA, 18 nt, Human herpesvirus 5
gaaucgcgagcugggcga

SEQ ID NO: 2028612 - RNA, 14 nt, Human herpesvirus 5
acgggcugcugguc

SEQ ID NO: 2028613 - RNA, 18 nt, Human herpesvirus 5
gugucacuagacagauuc

SEQ ID NO: 2028614 - RNA, 18 nt, Human herpesvirus 5
uggguccagccagcaucg

SEQ ID NO: 2028615 - RNA, 19 nt, Human herpesvirus 5
ccaucaguacggcuuucug

SEQ ID NO: 2028616 - RNA, 16 nt, Human herpesvirus 5
cguccacgggcugcgc

SEQ ID NO: 2028617 - RNA, 23 nt, Human herpesvirus 5
gccaccacccgacugcagcccac

SEQ ID NO: 2028618 - RNA, 17 nt, Human herpesvirus 5
uccagcuuaccgccacc

SEQ ID NO: 2028619 - RNA, 15 nt, Human herpesvirus 5
agcccgggccgccgc

SEQ ID NO: 2028620 - RNA, 13 nt, Human herpesvirus 5
acgcucgagggcu

SEQ ID NO: 2028621 - RNA, 21 nt, Human herpesvirus 5
ugcagcacgcgauuggccagc

SEQ ID NO: 2028622 - RNA, 13 nt, Human herpesvirus 5
gccgcggcagcac

SEQ ID NO: 2028623 - RNA, 20 nt, Human herpesvirus 5
cggccgcggugcgcugcagc

SEQ ID NO: 2028624 - RNA, 19 nt, Human herpesvirus 5
gccgugcucuuggcgccgc

SEQ ID NO: 2028625 - RNA, 14 nt, Human herpesvirus 5
cgacauggacauga

SEQ ID NO: 2028626 - RNA, 14 nt, Human herpesvirus 5
cgcgcuuuugaccg

SEQ ID NO: 2028627 - RNA, 23 nt, Human herpesvirus 5
cacgggcucgaccggcggcugcu

SEQ ID NO: 2028628 - RNA, 18 nt, Human herpesvirus 5
ccaccacgaccaugaugg

SEQ ID NO: 2028629 - RNA, 19 nt, Human herpesvirus 5
ugugcaccgucaucggcac

SEQ ID NO: 2028630 - RNA, 22 nt, Human herpesvirus 5
gacucuauaaaaacccacgucc

SEQ ID NO: 2028631 - RNA, 17 nt, Human herpesvirus 5
ccgcuguggcugccgcu

SEQ ID NO: 2028632 - RNA, 16 nt, Human herpesvirus 5
cgagggcucgugcgug

SEQ ID NO: 2028633 - RNA, 18 nt, Human herpesvirus 5
cuccgacgacgccgagga

SEQ ID NO: 2028634 - RNA, 19 nt, Human herpesvirus 5
ugcucuacugcaacugcac

SEQ ID NO: 2028635 - RNA, 11 nt, Human herpesvirus 5
gauccaggagg

SEQ ID NO: 2028636 - RNA, 23 nt, Human herpesvirus 5
cagccacggaggagacgagagaa

SEQ ID NO: 2028637 - RNA, 16 nt, Human herpesvirus 5
gcuacugaucgccugg

SEQ ID NO: 2028638 - RNA, 16 nt, Human herpesvirus 5
guggugguggcucacg

SEQ ID NO: 2028639 - RNA, 19 nt, Human herpesvirus 5
ucacuugcgcgguuauggc

SEQ ID NO: 2028640 - RNA, 14 nt, Human herpesvirus 5
gcugcgucugucuu

SEQ ID NO: 2028641 - RNA, 19 nt, Human herpesvirus 5
gcagcccggcuccgcgcag

SEQ ID NO: 2028642 - RNA, 14 nt, Human herpesvirus 5
uuuguaacacuaca

SEQ ID NO: 2028643 - RNA, 22 nt, Human herpesvirus 5
ccccgauaaucggcucucaggc

SEQ ID NO: 2028644 - RNA, 22 nt, Human herpesvirus 5
ugcugcugguuuuugcccccuc

SEQ ID NO: 2028645 - RNA, 17 nt, Human herpesvirus 5
cucacccggcugcuggc

SEQ ID NO: 2028646 - RNA, 13 nt, Human herpesvirus 5
acccauuacagua

SEQ ID NO: 2028647 - RNA, 23 nt, Human herpesvirus 5
gcggcuuauguuucugggguggg

SEQ ID NO: 2028648 - RNA, 22 nt, Human herpesvirus 5
uaaaccgcccgugccucccgcg

SEQ ID NO: 2028649 - RNA, 22 nt, Human herpesvirus 5
cugagcuacgaugaccacgaag

SEQ ID NO: 2028650 - RNA, 20 nt, Human herpesvirus 5
acgucacuauccgaugguuu

SEQ ID NO: 2028651 - RNA, 16 nt, Human herpesvirus 5
aagacggacuguuuca

SEQ ID NO: 2028652 - RNA, 22 nt, Human herpesvirus 5
cacgucaagaucguacccacca

SEQ ID NO: 2028653 - RNA, 17 nt, Human herpesvirus 5
acgcgaccagcugcugg

SEQ ID NO: 2028654 - RNA, 19 nt, Human herpesvirus 5
gcucauccacaacgaggaa

SEQ ID NO: 2028655 - RNA, 15 nt, Human herpesvirus 5
gcugcuccucggagc

SEQ ID NO: 2028656 - RNA, 17 nt, Human herpesvirus 5
gguagcuagugcagccu

SEQ ID NO: 2028657 - RNA, 22 nt, Human herpesvirus 5
ccggagcuacgcgaccagcugc

SEQ ID NO: 2028658 - RNA, 22 nt, Human herpesvirus 5
ccgccguugcggccgccgcuca

SEQ ID NO: 2028659 - RNA, 15 nt, Human herpesvirus 5
ggccgucgcuugccg

SEQ ID NO: 2028660 - RNA, 11 nt, Human herpesvirus 5
ucaaguucagu

SEQ ID NO: 2028661 - RNA, 14 nt, Human herpesvirus 5
cucaucucagccuc

SEQ ID NO: 2028662 - RNA, 16 nt, Human herpesvirus 5
cuuugcuuaucugccu

SEQ ID NO: 2028663 - RNA, 15 nt, Human herpesvirus 5
gccacugggccucgg

SEQ ID NO: 2028664 - RNA, 16 nt, Human herpesvirus 5
ugcuucauccagcucc

SEQ ID NO: 2028665 - RNA, 12 nt, Human herpesvirus 5
ucgccccucacg

SEQ ID NO: 2028666 - RNA, 18 nt, Human herpesvirus 5
ggaaugcggucaguuggg

SEQ ID NO: 2028667 - RNA, 20 nt, Human herpesvirus 5
augcaugucgcgacagagag

SEQ ID NO: 2028668 - RNA, 13 nt, Human herpesvirus 5
cguaauguagaca

SEQ ID NO: 2028669 - RNA, 18 nt, Human herpesvirus 5
gaaaaaaugguguuacac

SEQ ID NO: 2028670 - RNA, 16 nt, Human herpesvirus 5
caaggcgacauggccc

SEQ ID NO: 2028671 - RNA, 14 nt, Human herpesvirus 5
aggccuccucuccg

SEQ ID NO: 2028672 - RNA, 16 nt, Human herpesvirus 5
cuugggcagcagcggc

SEQ ID NO: 2028673 - RNA, 16 nt, Human herpesvirus 5
gcguuccaaugcaccg

SEQ ID NO: 2028674 - RNA, 22 nt, Human herpesvirus 5
cgcgcccacgguccgggcacaa

SEQ ID NO: 2028675 - RNA, 21 nt, Human herpesvirus 5
gucugcgucaagacgggccug

SEQ ID NO: 2028676 - RNA, 13 nt, Human herpesvirus 5
guuggcugguguc

SEQ ID NO: 2028677 - RNA, 13 nt, Human herpesvirus 5
accgcaggagcug

SEQ ID NO: 2028678 - RNA, 22 nt, Human herpesvirus 5
caguuuuuuuccauccuggcca

SEQ ID NO: 2028679 - RNA, 13 nt, Human herpesvirus 5
cacgcgcuagccu

SEQ ID NO: 2028680 - RNA, 17 nt, Human herpesvirus 5
uagacauuccccaccuu

SEQ ID NO: 2028681 - RNA, 16 nt, Human herpesvirus 5
cguguaggcgacuggc

SEQ ID NO: 2028682 - RNA, 14 nt, Human herpesvirus 5
cuugcaagaggaau

SEQ ID NO: 2028683 - RNA, 14 nt, Human herpesvirus 5
uaauagacacaccg

SEQ ID NO: 2028684 - RNA, 23 nt, Human herpesvirus 5
ccuacucaccaaagccgccgccg

SEQ ID NO: 2028685 - RNA, 12 nt, Human herpesvirus 5
ccccucugcugc

SEQ ID NO: 2028686 - RNA, 15 nt, Human herpesvirus 5
auuuucuuucuagug

SEQ ID NO: 2028687 - RNA, 18 nt, Human herpesvirus 5
cccuguaauuauuccagc

SEQ ID NO: 2028688 - RNA, 15 nt, Human herpesvirus 5
ccgcagacaccaagc

SEQ ID NO: 2028689 - RNA, 23 nt, Human herpesvirus 5
cggcggacuuggcagcgggccug

SEQ ID NO: 2028690 - RNA, 16 nt, Human herpesvirus 5
cucggguuccucggcc

SEQ ID NO: 2028691 - RNA, 14 nt, Human herpesvirus 5
ucgucucaucacau

SEQ ID NO: 2028692 - RNA, 13 nt, Human herpesvirus 5
gggcgcagaaacu

SEQ ID NO: 2028693 - RNA, 18 nt, Human herpesvirus 5
cagggaaagguuauauaa

SEQ ID NO: 2028694 - RNA, 16 nt, Human herpesvirus 5
guccaguggcaggccc

SEQ ID NO: 2028695 - RNA, 13 nt, Human herpesvirus 5
ucacacuuaagaa

SEQ ID NO: 2028696 - RNA, 18 nt, Human herpesvirus 5
cgaccacgacacggugcu

SEQ ID NO: 2028697 - RNA, 22 nt, Human herpesvirus 5
acucgcugccgcagcugcugga

SEQ ID NO: 2028698 - RNA, 15 nt, Human herpesvirus 5
ggacgacguggccuc

SEQ ID NO: 2028699 - RNA, 16 nt, Human herpesvirus 5
acacgcagaccguggg

SEQ ID NO: 2028700 - RNA, 20 nt, Human herpesvirus 5
gauucccaucucaacgucaa

SEQ ID NO: 2028701 - RNA, 23 nt, Human herpesvirus 5
cugaacaauaaacuaaaacauuc

SEQ ID NO: 2028702 - RNA, 19 nt, Human herpesvirus 5
ccguuugcgccagugggug

SEQ ID NO: 2028703 - RNA, 11 nt, Human herpesvirus 5
guaccacauuu

SEQ ID NO: 2028704 - RNA, 19 nt, Human herpesvirus 5
ggcccguuucgacgaaauc

SEQ ID NO: 2028705 - RNA, 17 nt, Human herpesvirus 5
cggagccccugcgcgcc

SEQ ID NO: 2028706 - RNA, 13 nt, Human herpesvirus 5
ugaccggaggcua

SEQ ID NO: 2028707 - RNA, 13 nt, Human herpesvirus 5
gggacggugauga

SEQ ID NO: 2028708 - RNA, 20 nt, Human herpesvirus 5
ucgccacgguuuguggcaag

SEQ ID NO: 2028709 - RNA, 23 nt, Human herpesvirus 5
caugaggaagcggggguguauag

SEQ ID NO: 2028710 - RNA, 19 nt, Human herpesvirus 5
agguagguggccaugauga

SEQ ID NO: 2028711 - RNA, 23 nt, Human herpesvirus 5
ccgugcccguuuucacagcagcc

SEQ ID NO: 2028712 - RNA, 23 nt, Human herpesvirus 5
aacuacaauguauagauacacgu

SEQ ID NO: 2028713 - RNA, 21 nt, Human herpesvirus 5
gaccuccgcgucggucgccgc

SEQ ID NO: 2028714 - RNA, 16 nt, Human herpesvirus 5
uaauuggagacacaac

SEQ ID NO: 2028715 - RNA, 20 nt, Human herpesvirus 5
gcugcugcacgggcucgacc

SEQ ID NO: 2028716 - RNA, 14 nt, Human herpesvirus 5
gccgucgcuugccg

SEQ ID NO: 2028717 - RNA, 18 nt, Human herpesvirus 5
uaucaucuaaagacuaua

SEQ ID NO: 2028718 - RNA, 18 nt, Human herpesvirus 5
gcugccgcagcugcugga

SEQ ID NO: 2028719 - RNA, 18 nt, Human herpesvirus 5
gcguagccaccuguugga

SEQ ID NO: 2028720 - RNA, 17 nt, Human herpesvirus 5
ccgaauuugggcggugg

SEQ ID NO: 2028721 - RNA, 13 nt, Human herpesvirus 5
gaggguaacuaug

SEQ ID NO: 2028722 - RNA, 21 nt, Human herpesvirus 5
cacgucggagccccugcgcgc

SEQ ID NO: 2028723 - RNA, 23 nt, Human herpesvirus 5
uacggcccggcagcaccaugccg

SEQ ID NO: 2028724 - RNA, 15 nt, Human herpesvirus 5
cuuucgcgcagcgcg

SEQ ID NO: 2028725 - RNA, 15 nt, Human herpesvirus 5
agcacauuagacaca

SEQ ID NO: 2028726 - RNA, 22 nt, Human herpesvirus 5
aacagccuucccuuguaagaca

SEQ ID NO: 2028727 - RNA, 14 nt, Human herpesvirus 5
ucugacguccagca

SEQ ID NO: 2028728 - RNA, 20 nt, Human herpesvirus 5
aaggccgccucuucuggccc

SEQ ID NO: 2028729 - RNA, 12 nt, Human herpesvirus 5
cgcaagggcugc

SEQ ID NO: 2028730 - RNA, 19 nt, Human herpesvirus 5
acgcggugcagguucugaa

SEQ ID NO: 2028731 - RNA, 17 nt, Human herpesvirus 5
acauucaauacaucaua

SEQ ID NO: 2028732 - RNA, 20 nt, Human herpesvirus 5
ggcgcgcaucgccgucgagu

SEQ ID NO: 2028733 - RNA, 11 nt, Human herpesvirus 5
gccgugcucag

SEQ ID NO: 2028734 - RNA, 15 nt, Human herpesvirus 5
uaaagcccccacgac

SEQ ID NO: 2028735 - RNA, 14 nt, Human herpesvirus 5
cccucugcugcugg

SEQ ID NO: 2028736 - RNA, 17 nt, Human herpesvirus 5
cugaggaaggggaggag

SEQ ID NO: 2028737 - RNA, 19 nt, Human herpesvirus 5
cagcuaccgccgcaacagc

SEQ ID NO: 2028738 - RNA, 15 nt, Human herpesvirus 5
cgccgucaaggccgc

SEQ ID NO: 2028739 - RNA, 19 nt, Human herpesvirus 5
ccaugucuccaagucuggu

SEQ ID NO: 2028740 - RNA, 22 nt, Human herpesvirus 5
cgggccgcgcuccaggcggaga

SEQ ID NO: 2028741 - RNA, 14 nt, Human herpesvirus 5
aacugguuccugca

SEQ ID NO: 2028742 - RNA, 15 nt, Human herpesvirus 5
agaacuuugcugcua

SEQ ID NO: 2028743 - RNA, 13 nt, Human herpesvirus 5
ccaaucgacugcc

SEQ ID NO: 2028744 - RNA, 21 nt, Human herpesvirus 5
cacgcggcucacguagcaggc

SEQ ID NO: 2028745 - RNA, 13 nt, Human herpesvirus 5
cagcagcagcugg

SEQ ID NO: 2028746 - RNA, 16 nt, Human herpesvirus 5
gacgucggcgguccuc

SEQ ID NO: 2028747 - RNA, 10 nt, Human herpesvirus 5
cacagcagcc

SEQ ID NO: 2028748 - RNA, 15 nt, Human herpesvirus 5
agcacgggcugcugg

SEQ ID NO: 2028749 - RNA, 23 nt, Human herpesvirus 5
caaagcuggacagugagagcuca

SEQ ID NO: 2028750 - RNA, 15 nt, Human herpesvirus 5
cucgaggaggggccg

SEQ ID NO: 2028751 - RNA, 15 nt, Human herpesvirus 5
aggcuacugcugcuu

SEQ ID NO: 2028752 - RNA, 14 nt, Human herpesvirus 5
uaacaacacaucaa

SEQ ID NO: 2028753 - RNA, 18 nt, Human herpesvirus 5
cagcgugcaccugcugcc

SEQ ID NO: 2028754 - RNA, 15 nt, Human herpesvirus 5
caaggcgagccacuc

SEQ ID NO: 2028755 - RNA, 22 nt, Human herpesvirus 5
ccguuacgccgacgugauccag

SEQ ID NO: 2028756 - RNA, 17 nt, Human herpesvirus 5
gccaccgucgcccucag

SEQ ID NO: 2028757 - RNA, 17 nt, Human herpesvirus 5
gcggcgacaagcugugg

SEQ ID NO: 2028758 - RNA, 14 nt, Human herpesvirus 5
auacgauaauugcu

SEQ ID NO: 2028759 - RNA, 18 nt, Human herpesvirus 5
ugacugcaacgacaccuc

SEQ ID NO: 2028760 - RNA, 14 nt, Human herpesvirus 5
cuggggcugcugcu

SEQ ID NO: 2028761 - RNA, 18 nt, Human herpesvirus 5
cgccguucggcucuccuc

SEQ ID NO: 2028762 - RNA, 20 nt, Human herpesvirus 5
cuguuggagcaacgggcggc

SEQ ID NO: 2028763 - RNA, 13 nt, Human herpesvirus 5
agcugcuggagcg

SEQ ID NO: 2028764 - RNA, 22 nt, Human herpesvirus 5
guccucuccuccuucuuccucg

SEQ ID NO: 2028765 - RNA, 19 nt, Human herpesvirus 5
ucccgguauucggaaacag

SEQ ID NO: 2028766 - RNA, 17 nt, Human herpesvirus 5
ggcugccuguuccugcu

SEQ ID NO: 2028767 - RNA, 21 nt, Human herpesvirus 5
cgccguacggcaacgagcagg

SEQ ID NO: 2028768 - RNA, 18 nt, Human herpesvirus 5
gagcgacguaccagcugu

SEQ ID NO: 2028769 - RNA, 13 nt, Human herpesvirus 5
cgguggcggccgc

SEQ ID NO: 2028770 - RNA, 20 nt, Human herpesvirus 5
aggcggcgccggcgccuggu

SEQ ID NO: 2028771 - RNA, 19 nt, Human herpesvirus 5
gccaacuccgugccagcug

SEQ ID NO: 2028772 - RNA, 15 nt, Human herpesvirus 5
caacagcagcaacag

SEQ ID NO: 2028773 - RNA, 22 nt, Human herpesvirus 5
guccacacgccgucucgucaca

SEQ ID NO: 2028774 - RNA, 14 nt, Human herpesvirus 5
gcaagugcucgacu

SEQ ID NO: 2028775 - RNA, 23 nt, Human herpesvirus 5
acuccuguuggcuuacugccugc

SEQ ID NO: 2028776 - RNA, 23 nt, Human herpesvirus 5
cccucggggugcggguggcgggc

SEQ ID NO: 2028777 - RNA, 17 nt, Human herpesvirus 5
auaaaaaaagacacuca

SEQ ID NO: 2028778 - RNA, 17 nt, Human herpesvirus 5
cggcgacugacgccggc

SEQ ID NO: 2028779 - RNA, 13 nt, Human herpesvirus 5
ccgaacucagagg

SEQ ID NO: 2028780 - RNA, 13 nt, Human herpesvirus 5
cggaucuacucau

SEQ ID NO: 2028781 - RNA, 21 nt, Human herpesvirus 5
gcuggcugucgagcugguuaa

SEQ ID NO: 2028782 - RNA, 17 nt, Human herpesvirus 5
cgccggcuugcuccucu

SEQ ID NO: 2028783 - RNA, 14 nt, Human herpesvirus 5
cuccaguccauaug

SEQ ID NO: 2028784 - RNA, 15 nt, Human herpesvirus 5
ugcugggcugggugc

SEQ ID NO: 2028785 - RNA, 22 nt, Human herpesvirus 5
cuacgccggggaagccuccgga

SEQ ID NO: 2028786 - RNA, 21 nt, Human herpesvirus 5
cugcugcaccacagcgccagg

SEQ ID NO: 2028787 - RNA, 14 nt, Human herpesvirus 5
gcccgcagacacca

SEQ ID NO: 2028788 - RNA, 21 nt, Human herpesvirus 5
cgaguugcaaaagaagcugcc

SEQ ID NO: 2028789 - RNA, 13 nt, Human herpesvirus 5
ccgcgcuccaggc

SEQ ID NO: 2028790 - RNA, 18 nt, Human herpesvirus 5
uacgcgaccagcugcugg

SEQ ID NO: 2028791 - RNA, 17 nt, Human herpesvirus 5
ucaccaucgugccgcuc

SEQ ID NO: 2028792 - RNA, 18 nt, Human herpesvirus 5
gccgcagccguuggugga

SEQ ID NO: 2028793 - RNA, 17 nt, Human herpesvirus 5
gcuaccagcugcaggca

SEQ ID NO: 2028794 - RNA, 17 nt, Human herpesvirus 5
acgcuacgaccuggccu

SEQ ID NO: 2028795 - RNA, 14 nt, Human herpesvirus 5
acgcugauggccua

SEQ ID NO: 2028796 - RNA, 18 nt, Human herpesvirus 5
ggcauagugccagcccua

SEQ ID NO: 2028797 - RNA, 23 nt, Human herpesvirus 5
uuaacaugaugaagauggccauc

SEQ ID NO: 2028798 - RNA, 20 nt, Human herpesvirus 5
uacaugaugaaugucaucau

SEQ ID NO: 2028799 - RNA, 16 nt, Human herpesvirus 5
ucgcugccgcagcugc

SEQ ID NO: 2028800 - RNA, 16 nt, Human herpesvirus 5
acgcuuuaagcugcuc

SEQ ID NO: 2028801 - RNA, 13 nt, Human herpesvirus 5
uggggauuuuuga

SEQ ID NO: 2028802 - RNA, 17 nt, Human herpesvirus 5
cguagcgcgugucccug

SEQ ID NO: 2028803 - RNA, 13 nt, Human herpesvirus 5
ccgacacagcagc

SEQ ID NO: 2028804 - RNA, 21 nt, Human herpesvirus 5
acaacaccacggcacgacaua

SEQ ID NO: 2028805 - RNA, 17 nt, Human herpesvirus 5
cacuuuuaacagcucau

SEQ ID NO: 2028806 - RNA, 18 nt, Human herpesvirus 5
aaacucgucguuuccccc

SEQ ID NO: 2028807 - RNA, 17 nt, Human herpesvirus 5
cgggccgcgcuccaggc

SEQ ID NO: 2028808 - RNA, 16 nt, Human herpesvirus 5
gccggcgccugguugc

SEQ ID NO: 2028809 - RNA, 13 nt, Human herpesvirus 5
cggcgacaucacg

SEQ ID NO: 2028810 - RNA, 21 nt, Human herpesvirus 5
caucaauaaacuuuuuuuaac

SEQ ID NO: 2028811 - RNA, 17 nt, Human herpesvirus 5
acaggccagcugccacc

SEQ ID NO: 2028812 - RNA, 12 nt, Human herpesvirus 5
ucgaucucaugu

SEQ ID NO: 2028813 - RNA, 23 nt, Human herpesvirus 5
gaggcgcucgugaaacagcagcu

SEQ ID NO: 2028814 - RNA, 14 nt, Human herpesvirus 5
ggaaaaacaaagaa

SEQ ID NO: 2028815 - RNA, 17 nt, Human herpesvirus 5
agacggcgugacacagc

SEQ ID NO: 2028816 - RNA, 21 nt, Human herpesvirus 5
acugcuauguaucaucuuuau

SEQ ID NO: 2028817 - RNA, 19 nt, Human herpesvirus 5
uauccaacuucacuucaaa

SEQ ID NO: 2028818 - RNA, 13 nt, Human herpesvirus 5
ggcgguggccguc

SEQ ID NO: 2028819 - RNA, 17 nt, Human herpesvirus 5
guccucggugcccgcac

SEQ ID NO: 2028820 - RNA, 22 nt, Human herpesvirus 5
ccaccaggccgcaaagcuggac

SEQ ID NO: 2028821 - RNA, 19 nt, Human herpesvirus 5
ccguugccgccucagaacc

SEQ ID NO: 2028822 - RNA, 19 nt, Human herpesvirus 5
gcuguggcuucucuggaga

SEQ ID NO: 2028823 - RNA, 21 nt, Human herpesvirus 5
cggggcgugccgagcugccuu

SEQ ID NO: 2028824 - RNA, 14 nt, Human herpesvirus 5
ggcggcggugguga

SEQ ID NO: 2028825 - RNA, 16 nt, Human herpesvirus 5
uggucuucccuacagc

SEQ ID NO: 2028826 - RNA, 14 nt, Human herpesvirus 5
cccgaggcggagga

SEQ ID NO: 2028827 - RNA, 16 nt, Human herpesvirus 5
ggacggcaaggcggag

SEQ ID NO: 2028828 - RNA, 22 nt, Human herpesvirus 5
cccgcacacagacgacgcgccg

SEQ ID NO: 2028829 - RNA, 21 nt, Human herpesvirus 5
agggaaaacauaagaauagga

SEQ ID NO: 2028830 - RNA, 19 nt, Human herpesvirus 5
acgcagugcguggccgcac

SEQ ID NO: 2028831 - RNA, 19 nt, Human herpesvirus 5
gcuacguaggccuccucuc

SEQ ID NO: 2028832 - RNA, 18 nt, Human herpesvirus 5
ccuuaucugggugcaaug

SEQ ID NO: 2028833 - RNA, 13 nt, Human herpesvirus 5
cuuaccggggacc

SEQ ID NO: 2028834 - RNA, 20 nt, Human herpesvirus 5
accguggggucaucgaccga

SEQ ID NO: 2028835 - RNA, 17 nt, Human herpesvirus 5
acgccguugccacgagc

SEQ ID NO: 2028836 - RNA, 16 nt, Human herpesvirus 5
gcgucgucccagcagg

SEQ ID NO: 2028837 - RNA, 19 nt, Human herpesvirus 5
gccgcuggacugacacagc

SEQ ID NO: 2028838 - RNA, 15 nt, Human herpesvirus 5
cguccgggcuuuccu

SEQ ID NO: 2028839 - RNA, 15 nt, Human herpesvirus 5
ccaggcucugcgccg

SEQ ID NO: 2028840 - RNA, 21 nt, Human herpesvirus 5
auacuucucguacgacgucug

SEQ ID NO: 2028841 - RNA, 14 nt, Human herpesvirus 5
cacgccgugcucgc

SEQ ID NO: 2028842 - RNA, 18 nt, Human herpesvirus 5
gcgacuuuuuucugugag

SEQ ID NO: 2028843 - RNA, 16 nt, Human herpesvirus 5
gcaccgguuggagcag

SEQ ID NO: 2028844 - RNA, 22 nt, Human herpesvirus 5
cuaguaaaaaaagugcgucaaa

SEQ ID NO: 2028845 - RNA, 14 nt, Human herpesvirus 5
cguccgcuggaaau

SEQ ID NO: 2028846 - RNA, 17 nt, Human herpesvirus 5
gcacgagugggccagcc

SEQ ID NO: 2028847 - RNA, 20 nt, Human herpesvirus 5
ucagcuaccgccgcaacagc

SEQ ID NO: 2028848 - RNA, 16 nt, Human herpesvirus 5
gugugaucugggcagc

SEQ ID NO: 2028849 - RNA, 13 nt, Human herpesvirus 5
ucuuccccucugc

SEQ ID NO: 2028850 - RNA, 15 nt, Human herpesvirus 5
ccgcgugcuccacca

SEQ ID NO: 2028851 - RNA, 14 nt, Human herpesvirus 5
gugcgccaagccau

SEQ ID NO: 2028852 - RNA, 14 nt, Human herpesvirus 5
agacagacaggaca

SEQ ID NO: 2028853 - RNA, 12 nt, Human herpesvirus 5
gccaccgugggu

SEQ ID NO: 2028854 - RNA, 14 nt, Human herpesvirus 5
uuaacauguuaugu

SEQ ID NO: 2028855 - RNA, 18 nt, Human herpesvirus 5
ccagcggccgcagugggc

SEQ ID NO: 2028856 - RNA, 22 nt, Human herpesvirus 5
cgccacuauguccuccgcacuu

SEQ ID NO: 2028857 - RNA, 18 nt, Human herpesvirus 5
caacugguuccugcaggu

SEQ ID NO: 2028858 - RNA, 15 nt, Human herpesvirus 5
aacgaggagcggcaa

SEQ ID NO: 2028859 - RNA, 15 nt, Human herpesvirus 5
auuguguguacgaca

SEQ ID NO: 2028860 - RNA, 14 nt, Human herpesvirus 5
ucugcgagaggaag

SEQ ID NO: 2028861 - RNA, 22 nt, Human herpesvirus 5
auacauugcccuucuggagcac

SEQ ID NO: 2028862 - RNA, 23 nt, Human herpesvirus 5
gcggccccguaccgcucuucugg

SEQ ID NO: 2028863 - RNA, 17 nt, Human herpesvirus 5
cugcaacgccuggcgug

SEQ ID NO: 2028864 - RNA, 14 nt, Human herpesvirus 5
ggccgugguggccg

SEQ ID NO: 2028865 - RNA, 12 nt, Human herpesvirus 5
cagguucugaau

SEQ ID NO: 2028866 - RNA, 18 nt, Human herpesvirus 5
uggagacaguuuccacgc

SEQ ID NO: 2028867 - RNA, 13 nt, Human herpesvirus 5
ugccgcagcugcu

SEQ ID NO: 2028868 - RNA, 18 nt, Human herpesvirus 5
cuggacacucuggcccug

SEQ ID NO: 2028869 - RNA, 18 nt, Human herpesvirus 5
acugcguggggugcugga

SEQ ID NO: 2028870 - RNA, 19 nt, Human herpesvirus 5
caugggcgacaccgccucg

SEQ ID NO: 2028871 - RNA, 15 nt, Human herpesvirus 5
gaggcucuguggacc

SEQ ID NO: 2028872 - RNA, 13 nt, Human herpesvirus 5
cacgacgcaugca

SEQ ID NO: 2028873 - RNA, 16 nt, Human herpesvirus 5
ccgcggcaccagagac

SEQ ID NO: 2028874 - RNA, 19 nt, Human herpesvirus 5
gagacgagagaaccuaccu

SEQ ID NO: 2028875 - RNA, 22 nt, Human herpesvirus 5
ucugaccuugcugaugugccag

SEQ ID NO: 2028876 - RNA, 20 nt, Human herpesvirus 5
gcggcuuauguuucuggggu

SEQ ID NO: 2028877 - RNA, 19 nt, Human herpesvirus 5
ggcgugaaugggcacgccg

SEQ ID NO: 2028878 - RNA, 21 nt, Human herpesvirus 5
gccgcgguacgcacgucgccg

SEQ ID NO: 2028879 - RNA, 21 nt, Human herpesvirus 5
gucgcacaaagaagucucuuu

SEQ ID NO: 2028880 - RNA, 16 nt, Human herpesvirus 5
gaaccccguggaucag

SEQ ID NO: 2028881 - RNA, 21 nt, Human herpesvirus 5
ggagcuacgcgaccagcugcu

SEQ ID NO: 2028882 - RNA, 13 nt, Human herpesvirus 5
gucaaccugcuga

SEQ ID NO: 2028883 - RNA, 17 nt, Human herpesvirus 5
agcccauccucguggaa

SEQ ID NO: 2028884 - RNA, 16 nt, Human herpesvirus 5
cucuaccgcgacggcg

SEQ ID NO: 2028885 - RNA, 14 nt, Human herpesvirus 5
uugcaccugggugg

SEQ ID NO: 2028886 - RNA, 17 nt, Human herpesvirus 5
agcccgggccgccgcca

SEQ ID NO: 2028887 - RNA, 15 nt, Human herpesvirus 5
aucaucaacagcagc

SEQ ID NO: 2028888 - RNA, 20 nt, Human herpesvirus 5
aacaagccgacccccaccag

SEQ ID NO: 2028889 - RNA, 18 nt, Human herpesvirus 5
ccucuacacuuggugcuc

SEQ ID NO: 2028890 - RNA, 18 nt, Human herpesvirus 5
cgaagcugcgcaggccgc

SEQ ID NO: 2028891 - RNA, 20 nt, Human herpesvirus 5
ccugguauacgaggcucucu

SEQ ID NO: 2028892 - RNA, 21 nt, Human herpesvirus 5
ggcugacgcggacgaggaaca

SEQ ID NO: 2028893 - RNA, 18 nt, Human herpesvirus 5
ggcugucacaucaacucu

SEQ ID NO: 2028894 - RNA, 13 nt, Human herpesvirus 5
cacuccguaagga

SEQ ID NO: 2028895 - RNA, 21 nt, Human herpesvirus 5
caucggcaacuucuuggugau

SEQ ID NO: 2028896 - RNA, 16 nt, Human herpesvirus 5
cugcuuuucgggccgc

SEQ ID NO: 2028897 - RNA, 18 nt, Human herpesvirus 5
cucucuauccgguggcgc

SEQ ID NO: 2028898 - RNA, 15 nt, Human herpesvirus 5
acggcccggcagcac

SEQ ID NO: 2028899 - RNA, 14 nt, Human herpesvirus 5
cccgccggcgggcg

SEQ ID NO: 2028900 - RNA, 14 nt, Human herpesvirus 5
cauagugccagccc

SEQ ID NO: 2028901 - RNA, 13 nt, Human herpesvirus 5
caucaccgccucc

SEQ ID NO: 2028902 - RNA, 14 nt, Human herpesvirus 5
acaucauaaaaacc

SEQ ID NO: 2028903 - RNA, 14 nt, Human herpesvirus 5
aacguugagacuac

SEQ ID NO: 2028904 - RNA, 16 nt, Human herpesvirus 5
ucccuggggcugcugc

SEQ ID NO: 2028905 - RNA, 19 nt, Human herpesvirus 5
ccgcuggacugacacagcu

SEQ ID NO: 2028906 - RNA, 11 nt, Human herpesvirus 5
ugauggagaaa

SEQ ID NO: 2028907 - RNA, 13 nt, Human herpesvirus 5
ggccgcggaggug

SEQ ID NO: 2028908 - RNA, 18 nt, Human herpesvirus 5
uuggguaacgcuggcuca

SEQ ID NO: 2028909 - RNA, 21 nt, Human herpesvirus 5
acgauaaaaauccuauuguuu

SEQ ID NO: 2028910 - RNA, 21 nt, Human herpesvirus 5
cgggccugguauacgaggcuc

SEQ ID NO: 2028911 - RNA, 15 nt, Human herpesvirus 5
caauaaguaccucua

SEQ ID NO: 2028912 - RNA, 15 nt, Human herpesvirus 5
cuccgugccagcugg

SEQ ID NO: 2028913 - RNA, 14 nt, Human herpesvirus 5
ggagcgggucgccg

SEQ ID NO: 2028914 - RNA, 23 nt, Human herpesvirus 5
gccuuuuuaauaaagucuggguu

SEQ ID NO: 2028915 - RNA, 20 nt, Human herpesvirus 5
ugcgccuccucgucggccug

SEQ ID NO: 2028916 - RNA, 16 nt, Human herpesvirus 5
caagcguauccugguc

SEQ ID NO: 2028917 - RNA, 21 nt, Human herpesvirus 5
cucaacuuuggcgugcccagc

SEQ ID NO: 2028918 - RNA, 14 nt, Human herpesvirus 5
cgcgccuuccuccu

SEQ ID NO: 2028919 - RNA, 22 nt, Human herpesvirus 5
gguggugugugauggggugugg

SEQ ID NO: 2028920 - RNA, 18 nt, Human herpesvirus 5
uccgcuacucccgagcuc

SEQ ID NO: 2028921 - RNA, 17 nt, Human herpesvirus 5
ucaacgacgccacacac

SEQ ID NO: 2028922 - RNA, 20 nt, Human herpesvirus 5
ggugauucuauuacacucua

SEQ ID NO: 2028923 - RNA, 14 nt, Human herpesvirus 5
cgcagugggcccac

SEQ ID NO: 2028924 - RNA, 14 nt, Human herpesvirus 5
ugccacguucuugc

SEQ ID NO: 2028925 - RNA, 17 nt, Human herpesvirus 5
gacgcagugcguggccg

SEQ ID NO: 2028926 - RNA, 22 nt, Human herpesvirus 5
gcugcuccucggagcacgggcg

SEQ ID NO: 2028927 - RNA, 18 nt, Human herpesvirus 5
gaccuuccuagcgacggc

SEQ ID NO: 2028928 - RNA, 15 nt, Human herpesvirus 5
cgguuuccgaacacc

SEQ ID NO: 2028929 - RNA, 19 nt, Human herpesvirus 5
cugcgucgucaaggacggc

SEQ ID NO: 2028930 - RNA, 19 nt, Human herpesvirus 5
gcuguuuuuguucacaacu

SEQ ID NO: 2028931 - RNA, 17 nt, Human herpesvirus 5
ggcgcgcgucuggacgc

SEQ ID NO: 2028932 - RNA, 12 nt, Human herpesvirus 5
cucccuucucug

SEQ ID NO: 2028933 - RNA, 12 nt, Human herpesvirus 5
aaguaugugcuc

SEQ ID NO: 2028934 - RNA, 15 nt, Human herpesvirus 5
cccucugcugcuggu

SEQ ID NO: 2028935 - RNA, 17 nt, Human herpesvirus 5
cccgguguuggccacca

SEQ ID NO: 2028936 - RNA, 13 nt, Human herpesvirus 5
ccucgucggaagc

SEQ ID NO: 2028937 - RNA, 14 nt, Human herpesvirus 5
ugaucgugggccag

SEQ ID NO: 2028938 - RNA, 15 nt, Human herpesvirus 5
cuagcauucugguga

SEQ ID NO: 2028939 - RNA, 21 nt, Human herpesvirus 5
gcaccacggccuuauguggcu

SEQ ID NO: 2028940 - RNA, 21 nt, Human herpesvirus 5
caccgccgcuauggcggccau

SEQ ID NO: 2028941 - RNA, 16 nt, Human herpesvirus 5
uucggccggcugcugc

SEQ ID NO: 2028942 - RNA, 17 nt, Human herpesvirus 5
aggaggugaccuggcug

SEQ ID NO: 2028943 - RNA, 24 nt, Human herpesvirus 5
cugcacaccuauggcgccgugggu

SEQ ID NO: 2028944 - RNA, 15 nt, Human herpesvirus 5
aucuccgucucuggu

SEQ ID NO: 2028945 - RNA, 15 nt, Human herpesvirus 5
ccgcagucuggcuug

SEQ ID NO: 2028946 - RNA, 18 nt, Human herpesvirus 5
cgcggaggugcuggcggc

SEQ ID NO: 2028947 - RNA, 17 nt, Human herpesvirus 5
ccucuaccccgccgccg

SEQ ID NO: 2028948 - RNA, 20 nt, Human herpesvirus 5
cgcgucggcgcccgggccgc

SEQ ID NO: 2028949 - RNA, 14 nt, Human herpesvirus 5
cuucacgccccuga

SEQ ID NO: 2028950 - RNA, 14 nt, Human herpesvirus 5
cacgggcugcuggu

SEQ ID NO: 2028951 - RNA, 17 nt, Human herpesvirus 5
cugaguuccgucagcac

SEQ ID NO: 2028952 - RNA, 17 nt, Human herpesvirus 5
ccucaaaaagcaggugg

SEQ ID NO: 2028953 - RNA, 22 nt, Human herpesvirus 5
ugcucaacuuuggcgugcccag

SEQ ID NO: 2028954 - RNA, 14 nt, Human herpesvirus 5
gaccugccgcuuga

SEQ ID NO: 2028955 - RNA, 18 nt, Human herpesvirus 5
agcacguacaaauagcag

SEQ ID NO: 2028956 - RNA, 15 nt, Human herpesvirus 5
gccgcaacagcggcg

SEQ ID NO: 2028957 - RNA, 16 nt, Human herpesvirus 5
ccgccgacucgcugcc

SEQ ID NO: 2028958 - RNA, 20 nt, Human herpesvirus 5
gcaccggcgccugcugcucg

SEQ ID NO: 2028959 - RNA, 13 nt, Human herpesvirus 5
uccccucugcugc

SEQ ID NO: 2028960 - RNA, 22 nt, Human herpesvirus 5
gcugucccuuaucccguuacaa

SEQ ID NO: 2028961 - RNA, 15 nt, Human herpesvirus 5
ggcgccgucagagca

SEQ ID NO: 2028962 - RNA, 21 nt, Human herpesvirus 5
cgggaugcacagcgucuggcc

SEQ ID NO: 2028963 - RNA, 17 nt, Human herpesvirus 5
cuacugaucgccuggag

SEQ ID NO: 2028964 - RNA, 20 nt, Human herpesvirus 5
cacugggagacggccuggau

SEQ ID NO: 2028965 - RNA, 15 nt, Human herpesvirus 5
gccgccgcucagguc

SEQ ID NO: 2028966 - RNA, 15 nt, Human herpesvirus 5
gccgcagcugcugga

SEQ ID NO: 2028967 - RNA, 23 nt, Human herpesvirus 5
auguauccuggggaaaaaaauac

SEQ ID NO: 2028968 - RNA, 22 nt, Human herpesvirus 5
uuccaagccgcagcgcggaaac

SEQ ID NO: 2028969 - RNA, 16 nt, Human herpesvirus 5
uccgccuccacuuccg

SEQ ID NO: 2028970 - RNA, 16 nt, Human herpesvirus 5
ccaccuggacgggggg

SEQ ID NO: 2028971 - RNA, 18 nt, Human herpesvirus 5
gggcucguguggcagcug

SEQ ID NO: 2028972 - RNA, 21 nt, Human herpesvirus 5
aucaugcugggcgacacucag

SEQ ID NO: 2028973 - RNA, 14 nt, Human herpesvirus 5
agcgggcugucaca

SEQ ID NO: 2028974 - RNA, 21 nt, Human herpesvirus 5
ggcguagucggcuaacaaagc

SEQ ID NO: 2028975 - RNA, 21 nt, Human herpesvirus 5
uacuagggaaaacauaagaau

SEQ ID NO: 2028976 - RNA, 23 nt, Human herpesvirus 5
cacgucaccgugccccacucgcu

SEQ ID NO: 2028977 - RNA, 13 nt, Human herpesvirus 5
uggggcuucgccu

SEQ ID NO: 2028978 - RNA, 18 nt, Human herpesvirus 5
aucgcagccacgcgcugg

SEQ ID NO: 2028979 - RNA, 15 nt, Human herpesvirus 5
cgcuuucccaccgcg

SEQ ID NO: 2028980 - RNA, 10 nt, Human herpesvirus 5
guaccugcau

SEQ ID NO: 2028981 - RNA, 16 nt, Human herpesvirus 5
gugcaggccgcgcagg

SEQ ID NO: 2028982 - RNA, 17 nt, Human herpesvirus 5
uuguaaucauccuaauu

SEQ ID NO: 2028983 - RNA, 18 nt, Human herpesvirus 5
gcugcuauaagaaggcca

SEQ ID NO: 2028984 - RNA, 14 nt, Human herpesvirus 5
guuccacggccagc

SEQ ID NO: 2028985 - RNA, 20 nt, Human herpesvirus 5
cgcguagccuccuccaccac

SEQ ID NO: 2028986 - RNA, 14 nt, Human herpesvirus 5
gccgcgcaggccgc

SEQ ID NO: 2028987 - RNA, 22 nt, Human herpesvirus 5
caagagcaugcugugggcccac

SEQ ID NO: 2028988 - RNA, 22 nt, Human herpesvirus 5
cgcguggugaucgugggccagg

SEQ ID NO: 2028989 - RNA, 21 nt, Human herpesvirus 5
uccgcgucggucgccgccucc

SEQ ID NO: 2028990 - RNA, 16 nt, Human herpesvirus 5
cuccgugcggccccca

SEQ ID NO: 2028991 - RNA, 20 nt, Human herpesvirus 5
caagucgccgacgaagaaga

SEQ ID NO: 2028992 - RNA, 15 nt, Human herpesvirus 5
ucacccgccucaugg

SEQ ID NO: 2028993 - RNA, 19 nt, Human herpesvirus 5
gccgccaucaucauguggg

SEQ ID NO: 2028994 - RNA, 18 nt, Human herpesvirus 5
cuguggcuucucuggaga

SEQ ID NO: 2028995 - RNA, 16 nt, Human herpesvirus 5
ugauauuuuacaggua

SEQ ID NO: 2028996 - RNA, 19 nt, Human herpesvirus 5
gauacuaguaaaaaaagug

SEQ ID NO: 2028997 - RNA, 22 nt, Human herpesvirus 5
acggugccauggaccugaccug

SEQ ID NO: 2028998 - RNA, 18 nt, Human herpesvirus 5
gccacuuuucuccccgcu

SEQ ID NO: 2028999 - RNA, 15 nt, Human herpesvirus 5
ugcucucccgcaugg

SEQ ID NO: 2029000 - RNA, 13 nt, Human herpesvirus 5
acauggacucuug

SEQ ID NO: 2029001 - RNA, 20 nt, Human herpesvirus 5
gguggacuuccaggugcgca

SEQ ID NO: 2029002 - RNA, 16 nt, Human herpesvirus 5
acgcuuuuaugaaggu

SEQ ID NO: 2029003 - RNA, 14 nt, Human herpesvirus 5
ugucuucuccgggu

SEQ ID NO: 2029004 - RNA, 14 nt, Human herpesvirus 5
cugccaccagggcg

SEQ ID NO: 2029005 - RNA, 12 nt, Human herpesvirus 5
ugugauugacgu

SEQ ID NO: 2029006 - RNA, 12 nt, Human herpesvirus 5
caguacuuuggg

SEQ ID NO: 2029007 - RNA, 17 nt, Human herpesvirus 5
ucagaaagcugcaauca

SEQ ID NO: 2029008 - RNA, 12 nt, Human herpesvirus 5
gccggcugcugc

SEQ ID NO: 2029009 - RNA, 19 nt, Human herpesvirus 5
ccgggcggcuuccugcggc

SEQ ID NO: 2029010 - RNA, 16 nt, Human herpesvirus 5
ccagcuacagccacga

SEQ ID NO: 2029011 - RNA, 14 nt, Human herpesvirus 5
ggaugggggggacc

SEQ ID NO: 2029012 - RNA, 12 nt, Human herpesvirus 5
agcggugcugau

SEQ ID NO: 2029013 - RNA, 20 nt, Human herpesvirus 5
uuacagcuuuuuaauaaaaa

SEQ ID NO: 2029014 - RNA, 17 nt, Human herpesvirus 5
ggacgcgccacgcucgc

SEQ ID NO: 2029015 - RNA, 19 nt, Human herpesvirus 5
acacuaaauuguuauugcc

SEQ ID NO: 2029016 - RNA, 19 nt, Human herpesvirus 5
ucugcagccggugcgcgac

SEQ ID NO: 2029017 - RNA, 22 nt, Human herpesvirus 5
ucgucugcauguucaucacgua

SEQ ID NO: 2029018 - RNA, 21 nt, Human herpesvirus 5
auggaaauacaugaugaaugu

SEQ ID NO: 2029019 - RNA, 14 nt, Human herpesvirus 5
cagcagcaccaggc

SEQ ID NO: 2029020 - RNA, 19 nt, Human herpesvirus 5
aguacaauacaaaaagcuc

SEQ ID NO: 2029021 - RNA, 23 nt, Human herpesvirus 5
gccccgauaaucggcucucaggc

SEQ ID NO: 2029022 - RNA, 14 nt, Human herpesvirus 5
gccuucggccagcg

SEQ ID NO: 2029023 - RNA, 13 nt, Human herpesvirus 5
gugcagcugguga

SEQ ID NO: 2029024 - RNA, 15 nt, Human herpesvirus 5
ggccgacggcagcgu

SEQ ID NO: 2029025 - RNA, 12 nt, Human herpesvirus 5
agacacuugaau

SEQ ID NO: 2029026 - RNA, 16 nt, Human herpesvirus 5
uccaucgcagccacgc

SEQ ID NO: 2029027 - RNA, 16 nt, Human herpesvirus 5
ggaccgacacggagga

SEQ ID NO: 2029028 - RNA, 15 nt, Human herpesvirus 5
cgugcucgcgcacgu

SEQ ID NO: 2029029 - RNA, 12 nt, Human herpesvirus 5
uacuuuaccuag

SEQ ID NO: 2029030 - RNA, 14 nt, Human herpesvirus 5
ggagcucacccggc

SEQ ID NO: 2029031 - RNA, 12 nt, Human herpesvirus 5
acggagugguga

SEQ ID NO: 2029032 - RNA, 15 nt, Human herpesvirus 5
gaucacguuguccuu

SEQ ID NO: 2029033 - RNA, 15 nt, Human herpesvirus 5
acaccgucagcugcg

SEQ ID NO: 2029034 - RNA, 21 nt, Human herpesvirus 5
augaagccaagcguauccugg

SEQ ID NO: 2029035 - RNA, 20 nt, Human herpesvirus 5
aagugcucgacuuuacggug

SEQ ID NO: 2029036 - RNA, 16 nt, Human herpesvirus 5
guagugagcuuugacg

SEQ ID NO: 2029037 - RNA, 19 nt, Human herpesvirus 5
guggcgccccggcuucauu

SEQ ID NO: 2029038 - RNA, 18 nt, Human herpesvirus 5
cagcgaguugcugugcac

SEQ ID NO: 2029039 - RNA, 15 nt, Human herpesvirus 5
cuacggaccgcagca

SEQ ID NO: 2029040 - RNA, 13 nt, Human herpesvirus 5
cauccaauuacac

SEQ ID NO: 2029041 - RNA, 22 nt, Human herpesvirus 5
gucugcgucaagacgggccugg

SEQ ID NO: 2029042 - RNA, 15 nt, Human herpesvirus 5
cgccgugggcggcga

SEQ ID NO: 2029043 - RNA, 13 nt, Human herpesvirus 5
gccgugguggccg

SEQ ID NO: 2029044 - RNA, 22 nt, Human herpesvirus 5
cgccgccacccgcaccagacuu

SEQ ID NO: 2029045 - RNA, 21 nt, Human herpesvirus 5
cauguuucugguuuuuggacu

SEQ ID NO: 2029046 - RNA, 11 nt, Human herpesvirus 5
cacagaagaaa

SEQ ID NO: 2029047 - RNA, 15 nt, Human herpesvirus 5
ccgcagguuagcggc

SEQ ID NO: 2029048 - RNA, 22 nt, Human herpesvirus 5
cagagggucguuguccuccucg

SEQ ID NO: 2029049 - RNA, 13 nt, Human herpesvirus 5
guccagcuucugg

SEQ ID NO: 2029050 - RNA, 18 nt, Human herpesvirus 5
cuugcgcuucugcagcuc

SEQ ID NO: 2029051 - RNA, 23 nt, Human herpesvirus 5
uauccgaguccaccucugcuacu

SEQ ID NO: 2029052 - RNA, 21 nt, Human herpesvirus 5
ucauauacgguacacgucccc

SEQ ID NO: 2029053 - RNA, 23 nt, Human herpesvirus 5
aucauguuccuacacgccuugca

SEQ ID NO: 2029054 - RNA, 16 nt, Human herpesvirus 5
gaagaugccgaugugu

SEQ ID NO: 2029055 - RNA, 21 nt, Human herpesvirus 5
gggcuucccuccugcagcugc

SEQ ID NO: 2029056 - RNA, 15 nt, Human herpesvirus 5
uuuggcgugcccagc

SEQ ID NO: 2029057 - RNA, 15 nt, Human herpesvirus 5
gaggacagcaaggcc

SEQ ID NO: 2029058 - RNA, 23 nt, Human herpesvirus 5
gcuggcggccguggccuguggcc

SEQ ID NO: 2029059 - RNA, 17 nt, Human herpesvirus 5
uagcacgucagugguga

SEQ ID NO: 2029060 - RNA, 16 nt, Human herpesvirus 5
agcgccaggcggcuga

SEQ ID NO: 2029061 - RNA, 21 nt, Human herpesvirus 5
ggcucccagagcugcuaggaa

SEQ ID NO: 2029062 - RNA, 20 nt, Human herpesvirus 5
ccgagucgugucgcugcguc

SEQ ID NO: 2029063 - RNA, 18 nt, Human herpesvirus 5
cacaucugucaccucaca

SEQ ID NO: 2029064 - RNA, 15 nt, Human herpesvirus 5
cuggcggccgccggc

SEQ ID NO: 2029065 - RNA, 17 nt, Human herpesvirus 5
ugggagaugcggggugg

SEQ ID NO: 2029066 - RNA, 16 nt, Human herpesvirus 5
caccacccgacugcag

SEQ ID NO: 2029067 - RNA, 16 nt, Human herpesvirus 5
ccggugccgaugagau

SEQ ID NO: 2029068 - RNA, 21 nt, Human herpesvirus 5
auuauuaaggcgcuaacgccu

SEQ ID NO: 2029069 - RNA, 17 nt, Human herpesvirus 5
gaaggguguugugcgug

SEQ ID NO: 2029070 - RNA, 13 nt, Human herpesvirus 5
ccucuaccccgcc

SEQ ID NO: 2029071 - RNA, 16 nt, Human herpesvirus 5
cgccgaggcuacugcu

SEQ ID NO: 2029072 - RNA, 13 nt, Human herpesvirus 5
ugacguacauaua

SEQ ID NO: 2029073 - RNA, 18 nt, Human herpesvirus 5
guagacgaaagacaauga

SEQ ID NO: 2029074 - RNA, 22 nt, Human herpesvirus 5
gacgagcggcggccgaccccgc

SEQ ID NO: 2029075 - RNA, 15 nt, Human herpesvirus 5
ccgcgccgccuggag

SEQ ID NO: 2029076 - RNA, 16 nt, Human herpesvirus 5
gcuacgucgacaugaa

SEQ ID NO: 2029077 - RNA, 16 nt, Human herpesvirus 5
caacuguuguuaguuu

SEQ ID NO: 2029078 - RNA, 19 nt, Human herpesvirus 5
cggcgcugacagcccaagg

SEQ ID NO: 2029079 - RNA, 21 nt, Human herpesvirus 5
gucgccgcgucagcggccgcc

SEQ ID NO: 2029080 - RNA, 14 nt, Human herpesvirus 5
aaucgacaggaggc

SEQ ID NO: 2029081 - RNA, 20 nt, Human herpesvirus 5
auagauuagcagaaggaaua

SEQ ID NO: 2029082 - RNA, 23 nt, Human herpesvirus 5
acagucgcagcccccguggccgc

SEQ ID NO: 2029083 - RNA, 21 nt, Human herpesvirus 5
ucugcgccuuuugcuggcugg

SEQ ID NO: 2029084 - RNA, 16 nt, Human herpesvirus 5
uugaugguguaggaga

SEQ ID NO: 2029085 - RNA, 24 nt, Human herpesvirus 5
gcggcgguagaaacgucgcagcca

SEQ ID NO: 2029086 - RNA, 16 nt, Human herpesvirus 5
cuugcgcucggucagc

SEQ ID NO: 2029087 - RNA, 15 nt, Human herpesvirus 5
cuugagcgacagcag

SEQ ID NO: 2029088 - RNA, 23 nt, Human herpesvirus 5
ccuggacacucuggcccugcugu

SEQ ID NO: 2029089 - RNA, 21 nt, Human herpesvirus 5
cgcgguccuagcacgucagug

SEQ ID NO: 2029090 - RNA, 18 nt, Human herpesvirus 5
uggaaggcguggaugagg

SEQ ID NO: 2029091 - RNA, 17 nt, Human herpesvirus 5
gacuugcacgcuguccg

SEQ ID NO: 2029092 - RNA, 12 nt, Human herpesvirus 5
cucgcugggcua

SEQ ID NO: 2029093 - RNA, 18 nt, Human herpesvirus 5
gacgcgguaaggagcaaa

SEQ ID NO: 2029094 - RNA, 16 nt, Human herpesvirus 5
ccgcaaugggcuuccc

SEQ ID NO: 2029095 - RNA, 21 nt, Human herpesvirus 5
ucccaccgcgacccagcgaca

SEQ ID NO: 2029096 - RNA, 12 nt, Human herpesvirus 5
accgcgggccgc

SEQ ID NO: 2029097 - RNA, 14 nt, Human herpesvirus 5
gugacguggauacu

SEQ ID NO: 2029098 - RNA, 13 nt, Human herpesvirus 5
ccagcggccuggc

SEQ ID NO: 2029099 - RNA, 17 nt, Human herpesvirus 5
cgcagucagacccacua

SEQ ID NO: 2029100 - RNA, 17 nt, Human herpesvirus 5
aaggcgcgggugguguu

SEQ ID NO: 2029101 - RNA, 15 nt, Human herpesvirus 5
aacaugcccagcauc

SEQ ID NO: 2029102 - RNA, 18 nt, Human herpesvirus 5
cagacaggcggccagcuu

SEQ ID NO: 2029103 - RNA, 16 nt, Human herpesvirus 5
ccgggacggccugggc

SEQ ID NO: 2029104 - RNA, 16 nt, Human herpesvirus 5
ugcgucaagacgggcc

SEQ ID NO: 2029105 - RNA, 14 nt, Human herpesvirus 5
ccggcuugaccgcg

SEQ ID NO: 2029106 - RNA, 19 nt, Human herpesvirus 5
caucucgcguaacgugucu

SEQ ID NO: 2029107 - RNA, 21 nt, Human herpesvirus 5
gcuuuccaagcugucguggug

SEQ ID NO: 2029108 - RNA, 20 nt, Human herpesvirus 5
gccgcuuucucaucucagcc

SEQ ID NO: 2029109 - RNA, 19 nt, Human herpesvirus 5
gccgaugugaguuucugug

SEQ ID NO: 2029110 - RNA, 14 nt, Human herpesvirus 5
gacugacacagcuc

SEQ ID NO: 2029111 - RNA, 20 nt, Human herpesvirus 5
gguucacacgucguuagcca

SEQ ID NO: 2029112 - RNA, 13 nt, Human herpesvirus 5
gcaacacuaaauu

SEQ ID NO: 2029113 - RNA, 22 nt, Human herpesvirus 5
agcggggguguauagaccccaa

SEQ ID NO: 2029114 - RNA, 15 nt, Human herpesvirus 5
uggaaguaacaucau

SEQ ID NO: 2029115 - RNA, 14 nt, Human herpesvirus 5
ggcuugaccgcguu

SEQ ID NO: 2029116 - RNA, 20 nt, Human herpesvirus 5
ggcugccgccgcuguggcug

SEQ ID NO: 2029117 - RNA, 23 nt, Human herpesvirus 5
caacguggaaggcggcucgcugg

SEQ ID NO: 2029118 - RNA, 15 nt, Human herpesvirus 5
cgagugggccagccc

SEQ ID NO: 2029119 - RNA, 15 nt, Human herpesvirus 5
gcgaggcggcaacug

SEQ ID NO: 2029120 - RNA, 21 nt, Human herpesvirus 5
aagccuccggaacccucuggc

SEQ ID NO: 2029121 - RNA, 15 nt, Human herpesvirus 5
aggcaggcgaugcgc

SEQ ID NO: 2029122 - RNA, 23 nt, Human herpesvirus 5
uggagucgcgguucggccggacc

SEQ ID NO: 2029123 - RNA, 13 nt, Human herpesvirus 5
gccgcagcugcug

SEQ ID NO: 2029124 - RNA, 14 nt, Human herpesvirus 5
uugacccagggcug

SEQ ID NO: 2029125 - RNA, 19 nt, Human herpesvirus 5
gugccgaugagauaaaagu

SEQ ID NO: 2029126 - RNA, 21 nt, Human herpesvirus 5
agccccaucauggcccaagga

SEQ ID NO: 2029127 - RNA, 20 nt, Human herpesvirus 5
gacggugaugaugcugcuga

SEQ ID NO: 2029128 - RNA, 15 nt, Human herpesvirus 5
cggucgcgacgguga

SEQ ID NO: 2029129 - RNA, 16 nt, Human herpesvirus 5
cucuggcgaucugccu

SEQ ID NO: 2029130 - RNA, 19 nt, Human herpesvirus 5
gcuucggccggcugcugca

SEQ ID NO: 2029131 - RNA, 22 nt, Human herpesvirus 5
cguuguucgucucugccucucc

SEQ ID NO: 2029132 - RNA, 15 nt, Human herpesvirus 5
uccacguagguuucu

SEQ ID NO: 2029133 - RNA, 12 nt, Human herpesvirus 5
accgugucuccg

SEQ ID NO: 2029134 - RNA, 15 nt, Human herpesvirus 5
acuugaguacuuuca

SEQ ID NO: 2029135 - RNA, 17 nt, Human herpesvirus 5
accuucccucuccaccc

SEQ ID NO: 2029136 - RNA, 15 nt, Human herpesvirus 5
caguauuuuugugcu

SEQ ID NO: 2029137 - RNA, 10 nt, Human herpesvirus 5
ggguggaaac

SEQ ID NO: 2029138 - RNA, 22 nt, Human herpesvirus 5
gcgacaagcuguggcugcacac

SEQ ID NO: 2029139 - RNA, 15 nt, Human herpesvirus 5
ggccgaccgccgccg

SEQ ID NO: 2029140 - RNA, 13 nt, Human herpesvirus 5
gacagcgugccgg

SEQ ID NO: 2029141 - RNA, 23 nt, Human herpesvirus 5
caucaucagcgccgugcucagcg

SEQ ID NO: 2029142 - RNA, 15 nt, Human herpesvirus 5
agggcgcgggcggcc

SEQ ID NO: 2029143 - RNA, 24 nt, Human herpesvirus 5
ggcgaccgucuggagguggccugc

SEQ ID NO: 2029144 - RNA, 17 nt, Human herpesvirus 5
augucuuacaaaucaca

SEQ ID NO: 2029145 - RNA, 22 nt, Human herpesvirus 5
cguggacgacuggcucaacuuu

SEQ ID NO: 2029146 - RNA, 13 nt, Human herpesvirus 5
cugcauguuggug

SEQ ID NO: 2029147 - RNA, 19 nt, Human herpesvirus 5
caguagacagacaggacac

SEQ ID NO: 2029148 - RNA, 15 nt, Human herpesvirus 5
acauggagacaguuu

SEQ ID NO: 2029149 - RNA, 14 nt, Human herpesvirus 5
cugggcgcccccac

SEQ ID NO: 2029150 - RNA, 14 nt, Human herpesvirus 5
ucacgccagacuug

SEQ ID NO: 2029151 - RNA, 17 nt, Human herpesvirus 5
cuauguaaauguuuuua

SEQ ID NO: 2029152 - RNA, 20 nt, Human herpesvirus 5
cuucuuugccggcucuccuc

SEQ ID NO: 2029153 - RNA, 13 nt, Human herpesvirus 5
aaccuacgugcaa

SEQ ID NO: 2029154 - RNA, 19 nt, Human herpesvirus 5
cugacgcuguacaaucuca

SEQ ID NO: 2029155 - RNA, 13 nt, Human herpesvirus 5
ugggauugacgcg

SEQ ID NO: 2029156 - RNA, 19 nt, Human herpesvirus 5
uacuauagggaggacgaac

SEQ ID NO: 2029157 - RNA, 14 nt, Human herpesvirus 5
cauauagccaauaa

SEQ ID NO: 2029158 - RNA, 21 nt, Human herpesvirus 5
cgcauaagaacggagugguga

SEQ ID NO: 2029159 - RNA, 19 nt, Human herpesvirus 5
guguccgcucaacuuucua

SEQ ID NO: 2029160 - RNA, 13 nt, Human herpesvirus 5
cugaaaacaccau

SEQ ID NO: 2029161 - RNA, 22 nt, Human herpesvirus 5
gaccaccguuaccaguaccacc

SEQ ID NO: 2029162 - RNA, 19 nt, Human herpesvirus 5
gggccgcgcuccaggcgga

SEQ ID NO: 2029163 - RNA, 16 nt, Human herpesvirus 5
ugacccagggcugcuc

SEQ ID NO: 2029164 - RNA, 14 nt, Human herpesvirus 5
caugucgcgacaga

SEQ ID NO: 2029165 - RNA, 14 nt, Human herpesvirus 5
ucgcagccuccucg

SEQ ID NO: 2029166 - RNA, 17 nt, Human herpesvirus 5
cucaccgugcucgugcc

SEQ ID NO: 2029167 - RNA, 15 nt, Human herpesvirus 5
auguugacuaccuug

SEQ ID NO: 2029168 - RNA, 22 nt, Human herpesvirus 5
uuguacccucacggucugcuug

SEQ ID NO: 2029169 - RNA, 15 nt, Human herpesvirus 5
cauuuucuuucuagu

SEQ ID NO: 2029170 - RNA, 14 nt, Human herpesvirus 5
agcaugaacugcca

SEQ ID NO: 2029171 - RNA, 18 nt, Human herpesvirus 5
cagcgugacgcggugcag

SEQ ID NO: 2029172 - RNA, 20 nt, Human herpesvirus 5
gacgccaugcucaagacaga

SEQ ID NO: 2029173 - RNA, 14 nt, Human herpesvirus 5
cgaucuccucccgg

SEQ ID NO: 2029174 - RNA, 15 nt, Human herpesvirus 5
agagccaaaggugac

SEQ ID NO: 2029175 - RNA, 20 nt, Human herpesvirus 5
aggucagcgugucugauacc

SEQ ID NO: 2029176 - RNA, 20 nt, Human herpesvirus 5
cgccuuuugaucgccaccgc

SEQ ID NO: 2029177 - RNA, 14 nt, Human herpesvirus 5
ccgccgcagccacg

SEQ ID NO: 2029178 - RNA, 20 nt, Human herpesvirus 5
uaaucugucguacuguccuu

SEQ ID NO: 2029179 - RNA, 13 nt, Human herpesvirus 5
agagcgguccgcc

SEQ ID NO: 2029180 - RNA, 13 nt, Human herpesvirus 5
cagauguaaauaa

SEQ ID NO: 2029181 - RNA, 21 nt, Human herpesvirus 5
ggucccggauaauuguccuuc

SEQ ID NO: 2029182 - RNA, 19 nt, Human herpesvirus 5
caggcucgucgugggcuac

SEQ ID NO: 2029183 - RNA, 20 nt, Human herpesvirus 5
acacuaaauuguuauugcca

SEQ ID NO: 2029184 - RNA, 18 nt, Human herpesvirus 5
cggcugacgcggacgagg

SEQ ID NO: 2029185 - RNA, 22 nt, Human herpesvirus 5
uuaugaggagcgcgcacaaagg

SEQ ID NO: 2029186 - RNA, 16 nt, Human herpesvirus 5
gccaccaggugccggc

SEQ ID NO: 2029187 - RNA, 20 nt, Human herpesvirus 5
acaguauagcaugcauaaga

SEQ ID NO: 2029188 - RNA, 14 nt, Human herpesvirus 5
ucaccgaugccggc

SEQ ID NO: 2029189 - RNA, 14 nt, Human herpesvirus 5
agcgugcaccugcu

SEQ ID NO: 2029190 - RNA, 14 nt, Human herpesvirus 5
ccaccucugcuacu

SEQ ID NO: 2029191 - RNA, 18 nt, Human herpesvirus 5
gccgggacucuggugcua

SEQ ID NO: 2029192 - RNA, 14 nt, Human herpesvirus 5
ggcggccgcagaag

SEQ ID NO: 2029193 - RNA, 16 nt, Human herpesvirus 5
gcuccgcaagcgccgc

SEQ ID NO: 2029194 - RNA, 13 nt, Human herpesvirus 5
cgcugccgcagcu

SEQ ID NO: 2029195 - RNA, 15 nt, Human herpesvirus 5
cagaacccgacgcgg

SEQ ID NO: 2029196 - RNA, 18 nt, Human herpesvirus 5
auguggcuccgccggcac

SEQ ID NO: 2029197 - RNA, 20 nt, Human herpesvirus 5
gaguggggcaacugcugccu

SEQ ID NO: 2029198 - RNA, 20 nt, Human herpesvirus 5
gucuccaccaaucaagccug

SEQ ID NO: 2029199 - RNA, 18 nt, Human herpesvirus 5
ccccgugacgugcaagac

SEQ ID NO: 2029200 - RNA, 19 nt, Human herpesvirus 5
ucuaggcuacucugacugu

SEQ ID NO: 2029201 - RNA, 14 nt, Human herpesvirus 5
ccaacuucacuuca

SEQ ID NO: 2029202 - RNA, 12 nt, Human herpesvirus 5
gggcguuguuga

SEQ ID NO: 2029203 - RNA, 23 nt, Human herpesvirus 5
acgucguuagccagcgucggcau

SEQ ID NO: 2029204 - RNA, 16 nt, Human herpesvirus 5
ucgccaagaugcugcg

SEQ ID NO: 2029205 - RNA, 13 nt, Human herpesvirus 5
uuuggauguaugu

SEQ ID NO: 2029206 - RNA, 13 nt, Human herpesvirus 5
agccuggggcacc

SEQ ID NO: 2029207 - RNA, 16 nt, Human herpesvirus 5
caguauuccccgcugu

SEQ ID NO: 2029208 - RNA, 14 nt, Human herpesvirus 5
cuguuccugcugcu

SEQ ID NO: 2029209 - RNA, 18 nt, Human herpesvirus 5
ccaagagcaugcuguggg

SEQ ID NO: 2029210 - RNA, 16 nt, Human herpesvirus 5
cgaggacaaggcuccg

SEQ ID NO: 2029211 - RNA, 15 nt, Human herpesvirus 5
ccuauccgcgcggcu

SEQ ID NO: 2029212 - RNA, 21 nt, Human herpesvirus 5
ucauauagccuccggcuguca

SEQ ID NO: 2029213 - RNA, 15 nt, Human herpesvirus 5
ggccugcgggcaggc

SEQ ID NO: 2029214 - RNA, 23 nt, Human herpesvirus 5
caguacggccucugggcugagac

SEQ ID NO: 2029215 - RNA, 23 nt, Human herpesvirus 5
ggccaacagccuguggcaccgcc

SEQ ID NO: 2029216 - RNA, 19 nt, Human herpesvirus 5
caaagaaaagaaaaaaugg

SEQ ID NO: 2029217 - RNA, 15 nt, Human herpesvirus 5
uaccaucuggcgcag

SEQ ID NO: 2029218 - RNA, 16 nt, Human herpesvirus 5
gaugaacgcucucguc

SEQ ID NO: 2029219 - RNA, 17 nt, Human herpesvirus 5
ugagcaacagucggcag

SEQ ID NO: 2029220 - RNA, 16 nt, Human herpesvirus 5
ugggcaccgucuguuc

SEQ ID NO: 2029221 - RNA, 14 nt, Human herpesvirus 5
aaaauaauagauua

SEQ ID NO: 2029222 - RNA, 13 nt, Human herpesvirus 5
cacacaccgcuuu

SEQ ID NO: 2029223 - RNA, 17 nt, Human herpesvirus 5
cugaccugucagaaggc

SEQ ID NO: 2029224 - RNA, 17 nt, Human herpesvirus 5
gcggcucaaacaccgcu

SEQ ID NO: 2029225 - RNA, 22 nt, Human herpesvirus 5
cagucgacgggugguaccugca

SEQ ID NO: 2029226 - RNA, 18 nt, Human herpesvirus 5
cgucuaccggcgagggug

SEQ ID NO: 2029227 - RNA, 17 nt, Human herpesvirus 5
cagcugcaccacggccu

SEQ ID NO: 2029228 - RNA, 15 nt, Human herpesvirus 5
gccacccgccggagc

SEQ ID NO: 2029229 - RNA, 16 nt, Human herpesvirus 5
augaaaaacaucuuaa

SEQ ID NO: 2029230 - RNA, 16 nt, Human herpesvirus 5
gguaccgucuccacca

SEQ ID NO: 2029231 - RNA, 14 nt, Human herpesvirus 5
ucaacagcagcaac

SEQ ID NO: 2029232 - RNA, 14 nt, Human herpesvirus 5
ggcgcuucgagggc

SEQ ID NO: 2029233 - RNA, 18 nt, Human herpesvirus 5
uauagauagcggcacuuu

SEQ ID NO: 2029234 - RNA, 13 nt, Human herpesvirus 5
uauuucuagagca

SEQ ID NO: 2029235 - RNA, 17 nt, Human herpesvirus 5
guugaccguugugggga

SEQ ID NO: 2029236 - RNA, 17 nt, Human herpesvirus 5
uauccaauaaacccauc

SEQ ID NO: 2029237 - RNA, 21 nt, Human herpesvirus 5
cagcgccaccauagccacuac

SEQ ID NO: 2029238 - RNA, 13 nt, Human herpesvirus 5
gccucugggcuga

SEQ ID NO: 2029239 - RNA, 22 nt, Human herpesvirus 5
cggccgacggcagcgugcugug

SEQ ID NO: 2029240 - RNA, 16 nt, Human herpesvirus 5
ccgugcugggcugggu

SEQ ID NO: 2029241 - RNA, 17 nt, Human herpesvirus 5
ugccauggaccugaccu

SEQ ID NO: 2029242 - RNA, 15 nt, Human herpesvirus 5
gccaggugaccagca

SEQ ID NO: 2029243 - RNA, 21 nt, Human herpesvirus 5
acggccuuauguggcugcgcc

SEQ ID NO: 2029244 - RNA, 19 nt, Human herpesvirus 5
ggcucucaggcgcgcagac

SEQ ID NO: 2029245 - RNA, 15 nt, Human herpesvirus 5
auuugaagccaggcg

SEQ ID NO: 2029246 - RNA, 17 nt, Human herpesvirus 5
gcuggccagcaaagugg

SEQ ID NO: 2029247 - RNA, 13 nt, Human herpesvirus 5
gacuacaugcuau

SEQ ID NO: 2029248 - RNA, 17 nt, Human herpesvirus 5
gaugugaguuucugugu

SEQ ID NO: 2029249 - RNA, 22 nt, Human herpesvirus 5
cucggccuuucuaggcuacucc

SEQ ID NO: 2029250 - RNA, 17 nt, Human herpesvirus 5
ccucggguugccuggac

SEQ ID NO: 2029251 - RNA, 20 nt, Human herpesvirus 5
gccgugacacuuuggcucuu

SEQ ID NO: 2029252 - RNA, 21 nt, Human herpesvirus 5
caguauuucuagagcacugag

SEQ ID NO: 2029253 - RNA, 13 nt, Human herpesvirus 5
uucuggcgcuugg

SEQ ID NO: 2029254 - RNA, 13 nt, Human herpesvirus 5
gagcgccgacugg

SEQ ID NO: 2029255 - RNA, 18 nt, Human herpesvirus 5
cgcuacugaucgccugga

SEQ ID NO: 2029256 - RNA, 15 nt, Human herpesvirus 5
gaggcgcgcugcucc

SEQ ID NO: 2029257 - RNA, 12 nt, Human herpesvirus 5
auuuuauuggga

SEQ ID NO: 2029258 - RNA, 20 nt, Human herpesvirus 5
ggucgggcacucggcugugc

SEQ ID NO: 2029259 - RNA, 22 nt, Human herpesvirus 5
gcacgacaucuuccgcgagcac

SEQ ID NO: 2029260 - RNA, 23 nt, Human herpesvirus 5
gcaacagcagccaccgacacagc

SEQ ID NO: 2029261 - RNA, 16 nt, Human herpesvirus 5
ccacguccacccaucc

SEQ ID NO: 2029262 - RNA, 23 nt, Human herpesvirus 5
cgcgaaagcuucggccggcugcu

SEQ ID NO: 2029263 - RNA, 16 nt, Human herpesvirus 5
gccaccgccgccacca

SEQ ID NO: 2029264 - RNA, 18 nt, Human herpesvirus 5
uggcccuggucuggccca

SEQ ID NO: 2029265 - RNA, 14 nt, Human herpesvirus 5
aguuggcguugagc

SEQ ID NO: 2029266 - RNA, 21 nt, Human herpesvirus 5
gaggcacauacgggacuuaca

SEQ ID NO: 2029267 - RNA, 15 nt, Human herpesvirus 5
gcugcugcaccacag

SEQ ID NO: 2029268 - RNA, 15 nt, Human herpesvirus 5
gaacggagcaggaac

SEQ ID NO: 2029269 - RNA, 15 nt, Human herpesvirus 5
gugucgcugggcugg

SEQ ID NO: 2029270 - RNA, 16 nt, Human herpesvirus 5
uaacucacuguuugaa

SEQ ID NO: 2029271 - RNA, 22 nt, Human herpesvirus 5
uauucucaacacguaacgucuu

SEQ ID NO: 2029272 - RNA, 18 nt, Human herpesvirus 5
gccaccaugcaucccacc

SEQ ID NO: 2029273 - RNA, 13 nt, Human herpesvirus 5
cgucgaccuugag

SEQ ID NO: 2029274 - RNA, 19 nt, Human herpesvirus 5
gucugagcgccgacuggau

SEQ ID NO: 2029275 - RNA, 14 nt, Human herpesvirus 5
acgucaaccacccg

SEQ ID NO: 2029276 - RNA, 15 nt, Human herpesvirus 5
cgccuuccuccucug

SEQ ID NO: 2029277 - RNA, 17 nt, Human herpesvirus 5
ccuguuggcuuacugcc

SEQ ID NO: 2029278 - RNA, 14 nt, Human herpesvirus 5
ugaaguuguugauc

SEQ ID NO: 2029279 - RNA, 23 nt, Human herpesvirus 5
ggccaguacggccucugggcuga

SEQ ID NO: 2029280 - RNA, 20 nt, Human herpesvirus 5
ccaagccgcagcgcggaaac

SEQ ID NO: 2029281 - RNA, 16 nt, Human herpesvirus 5
accuagcuacuuugga

SEQ ID NO: 2029282 - RNA, 21 nt, Human herpesvirus 5
ccgucggcgucgcgucgcagg

SEQ ID NO: 2029283 - RNA, 22 nt, Human herpesvirus 5
uaaagcuuucuuucucagucug

SEQ ID NO: 2029284 - RNA, 16 nt, Human herpesvirus 5
ucgggcgugugguaga

SEQ ID NO: 2029285 - RNA, 17 nt, Human herpesvirus 5
ggccaguacggccucug

SEQ ID NO: 2029286 - RNA, 17 nt, Human herpesvirus 5
acggggcgucggagagu

SEQ ID NO: 2029287 - RNA, 22 nt, Human herpesvirus 5
agggcucuucacggucgggcac

SEQ ID NO: 2029288 - RNA, 17 nt, Human herpesvirus 5
cagcaacagcagccacc

SEQ ID NO: 2029289 - RNA, 15 nt, Human herpesvirus 5
uggggccgucugcac

SEQ ID NO: 2029290 - RNA, 21 nt, Human herpesvirus 5
auaaaggguggcgagguguga

SEQ ID NO: 2029291 - RNA, 14 nt, Human herpesvirus 5
gccgggacucuggu

SEQ ID NO: 2029292 - RNA, 20 nt, Human herpesvirus 5
cuaaccacuaccgcaacagc

SEQ ID NO: 2029293 - RNA, 15 nt, Human herpesvirus 5
aucaauacaaugaca

SEQ ID NO: 2029294 - RNA, 11 nt, Human herpesvirus 5
acggaggagac

SEQ ID NO: 2029295 - RNA, 15 nt, Human herpesvirus 5
ucggcgccccacagc

SEQ ID NO: 2029296 - RNA, 15 nt, Human herpesvirus 5
ggccacgagccagac

SEQ ID NO: 2029297 - RNA, 18 nt, Human herpesvirus 5
aacauggcucccagagcu

SEQ ID NO: 2029298 - RNA, 14 nt, Human herpesvirus 5
cugaaucugcucca

SEQ ID NO: 2029299 - RNA, 13 nt, Human herpesvirus 5
caguggcaggccc

SEQ ID NO: 2029300 - RNA, 21 nt, Human herpesvirus 5
ccacgcuauacauagcccgcu

SEQ ID NO: 2029301 - RNA, 21 nt, Human herpesvirus 5
ucuaaugugcuguuugaaaca

SEQ ID NO: 2029302 - RNA, 19 nt, Human herpesvirus 5
gaauuguuaccagaacucu

SEQ ID NO: 2029303 - RNA, 14 nt, Human herpesvirus 5
accuaccugggcug

SEQ ID NO: 2029304 - RNA, 16 nt, Human herpesvirus 5
ugccaguugcuguugc

SEQ ID NO: 2029305 - RNA, 22 nt, Human herpesvirus 5
caacagccuguggcaccgccuc

SEQ ID NO: 2029306 - RNA, 23 nt, Human herpesvirus 5
gcucacguagcaggccgacucgc

SEQ ID NO: 2029307 - RNA, 23 nt, Human herpesvirus 5
auggaaaugcccgccaccaugca

SEQ ID NO: 2029308 - RNA, 18 nt, Human herpesvirus 5
gcaggaaugcggcacccg

SEQ ID NO: 2029309 - RNA, 19 nt, Human herpesvirus 5
gucuuggguagcuucucuc

SEQ ID NO: 2029310 - RNA, 14 nt, Human herpesvirus 5
ccgaacagcagcuc

SEQ ID NO: 2029311 - RNA, 13 nt, Human herpesvirus 5
gcuuuagccaggu

SEQ ID NO: 2029312 - RNA, 11 nt, Human herpesvirus 5
ugcgcgcggcg

SEQ ID NO: 2029313 - RNA, 22 nt, Human herpesvirus 5
aagcugcugguggugacccagg

SEQ ID NO: 2029314 - RNA, 14 nt, Human herpesvirus 5
cuguuugucugugc

SEQ ID NO: 2029315 - RNA, 18 nt, Human herpesvirus 5
uaccgucgccaccaccgg

SEQ ID NO: 2029316 - RNA, 11 nt, Human herpesvirus 5
gccaugccuuc

SEQ ID NO: 2029317 - RNA, 19 nt, Human herpesvirus 5
gggagugguggcggcagcc

SEQ ID NO: 2029318 - RNA, 20 nt, Human herpesvirus 5
cgggcggcuuccugcggccg

SEQ ID NO: 2029319 - RNA, 23 nt, Human herpesvirus 5
cugcuagaugaccauguucagcu

SEQ ID NO: 2029320 - RNA, 15 nt, Human herpesvirus 5
cuacgaugcgagcca

SEQ ID NO: 2029321 - RNA, 23 nt, Human herpesvirus 5
gcugccggucuacagacugggcg

SEQ ID NO: 2029322 - RNA, 22 nt, Human herpesvirus 5
gcggucaugaguuggugcagcu

SEQ ID NO: 2029323 - RNA, 22 nt, Human herpesvirus 5
cauucgauacgcugcuuuuggc

SEQ ID NO: 2029324 - RNA, 18 nt, Human herpesvirus 5
gcugcuguugcacgggcu

SEQ ID NO: 2029325 - RNA, 20 nt, Human herpesvirus 5
ccaccguaccugcaucacgg

SEQ ID NO: 2029326 - RNA, 15 nt, Human herpesvirus 5
ugagcagcaaaacga

SEQ ID NO: 2029327 - RNA, 23 nt, Human herpesvirus 5
gaaagcuucggccggcugcugca

SEQ ID NO: 2029328 - RNA, 14 nt, Human herpesvirus 5
guggucgaugcuga

SEQ ID NO: 2029329 - RNA, 18 nt, Human herpesvirus 5
ucuauauauauuggucac

SEQ ID NO: 2029330 - RNA, 17 nt, Human herpesvirus 5
uccucuaccccgccgcc

SEQ ID NO: 2029331 - RNA, 17 nt, Human herpesvirus 5
accacgaguaacaccgu

SEQ ID NO: 2029332 - RNA, 17 nt, Human herpesvirus 5
ccuucucccccucaugu

SEQ ID NO: 2029333 - RNA, 17 nt, Human herpesvirus 5
gagagccaccuuggugg

SEQ ID NO: 2029334 - RNA, 17 nt, Human herpesvirus 5
aaccaccguagcacugc

SEQ ID NO: 2029335 - RNA, 20 nt, Human herpesvirus 5
ccgcuauugcuuagcugcac

SEQ ID NO: 2029336 - RNA, 20 nt, Human herpesvirus 5
aauaugggaauuccccugcc

SEQ ID NO: 2029337 - RNA, 17 nt, Human herpesvirus 5
aacgaggucguggaucu

SEQ ID NO: 2029338 - RNA, 21 nt, Human herpesvirus 5
uaugauagaaagucacaggaa

SEQ ID NO: 2029339 - RNA, 14 nt, Human herpesvirus 5
aaggcugguuuccc

SEQ ID NO: 2029340 - RNA, 17 nt, Human herpesvirus 5
cuaacacuccucucccc

SEQ ID NO: 2029341 - RNA, 18 nt, Human herpesvirus 5
ucuauaaacgguuucuca

SEQ ID NO: 2029342 - RNA, 16 nt, Human herpesvirus 5
ugcacgcgcugcuuuc

SEQ ID NO: 2029343 - RNA, 14 nt, Human herpesvirus 5
gucguaugccgcca

SEQ ID NO: 2029344 - RNA, 12 nt, Human herpesvirus 5
cucucgggccga

SEQ ID NO: 2029345 - RNA, 21 nt, Human herpesvirus 5
cgcaccggcagcacaccugcc

SEQ ID NO: 2029346 - RNA, 16 nt, Human herpesvirus 5
uugcgggcccugcuga

SEQ ID NO: 2029347 - RNA, 19 nt, Human herpesvirus 5
gugcaucugccgaaacacc

SEQ ID NO: 2029348 - RNA, 13 nt, Human herpesvirus 5
aguccaccucugc

SEQ ID NO: 2029349 - RNA, 22 nt, Human herpesvirus 5
augaaguuguugaucugcugaa

SEQ ID NO: 2029350 - RNA, 21 nt, Human herpesvirus 5
ugaaccgaacuauguggcucc

SEQ ID NO: 2029351 - RNA, 17 nt, Human herpesvirus 5
agucguuucagcccaag

SEQ ID NO: 2029352 - RNA, 13 nt, Human herpesvirus 5
gcgcggcuacacg

SEQ ID NO: 2029353 - RNA, 17 nt, Human herpesvirus 5
cgcugguuuggcugggu

SEQ ID NO: 2029354 - RNA, 20 nt, Human herpesvirus 5
cggauaagcgcuuucugaau

SEQ ID NO: 2029355 - RNA, 18 nt, Human herpesvirus 5
cgcucgugaaacagcagc

SEQ ID NO: 2029356 - RNA, 19 nt, Human herpesvirus 5
caggcgaugcgcacggccg

SEQ ID NO: 2029357 - RNA, 16 nt, Human herpesvirus 5
cuaccgccgcaacagc

SEQ ID NO: 2029358 - RNA, 17 nt, Human herpesvirus 5
ugggucagcggcacgcc

SEQ ID NO: 2029359 - RNA, 16 nt, Human herpesvirus 5
ggucugcgcuuuccca

SEQ ID NO: 2029360 - RNA, 16 nt, Human herpesvirus 5
gacaccaauugcuuua

SEQ ID NO: 2029361 - RNA, 19 nt, Human herpesvirus 5
acgucaggaaucugggagg

SEQ ID NO: 2029362 - RNA, 14 nt, Human herpesvirus 5
guuaccggucacug

SEQ ID NO: 2029363 - RNA, 15 nt, Human herpesvirus 5
cgggcguuggccugu

SEQ ID NO: 2029364 - RNA, 17 nt, Human herpesvirus 5
gacaaccugcugcacuu

SEQ ID NO: 2029365 - RNA, 23 nt, Human herpesvirus 5
gcgagagcacugacagggguggc

SEQ ID NO: 2029366 - RNA, 21 nt, Human herpesvirus 5
caacaguuaucagcaauaaaa

SEQ ID NO: 2029367 - RNA, 21 nt, Human herpesvirus 5
acagccacaucaacauacagu

SEQ ID NO: 2029368 - RNA, 19 nt, Human herpesvirus 5
uuucuaucauaaacuguuc

SEQ ID NO: 2029369 - RNA, 17 nt, Human herpesvirus 5
gguggccgugcugggcu

SEQ ID NO: 2029370 - RNA, 19 nt, Human herpesvirus 5
caauugcgggcccugcuga

SEQ ID NO: 2029371 - RNA, 11 nt, Human herpesvirus 5
gaauccggcug

SEQ ID NO: 2029372 - RNA, 14 nt, Human herpesvirus 5
gggcuucccuccug

SEQ ID NO: 2029373 - RNA, 22 nt, Human herpesvirus 5
gcgggcaauugcaugucgccca

SEQ ID NO: 2029374 - RNA, 16 nt, Human herpesvirus 5
cugauggccgacgagg

SEQ ID NO: 2029375 - RNA, 17 nt, Human herpesvirus 5
aagcccguggcccagga

SEQ ID NO: 2029376 - RNA, 20 nt, Human herpesvirus 5
gaggcaaauauacuagggaa

SEQ ID NO: 2029377 - RNA, 22 nt, Human herpesvirus 5
gaguacacguuaccgucgcccu

SEQ ID NO: 2029378 - RNA, 15 nt, Human herpesvirus 5
agaaagucacaggaa

SEQ ID NO: 2029379 - RNA, 15 nt, Human herpesvirus 5
ccugcacgaccugcu

SEQ ID NO: 2029380 - RNA, 19 nt, Human herpesvirus 5
gcgccggccgucuccacca

SEQ ID NO: 2029381 - RNA, 20 nt, Human herpesvirus 5
uccccacccaguagacagac

SEQ ID NO: 2029382 - RNA, 23 nt, Human herpesvirus 5
ccuaucauaaagaaugcaacgcu

SEQ ID NO: 2029383 - RNA, 18 nt, Human herpesvirus 5
cuccucccucgcgccgcc

SEQ ID NO: 2029384 - RNA, 15 nt, Human herpesvirus 5
augaagccuaucaau

SEQ ID NO: 2029385 - RNA, 17 nt, Human herpesvirus 5
agacccaucgcaccauc

SEQ ID NO: 2029386 - RNA, 19 nt, Human herpesvirus 5
augccuuggcgcucuggau

SEQ ID NO: 2029387 - RNA, 17 nt, Human herpesvirus 5
cuucuuccucucaguca

SEQ ID NO: 2029388 - RNA, 15 nt, Human herpesvirus 5
caaaagggguggaaa

SEQ ID NO: 2029389 - RNA, 15 nt, Human herpesvirus 5
gaugaaaacgagguc

SEQ ID NO: 2029390 - RNA, 22 nt, Human herpesvirus 5
cuccaucgcagccacgcgcugg

SEQ ID NO: 2029391 - RNA, 19 nt, Human herpesvirus 5
ccacggccugcgggcaggc

SEQ ID NO: 2029392 - RNA, 23 nt, Human herpesvirus 5
cgcgucgcuucgccgccaccuuc

SEQ ID NO: 2029393 - RNA, 11 nt, Human herpesvirus 5
uggagcccacg

SEQ ID NO: 2029394 - RNA, 13 nt, Human herpesvirus 5
gcaccgcgacagc

SEQ ID NO: 2029395 - RNA, 16 nt, Human herpesvirus 5
gaugagcaauugccuc

SEQ ID NO: 2029396 - RNA, 16 nt, Human herpesvirus 5
guuugcgccagugggu

SEQ ID NO: 2029397 - RNA, 22 nt, Human herpesvirus 5
guugcucuccucuaccccgccg

SEQ ID NO: 2029398 - RNA, 14 nt, Human herpesvirus 5
gcauacaaugugcu

SEQ ID NO: 2029399 - RNA, 22 nt, Human herpesvirus 5
gucucccgacaggcucgucgug

SEQ ID NO: 2029400 - RNA, 23 nt, Human herpesvirus 5
accccuuuuggugugugucuaua

SEQ ID NO: 2029401 - RNA, 14 nt, Human herpesvirus 5
cagcggucucaucu

SEQ ID NO: 2029402 - RNA, 16 nt, Human herpesvirus 5
gccauuuucagcgacg

SEQ ID NO: 2029403 - RNA, 15 nt, Human herpesvirus 5
cgcggcuagagcgcg

SEQ ID NO: 2029404 - RNA, 18 nt, Human herpesvirus 5
cguggcccuggucuggcc

SEQ ID NO: 2029405 - RNA, 19 nt, Human herpesvirus 5
ggcgguccaguggcaggcc

SEQ ID NO: 2029406 - RNA, 22 nt, Human herpesvirus 5
guugccgcuggacugacacagc

SEQ ID NO: 2029407 - RNA, 18 nt, Human herpesvirus 5
ggcgaaccgccgucgccg

SEQ ID NO: 2029408 - RNA, 23 nt, Human herpesvirus 5
aggccaccgggacggccugggcg

SEQ ID NO: 2029409 - RNA, 15 nt, Human herpesvirus 5
accaagaaacaccgg

SEQ ID NO: 2029410 - RNA, 18 nt, Human herpesvirus 5
aacccagcagccggagga

SEQ ID NO: 2029411 - RNA, 15 nt, Human herpesvirus 5
cgggccgccgccagc

SEQ ID NO: 2029412 - RNA, 23 nt, Human herpesvirus 5
ccugccgaagaccucaccaucuc

SEQ ID NO: 2029413 - RNA, 19 nt, Human herpesvirus 5
augaaggaacgcacgcugg

SEQ ID NO: 2029414 - RNA, 12 nt, Human herpesvirus 5
cgcguggcccug

SEQ ID NO: 2029415 - RNA, 20 nt, Human herpesvirus 5
auguuggugccccaggauga

SEQ ID NO: 2029416 - RNA, 23 nt, Human herpesvirus 5
caaggccgccucuucuggcccuc

SEQ ID NO: 2029417 - RNA, 20 nt, Human herpesvirus 5
cuacauccuuaucugggugc

SEQ ID NO: 2029418 - RNA, 22 nt, Human herpesvirus 5
uauauucaguccauugucagua

SEQ ID NO: 2029419 - RNA, 19 nt, Human herpesvirus 5
gaagacgccgucacgcagg

SEQ ID NO: 2029420 - RNA, 12 nt, Human herpesvirus 5
auuacacucuau

SEQ ID NO: 2029421 - RNA, 14 nt, Human herpesvirus 5
ucuucacuacguug

SEQ ID NO: 2029422 - RNA, 15 nt, Human herpesvirus 5
ucuuucuacaagaca

SEQ ID NO: 2029423 - RNA, 21 nt, Human herpesvirus 5
gggcucguguggcagcuggcu

SEQ ID NO: 2029424 - RNA, 20 nt, Human herpesvirus 5
agacuacaugcuauaagaca

SEQ ID NO: 2029425 - RNA, 13 nt, Human herpesvirus 5
guguugacagggc

SEQ ID NO: 2029426 - RNA, 20 nt, Human herpesvirus 5
caaugacacucgaagcaaca

SEQ ID NO: 2029427 - RNA, 18 nt, Human herpesvirus 5
gauggggucguggcucag

SEQ ID NO: 2029428 - RNA, 15 nt, Human herpesvirus 5
caguuugcggcgcag

SEQ ID NO: 2029429 - RNA, 13 nt, Human herpesvirus 5
cgagugggccagc

SEQ ID NO: 2029430 - RNA, 15 nt, Human herpesvirus 5
ccaccgucgccguca

SEQ ID NO: 2029431 - RNA, 14 nt, Human herpesvirus 5
ccgcagcugcugga

SEQ ID NO: 2029432 - RNA, 16 nt, Human herpesvirus 5
ucggggugcaucaucu

SEQ ID NO: 2029433 - RNA, 15 nt, Human herpesvirus 5
cacguucuugcgucc

SEQ ID NO: 2029434 - RNA, 14 nt, Human herpesvirus 5
caacaacagcaaca

SEQ ID NO: 2029435 - RNA, 18 nt, Human herpesvirus 5
accuaucauaaagaaugc

SEQ ID NO: 2029436 - RNA, 18 nt, Human herpesvirus 5
gcguuaugauaucuacag

SEQ ID NO: 2029437 - RNA, 14 nt, Human herpesvirus 5
gcgcccccgugugu

SEQ ID NO: 2029438 - RNA, 17 nt, Human herpesvirus 5
gcauaagcgcggagguu

SEQ ID NO: 2029439 - RNA, 13 nt, Human herpesvirus 5
gcagcugcuuucu

SEQ ID NO: 2029440 - RNA, 13 nt, Human herpesvirus 5
ugcacgccgccgu

SEQ ID NO: 2029441 - RNA, 13 nt, Human herpesvirus 5
ggcucgcucggcc

SEQ ID NO: 2029442 - RNA, 13 nt, Human herpesvirus 5
uacuuuuacauga

SEQ ID NO: 2029443 - RNA, 19 nt, Human herpesvirus 5
ucaagggucacggugccau

SEQ ID NO: 2029444 - RNA, 19 nt, Human herpesvirus 5
ucaucuuuauuugcaucau

SEQ ID NO: 2029445 - RNA, 13 nt, Human herpesvirus 5
gcaaagucaacau

SEQ ID NO: 2029446 - RNA, 12 nt, Human herpesvirus 5
uaucggaagcug

SEQ ID NO: 2029447 - RNA, 14 nt, Human herpesvirus 5
acgucaaagcucac

SEQ ID NO: 2029448 - RNA, 18 nt, Human herpesvirus 5
ggccuguggugcgacugc

SEQ ID NO: 2029449 - RNA, 23 nt, Human herpesvirus 5
aagcccuacuuuguguuucucgc

SEQ ID NO: 2029450 - RNA, 22 nt, Human herpesvirus 5
gacgcaugauuagcaauauuau

SEQ ID NO: 2029451 - RNA, 14 nt, Human herpesvirus 5
gcggguccauugga

SEQ ID NO: 2029452 - RNA, 17 nt, Human herpesvirus 5
cugcuguguugucuuua

SEQ ID NO: 2029453 - RNA, 20 nt, Human herpesvirus 5
cgcugcggucccgacaugga

SEQ ID NO: 2029454 - RNA, 15 nt, Human herpesvirus 5
ucucccgacgucacu

SEQ ID NO: 2029455 - RNA, 17 nt, Human herpesvirus 5
cgaguggugaggagcgc

SEQ ID NO: 2029456 - RNA, 15 nt, Human herpesvirus 5
gccggaggagcaggc

SEQ ID NO: 2029457 - RNA, 20 nt, Human herpesvirus 5
aggaacgcacgcuggaggac

SEQ ID NO: 2029458 - RNA, 20 nt, Human herpesvirus 5
cugaugccgaucaugugcuu

SEQ ID NO: 2029459 - RNA, 17 nt, Human herpesvirus 5
aacagguccagcuuaaa

SEQ ID NO: 2029460 - RNA, 22 nt, Human herpesvirus 5
cagccgcgcuugucgccaugcu

SEQ ID NO: 2029461 - RNA, 16 nt, Human herpesvirus 5
cgucgagggcccggcc

SEQ ID NO: 2029462 - RNA, 16 nt, Human herpesvirus 5
gaagcugcggcucugc

SEQ ID NO: 2029463 - RNA, 20 nt, Human herpesvirus 5
ccaccgugucuccgugacgg

SEQ ID NO: 2029464 - RNA, 13 nt, Human herpesvirus 5
auccgucagccuc

SEQ ID NO: 2029465 - RNA, 13 nt, Human herpesvirus 5
aacgggugggcug

SEQ ID NO: 2029466 - RNA, 19 nt, Human herpesvirus 5
gcuggccgauccacgggcc

SEQ ID NO: 2029467 - RNA, 18 nt, Human herpesvirus 5
cuucccugagcgagcgcg

SEQ ID NO: 2029468 - RNA, 18 nt, Human herpesvirus 5
gcucggacacagcgccgc

SEQ ID NO: 2029469 - RNA, 14 nt, Human herpesvirus 5
cgcgaccgccucaa

SEQ ID NO: 2029470 - RNA, 23 nt, Human herpesvirus 5
agaccgugggucgggagcacaua

SEQ ID NO: 2029471 - RNA, 20 nt, Human herpesvirus 5
cagcggaaaaugccgccgcc

SEQ ID NO: 2029472 - RNA, 13 nt, Human herpesvirus 5
ccaucccgccuuc

SEQ ID NO: 2029473 - RNA, 19 nt, Human herpesvirus 5
acggaguggugagcggguu

SEQ ID NO: 2029474 - RNA, 19 nt, Human herpesvirus 5
ggcagacggacggugcggg

SEQ ID NO: 2029475 - RNA, 17 nt, Human herpesvirus 5
aaugacauggauaacga

SEQ ID NO: 2029476 - RNA, 17 nt, Human herpesvirus 5
gcugcuuucuuuuugca

SEQ ID NO: 2029477 - RNA, 16 nt, Human herpesvirus 5
ggccgcucgggaacag

SEQ ID NO: 2029478 - RNA, 23 nt, Human herpesvirus 5
cuuuugcgucgcccucgacggcg

SEQ ID NO: 2029479 - RNA, 15 nt, Human herpesvirus 5
gccccagcagaccag

SEQ ID NO: 2029480 - RNA, 11 nt, Human herpesvirus 5
auacacacgga

SEQ ID NO: 2029481 - RNA, 19 nt, Human herpesvirus 5
cguccgcggaaacgacgga

SEQ ID NO: 2029482 - RNA, 20 nt, Human herpesvirus 5
gguagcuucucucuggucuu

SEQ ID NO: 2029483 - RNA, 16 nt, Human herpesvirus 5
guuaucacagaacaca

SEQ ID NO: 2029484 - RNA, 14 nt, Human herpesvirus 5
cgggaacuggccug

SEQ ID NO: 2029485 - RNA, 17 nt, Human herpesvirus 5
caccgucaccacuccca

SEQ ID NO: 2029486 - RNA, 19 nt, Human herpesvirus 5
cuuugacgugcucaagagg

SEQ ID NO: 2029487 - RNA, 19 nt, Human herpesvirus 5
cugucauggggagaaaaga

SEQ ID NO: 2029488 - RNA, 16 nt, Human herpesvirus 5
guuuauuucaauaaau

SEQ ID NO: 2029489 - RNA, 18 nt, Human herpesvirus 5
uauccaauacggcugcca

SEQ ID NO: 2029490 - RNA, 15 nt, Human herpesvirus 5
uguuaccgccgccgc

SEQ ID NO: 2029491 - RNA, 23 nt, Human herpesvirus 5
ggcggaggagagaacggaagaag

SEQ ID NO: 2029492 - RNA, 16 nt, Human herpesvirus 5
acuccgucuccagaca

SEQ ID NO: 2029493 - RNA, 14 nt, Human herpesvirus 5
gcuucugcagcucc

SEQ ID NO: 2029494 - RNA, 19 nt, Human herpesvirus 5
cuucuggagcacacugcua

SEQ ID NO: 2029495 - RNA, 17 nt, Human herpesvirus 5
acaugauggaaaugccc

SEQ ID NO: 2029496 - RNA, 13 nt, Human herpesvirus 5
ucgaugcugcaag

SEQ ID NO: 2029497 - RNA, 19 nt, Human herpesvirus 5
auuccaguagcaccggccc

SEQ ID NO: 2029498 - RNA, 16 nt, Human herpesvirus 5
aagggauaguggcucg

SEQ ID NO: 2029499 - RNA, 20 nt, Human herpesvirus 5
ccggugguacugcuguggug

SEQ ID NO: 2029500 - RNA, 22 nt, Human herpesvirus 5
cugcggaaugauuuggcugggu

SEQ ID NO: 2029501 - RNA, 11 nt, Human herpesvirus 5
guggaaggcac

SEQ ID NO: 2029502 - RNA, 15 nt, Human herpesvirus 5
acgaggaggccgaga

SEQ ID NO: 2029503 - RNA, 15 nt, Human herpesvirus 5
acuucccccuccccu

SEQ ID NO: 2029504 - RNA, 17 nt, Human herpesvirus 5
uaccaccgugacaccgg

SEQ ID NO: 2029505 - RNA, 17 nt, Human herpesvirus 5
cucgguaguggacaugg

SEQ ID NO: 2029506 - RNA, 21 nt, Human herpesvirus 5
gaaguuguugcaacuguuguu

SEQ ID NO: 2029507 - RNA, 17 nt, Human herpesvirus 5
ccagcugccaccagggc

SEQ ID NO: 2029508 - RNA, 15 nt, Human herpesvirus 5
ugauuucuugcuugc

SEQ ID NO: 2029509 - RNA, 17 nt, Human herpesvirus 5
caggaacgauaaccgug

SEQ ID NO: 2029510 - RNA, 14 nt, Human herpesvirus 5
auccagcagcugcg

SEQ ID NO: 2029511 - RNA, 16 nt, Human herpesvirus 5
ccgggccgccgccagc

SEQ ID NO: 2029512 - RNA, 16 nt, Human herpesvirus 5
gaccggcggcugcugu

SEQ ID NO: 2029513 - RNA, 16 nt, Human herpesvirus 5
uggccaucacgggcaa

SEQ ID NO: 2029514 - RNA, 16 nt, Human herpesvirus 5
cccaccccccgggcca

SEQ ID NO: 2029515 - RNA, 13 nt, Human herpesvirus 5
cacaauacacaug

SEQ ID NO: 2029516 - RNA, 15 nt, Human herpesvirus 5
cuuacaaaucacguu

SEQ ID NO: 2029517 - RNA, 19 nt, Human herpesvirus 5
cggcgcccaaaccgcagga

SEQ ID NO: 2029518 - RNA, 21 nt, Human herpesvirus 5
cguagaauacuggaagcugcu

SEQ ID NO: 2029519 - RNA, 12 nt, Human herpesvirus 5
acuucuacggag

SEQ ID NO: 2029520 - RNA, 15 nt, Human herpesvirus 5
gaggcggaggagccg

SEQ ID NO: 2029521 - RNA, 19 nt, Human herpesvirus 5
gcaccgguuggagcagcuc

SEQ ID NO: 2029522 - RNA, 14 nt, Human herpesvirus 5
augaggcacaugau

SEQ ID NO: 2029523 - RNA, 14 nt, Human herpesvirus 5
gaccgucuggaggu

SEQ ID NO: 2029524 - RNA, 13 nt, Human herpesvirus 5
caacgucacuucu

SEQ ID NO: 2029525 - RNA, 13 nt, Human herpesvirus 5
aaacgcugcuugg

SEQ ID NO: 2029526 - RNA, 15 nt, Human herpesvirus 5
gcgugucccugccag

SEQ ID NO: 2029527 - RNA, 12 nt, Human herpesvirus 5
agcgccgcggca

SEQ ID NO: 2029528 - RNA, 21 nt, Human herpesvirus 5
acagacugggcgacgaagugc

SEQ ID NO: 2029529 - RNA, 12 nt, Human herpesvirus 5
auguaguugcag

SEQ ID NO: 2029530 - RNA, 22 nt, Human herpesvirus 5
cugucguucuccgcuugcugcg

SEQ ID NO: 2029531 - RNA, 21 nt, Human herpesvirus 5
caacugagcuucggagguccu

SEQ ID NO: 2029532 - RNA, 15 nt, Human herpesvirus 5
acagccuugagaacc

SEQ ID NO: 2029533 - RNA, 16 nt, Human herpesvirus 5
agagggugaaggcaaa

SEQ ID NO: 2029534 - RNA, 17 nt, Human herpesvirus 5
cacgcaggugaggcucu

SEQ ID NO: 2029535 - RNA, 19 nt, Human herpesvirus 5
ugcuggcggccguggccug

SEQ ID NO: 2029536 - RNA, 12 nt, Human herpesvirus 5
gcgcuuucugaa

SEQ ID NO: 2029537 - RNA, 20 nt, Human herpesvirus 5
ugguggucuacaagcgcaac

SEQ ID NO: 2029538 - RNA, 13 nt, Human herpesvirus 5
ucacuacucuggg

SEQ ID NO: 2029539 - RNA, 20 nt, Human herpesvirus 5
gcggcgguggugacugggga

SEQ ID NO: 2029540 - RNA, 23 nt, Human herpesvirus 5
agcgcggucgccaccuggaucug

SEQ ID NO: 2029541 - RNA, 15 nt, Human herpesvirus 5
ugauguaguugcaga

SEQ ID NO: 2029542 - RNA, 12 nt, Human herpesvirus 5
gaggagcaggcu

SEQ ID NO: 2029543 - RNA, 11 nt, Human herpesvirus 5
cccucugcugc

SEQ ID NO: 2029544 - RNA, 15 nt, Human herpesvirus 5
acaaguaugaaaguu

SEQ ID NO: 2029545 - RNA, 14 nt, Human herpesvirus 5
agcgcgugaccugu

SEQ ID NO: 2029546 - RNA, 19 nt, Human herpesvirus 5
cggucguaagcggcagcau

SEQ ID NO: 2029547 - RNA, 15 nt, Human herpesvirus 5
acgcaggugaggcuc

SEQ ID NO: 2029548 - RNA, 13 nt, Human herpesvirus 5
gcuggccggcuug

SEQ ID NO: 2029549 - RNA, 12 nt, Human herpesvirus 5
cgagguggucaa

SEQ ID NO: 2029550 - RNA, 17 nt, Human herpesvirus 5
acacaggccagcugcca

SEQ ID NO: 2029551 - RNA, 22 nt, Human herpesvirus 5
uguccauagugcgccaagccau

SEQ ID NO: 2029552 - RNA, 15 nt, Human herpesvirus 5
cucggguugccugga

SEQ ID NO: 2029553 - RNA, 15 nt, Human herpesvirus 5
ggccgaccugugcgu

SEQ ID NO: 2029554 - RNA, 13 nt, Human herpesvirus 5
uguugauucugga

SEQ ID NO: 2029555 - RNA, 16 nt, Human herpesvirus 5
aguuggccaccaagaa

SEQ ID NO: 2029556 - RNA, 21 nt, Human herpesvirus 5
cccagcagaccagccaccguc

SEQ ID NO: 2029557 - RNA, 19 nt, Human herpesvirus 5
gguggaaccgugccguugc

SEQ ID NO: 2029558 - RNA, 16 nt, Human herpesvirus 5
cccgucggcugccugu

SEQ ID NO: 2029559 - RNA, 23 nt, Human herpesvirus 5
ggcgauggucauguucucccagg

SEQ ID NO: 2029560 - RNA, 12 nt, Human herpesvirus 5
cuccgucucugg

SEQ ID NO: 2029561 - RNA, 15 nt, Human herpesvirus 5
ggcucugggaagcug

SEQ ID NO: 2029562 - RNA, 17 nt, Human herpesvirus 5
cgacgacuaugaugaag

SEQ ID NO: 2029563 - RNA, 17 nt, Human herpesvirus 5
cgggcuuuuuugucccg

SEQ ID NO: 2029564 - RNA, 19 nt, Human herpesvirus 5
cccuucuggagcacacugc

SEQ ID NO: 2029565 - RNA, 21 nt, Human herpesvirus 5
gaggaugggggggaccggggu

SEQ ID NO: 2029566 - RNA, 23 nt, Human herpesvirus 5
acuggggacggugaugaugcugc

SEQ ID NO: 2029567 - RNA, 13 nt, Human herpesvirus 5
cucaucucagccu

SEQ ID NO: 2029568 - RNA, 16 nt, Human herpesvirus 5
aacuguuccacggcca

SEQ ID NO: 2029569 - RNA, 18 nt, Human herpesvirus 5
cguuggcucucgcagccc

SEQ ID NO: 2029570 - RNA, 22 nt, Human herpesvirus 5
ccccggggcgugccgagcugcc

SEQ ID NO: 2029571 - RNA, 18 nt, Human herpesvirus 5
ggagguggucgagcgcga

SEQ ID NO: 2029572 - RNA, 21 nt, Human herpesvirus 5
ggcgggcuuuuuugucccggg

SEQ ID NO: 2029573 - RNA, 14 nt, Human herpesvirus 5
cguacgucaccgcg

SEQ ID NO: 2029574 - RNA, 19 nt, Human herpesvirus 5
gucgcagcccccguggccg

SEQ ID NO: 2029575 - RNA, 14 nt, Human herpesvirus 5
cgaucuggaaggcg

SEQ ID NO: 2029576 - RNA, 22 nt, Human herpesvirus 5
agcgaguggggcaacugcugcc

SEQ ID NO: 2029577 - RNA, 21 nt, Human herpesvirus 5
cgcaacuuuuggccgccacac

SEQ ID NO: 2029578 - RNA, 22 nt, Human herpesvirus 5
gccgcuacugaucgccuggagc

SEQ ID NO: 2029579 - RNA, 18 nt, Human herpesvirus 5
ggaucuggcggccgccgg

SEQ ID NO: 2029580 - RNA, 15 nt, Human herpesvirus 5
auggcuauguacaca

SEQ ID NO: 2029581 - RNA, 22 nt, Human herpesvirus 5
uaaaucacgucagguucacacg

SEQ ID NO: 2029582 - RNA, 21 nt, Human herpesvirus 5
gcucugucggaugaggcaggc

SEQ ID NO: 2029583 - RNA, 17 nt, Human herpesvirus 5
gggagucaacacuacca

SEQ ID NO: 2029584 - RNA, 17 nt, Human herpesvirus 5
agcggcggacuuggcag

SEQ ID NO: 2029585 - RNA, 12 nt, Human herpesvirus 5
caggaaaguaug

SEQ ID NO: 2029586 - RNA, 23 nt, Human herpesvirus 5
gauggccaucacgggcaaagagu

SEQ ID NO: 2029587 - RNA, 20 nt, Human herpesvirus 5
guuggccaccaagaaacacc

SEQ ID NO: 2029588 - RNA, 23 nt, Human herpesvirus 5
gcuacauucgccgcaaugggcuu

SEQ ID NO: 2029589 - RNA, 23 nt, Human herpesvirus 5
cgcggucgccgcgucagcggccg

SEQ ID NO: 2029590 - RNA, 15 nt, Human herpesvirus 5
aaccuaccugggcug

SEQ ID NO: 2029591 - RNA, 22 nt, Human herpesvirus 5
caugcauucugguaccugcuaa

SEQ ID NO: 2029592 - RNA, 16 nt, Human herpesvirus 5
aaaagaccuaauacua

SEQ ID NO: 2029593 - RNA, 12 nt, Human herpesvirus 5
agacacacacca

SEQ ID NO: 2029594 - RNA, 20 nt, Human herpesvirus 5
cuggucucgugauguggggg

SEQ ID NO: 2029595 - RNA, 23 nt, Human herpesvirus 5
ggcccugugcuuuugcuuacugu

SEQ ID NO: 2029596 - RNA, 17 nt, Human herpesvirus 5
gauaaccuaccuggugu

SEQ ID NO: 2029597 - RNA, 20 nt, Human herpesvirus 5
agaguggugggaaugcacgu

SEQ ID NO: 2029598 - RNA, 17 nt, Human herpesvirus 5
gaacaccagaugcuccc

SEQ ID NO: 2029599 - RNA, 20 nt, Human herpesvirus 5
gucggaugaggcaggcgaug

SEQ ID NO: 2029600 - RNA, 19 nt, Human herpesvirus 5
ggcggccgacggcagcgug

SEQ ID NO: 2029601 - RNA, 18 nt, Human herpesvirus 5
cugcgguuaacccuagca

SEQ ID NO: 2029602 - RNA, 15 nt, Human herpesvirus 5
gcagcagcuggugca

SEQ ID NO: 2029603 - RNA, 21 nt, Human herpesvirus 5
auccacgcucguucaauaauc

SEQ ID NO: 2029604 - RNA, 15 nt, Human herpesvirus 5
gcuaggcgggcugga

SEQ ID NO: 2029605 - RNA, 18 nt, Human herpesvirus 5
gaacccuucccgaccucc

SEQ ID NO: 2029606 - RNA, 21 nt, Human herpesvirus 5
gucaucggcacgugcucuuuu

SEQ ID NO: 2029607 - RNA, 18 nt, Human herpesvirus 5
acuaucgacguguuauca

SEQ ID NO: 2029608 - RNA, 20 nt, Human herpesvirus 5
augguuugugccucugaaag

SEQ ID NO: 2029609 - RNA, 21 nt, Human herpesvirus 5
gccgagacggcgugacacagc

SEQ ID NO: 2029610 - RNA, 18 nt, Human herpesvirus 5
gccucaaaaagcaggugg

SEQ ID NO: 2029611 - RNA, 17 nt, Human herpesvirus 5
aaucuuccccucugcug

SEQ ID NO: 2029612 - RNA, 16 nt, Human herpesvirus 5
ccaugucgcgacacga

SEQ ID NO: 2029613 - RNA, 18 nt, Human herpesvirus 5
ugaauggaaauacaugau

SEQ ID NO: 2029614 - RNA, 22 nt, Human herpesvirus 5
cagcagcucuuccaaugguuga

SEQ ID NO: 2029615 - RNA, 17 nt, Human herpesvirus 5
ggugcaucaucugguag

SEQ ID NO: 2029616 - RNA, 22 nt, Human herpesvirus 5
cuauugcuuagcugcacaccag

SEQ ID NO: 2029617 - RNA, 23 nt, Human herpesvirus 5
cacagggaauaauaauaccacaa

SEQ ID NO: 2029618 - RNA, 22 nt, Human herpesvirus 5
cggaggaggugaccuggcugcu

SEQ ID NO: 2029619 - RNA, 20 nt, Human herpesvirus 5
gguccgucgagaccggcgga

SEQ ID NO: 2029620 - RNA, 13 nt, Human herpesvirus 5
guagguggccaug

SEQ ID NO: 2029621 - RNA, 17 nt, Human herpesvirus 5
gcuucgagggcucgugc

SEQ ID NO: 2029622 - RNA, 23 nt, Human herpesvirus 5
agcgaguggggcaacugcugccu

SEQ ID NO: 2029623 - RNA, 22 nt, Human herpesvirus 5
caucgcccacaguagcgguacc

SEQ ID NO: 2029624 - RNA, 14 nt, Human herpesvirus 5
cacgccaaaccgcg

SEQ ID NO: 2029625 - RNA, 14 nt, Human herpesvirus 5
ugaaaagguacuuu

SEQ ID NO: 2029626 - RNA, 16 nt, Human herpesvirus 5
gaggagugucagacac

SEQ ID NO: 2029627 - RNA, 17 nt, Human herpesvirus 5
cagaagaaaaaaacaca

SEQ ID NO: 2029628 - RNA, 22 nt, Human herpesvirus 5
gugaucacguacguuuuccaaa

SEQ ID NO: 2029629 - RNA, 13 nt, Human herpesvirus 5
gucuccaccacag

SEQ ID NO: 2029630 - RNA, 15 nt, Human herpesvirus 5
ggcggcuugggcagc

SEQ ID NO: 2029631 - RNA, 22 nt, Human herpesvirus 5
acacaaaaucuucuaaaacggu

SEQ ID NO: 2029632 - RNA, 19 nt, Human herpesvirus 5
ccugcugccgccacugggc

SEQ ID NO: 2029633 - RNA, 14 nt, Human herpesvirus 5
ucacuacucuggga

SEQ ID NO: 2029634 - RNA, 18 nt, Human herpesvirus 5
cguggcgguccaguggca

SEQ ID NO: 2029635 - RNA, 17 nt, Human herpesvirus 5
ugauuuuuuuuacaaua

SEQ ID NO: 2029636 - RNA, 14 nt, Human herpesvirus 5
uagcacugcgcaac

SEQ ID NO: 2029637 - RNA, 21 nt, Human herpesvirus 5
acgcugcuauaagaaggccau

SEQ ID NO: 2029638 - RNA, 20 nt, Human herpesvirus 5
cuuggguagcuucucucugg

SEQ ID NO: 2029639 - RNA, 17 nt, Human herpesvirus 5
cgcauagccucuacaaa

SEQ ID NO: 2029640 - RNA, 18 nt, Human herpesvirus 5
cgggucucuuugacacga

SEQ ID NO: 2029641 - RNA, 21 nt, Human herpesvirus 5
ggccuguggauagauuucugc

SEQ ID NO: 2029642 - RNA, 22 nt, Human herpesvirus 5
gccggagcccggucugagcucc

SEQ ID NO: 2029643 - RNA, 14 nt, Human herpesvirus 5
gcgcaagugccugc

SEQ ID NO: 2029644 - RNA, 13 nt, Human herpesvirus 5
uccaugugcagcu

SEQ ID NO: 2029645 - RNA, 14 nt, Human herpesvirus 5
gcgccuuccuccuc

SEQ ID NO: 2029646 - RNA, 16 nt, Human herpesvirus 5
cugcagaccgaggcgc

SEQ ID NO: 2029647 - RNA, 16 nt, Human herpesvirus 5
cccagcagaccagcca

SEQ ID NO: 2029648 - RNA, 17 nt, Human herpesvirus 5
uacgucgcuuuuuacuu

SEQ ID NO: 2029649 - RNA, 21 nt, Human herpesvirus 5
cauaaaaccaccguaccugca

SEQ ID NO: 2029650 - RNA, 17 nt, Human herpesvirus 5
ccagcagcagcuggugc

SEQ ID NO: 2029651 - RNA, 14 nt, Human herpesvirus 5
gggcgcgacggcaa

SEQ ID NO: 2029652 - RNA, 14 nt, Human herpesvirus 5
acggccagcuccac

SEQ ID NO: 2029653 - RNA, 15 nt, Human herpesvirus 5
ucaaaagccugggua

SEQ ID NO: 2029654 - RNA, 19 nt, Human herpesvirus 5
uuccuccucgucgucgccg

SEQ ID NO: 2029655 - RNA, 16 nt, Human herpesvirus 5
ggacauggacucgcca

SEQ ID NO: 2029656 - RNA, 18 nt, Human herpesvirus 5
ugcugugcaccucggccu

SEQ ID NO: 2029657 - RNA, 20 nt, Human herpesvirus 5
cacuaccagcugggccuaca

SEQ ID NO: 2029658 - RNA, 14 nt, Human herpesvirus 5
uucagcucacuguu

SEQ ID NO: 2029659 - RNA, 15 nt, Human herpesvirus 5
cuauagggaggacga

SEQ ID NO: 2029660 - RNA, 16 nt, Human herpesvirus 5
gcgggugccgggacag

SEQ ID NO: 2029661 - RNA, 13 nt, Human herpesvirus 5
ucaucagccaacu

SEQ ID NO: 2029662 - RNA, 15 nt, Human herpesvirus 5
gacgggcgacagcac

SEQ ID NO: 2029663 - RNA, 15 nt, Human herpesvirus 5
cgcuggaggccuccu

SEQ ID NO: 2029664 - RNA, 17 nt, Human herpesvirus 5
aaccgcccgugccuccc

SEQ ID NO: 2029665 - RNA, 19 nt, Human herpesvirus 5
gcaguaccucaacacauug

SEQ ID NO: 2029666 - RNA, 15 nt, Human herpesvirus 5
ggcuucccuccugca

SEQ ID NO: 2029667 - RNA, 21 nt, Human herpesvirus 5
ccggucgcuaacugauaacga

SEQ ID NO: 2029668 - RNA, 17 nt, Human herpesvirus 5
aaguacaauaucaaaga

SEQ ID NO: 2029669 - RNA, 18 nt, Human herpesvirus 5
gaagcacggagacugcgg

SEQ ID NO: 2029670 - RNA, 13 nt, Human herpesvirus 5
cagcgucacagag

SEQ ID NO: 2029671 - RNA, 15 nt, Human herpesvirus 5
aucggcguucugcuc

SEQ ID NO: 2029672 - RNA, 15 nt, Human herpesvirus 5
aacagcagcaacagc

SEQ ID NO: 2029673 - RNA, 19 nt, Human herpesvirus 5
cuguuggcuuacugccugc

SEQ ID NO: 2029674 - RNA, 13 nt, Human herpesvirus 5
gccugguugcugc

SEQ ID NO: 2029675 - RNA, 22 nt, Human herpesvirus 5
uaauaagccggcagcugcuuuc

SEQ ID NO: 2029676 - RNA, 14 nt, Human herpesvirus 5
gcgacguggaggag

SEQ ID NO: 2029677 - RNA, 12 nt, Human herpesvirus 5
cagagcugcuag

SEQ ID NO: 2029678 - RNA, 20 nt, Human herpesvirus 5
guugagcacgucuagcaggc

SEQ ID NO: 2029679 - RNA, 19 nt, Human herpesvirus 5
accgucgccgucacugcca

SEQ ID NO: 2029680 - RNA, 17 nt, Human herpesvirus 5
guaguuggcguugagca

SEQ ID NO: 2029681 - RNA, 14 nt, Human herpesvirus 5
ggcgccgcgguggu

SEQ ID NO: 2029682 - RNA, 17 nt, Human herpesvirus 5
gacacuuuaggcggcgc

SEQ ID NO: 2029683 - RNA, 14 nt, Human herpesvirus 5
ggcuacugcugcuu

SEQ ID NO: 2029684 - RNA, 21 nt, Human herpesvirus 5
gcgacugcggcgacuggcgag

SEQ ID NO: 2029685 - RNA, 17 nt, Human herpesvirus 5
gagugguggcggcagcc

SEQ ID NO: 2029686 - RNA, 13 nt, Human herpesvirus 5
agaaagagcagcg

SEQ ID NO: 2029687 - RNA, 16 nt, Human herpesvirus 5
ccgcucuucuggggcg

SEQ ID NO: 2029688 - RNA, 13 nt, Human herpesvirus 5
cuuuuacuaguau

SEQ ID NO: 2029689 - RNA, 19 nt, Human herpesvirus 5
cgaccuacgggacacgcug

SEQ ID NO: 2029690 - RNA, 22 nt, Human herpesvirus 5
cucgcugggcuacaagugcagc

SEQ ID NO: 2029691 - RNA, 22 nt, Human herpesvirus 5
aagugccugcacgaccugcucc

SEQ ID NO: 2029692 - RNA, 16 nt, Human herpesvirus 5
gaaucgcgagcugggc

SEQ ID NO: 2029693 - RNA, 20 nt, Human herpesvirus 5
acgguaccgcugggaugggu

SEQ ID NO: 2029694 - RNA, 16 nt, Human herpesvirus 5
gcccccgucgcccgag

SEQ ID NO: 2029695 - RNA, 22 nt, Human herpesvirus 5
gcugagcuacgaugaccacgaa

SEQ ID NO: 2029696 - RNA, 18 nt, Human herpesvirus 5
cgugcucagcugguggcu

SEQ ID NO: 2029697 - RNA, 15 nt, Human herpesvirus 5
cuugcuccucuucca

SEQ ID NO: 2029698 - RNA, 17 nt, Human herpesvirus 5
acacgcgggggaaaaac

SEQ ID NO: 2029699 - RNA, 20 nt, Human herpesvirus 5
auaguguguuccuguccggu

SEQ ID NO: 2029700 - RNA, 16 nt, Human herpesvirus 5
guguuuuuuccuuccu

SEQ ID NO: 2029701 - RNA, 18 nt, Human herpesvirus 5
agccaccgacacagcagc

SEQ ID NO: 2029702 - RNA, 17 nt, Human herpesvirus 5
gcaacaacgguagauga

SEQ ID NO: 2029703 - RNA, 16 nt, Human herpesvirus 5
cagcaaccaccguuuc

SEQ ID NO: 2029704 - RNA, 14 nt, Human herpesvirus 5
agggugaaggcaaa

SEQ ID NO: 2029705 - RNA, 15 nt, Human herpesvirus 5
cgcgcccgacagcug

SEQ ID NO: 2029706 - RNA, 18 nt, Human herpesvirus 5
ccuacgucuucaugacgg

SEQ ID NO: 2029707 - RNA, 13 nt, Human herpesvirus 5
cuacagucccgag

SEQ ID NO: 2029708 - RNA, 18 nt, Human herpesvirus 5
ccggaggaagcggcggua

SEQ ID NO: 2029709 - RNA, 22 nt, Human herpesvirus 5
ucggcugccuguuccugcugcu

SEQ ID NO: 2029710 - RNA, 12 nt, Human herpesvirus 5
ggcgcucuggau

SEQ ID NO: 2029711 - RNA, 15 nt, Human herpesvirus 5
cgacgagcaggcucg

SEQ ID NO: 2029712 - RNA, 13 nt, Human herpesvirus 5
cuccggcugucau

SEQ ID NO: 2029713 - RNA, 15 nt, Human herpesvirus 5
ugcgaaguguugacc

SEQ ID NO: 2029714 - RNA, 17 nt, Human herpesvirus 5
auggagccgcaagugcu

SEQ ID NO: 2029715 - RNA, 19 nt, Human herpesvirus 5
gaagucgaucuggaaggcg

SEQ ID NO: 2029716 - RNA, 20 nt, Human herpesvirus 5
cugcgugaugccuggaccca

SEQ ID NO: 2029717 - RNA, 20 nt, Human herpesvirus 5
ccgccgacucgcugccgcag

SEQ ID NO: 2029718 - RNA, 16 nt, Human herpesvirus 5
ucaccgugccccacuc

SEQ ID NO: 2029719 - RNA, 19 nt, Human herpesvirus 5
cugccgcuacugaucgccu

SEQ ID NO: 2029720 - RNA, 15 nt, Human herpesvirus 5
ucugaaucugcucca

SEQ ID NO: 2029721 - RNA, 14 nt, Human herpesvirus 5
accgcaacaacagc

SEQ ID NO: 2029722 - RNA, 18 nt, Human herpesvirus 5
aacagacccgauacaguc

SEQ ID NO: 2029723 - RNA, 18 nt, Human herpesvirus 5
ugcagcgcuacgugcgcg

SEQ ID NO: 2029724 - RNA, 22 nt, Human herpesvirus 5
aucuuuuggaggauguucugca

SEQ ID NO: 2029725 - RNA, 12 nt, Human herpesvirus 5
guguaugcaugu

SEQ ID NO: 2029726 - RNA, 20 nt, Human herpesvirus 5
cuccucgacgcgcggcggcg

SEQ ID NO: 2029727 - RNA, 14 nt, Human herpesvirus 5
ucuaggaacacuga

SEQ ID NO: 2029728 - RNA, 14 nt, Human herpesvirus 5
gccgaggcuacugc

SEQ ID NO: 2029729 - RNA, 16 nt, Human herpesvirus 5
cuugagaaccugcuca

SEQ ID NO: 2029730 - RNA, 15 nt, Human herpesvirus 5
cugcgcgccuccguc

SEQ ID NO: 2029731 - RNA, 17 nt, Human herpesvirus 5
caaacgcgugcgggugc

SEQ ID NO: 2029732 - RNA, 12 nt, Human herpesvirus 5
guggggcugcuc

SEQ ID NO: 2029733 - RNA, 12 nt, Human herpesvirus 5
acgguggugugu

SEQ ID NO: 2029734 - RNA, 15 nt, Human herpesvirus 5
caauugcaugucgcc

SEQ ID NO: 2029735 - RNA, 15 nt, Human herpesvirus 5
ggcucuacagugggu

SEQ ID NO: 2029736 - RNA, 14 nt, Human herpesvirus 5
cgcaguugcugccu

SEQ ID NO: 2029737 - RNA, 21 nt, Human herpesvirus 5
cggaggaggugaccuggcugc

SEQ ID NO: 2029738 - RNA, 19 nt, Human herpesvirus 5
gcgcgucaucggcaccauc

SEQ ID NO: 2029739 - RNA, 16 nt, Human herpesvirus 5
gcaggccgcgcaggcc

SEQ ID NO: 2029740 - RNA, 15 nt, Human herpesvirus 5
gucguggaggcagcg

SEQ ID NO: 2029741 - RNA, 15 nt, Human herpesvirus 5
acgcugacguggugc

SEQ ID NO: 2029742 - RNA, 15 nt, Human herpesvirus 5
cggccgcggaggugc

SEQ ID NO: 2029743 - RNA, 16 nt, Human herpesvirus 5
cguugggucugcgcug

SEQ ID NO: 2029744 - RNA, 17 nt, Human herpesvirus 5
cgccggcguugccgcca

SEQ ID NO: 2029745 - RNA, 22 nt, Human herpesvirus 5
cugcagguacggcccggcagca

SEQ ID NO: 2029746 - RNA, 19 nt, Human herpesvirus 5
caugaugaagauggccauc

SEQ ID NO: 2029747 - RNA, 22 nt, Human herpesvirus 5
agccaggugaccagcaguauga

SEQ ID NO: 2029748 - RNA, 17 nt, Human herpesvirus 5
cacacaggccagcugcc

SEQ ID NO: 2029749 - RNA, 15 nt, Human herpesvirus 5
ccaguaccaccgcug

SEQ ID NO: 2029750 - RNA, 20 nt, Human herpesvirus 5
cagaccgcaacaacagcagc

SEQ ID NO: 2029751 - RNA, 13 nt, Human herpesvirus 5
cuuggcggccgag

SEQ ID NO: 2029752 - RNA, 17 nt, Human herpesvirus 5
cucugucggcgccgccg

SEQ ID NO: 2029753 - RNA, 16 nt, Human herpesvirus 5
ccgccgucaccaccgc

SEQ ID NO: 2029754 - RNA, 14 nt, Human herpesvirus 5
accgucgcccucag

SEQ ID NO: 2029755 - RNA, 16 nt, Human herpesvirus 5
agcucccgcgguccga

SEQ ID NO: 2029756 - RNA, 13 nt, Human herpesvirus 5
ccgccacaccugu

SEQ ID NO: 2029757 - RNA, 19 nt, Human herpesvirus 5
ucauauaaaagucuguaua

SEQ ID NO: 2029758 - RNA, 14 nt, Human herpesvirus 5
cgagcuggccagca

SEQ ID NO: 2029759 - RNA, 20 nt, Human herpesvirus 5
ccauccuuuucaugcucaua

SEQ ID NO: 2029760 - RNA, 19 nt, Human herpesvirus 5
gccgcggugccggcggcua

SEQ ID NO: 2029761 - RNA, 21 nt, Human herpesvirus 5
ggcgauggcaaggugcugcac

SEQ ID NO: 2029762 - RNA, 21 nt, Human herpesvirus 5
uucacaaccguauauucuaca

SEQ ID NO: 2029763 - RNA, 14 nt, Human herpesvirus 5
ggcgugccgagcug

SEQ ID NO: 2029764 - RNA, 19 nt, Human herpesvirus 5
guaguauuuuuucauaguu

SEQ ID NO: 2029765 - RNA, 17 nt, Human herpesvirus 5
cuacggaguuuucccuc

SEQ ID NO: 2029766 - RNA, 15 nt, Human herpesvirus 5
gacgaagaggacacc

SEQ ID NO: 2029767 - RNA, 15 nt, Human herpesvirus 5
ucaacaaacagcucu

SEQ ID NO: 2029768 - RNA, 12 nt, Human herpesvirus 5
cccguggcccag

SEQ ID NO: 2029769 - RNA, 21 nt, Human herpesvirus 5
caccgguuggagcagcucuuu

SEQ ID NO: 2029770 - RNA, 16 nt, Human herpesvirus 5
gacuuagaaucucuug

SEQ ID NO: 2029771 - RNA, 12 nt, Human herpesvirus 5
ucugcuccccca

SEQ ID NO: 2029772 - RNA, 14 nt, Human herpesvirus 5
aauguugacccagg

SEQ ID NO: 2029773 - RNA, 12 nt, Human herpesvirus 5
aggccggcggcg

SEQ ID NO: 2029774 - RNA, 23 nt, Human herpesvirus 5
gcccgccggcgggcggcugccgg

SEQ ID NO: 2029775 - RNA, 18 nt, Human herpesvirus 5
uaaggaaaacgugacuuu

SEQ ID NO: 2029776 - RNA, 16 nt, Human herpesvirus 5
acggcgcucuuucagc

SEQ ID NO: 2029777 - RNA, 14 nt, Human herpesvirus 5
augggcuucccucc

SEQ ID NO: 2029778 - RNA, 17 nt, Human herpesvirus 5
guaacgccacggugcuu

SEQ ID NO: 2029779 - RNA, 13 nt, Human herpesvirus 5
ugaccaugggcua

SEQ ID NO: 2029780 - RNA, 13 nt, Human herpesvirus 5
aacaucuuaagaa

SEQ ID NO: 2029781 - RNA, 15 nt, Human herpesvirus 5
cuauguggcuccgcc

SEQ ID NO: 2029782 - RNA, 16 nt, Human herpesvirus 5
cacgggacccgccgcc

SEQ ID NO: 2029783 - RNA, 14 nt, Human herpesvirus 5
guccaucauguucg

SEQ ID NO: 2029784 - RNA, 13 nt, Human herpesvirus 5
gcugcugagacug

SEQ ID NO: 2029785 - RNA, 22 nt, Human herpesvirus 5
uugcuuuggcggcagcggaggu

SEQ ID NO: 2029786 - RNA, 13 nt, Human herpesvirus 5
gccgccuggaguc

SEQ ID NO: 2029787 - RNA, 14 nt, Human herpesvirus 5
cgacacagcagcac

SEQ ID NO: 2029788 - RNA, 21 nt, Human herpesvirus 5
gccugagcgcgcucagcuacc

SEQ ID NO: 2029789 - RNA, 18 nt, Human herpesvirus 5
cgacgucggucccaucgc

SEQ ID NO: 2029790 - RNA, 22 nt, Human herpesvirus 5
ucgcgagccccaucgggcccgc

SEQ ID NO: 2029791 - RNA, 18 nt, Human herpesvirus 5
gaugaccauguucagcuu

SEQ ID NO: 2029792 - RNA, 22 nt, Human herpesvirus 5
cguagaauacuggaagcugcug

SEQ ID NO: 2029793 - RNA, 18 nt, Human herpesvirus 5
gcgagaugaacuguucca

SEQ ID NO: 2029794 - RNA, 16 nt, Human herpesvirus 5
aaauuauaacggaaau

SEQ ID NO: 2029795 - RNA, 14 nt, Human herpesvirus 5
cugguauaaccagu

SEQ ID NO: 2029796 - RNA, 18 nt, Human herpesvirus 5
cgggugccgggacagcgu

SEQ ID NO: 2029797 - RNA, 19 nt, Human herpesvirus 5
ugccggcauguccggccgu

SEQ ID NO: 2029798 - RNA, 22 nt, Human herpesvirus 5
ugaaucuuccccucugcugcug

SEQ ID NO: 2029799 - RNA, 13 nt, Human herpesvirus 5
cgcgugucccugc

SEQ ID NO: 2029800 - RNA, 16 nt, Human herpesvirus 5
ucacccggcugcuggc

SEQ ID NO: 2029801 - RNA, 17 nt, Human herpesvirus 5
cugaaucugcuccagaa

SEQ ID NO: 2029802 - RNA, 17 nt, Human herpesvirus 5
ucgcgccuuccuccucu

SEQ ID NO: 2029803 - RNA, 15 nt, Human herpesvirus 5
aggagcuucuccccg

SEQ ID NO: 2029804 - RNA, 17 nt, Human herpesvirus 5
gggagacaaggugguga

SEQ ID NO: 2029805 - RNA, 19 nt, Human herpesvirus 5
gccaccaugcaucccacca

SEQ ID NO: 2029806 - RNA, 14 nt, Human herpesvirus 5
ugguuuuugcuucc

SEQ ID NO: 2029807 - RNA, 12 nt, Human herpesvirus 5
ggcagcacaccu

SEQ ID NO: 2029808 - RNA, 19 nt, Human herpesvirus 5
ggaagaaaccguguuucgc

SEQ ID NO: 2029809 - RNA, 21 nt, Human herpesvirus 5
acagacgccuauaaagaaacc

SEQ ID NO: 2029810 - RNA, 19 nt, Human herpesvirus 5
agccgcggugcaggccgcg

SEQ ID NO: 2029811 - RNA, 16 nt, Human herpesvirus 5
caacagcggcgacaga

SEQ ID NO: 2029812 - RNA, 13 nt, Human herpesvirus 5
ccuggagcagcgg

SEQ ID NO: 2029813 - RNA, 17 nt, Human herpesvirus 5
cuuugcuuaucugccuc

SEQ ID NO: 2029814 - RNA, 16 nt, Human herpesvirus 5
ucaccagacuuuuugc

SEQ ID NO: 2029815 - RNA, 18 nt, Human herpesvirus 5
gauaaccuaccugguguc

SEQ ID NO: 2029816 - RNA, 20 nt, Human herpesvirus 5
gccccgaagguuagcgccgc

SEQ ID NO: 2029817 - RNA, 23 nt, Human herpesvirus 5
cuuagacauuccccaccuucccu

SEQ ID NO: 2029818 - RNA, 11 nt, Human herpesvirus 5
gugcagcuggu

SEQ ID NO: 2029819 - RNA, 20 nt, Human herpesvirus 5
auguaucgcauaaagggugg

SEQ ID NO: 2029820 - RNA, 12 nt, Human herpesvirus 5
aaaaauacugac

SEQ ID NO: 2029821 - RNA, 14 nt, Human herpesvirus 5
cgcuaagagcuuug

SEQ ID NO: 2029822 - RNA, 18 nt, Human herpesvirus 5
acggcggcgcguugccac

SEQ ID NO: 2029823 - RNA, 20 nt, Human herpesvirus 5
auuagccccacaugcugcuu

SEQ ID NO: 2029824 - RNA, 14 nt, Human herpesvirus 5
cacgagugggccag

SEQ ID NO: 2029825 - RNA, 14 nt, Human herpesvirus 5
acaucgcauaugac

SEQ ID NO: 2029826 - RNA, 12 nt, Human herpesvirus 5
ggaaucugggag

SEQ ID NO: 2029827 - RNA, 12 nt, Human herpesvirus 5
cggaagaagaag

SEQ ID NO: 2029828 - RNA, 12 nt, Human herpesvirus 5
cuggagguggcc

SEQ ID NO: 2029829 - RNA, 15 nt, Human herpesvirus 5
ggaggugaccuggcu

SEQ ID NO: 2029830 - RNA, 14 nt, Human herpesvirus 5
gacgcgccucaugg

SEQ ID NO: 2029831 - RNA, 16 nt, Human herpesvirus 5
augacacgaacgugac

SEQ ID NO: 2029832 - RNA, 16 nt, Human herpesvirus 5
gucgccgucacugcca

SEQ ID NO: 2029833 - RNA, 23 nt, Human herpesvirus 5
cugauuuugaugguuugugccuc

SEQ ID NO: 2029834 - RNA, 19 nt, Human herpesvirus 5
gucagacccacuaccugga

SEQ ID NO: 2029835 - RNA, 12 nt, Human herpesvirus 5
cuggcagagcca

SEQ ID NO: 2029836 - RNA, 17 nt, Human herpesvirus 5
aacuacuaauacagaua

SEQ ID NO: 2029837 - RNA, 15 nt, Human herpesvirus 5
acccaucgcaccauc

SEQ ID NO: 2029838 - RNA, 14 nt, Human herpesvirus 5
cguagugagcuuug

SEQ ID NO: 2029839 - RNA, 14 nt, Human herpesvirus 5
gaugagauaaaagu

SEQ ID NO: 2029840 - RNA, 22 nt, Human herpesvirus 5
ccccacggcggcggccugcucg

SEQ ID NO: 2029841 - RNA, 19 nt, Human herpesvirus 5
gcugucguucuccgcuugc

SEQ ID NO: 2029842 - RNA, 13 nt, Human herpesvirus 5
gaugaaucaugug

SEQ ID NO: 2029843 - RNA, 23 nt, Human herpesvirus 5
gcgccacguagccgaugcugaug

SEQ ID NO: 2029844 - RNA, 20 nt, Human herpesvirus 5
caacguaacagcaaacgcua

SEQ ID NO: 2029845 - RNA, 19 nt, Human herpesvirus 5
gacggcagcuaucgugacu

SEQ ID NO: 2029846 - RNA, 17 nt, Human herpesvirus 5
gcacuucggucucgggc

SEQ ID NO: 2029847 - RNA, 23 nt, Human herpesvirus 5
gucaugggcgacuuucagggcau

SEQ ID NO: 2029848 - RNA, 15 nt, Human herpesvirus 5
ccucagucgccguca

SEQ ID NO: 2029849 - RNA, 15 nt, Human herpesvirus 5
uccacaaccugugga

SEQ ID NO: 2029850 - RNA, 16 nt, Human herpesvirus 5
ugcgacugcggcgacu

SEQ ID NO: 2029851 - RNA, 17 nt, Human herpesvirus 5
gcaaggucaacuacagc

SEQ ID NO: 2029852 - RNA, 13 nt, Human herpesvirus 5
aaagaaaaaagac

SEQ ID NO: 2029853 - RNA, 15 nt, Human herpesvirus 5
gcugguguugccgca

SEQ ID NO: 2029854 - RNA, 14 nt, Human herpesvirus 5
ucgaugugguucug

SEQ ID NO: 2029855 - RNA, 13 nt, Human herpesvirus 5
ccgugcugggcug

SEQ ID NO: 2029856 - RNA, 20 nt, Human herpesvirus 5
cugcgggcccacgguacgcc

SEQ ID NO: 2029857 - RNA, 20 nt, Human herpesvirus 5
ucuuuaaaaacacuggcugc

SEQ ID NO: 2029858 - RNA, 13 nt, Human herpesvirus 5
guauaugauuuug

SEQ ID NO: 2029859 - RNA, 13 nt, Human herpesvirus 5
aaaagcaccauga

SEQ ID NO: 2029860 - RNA, 22 nt, Human herpesvirus 5
guuguccucgcaccgggcuuug

SEQ ID NO: 2029861 - RNA, 19 nt, Human herpesvirus 5
uguuguagcaacuggcaaa

SEQ ID NO: 2029862 - RNA, 21 nt, Human herpesvirus 5
accgacgacgacagucuccuc

SEQ ID NO: 2029863 - RNA, 17 nt, Human herpesvirus 5
uacuucccccuccccuu

SEQ ID NO: 2029864 - RNA, 15 nt, Human herpesvirus 5
aaaauaauauacaca

SEQ ID NO: 2029865 - RNA, 23 nt, Human herpesvirus 5
accgcuacaacgcgcgccugacc

SEQ ID NO: 2029866 - RNA, 17 nt, Human herpesvirus 5
cacguagaucccacugg

SEQ ID NO: 2029867 - RNA, 13 nt, Human herpesvirus 5
gugcgggugcaug

SEQ ID NO: 2029868 - RNA, 13 nt, Human herpesvirus 5
cugcuccucggag

SEQ ID NO: 2029869 - RNA, 18 nt, Human herpesvirus 5
augaugaaucaugugguc

SEQ ID NO: 2029870 - RNA, 13 nt, Human herpesvirus 5
accgucagcugcg

SEQ ID NO: 2029871 - RNA, 19 nt, Human herpesvirus 5
cgcagugcguggccgcaca

SEQ ID NO: 2029872 - RNA, 18 nt, Human herpesvirus 5
cugagacugguggugaga

SEQ ID NO: 2029873 - RNA, 16 nt, Human herpesvirus 5
cauuacuaaacaaaaa

SEQ ID NO: 2029874 - RNA, 22 nt, Human herpesvirus 5
aaucugggagguggcugggcuc

SEQ ID NO: 2029875 - RNA, 19 nt, Human herpesvirus 5
cuuuuuuuaaccaauaaca

SEQ ID NO: 2029876 - RNA, 14 nt, Human herpesvirus 5
cagcgcccuggggc

SEQ ID NO: 2029877 - RNA, 16 nt, Human herpesvirus 5
aaugugcugcaugaga

SEQ ID NO: 2029878 - RNA, 16 nt, Human herpesvirus 5
ccguguucuuaaucuu

SEQ ID NO: 2029879 - RNA, 22 nt, Human herpesvirus 5
ccgcaacagcggcgacagacgg

SEQ ID NO: 2029880 - RNA, 12 nt, Human herpesvirus 5
gacgggccuggu

SEQ ID NO: 2029881 - RNA, 22 nt, Human herpesvirus 5
gaaccaagucuugccgugacgu

SEQ ID NO: 2029882 - RNA, 17 nt, Human herpesvirus 5
uuccgcgugcuccacca

SEQ ID NO: 2029883 - RNA, 13 nt, Human herpesvirus 5
cgaacggagcagg

SEQ ID NO: 2029884 - RNA, 16 nt, Human herpesvirus 5
uggcgguccaguggca

SEQ ID NO: 2029885 - RNA, 19 nt, Human herpesvirus 5
agugguggggcugcgucgc

SEQ ID NO: 2029886 - RNA, 18 nt, Human herpesvirus 5
uuguuagacuagcacaga

SEQ ID NO: 2029887 - RNA, 12 nt, Human herpesvirus 5
gccgugcucagc

SEQ ID NO: 2029888 - RNA, 16 nt, Human herpesvirus 5
cguccacacaccgcuu

SEQ ID NO: 2029889 - RNA, 13 nt, Human herpesvirus 5
gggcugggugcau

SEQ ID NO: 2029890 - RNA, 22 nt, Human herpesvirus 5
gggcugcaagguacggacucua

SEQ ID NO: 2029891 - RNA, 13 nt, Human herpesvirus 5
cugugcuggccgc

SEQ ID NO: 2029892 - RNA, 22 nt, Human herpesvirus 5
gaugaacuguuccacggccagc

SEQ ID NO: 2029893 - RNA, 22 nt, Human herpesvirus 5
gccguacccgccccagcagacc

SEQ ID NO: 2029894 - RNA, 17 nt, Human herpesvirus 5
cggugguuucgcuggga

SEQ ID NO: 2029895 - RNA, 20 nt, Human herpesvirus 5
acgguuacuccacaaccugu

SEQ ID NO: 2029896 - RNA, 20 nt, Human herpesvirus 5
aaguaccucuaacaacguca

SEQ ID NO: 2029897 - RNA, 19 nt, Human herpesvirus 5
guguacgccaucuucaucu

SEQ ID NO: 2029898 - RNA, 15 nt, Human herpesvirus 5
cagcuugcccgacca

SEQ ID NO: 2029899 - RNA, 21 nt, Human herpesvirus 5
ccccaucgggcccgccacugc

SEQ ID NO: 2029900 - RNA, 18 nt, Human herpesvirus 5
cgcguagccaccuguugg

SEQ ID NO: 2029901 - RNA, 19 nt, Human herpesvirus 5
cggccgcagaaggccauga

SEQ ID NO: 2029902 - RNA, 19 nt, Human herpesvirus 5
ccguaaccacgucgaccag

SEQ ID NO: 2029903 - RNA, 14 nt, Human herpesvirus 5
gaaggcaaagaaaa

SEQ ID NO: 2029904 - RNA, 15 nt, Human herpesvirus 5
agacgaagaggacac

SEQ ID NO: 2029905 - RNA, 17 nt, Human herpesvirus 5
acucccaccacgguuuc

SEQ ID NO: 2029906 - RNA, 15 nt, Human herpesvirus 5
gagcgcgagcgggca

SEQ ID NO: 2029907 - RNA, 17 nt, Human herpesvirus 5
cugcaccaggagggcuu

SEQ ID NO: 2029908 - RNA, 23 nt, Human herpesvirus 5
ggccgagacggcgugacacagca

SEQ ID NO: 2029909 - RNA, 21 nt, Human herpesvirus 5
cgugcucaagaggugagggua

SEQ ID NO: 2029910 - RNA, 20 nt, Human herpesvirus 5
gaauacuggaagcugcuggu

SEQ ID NO: 2029911 - RNA, 11 nt, Human herpesvirus 5
ggacaaguauu

SEQ ID NO: 2029912 - RNA, 20 nt, Human herpesvirus 5
accgugcccguuuucacagc

SEQ ID NO: 2029913 - RNA, 14 nt, Human herpesvirus 5
gcaucccaccacgg

SEQ ID NO: 2029914 - RNA, 20 nt, Human herpesvirus 5
ucugcgcgggcagcccaagu

SEQ ID NO: 2029915 - RNA, 21 nt, Human herpesvirus 5
gccugcgggcaggcggguugc

SEQ ID NO: 2029916 - RNA, 21 nt, Human herpesvirus 5
cggcggcgugaccggcggugc

SEQ ID NO: 2029917 - RNA, 15 nt, Human herpesvirus 5
cgcaggccgccgccg

SEQ ID NO: 2029918 - RNA, 15 nt, Human herpesvirus 5
guacccaccaccucc

SEQ ID NO: 2029919 - RNA, 20 nt, Human herpesvirus 5
cuagcuggcggccucuuuug

SEQ ID NO: 2029920 - RNA, 19 nt, Human herpesvirus 5
ggcgguacugaagccgccg

SEQ ID NO: 2029921 - RNA, 22 nt, Human herpesvirus 5
acagguagguggccaugaugac

SEQ ID NO: 2029922 - RNA, 14 nt, Human herpesvirus 5
ggaagcguccgcug

SEQ ID NO: 2029923 - RNA, 14 nt, Human herpesvirus 5
gccucauccuuaug

SEQ ID NO: 2029924 - RNA, 17 nt, Human herpesvirus 5
cgcggacacccgcggcc

SEQ ID NO: 2029925 - RNA, 22 nt, Human herpesvirus 5
acgaaccagcugguaccugaaa

SEQ ID NO: 2029926 - RNA, 20 nt, Human herpesvirus 5
ggcugcgcggguuucaggua

SEQ ID NO: 2029927 - RNA, 22 nt, Human herpesvirus 5
guggaucgucgcggacugccgg

SEQ ID NO: 2029928 - RNA, 14 nt, Human herpesvirus 5
guagcuagugcagc

SEQ ID NO: 2029929 - RNA, 16 nt, Human herpesvirus 5
caaggucaacuacagc

SEQ ID NO: 2029930 - RNA, 16 nt, Human herpesvirus 5
acggcaaggcggagga

SEQ ID NO: 2029931 - RNA, 21 nt, Human herpesvirus 5
aguacuucccaugcaacuucu

SEQ ID NO: 2029932 - RNA, 19 nt, Human herpesvirus 5
gaggaagucgaucuggaag

SEQ ID NO: 2029933 - RNA, 15 nt, Human herpesvirus 5
ccgugcucagcggcg

SEQ ID NO: 2029934 - RNA, 22 nt, Human herpesvirus 5
ggcuaacgcgcugcugcucucc

SEQ ID NO: 2029935 - RNA, 13 nt, Human herpesvirus 5
ugcuuagcugcac

SEQ ID NO: 2029936 - RNA, 16 nt, Human herpesvirus 5
ucccucguuacccccg

SEQ ID NO: 2029937 - RNA, 15 nt, Human herpesvirus 5
acgucacgccagacu

SEQ ID NO: 2029938 - RNA, 17 nt, Human herpesvirus 5
cgggcucguguggcagc

SEQ ID NO: 2029939 - RNA, 15 nt, Human herpesvirus 5
ccgccgacucgcugc

SEQ ID NO: 2029940 - RNA, 16 nt, Human herpesvirus 5
auauucaaucauuacu

SEQ ID NO: 2029941 - RNA, 22 nt, Human herpesvirus 5
accuccuccucccucgcgccgc

SEQ ID NO: 2029942 - RNA, 21 nt, Human herpesvirus 5
ccaccaaggcgacauggcccu

SEQ ID NO: 2029943 - RNA, 22 nt, Human herpesvirus 5
guuugcccgaagcggcuguggc

SEQ ID NO: 2029944 - RNA, 17 nt, Human herpesvirus 5
gguuugugccucugaaa

SEQ ID NO: 2029945 - RNA, 17 nt, Human herpesvirus 5
acgugauuuacgagguc

SEQ ID NO: 2029946 - RNA, 15 nt, Human herpesvirus 5
ccuguugcucuccuc

SEQ ID NO: 2029947 - RNA, 17 nt, Human herpesvirus 5
agggcugcucggcggcc

SEQ ID NO: 2029948 - RNA, 20 nt, Human herpesvirus 5
cgcaacagcggcgacagacg

SEQ ID NO: 2029949 - RNA, 13 nt, Human herpesvirus 5
uuuuaucuuuaaa

SEQ ID NO: 2029950 - RNA, 20 nt, Human herpesvirus 5
caacgacguuuaaaguaaau

SEQ ID NO: 2029951 - RNA, 13 nt, Human herpesvirus 5
gcggcgccgggaa

SEQ ID NO: 2029952 - RNA, 22 nt, Human herpesvirus 5
aggguuucaaguacccaccgau

SEQ ID NO: 2029953 - RNA, 19 nt, Human herpesvirus 5
gguaacgcuggcucacgcc

SEQ ID NO: 2029954 - RNA, 17 nt, Human herpesvirus 5
ccuugagcgacagcagc

SEQ ID NO: 2029955 - RNA, 17 nt, Human herpesvirus 5
cguagaauacuggaagc

SEQ ID NO: 2029956 - RNA, 22 nt, Human herpesvirus 5
ugccgccgcuguggcugccgcu

SEQ ID NO: 2029957 - RNA, 16 nt, Human herpesvirus 5
gaacccuucccgaccu

SEQ ID NO: 2029958 - RNA, 22 nt, Human herpesvirus 5
uuacucgagcuuauugagcgca

SEQ ID NO: 2029959 - RNA, 16 nt, Human herpesvirus 5
gucagagagucugaaa

SEQ ID NO: 2029960 - RNA, 21 nt, Human herpesvirus 5
accaucucacguacaggcaua

SEQ ID NO: 2029961 - RNA, 16 nt, Human herpesvirus 5
cgggacggccugggcg

SEQ ID NO: 2029962 - RNA, 11 nt, Human herpesvirus 5
uauucaacaau

SEQ ID NO: 2029963 - RNA, 15 nt, Human herpesvirus 5
ugcucuaaaaacacc

SEQ ID NO: 2029964 - RNA, 20 nt, Human herpesvirus 5
ugcggcccccagaggcccgc

SEQ ID NO: 2029965 - RNA, 13 nt, Human herpesvirus 5
gcacgacuggcca

SEQ ID NO: 2029966 - RNA, 21 nt, Human herpesvirus 5
cgagcuuauugagcgcagcca

SEQ ID NO: 2029967 - RNA, 15 nt, Human herpesvirus 5
cgggcgacagcacgu

SEQ ID NO: 2029968 - RNA, 20 nt, Human herpesvirus 5
ucaccguauggcugcgcgug

SEQ ID NO: 2029969 - RNA, 21 nt, Human herpesvirus 5
guuggaacccaucgaggaggc

SEQ ID NO: 2029970 - RNA, 22 nt, Human herpesvirus 5
gaguuggccucgauccauccug

SEQ ID NO: 2029971 - RNA, 15 nt, Human herpesvirus 5
ugcagcuuuugcacg

SEQ ID NO: 2029972 - RNA, 23 nt, Human herpesvirus 5
cccguauacgcgcuggaggcccu

SEQ ID NO: 2029973 - RNA, 23 nt, Human herpesvirus 5
cagcuaccgccgcaacagcggcg

SEQ ID NO: 2029974 - RNA, 13 nt, Human herpesvirus 5
ucaugucuuacaa

SEQ ID NO: 2029975 - RNA, 17 nt, Human herpesvirus 5
augccgaugugugacua

SEQ ID NO: 2029976 - RNA, 22 nt, Human herpesvirus 5
ggggaaaaucacgaaaggcacc

SEQ ID NO: 2029977 - RNA, 19 nt, Human herpesvirus 5
ucgcuccgcggucaggucc

SEQ ID NO: 2029978 - RNA, 13 nt, Human herpesvirus 5
ucuucuggcccuc

SEQ ID NO: 2029979 - RNA, 23 nt, Human herpesvirus 5
aggccgccgccgcucaggucgcc

SEQ ID NO: 2029980 - RNA, 16 nt, Human herpesvirus 5
acgacggaaauggcac

SEQ ID NO: 2029981 - RNA, 15 nt, Human herpesvirus 5
ucgcccagaaagaac

SEQ ID NO: 2029982 - RNA, 19 nt, Human herpesvirus 5
ccugucgucgacaugucgc

SEQ ID NO: 2029983 - RNA, 19 nt, Human herpesvirus 5
auccgcuacucccgagcuc

SEQ ID NO: 2029984 - RNA, 17 nt, Human herpesvirus 5
agcaggguaaaaaccac

SEQ ID NO: 2029985 - RNA, 15 nt, Human herpesvirus 5
ggcuaacgcgcugcu

SEQ ID NO: 2029986 - RNA, 16 nt, Human herpesvirus 5
ugcugauucgcgccgu

SEQ ID NO: 2029987 - RNA, 21 nt, Human herpesvirus 5
aagucacacaggccagcugcc

SEQ ID NO: 2029988 - RNA, 18 nt, Human herpesvirus 5
gacggccugggcgccccc

SEQ ID NO: 2029989 - RNA, 23 nt, Human herpesvirus 5
acacuuggugcucgaccaggagg

SEQ ID NO: 2029990 - RNA, 17 nt, Human herpesvirus 5
cucagcggcguguacag

SEQ ID NO: 2029991 - RNA, 17 nt, Human herpesvirus 5
gccuugagaaccugcuc

SEQ ID NO: 2029992 - RNA, 23 nt, Human herpesvirus 5
cuaucacgggcucguguggcagc

SEQ ID NO: 2029993 - RNA, 18 nt, Human herpesvirus 5
gugcgccguggugcuggg

SEQ ID NO: 2029994 - RNA, 14 nt, Human herpesvirus 5
gcacguggccuggc

SEQ ID NO: 2029995 - RNA, 22 nt, Human herpesvirus 5
ucgcgccuuccuccucugccug

SEQ ID NO: 2029996 - RNA, 19 nt, Human herpesvirus 5
uaaacccacgaccauuucc

SEQ ID NO: 2029997 - RNA, 14 nt, Human herpesvirus 5
uuaagcuggaccug

SEQ ID NO: 2029998 - RNA, 19 nt, Human herpesvirus 5
ugccagcccuauccuccau

SEQ ID NO: 2029999 - RNA, 18 nt, Human herpesvirus 5
accuucuugcccacgccg

SEQ ID NO: 2030000 - RNA, 19 nt, Human herpesvirus 5
gaguuggugcagcugcgcc

SEQ ID NO: 2030001 - RNA, 16 nt, Human herpesvirus 5
ccagcggccgcagugg

SEQ ID NO: 2030002 - RNA, 12 nt, Human herpesvirus 5
cccuucucuggu

SEQ ID NO: 2030003 - RNA, 14 nt, Human herpesvirus 5
ucuauguuauacuc

SEQ ID NO: 2030004 - RNA, 15 nt, Human herpesvirus 5
agauuucgcccgacu

SEQ ID NO: 2030005 - RNA, 20 nt, Human herpesvirus 5
cugagaacauguggaaauca

SEQ ID NO: 2030006 - RNA, 17 nt, Human herpesvirus 5
ccucauauacgguacac

SEQ ID NO: 2030007 - RNA, 23 nt, Human herpesvirus 5
cucggcgugcucaggccacccgc

SEQ ID NO: 2030008 - RNA, 22 nt, Human herpesvirus 5
cucacgucguugggaaugucca

SEQ ID NO: 2030009 - RNA, 20 nt, Human herpesvirus 5
cggccaacaaccacggcgaa

SEQ ID NO: 2030010 - RNA, 12 nt, Human herpesvirus 5
agcggccgccgg

SEQ ID NO: 2030011 - RNA, 22 nt, Human herpesvirus 5
ugcacccccgauaugggccgcu

SEQ ID NO: 2030012 - RNA, 18 nt, Human herpesvirus 5
gaggugaccuggcugcuu

SEQ ID NO: 2030013 - RNA, 14 nt, Human herpesvirus 5
uucggguuccgcgu

SEQ ID NO: 2030014 - RNA, 18 nt, Human herpesvirus 5
uccccggucgcuuaugcg

SEQ ID NO: 2030015 - RNA, 15 nt, Human herpesvirus 5
cucgacguuucugau

SEQ ID NO: 2030016 - RNA, 15 nt, Human herpesvirus 5
gcaccggcagcccau

SEQ ID NO: 2030017 - RNA, 13 nt, Human herpesvirus 5
gcgacggcagcgc

SEQ ID NO: 2030018 - RNA, 23 nt, Human herpesvirus 5
acgcugcuugguacccgaggucu

SEQ ID NO: 2030019 - RNA, 13 nt, Human herpesvirus 5
gccgcaagcggcg

SEQ ID NO: 2030020 - RNA, 14 nt, Human herpesvirus 5
uauagccaauaaag

SEQ ID NO: 2030021 - RNA, 16 nt, Human herpesvirus 5
aagcccguggcccagg

SEQ ID NO: 2030022 - RNA, 23 nt, Human herpesvirus 5
gcucgugcgugucgcugggcugg

SEQ ID NO: 2030023 - RNA, 17 nt, Human herpesvirus 5
uuccccgugacgugcaa

SEQ ID NO: 2030024 - RNA, 18 nt, Human herpesvirus 5
gcgcggucgccaccugga

SEQ ID NO: 2030025 - RNA, 15 nt, Human herpesvirus 5
ggucaaaagccuggg

SEQ ID NO: 2030026 - RNA, 14 nt, Human herpesvirus 5
agcacuaccagcug

SEQ ID NO: 2030027 - RNA, 14 nt, Human herpesvirus 5
cugaacaauaaacu

SEQ ID NO: 2030028 - RNA, 18 nt, Human herpesvirus 5
acggcgucuuccuccucg

SEQ ID NO: 2030029 - RNA, 13 nt, Human herpesvirus 5
cauaucgggcccu

SEQ ID NO: 2030030 - RNA, 14 nt, Human herpesvirus 5
cuccuccucccucg

SEQ ID NO: 2030031 - RNA, 14 nt, Human herpesvirus 5
cgcauccugcccac

SEQ ID NO: 2030032 - RNA, 16 nt, Human herpesvirus 5
caaagaagucucuuuc

SEQ ID NO: 2030033 - RNA, 15 nt, Human herpesvirus 5
gagcguaccagggaa

SEQ ID NO: 2030034 - RNA, 21 nt, Human herpesvirus 5
cguagccuccuccaccacggc

SEQ ID NO: 2030035 - RNA, 21 nt, Human herpesvirus 5
aacuugagcacaaaaauacug

SEQ ID NO: 2030036 - RNA, 18 nt, Human herpesvirus 5
ccgcggccgcugccgccg

SEQ ID NO: 2030037 - RNA, 13 nt, Human herpesvirus 5
gcaggccgcgcag

SEQ ID NO: 2030038 - RNA, 21 nt, Human herpesvirus 5
gccuuucugaccuugcugaug

SEQ ID NO: 2030039 - RNA, 12 nt, Human herpesvirus 5
acccuaaaacac

SEQ ID NO: 2030040 - RNA, 22 nt, Human herpesvirus 5
gaugagccccucagucuguuuc

SEQ ID NO: 2030041 - RNA, 23 nt, Human herpesvirus 5
caaucaaaccuguuccugucaau

SEQ ID NO: 2030042 - RNA, 20 nt, Human herpesvirus 5
gguguugccuucugcugccc

SEQ ID NO: 2030043 - RNA, 18 nt, Human herpesvirus 5
cuaacauuccccugggaa

SEQ ID NO: 2030044 - RNA, 18 nt, Human herpesvirus 5
agguacgggucuaccaaa

SEQ ID NO: 2030045 - RNA, 22 nt, Human herpesvirus 5
cgcaaugggcuucccuccugca

SEQ ID NO: 2030046 - RNA, 21 nt, Human herpesvirus 5
ugcuccucggagcacgggcga

SEQ ID NO: 2030047 - RNA, 20 nt, Human herpesvirus 5
gugaagagggugaaggcaaa

SEQ ID NO: 2030048 - RNA, 12 nt, Human herpesvirus 5
uaaaaaaaccac

SEQ ID NO: 2030049 - RNA, 19 nt, Human herpesvirus 5
acguuggcucucgcagccc

SEQ ID NO: 2030050 - RNA, 16 nt, Human herpesvirus 5
ugacgcugcuggccga

SEQ ID NO: 2030051 - RNA, 13 nt, Human herpesvirus 5
cuggcggccgugg

SEQ ID NO: 2030052 - RNA, 18 nt, Human herpesvirus 5
cacugccaacccagcagc

SEQ ID NO: 2030053 - RNA, 12 nt, Human herpesvirus 5
cgcagcugcugg

SEQ ID NO: 2030054 - RNA, 14 nt, Human herpesvirus 5
auuuuauugggaau

SEQ ID NO: 2030055 - RNA, 19 nt, Human herpesvirus 5
cugacaguucacggggaga

SEQ ID NO: 2030056 - RNA, 22 nt, Human herpesvirus 5
cagguacggcccggcagcacca

SEQ ID NO: 2030057 - RNA, 19 nt, Human herpesvirus 5
uagaacugaguuuagugcu

SEQ ID NO: 2030058 - RNA, 12 nt, Human herpesvirus 5
cacccgcggccg

SEQ ID NO: 2030059 - RNA, 13 nt, Human herpesvirus 5
cgcugaagcggau

SEQ ID NO: 2030060 - RNA, 11 nt, Human herpesvirus 5
gcuucuuuucu

SEQ ID NO: 2030061 - RNA, 12 nt, Human herpesvirus 5
cgacccaccgcc

SEQ ID NO: 2030062 - RNA, 17 nt, Human herpesvirus 5
cgguccuccagcagcag

SEQ ID NO: 2030063 - RNA, 15 nt, Human herpesvirus 5
cgccgaacagacuug

SEQ ID NO: 2030064 - RNA, 24 nt, Human herpesvirus 5
aucuguucuuccaccagcuacuuu

SEQ ID NO: 2030065 - RNA, 22 nt, Human herpesvirus 5
ucacacaggccagcugccacca

SEQ ID NO: 2030066 - RNA, 23 nt, Human herpesvirus 5
agcggcggcgguggugacugggg

SEQ ID NO: 2030067 - RNA, 20 nt, Human herpesvirus 5
acgagcuggacaaguacagc

SEQ ID NO: 2030068 - RNA, 20 nt, Human herpesvirus 5
ccugccuacgucuucaugac

SEQ ID NO: 2030069 - RNA, 17 nt, Human herpesvirus 5
uagaagcacccauuaca

SEQ ID NO: 2030070 - RNA, 14 nt, Human herpesvirus 5
caacagcgggucaa

SEQ ID NO: 2030071 - RNA, 15 nt, Human herpesvirus 5
aaaucuuaccacagu

SEQ ID NO: 2030072 - RNA, 21 nt, Human herpesvirus 5
gagucaccguaaucaccaaag

SEQ ID NO: 2030073 - RNA, 18 nt, Human herpesvirus 5
gcgcugcggucccgacau

SEQ ID NO: 2030074 - RNA, 17 nt, Human herpesvirus 5
gcuuccauaaacgcuuu

SEQ ID NO: 2030075 - RNA, 23 nt, Human herpesvirus 5
acaaggaagcguccgcuggaaau

SEQ ID NO: 2030076 - RNA, 15 nt, Human herpesvirus 5
acgcagucugcccug

SEQ ID NO: 2030077 - RNA, 23 nt, Human herpesvirus 5
accuguuggagcaacgggcggcc

SEQ ID NO: 2030078 - RNA, 18 nt, Human herpesvirus 5
ccgcgcccgucgcgcacg

SEQ ID NO: 2030079 - RNA, 23 nt, Human herpesvirus 5
auuaacaauuccacgccgcugcu

SEQ ID NO: 2030080 - RNA, 19 nt, Human herpesvirus 5
ccgcgccucacgcugcacg

SEQ ID NO: 2030081 - RNA, 15 nt, Human herpesvirus 5
uccaugugcagcugg

SEQ ID NO: 2030082 - RNA, 14 nt, Human herpesvirus 5
ccuguuccugcugc

SEQ ID NO: 2030083 - RNA, 16 nt, Human herpesvirus 5
acgcgcuggaggcccu

SEQ ID NO: 2030084 - RNA, 20 nt, Human herpesvirus 5
ccacgcucgagggcuccguc

SEQ ID NO: 2030085 - RNA, 14 nt, Human herpesvirus 5
gggcggucgacugg

SEQ ID NO: 2030086 - RNA, 13 nt, Human herpesvirus 5
cgcgacacccggg

SEQ ID NO: 2030087 - RNA, 15 nt, Human herpesvirus 5
aagacgucaaugaca

SEQ ID NO: 2030088 - RNA, 22 nt, Human herpesvirus 5
ggaagaagaagaacaagcggug

SEQ ID NO: 2030089 - RNA, 22 nt, Human herpesvirus 5
cgaguggugaggagcgccgggg

SEQ ID NO: 2030090 - RNA, 22 nt, Human herpesvirus 5
cgcggucauauagccuccggcu

SEQ ID NO: 2030091 - RNA, 21 nt, Human herpesvirus 5
gcagauucaguaaccuggagc

SEQ ID NO: 2030092 - RNA, 23 nt, Human herpesvirus 5
cgaaucgccggcuugcuccucuu

SEQ ID NO: 2030093 - RNA, 20 nt, Human herpesvirus 5
gugguggcuguaggcuaccg

SEQ ID NO: 2030094 - RNA, 14 nt, Human herpesvirus 5
acagcgucuggcca

SEQ ID NO: 2030095 - RNA, 18 nt, Human herpesvirus 5
aaacacgacgaaagcguu

SEQ ID NO: 2030096 - RNA, 22 nt, Human herpesvirus 5
ucgcuggaaagacaauaaacag

SEQ ID NO: 2030097 - RNA, 19 nt, Human herpesvirus 5
agcucuuccaaugguugaa

SEQ ID NO: 2030098 - RNA, 14 nt, Human herpesvirus 5
ccugcacgccgccg

SEQ ID NO: 2030099 - RNA, 12 nt, Human herpesvirus 5
uccgcuggaaau

SEQ ID NO: 2030100 - RNA, 20 nt, Human herpesvirus 5
ggcuugcuccucuuccaaau

SEQ ID NO: 2030101 - RNA, 22 nt, Human herpesvirus 5
uaucaucugucugcgagcaccu

SEQ ID NO: 2030102 - RNA, 15 nt, Human herpesvirus 5
cagcuccaaaacgac

SEQ ID NO: 2030103 - RNA, 20 nt, Human herpesvirus 5
ccggggagacaaggugguga

SEQ ID NO: 2030104 - RNA, 13 nt, Human herpesvirus 5
uacuucccccucc

SEQ ID NO: 2030105 - RNA, 16 nt, Human herpesvirus 5
ugggauggguguuuuu

SEQ ID NO: 2030106 - RNA, 13 nt, Human herpesvirus 5
uguguuugacauu

SEQ ID NO: 2030107 - RNA, 12 nt, Human herpesvirus 5
gggaggcgguga

SEQ ID NO: 2030108 - RNA, 18 nt, Human herpesvirus 5
ccgccggcacgucaguuu

SEQ ID NO: 2030109 - RNA, 14 nt, Human herpesvirus 5
ggugccgggacagc

SEQ ID NO: 2030110 - RNA, 22 nt, Human herpesvirus 5
caggugacauccucgcccaggc

SEQ ID NO: 2030111 - RNA, 23 nt, Human herpesvirus 5
ccagccuguuuaaugacaagugc

SEQ ID NO: 2030112 - RNA, 21 nt, Human herpesvirus 5
cucgguaaugcguguccagau

SEQ ID NO: 2030113 - RNA, 20 nt, Human herpesvirus 5
agccgugucgcgcacccggc

SEQ ID NO: 2030114 - RNA, 23 nt, Human herpesvirus 5
cggcgauggcggggcugguugcu

SEQ ID NO: 2030115 - RNA, 15 nt, Human herpesvirus 5
cgaacgcgacuggcg

SEQ ID NO: 2030116 - RNA, 13 nt, Human herpesvirus 5
cgccguuugcccg

SEQ ID NO: 2030117 - RNA, 15 nt, Human herpesvirus 5
gacgacucagggcug

SEQ ID NO: 2030118 - RNA, 14 nt, Human herpesvirus 5
uguuccuguccggu

SEQ ID NO: 2030119 - RNA, 15 nt, Human herpesvirus 5
uagcaaguccuccaa

SEQ ID NO: 2030120 - RNA, 15 nt, Human herpesvirus 5
ugcuggagcgcggcc

SEQ ID NO: 2030121 - RNA, 17 nt, Human herpesvirus 5
gccgagugggacggcaa

SEQ ID NO: 2030122 - RNA, 12 nt, Human herpesvirus 5
uguccgccccuc

SEQ ID NO: 2030123 - RNA, 20 nt, Human herpesvirus 5
gcacggcaucaugcugggcg

SEQ ID NO: 2030124 - RNA, 19 nt, Human herpesvirus 5
gucaucucauuugcuuuua

SEQ ID NO: 2030125 - RNA, 11 nt, Human herpesvirus 5
aaaauauguag

SEQ ID NO: 2030126 - RNA, 11 nt, Human herpesvirus 5
acgagcucuug

SEQ ID NO: 2030127 - RNA, 15 nt, Human herpesvirus 5
augugcucggaccgu

SEQ ID NO: 2030128 - RNA, 19 nt, Human herpesvirus 5
ggcggcggugguggaggag

SEQ ID NO: 2030129 - RNA, 16 nt, Human herpesvirus 5
cgaugcugcaaggccu

SEQ ID NO: 2030130 - RNA, 22 nt, Human herpesvirus 5
uaagugacguggauacuaguaa

SEQ ID NO: 2030131 - RNA, 13 nt, Human herpesvirus 5
gcagcagcuggug

SEQ ID NO: 2030132 - RNA, 20 nt, Human herpesvirus 5
aggcucucggaucugcggcu

SEQ ID NO: 2030133 - RNA, 10 nt, Human herpesvirus 5
gaugaaccuc

SEQ ID NO: 2030134 - RNA, 24 nt, Human herpesvirus 5
gcaggacgggauaucccagaggaa

SEQ ID NO: 2030135 - RNA, 18 nt, Human herpesvirus 5
agugcgccaagccaugca

SEQ ID NO: 2030136 - RNA, 14 nt, Human herpesvirus 5
ggcgcucuuucagc

SEQ ID NO: 2030137 - RNA, 14 nt, Human herpesvirus 5
gggcaacugcugcc

SEQ ID NO: 2030138 - RNA, 19 nt, Human herpesvirus 5
uagggaucauuuucuuggc

SEQ ID NO: 2030139 - RNA, 19 nt, Human herpesvirus 5
uggccgauccacgggccgc

SEQ ID NO: 2030140 - RNA, 23 nt, Human herpesvirus 5
cauccaucacaucacccaacacu

SEQ ID NO: 2030141 - RNA, 20 nt, Human herpesvirus 5
gggccgccaauuggcggcga

SEQ ID NO: 2030142 - RNA, 16 nt, Human herpesvirus 5
aauaaagucuggguuu

SEQ ID NO: 2030143 - RNA, 23 nt, Human herpesvirus 5
ccggcugcggcggcacucgcucc

SEQ ID NO: 2030144 - RNA, 14 nt, Human herpesvirus 5
gccuggacccacaa

SEQ ID NO: 2030145 - RNA, 13 nt, Human herpesvirus 5
ccuuuugcuggcu

SEQ ID NO: 2030146 - RNA, 19 nt, Human herpesvirus 5
ggagcgggucgccgaggcu

SEQ ID NO: 2030147 - RNA, 18 nt, Human herpesvirus 5
acuucagaaucuauaaau

SEQ ID NO: 2030148 - RNA, 22 nt, Human herpesvirus 5
gaacugucgucgccggaaggaa

SEQ ID NO: 2030149 - RNA, 19 nt, Human herpesvirus 5
cacuuuacauaaaaccacc

SEQ ID NO: 2030150 - RNA, 14 nt, Human herpesvirus 5
aggacgaggcaggg

SEQ ID NO: 2030151 - RNA, 20 nt, Human herpesvirus 5
cgaaucaccgucggcggggc

SEQ ID NO: 2030152 - RNA, 18 nt, Human herpesvirus 5
uggaggagaccauccuca

SEQ ID NO: 2030153 - RNA, 16 nt, Human herpesvirus 5
gggguacgcuaugugu

SEQ ID NO: 2030154 - RNA, 14 nt, Human herpesvirus 5
ccgucgccaccacc

SEQ ID NO: 2030155 - RNA, 14 nt, Human herpesvirus 5
cuaccaugcgcaac

SEQ ID NO: 2030156 - RNA, 15 nt, Human herpesvirus 5
uagacagacaggaca

SEQ ID NO: 2030157 - RNA, 15 nt, Human herpesvirus 5
cacgcugcacgaccu

SEQ ID NO: 2030158 - RNA, 19 nt, Human herpesvirus 5
cuuagucgagacuugcacg

SEQ ID NO: 2030159 - RNA, 14 nt, Human herpesvirus 5
cguguggcagcugg

SEQ ID NO: 2030160 - RNA, 20 nt, Human herpesvirus 5
gcaacaacgacgacuaugau

SEQ ID NO: 2030161 - RNA, 14 nt, Human herpesvirus 5
cagcggcgacagac

SEQ ID NO: 2030162 - RNA, 21 nt, Human herpesvirus 5
acuggggucaaaagccugggu

SEQ ID NO: 2030163 - RNA, 12 nt, Human herpesvirus 5
gcgcucccugcu

SEQ ID NO: 2030164 - RNA, 20 nt, Human herpesvirus 5
gaauaccguaaacauaauga

SEQ ID NO: 2030165 - RNA, 16 nt, Human herpesvirus 5
acaaccugugguguac

SEQ ID NO: 2030166 - RNA, 20 nt, Human herpesvirus 5
aacgacaguaguagcggcag

SEQ ID NO: 2030167 - RNA, 12 nt, Human herpesvirus 5
ucagagcaucaa

SEQ ID NO: 2030168 - RNA, 19 nt, Human herpesvirus 5
ggccgcacuggacgacguc

SEQ ID NO: 2030169 - RNA, 13 nt, Human herpesvirus 5
ugcugaucgccgu

SEQ ID NO: 2030170 - RNA, 18 nt, Human herpesvirus 5
cggcgaauggaucaucug

SEQ ID NO: 2030171 - RNA, 17 nt, Human herpesvirus 5
augcguguuaaacacua

SEQ ID NO: 2030172 - RNA, 14 nt, Human herpesvirus 5
gcagcagcuggugc

SEQ ID NO: 2030173 - RNA, 23 nt, Human herpesvirus 5
ucucguuguacgcauuacacagg

SEQ ID NO: 2030174 - RNA, 13 nt, Human herpesvirus 5
acaagguggugaa

SEQ ID NO: 2030175 - RNA, 14 nt, Human herpesvirus 5
uauaaagauucacu

SEQ ID NO: 2030176 - RNA, 22 nt, Human herpesvirus 5
gccugcacgccgccgugacugc

SEQ ID NO: 2030177 - RNA, 21 nt, Human herpesvirus 5
gccgccgaagccuggggcacc

SEQ ID NO: 2030178 - RNA, 16 nt, Human herpesvirus 5
caguagacagacagga

SEQ ID NO: 2030179 - RNA, 13 nt, Human herpesvirus 5
gcagcgaguugcu

SEQ ID NO: 2030180 - RNA, 17 nt, Human herpesvirus 5
cgccgggcggcuuccug

SEQ ID NO: 2030181 - RNA, 15 nt, Human herpesvirus 5
uggcaagaguucaaa

SEQ ID NO: 2030182 - RNA, 17 nt, Human herpesvirus 5
aagcuauaccaucaccu

SEQ ID NO: 2030183 - RNA, 22 nt, Human herpesvirus 5
ggcugagacaggacgaggcagg

SEQ ID NO: 2030184 - RNA, 19 nt, Human herpesvirus 5
cugcucgaccgcuggaggc

SEQ ID NO: 2030185 - RNA, 23 nt, Human herpesvirus 5
gacggucaccaucgugccgcucc

SEQ ID NO: 2030186 - RNA, 21 nt, Human herpesvirus 5
cuggcguucaccacgccggcc

SEQ ID NO: 2030187 - RNA, 17 nt, Human herpesvirus 5
uggggcaacugcugccu

SEQ ID NO: 2030188 - RNA, 13 nt, Human herpesvirus 5
aaaccgcuuucag

SEQ ID NO: 2030189 - RNA, 21 nt, Human herpesvirus 5
cuucuuugguaucuacaucag

SEQ ID NO: 2030190 - RNA, 12 nt, Human herpesvirus 5
augcguguccug

SEQ ID NO: 2030191 - RNA, 15 nt, Human herpesvirus 5
agcuguguauaguuu

SEQ ID NO: 2030192 - RNA, 18 nt, Human herpesvirus 5
ggugagggucguggcgcg

SEQ ID NO: 2030193 - RNA, 14 nt, Human herpesvirus 5
ucucagccucgucg

SEQ ID NO: 2030194 - RNA, 13 nt, Human herpesvirus 5
augagcgugcugc

SEQ ID NO: 2030195 - RNA, 18 nt, Human herpesvirus 5
ccuggccuucggcacgcu

SEQ ID NO: 2030196 - RNA, 14 nt, Human herpesvirus 5
uagcuacuuuggaa

SEQ ID NO: 2030197 - RNA, 13 nt, Human herpesvirus 5
cuuuaagcugcuc

SEQ ID NO: 2030198 - RNA, 15 nt, Human herpesvirus 5
cggcgcuucgagggc

SEQ ID NO: 2030199 - RNA, 20 nt, Human herpesvirus 5
gcuguacgucacgccagacu

SEQ ID NO: 2030200 - RNA, 22 nt, Human herpesvirus 5
gcgccucacgcugcacgaccug

SEQ ID NO: 2030201 - RNA, 14 nt, Human herpesvirus 5
acgcgccgggcggc

SEQ ID NO: 2030202 - RNA, 19 nt, Human herpesvirus 5
gauguaccugcagcucgaa

SEQ ID NO: 2030203 - RNA, 22 nt, Human herpesvirus 5
agucuagacaggguaacagccu

SEQ ID NO: 2030204 - RNA, 16 nt, Human herpesvirus 5
cgaggaggaggggccg

SEQ ID NO: 2030205 - RNA, 15 nt, Human herpesvirus 5
ccucgucgugcccgu

SEQ ID NO: 2030206 - RNA, 13 nt, Human herpesvirus 5
ugagguacugcag

SEQ ID NO: 2030207 - RNA, 14 nt, Human herpesvirus 5
cacuuuacauaaaa

SEQ ID NO: 2030208 - RNA, 23 nt, Human herpesvirus 5
cgggcucguguggcagcuggcuu

SEQ ID NO: 2030209 - RNA, 17 nt, Human herpesvirus 5
ugcacagcgucuggcca

SEQ ID NO: 2030210 - RNA, 16 nt, Human herpesvirus 5
gcacgcaccuguguga

SEQ ID NO: 2030211 - RNA, 15 nt, Human herpesvirus 5
cgcaccggcagcaca

SEQ ID NO: 2030212 - RNA, 15 nt, Human herpesvirus 5
aucugcaagucccug

SEQ ID NO: 2030213 - RNA, 19 nt, Human herpesvirus 5
cacagcgucgccacauugg

SEQ ID NO: 2030214 - RNA, 15 nt, Human herpesvirus 5
cauggucggugacau

SEQ ID NO: 2030215 - RNA, 13 nt, Human herpesvirus 5
ccgccgccgcccg

SEQ ID NO: 2030216 - RNA, 21 nt, Human herpesvirus 5
guaccugaaaccuaccugggc

SEQ ID NO: 2030217 - RNA, 15 nt, Human herpesvirus 5
ccauggagcugcacu

SEQ ID NO: 2030218 - RNA, 16 nt, Human herpesvirus 5
ucuugcgcccucucgg

SEQ ID NO: 2030219 - RNA, 20 nt, Human herpesvirus 5
ugcuccucggagcacgggcg

SEQ ID NO: 2030220 - RNA, 16 nt, Human herpesvirus 5
gcuucuuuucuggggu

SEQ ID NO: 2030221 - RNA, 18 nt, Human herpesvirus 5
cuucccgaccucccacga

SEQ ID NO: 2030222 - RNA, 19 nt, Human herpesvirus 5
ugggcgguggucggcugcc

SEQ ID NO: 2030223 - RNA, 15 nt, Human herpesvirus 5
uugaucugcugaaac

SEQ ID NO: 2030224 - RNA, 19 nt, Human herpesvirus 5
cgagaacuaauauugcaau

SEQ ID NO: 2030225 - RNA, 18 nt, Human herpesvirus 5
gggucguuguccuccucg

SEQ ID NO: 2030226 - RNA, 22 nt, Human herpesvirus 5
ucaccaccaucagcaaagcucc

SEQ ID NO: 2030227 - RNA, 17 nt, Human herpesvirus 5
caucauaaacuuaugau

SEQ ID NO: 2030228 - RNA, 21 nt, Human herpesvirus 5
cagcagcucgcgcuggcuuuc

SEQ ID NO: 2030229 - RNA, 14 nt, Human herpesvirus 5
ccaugcaucccacc

SEQ ID NO: 2030230 - RNA, 20 nt, Human herpesvirus 5
gccugccgaagaccucacca

SEQ ID NO: 2030231 - RNA, 20 nt, Human herpesvirus 5
ggugcuucuucuaccuggcu

SEQ ID NO: 2030232 - RNA, 14 nt, Human herpesvirus 5
gcuccgacgcagga

SEQ ID NO: 2030233 - RNA, 14 nt, Human herpesvirus 5
cgagaaaacuaaaa

SEQ ID NO: 2030234 - RNA, 13 nt, Human herpesvirus 5
cugcgcaggccgc

SEQ ID NO: 2030235 - RNA, 14 nt, Human herpesvirus 5
caucacgcaaagca

SEQ ID NO: 2030236 - RNA, 13 nt, Human herpesvirus 5
uaccgccccaccg

SEQ ID NO: 2030237 - RNA, 22 nt, Human herpesvirus 5
ccacgccggccugagcgcgcuc

SEQ ID NO: 2030238 - RNA, 14 nt, Human herpesvirus 5
cguugguggaaacu

SEQ ID NO: 2030239 - RNA, 20 nt, Human herpesvirus 5
gcugccgccgcuguggcugc

SEQ ID NO: 2030240 - RNA, 19 nt, Human herpesvirus 5
gcuauugggucacagccgc

SEQ ID NO: 2030241 - RNA, 17 nt, Human herpesvirus 5
uugagcgccuucugcua

SEQ ID NO: 2030242 - RNA, 14 nt, Human herpesvirus 5
acggccuguggugc

SEQ ID NO: 2030243 - RNA, 21 nt, Human herpesvirus 5
uuuuccguguugccgacggcg

SEQ ID NO: 2030244 - RNA, 21 nt, Human herpesvirus 5
ccgcaccgguuggagcagcuc

SEQ ID NO: 2030245 - RNA, 14 nt, Human herpesvirus 5
cugacacagcuccu

SEQ ID NO: 2030246 - RNA, 14 nt, Human herpesvirus 5
ugccucuacuugga

SEQ ID NO: 2030247 - RNA, 13 nt, Human herpesvirus 5
cgcauccugccca

SEQ ID NO: 2030248 - RNA, 20 nt, Human herpesvirus 5
acgucggcgguccuccagca

SEQ ID NO: 2030249 - RNA, 23 nt, Human herpesvirus 5
guaccuuaacaugaugaagaugg

SEQ ID NO: 2030250 - RNA, 23 nt, Human herpesvirus 5
cagccggagcccgcacacuggcu

SEQ ID NO: 2030251 - RNA, 15 nt, Human herpesvirus 5
ccuagcacgucagug

SEQ ID NO: 2030252 - RNA, 16 nt, Human herpesvirus 5
gcuaagagcuuugacg

SEQ ID NO: 2030253 - RNA, 15 nt, Human herpesvirus 5
cacgcggaugagcgu

SEQ ID NO: 2030254 - RNA, 18 nt, Human herpesvirus 5
gucgaacuauaccgggcg

SEQ ID NO: 2030255 - RNA, 19 nt, Human herpesvirus 5
cgagcaccggcgccugcug

SEQ ID NO: 2030256 - RNA, 15 nt, Human herpesvirus 5
cagcugcgccuggac

SEQ ID NO: 2030257 - RNA, 19 nt, Human herpesvirus 5
cuacggaguuuucccucag

SEQ ID NO: 2030258 - RNA, 15 nt, Human herpesvirus 5
gccgugguggccgug

SEQ ID NO: 2030259 - RNA, 19 nt, Human herpesvirus 5
caugaguuggugcagcugc

SEQ ID NO: 2030260 - RNA, 19 nt, Human herpesvirus 5
gggcacucggcugugccug

SEQ ID NO: 2030261 - RNA, 17 nt, Human herpesvirus 5
aggcucuguggacccug

SEQ ID NO: 2030262 - RNA, 22 nt, Human herpesvirus 5
aguuuaucgagcgcgcucuuga

SEQ ID NO: 2030263 - RNA, 20 nt, Human herpesvirus 5
guacacagccaaggugcggg

SEQ ID NO: 2030264 - RNA, 23 nt, Human herpesvirus 5
agcauacggggaggagacacaga

SEQ ID NO: 2030265 - RNA, 17 nt, Human herpesvirus 5
cugggagguggcugggc

SEQ ID NO: 2030266 - RNA, 17 nt, Human herpesvirus 5
ugaauugcgaagccagc

SEQ ID NO: 2030267 - RNA, 14 nt, Human herpesvirus 5
ggcgaagcgggaag

SEQ ID NO: 2030268 - RNA, 23 nt, Human herpesvirus 5
uauaagcguggauggucauauau

SEQ ID NO: 2030269 - RNA, 16 nt, Human herpesvirus 5
aucauuacuaaacaaa

SEQ ID NO: 2030270 - RNA, 15 nt, Human herpesvirus 5
cauuccccaccuucc

SEQ ID NO: 2030271 - RNA, 22 nt, Human herpesvirus 5
cacggcgccggugacccgcccc

SEQ ID NO: 2030272 - RNA, 12 nt, Human herpesvirus 5
aacaacgucacu

SEQ ID NO: 2030273 - RNA, 22 nt, Human herpesvirus 5
cagcaaccaccguuucuacaaa

SEQ ID NO: 2030274 - RNA, 14 nt, Human herpesvirus 5
cuccugcagcugca

SEQ ID NO: 2030275 - RNA, 21 nt, Human herpesvirus 5
gacgggccugguauacgaggc

SEQ ID NO: 2030276 - RNA, 15 nt, Human herpesvirus 5
caccccccgggccac

SEQ ID NO: 2030277 - RNA, 13 nt, Human herpesvirus 5
ccucuacuuggac

SEQ ID NO: 2030278 - RNA, 21 nt, Human herpesvirus 5
uccagauacgcgcugguucug

SEQ ID NO: 2030279 - RNA, 21 nt, Human herpesvirus 5
cggccugggcgcccccacccc

SEQ ID NO: 2030280 - RNA, 17 nt, Human herpesvirus 5
aggagccaaacugcgag

SEQ ID NO: 2030281 - RNA, 16 nt, Human herpesvirus 5
acugacacagcuccug

SEQ ID NO: 2030282 - RNA, 21 nt, Human herpesvirus 5
aagguugggagaugcggggug

SEQ ID NO: 2030283 - RNA, 15 nt, Human herpesvirus 5
gugacgcuaggcggc

SEQ ID NO: 2030284 - RNA, 15 nt, Human herpesvirus 5
gacguggaggagacc

SEQ ID NO: 2030285 - RNA, 21 nt, Human herpesvirus 5
gaugaaaaacaucuuaagaaa

SEQ ID NO: 2030286 - RNA, 15 nt, Human herpesvirus 5
cgcuucggcacccca

SEQ ID NO: 2030287 - RNA, 19 nt, Human herpesvirus 5
uacggcccggcagcaccau

SEQ ID NO: 2030288 - RNA, 13 nt, Human herpesvirus 5
gcagcccccgugg

SEQ ID NO: 2030289 - RNA, 20 nt, Human herpesvirus 5
acgugcuuggacugguacau

SEQ ID NO: 2030290 - RNA, 20 nt, Human herpesvirus 5
gaccagcgccaccauagcca

SEQ ID NO: 2030291 - RNA, 17 nt, Human herpesvirus 5
uguccucgcaccgggcu

SEQ ID NO: 2030292 - RNA, 22 nt, Human herpesvirus 5
gcauacggggaggagacacaga

SEQ ID NO: 2030293 - RNA, 15 nt, Human herpesvirus 5
cugccgcgguacgca

SEQ ID NO: 2030294 - RNA, 21 nt, Human herpesvirus 5
ggcuacguagcgcgugucccu

SEQ ID NO: 2030295 - RNA, 18 nt, Human herpesvirus 5
gaagucucuuucucugcu

SEQ ID NO: 2030296 - RNA, 23 nt, Human herpesvirus 5
ucagcggcguguacagcuaccuc

SEQ ID NO: 2030297 - RNA, 20 nt, Human herpesvirus 5
auauuugaaaauauggcaua

SEQ ID NO: 2030298 - RNA, 15 nt, Human herpesvirus 5
cgaggccggcggcgg

SEQ ID NO: 2030299 - RNA, 14 nt, Human herpesvirus 5
acgugcgaccugga

SEQ ID NO: 2030300 - RNA, 13 nt, Human herpesvirus 5
ccucacacugacg

SEQ ID NO: 2030301 - RNA, 16 nt, Human herpesvirus 5
acugucggggcgcaga

SEQ ID NO: 2030302 - RNA, 18 nt, Human herpesvirus 5
ugucuaagagauccuggg

SEQ ID NO: 2030303 - RNA, 16 nt, Human herpesvirus 5
uagccuuucugaccuu

SEQ ID NO: 2030304 - RNA, 20 nt, Human herpesvirus 5
uaguggucuuucacaucgcc

SEQ ID NO: 2030305 - RNA, 17 nt, Human herpesvirus 5
uggucggugacaucacc

SEQ ID NO: 2030306 - RNA, 16 nt, Human herpesvirus 5
gcaagccgagcgggag

SEQ ID NO: 2030307 - RNA, 14 nt, Human herpesvirus 5
uuacugccugccgc

SEQ ID NO: 2030308 - RNA, 16 nt, Human herpesvirus 5
cguacgauacacccug

SEQ ID NO: 2030309 - RNA, 13 nt, Human herpesvirus 5
cgguccuccagca

SEQ ID NO: 2030310 - RNA, 23 nt, Human herpesvirus 5
gcuacagccacgaccaagugucu

SEQ ID NO: 2030311 - RNA, 11 nt, Human herpesvirus 5
agcgccgccgc

SEQ ID NO: 2030312 - RNA, 15 nt, Human herpesvirus 5
gucggccugggcugc

SEQ ID NO: 2030313 - RNA, 17 nt, Human herpesvirus 5
gucaggcgcugcucuca

SEQ ID NO: 2030314 - RNA, 15 nt, Human herpesvirus 5
gcggauaggcaccug

SEQ ID NO: 2030315 - RNA, 15 nt, Human herpesvirus 5
uucaugucuuacaaa

SEQ ID NO: 2030316 - RNA, 14 nt, Human herpesvirus 5
gaagcgguggagga

SEQ ID NO: 2030317 - RNA, 18 nt, Human herpesvirus 5
aagcgccgcggcagcacc

SEQ ID NO: 2030318 - RNA, 15 nt, Human herpesvirus 5
ggcugccuguuccug

SEQ ID NO: 2030319 - RNA, 16 nt, Human herpesvirus 5
aggagcugcugcucgg

SEQ ID NO: 2030320 - RNA, 17 nt, Human herpesvirus 5
cacgucaccgugcccca

SEQ ID NO: 2030321 - RNA, 18 nt, Human herpesvirus 5
auuaaaaagcuguaaggu

SEQ ID NO: 2030322 - RNA, 13 nt, Human herpesvirus 5
acgacgacgcgcc

SEQ ID NO: 2030323 - RNA, 17 nt, Human herpesvirus 5
uccugcugcgcaucuac

SEQ ID NO: 2030324 - RNA, 12 nt, Human herpesvirus 5
agacggccugga

SEQ ID NO: 2030325 - RNA, 21 nt, Human herpesvirus 5
agcagcaucuggcgcggucug

SEQ ID NO: 2030326 - RNA, 23 nt, Human herpesvirus 5
guuccagaccagcgccaccauag

SEQ ID NO: 2030327 - RNA, 17 nt, Human herpesvirus 5
gccaccaugcaucccac

SEQ ID NO: 2030328 - RNA, 17 nt, Human herpesvirus 5
ccggaggacgacagcuc

SEQ ID NO: 2030329 - RNA, 16 nt, Human herpesvirus 5
cagcagcagcuggugc

SEQ ID NO: 2030330 - RNA, 11 nt, Human herpesvirus 5
acguggccugg

SEQ ID NO: 2030331 - RNA, 18 nt, Human herpesvirus 5
cuuugagcacaaacugcg

SEQ ID NO: 2030332 - RNA, 18 nt, Human herpesvirus 5
ggagaaaaguggcagaua

SEQ ID NO: 2030333 - RNA, 17 nt, Human herpesvirus 5
ccagcccuauccuccau

SEQ ID NO: 2030334 - RNA, 20 nt, Human herpesvirus 5
aaacgguacgcagucacugc

SEQ ID NO: 2030335 - RNA, 14 nt, Human herpesvirus 5
uggcagcuggcuug

SEQ ID NO: 2030336 - RNA, 16 nt, Human herpesvirus 5
ccgcagcugcuggagc

SEQ ID NO: 2030337 - RNA, 17 nt, Human herpesvirus 5
cggaagaagaagaacaa

SEQ ID NO: 2030338 - RNA, 14 nt, Human herpesvirus 5
uguucucccaggac

SEQ ID NO: 2030339 - RNA, 15 nt, Human herpesvirus 5
ugucgagcugguuaa

SEQ ID NO: 2030340 - RNA, 13 nt, Human herpesvirus 5
uggcucagcuuga

SEQ ID NO: 2030341 - RNA, 21 nt, Human herpesvirus 5
uguucuuacaguuuucaugua

SEQ ID NO: 2030342 - RNA, 21 nt, Human herpesvirus 5
ccaccgagacgugcgaccugg

SEQ ID NO: 2030343 - RNA, 20 nt, Human herpesvirus 5
aaccacgaguaacaccguca

SEQ ID NO: 2030344 - RNA, 13 nt, Human herpesvirus 5
ugcuccaacuuug

SEQ ID NO: 2030345 - RNA, 13 nt, Human herpesvirus 5
caggccagcugcc

SEQ ID NO: 2030346 - RNA, 21 nt, Human herpesvirus 5
gcucccugcuccgcaagcgcc

SEQ ID NO: 2030347 - RNA, 24 nt, Human herpesvirus 5
uacauugcccuucuggagcacacu

SEQ ID NO: 2030348 - RNA, 23 nt, Human herpesvirus 5
cgucgccacauuggugaaggccg

SEQ ID NO: 2030349 - RNA, 20 nt, Human herpesvirus 5
aagaaacccucaaaacauca

SEQ ID NO: 2030350 - RNA, 14 nt, Human herpesvirus 5
gacaccucaauguu

SEQ ID NO: 2030351 - RNA, 17 nt, Human herpesvirus 5
guuauguccgcucgugu

SEQ ID NO: 2030352 - RNA, 20 nt, Human herpesvirus 5
gcuacgcgaccagcugcugg

SEQ ID NO: 2030353 - RNA, 16 nt, Human herpesvirus 5
uguggcuguuguugac

SEQ ID NO: 2030354 - RNA, 15 nt, Human herpesvirus 5
ccuugagcgacagca

SEQ ID NO: 2030355 - RNA, 13 nt, Human herpesvirus 5
auuuuugggcaua

SEQ ID NO: 2030356 - RNA, 17 nt, Human herpesvirus 5
cccgaccacgacacggu

SEQ ID NO: 2030357 - RNA, 14 nt, Human herpesvirus 5
gggagucaacacua

SEQ ID NO: 2030358 - RNA, 18 nt, Human herpesvirus 5
ucguacgacgucugcuca

SEQ ID NO: 2030359 - RNA, 15 nt, Human herpesvirus 5
gccgugcugggcugg

SEQ ID NO: 2030360 - RNA, 16 nt, Human herpesvirus 5
agcguauccuggucaa

SEQ ID NO: 2030361 - RNA, 14 nt, Human herpesvirus 5
acaaguauuuauga

SEQ ID NO: 2030362 - RNA, 19 nt, Human herpesvirus 5
cgccgccaacgcgagcugg

SEQ ID NO: 2030363 - RNA, 19 nt, Human herpesvirus 5
agccaccgacacagcagca

SEQ ID NO: 2030364 - RNA, 23 nt, Human herpesvirus 5
cgagcaucgcaacaacagcaaca

SEQ ID NO: 2030365 - RNA, 20 nt, Human herpesvirus 5
ugugcuuuuuaucagggaga

SEQ ID NO: 2030366 - RNA, 16 nt, Human herpesvirus 5
ucagucuauucucaac

SEQ ID NO: 2030367 - RNA, 11 nt, Human herpesvirus 5
uccagccagca

SEQ ID NO: 2030368 - RNA, 15 nt, Human herpesvirus 5
ccugagaacaugugg

SEQ ID NO: 2030369 - RNA, 19 nt, Human herpesvirus 5
gucaauaaagaaaaccaca

SEQ ID NO: 2030370 - RNA, 13 nt, Human herpesvirus 5
ccaccgacacagc

SEQ ID NO: 2030371 - RNA, 21 nt, Human herpesvirus 5
cguuagagaaagagcagcgcg

SEQ ID NO: 2030372 - RNA, 20 nt, Human herpesvirus 5
cugggcgaccgucucuacca

SEQ ID NO: 2030373 - RNA, 21 nt, Human herpesvirus 5
ucacggcggcguguguuuuau

SEQ ID NO: 2030374 - RNA, 18 nt, Human herpesvirus 5
acaaccuguggaauaccc

SEQ ID NO: 2030375 - RNA, 15 nt, Human herpesvirus 5
gcgagcuggccagca

SEQ ID NO: 2030376 - RNA, 22 nt, Human herpesvirus 5
cgcggucgccgcgucagcggcc

SEQ ID NO: 2030377 - RNA, 22 nt, Human herpesvirus 5
uggcugcgccuccucgucggcc

SEQ ID NO: 2030378 - RNA, 23 nt, Human herpesvirus 5
cugccggucuacagacugggcga

SEQ ID NO: 2030379 - RNA, 15 nt, Human herpesvirus 5
ugcggcugugucggg

SEQ ID NO: 2030380 - RNA, 18 nt, Human herpesvirus 5
cuccaccgagacgcucac

SEQ ID NO: 2030381 - RNA, 22 nt, Human herpesvirus 5
cacacguguggaagacauggcg

SEQ ID NO: 2030382 - RNA, 14 nt, Human herpesvirus 5
uguugaucugcuga

SEQ ID NO: 2030383 - RNA, 12 nt, Human herpesvirus 5
gcggugucuccu

SEQ ID NO: 2030384 - RNA, 15 nt, Human herpesvirus 5
guccccuucugugga

SEQ ID NO: 2030385 - RNA, 21 nt, Human herpesvirus 5
cggcagauuuguucgggguga

SEQ ID NO: 2030386 - RNA, 14 nt, Human herpesvirus 5
cggcgccccacagc

SEQ ID NO: 2030387 - RNA, 15 nt, Human herpesvirus 5
gauacuaguaaaagg

SEQ ID NO: 2030388 - RNA, 16 nt, Human herpesvirus 5
cccacgguggccaaca

SEQ ID NO: 2030389 - RNA, 14 nt, Human herpesvirus 5
ggaacauguccugg

SEQ ID NO: 2030390 - RNA, 16 nt, Human herpesvirus 5
accgcaacaacagcag

SEQ ID NO: 2030391 - RNA, 17 nt, Human herpesvirus 5
uguggcaaguuggccac

SEQ ID NO: 2030392 - RNA, 18 nt, Human herpesvirus 5
ucaugaguuggugcagcu

SEQ ID NO: 2030393 - RNA, 20 nt, Human herpesvirus 5
gcgacggcggguggagauga

SEQ ID NO: 2030394 - RNA, 18 nt, Human herpesvirus 5
gcuggaggcccuggugga

SEQ ID NO: 2030395 - RNA, 17 nt, Human herpesvirus 5
cgguguuucggcucccg

SEQ ID NO: 2030396 - RNA, 20 nt, Human herpesvirus 5
gcaacaacagucgcagcccc

SEQ ID NO: 2030397 - RNA, 18 nt, Human herpesvirus 5
aggugggguggcucuugc

SEQ ID NO: 2030398 - RNA, 21 nt, Human herpesvirus 5
cucuggaugguacgucucuac

SEQ ID NO: 2030399 - RNA, 14 nt, Human herpesvirus 5
ccgugccagcuggc

SEQ ID NO: 2030400 - RNA, 19 nt, Human herpesvirus 5
cacgucgauucccaucuca

SEQ ID NO: 2030401 - RNA, 16 nt, Human herpesvirus 5
ugccuguuccugcugc

SEQ ID NO: 2030402 - RNA, 13 nt, Human herpesvirus 5
uaugagggccugc

SEQ ID NO: 2030403 - RNA, 17 nt, Human herpesvirus 5
ggucugcuugcuggcuu

SEQ ID NO: 2030404 - RNA, 17 nt, Human herpesvirus 5
cgugugacguggauacu

SEQ ID NO: 2030405 - RNA, 18 nt, Human herpesvirus 5
ccacgguacgccaguagc

SEQ ID NO: 2030406 - RNA, 20 nt, Human herpesvirus 5
ggaggagugucagacacagc

SEQ ID NO: 2030407 - RNA, 14 nt, Human herpesvirus 5
uggaugagggcucu

SEQ ID NO: 2030408 - RNA, 18 nt, Human herpesvirus 5
agacauggcgacuuuccg

SEQ ID NO: 2030409 - RNA, 16 nt, Human herpesvirus 5
augaaucuuccccucu

SEQ ID NO: 2030410 - RNA, 13 nt, Human herpesvirus 5
aagcuugguacac

SEQ ID NO: 2030411 - RNA, 18 nt, Human herpesvirus 5
cagcagcaacagcagcca

SEQ ID NO: 2030412 - RNA, 14 nt, Human herpesvirus 5
gcaucaugugccuc

SEQ ID NO: 2030413 - RNA, 18 nt, Human herpesvirus 5
uucgcgauccgcucacca

SEQ ID NO: 2030414 - RNA, 20 nt, Human herpesvirus 5
cuagccuuucugaccuugcu

SEQ ID NO: 2030415 - RNA, 22 nt, Human herpesvirus 5
ggccauaagaaagagaaacccc

SEQ ID NO: 2030416 - RNA, 14 nt, Human herpesvirus 5
ccacgcugcuucac

SEQ ID NO: 2030417 - RNA, 15 nt, Human herpesvirus 5
cgcacauauguagca

SEQ ID NO: 2030418 - RNA, 13 nt, Human herpesvirus 5
uagcgggcuguca

SEQ ID NO: 2030419 - RNA, 14 nt, Human herpesvirus 5
ugguggcucaugcc

SEQ ID NO: 2030420 - RNA, 15 nt, Human herpesvirus 5
ccguuagccugguca

SEQ ID NO: 2030421 - RNA, 16 nt, Human herpesvirus 5
ugacggggcugggugg

SEQ ID NO: 2030422 - RNA, 14 nt, Human herpesvirus 5
ucuccgagcccccg

SEQ ID NO: 2030423 - RNA, 22 nt, Human herpesvirus 5
guaccugaaaccuaccugggcu

SEQ ID NO: 2030424 - RNA, 15 nt, Human herpesvirus 5
gggcucgugcguguc

SEQ ID NO: 2030425 - RNA, 14 nt, Human herpesvirus 5
aaaaagcucccaug

SEQ ID NO: 2030426 - RNA, 15 nt, Human herpesvirus 5
ccucuaucugcgcca

SEQ ID NO: 2030427 - RNA, 21 nt, Human herpesvirus 5
gcucguguggcagcuggcuug

SEQ ID NO: 2030428 - RNA, 13 nt, Human herpesvirus 5
guguccucggugc

SEQ ID NO: 2030429 - RNA, 18 nt, Human herpesvirus 5
accgccgccgagaaaguc

SEQ ID NO: 2030430 - RNA, 17 nt, Human herpesvirus 5
caauguuacacauuacu

SEQ ID NO: 2030431 - RNA, 20 nt, Human herpesvirus 5
auagguguggcgaaagccuc

SEQ ID NO: 2030432 - RNA, 23 nt, Human herpesvirus 5
cuggguaucaaccccgcggcuga

SEQ ID NO: 2030433 - RNA, 21 nt, Human herpesvirus 5
cccguggaucagccgccgccu

SEQ ID NO: 2030434 - RNA, 18 nt, Human herpesvirus 5
uucggccggcugcugcac

SEQ ID NO: 2030435 - RNA, 23 nt, Human herpesvirus 5
gcggaagauaccgucggcgccgc

SEQ ID NO: 2030436 - RNA, 13 nt, Human herpesvirus 5
acgaaaggcaccg

SEQ ID NO: 2030437 - RNA, 14 nt, Human herpesvirus 5
guguaggcgacugg

SEQ ID NO: 2030438 - RNA, 20 nt, Human herpesvirus 5
gccuugcgcucccugcuccg

SEQ ID NO: 2030439 - RNA, 20 nt, Human herpesvirus 5
gucaaggccgccucuucugg

SEQ ID NO: 2030440 - RNA, 13 nt, Human herpesvirus 5
ccccaccuucccu

SEQ ID NO: 2030441 - RNA, 15 nt, Human herpesvirus 5
cuaaagcucgccaac

SEQ ID NO: 2030442 - RNA, 15 nt, Human herpesvirus 5
ucgggcccgccacug

SEQ ID NO: 2030443 - RNA, 16 nt, Human herpesvirus 5
cauggggagaaaagag

SEQ ID NO: 2030444 - RNA, 18 nt, Human herpesvirus 5
ugcacuuccuguacacau

SEQ ID NO: 2030445 - RNA, 15 nt, Human herpesvirus 5
ucggaagcuguuuug

SEQ ID NO: 2030446 - RNA, 19 nt, Human herpesvirus 5
gcgguucgcugacgaugag

SEQ ID NO: 2030447 - RNA, 13 nt, Human herpesvirus 5
cgcgaccuucccu

SEQ ID NO: 2030448 - RNA, 18 nt, Human herpesvirus 5
gguuauggauaugaggaa

SEQ ID NO: 2030449 - RNA, 19 nt, Human herpesvirus 5
ccacgcucgagggcuccgu

SEQ ID NO: 2030450 - RNA, 15 nt, Human herpesvirus 5
gacggcuccaagaaa

SEQ ID NO: 2030451 - RNA, 15 nt, Human herpesvirus 5
cuacguacgauacac

SEQ ID NO: 2030452 - RNA, 17 nt, Human herpesvirus 5
agccaggugaccagcag

SEQ ID NO: 2030453 - RNA, 15 nt, Human herpesvirus 5
ucuugacuggccgga

SEQ ID NO: 2030454 - RNA, 17 nt, Human herpesvirus 5
cacaaccguauauucua

SEQ ID NO: 2030455 - RNA, 15 nt, Human herpesvirus 5
aaccagauacaacgu

SEQ ID NO: 2030456 - RNA, 14 nt, Human herpesvirus 5
ccgaggcggaggag

SEQ ID NO: 2030457 - RNA, 20 nt, Human herpesvirus 5
ccucuacaaacuagcauucu

SEQ ID NO: 2030458 - RNA, 15 nt, Human herpesvirus 5
ggagagccgcacaga

SEQ ID NO: 2030459 - RNA, 16 nt, Human herpesvirus 5
aucgaggaggccgcac

SEQ ID NO: 2030460 - RNA, 16 nt, Human herpesvirus 5
acgacgcgccccccac

SEQ ID NO: 2030461 - RNA, 14 nt, Human herpesvirus 5
uccugguuuuucau

SEQ ID NO: 2030462 - RNA, 15 nt, Human herpesvirus 5
ccgcaguuacaccac

SEQ ID NO: 2030463 - RNA, 12 nt, Human herpesvirus 5
ugcgcugcagcc

SEQ ID NO: 2030464 - RNA, 22 nt, Human herpesvirus 5
ugcccgaccacgacacggugcu

SEQ ID NO: 2030465 - RNA, 11 nt, Human herpesvirus 5
guuuucuaguu

SEQ ID NO: 2030466 - RNA, 13 nt, Human herpesvirus 5
acaugaggaagcg

SEQ ID NO: 2030467 - RNA, 15 nt, Human herpesvirus 5
gaccgcaacgugcug

SEQ ID NO: 2030468 - RNA, 22 nt, Human herpesvirus 5
ggagcuacgcgaccagcugcug

SEQ ID NO: 2030469 - RNA, 20 nt, Human herpesvirus 5
cugucuaacuagccuucccg

SEQ ID NO: 2030470 - RNA, 21 nt, Human herpesvirus 5
cugggagagccgcacagacca

SEQ ID NO: 2030471 - RNA, 13 nt, Human herpesvirus 5
acagcagcaacag

SEQ ID NO: 2030472 - RNA, 15 nt, Human herpesvirus 5
gucgcuauacaccaa

SEQ ID NO: 2030473 - RNA, 13 nt, Human herpesvirus 5
ucgcggacgaaag

SEQ ID NO: 2030474 - RNA, 22 nt, Human herpesvirus 5
cuacauauuuuccauaaaucua

SEQ ID NO: 2030475 - RNA, 17 nt, Human herpesvirus 5
gccucuacacuuggugc

SEQ ID NO: 2030476 - RNA, 13 nt, Human herpesvirus 5
ccccucgcugggc

SEQ ID NO: 2030477 - RNA, 17 nt, Human herpesvirus 5
acgacgacgcgcccccc

SEQ ID NO: 2030478 - RNA, 18 nt, Human herpesvirus 5
agugccgcgccgccugga

SEQ ID NO: 2030479 - RNA, 19 nt, Human herpesvirus 5
cccucagcgugcucagcug

SEQ ID NO: 2030480 - RNA, 14 nt, Human herpesvirus 5
cugccugccgcacg

SEQ ID NO: 2030481 - RNA, 16 nt, Human herpesvirus 5
acgaucgcuggugucu

SEQ ID NO: 2030482 - RNA, 17 nt, Human herpesvirus 5
acaucccaagcacgcca

SEQ ID NO: 2030483 - RNA, 18 nt, Human herpesvirus 5
cgcagcagagccaccagg

SEQ ID NO: 2030484 - RNA, 12 nt, Human herpesvirus 5
ugacacagcucc

SEQ ID NO: 2030485 - RNA, 14 nt, Human herpesvirus 5
ucagccgccgccuc

SEQ ID NO: 2030486 - RNA, 17 nt, Human herpesvirus 5
agcuuucuugacuggcc

SEQ ID NO: 2030487 - RNA, 16 nt, Human herpesvirus 5
agagccaccaggugcc

SEQ ID NO: 2030488 - RNA, 22 nt, Human herpesvirus 5
gccgcacgcgcuagccuuucug

SEQ ID NO: 2030489 - RNA, 18 nt, Human herpesvirus 5
gaagacuuugauguaguu

SEQ ID NO: 2030490 - RNA, 11 nt, Human herpesvirus 5
cggcugcugca

SEQ ID NO: 2030491 - RNA, 22 nt, Human herpesvirus 5
cucgcucacgucguugggaaug

SEQ ID NO: 2030492 - RNA, 19 nt, Human herpesvirus 5
ggcuucccuccugcagcug

SEQ ID NO: 2030493 - RNA, 19 nt, Human herpesvirus 5
ccgcggugcaggccgcgca

SEQ ID NO: 2030494 - RNA, 22 nt, Human herpesvirus 5
gugcgcggcgacaagcuguggc

SEQ ID NO: 2030495 - RNA, 16 nt, Human herpesvirus 5
agcgacguaccagcug

SEQ ID NO: 2030496 - RNA, 19 nt, Human herpesvirus 5
uuagccccacaugcugcuu

SEQ ID NO: 2030497 - RNA, 21 nt, Human herpesvirus 5
gcgcagugcgccgagcggccg

SEQ ID NO: 2030498 - RNA, 17 nt, Human herpesvirus 5
ccuagcgaucgcaugcu

SEQ ID NO: 2030499 - RNA, 14 nt, Human herpesvirus 5
guaaccuggagcag

SEQ ID NO: 2030500 - RNA, 17 nt, Human herpesvirus 5
ggccaccaagaaacacc

SEQ ID NO: 2030501 - RNA, 14 nt, Human herpesvirus 5
gcugccuguuccug

SEQ ID NO: 2030502 - RNA, 14 nt, Human herpesvirus 5
gcugcaagguacgg

SEQ ID NO: 2030503 - RNA, 14 nt, Human herpesvirus 5
cuagacgaaauuca

SEQ ID NO: 2030504 - RNA, 15 nt, Human herpesvirus 5
auagaaagucacagg

SEQ ID NO: 2030505 - RNA, 16 nt, Human herpesvirus 5
ucacaccuaucauaaa

SEQ ID NO: 2030506 - RNA, 20 nt, Human herpesvirus 5
gaugguacuauaugcgugag

SEQ ID NO: 2030507 - RNA, 18 nt, Human herpesvirus 5
ggcggccguugccggcaa

SEQ ID NO: 2030508 - RNA, 22 nt, Human herpesvirus 5
gaaagugauuauaucuuucuac

SEQ ID NO: 2030509 - RNA, 13 nt, Human herpesvirus 5
caugugcagcugg

SEQ ID NO: 2030510 - RNA, 16 nt, Human herpesvirus 5
gucuccgaacucagag

SEQ ID NO: 2030511 - RNA, 13 nt, Human herpesvirus 5
gccaccacuacca

SEQ ID NO: 2030512 - RNA, 18 nt, Human herpesvirus 5
acacggagcacgggcugc

SEQ ID NO: 2030513 - RNA, 22 nt, Human herpesvirus 5
uaccaauaaagauaaucugcca

SEQ ID NO: 2030514 - RNA, 21 nt, Human herpesvirus 5
gcagcacgcgauuggccagca

SEQ ID NO: 2030515 - RNA, 21 nt, Human herpesvirus 5
gacucaccagacuuuuugcuu

SEQ ID NO: 2030516 - RNA, 11 nt, Human herpesvirus 5
cuaaugugcug

SEQ ID NO: 2030517 - RNA, 19 nt, Human herpesvirus 5
ugggcgggcucugggaagc

SEQ ID NO: 2030518 - RNA, 18 nt, Human herpesvirus 5
gcagcgaguugcugugca

SEQ ID NO: 2030519 - RNA, 18 nt, Human herpesvirus 5
uuggccgaccugugcgug

SEQ ID NO: 2030520 - RNA, 16 nt, Human herpesvirus 5
ugcacgagugggccag

SEQ ID NO: 2030521 - RNA, 14 nt, Human herpesvirus 5
cugcacgcucuguc

SEQ ID NO: 2030522 - RNA, 20 nt, Human herpesvirus 5
ggccgucugcacgccccgga

SEQ ID NO: 2030523 - RNA, 16 nt, Human herpesvirus 5
gucgucgccggaagga

SEQ ID NO: 2030524 - RNA, 14 nt, Human herpesvirus 5
uaccuggaggagau

SEQ ID NO: 2030525 - RNA, 17 nt, Human herpesvirus 5
agcuucggccggcugcu

SEQ ID NO: 2030526 - RNA, 22 nt, Human herpesvirus 5
accauuuccaugugcagcuggu

SEQ ID NO: 2030527 - RNA, 17 nt, Human herpesvirus 5
caacuucuaccaucucc

SEQ ID NO: 2030528 - RNA, 15 nt, Human herpesvirus 5
gaacccaucgaggag

SEQ ID NO: 2030529 - RNA, 14 nt, Human herpesvirus 5
cuacgacaacaucc

SEQ ID NO: 2030530 - RNA, 16 nt, Human herpesvirus 5
gucacggugccaugga

SEQ ID NO: 2030531 - RNA, 17 nt, Human herpesvirus 5
gaaugccucuacuugga

SEQ ID NO: 2030532 - RNA, 12 nt, Human herpesvirus 5
uacuauguguau

SEQ ID NO: 2030533 - RNA, 16 nt, Human herpesvirus 5
ggaguuuguguaaugc

SEQ ID NO: 2030534 - RNA, 15 nt, Human herpesvirus 5
cccaguagacagaca

SEQ ID NO: 2030535 - RNA, 14 nt, Human herpesvirus 5
caugccggcagaac

SEQ ID NO: 2030536 - RNA, 17 nt, Human herpesvirus 5
ggucggcaagagccgga

SEQ ID NO: 2030537 - RNA, 19 nt, Human herpesvirus 5
ucguccgccuccacuuccg

SEQ ID NO: 2030538 - RNA, 15 nt, Human herpesvirus 5
aauaauauacacacg

SEQ ID NO: 2030539 - RNA, 13 nt, Human herpesvirus 5
aguggaagggugc

SEQ ID NO: 2030540 - RNA, 18 nt, Human herpesvirus 5
guuacaaaagauagagaa

SEQ ID NO: 2030541 - RNA, 16 nt, Human herpesvirus 5
gcaacggcaucauguu

SEQ ID NO: 2030542 - RNA, 19 nt, Human herpesvirus 5
ggcucgaccggcggcugcu

SEQ ID NO: 2030543 - RNA, 19 nt, Human herpesvirus 5
cugcucaaaguacuugucg

SEQ ID NO: 2030544 - RNA, 20 nt, Human herpesvirus 5
acgugcuuuuggugcgccac

SEQ ID NO: 2030545 - RNA, 21 nt, Human herpesvirus 5
ggcgaugacgaguaggcgcgc

SEQ ID NO: 2030546 - RNA, 13 nt, Human herpesvirus 5
cgcgguagagcuc

SEQ ID NO: 2030547 - RNA, 23 nt, Human herpesvirus 5
ugcuggccgccgcugcacggcau

SEQ ID NO: 2030548 - RNA, 20 nt, Human herpesvirus 5
ugaacaccuuuuugcugcac

SEQ ID NO: 2030549 - RNA, 18 nt, Human herpesvirus 5
agcuagugcagccuuagg

SEQ ID NO: 2030550 - RNA, 22 nt, Human herpesvirus 5
gugaugguacuauaugcgugag

SEQ ID NO: 2030551 - RNA, 19 nt, Human herpesvirus 5
gccuuccuccucugccugg

SEQ ID NO: 2030552 - RNA, 17 nt, Human herpesvirus 5
gugguggccgugcuggg

SEQ ID NO: 2030553 - RNA, 16 nt, Human herpesvirus 5
uuauucccgucaguga

SEQ ID NO: 2030554 - RNA, 11 nt, Human herpesvirus 5
ccuccgcggcc

SEQ ID NO: 2030555 - RNA, 20 nt, Human herpesvirus 5
caauaaagacgucaaugaca

SEQ ID NO: 2030556 - RNA, 15 nt, Human herpesvirus 5
cuuaacaugaugaag

SEQ ID NO: 2030557 - RNA, 17 nt, Human herpesvirus 5
cauggccaaugcauauc

SEQ ID NO: 2030558 - RNA, 21 nt, Human herpesvirus 5
ggaaggcggcucgcuggaagc

SEQ ID NO: 2030559 - RNA, 20 nt, Human herpesvirus 5
acgggccugguauacgaggc

SEQ ID NO: 2030560 - RNA, 23 nt, Human herpesvirus 5
cugugguguugccuucugcugcc

SEQ ID NO: 2030561 - RNA, 16 nt, Human herpesvirus 5
acuacguugggucugc

SEQ ID NO: 2030562 - RNA, 13 nt, Human herpesvirus 5
aggcggaggagag

SEQ ID NO: 2030563 - RNA, 22 nt, Human herpesvirus 5
uuucugucgccgacuaaauuca

SEQ ID NO: 2030564 - RNA, 23 nt, Human herpesvirus 5
auguuuuuauauaauacacgugg

SEQ ID NO: 2030565 - RNA, 19 nt, Human herpesvirus 5
cagacccgauacagucagc

SEQ ID NO: 2030566 - RNA, 23 nt, Human herpesvirus 5
cggcuccaagugcaagcgccgcg

SEQ ID NO: 2030567 - RNA, 18 nt, Human herpesvirus 5
cuccgaacucagaggcca

SEQ ID NO: 2030568 - RNA, 16 nt, Human herpesvirus 5
uaagagauccugggac

SEQ ID NO: 2030569 - RNA, 16 nt, Human herpesvirus 5
gucaaaagccugggua

SEQ ID NO: 2030570 - RNA, 20 nt, Human herpesvirus 5
caccgucaccacucccacca

SEQ ID NO: 2030571 - RNA, 19 nt, Human herpesvirus 5
ucucugcaacgccuggcgu

SEQ ID NO: 2030572 - RNA, 15 nt, Human herpesvirus 5
uacacgccuugcacc

SEQ ID NO: 2030573 - RNA, 13 nt, Human herpesvirus 5
acuugaguaccaa

SEQ ID NO: 2030574 - RNA, 23 nt, Human herpesvirus 5
gccaccaggugccggcgacugac

SEQ ID NO: 2030575 - RNA, 15 nt, Human herpesvirus 5
caggagguguugagu

SEQ ID NO: 2030576 - RNA, 17 nt, Human herpesvirus 5
acccccguacugccugg

SEQ ID NO: 2030577 - RNA, 21 nt, Human herpesvirus 5
cucaccccgcgcgacguagaa

SEQ ID NO: 2030578 - RNA, 18 nt, Human herpesvirus 5
caguggcagcaggaccug

SEQ ID NO: 2030579 - RNA, 13 nt, Human herpesvirus 5
agaccuacagcac

SEQ ID NO: 2030580 - RNA, 14 nt, Human herpesvirus 5
accuggguagcaag

SEQ ID NO: 2030581 - RNA, 13 nt, Human herpesvirus 5
agguugcgccgca

SEQ ID NO: 2030582 - RNA, 22 nt, Human herpesvirus 5
ccccggacgggcaggacgucaa

SEQ ID NO: 2030583 - RNA, 22 nt, Human herpesvirus 5
cucgagcuuauugagcgcagcc

SEQ ID NO: 2030584 - RNA, 21 nt, Human herpesvirus 5
ccguguauaacuaacgugucc

SEQ ID NO: 2030585 - RNA, 13 nt, Human herpesvirus 5
ggcgacccgcagu

SEQ ID NO: 2030586 - RNA, 18 nt, Human herpesvirus 5
uaacaccaaaaauccaga

SEQ ID NO: 2030587 - RNA, 19 nt, Human herpesvirus 5
cagacgaugaaccuucccc

SEQ ID NO: 2030588 - RNA, 14 nt, Human herpesvirus 5
ccucuagagacaga

SEQ ID NO: 2030589 - RNA, 22 nt, Human herpesvirus 5
gcccguuguguaugcaugucgc

SEQ ID NO: 2030590 - RNA, 18 nt, Human herpesvirus 5
cucuugcgcuucugcagc

SEQ ID NO: 2030591 - RNA, 14 nt, Human herpesvirus 5
gagcacgggcugcu

SEQ ID NO: 2030592 - RNA, 15 nt, Human herpesvirus 5
caccacgcagcaggc

SEQ ID NO: 2030593 - RNA, 19 nt, Human herpesvirus 5
uacaaguauguggaacagc

SEQ ID NO: 2030594 - RNA, 16 nt, Human herpesvirus 5
ucgccgucacugccac

SEQ ID NO: 2030595 - RNA, 19 nt, Human herpesvirus 5
ccucccgguauucggaaac

SEQ ID NO: 2030596 - RNA, 15 nt, Human herpesvirus 5
gaguggcugcugugu

SEQ ID NO: 2030597 - RNA, 17 nt, Human herpesvirus 5
ccacgccaccgccgcca

SEQ ID NO: 2030598 - RNA, 23 nt, Human herpesvirus 5
cucgaugcgccuccgguggugcg

SEQ ID NO: 2030599 - RNA, 15 nt, Human herpesvirus 5
uggggcugcugcugc

SEQ ID NO: 2030600 - RNA, 12 nt, Human herpesvirus 5
ggggcugcucaa

SEQ ID NO: 2030601 - RNA, 23 nt, Human herpesvirus 5
ggagcuaauagauuaaugugucg

SEQ ID NO: 2030602 - RNA, 17 nt, Human herpesvirus 5
guaagcggcagcauggg

SEQ ID NO: 2030603 - RNA, 13 nt, Human herpesvirus 5
ccgccgcaacagc

SEQ ID NO: 2030604 - RNA, 20 nt, Human herpesvirus 5
cggccagcgugacgcggugc

SEQ ID NO: 2030605 - RNA, 16 nt, Human herpesvirus 5
ggcuugucauggucug

SEQ ID NO: 2030606 - RNA, 20 nt, Human herpesvirus 5
gccgcgaggugucauguucg

SEQ ID NO: 2030607 - RNA, 20 nt, Human herpesvirus 5
ggcagcgguacccgacgcgg

SEQ ID NO: 2030608 - RNA, 13 nt, Human herpesvirus 5
cgacagcugcaau

SEQ ID NO: 2030609 - RNA, 14 nt, Human herpesvirus 5
aguacuuucacaac

SEQ ID NO: 2030610 - RNA, 15 nt, Human herpesvirus 5
auugcuuagcugcac

SEQ ID NO: 2030611 - RNA, 14 nt, Human herpesvirus 5
ucccuacagcgacu

SEQ ID NO: 2030612 - RNA, 21 nt, Human herpesvirus 5
accguuguccccgcaaacucc

SEQ ID NO: 2030613 - RNA, 13 nt, Human herpesvirus 5
aucgucucaauaa

SEQ ID NO: 2030614 - RNA, 22 nt, Human herpesvirus 5
gggcgacacucaguacuuuggg

SEQ ID NO: 2030615 - RNA, 16 nt, Human herpesvirus 5
gccugguauacgaggc

SEQ ID NO: 2030616 - RNA, 14 nt, Human herpesvirus 5
ggacgugguaacga

SEQ ID NO: 2030617 - RNA, 19 nt, Human herpesvirus 5
aagccgacaaccugcugca

SEQ ID NO: 2030618 - RNA, 13 nt, Human herpesvirus 5
gucaaagcucacu

SEQ ID NO: 2030619 - RNA, 13 nt, Human herpesvirus 5
cggagcagagggu

SEQ ID NO: 2030620 - RNA, 20 nt, Human herpesvirus 5
uauuaauuuaacaagucacu

SEQ ID NO: 2030621 - RNA, 18 nt, Human herpesvirus 5
gcacgccaaaccgcgucc

SEQ ID NO: 2030622 - RNA, 20 nt, Human herpesvirus 5
auuuuuucggccgcggaggu

SEQ ID NO: 2030623 - RNA, 13 nt, Human herpesvirus 5
gucacugccaccg

SEQ ID NO: 2030624 - RNA, 15 nt, Human herpesvirus 5
gccgcggugcaggcc

SEQ ID NO: 2030625 - RNA, 19 nt, Human herpesvirus 5
ccgucgcggacgaaagugg

SEQ ID NO: 2030626 - RNA, 15 nt, Human herpesvirus 5
cuauaagacagccuu

SEQ ID NO: 2030627 - RNA, 17 nt, Human herpesvirus 5
gcagcggggagaaaagu

SEQ ID NO: 2030628 - RNA, 18 nt, Human herpesvirus 5
cgacggcuccaagaaaaa

SEQ ID NO: 2030629 - RNA, 16 nt, Human herpesvirus 5
aacgccacgucggagc

SEQ ID NO: 2030630 - RNA, 18 nt, Human herpesvirus 5
gugcucucuauaaaacuu

SEQ ID NO: 2030631 - RNA, 15 nt, Human herpesvirus 5
gacgcuuaucgggcg

SEQ ID NO: 2030632 - RNA, 15 nt, Human herpesvirus 5
uggggacggugauga

SEQ ID NO: 2030633 - RNA, 16 nt, Human herpesvirus 5
gucugacgcugcuccu

SEQ ID NO: 2030634 - RNA, 14 nt, Human herpesvirus 5
gacacaugcacaau

SEQ ID NO: 2030635 - RNA, 19 nt, Human herpesvirus 5
ucauuagcgcgcugguuug

SEQ ID NO: 2030636 - RNA, 17 nt, Human herpesvirus 5
agccaacagcagggagc

SEQ ID NO: 2030637 - RNA, 16 nt, Human herpesvirus 5
cucgggaaugccagag

SEQ ID NO: 2030638 - RNA, 15 nt, Human herpesvirus 5
gaccucguuguccuc

SEQ ID NO: 2030639 - RNA, 21 nt, Human herpesvirus 5
cccacaugcugcuuaauaaac

SEQ ID NO: 2030640 - RNA, 15 nt, Human herpesvirus 5
cuacagacugggcga

SEQ ID NO: 2030641 - RNA, 18 nt, Human herpesvirus 5
gccgcagagggcgcgccg

SEQ ID NO: 2030642 - RNA, 17 nt, Human herpesvirus 5
ccaccgacacagcagca

SEQ ID NO: 2030643 - RNA, 22 nt, Human herpesvirus 5
uuucuugccaagcuuuagccag

SEQ ID NO: 2030644 - RNA, 17 nt, Human herpesvirus 5
gaauugagcaacaaaca

SEQ ID NO: 2030645 - RNA, 17 nt, Human herpesvirus 5
accguuguggggauuuu

SEQ ID NO: 2030646 - RNA, 16 nt, Human herpesvirus 5
gcggccgacggcagcg

SEQ ID NO: 2030647 - RNA, 21 nt, Human herpesvirus 5
ugcacaccaguauugguucug

SEQ ID NO: 2030648 - RNA, 21 nt, Human herpesvirus 5
acucgcgacgcuucauauuag

SEQ ID NO: 2030649 - RNA, 17 nt, Human herpesvirus 5
uugcacauccucacgag

SEQ ID NO: 2030650 - RNA, 16 nt, Human herpesvirus 5
cggccgugcagcaaga

SEQ ID NO: 2030651 - RNA, 15 nt, Human herpesvirus 5
uaagccggcagcugc

SEQ ID NO: 2030652 - RNA, 15 nt, Human herpesvirus 5
agcagccgacacagc

SEQ ID NO: 2030653 - RNA, 19 nt, Human herpesvirus 5
guggccagcgccugguacu

SEQ ID NO: 2030654 - RNA, 20 nt, Human herpesvirus 5
gcccauugagcgagaacuaa

SEQ ID NO: 2030655 - RNA, 22 nt, Human herpesvirus 5
uccaccauccgaagcuacagcc

SEQ ID NO: 2030656 - RNA, 12 nt, Human herpesvirus 5
uuucgccgccgg

SEQ ID NO: 2030657 - RNA, 23 nt, Human herpesvirus 5
aggaggccgcacuggacgacguc

SEQ ID NO: 2030658 - RNA, 22 nt, Human herpesvirus 5
agaagagauggcguccgggcuc

SEQ ID NO: 2030659 - RNA, 12 nt, Human herpesvirus 5
ggacacugggcg

SEQ ID NO: 2030660 - RNA, 16 nt, Human herpesvirus 5
ucaauugcgggcccug

SEQ ID NO: 2030661 - RNA, 19 nt, Human herpesvirus 5
ucucaugucgcucuuggag

SEQ ID NO: 2030662 - RNA, 14 nt, Human herpesvirus 5
cgcgcccacuggag

SEQ ID NO: 2030663 - RNA, 16 nt, Human herpesvirus 5
gcgugcgggugcauga

SEQ ID NO: 2030664 - RNA, 16 nt, Human herpesvirus 5
accacgaguaacaccg

SEQ ID NO: 2030665 - RNA, 22 nt, Human herpesvirus 5
cuauggacaauuccccucgccu

SEQ ID NO: 2030666 - RNA, 14 nt, Human herpesvirus 5
ggacuuucuccuuu

SEQ ID NO: 2030667 - RNA, 14 nt, Human herpesvirus 5
ucggcgccgccucg

SEQ ID NO: 2030668 - RNA, 16 nt, Human herpesvirus 5
ggcccuucaacggcac

SEQ ID NO: 2030669 - RNA, 23 nt, Human herpesvirus 5
cagcagagccaccaggugccggc

SEQ ID NO: 2030670 - RNA, 14 nt, Human herpesvirus 5
cccccaucccgccu

SEQ ID NO: 2030671 - RNA, 13 nt, Human herpesvirus 5
gcacaugaugcaa

SEQ ID NO: 2030672 - RNA, 22 nt, Human herpesvirus 5
guaugggcgguggucggcugcc

SEQ ID NO: 2030673 - RNA, 20 nt, Human herpesvirus 5
cuuuuaccaacguaacagca

SEQ ID NO: 2030674 - RNA, 16 nt, Human herpesvirus 5
uaucaucaaucaccca

SEQ ID NO: 2030675 - RNA, 15 nt, Human herpesvirus 5
agguuagcgccgcgg

SEQ ID NO: 2030676 - RNA, 15 nt, Human herpesvirus 5
uggacuguguucgug

SEQ ID NO: 2030677 - RNA, 15 nt, Human herpesvirus 5
uguuauguuauuaua

SEQ ID NO: 2030678 - RNA, 16 nt, Human herpesvirus 5
gcgcaucgccugcacc

SEQ ID NO: 2030679 - RNA, 17 nt, Human herpesvirus 5
ccauacuuaccaccgug

SEQ ID NO: 2030680 - RNA, 15 nt, Human herpesvirus 5
cuggacuucaauguc

SEQ ID NO: 2030681 - RNA, 20 nt, Human herpesvirus 5
ugauggaaaugcccgccacc

SEQ ID NO: 2030682 - RNA, 17 nt, Human herpesvirus 5
cagcucguggaccucac

SEQ ID NO: 2030683 - RNA, 21 nt, Human herpesvirus 5
cccacccgguguuggccacca

SEQ ID NO: 2030684 - RNA, 16 nt, Human herpesvirus 5
agaagucucuuucucu

SEQ ID NO: 2030685 - RNA, 16 nt, Human herpesvirus 5
uuacggguaaugcaug

SEQ ID NO: 2030686 - RNA, 16 nt, Human herpesvirus 5
ugucccugccagucuc

SEQ ID NO: 2030687 - RNA, 14 nt, Human herpesvirus 5
gacgugaggcgcuc

SEQ ID NO: 2030688 - RNA, 13 nt, Human herpesvirus 5
gcaccggcagcac

SEQ ID NO: 2030689 - RNA, 22 nt, Human herpesvirus 5
cugaaugacguuaucauaaacu

SEQ ID NO: 2030690 - RNA, 13 nt, Human herpesvirus 5
accgcgacccagc

SEQ ID NO: 2030691 - RNA, 13 nt, Human herpesvirus 5
uuucuuucucagu

SEQ ID NO: 2030692 - RNA, 15 nt, Human herpesvirus 5
agcggcggcgguggu

SEQ ID NO: 2030693 - RNA, 17 nt, Human herpesvirus 5
gagacacgcagaccgug

SEQ ID NO: 2030694 - RNA, 11 nt, Human herpesvirus 5
ccacaguuucc

SEQ ID NO: 2030695 - RNA, 16 nt, Human herpesvirus 5
ccuguuggaacccauc

SEQ ID NO: 2030696 - RNA, 19 nt, Human herpesvirus 5
ccgcacuggacgacgucaa

SEQ ID NO: 2030697 - RNA, 17 nt, Human herpesvirus 5
uccucguccgggucuac

SEQ ID NO: 2030698 - RNA, 15 nt, Human herpesvirus 5
gcaacagcagccacc

SEQ ID NO: 2030699 - RNA, 17 nt, Human herpesvirus 5
guugccgcguggcgcug

SEQ ID NO: 2030700 - RNA, 15 nt, Human herpesvirus 5
acuuucuccuuuggu

SEQ ID NO: 2030701 - RNA, 19 nt, Human herpesvirus 5
uaccgcauuacugggacgc

SEQ ID NO: 2030702 - RNA, 12 nt, Human herpesvirus 5
cgagcucagccc

SEQ ID NO: 2030703 - RNA, 23 nt, Human herpesvirus 5
auacgcgcuggaggcccuggugg

SEQ ID NO: 2030704 - RNA, 15 nt, Human herpesvirus 5
agcucugaaacacag

SEQ ID NO: 2030705 - RNA, 19 nt, Human herpesvirus 5
cuaaaacgguacgggcccc

SEQ ID NO: 2030706 - RNA, 16 nt, Human herpesvirus 5
uggcccgacggcagcu

SEQ ID NO: 2030707 - RNA, 12 nt, Human herpesvirus 5
gcccucgccggc

SEQ ID NO: 2030708 - RNA, 15 nt, Human herpesvirus 5
auuuuuuguaacacu

SEQ ID NO: 2030709 - RNA, 15 nt, Human herpesvirus 5
gaccgguaaggcgga

SEQ ID NO: 2030710 - RNA, 17 nt, Human herpesvirus 5
ccacgucgaccaggugc

SEQ ID NO: 2030711 - RNA, 13 nt, Human herpesvirus 5
aggacgaggcagg

SEQ ID NO: 2030712 - RNA, 16 nt, Human herpesvirus 5
cgccgcggcagcacca

SEQ ID NO: 2030713 - RNA, 16 nt, Human herpesvirus 5
gucggaugaggcaggc

SEQ ID NO: 2030714 - RNA, 13 nt, Human herpesvirus 5
aagggcugcucgg

SEQ ID NO: 2030715 - RNA, 16 nt, Human herpesvirus 5
gacaacggcuggaaau

SEQ ID NO: 2030716 - RNA, 14 nt, Human herpesvirus 5
guuacaaugucacu

SEQ ID NO: 2030717 - RNA, 14 nt, Human herpesvirus 5
accaccuccugggu

SEQ ID NO: 2030718 - RNA, 13 nt, Human herpesvirus 5
gagguacugcagc

SEQ ID NO: 2030719 - RNA, 19 nt, Human herpesvirus 5
ccucgggaggacucagagc

SEQ ID NO: 2030720 - RNA, 20 nt, Human herpesvirus 5
gcuccacacgcaucugcaag

SEQ ID NO: 2030721 - RNA, 24 nt, Human herpesvirus 5
gcgcuacgaaacuuuucugcgggu

SEQ ID NO: 2030722 - RNA, 14 nt, Human herpesvirus 5
cuccucuaccccgc

SEQ ID NO: 2030723 - RNA, 17 nt, Human herpesvirus 5
caaccgcauccugccca

SEQ ID NO: 2030724 - RNA, 21 nt, Human herpesvirus 5
uccacaggcgcguuggacggg

SEQ ID NO: 2030725 - RNA, 19 nt, Human herpesvirus 5
cucgaccgcuggaggccuc

SEQ ID NO: 2030726 - RNA, 19 nt, Human herpesvirus 5
cugcugguuuuugcccccu

SEQ ID NO: 2030727 - RNA, 14 nt, Human herpesvirus 5
uggaccugaccugu

SEQ ID NO: 2030728 - RNA, 14 nt, Human herpesvirus 5
guucgcgauucuca

SEQ ID NO: 2030729 - RNA, 23 nt, Human herpesvirus 5
ucaccgugcucgugcccaucguc

SEQ ID NO: 2030730 - RNA, 21 nt, Human herpesvirus 5
uacaugcuauaagacagccuu

SEQ ID NO: 2030731 - RNA, 19 nt, Human herpesvirus 5
ucugcuugcuggcuuggcu

SEQ ID NO: 2030732 - RNA, 17 nt, Human herpesvirus 5
gucagcggcacgccgcc

SEQ ID NO: 2030733 - RNA, 17 nt, Human herpesvirus 5
caccccccgggccacca

SEQ ID NO: 2030734 - RNA, 20 nt, Human herpesvirus 5
aagaggaagccgcugcuaaa

SEQ ID NO: 2030735 - RNA, 16 nt, Human herpesvirus 5
guguugcuacagggag

SEQ ID NO: 2030736 - RNA, 20 nt, Human herpesvirus 5
cgccgaugcuccgcgaccgg

SEQ ID NO: 2030737 - RNA, 22 nt, Human herpesvirus 5
gucucgggcucgcucggccucg

SEQ ID NO: 2030738 - RNA, 19 nt, Human herpesvirus 5
cccuguaugagcuguuucg

SEQ ID NO: 2030739 - RNA, 19 nt, Human herpesvirus 5
cgcgguagcgaggcggcaa

SEQ ID NO: 2030740 - RNA, 16 nt, Human herpesvirus 5
ccaugagaagagaaaa

SEQ ID NO: 2030741 - RNA, 22 nt, Human herpesvirus 5
cugagaacauguggaaaucacc

SEQ ID NO: 2030742 - RNA, 20 nt, Human herpesvirus 5
cgaccuugagcgacagcagc

SEQ ID NO: 2030743 - RNA, 19 nt, Human herpesvirus 5
acaugaaucuuccccucug

SEQ ID NO: 2030744 - RNA, 17 nt, Human herpesvirus 5
ccucauggacccgccgc

SEQ ID NO: 2030745 - RNA, 12 nt, Human herpesvirus 5
ccgucagccucg

SEQ ID NO: 2030746 - RNA, 12 nt, Human herpesvirus 5
uauggugaccau

SEQ ID NO: 2030747 - RNA, 22 nt, Human herpesvirus 5
cuccgucguuaucuucccugag

SEQ ID NO: 2030748 - RNA, 22 nt, Human herpesvirus 5
acuccgaauaacaacacaucaa

SEQ ID NO: 2030749 - RNA, 19 nt, Human herpesvirus 5
cguucagucgcggcugagc

SEQ ID NO: 2030750 - RNA, 11 nt, Human herpesvirus 5
ccggcagcugc

SEQ ID NO: 2030751 - RNA, 23 nt, Human herpesvirus 5
acgcgccucauggcggcggccac

SEQ ID NO: 2030752 - RNA, 20 nt, Human herpesvirus 5
ugccccccgggauccaagag

SEQ ID NO: 2030753 - RNA, 14 nt, Human herpesvirus 5
cccgggccaccagc

SEQ ID NO: 2030754 - RNA, 13 nt, Human herpesvirus 5
ugcuucuuuucug

SEQ ID NO: 2030755 - RNA, 21 nt, Human herpesvirus 5
gcuggcuuuccucgggcgagu

SEQ ID NO: 2030756 - RNA, 19 nt, Human herpesvirus 5
ggagcccgcacacuggcug

SEQ ID NO: 2030757 - RNA, 15 nt, Human herpesvirus 5
cggaugaccuggccg

SEQ ID NO: 2030758 - RNA, 16 nt, Human herpesvirus 5
gugagcggguucccac

SEQ ID NO: 2030759 - RNA, 19 nt, Human herpesvirus 5
cggccgaccccgucacugu

SEQ ID NO: 2030760 - RNA, 21 nt, Human herpesvirus 5
cacuuccccuaguaauaccac

SEQ ID NO: 2030761 - RNA, 13 nt, Human herpesvirus 5
cuccgacagcgcg

SEQ ID NO: 2030762 - RNA, 14 nt, Human herpesvirus 5
auacuggaagcugc

SEQ ID NO: 2030763 - RNA, 17 nt, Human herpesvirus 5
guugggaccgcagcgug

SEQ ID NO: 2030764 - RNA, 15 nt, Human herpesvirus 5
gccuccagcgccucc

SEQ ID NO: 2030765 - RNA, 14 nt, Human herpesvirus 5
gaaaaaagaccgga

SEQ ID NO: 2030766 - RNA, 14 nt, Human herpesvirus 5
gugcuggcggccgu

SEQ ID NO: 2030767 - RNA, 18 nt, Human herpesvirus 5
gccugggcugcuguuggg

SEQ ID NO: 2030768 - RNA, 12 nt, Human herpesvirus 5
acuuugcugcua

SEQ ID NO: 2030769 - RNA, 17 nt, Human herpesvirus 5
cgggugccgggacagcg

SEQ ID NO: 2030770 - RNA, 20 nt, Human herpesvirus 5
uggugaccauggucggugac

SEQ ID NO: 2030771 - RNA, 19 nt, Human herpesvirus 5
ucgaccggcggcugcuguu

SEQ ID NO: 2030772 - RNA, 16 nt, Human herpesvirus 5
acaacagcagcaacag

SEQ ID NO: 2030773 - RNA, 19 nt, Human herpesvirus 5
gcaggucacacugggagac

SEQ ID NO: 2030774 - RNA, 14 nt, Human herpesvirus 5
caccgucagcugcg

SEQ ID NO: 2030775 - RNA, 21 nt, Human herpesvirus 5
ccaccgccgcuuucucaucuc

SEQ ID NO: 2030776 - RNA, 18 nt, Human herpesvirus 5
uggacauuuggguuucca

SEQ ID NO: 2030777 - RNA, 22 nt, Human herpesvirus 5
ccaagaauaaaaagugcgucua

SEQ ID NO: 2030778 - RNA, 22 nt, Human herpesvirus 5
gcuuucagcguacucauuagcg

SEQ ID NO: 2030779 - RNA, 17 nt, Human herpesvirus 5
augucuccgaacucaga

SEQ ID NO: 2030780 - RNA, 22 nt, Human herpesvirus 5
acggcagcgccagcggccuggc

SEQ ID NO: 2030781 - RNA, 12 nt, Human herpesvirus 5
uguuuugucuga

SEQ ID NO: 2030782 - RNA, 20 nt, Human herpesvirus 5
cgaagguuagcgccgcggca

SEQ ID NO: 2030783 - RNA, 18 nt, Human herpesvirus 5
agcccaaguucagcagca

SEQ ID NO: 2030784 - RNA, 15 nt, Human herpesvirus 5
uacgcgaccagcugc

SEQ ID NO: 2030785 - RNA, 20 nt, Human herpesvirus 5
cuguggcuucucuggagacg

SEQ ID NO: 2030786 - RNA, 21 nt, Human herpesvirus 5
uggacgccaucauggaagagg

SEQ ID NO: 2030787 - RNA, 15 nt, Human herpesvirus 5
gguaccuaaagcccc

SEQ ID NO: 2030788 - RNA, 19 nt, Human herpesvirus 5
gagcccgcacacuggcugg

SEQ ID NO: 2030789 - RNA, 23 nt, Human herpesvirus 5
gcgagcggaacccgggcucaccg

SEQ ID NO: 2030790 - RNA, 17 nt, Human herpesvirus 5
gaucgaggcggcggcga

SEQ ID NO: 2030791 - RNA, 16 nt, Human herpesvirus 5
gaacuggcgcguacgg

SEQ ID NO: 2030792 - RNA, 13 nt, Human herpesvirus 5
cgggcacugggga

SEQ ID NO: 2030793 - RNA, 16 nt, Human herpesvirus 5
uguugcuacagggagu

SEQ ID NO: 2030794 - RNA, 23 nt, Human herpesvirus 5
accgucgaaaacaaccacacaga

SEQ ID NO: 2030795 - RNA, 12 nt, Human herpesvirus 5
cugggugcaaug

SEQ ID NO: 2030796 - RNA, 15 nt, Human herpesvirus 5
uaacaacgucacuuc

SEQ ID NO: 2030797 - RNA, 16 nt, Human herpesvirus 5
cacgguuucuucccau

SEQ ID NO: 2030798 - RNA, 21 nt, Human herpesvirus 5
ggcugccgccgcuguggcugc

SEQ ID NO: 2030799 - RNA, 19 nt, Human herpesvirus 5
ugggaagaugggacguggu

SEQ ID NO: 2030800 - RNA, 17 nt, Human herpesvirus 5
caugcggcaaucggugc

SEQ ID NO: 2030801 - RNA, 20 nt, Human herpesvirus 5
gugcuacgagaucagccgug

SEQ ID NO: 2030802 - RNA, 14 nt, Human herpesvirus 5
gugcagcuggugau

SEQ ID NO: 2030803 - RNA, 23 nt, Human herpesvirus 5
cugcuuuuuugucuccuguggau

SEQ ID NO: 2030804 - RNA, 13 nt, Human herpesvirus 5
gguaacuggcaga

SEQ ID NO: 2030805 - RNA, 13 nt, Human herpesvirus 5
aaauauguaguau

SEQ ID NO: 2030806 - RNA, 17 nt, Human herpesvirus 5
acauggagcccacgccg

SEQ ID NO: 2030807 - RNA, 19 nt, Human herpesvirus 5
cgugucugggccacaggga

SEQ ID NO: 2030808 - RNA, 19 nt, Human herpesvirus 5
gcugccgcagcugcuggag

SEQ ID NO: 2030809 - RNA, 13 nt, Human herpesvirus 5
acacccugcggag

SEQ ID NO: 2030810 - RNA, 14 nt, Human herpesvirus 5
uguucuuacaguuu

SEQ ID NO: 2030811 - RNA, 16 nt, Human herpesvirus 5
uaugcuaauauaucca

SEQ ID NO: 2030812 - RNA, 19 nt, Human herpesvirus 5
cagcacggggaucuugguc

SEQ ID NO: 2030813 - RNA, 23 nt, Human herpesvirus 5
cacgcaucugcaagucccuggcc

SEQ ID NO: 2030814 - RNA, 13 nt, Human herpesvirus 5
gaagugacggacg

SEQ ID NO: 2030815 - RNA, 22 nt, Human herpesvirus 5
ugccgugacgucgcggcaccag

SEQ ID NO: 2030816 - RNA, 19 nt, Human herpesvirus 5
gucgcccgaggcggaggag

SEQ ID NO: 2030817 - RNA, 15 nt, Human herpesvirus 5
cggccgugguggccg

SEQ ID NO: 2030818 - RNA, 13 nt, Human herpesvirus 5
ccagccccagagc

SEQ ID NO: 2030819 - RNA, 15 nt, Human herpesvirus 5
auucacaaaaacacc

SEQ ID NO: 2030820 - RNA, 20 nt, Human herpesvirus 5
ugacgacggcgugguaucca

SEQ ID NO: 2030821 - RNA, 20 nt, Human herpesvirus 5
ccuucccucuagagacagac

SEQ ID NO: 2030822 - RNA, 16 nt, Human herpesvirus 5
ucguaguuguugcaga

SEQ ID NO: 2030823 - RNA, 13 nt, Human herpesvirus 5
gcaccugcugccg

SEQ ID NO: 2030824 - RNA, 18 nt, Human herpesvirus 5
gugacguggauacuagua

SEQ ID NO: 2030825 - RNA, 20 nt, Human herpesvirus 5
caagagcaugcugugggccc

SEQ ID NO: 2030826 - RNA, 18 nt, Human herpesvirus 5
gccgcuuucucaucucag

SEQ ID NO: 2030827 - RNA, 15 nt, Human herpesvirus 5
ccuaguaaugcauua

SEQ ID NO: 2030828 - RNA, 20 nt, Human herpesvirus 5
ccgcaccagacuuggagaca

SEQ ID NO: 2030829 - RNA, 18 nt, Human herpesvirus 5
uuccacgcagcgggaaac

SEQ ID NO: 2030830 - RNA, 13 nt, Human herpesvirus 5
gaaccuuccccac

SEQ ID NO: 2030831 - RNA, 14 nt, Human herpesvirus 5
ggaagcggugcuga

SEQ ID NO: 2030832 - RNA, 16 nt, Human herpesvirus 5
cucuuccaaaucuccg

SEQ ID NO: 2030833 - RNA, 21 nt, Human herpesvirus 5
guccccugccaccucagugga

SEQ ID NO: 2030834 - RNA, 15 nt, Human herpesvirus 5
auccagaccucaugu

SEQ ID NO: 2030835 - RNA, 20 nt, Human herpesvirus 5
aaacguugagacuaccacau

SEQ ID NO: 2030836 - RNA, 20 nt, Human herpesvirus 5
gaaagugauuauaucuuucu

SEQ ID NO: 2030837 - RNA, 14 nt, Human herpesvirus 5
cucgucgugcccgu

SEQ ID NO: 2030838 - RNA, 20 nt, Human herpesvirus 5
uccagauacgcguuggccag

SEQ ID NO: 2030839 - RNA, 14 nt, Human herpesvirus 5
uguaaauaaaaagc

SEQ ID NO: 2030840 - RNA, 18 nt, Human herpesvirus 5
cuuugcuuaucugccucu

SEQ ID NO: 2030841 - RNA, 22 nt, Human herpesvirus 5
ccaucaguacggcuuucugcgg

SEQ ID NO: 2030842 - RNA, 16 nt, Human herpesvirus 5
cugcgacguggaggag

SEQ ID NO: 2030843 - RNA, 23 nt, Human herpesvirus 5
gcggccacggccugcgggcaggc

SEQ ID NO: 2030844 - RNA, 21 nt, Human herpesvirus 5
caccaucgugguagcgccgcg

SEQ ID NO: 2030845 - RNA, 13 nt, Human herpesvirus 5
caacggccccugu

SEQ ID NO: 2030846 - RNA, 19 nt, Human herpesvirus 5
caugcuucaugucgucccg

SEQ ID NO: 2030847 - RNA, 13 nt, Human herpesvirus 5
augaugcugcuga

SEQ ID NO: 2030848 - RNA, 15 nt, Human herpesvirus 5
ccaaguucagcagca

SEQ ID NO: 2030849 - RNA, 24 nt, Human herpesvirus 5
agcgcgaguugcaaaagaagcugc

SEQ ID NO: 2030850 - RNA, 21 nt, Human herpesvirus 5
guuaacgucguuuuggagcug

SEQ ID NO: 2030851 - RNA, 23 nt, Human herpesvirus 5
ccgaguccaccucugcuacuggc

SEQ ID NO: 2030852 - RNA, 19 nt, Human herpesvirus 5
gucgccgcgucagcggccg

SEQ ID NO: 2030853 - RNA, 18 nt, Human herpesvirus 5
ccagcaucuccucgccca

SEQ ID NO: 2030854 - RNA, 18 nt, Human herpesvirus 5
guuagacuagcacagaga

SEQ ID NO: 2030855 - RNA, 16 nt, Human herpesvirus 5
aggauucugagggccg

SEQ ID NO: 2030856 - RNA, 16 nt, Human herpesvirus 5
uccaugucuccaaguc

SEQ ID NO: 2030857 - RNA, 22 nt, Human herpesvirus 5
cugccggucuacagacugggcg

SEQ ID NO: 2030858 - RNA, 18 nt, Human herpesvirus 5
augcuauaagacagccuu

SEQ ID NO: 2030859 - RNA, 23 nt, Human herpesvirus 5
aucuauaaauguucucugaaacc

SEQ ID NO: 2030860 - RNA, 21 nt, Human herpesvirus 5
ggugccccaggaugaagccaa

SEQ ID NO: 2030861 - RNA, 17 nt, Human herpesvirus 5
ucagcuaccgccgcaac

SEQ ID NO: 2030862 - RNA, 14 nt, Human herpesvirus 5
augccgccacuuug

SEQ ID NO: 2030863 - RNA, 12 nt, Human herpesvirus 5
ggcagaaacgag

SEQ ID NO: 2030864 - RNA, 17 nt, Human herpesvirus 5
ugacguggauacuagua

SEQ ID NO: 2030865 - RNA, 18 nt, Human herpesvirus 5
uggauuaguaauggaaag

SEQ ID NO: 2030866 - RNA, 18 nt, Human herpesvirus 5
cugcguucuguggugcgu

SEQ ID NO: 2030867 - RNA, 20 nt, Human herpesvirus 5
acgacggcgguuucagcugg

SEQ ID NO: 2030868 - RNA, 17 nt, Human herpesvirus 5
gacgggacggcugccuc

SEQ ID NO: 2030869 - RNA, 19 nt, Human herpesvirus 5
acgucaacgguuucuggaa

SEQ ID NO: 2030870 - RNA, 18 nt, Human herpesvirus 5
gaauacuggaagcugcug

SEQ ID NO: 2030871 - RNA, 16 nt, Human herpesvirus 5
uaccagcccagggauc

SEQ ID NO: 2030872 - RNA, 15 nt, Human herpesvirus 5
uauagacacacacca

SEQ ID NO: 2030873 - RNA, 21 nt, Human herpesvirus 5
acccagcuggggaaguacaau

SEQ ID NO: 2030874 - RNA, 13 nt, Human herpesvirus 5
ucccuccugcagc

SEQ ID NO: 2030875 - RNA, 17 nt, Human herpesvirus 5
ggcaccaucggacucgc

SEQ ID NO: 2030876 - RNA, 18 nt, Human herpesvirus 5
ccauccucacacugacgg

SEQ ID NO: 2030877 - RNA, 21 nt, Human herpesvirus 5
cuccggcugucaugggucugc

SEQ ID NO: 2030878 - RNA, 23 nt, Human herpesvirus 5
augcuuuccuggacacucuggcc

SEQ ID NO: 2030879 - RNA, 18 nt, Human herpesvirus 5
agcugcgcaggccgccgc

SEQ ID NO: 2030880 - RNA, 17 nt, Human herpesvirus 5
uggcuuuccucgggcga

SEQ ID NO: 2030881 - RNA, 12 nt, Human herpesvirus 5
accugaccuguc

SEQ ID NO: 2030882 - RNA, 22 nt, Human herpesvirus 5
agcccggucggucuuccugcug

SEQ ID NO: 2030883 - RNA, 14 nt, Human herpesvirus 5
ugucaugggucugc

SEQ ID NO: 2030884 - RNA, 18 nt, Human herpesvirus 5
ugcgagcgggguucaccu

SEQ ID NO: 2030885 - RNA, 23 nt, Human herpesvirus 5
ccgagcaagcagucaaaaaagaa

SEQ ID NO: 2030886 - RNA, 14 nt, Human herpesvirus 5
uaccccucgcuggg

SEQ ID NO: 2030887 - RNA, 18 nt, Human herpesvirus 5
cagguccaaucgcacuag

SEQ ID NO: 2030888 - RNA, 21 nt, Human herpesvirus 5
ccacguucuugcguccuucau

SEQ ID NO: 2030889 - RNA, 18 nt, Human herpesvirus 5
uaucgagcgguguagcau

SEQ ID NO: 2030890 - RNA, 20 nt, Human herpesvirus 5
cauggaggucuaucacgggc

SEQ ID NO: 2030891 - RNA, 23 nt, Human herpesvirus 5
gccaaggugcgggagacuagguc

SEQ ID NO: 2030892 - RNA, 20 nt, Human herpesvirus 5
ccuggacguaaauccagacc

SEQ ID NO: 2030893 - RNA, 17 nt, Human herpesvirus 5
cgucgacgcaucuguca

SEQ ID NO: 2030894 - RNA, 17 nt, Human herpesvirus 5
gcaacuuaacgcgcaag

SEQ ID NO: 2030895 - RNA, 15 nt, Human herpesvirus 5
ucuggagacggccgu

SEQ ID NO: 2030896 - RNA, 17 nt, Human herpesvirus 5
gaugaucauggagccgc

SEQ ID NO: 2030897 - RNA, 12 nt, Human herpesvirus 5
gccucuuccucg

SEQ ID NO: 2030898 - RNA, 18 nt, Human herpesvirus 5
aacggauggcguguauau

SEQ ID NO: 2030899 - RNA, 19 nt, Human herpesvirus 5
agcggcaggaaggccucgu

SEQ ID NO: 2030900 - RNA, 15 nt, Human herpesvirus 5
ucgccgccgcgccac

SEQ ID NO: 2030901 - RNA, 17 nt, Human herpesvirus 5
ccucguuguccucuccu

SEQ ID NO: 2030902 - RNA, 17 nt, Human herpesvirus 5
uccugcccaccgccucc

SEQ ID NO: 2030903 - RNA, 17 nt, Human herpesvirus 5
acaaagcccgggccgcc

SEQ ID NO: 2030904 - RNA, 23 nt, Human herpesvirus 5
gcugauaauaaaggcucucuguu

SEQ ID NO: 2030905 - RNA, 15 nt, Human herpesvirus 5
gcgugcaccugcugc

SEQ ID NO: 2030906 - RNA, 14 nt, Human herpesvirus 5
guucccagcgcggc

SEQ ID NO: 2030907 - RNA, 13 nt, Human herpesvirus 5
cagguaggauucc

SEQ ID NO: 2030908 - RNA, 20 nt, Human herpesvirus 5
gggcucguguggcagcuggc

SEQ ID NO: 2030909 - RNA, 13 nt, Human herpesvirus 5
cacagcgccaggc

SEQ ID NO: 2030910 - RNA, 14 nt, Human herpesvirus 5
acacguugcuuucg

SEQ ID NO: 2030911 - RNA, 12 nt, Human herpesvirus 5
gggcgugugggu

SEQ ID NO: 2030912 - RNA, 17 nt, Human herpesvirus 5
cgucacuacucugggau

SEQ ID NO: 2030913 - RNA, 17 nt, Human herpesvirus 5
gucugcauguucaucac

SEQ ID NO: 2030914 - RNA, 21 nt, Human herpesvirus 5
caucacccgccucauggaccc

SEQ ID NO: 2030915 - RNA, 20 nt, Human herpesvirus 5
cugcugcuacgcgguccguc

SEQ ID NO: 2030916 - RNA, 17 nt, Human herpesvirus 5
aagguacuuuaccuagc

SEQ ID NO: 2030917 - RNA, 20 nt, Human herpesvirus 5
ugaagccgccgucgagccac

SEQ ID NO: 2030918 - RNA, 18 nt, Human herpesvirus 5
gagcaugcugugggccca

SEQ ID NO: 2030919 - RNA, 15 nt, Human herpesvirus 5
ccgcgcacgacuggc

SEQ ID NO: 2030920 - RNA, 16 nt, Human herpesvirus 5
acaacggccgccgcag

SEQ ID NO: 2030921 - RNA, 18 nt, Human herpesvirus 5
aauacggcugccacuaca

SEQ ID NO: 2030922 - RNA, 19 nt, Human herpesvirus 5
aggccagcugccaccaggg

SEQ ID NO: 2030923 - RNA, 16 nt, Human herpesvirus 5
ugagcaacaaacacag

SEQ ID NO: 2030924 - RNA, 16 nt, Human herpesvirus 5
gucgccgacgaagaag

SEQ ID NO: 2030925 - RNA, 17 nt, Human herpesvirus 5
cucagugaauucuggca

SEQ ID NO: 2030926 - RNA, 15 nt, Human herpesvirus 5
cggcgcccgggccgc

SEQ ID NO: 2030927 - RNA, 14 nt, Human herpesvirus 5
aaaugagaccccau

SEQ ID NO: 2030928 - RNA, 16 nt, Human herpesvirus 5
ugcucgaccaggaggu

SEQ ID NO: 2030929 - RNA, 17 nt, Human herpesvirus 5
agacgaugaaccuuccc

SEQ ID NO: 2030930 - RNA, 20 nt, Human herpesvirus 5
gcguguguguuucuuaacua

SEQ ID NO: 2030931 - RNA, 16 nt, Human herpesvirus 5
agugaucuucauucac

SEQ ID NO: 2030932 - RNA, 22 nt, Human herpesvirus 5
uaucuguguccgcccgagcagg

SEQ ID NO: 2030933 - RNA, 17 nt, Human herpesvirus 5
caccccuuuuggugugu

SEQ ID NO: 2030934 - RNA, 18 nt, Human herpesvirus 5
cgcgagcggaacccgggc

SEQ ID NO: 2030935 - RNA, 23 nt, Human herpesvirus 5
aagacgggacggcugccucucau

SEQ ID NO: 2030936 - RNA, 20 nt, Human herpesvirus 5
aagaugggacgugguaacga

SEQ ID NO: 2030937 - RNA, 19 nt, Human herpesvirus 5
cggcgcuguacggcagcgg

SEQ ID NO: 2030938 - RNA, 14 nt, Human herpesvirus 5
cuggguauccccga

SEQ ID NO: 2030939 - RNA, 14 nt, Human herpesvirus 5
aaggguaggugcgc

SEQ ID NO: 2030940 - RNA, 20 nt, Human herpesvirus 5
acgcugucuugcuuaaugau

SEQ ID NO: 2030941 - RNA, 16 nt, Human herpesvirus 5
cgcgcaagugccugca

SEQ ID NO: 2030942 - RNA, 14 nt, Human herpesvirus 5
gcuuugguggauaa

SEQ ID NO: 2030943 - RNA, 12 nt, Human herpesvirus 5
cacccaggccgc

SEQ ID NO: 2030944 - RNA, 21 nt, Human herpesvirus 5
cggacuuggcagcgggccugu

SEQ ID NO: 2030945 - RNA, 22 nt, Human herpesvirus 5
ccucuuaacaagccgaccccca

SEQ ID NO: 2030946 - RNA, 18 nt, Human herpesvirus 5
augggaaacggacacuag

SEQ ID NO: 2030947 - RNA, 12 nt, Human herpesvirus 5
caucauggagcu

SEQ ID NO: 2030948 - RNA, 21 nt, Human herpesvirus 5
uuuuaaagucggucaugaagu

SEQ ID NO: 2030949 - RNA, 19 nt, Human herpesvirus 5
cugcauccaucacaucacc

SEQ ID NO: 2030950 - RNA, 13 nt, Human herpesvirus 5
gugcucaggccac

SEQ ID NO: 2030951 - RNA, 14 nt, Human herpesvirus 5
cuagccgggcagga

SEQ ID NO: 2030952 - RNA, 23 nt, Human herpesvirus 5
acguuggcucucgcagcccgagg

SEQ ID NO: 2030953 - RNA, 18 nt, Human herpesvirus 5
uccaggagguggucgagc

SEQ ID NO: 2030954 - RNA, 17 nt, Human herpesvirus 5
auguggcuccgccggca

SEQ ID NO: 2030955 - RNA, 23 nt, Human herpesvirus 5
cuggauacaguugauaacaaaca

SEQ ID NO: 2030956 - RNA, 23 nt, Human herpesvirus 5
aguccaccaggccgcaaagcugg

SEQ ID NO: 2030957 - RNA, 19 nt, Human herpesvirus 5
ccuguuccugucaaugucc

SEQ ID NO: 2030958 - RNA, 14 nt, Human herpesvirus 5
aaagacuguggugg

SEQ ID NO: 2030959 - RNA, 13 nt, Human herpesvirus 5
ccgcguagcgcuc

SEQ ID NO: 2030960 - RNA, 21 nt, Human herpesvirus 5
caagagcaugcugugggccca

SEQ ID NO: 2030961 - RNA, 16 nt, Human herpesvirus 5
gucccuacggaaccug

SEQ ID NO: 2030962 - RNA, 12 nt, Human herpesvirus 5
gacauggagccc

SEQ ID NO: 2030963 - RNA, 20 nt, Human herpesvirus 5
cugcucccccaacccaggga

SEQ ID NO: 2030964 - RNA, 16 nt, Human herpesvirus 5
ccgcggcgguggccgu

SEQ ID NO: 2030965 - RNA, 17 nt, Human herpesvirus 5
ggugaugcguguggccg

SEQ ID NO: 2030966 - RNA, 18 nt, Human herpesvirus 5
cuuuguagcgcucaaagg

SEQ ID NO: 2030967 - RNA, 13 nt, Human herpesvirus 5
cggccugagcgcg

SEQ ID NO: 2030968 - RNA, 23 nt, Human herpesvirus 5
guuuuccaaaacgugccaggcug

SEQ ID NO: 2030969 - RNA, 16 nt, Human herpesvirus 5
gcgccgccagcgcggu

SEQ ID NO: 2030970 - RNA, 19 nt, Human herpesvirus 5
caucugcggcagcgguacc

SEQ ID NO: 2030971 - RNA, 19 nt, Human herpesvirus 5
ccgcggugcgcugcagccg

SEQ ID NO: 2030972 - RNA, 12 nt, Human herpesvirus 5
cggugagacccg

SEQ ID NO: 2030973 - RNA, 20 nt, Human herpesvirus 5
cccgaugugcagggacagug

SEQ ID NO: 2030974 - RNA, 22 nt, Human herpesvirus 5
cgccgucgcgccuuccuccucu

SEQ ID NO: 2030975 - RNA, 20 nt, Human herpesvirus 5
gggaacuacguggguaagug

SEQ ID NO: 2030976 - RNA, 21 nt, Human herpesvirus 5
accagcaaggucaacuacagc

SEQ ID NO: 2030977 - RNA, 22 nt, Human herpesvirus 5
cccugcuccgcaagcgccgcca

SEQ ID NO: 2030978 - RNA, 13 nt, Human herpesvirus 5
cgucggucccauc

SEQ ID NO: 2030979 - RNA, 14 nt, Human herpesvirus 5
cggaacccuucccg

SEQ ID NO: 2030980 - RNA, 17 nt, Human herpesvirus 5
augagcgugcugcucug

SEQ ID NO: 2030981 - RNA, 23 nt, Human herpesvirus 5
auaugucaacaugaaucuucccc

SEQ ID NO: 2030982 - RNA, 19 nt, Human herpesvirus 5
ggcguuacuugcggcgcuu

SEQ ID NO: 2030983 - RNA, 14 nt, Human herpesvirus 5
cgcgguuaagggag

SEQ ID NO: 2030984 - RNA, 21 nt, Human herpesvirus 5
agacauuccccaccuucccuc

SEQ ID NO: 2030985 - RNA, 14 nt, Human herpesvirus 5
cggcgucaccacuu

SEQ ID NO: 2030986 - RNA, 22 nt, Human herpesvirus 5
cagaccgcaacaacagcagcaa

SEQ ID NO: 2030987 - RNA, 17 nt, Human herpesvirus 5
cgacguucuccaaggga

SEQ ID NO: 2030988 - RNA, 21 nt, Human herpesvirus 5
gcgcucuugugucucccgaca

SEQ ID NO: 2030989 - RNA, 20 nt, Human herpesvirus 5
cacgcguuauacgccgagug

SEQ ID NO: 2030990 - RNA, 13 nt, Human herpesvirus 5
cccgcugcugcug

SEQ ID NO: 2030991 - RNA, 17 nt, Human herpesvirus 5
ucgaggaggggccgcug

SEQ ID NO: 2030992 - RNA, 16 nt, Human herpesvirus 5
uaccaacgcuuccugc

SEQ ID NO: 2030993 - RNA, 22 nt, Human herpesvirus 5
aggccucguugcacgagugggc

SEQ ID NO: 2030994 - RNA, 23 nt, Human herpesvirus 5
ggcccguuuugcauaagcgcgga

SEQ ID NO: 2030995 - RNA, 14 nt, Human herpesvirus 5
cuuagcuuucuuga

SEQ ID NO: 2030996 - RNA, 14 nt, Human herpesvirus 5
ugcguggggugcug

SEQ ID NO: 2030997 - RNA, 20 nt, Human herpesvirus 5
gcgcuccaggcggagaugag

SEQ ID NO: 2030998 - RNA, 12 nt, Human herpesvirus 5
ccuggagcagcg

SEQ ID NO: 2030999 - RNA, 15 nt, Human herpesvirus 5
caagagcaugcugug

SEQ ID NO: 2031000 - RNA, 23 nt, Human herpesvirus 5
cugagccggggugccgccgcugc

SEQ ID NO: 2031001 - RNA, 18 nt, Human herpesvirus 5
acgugcgguaacuggcag

SEQ ID NO: 2031002 - RNA, 14 nt, Human herpesvirus 5
uccaaaacgugcca

SEQ ID NO: 2031003 - RNA, 20 nt, Human herpesvirus 5
cguccccacguccacccauc

SEQ ID NO: 2031004 - RNA, 18 nt, Human herpesvirus 5
acucacaauggaagccau

SEQ ID NO: 2031005 - RNA, 13 nt, Human herpesvirus 5
gcccgacagcugc

SEQ ID NO: 2031006 - RNA, 21 nt, Human herpesvirus 5
aaccaccguagcacugcgcaa

SEQ ID NO: 2031007 - RNA, 20 nt, Human herpesvirus 5
guaaccacgucgaccaggug

SEQ ID NO: 2031008 - RNA, 12 nt, Human herpesvirus 5
uugcgcauggua

SEQ ID NO: 2031009 - RNA, 13 nt, Human herpesvirus 5
uggagcagcucuu

SEQ ID NO: 2031010 - RNA, 15 nt, Human herpesvirus 5
ucguuguccuccucg

SEQ ID NO: 2031011 - RNA, 17 nt, Human herpesvirus 5
cgcgaguaucgggccgu

SEQ ID NO: 2031012 - RNA, 19 nt, Human herpesvirus 5
aaaagacuuaccaccuccu

SEQ ID NO: 2031013 - RNA, 22 nt, Human herpesvirus 5
uucaccuuugcgcauccccuga

SEQ ID NO: 2031014 - RNA, 17 nt, Human herpesvirus 5
ccacuaccaccacgacc

SEQ ID NO: 2031015 - RNA, 17 nt, Human herpesvirus 5
cgagcugaaggacacgg

SEQ ID NO: 2031016 - RNA, 23 nt, Human herpesvirus 5
ccgcugugcuggccgccgcugca

SEQ ID NO: 2031017 - RNA, 22 nt, Human herpesvirus 5
ggaggccgcacuggacgacguc

SEQ ID NO: 2031018 - RNA, 13 nt, Human herpesvirus 5
cugcggcgacugg

SEQ ID NO: 2031019 - RNA, 21 nt, Human herpesvirus 5
cccaugcgggaacuggccugg

SEQ ID NO: 2031020 - RNA, 19 nt, Human herpesvirus 5
cgguuuccacgccaccgcc

SEQ ID NO: 2031021 - RNA, 22 nt, Human herpesvirus 5
cucgagggcuccgucugcguca

SEQ ID NO: 2031022 - RNA, 17 nt, Human herpesvirus 5
gcucucgcggcccuuca

SEQ ID NO: 2031023 - RNA, 19 nt, Human herpesvirus 5
cgggcucguguggcagcug

SEQ ID NO: 2031024 - RNA, 17 nt, Human herpesvirus 5
uggggucugcuguuacu

SEQ ID NO: 2031025 - RNA, 18 nt, Human herpesvirus 5
gccguucgacgaucuuua

SEQ ID NO: 2031026 - RNA, 20 nt, Human herpesvirus 5
gucgccggccgacgcgcgcc

SEQ ID NO: 2031027 - RNA, 16 nt, Human herpesvirus 5
uaucagaaagcugcaa

SEQ ID NO: 2031028 - RNA, 16 nt, Human herpesvirus 5
aacuucuaccaucucc

SEQ ID NO: 2031029 - RNA, 20 nt, Human herpesvirus 5
cgcucgugaaacagcagcuc

SEQ ID NO: 2031030 - RNA, 17 nt, Human herpesvirus 5
ugcacgagugggccagc

SEQ ID NO: 2031031 - RNA, 22 nt, Human herpesvirus 5
cgcgagcggcggacuuggcagc

SEQ ID NO: 2031032 - RNA, 18 nt, Human herpesvirus 5
gugugaucugggcagcgg

SEQ ID NO: 2031033 - RNA, 20 nt, Human herpesvirus 5
gcgcuguacggcagcgggga

SEQ ID NO: 2031034 - RNA, 16 nt, Human herpesvirus 5
agcuuuagccagguga

SEQ ID NO: 2031035 - RNA, 23 nt, Human herpesvirus 5
acgcuacuuuccgauccuuggaa

SEQ ID NO: 2031036 - RNA, 14 nt, Human herpesvirus 5
ugcccgcgauuucu

SEQ ID NO: 2031037 - RNA, 19 nt, Human herpesvirus 5
cuugcggcgccgacuccuu

SEQ ID NO: 2031038 - RNA, 16 nt, Human herpesvirus 5
caugugcagcugguga

SEQ ID NO: 2031039 - RNA, 14 nt, Human herpesvirus 5
ucgaugaagccuau

SEQ ID NO: 2031040 - RNA, 16 nt, Human herpesvirus 5
gugcagcugcgccugg

SEQ ID NO: 2031041 - RNA, 22 nt, Human herpesvirus 5
uuuuucuaugauaugcgugucu

SEQ ID NO: 2031042 - RNA, 19 nt, Human herpesvirus 5
agugacguggauacuagua

SEQ ID NO: 2031043 - RNA, 16 nt, Human herpesvirus 5
accgcagcgguggcug

SEQ ID NO: 2031044 - RNA, 17 nt, Human herpesvirus 5
cguacaccgcuggagcu

SEQ ID NO: 2031045 - RNA, 20 nt, Human herpesvirus 5
gcucgugaaacagcagcucg

SEQ ID NO: 2031046 - RNA, 14 nt, Human herpesvirus 5
guguuccacuccau

SEQ ID NO: 2031047 - RNA, 15 nt, Human herpesvirus 5
caggguaacagccuu

SEQ ID NO: 2031048 - RNA, 19 nt, Human herpesvirus 5
aaugcgucugcaacggcau

SEQ ID NO: 2031049 - RNA, 14 nt, Human herpesvirus 5
ucugcaagucccug

SEQ ID NO: 2031050 - RNA, 13 nt, Human herpesvirus 5
auccauccugggg

SEQ ID NO: 2031051 - RNA, 16 nt, Human herpesvirus 5
aucgggcccgccggcc

SEQ ID NO: 2031052 - RNA, 15 nt, Human herpesvirus 5
cgaccagcugcugga

SEQ ID NO: 2031053 - RNA, 14 nt, Human herpesvirus 5
gccggaggcugugg

SEQ ID NO: 2031054 - RNA, 18 nt, Human herpesvirus 5
uggacgguacaguuuaug

SEQ ID NO: 2031055 - RNA, 13 nt, Human herpesvirus 5
gaggauguucugc

SEQ ID NO: 2031056 - RNA, 23 nt, Human herpesvirus 5
gucacacaggccagcugccacca

SEQ ID NO: 2031057 - RNA, 17 nt, Human herpesvirus 5
accgcaguugcugccuu

SEQ ID NO: 2031058 - RNA, 22 nt, Human herpesvirus 5
uguacgugcgguaacuggcaga

SEQ ID NO: 2031059 - RNA, 22 nt, Human herpesvirus 5
ucugggugcaaugccucauccu

SEQ ID NO: 2031060 - RNA, 23 nt, Human herpesvirus 5
ccgcgagcggcggacuuggcagc

SEQ ID NO: 2031061 - RNA, 20 nt, Human herpesvirus 5
gcuggcgguauggcugcgcg

SEQ ID NO: 2031062 - RNA, 16 nt, Human herpesvirus 5
ccuggaucuuggcggc

SEQ ID NO: 2031063 - RNA, 13 nt, Human herpesvirus 5
aagcguucagugu

SEQ ID NO: 2031064 - RNA, 15 nt, Human herpesvirus 5
uggacggguuucagc

SEQ ID NO: 2031065 - RNA, 20 nt, Human herpesvirus 5
ccaucucgcguaacgugucu

SEQ ID NO: 2031066 - RNA, 14 nt, Human herpesvirus 5
ggaugagggcucuu

SEQ ID NO: 2031067 - RNA, 15 nt, Human herpesvirus 5
guacggcccggcagc

SEQ ID NO: 2031068 - RNA, 20 nt, Human herpesvirus 5
cgcaucaucaacagcagcaa

SEQ ID NO: 2031069 - RNA, 21 nt, Human herpesvirus 5
gcuggugaucggccgcggugc

SEQ ID NO: 2031070 - RNA, 24 nt, Human herpesvirus 5
gugcagguucugaaucugcuccag

SEQ ID NO: 2031071 - RNA, 16 nt, Human herpesvirus 5
ggccgacgaggccggc

SEQ ID NO: 2031072 - RNA, 16 nt, Human herpesvirus 5
caucagcgcacggugg

SEQ ID NO: 2031073 - RNA, 12 nt, Human herpesvirus 5
gcugaugucugc

SEQ ID NO: 2031074 - RNA, 12 nt, Human herpesvirus 5
ggcggcagccac

SEQ ID NO: 2031075 - RNA, 19 nt, Human herpesvirus 5
accuggguggaacgagcgc

SEQ ID NO: 2031076 - RNA, 20 nt, Human herpesvirus 5
cgucgguaccgucuccacca

SEQ ID NO: 2031077 - RNA, 12 nt, Human herpesvirus 5
cgccacacgugu

SEQ ID NO: 2031078 - RNA, 23 nt, Human herpesvirus 5
agucauagagccaacgagacuau

SEQ ID NO: 2031079 - RNA, 21 nt, Human herpesvirus 5
guaaucuuccauaauaaaagu

SEQ ID NO: 2031080 - RNA, 13 nt, Human herpesvirus 5
guuuccacgccac

SEQ ID NO: 2031081 - RNA, 21 nt, Human herpesvirus 5
ucccgacaggcucgucguggg

SEQ ID NO: 2031082 - RNA, 14 nt, Human herpesvirus 5
auaauaaaaguaaa

SEQ ID NO: 2031083 - RNA, 12 nt, Human herpesvirus 5
ccaaguucagca

SEQ ID NO: 2031084 - RNA, 13 nt, Human herpesvirus 5
gagacagccacau

SEQ ID NO: 2031085 - RNA, 18 nt, Human herpesvirus 5
cucggaaacugugcguca

SEQ ID NO: 2031086 - RNA, 23 nt, Human herpesvirus 5
augcagaccuacagcaccccccu

SEQ ID NO: 2031087 - RNA, 13 nt, Human herpesvirus 5
ucacgcaggugag

SEQ ID NO: 2031088 - RNA, 14 nt, Human herpesvirus 5
ggacaaggcuccga

SEQ ID NO: 2031089 - RNA, 21 nt, Human herpesvirus 5
uggcgggccgaccgccgccgc

SEQ ID NO: 2031090 - RNA, 12 nt, Human herpesvirus 5
cggaggagcguc

SEQ ID NO: 2031091 - RNA, 18 nt, Human herpesvirus 5
gaugagccccucagucug

SEQ ID NO: 2031092 - RNA, 13 nt, Human herpesvirus 5
cuugcgcuucugc

SEQ ID NO: 2031093 - RNA, 15 nt, Human herpesvirus 5
caccgucgcccucag

SEQ ID NO: 2031094 - RNA, 15 nt, Human herpesvirus 5
gccucuuuugacaug

SEQ ID NO: 2031095 - RNA, 17 nt, Human herpesvirus 5
acgugaccgugggacaa

SEQ ID NO: 2031096 - RNA, 24 nt, Human herpesvirus 5
uggggcaacugcugccucgaugcg

SEQ ID NO: 2031097 - RNA, 16 nt, Human herpesvirus 5
aauacgauaauugcua

SEQ ID NO: 2031098 - RNA, 19 nt, Human herpesvirus 5
acgcuggcucacgccggca

SEQ ID NO: 2031099 - RNA, 15 nt, Human herpesvirus 5
caaauaccaacacua

SEQ ID NO: 2031100 - RNA, 17 nt, Human herpesvirus 5
cucuaucgcgacagaca

SEQ ID NO: 2031101 - RNA, 20 nt, Human herpesvirus 5
cacacggugugaugguacua

SEQ ID NO: 2031102 - RNA, 18 nt, Human herpesvirus 5
ucuacuccaucaugaagg

SEQ ID NO: 2031103 - RNA, 18 nt, Human herpesvirus 5
ucgacuggaggcucugug

SEQ ID NO: 2031104 - RNA, 16 nt, Human herpesvirus 5
cgaaagacaaugaaaa

SEQ ID NO: 2031105 - RNA, 16 nt, Human herpesvirus 5
gcugccuguuccugcu

SEQ ID NO: 2031106 - RNA, 12 nt, Human herpesvirus 5
ucgucugagccg

SEQ ID NO: 2031107 - RNA, 18 nt, Human herpesvirus 5
auaugcuaauauauccaa

SEQ ID NO: 2031108 - RNA, 17 nt, Human herpesvirus 5
cauuacuaaacaaaaaa

SEQ ID NO: 2031109 - RNA, 13 nt, Human herpesvirus 5
cuugcgcucccug

SEQ ID NO: 2031110 - RNA, 15 nt, Human herpesvirus 5
gucgagacggcuccg

SEQ ID NO: 2031111 - RNA, 16 nt, Human herpesvirus 5
cgcaucuugccggugc

SEQ ID NO: 2031112 - RNA, 20 nt, Human herpesvirus 5
cgugguggccgugcugggcu

SEQ ID NO: 2031113 - RNA, 17 nt, Human herpesvirus 5
gggaacgccguguggga

SEQ ID NO: 2031114 - RNA, 19 nt, Human herpesvirus 5
agcgccagcggccuggccu

SEQ ID NO: 2031115 - RNA, 18 nt, Human herpesvirus 5
acgacuggcucaacuuuc

SEQ ID NO: 2031116 - RNA, 14 nt, Human herpesvirus 5
cugggucagugcca

SEQ ID NO: 2031117 - RNA, 14 nt, Human herpesvirus 5
uuuauuaaagguuu

SEQ ID NO: 2031118 - RNA, 21 nt, Human herpesvirus 5
ggcugagauucgcgggaucgu

SEQ ID NO: 2031119 - RNA, 23 nt, Human herpesvirus 5
gacucgcugccgcagcugcugga

SEQ ID NO: 2031120 - RNA, 18 nt, Human herpesvirus 5
gcagaucgugccgcgagg

SEQ ID NO: 2031121 - RNA, 14 nt, Human herpesvirus 5
gcugacgaugagca

SEQ ID NO: 2031122 - RNA, 18 nt, Human herpesvirus 5
gagcaucgcaacaacagc

SEQ ID NO: 2031123 - RNA, 20 nt, Human herpesvirus 5
ggcucgaccggcggcugcug

SEQ ID NO: 2031124 - RNA, 16 nt, Human herpesvirus 5
gcaagcagucaaaaaa

SEQ ID NO: 2031125 - RNA, 21 nt, Human herpesvirus 5
aaccagcugguaccugaaacc

SEQ ID NO: 2031126 - RNA, 16 nt, Human herpesvirus 5
cuacgccggggaagcc

SEQ ID NO: 2031127 - RNA, 17 nt, Human herpesvirus 5
acacagcgccgcgcugg

SEQ ID NO: 2031128 - RNA, 20 nt, Human herpesvirus 5
gacagcacguuaguuacagc

SEQ ID NO: 2031129 - RNA, 16 nt, Human herpesvirus 5
aauuuuuucgcugcca

SEQ ID NO: 2031130 - RNA, 20 nt, Human herpesvirus 5
gcuuacccuucaauuuccac

SEQ ID NO: 2031131 - RNA, 13 nt, Human herpesvirus 5
accuaccugggcu

SEQ ID NO: 2031132 - RNA, 21 nt, Human herpesvirus 5
ugcugagacugagacuggugg

SEQ ID NO: 2031133 - RNA, 12 nt, Human herpesvirus 5
acgcuuucagga

SEQ ID NO: 2031134 - RNA, 18 nt, Human herpesvirus 5
aacgucguuguguucuua

SEQ ID NO: 2031135 - RNA, 14 nt, Human herpesvirus 5
gaccgcggcgcagg

SEQ ID NO: 2031136 - RNA, 15 nt, Human herpesvirus 5
ccucagguuccccga

SEQ ID NO: 2031137 - RNA, 23 nt, Human herpesvirus 5
ccaccgugaugucaacacugacg

SEQ ID NO: 2031138 - RNA, 22 nt, Human herpesvirus 5
ccgcagcugcuggagcgcggcc

SEQ ID NO: 2031139 - RNA, 16 nt, Human herpesvirus 5
gugucgcgcacccggc

SEQ ID NO: 2031140 - RNA, 12 nt, Human herpesvirus 5
ggucggugucuc

SEQ ID NO: 2031141 - RNA, 20 nt, Human herpesvirus 5
gggcuuuccuugucacguug

SEQ ID NO: 2031142 - RNA, 16 nt, Human herpesvirus 5
cucagcuugauggugu

SEQ ID NO: 2031143 - RNA, 16 nt, Human herpesvirus 5
gcguagcgcuccugga

SEQ ID NO: 2031144 - RNA, 22 nt, Human herpesvirus 5
ccgcugccguacagcgccgccg

SEQ ID NO: 2031145 - RNA, 17 nt, Human herpesvirus 5
uaaaaguaaaaaugccc

SEQ ID NO: 2031146 - RNA, 15 nt, Human herpesvirus 5
auauugaaaaugucg

SEQ ID NO: 2031147 - RNA, 18 nt, Human herpesvirus 5
cuguguuauucagaacca

SEQ ID NO: 2031148 - RNA, 19 nt, Human herpesvirus 5
uccaaggccuccagcgccu

SEQ ID NO: 2031149 - RNA, 13 nt, Human herpesvirus 5
ccuaacuguagca

SEQ ID NO: 2031150 - RNA, 19 nt, Human herpesvirus 5
ggcgcccaaaccgcaggag

SEQ ID NO: 2031151 - RNA, 19 nt, Human herpesvirus 5
ucgagucgcguguguuuug

SEQ ID NO: 2031152 - RNA, 17 nt, Human herpesvirus 5
cgccggccacgagccag

SEQ ID NO: 2031153 - RNA, 19 nt, Human herpesvirus 5
gguauccacgcucguucaa

SEQ ID NO: 2031154 - RNA, 21 nt, Human herpesvirus 5
uuuuaucgucucaauaaaagc

SEQ ID NO: 2031155 - RNA, 18 nt, Human herpesvirus 5
gucugagcgccgacugga

SEQ ID NO: 2031156 - RNA, 20 nt, Human herpesvirus 5
acgugcgauuuggaccugga

SEQ ID NO: 2031157 - RNA, 21 nt, Human herpesvirus 5
cagcagauacaugcgucguau

SEQ ID NO: 2031158 - RNA, 15 nt, Human herpesvirus 5
ggcugugcgcgccgg

SEQ ID NO: 2031159 - RNA, 15 nt, Human herpesvirus 5
cccgccggagcccgg

SEQ ID NO: 2031160 - RNA, 15 nt, Human herpesvirus 5
caggaaaacggaaug

SEQ ID NO: 2031161 - RNA, 23 nt, Human herpesvirus 5
agcgugacuuugagcggcucgcc

SEQ ID NO: 2031162 - RNA, 14 nt, Human herpesvirus 5
cgggcuccaugcug

SEQ ID NO: 2031163 - RNA, 14 nt, Human herpesvirus 5
cugucugcagccgg

SEQ ID NO: 2031164 - RNA, 15 nt, Human herpesvirus 5
ccagcgagcugcgcg

SEQ ID NO: 2031165 - RNA, 17 nt, Human herpesvirus 5
cgacugcggcgacuggc

SEQ ID NO: 2031166 - RNA, 18 nt, Human herpesvirus 5
cggcucaccacgcagcag

SEQ ID NO: 2031167 - RNA, 17 nt, Human herpesvirus 5
gcccgggggugacaagg

SEQ ID NO: 2031168 - RNA, 23 nt, Human herpesvirus 5
gucacuauccgaugguuucauua

SEQ ID NO: 2031169 - RNA, 20 nt, Human herpesvirus 5
cugagcuacgaugaccacga

SEQ ID NO: 2031170 - RNA, 16 nt, Human herpesvirus 5
guacagcggcucgccg

SEQ ID NO: 2031171 - RNA, 16 nt, Human herpesvirus 5
gugcggacggugcggg

SEQ ID NO: 2031172 - RNA, 21 nt, Human herpesvirus 5
guaugcaugucgcgacagaga

SEQ ID NO: 2031173 - RNA, 13 nt, Human herpesvirus 5
gcucgaccaggag

SEQ ID NO: 2031174 - RNA, 15 nt, Human herpesvirus 5
gcugcugcacgggcu

SEQ ID NO: 2031175 - RNA, 13 nt, Human herpesvirus 5
gggucaaaagccu

SEQ ID NO: 2031176 - RNA, 13 nt, Human herpesvirus 5
gcaagagccggaa

SEQ ID NO: 2031177 - RNA, 14 nt, Human herpesvirus 5
ccggugcugccgca

SEQ ID NO: 2031178 - RNA, 18 nt, Human herpesvirus 5
ucgaccggcggcugcugu

SEQ ID NO: 2031179 - RNA, 15 nt, Human herpesvirus 5
cuucggccggcugcu

SEQ ID NO: 2031180 - RNA, 19 nt, Human herpesvirus 5
cugagaaccuacgugcaac

SEQ ID NO: 2031181 - RNA, 16 nt, Human herpesvirus 5
gcgucggcgccccaca

SEQ ID NO: 2031182 - RNA, 18 nt, Human herpesvirus 5
gagucgcguguguuuuga

SEQ ID NO: 2031183 - RNA, 13 nt, Human herpesvirus 5
cagcugcgccugg

SEQ ID NO: 2031184 - RNA, 20 nt, Human herpesvirus 5
uucugcuuuuuugucuccug

SEQ ID NO: 2031185 - RNA, 12 nt, Human herpesvirus 5
uguacugaaggg

SEQ ID NO: 2031186 - RNA, 14 nt, Human herpesvirus 5
ccgccagcggaagc

SEQ ID NO: 2031187 - RNA, 14 nt, Human herpesvirus 5
cucaaacaccgcug

SEQ ID NO: 2031188 - RNA, 13 nt, Human herpesvirus 5
ucaugccgccacc

SEQ ID NO: 2031189 - RNA, 18 nt, Human herpesvirus 5
cgcgccucacgcugcacg

SEQ ID NO: 2031190 - RNA, 23 nt, Human herpesvirus 5
caguacgauccuccggcgcugag

SEQ ID NO: 2031191 - RNA, 16 nt, Human herpesvirus 5
gcucacguagcaggcc

SEQ ID NO: 2031192 - RNA, 24 nt, Human herpesvirus 5
ugguggccgaacagcagcucuucc

SEQ ID NO: 2031193 - RNA, 17 nt, Human herpesvirus 5
ccgaguaacgcgccguc

SEQ ID NO: 2031194 - RNA, 14 nt, Human herpesvirus 5
uaacggucaagaag

SEQ ID NO: 2031195 - RNA, 15 nt, Human herpesvirus 5
acggcuuuccaagcu

SEQ ID NO: 2031196 - RNA, 18 nt, Human herpesvirus 5
acggcaucaugcugggcg

SEQ ID NO: 2031197 - RNA, 22 nt, Human herpesvirus 5
agcggcuguggcuucucuggag

SEQ ID NO: 2031198 - RNA, 15 nt, Human herpesvirus 5
ugcugcaacggccgu

SEQ ID NO: 2031199 - RNA, 23 nt, Human herpesvirus 5
gaccggcagcaccaguuggccac

SEQ ID NO: 2031200 - RNA, 22 nt, Human herpesvirus 5
gcugcagccggaggaagcggcg

SEQ ID NO: 2031201 - RNA, 16 nt, Human herpesvirus 5
uccgugauagccacga

SEQ ID NO: 2031202 - RNA, 20 nt, Human herpesvirus 5
uuuuuaauaaaaaacaaggu

SEQ ID NO: 2031203 - RNA, 17 nt, Human herpesvirus 5
cugauccaguugcaccu

SEQ ID NO: 2031204 - RNA, 19 nt, Human herpesvirus 5
aagaaugcaacgcuuucag

SEQ ID NO: 2031205 - RNA, 23 nt, Human herpesvirus 5
uggcaauuacguggguugcaccc

SEQ ID NO: 2031206 - RNA, 19 nt, Human herpesvirus 5
uggaccggugguacugcug

SEQ ID NO: 2031207 - RNA, 15 nt, Human herpesvirus 5
aagaagaaccugccg

SEQ ID NO: 2031208 - RNA, 12 nt, Human herpesvirus 5
gguccagccagc

SEQ ID NO: 2031209 - RNA, 20 nt, Human herpesvirus 5
gacacucuggcccugcugua

SEQ ID NO: 2031210 - RNA, 20 nt, Human herpesvirus 5
aaagaaaaaaugguguuaca

SEQ ID NO: 2031211 - RNA, 22 nt, Human herpesvirus 5
ccgucggcgucgcgucgcaggc

SEQ ID NO: 2031212 - RNA, 14 nt, Human herpesvirus 5
cguaauguagacag

SEQ ID NO: 2031213 - RNA, 14 nt, Human herpesvirus 5
gagaaagagcagcg

SEQ ID NO: 2031214 - RNA, 17 nt, Human herpesvirus 5
gcugcuguugcacgggc

SEQ ID NO: 2031215 - RNA, 14 nt, Human herpesvirus 5
guggcuguuguuga

SEQ ID NO: 2031216 - RNA, 15 nt, Human herpesvirus 5
agcaugaacugccac

SEQ ID NO: 2031217 - RNA, 21 nt, Human herpesvirus 5
ccggucgucugcgacuccugg

SEQ ID NO: 2031218 - RNA, 17 nt, Human herpesvirus 5
aaaucaucguucgcaug

SEQ ID NO: 2031219 - RNA, 19 nt, Human herpesvirus 5
uuacacacuccuugguacu

SEQ ID NO: 2031220 - RNA, 18 nt, Human herpesvirus 5
gucuggagguggccugca

SEQ ID NO: 2031221 - RNA, 17 nt, Human herpesvirus 5
ccaguuacacucgcucu

SEQ ID NO: 2031222 - RNA, 14 nt, Human herpesvirus 5
uuguaucauuacag

SEQ ID NO: 2031223 - RNA, 20 nt, Human herpesvirus 5
ggcaagccaaaccacaaggc

SEQ ID NO: 2031224 - RNA, 20 nt, Human herpesvirus 5
cugccucagucucucggugc

SEQ ID NO: 2031225 - RNA, 18 nt, Human herpesvirus 5
gguguccggacggcgaag

SEQ ID NO: 2031226 - RNA, 14 nt, Human herpesvirus 5
ccuguugcucuccu

SEQ ID NO: 2031227 - RNA, 16 nt, Human herpesvirus 5
uccaauaaacccaucc

SEQ ID NO: 2031228 - RNA, 22 nt, Human herpesvirus 5
cacccgucaugguacagaucca

SEQ ID NO: 2031229 - RNA, 13 nt, Human herpesvirus 5
acgcucaaggaca

SEQ ID NO: 2031230 - RNA, 23 nt, Human herpesvirus 5
gaaaccguacuaagucucccgug

SEQ ID NO: 2031231 - RNA, 17 nt, Human herpesvirus 5
ggcaccgggaacuuaug

SEQ ID NO: 2031232 - RNA, 14 nt, Human herpesvirus 5
ugcugcaaggccuc

SEQ ID NO: 2031233 - RNA, 16 nt, Human herpesvirus 5
accgucgucgcucuag

SEQ ID NO: 2031234 - RNA, 12 nt, Human herpesvirus 5
cuacuuuggaau

SEQ ID NO: 2031235 - RNA, 20 nt, Human herpesvirus 5
uaacccccgacgagcaggcu

SEQ ID NO: 2031236 - RNA, 20 nt, Human herpesvirus 5
cuugaaagacggacccgcca

SEQ ID NO: 2031237 - RNA, 13 nt, Human herpesvirus 5
uguuacgaccugu

SEQ ID NO: 2031238 - RNA, 11 nt, Human herpesvirus 5
cgcgacacggu

SEQ ID NO: 2031239 - RNA, 23 nt, Human herpesvirus 5
gaggaccauuuccaugugcagcu

SEQ ID NO: 2031240 - RNA, 14 nt, Human herpesvirus 5
ugggcuacguaggc

SEQ ID NO: 2031241 - RNA, 17 nt, Human herpesvirus 5
accaacgcgaccaccgu

SEQ ID NO: 2031242 - RNA, 19 nt, Human herpesvirus 5
uuaguacgugcguguuuuu

SEQ ID NO: 2031243 - RNA, 20 nt, Human herpesvirus 5
ggagcgaguggggcaacugc

SEQ ID NO: 2031244 - RNA, 17 nt, Human herpesvirus 5
cagaagcugcggcucug

SEQ ID NO: 2031245 - RNA, 17 nt, Human herpesvirus 5
agaugaggcggcgugga

SEQ ID NO: 2031246 - RNA, 20 nt, Human herpesvirus 5
ugcuauaccucaguuauccc

SEQ ID NO: 2031247 - RNA, 12 nt, Human herpesvirus 5
gccgagcccaac

SEQ ID NO: 2031248 - RNA, 14 nt, Human herpesvirus 5
ugccgaaacaccgu

SEQ ID NO: 2031249 - RNA, 13 nt, Human herpesvirus 5
ggcuucucuggag

SEQ ID NO: 2031250 - RNA, 15 nt, Human herpesvirus 5
gcgguuauggcuccg

SEQ ID NO: 2031251 - RNA, 15 nt, Human herpesvirus 5
caaagaacgaaaaca

SEQ ID NO: 2031252 - RNA, 17 nt, Human herpesvirus 5
gagguugucguccgaau

SEQ ID NO: 2031253 - RNA, 15 nt, Human herpesvirus 5
gcgggagacuagguc

SEQ ID NO: 2031254 - RNA, 13 nt, Human herpesvirus 5
ugcaccugcugcc

SEQ ID NO: 2031255 - RNA, 22 nt, Human herpesvirus 5
uuuaucaauacaaugacacuaa

SEQ ID NO: 2031256 - RNA, 20 nt, Human herpesvirus 5
gucuccgaacucagaggcca

SEQ ID NO: 2031257 - RNA, 19 nt, Human herpesvirus 5
ucaugaguuggugcagcug

SEQ ID NO: 2031258 - RNA, 21 nt, Human herpesvirus 5
ggcaacgugccacgugacuca

SEQ ID NO: 2031259 - RNA, 21 nt, Human herpesvirus 5
ugaggcgguggcugcgccucc

SEQ ID NO: 2031260 - RNA, 13 nt, Human herpesvirus 5
cagaccagccacc

SEQ ID NO: 2031261 - RNA, 22 nt, Human herpesvirus 5
ggcucgccgcagaccauccuca

SEQ ID NO: 2031262 - RNA, 22 nt, Human herpesvirus 5
augcauuaucaucuaaagacua

SEQ ID NO: 2031263 - RNA, 18 nt, Human herpesvirus 5
aaguaagcauggcuuaca

SEQ ID NO: 2031264 - RNA, 22 nt, Human herpesvirus 5
auuugcgacaguugccggaacc

SEQ ID NO: 2031265 - RNA, 14 nt, Human herpesvirus 5
ggccgucuccacca

SEQ ID NO: 2031266 - RNA, 17 nt, Human herpesvirus 5
cuccgaacucagaggcc

SEQ ID NO: 2031267 - RNA, 13 nt, Human herpesvirus 5
uugcggccgccgc

SEQ ID NO: 2031268 - RNA, 15 nt, Human herpesvirus 5
agugucagacacagc

SEQ ID NO: 2031269 - RNA, 23 nt, Human herpesvirus 5
cggcauacaaugugcugcaugag

SEQ ID NO: 2031270 - RNA, 22 nt, Human herpesvirus 5
gcgcccgagacggcggcauccu

SEQ ID NO: 2031271 - RNA, 22 nt, Human herpesvirus 5
cgguucucaaaaacuguaaggu

SEQ ID NO: 2031272 - RNA, 13 nt, Human herpesvirus 5
cacucgcucgcuu

SEQ ID NO: 2031273 - RNA, 20 nt, Human herpesvirus 5
ccagauacaacgucaugcau

SEQ ID NO: 2031274 - RNA, 18 nt, Human herpesvirus 5
cuccuguguaugaggauc

SEQ ID NO: 2031275 - RNA, 13 nt, Human herpesvirus 5
cggaacccucugg

SEQ ID NO: 2031276 - RNA, 14 nt, Human herpesvirus 5
ccauccucguggaa

SEQ ID NO: 2031277 - RNA, 11 nt, Human herpesvirus 5
gccuccggcug

SEQ ID NO: 2031278 - RNA, 14 nt, Human herpesvirus 5
gacacggaggauga

SEQ ID NO: 2031279 - RNA, 18 nt, Human herpesvirus 5
gugcgccuuccaguccau

SEQ ID NO: 2031280 - RNA, 20 nt, Human herpesvirus 5
ccuguguaugaggaucagga

SEQ ID NO: 2031281 - RNA, 12 nt, Human herpesvirus 5
gauccagcugcu

SEQ ID NO: 2031282 - RNA, 18 nt, Human herpesvirus 5
caacaaugacuaacccug

SEQ ID NO: 2031283 - RNA, 15 nt, Human herpesvirus 5
aggaacaaaauaaua

SEQ ID NO: 2031284 - RNA, 17 nt, Human herpesvirus 5
cccgccguugcggccgc

SEQ ID NO: 2031285 - RNA, 19 nt, Human herpesvirus 5
gguccuccagcagcagcug

SEQ ID NO: 2031286 - RNA, 14 nt, Human herpesvirus 5
cggaagaagaagaa

SEQ ID NO: 2031287 - RNA, 14 nt, Human herpesvirus 5
cgugcacgcgcugc

SEQ ID NO: 2031288 - RNA, 14 nt, Human herpesvirus 5
gacccagggcugcu

SEQ ID NO: 2031289 - RNA, 19 nt, Human herpesvirus 5
gggcgaaaggcaccccgac

SEQ ID NO: 2031290 - RNA, 19 nt, Human herpesvirus 5
cccucaaaacaucaccacc

SEQ ID NO: 2031291 - RNA, 18 nt, Human herpesvirus 5
agcagaggguuggcuggu

SEQ ID NO: 2031292 - RNA, 12 nt, Human herpesvirus 5
ggcuccgccggc

SEQ ID NO: 2031293 - RNA, 15 nt, Human herpesvirus 5
auugcccuucuggag

SEQ ID NO: 2031294 - RNA, 18 nt, Human herpesvirus 5
gacuuacaucugcucccc

SEQ ID NO: 2031295 - RNA, 15 nt, Human herpesvirus 5
ggaacguaccuagcu

SEQ ID NO: 2031296 - RNA, 22 nt, Human herpesvirus 5
ucgugagcagcgugcaccugcu

SEQ ID NO: 2031297 - RNA, 21 nt, Human herpesvirus 5
cuuacaguuuucauguaauaa

SEQ ID NO: 2031298 - RNA, 22 nt, Human herpesvirus 5
acguggaaggcggcucgcugga

SEQ ID NO: 2031299 - RNA, 23 nt, Human herpesvirus 5
acugcuauguaucaucuuuauuu

SEQ ID NO: 2031300 - RNA, 18 nt, Human herpesvirus 5
acgccuugcaccugggug

SEQ ID NO: 2031301 - RNA, 15 nt, Human herpesvirus 5
cuuucuggagcagga

SEQ ID NO: 2031302 - RNA, 18 nt, Human herpesvirus 5
gcgacggcgaauggauca

SEQ ID NO: 2031303 - RNA, 21 nt, Human herpesvirus 5
ugauaggcggcgaggcgaaac

SEQ ID NO: 2031304 - RNA, 17 nt, Human herpesvirus 5
cucguuguccucuccuc

SEQ ID NO: 2031305 - RNA, 16 nt, Human herpesvirus 5
cacgcgucgucaaaaa

SEQ ID NO: 2031306 - RNA, 19 nt, Human herpesvirus 5
ggucguuguccuccucguc

SEQ ID NO: 2031307 - RNA, 23 nt, Human herpesvirus 5
cuguuacugaaucuucuuuucau

SEQ ID NO: 2031308 - RNA, 13 nt, Human herpesvirus 5
gcgcuggcucgcg

SEQ ID NO: 2031309 - RNA, 18 nt, Human herpesvirus 5
uggggucaaaagccuggg

SEQ ID NO: 2031310 - RNA, 22 nt, Human herpesvirus 5
aguguauuggcauauagccaau

SEQ ID NO: 2031311 - RNA, 21 nt, Human herpesvirus 5
uagacgauuuuaugcgccgcc

SEQ ID NO: 2031312 - RNA, 22 nt, Human herpesvirus 5
cgggaggacucagagccacuga

SEQ ID NO: 2031313 - RNA, 16 nt, Human herpesvirus 5
ggcacgcgcgucggcc

SEQ ID NO: 2031314 - RNA, 15 nt, Human herpesvirus 5
gacuuugauguaguu

SEQ ID NO: 2031315 - RNA, 13 nt, Human herpesvirus 5
gcggcgccgacuc

SEQ ID NO: 2031316 - RNA, 14 nt, Human herpesvirus 5
ugcucgaccaggag

SEQ ID NO: 2031317 - RNA, 16 nt, Human herpesvirus 5
guucuggucgggcgug

SEQ ID NO: 2031318 - RNA, 17 nt, Human herpesvirus 5
gcgucccuggggcugcu

SEQ ID NO: 2031319 - RNA, 21 nt, Human herpesvirus 5
ggcguuucguccggaggagcg

SEQ ID NO: 2031320 - RNA, 14 nt, Human herpesvirus 5
ggaggaugacgaua

SEQ ID NO: 2031321 - RNA, 14 nt, Human herpesvirus 5
cacuuuaggcggcg

SEQ ID NO: 2031322 - RNA, 12 nt, Human herpesvirus 5
agcagcucuuuu

SEQ ID NO: 2031323 - RNA, 19 nt, Human herpesvirus 5
aacacagacaggcggccag

SEQ ID NO: 2031324 - RNA, 17 nt, Human herpesvirus 5
uggucauguucucccag

SEQ ID NO: 2031325 - RNA, 20 nt, Human herpesvirus 5
ggaaggcggcucgcuggaag

SEQ ID NO: 2031326 - RNA, 23 nt, Human herpesvirus 5
gcgaaagcuucggccggcugcug

SEQ ID NO: 2031327 - RNA, 13 nt, Human herpesvirus 5
ucccccugaucug

SEQ ID NO: 2031328 - RNA, 13 nt, Human herpesvirus 5
ccgccuccacugc

SEQ ID NO: 2031329 - RNA, 14 nt, Human herpesvirus 5
aggaaggaaaaaac

SEQ ID NO: 2031330 - RNA, 16 nt, Human herpesvirus 5
uugagcacaaacugcg

SEQ ID NO: 2031331 - RNA, 18 nt, Human herpesvirus 5
aaugauauuuuacaggua

SEQ ID NO: 2031332 - RNA, 20 nt, Human herpesvirus 5
gacggugaugcguguggccg

SEQ ID NO: 2031333 - RNA, 17 nt, Human herpesvirus 5
gaacgggugggcugggg

SEQ ID NO: 2031334 - RNA, 13 nt, Human herpesvirus 5
ucccugccagucu

SEQ ID NO: 2031335 - RNA, 14 nt, Human herpesvirus 5
caccuacgagcagg

SEQ ID NO: 2031336 - RNA, 18 nt, Human herpesvirus 5
cguaguuguugcagaagu

SEQ ID NO: 2031337 - RNA, 15 nt, Human herpesvirus 5
cuaccagcccaggga

SEQ ID NO: 2031338 - RNA, 17 nt, Human herpesvirus 5
guuggcuuacugccugc

SEQ ID NO: 2031339 - RNA, 16 nt, Human herpesvirus 5
uuugcauccuccucau

SEQ ID NO: 2031340 - RNA, 15 nt, Human herpesvirus 5
uccccuaacgucacu

SEQ ID NO: 2031341 - RNA, 17 nt, Human herpesvirus 5
gccuggacgccugggcg

SEQ ID NO: 2031342 - RNA, 13 nt, Human herpesvirus 5
accguaaagagag

SEQ ID NO: 2031343 - RNA, 18 nt, Human herpesvirus 5
acgaccuggccuguggug

SEQ ID NO: 2031344 - RNA, 21 nt, Human herpesvirus 5
cggccaacaugcccagcaucu

SEQ ID NO: 2031345 - RNA, 19 nt, Human herpesvirus 5
aaacaggaaaggaauacaa

SEQ ID NO: 2031346 - RNA, 15 nt, Human herpesvirus 5
gguaggugcgccgca

SEQ ID NO: 2031347 - RNA, 13 nt, Human herpesvirus 5
acggucugcuugc

SEQ ID NO: 2031348 - RNA, 22 nt, Human herpesvirus 5
ucgaccuugagcgacagcagca

SEQ ID NO: 2031349 - RNA, 19 nt, Human herpesvirus 5
caccggcgccugcugcucg

SEQ ID NO: 2031350 - RNA, 17 nt, Human herpesvirus 5
cggcgugauugcaaagc

SEQ ID NO: 2031351 - RNA, 16 nt, Human herpesvirus 5
ggucgggcguguggua

SEQ ID NO: 2031352 - RNA, 21 nt, Human herpesvirus 5
ggaggugcuggcggccguggc

SEQ ID NO: 2031353 - RNA, 12 nt, Human herpesvirus 5
gguuuggccgug

SEQ ID NO: 2031354 - RNA, 16 nt, Human herpesvirus 5
ccgugcucgugcccau

SEQ ID NO: 2031355 - RNA, 14 nt, Human herpesvirus 5
gcuacgugcgcgcc

SEQ ID NO: 2031356 - RNA, 22 nt, Human herpesvirus 5
guuagcgccgcggcaccagaga

SEQ ID NO: 2031357 - RNA, 23 nt, Human herpesvirus 5
acgcggaugagcgugcugcucug

SEQ ID NO: 2031358 - RNA, 12 nt, Human herpesvirus 5
gcgugcuccacc

SEQ ID NO: 2031359 - RNA, 18 nt, Human herpesvirus 5
gagcguguggaggacggg

SEQ ID NO: 2031360 - RNA, 14 nt, Human herpesvirus 5
ucgucuccacguag

SEQ ID NO: 2031361 - RNA, 13 nt, Human herpesvirus 5
gccgacgcuggcg

SEQ ID NO: 2031362 - RNA, 19 nt, Human herpesvirus 5
cgucgggggggacuuggcu

SEQ ID NO: 2031363 - RNA, 12 nt, Human herpesvirus 5
gggucugugccc

SEQ ID NO: 2031364 - RNA, 20 nt, Human herpesvirus 5
cagaggucgccgcugauacu

SEQ ID NO: 2031365 - RNA, 13 nt, Human herpesvirus 5
auccggcggcgcc

SEQ ID NO: 2031366 - RNA, 21 nt, Human herpesvirus 5
aucagccgugagaacuuugua

SEQ ID NO: 2031367 - RNA, 16 nt, Human herpesvirus 5
accucagucaccgagu

SEQ ID NO: 2031368 - RNA, 20 nt, Human herpesvirus 5
auggcgacggacgucgggac

SEQ ID NO: 2031369 - RNA, 18 nt, Human herpesvirus 5
caggaggcugugcgcgcc

SEQ ID NO: 2031370 - RNA, 15 nt, Human herpesvirus 5
cugacgugaggcgcu

SEQ ID NO: 2031371 - RNA, 20 nt, Human herpesvirus 5
cgugagcagcgugcaccugc

SEQ ID NO: 2031372 - RNA, 19 nt, Human herpesvirus 5
caugcugugggcccacugc

SEQ ID NO: 2031373 - RNA, 16 nt, Human herpesvirus 5
agcgugcaccugcugc

SEQ ID NO: 2031374 - RNA, 17 nt, Human herpesvirus 5
auacuggaagcugcugg

SEQ ID NO: 2031375 - RNA, 13 nt, Human herpesvirus 5
gacuggagagacu

SEQ ID NO: 2031376 - RNA, 18 nt, Human herpesvirus 5
uacucguguuuuuuauuc

SEQ ID NO: 2031377 - RNA, 15 nt, Human herpesvirus 5
guacggccucugggc

SEQ ID NO: 2031378 - RNA, 18 nt, Human herpesvirus 5
ggugcgcugcagccggag

SEQ ID NO: 2031379 - RNA, 22 nt, Human herpesvirus 5
ccgucaucggcacgugcucuuu

SEQ ID NO: 2031380 - RNA, 15 nt, Human herpesvirus 5
cuacgugcaacgcca

SEQ ID NO: 2031381 - RNA, 20 nt, Human herpesvirus 5
cgcaacuucugucucggcac

SEQ ID NO: 2031382 - RNA, 23 nt, Human herpesvirus 5
cgcgguggcggccgcagaaggcc

SEQ ID NO: 2031383 - RNA, 17 nt, Human herpesvirus 5
ugcgccguuuugcuguc

SEQ ID NO: 2031384 - RNA, 18 nt, Human herpesvirus 5
cgcacuggacgacgucaa

SEQ ID NO: 2031385 - RNA, 15 nt, Human herpesvirus 5
cauggccaaugcaua

SEQ ID NO: 2031386 - RNA, 19 nt, Human herpesvirus 5
cgcaucacccgccucaugg

SEQ ID NO: 2031387 - RNA, 15 nt, Human herpesvirus 5
cagucagagagucug

SEQ ID NO: 2031388 - RNA, 18 nt, Human herpesvirus 5
aagaaucuaggaacacug

SEQ ID NO: 2031389 - RNA, 23 nt, Human herpesvirus 5
gcgaccgccucaaaaagcaggug

SEQ ID NO: 2031390 - RNA, 14 nt, Human herpesvirus 5
auggggugugguga

SEQ ID NO: 2031391 - RNA, 17 nt, Human herpesvirus 5
ccgacccccaccagcgu

SEQ ID NO: 2031392 - RNA, 19 nt, Human herpesvirus 5
ucuccucuaccccgccgcc

SEQ ID NO: 2031393 - RNA, 20 nt, Human herpesvirus 5
caccagcgucgcgguuacua

SEQ ID NO: 2031394 - RNA, 20 nt, Human herpesvirus 5
cauccuuuucaugcucauac

SEQ ID NO: 2031395 - RNA, 20 nt, Human herpesvirus 5
ccaguuggccacgaccacga

SEQ ID NO: 2031396 - RNA, 18 nt, Human herpesvirus 5
ucccgcuuguuggccacc

SEQ ID NO: 2031397 - RNA, 15 nt, Human herpesvirus 5
gugggcuacuuugac

SEQ ID NO: 2031398 - RNA, 11 nt, Human herpesvirus 5
uuuccacgcca

SEQ ID NO: 2031399 - RNA, 19 nt, Human herpesvirus 5
gauccuuggaagagggaag

SEQ ID NO: 2031400 - RNA, 14 nt, Human herpesvirus 5
ccgucggcgccgcc

SEQ ID NO: 2031401 - RNA, 20 nt, Human herpesvirus 5
cagaaucuauaaauugcucu

SEQ ID NO: 2031402 - RNA, 11 nt, Human herpesvirus 5
cacacggcuaa

SEQ ID NO: 2031403 - RNA, 18 nt, Human herpesvirus 5
aucugcucccgcugcugc

SEQ ID NO: 2031404 - RNA, 23 nt, Human herpesvirus 5
auaauagauuagcagaaggaaua

SEQ ID NO: 2031405 - RNA, 12 nt, Human herpesvirus 5
cgagcgacgcgg

SEQ ID NO: 2031406 - RNA, 20 nt, Human herpesvirus 5
cgucacucuuggcacgggga

SEQ ID NO: 2031407 - RNA, 14 nt, Human herpesvirus 5
guagaacugaguuu

SEQ ID NO: 2031408 - RNA, 17 nt, Human herpesvirus 5
cgcaggcaagccaaacc

SEQ ID NO: 2031409 - RNA, 22 nt, Human herpesvirus 5
gcgucccaccccccgggccacc

SEQ ID NO: 2031410 - RNA, 14 nt, Human herpesvirus 5
cuuaucugggugca

SEQ ID NO: 2031411 - RNA, 13 nt, Human herpesvirus 5
cuucgcgaggucu

SEQ ID NO: 2031412 - RNA, 20 nt, Human herpesvirus 5
uccgcgucggucgccgccuc

SEQ ID NO: 2031413 - RNA, 19 nt, Human herpesvirus 5
cggccuuauguggcugcgc

SEQ ID NO: 2031414 - RNA, 12 nt, Human herpesvirus 5
aacucuuucccc

SEQ ID NO: 2031415 - RNA, 15 nt, Human herpesvirus 5
aaaaagugcgucaaa

SEQ ID NO: 2031416 - RNA, 14 nt, Human herpesvirus 5
gcggccguggccug

SEQ ID NO: 2031417 - RNA, 17 nt, Human herpesvirus 5
ccaccccccgggccacc

SEQ ID NO: 2031418 - RNA, 14 nt, Human herpesvirus 5
accaucgugccgcu

SEQ ID NO: 2031419 - RNA, 19 nt, Human herpesvirus 5
uuuggcucuuuccugugca

SEQ ID NO: 2031420 - RNA, 18 nt, Human herpesvirus 5
gaggucguggaggcagcg

SEQ ID NO: 2031421 - RNA, 22 nt, Human herpesvirus 5
cuacggaguuuucccucagccu

SEQ ID NO: 2031422 - RNA, 21 nt, Human herpesvirus 5
gugguguugccuucugcugcc

SEQ ID NO: 2031423 - RNA, 17 nt, Human herpesvirus 5
cuugcaaacgguacgca

SEQ ID NO: 2031424 - RNA, 19 nt, Human herpesvirus 5
gcgaagcugcgcaggccgc

SEQ ID NO: 2031425 - RNA, 15 nt, Human herpesvirus 5
agguguaguuuuguu

SEQ ID NO: 2031426 - RNA, 17 nt, Human herpesvirus 5
gcccugucugcagccgg

SEQ ID NO: 2031427 - RNA, 18 nt, Human herpesvirus 5
aacgugccacgugacuca

SEQ ID NO: 2031428 - RNA, 17 nt, Human herpesvirus 5
agagacaccaauugcuu

SEQ ID NO: 2031429 - RNA, 18 nt, Human herpesvirus 5
uacgcgcuggaggcccug

SEQ ID NO: 2031430 - RNA, 20 nt, Human herpesvirus 5
cugcugagacugagacuggu

SEQ ID NO: 2031431 - RNA, 22 nt, Human herpesvirus 5
ugacaguauuaacgugugguga

SEQ ID NO: 2031432 - RNA, 17 nt, Human herpesvirus 5
gcaggucacacugggag

SEQ ID NO: 2031433 - RNA, 14 nt, Human herpesvirus 5
gugccugcacgacc

SEQ ID NO: 2031434 - RNA, 18 nt, Human herpesvirus 5
cgguggucggcugccgcc

SEQ ID NO: 2031435 - RNA, 14 nt, Human herpesvirus 5
uacauauacgugau

SEQ ID NO: 2031436 - RNA, 13 nt, Human herpesvirus 5
cgcagugggccca

SEQ ID NO: 2031437 - RNA, 14 nt, Human herpesvirus 5
cggcgguccuccag

SEQ ID NO: 2031438 - RNA, 23 nt, Human herpesvirus 5
cagcggcggcgguggugacuggg

SEQ ID NO: 2031439 - RNA, 12 nt, Human herpesvirus 5
uaugcgccgcca

SEQ ID NO: 2031440 - RNA, 13 nt, Human herpesvirus 5
uccgugccagcug

SEQ ID NO: 2031441 - RNA, 12 nt, Human herpesvirus 5
gucucaucacau

SEQ ID NO: 2031442 - RNA, 16 nt, Human herpesvirus 5
ggaauacccagcuggg

SEQ ID NO: 2031443 - RNA, 15 nt, Human herpesvirus 5
uggaaaucccucacc

SEQ ID NO: 2031444 - RNA, 18 nt, Human herpesvirus 5
gcgcuucuggucgguuuu

SEQ ID NO: 2031445 - RNA, 14 nt, Human herpesvirus 5
cggccgaccccgcc

SEQ ID NO: 2031446 - RNA, 16 nt, Human herpesvirus 5
ucgacacuaauuuauc

SEQ ID NO: 2031447 - RNA, 14 nt, Human herpesvirus 5
ccgacgaagaagaa

SEQ ID NO: 2031448 - RNA, 18 nt, Human herpesvirus 5
guccgucgaucgaccguu

SEQ ID NO: 2031449 - RNA, 22 nt, Human herpesvirus 5
ugacgcacuuuuuuuacuagua

SEQ ID NO: 2031450 - RNA, 12 nt, Human herpesvirus 5
cgauccuuggaa

SEQ ID NO: 2031451 - RNA, 15 nt, Human herpesvirus 5
cucuacgagcugggc

SEQ ID NO: 2031452 - RNA, 18 nt, Human herpesvirus 5
aggccgcaaagcuggaca

SEQ ID NO: 2031453 - RNA, 15 nt, Human herpesvirus 5
gucuuugucauaccc

SEQ ID NO: 2031454 - RNA, 22 nt, Human herpesvirus 5
uacauucgccgcaaugggcuuc

SEQ ID NO: 2031455 - RNA, 13 nt, Human herpesvirus 5
cuucggagguccu

SEQ ID NO: 2031456 - RNA, 15 nt, Human herpesvirus 5
gagcugcgcgucacc

SEQ ID NO: 2031457 - RNA, 11 nt, Human herpesvirus 5
augcaggaggu

SEQ ID NO: 2031458 - RNA, 21 nt, Human herpesvirus 5
cgccacggugcuuuucaucua

SEQ ID NO: 2031459 - RNA, 17 nt, Human herpesvirus 5
ccaagagacccggcugg

SEQ ID NO: 2031460 - RNA, 19 nt, Human herpesvirus 5
gacgugcgaccuggacggc

SEQ ID NO: 2031461 - RNA, 18 nt, Human herpesvirus 5
cggaggcgggguguuuuu

SEQ ID NO: 2031462 - RNA, 20 nt, Human herpesvirus 5
cacccguacgcgcaggcagc

SEQ ID NO: 2031463 - RNA, 13 nt, Human herpesvirus 5
gguaacguggacg

SEQ ID NO: 2031464 - RNA, 22 nt, Human herpesvirus 5
cgggcucaccgcaguugcugcc

SEQ ID NO: 2031465 - RNA, 12 nt, Human herpesvirus 5
gcaaacucccac

SEQ ID NO: 2031466 - RNA, 18 nt, Human herpesvirus 5
ucuaccagcccagggauc

SEQ ID NO: 2031467 - RNA, 16 nt, Human herpesvirus 5
cggccgucgcaagggc

SEQ ID NO: 2031468 - RNA, 22 nt, Human herpesvirus 5
cugccaacgccgucaaggccgc

SEQ ID NO: 2031469 - RNA, 15 nt, Human herpesvirus 5
ggcgccgggacucug

SEQ ID NO: 2031470 - RNA, 20 nt, Human herpesvirus 5
cgagagguagccaacagcag

SEQ ID NO: 2031471 - RNA, 18 nt, Human herpesvirus 5
gaauacccagcuggggaa

SEQ ID NO: 2031472 - RNA, 20 nt, Human herpesvirus 5
ucgcaucaucaacagcagca

SEQ ID NO: 2031473 - RNA, 11 nt, Human herpesvirus 5
cgauccuugga

SEQ ID NO: 2031474 - RNA, 15 nt, Human herpesvirus 5
cgcguccgaccggga

SEQ ID NO: 2031475 - RNA, 19 nt, Human herpesvirus 5
agcuggggaaguacaauau

SEQ ID NO: 2031476 - RNA, 20 nt, Human herpesvirus 5
guugggaccgcagcguggcc

SEQ ID NO: 2031477 - RNA, 21 nt, Human herpesvirus 5
caugaaguuguugaucugcug

SEQ ID NO: 2031478 - RNA, 16 nt, Human herpesvirus 5
cgccggcguugccgcc

SEQ ID NO: 2031479 - RNA, 23 nt, Human herpesvirus 5
cucgcguguuuugucugagcgcc

SEQ ID NO: 2031480 - RNA, 14 nt, Human herpesvirus 5
gacgacgcgccccc

SEQ ID NO: 2031481 - RNA, 18 nt, Human herpesvirus 5
gcuucggccggcugcugc

SEQ ID NO: 2031482 - RNA, 18 nt, Human herpesvirus 5
agcggccgugguggccgu

SEQ ID NO: 2031483 - RNA, 17 nt, Human herpesvirus 5
acgagcaucgcaacaac

SEQ ID NO: 2031484 - RNA, 10 nt, Human herpesvirus 5
guacugaagc

SEQ ID NO: 2031485 - RNA, 17 nt, Human herpesvirus 5
cacggacacgacaaaug

SEQ ID NO: 2031486 - RNA, 23 nt, Human herpesvirus 5
ccuggggcugcugcugcacgggc

SEQ ID NO: 2031487 - RNA, 16 nt, Human herpesvirus 5
cuccuguugcucuccu

SEQ ID NO: 2031488 - RNA, 15 nt, Human herpesvirus 5
aguggcgccccggcu

SEQ ID NO: 2031489 - RNA, 17 nt, Human herpesvirus 5
gacguaaauccagaccu

SEQ ID NO: 2031490 - RNA, 23 nt, Human herpesvirus 5
acuauuuuuuguaacacuacagc

SEQ ID NO: 2031491 - RNA, 12 nt, Human herpesvirus 5
ucuucuaccugg

SEQ ID NO: 2031492 - RNA, 13 nt, Human herpesvirus 5
aggccuccucucc

SEQ ID NO: 2031493 - RNA, 19 nt, Human herpesvirus 5
cggccgcagugggcccacg

SEQ ID NO: 2031494 - RNA, 14 nt, Human herpesvirus 5
cagacaccaagcau

SEQ ID NO: 2031495 - RNA, 23 nt, Human herpesvirus 5
gcuuuagccaggugaccagcagu

SEQ ID NO: 2031496 - RNA, 13 nt, Human herpesvirus 5
ccugcgcagcgcg

SEQ ID NO: 2031497 - RNA, 15 nt, Human herpesvirus 5
gaugucaacacugac

SEQ ID NO: 2031498 - RNA, 18 nt, Human herpesvirus 5
agcgucagaagacgagcu

SEQ ID NO: 2031499 - RNA, 14 nt, Human herpesvirus 5
caaaaaaacauggg

SEQ ID NO: 2031500 - RNA, 13 nt, Human herpesvirus 5
gcugaugugccag

SEQ ID NO: 2031501 - RNA, 17 nt, Human herpesvirus 5
acgcucgcucugacgcc

SEQ ID NO: 2031502 - RNA, 15 nt, Human herpesvirus 5
gguggcggcggugga

SEQ ID NO: 2031503 - RNA, 14 nt, Human herpesvirus 5
agccgccgccucca

SEQ ID NO: 2031504 - RNA, 18 nt, Human herpesvirus 5
ggcgccugguugcugccg

SEQ ID NO: 2031505 - RNA, 15 nt, Human herpesvirus 5
aauacuggacuuuug

SEQ ID NO: 2031506 - RNA, 15 nt, Human herpesvirus 5
acguugggaagacgg

SEQ ID NO: 2031507 - RNA, 13 nt, Human herpesvirus 5
cacgccgccguga

SEQ ID NO: 2031508 - RNA, 16 nt, Human herpesvirus 5
auccuggccaccaugu

SEQ ID NO: 2031509 - RNA, 16 nt, Human herpesvirus 5
gccuuccgcgugcucc

SEQ ID NO: 2031510 - RNA, 23 nt, Human herpesvirus 5
auuuacuacuucgauucucuaua

SEQ ID NO: 2031511 - RNA, 16 nt, Human herpesvirus 5
uugugccucugaaagc

SEQ ID NO: 2031512 - RNA, 19 nt, Human herpesvirus 5
cauggucggugacaucacc

SEQ ID NO: 2031513 - RNA, 16 nt, Human herpesvirus 5
cuaucuguguccgccc

SEQ ID NO: 2031514 - RNA, 15 nt, Human herpesvirus 5
ugcccugugggccca

SEQ ID NO: 2031515 - RNA, 22 nt, Human herpesvirus 5
cucggaucugcggcucaaacac

SEQ ID NO: 2031516 - RNA, 16 nt, Human herpesvirus 5
cacggccuuauguggc

SEQ ID NO: 2031517 - RNA, 13 nt, Human herpesvirus 5
agggacgagcagc

SEQ ID NO: 2031518 - RNA, 15 nt, Human herpesvirus 5
gccaucuagacucac

SEQ ID NO: 2031519 - RNA, 23 nt, Human herpesvirus 5
gggccucggcgugcucaggccac

SEQ ID NO: 2031520 - RNA, 20 nt, Human herpesvirus 5
caguaccuggacgcggugaa

SEQ ID NO: 2031521 - RNA, 17 nt, Human herpesvirus 5
ggcgcuguacggcagcg

SEQ ID NO: 2031522 - RNA, 19 nt, Human herpesvirus 5
ucuuauaaggaggcaaaua

SEQ ID NO: 2031523 - RNA, 23 nt, Human herpesvirus 5
ucuugucgucauucgggccagga

SEQ ID NO: 2031524 - RNA, 19 nt, Human herpesvirus 5
caggaacacgguggcuuuc

SEQ ID NO: 2031525 - RNA, 15 nt, Human herpesvirus 5
caaccguauauucua

SEQ ID NO: 2031526 - RNA, 14 nt, Human herpesvirus 5
cuccgucacgccuc

SEQ ID NO: 2031527 - RNA, 15 nt, Human herpesvirus 5
gcuaggauaaucaua

SEQ ID NO: 2031528 - RNA, 22 nt, Human herpesvirus 5
cuuucaugaugacggugaggag

SEQ ID NO: 2031529 - RNA, 16 nt, Human herpesvirus 5
uaccacgguaauugcg

SEQ ID NO: 2031530 - RNA, 19 nt, Human herpesvirus 5
acgacuguucgucgagcac

SEQ ID NO: 2031531 - RNA, 15 nt, Human herpesvirus 5
gacauccgucagccu

SEQ ID NO: 2031532 - RNA, 13 nt, Human herpesvirus 5
gcuacaccugaga

SEQ ID NO: 2031533 - RNA, 18 nt, Human herpesvirus 5
cucugcaacgccuggcgu

SEQ ID NO: 2031534 - RNA, 19 nt, Human herpesvirus 5
ggugguuuaugaugaaacc

SEQ ID NO: 2031535 - RNA, 15 nt, Human herpesvirus 5
cagugaguacacgca

SEQ ID NO: 2031536 - RNA, 20 nt, Human herpesvirus 5
cgucguuucccccacccgcc

SEQ ID NO: 2031537 - RNA, 12 nt, Human herpesvirus 5
gcggugguaagu

SEQ ID NO: 2031538 - RNA, 20 nt, Human herpesvirus 5
gccacauuggugaaggccgu

SEQ ID NO: 2031539 - RNA, 17 nt, Human herpesvirus 5
gaucggccgcggugcgc

SEQ ID NO: 2031540 - RNA, 22 nt, Human herpesvirus 5
gcagauucaguaaccuggagca

SEQ ID NO: 2031541 - RNA, 20 nt, Human herpesvirus 5
ucaccaccaucagcaaagcu

SEQ ID NO: 2031542 - RNA, 22 nt, Human herpesvirus 5
gcagcggggagaaaaguggcag

SEQ ID NO: 2031543 - RNA, 16 nt, Human herpesvirus 5
ugauaaccuaccuggu

SEQ ID NO: 2031544 - RNA, 15 nt, Human herpesvirus 5
acguaggccuccucu

SEQ ID NO: 2031545 - RNA, 16 nt, Human herpesvirus 5
caggguaaaaaccacg

SEQ ID NO: 2031546 - RNA, 23 nt, Human herpesvirus 5
ucggcguggucaacgcuuuggaa

SEQ ID NO: 2031547 - RNA, 17 nt, Human herpesvirus 5
auuggugaaggccgugg

SEQ ID NO: 2031548 - RNA, 11 nt, Human herpesvirus 5
uagagaggcug

SEQ ID NO: 2031549 - RNA, 13 nt, Human herpesvirus 5
agaccgccgccgc

SEQ ID NO: 2031550 - RNA, 21 nt, Human herpesvirus 5
accuacgucaaagcggucuca

SEQ ID NO: 2031551 - RNA, 22 nt, Human herpesvirus 5
cagggacagugcgccaacggca

SEQ ID NO: 2031552 - RNA, 14 nt, Human herpesvirus 5
gcagaacccgguug

SEQ ID NO: 2031553 - RNA, 16 nt, Human herpesvirus 5
accccucgcugggcua

SEQ ID NO: 2031554 - RNA, 13 nt, Human herpesvirus 5
aaacucuauggac

SEQ ID NO: 2031555 - RNA, 21 nt, Human herpesvirus 5
auaaaaaccauugagaaagcu

SEQ ID NO: 2031556 - RNA, 22 nt, Human herpesvirus 5
aggagauuauccguaucugcau

SEQ ID NO: 2031557 - RNA, 21 nt, Human herpesvirus 5
ggcucacgucacuacucuggg

SEQ ID NO: 2031558 - RNA, 18 nt, Human herpesvirus 5
ccuggaagcguguguggg

SEQ ID NO: 2031559 - RNA, 16 nt, Human herpesvirus 5
ggugccgccgcugccg

SEQ ID NO: 2031560 - RNA, 22 nt, Human herpesvirus 5
guccaagcgcguccuguuucau

SEQ ID NO: 2031561 - RNA, 12 nt, Human herpesvirus 5
cggcguggucaa

SEQ ID NO: 2031562 - RNA, 16 nt, Human herpesvirus 5
cgccgucucccucugc

SEQ ID NO: 2031563 - RNA, 19 nt, Human herpesvirus 5
ccuacgugcaacgccacca

SEQ ID NO: 2031564 - RNA, 15 nt, Human herpesvirus 5
caguauuccccgcug

SEQ ID NO: 2031565 - RNA, 22 nt, Human herpesvirus 5
ugaauaacaccaaaaauccaga

SEQ ID NO: 2031566 - RNA, 13 nt, Human herpesvirus 5
gaugaacuguucc

SEQ ID NO: 2031567 - RNA, 15 nt, Human herpesvirus 5
uccuguugcucuccu

SEQ ID NO: 2031568 - RNA, 15 nt, Human herpesvirus 5
cuagacagauucauc

SEQ ID NO: 2031569 - RNA, 16 nt, Human herpesvirus 5
gugccgaauacaaaag

SEQ ID NO: 2031570 - RNA, 14 nt, Human herpesvirus 5
caaggccgccgccg

SEQ ID NO: 2031571 - RNA, 22 nt, Human herpesvirus 5
cugcggcggcgcgaccuucccu

SEQ ID NO: 2031572 - RNA, 16 nt, Human herpesvirus 5
gcgacguaccagcugu

SEQ ID NO: 2031573 - RNA, 22 nt, Human herpesvirus 5
ugcccgggggugacaaggaagc

SEQ ID NO: 2031574 - RNA, 13 nt, Human herpesvirus 5
ccgaggaucuggc

SEQ ID NO: 2031575 - RNA, 22 nt, Human herpesvirus 5
cacgucgaccaggugcugucgc

SEQ ID NO: 2031576 - RNA, 19 nt, Human herpesvirus 5
gcucgggucggcuggucgg

SEQ ID NO: 2031577 - RNA, 17 nt, Human herpesvirus 5
cagcucgcgcuggcuuu

SEQ ID NO: 2031578 - RNA, 14 nt, Human herpesvirus 5
cacccgacugcagc

SEQ ID NO: 2031579 - RNA, 13 nt, Human herpesvirus 5
ugcccgucggcug

SEQ ID NO: 2031580 - RNA, 20 nt, Human herpesvirus 5
aucucacaccgucagcugcg

SEQ ID NO: 2031581 - RNA, 14 nt, Human herpesvirus 5
cagcgccagcggcc

SEQ ID NO: 2031582 - RNA, 19 nt, Human herpesvirus 5
gaggugugaggaugaaaca

SEQ ID NO: 2031583 - RNA, 15 nt, Human herpesvirus 5
ccuccugcagcugca

SEQ ID NO: 2031584 - RNA, 23 nt, Human herpesvirus 5
aucauggaagagggcgcgcgucu

SEQ ID NO: 2031585 - RNA, 12 nt, Human herpesvirus 5
cuccuccucccu

SEQ ID NO: 2031586 - RNA, 16 nt, Human herpesvirus 5
gacaaccugcugcacu

SEQ ID NO: 2031587 - RNA, 20 nt, Human herpesvirus 5
ccucagcuugcccgaccacg

SEQ ID NO: 2031588 - RNA, 18 nt, Human herpesvirus 5
gcaauaaucccuguaauu

SEQ ID NO: 2031589 - RNA, 15 nt, Human herpesvirus 5
ugacgcggucgccgc

SEQ ID NO: 2031590 - RNA, 16 nt, Human herpesvirus 5
uguugagaacauauau

SEQ ID NO: 2031591 - RNA, 10 nt, Human herpesvirus 5
acacuacagc

SEQ ID NO: 2031592 - RNA, 22 nt, Human herpesvirus 5
gacagcugcaauccgguaacgu

SEQ ID NO: 2031593 - RNA, 23 nt, Human herpesvirus 5
auuuugggucagcggcacgccgc

SEQ ID NO: 2031594 - RNA, 15 nt, Human herpesvirus 5
gcagcaacagccccg

SEQ ID NO: 2031595 - RNA, 23 nt, Human herpesvirus 5
gcaacggccguuaucaaggccac

SEQ ID NO: 2031596 - RNA, 16 nt, Human herpesvirus 5
ccgagcuugugcuucu

SEQ ID NO: 2031597 - RNA, 19 nt, Human herpesvirus 5
gucuaguucgcuucucacu

SEQ ID NO: 2031598 - RNA, 20 nt, Human herpesvirus 5
gcgcgccuaccugacgccga

SEQ ID NO: 2031599 - RNA, 16 nt, Human herpesvirus 5
cucuggcccugcugua

SEQ ID NO: 2031600 - RNA, 20 nt, Human herpesvirus 5
acgugauuauacaacaggug

SEQ ID NO: 2031601 - RNA, 17 nt, Human herpesvirus 5
aacuucugucucggcac

SEQ ID NO: 2031602 - RNA, 12 nt, Human herpesvirus 5
cccaccgccucc

SEQ ID NO: 2031603 - RNA, 15 nt, Human herpesvirus 5
gcggcuuauguuucu

SEQ ID NO: 2031604 - RNA, 15 nt, Human herpesvirus 5
caccucgaugaagcc

SEQ ID NO: 2031605 - RNA, 19 nt, Human herpesvirus 5
uguauuuuuaucgggaaug

SEQ ID NO: 2031606 - RNA, 12 nt, Human herpesvirus 5
ugcuacagggag

SEQ ID NO: 2031607 - RNA, 14 nt, Human herpesvirus 5
guggaaggcaccgc

SEQ ID NO: 2031608 - RNA, 14 nt, Human herpesvirus 5
agccagacugcccu

SEQ ID NO: 2031609 - RNA, 15 nt, Human herpesvirus 5
cgaugaaccuucccc

SEQ ID NO: 2031610 - RNA, 16 nt, Human herpesvirus 5
caggucgcccaggcuc

SEQ ID NO: 2031611 - RNA, 21 nt, Human herpesvirus 5
ggcucgcaaagacgugccacg

SEQ ID NO: 2031612 - RNA, 18 nt, Human herpesvirus 5
ugcgcaucuacauccuua

SEQ ID NO: 2031613 - RNA, 13 nt, Human herpesvirus 5
gcgggcccugcug

SEQ ID NO: 2031614 - RNA, 17 nt, Human herpesvirus 5
ccaguagacagacagga

SEQ ID NO: 2031615 - RNA, 19 nt, Human herpesvirus 5
gccgcucaagccgcggugc

SEQ ID NO: 2031616 - RNA, 17 nt, Human herpesvirus 5
cagcuaucgugacuggg

SEQ ID NO: 2031617 - RNA, 15 nt, Human herpesvirus 5
gacacggugcugcug

SEQ ID NO: 2031618 - RNA, 22 nt, Human herpesvirus 5
agcaucgcaacaacagcaacaa

SEQ ID NO: 2031619 - RNA, 19 nt, Human herpesvirus 5
ugugguucaaccugaacau

SEQ ID NO: 2031620 - RNA, 16 nt, Human herpesvirus 5
cagcaagaguugcaac

SEQ ID NO: 2031621 - RNA, 16 nt, Human herpesvirus 5
auggucguugcccacg

SEQ ID NO: 2031622 - RNA, 16 nt, Human herpesvirus 5
aguaauguauacuucc

SEQ ID NO: 2031623 - RNA, 14 nt, Human herpesvirus 5
ucuguauauucagu

SEQ ID NO: 2031624 - RNA, 16 nt, Human herpesvirus 5
gcaccaugagaagaga

SEQ ID NO: 2031625 - RNA, 15 nt, Human herpesvirus 5
acgugauccaggagg

SEQ ID NO: 2031626 - RNA, 13 nt, Human herpesvirus 5
guuccugcgcgcc

SEQ ID NO: 2031627 - RNA, 16 nt, Human herpesvirus 5
cauuggagaacagugc

SEQ ID NO: 2031628 - RNA, 12 nt, Human herpesvirus 5
gauccaggaggu

SEQ ID NO: 2031629 - RNA, 19 nt, Human herpesvirus 5
agucuccgcaguuacacca

SEQ ID NO: 2031630 - RNA, 16 nt, Human herpesvirus 5
cguuaccgccucuguc

SEQ ID NO: 2031631 - RNA, 13 nt, Human herpesvirus 5
uccacggcgccgg

SEQ ID NO: 2031632 - RNA, 15 nt, Human herpesvirus 5
agccggggugccgcc

SEQ ID NO: 2031633 - RNA, 14 nt, Human herpesvirus 5
cggccggcugcugc

SEQ ID NO: 2031634 - RNA, 18 nt, Human herpesvirus 5
ugaaaccuaccugggcug

SEQ ID NO: 2031635 - RNA, 20 nt, Human herpesvirus 5
agguuguugccgcuggacug

SEQ ID NO: 2031636 - RNA, 17 nt, Human herpesvirus 5
ggcguucggacgaccuc

SEQ ID NO: 2031637 - RNA, 15 nt, Human herpesvirus 5
ucccggccuugcugu

SEQ ID NO: 2031638 - RNA, 14 nt, Human herpesvirus 5
ucggaugaggcagg

SEQ ID NO: 2031639 - RNA, 21 nt, Human herpesvirus 5
ggcucaccgcaguugcugccu

SEQ ID NO: 2031640 - RNA, 23 nt, Human herpesvirus 5
cugcgagaggaagucgaucugga

SEQ ID NO: 2031641 - RNA, 21 nt, Human herpesvirus 5
acggaguuuucccucagccuc

SEQ ID NO: 2031642 - RNA, 23 nt, Human herpesvirus 5
gcagcacgcgauuggccagcacg

SEQ ID NO: 2031643 - RNA, 16 nt, Human herpesvirus 5
ggucugcgagaggaag

SEQ ID NO: 2031644 - RNA, 12 nt, Human herpesvirus 5
aauaaaaaccac

SEQ ID NO: 2031645 - RNA, 20 nt, Human herpesvirus 5
guagcaccggccccacgcug

SEQ ID NO: 2031646 - RNA, 16 nt, Human herpesvirus 5
uucgggccgacgucaa

SEQ ID NO: 2031647 - RNA, 19 nt, Human herpesvirus 5
gacuugggcgauucugugu

SEQ ID NO: 2031648 - RNA, 23 nt, Human herpesvirus 5
agucuagacaggguaacagccuu

SEQ ID NO: 2031649 - RNA, 16 nt, Human herpesvirus 5
gacaggaggcugugcg

SEQ ID NO: 2031650 - RNA, 20 nt, Human herpesvirus 5
gccaccgacauggagcccac

SEQ ID NO: 2031651 - RNA, 12 nt, Human herpesvirus 5
caacugcugccu

SEQ ID NO: 2031652 - RNA, 14 nt, Human herpesvirus 5
cacuggcugcgccg

SEQ ID NO: 2031653 - RNA, 23 nt, Human herpesvirus 5
agcgugcugugcuacgagaucag

SEQ ID NO: 2031654 - RNA, 12 nt, Human herpesvirus 5
cagcagcagcug

SEQ ID NO: 2031655 - RNA, 21 nt, Human herpesvirus 5
caacuuuggcgugcccagccc

SEQ ID NO: 2031656 - RNA, 23 nt, Human herpesvirus 5
uccguccucgucgccuuccagcu

SEQ ID NO: 2031657 - RNA, 18 nt, Human herpesvirus 5
caccucgugcgaggacaa

SEQ ID NO: 2031658 - RNA, 22 nt, Human herpesvirus 5
aaggggaaaaggaauagcaaga

SEQ ID NO: 2031659 - RNA, 15 nt, Human herpesvirus 5
aauucaauaaaaacc

SEQ ID NO: 2031660 - RNA, 16 nt, Human herpesvirus 5
cuccucugccugggca

SEQ ID NO: 2031661 - RNA, 22 nt, Human herpesvirus 5
gcaacagcagccaccgacacag

SEQ ID NO: 2031662 - RNA, 14 nt, Human herpesvirus 5
gcugcugcacgggc

SEQ ID NO: 2031663 - RNA, 15 nt, Human herpesvirus 5
caaaacgucaggaau

SEQ ID NO: 2031664 - RNA, 19 nt, Human herpesvirus 5
gcugagacaggacgaggca

SEQ ID NO: 2031665 - RNA, 23 nt, Human herpesvirus 5
aucuguucuuccaccagcuacuu

SEQ ID NO: 2031666 - RNA, 21 nt, Human herpesvirus 5
ccgcuuucucaucucagccuc

SEQ ID NO: 2031667 - RNA, 16 nt, Human herpesvirus 5
acucagagccacugau

SEQ ID NO: 2031668 - RNA, 13 nt, Human herpesvirus 5
gguggcugggcuc

SEQ ID NO: 2031669 - RNA, 12 nt, Human herpesvirus 5
cgcgagcugggc

SEQ ID NO: 2031670 - RNA, 17 nt, Human herpesvirus 5
gcagugggcccacggcu

SEQ ID NO: 2031671 - RNA, 20 nt, Human herpesvirus 5
gacaaggucguucuccucga

SEQ ID NO: 2031672 - RNA, 21 nt, Human herpesvirus 5
cgugcgccuuccaguccauac

SEQ ID NO: 2031673 - RNA, 14 nt, Human herpesvirus 5
caacaugcccagca

SEQ ID NO: 2031674 - RNA, 22 nt, Human herpesvirus 5
uauaggcuaagcuauaccauca

SEQ ID NO: 2031675 - RNA, 18 nt, Human herpesvirus 5
ucgagaacuacagcuucu

SEQ ID NO: 2031676 - RNA, 23 nt, Human herpesvirus 5
uugccgcaccgguuggagcagcu

SEQ ID NO: 2031677 - RNA, 16 nt, Human herpesvirus 5
ccgcuugcgcccgaga

SEQ ID NO: 2031678 - RNA, 16 nt, Human herpesvirus 5
cuaguaauaccaccgu

SEQ ID NO: 2031679 - RNA, 15 nt, Human herpesvirus 5
aagggagccccauca

SEQ ID NO: 2031680 - RNA, 18 nt, Human herpesvirus 5
ucuugcggcgccgacucc

SEQ ID NO: 2031681 - RNA, 15 nt, Human herpesvirus 5
gccgauggcugcccg

SEQ ID NO: 2031682 - RNA, 15 nt, Human herpesvirus 5
agguagguggccaug

SEQ ID NO: 2031683 - RNA, 17 nt, Human herpesvirus 5
ugacaacggcuggaaau

SEQ ID NO: 2031684 - RNA, 22 nt, Human herpesvirus 5
ugguacgcugacguggugcgcu

SEQ ID NO: 2031685 - RNA, 20 nt, Human herpesvirus 5
caucgaggaggccgcacugg

SEQ ID NO: 2031686 - RNA, 23 nt, Human herpesvirus 5
gggcuuuccggccaacaugccca

SEQ ID NO: 2031687 - RNA, 19 nt, Human herpesvirus 5
ugucucucgacguuucuga

SEQ ID NO: 2031688 - RNA, 22 nt, Human herpesvirus 5
ccugacaguuuaugagaaaagg

SEQ ID NO: 2031689 - RNA, 13 nt, Human herpesvirus 5
augauauaaagcg

SEQ ID NO: 2031690 - RNA, 19 nt, Human herpesvirus 5
gacauggagacaguuucca

SEQ ID NO: 2031691 - RNA, 15 nt, Human herpesvirus 5
cccaggacacauuuc

SEQ ID NO: 2031692 - RNA, 22 nt, Human herpesvirus 5
gacucgcugccgcagcugcugg

SEQ ID NO: 2031693 - RNA, 21 nt, Human herpesvirus 5
acggauaaccgcaaaggccac

SEQ ID NO: 2031694 - RNA, 18 nt, Human herpesvirus 5
cugcguucacgaggacca

SEQ ID NO: 2031695 - RNA, 17 nt, Human herpesvirus 5
gaaaguuggcugcgccc

SEQ ID NO: 2031696 - RNA, 20 nt, Human herpesvirus 5
caugauguacccgcuggugu

SEQ ID NO: 2031697 - RNA, 16 nt, Human herpesvirus 5
acuaccgugccaccug

SEQ ID NO: 2031698 - RNA, 16 nt, Human herpesvirus 5
uauugaaaucuaccug

SEQ ID NO: 2031699 - RNA, 18 nt, Human herpesvirus 5
uacacgcacgcugguuac

SEQ ID NO: 2031700 - RNA, 19 nt, Human herpesvirus 5
augucgcgacagagaggug

SEQ ID NO: 2031701 - RNA, 18 nt, Human herpesvirus 5
ugguuaccggucacugga

SEQ ID NO: 2031702 - RNA, 21 nt, Human herpesvirus 5
uaccuaugcgccguagguucu

SEQ ID NO: 2031703 - RNA, 15 nt, Human herpesvirus 5
ggaucgucaccacca

SEQ ID NO: 2031704 - RNA, 22 nt, Human herpesvirus 5
gcaccaucgugguagcgccgcg

SEQ ID NO: 2031705 - RNA, 13 nt, Human herpesvirus 5
ccaagucuugccg

SEQ ID NO: 2031706 - RNA, 20 nt, Human herpesvirus 5
cggcgcagacgucggcgguc

SEQ ID NO: 2031707 - RNA, 19 nt, Human herpesvirus 5
acaggggaucuauaaaugu

SEQ ID NO: 2031708 - RNA, 19 nt, Human herpesvirus 5
ggcucguguggcagcuggc

SEQ ID NO: 2031709 - RNA, 13 nt, Human herpesvirus 5
uaggcgggcugga

SEQ ID NO: 2031710 - RNA, 15 nt, Human herpesvirus 5
uuaagaggucacagg

SEQ ID NO: 2031711 - RNA, 16 nt, Human herpesvirus 5
ggcuacguacgacugc

SEQ ID NO: 2031712 - RNA, 14 nt, Human herpesvirus 5
ucacuaucuucaac

SEQ ID NO: 2031713 - RNA, 15 nt, Human herpesvirus 5
cugcugagacugaga

SEQ ID NO: 2031714 - RNA, 15 nt, Human herpesvirus 5
uuccuauugggaagg

SEQ ID NO: 2031715 - RNA, 20 nt, Human herpesvirus 5
cuguuagaaccgcgggccgc

SEQ ID NO: 2031716 - RNA, 20 nt, Human herpesvirus 5
gcgccuuuaagcuggaccug

SEQ ID NO: 2031717 - RNA, 22 nt, Human herpesvirus 5
ucaagaccgaugugugggaccu

SEQ ID NO: 2031718 - RNA, 19 nt, Human herpesvirus 5
ucguuguccucuccuccuu

SEQ ID NO: 2031719 - RNA, 23 nt, Human herpesvirus 5
cuacacgccuugcaccugggugg

SEQ ID NO: 2031720 - RNA, 17 nt, Human herpesvirus 5
acgggguuaaacuggau

SEQ ID NO: 2031721 - RNA, 13 nt, Human herpesvirus 5
gcaucaugugccu

SEQ ID NO: 2031722 - RNA, 19 nt, Human herpesvirus 5
cgcgccucacgcugcacga

SEQ ID NO: 2031723 - RNA, 13 nt, Human herpesvirus 5
aaucgucggcaga

SEQ ID NO: 2031724 - RNA, 21 nt, Human herpesvirus 5
cuggaggacgcgcuggcuguc

SEQ ID NO: 2031725 - RNA, 14 nt, Human herpesvirus 5
gcuuuuuugucccg

SEQ ID NO: 2031726 - RNA, 16 nt, Human herpesvirus 5
guucuuccaccagcua

SEQ ID NO: 2031727 - RNA, 13 nt, Human herpesvirus 5
ggcuccgccggca

SEQ ID NO: 2031728 - RNA, 17 nt, Human herpesvirus 5
gacaugauggaaaugcc

SEQ ID NO: 2031729 - RNA, 22 nt, Human herpesvirus 5
gccgcgacaacggccgccgcag

SEQ ID NO: 2031730 - RNA, 19 nt, Human herpesvirus 5
ucagaguaggugauccagu

SEQ ID NO: 2031731 - RNA, 17 nt, Human herpesvirus 5
cuccacgcucgagggcu

SEQ ID NO: 2031732 - RNA, 20 nt, Human herpesvirus 5
cgcuugcgcccgagacggcg

SEQ ID NO: 2031733 - RNA, 14 nt, Human herpesvirus 5
cuggggucaaaagc

SEQ ID NO: 2031734 - RNA, 16 nt, Human herpesvirus 5
gagugguggcggcagc

SEQ ID NO: 2031735 - RNA, 17 nt, Human herpesvirus 5
gcuggcuuuccucgggc

SEQ ID NO: 2031736 - RNA, 12 nt, Human herpesvirus 5
gcccccaccccc

SEQ ID NO: 2031737 - RNA, 16 nt, Human herpesvirus 5
aaguacacgccacacg

SEQ ID NO: 2031738 - RNA, 16 nt, Human herpesvirus 5
cgucggugcgcccauc

SEQ ID NO: 2031739 - RNA, 17 nt, Human herpesvirus 5
gcaacuucuucuacuca

SEQ ID NO: 2031740 - RNA, 17 nt, Human herpesvirus 5
guuccuguaaauaaaaa

SEQ ID NO: 2031741 - RNA, 17 nt, Human herpesvirus 5
ccgcaaugggcuucccu

SEQ ID NO: 2031742 - RNA, 22 nt, Human herpesvirus 5
aacgagacuaucuacaacacua

SEQ ID NO: 2031743 - RNA, 18 nt, Human herpesvirus 5
ccaaggaaccaccguagc

SEQ ID NO: 2031744 - RNA, 18 nt, Human herpesvirus 5
caccccgaacuggagcuc

SEQ ID NO: 2031745 - RNA, 19 nt, Human herpesvirus 5
acgguacgcagucacugcg

SEQ ID NO: 2031746 - RNA, 15 nt, Human herpesvirus 5
accggcgccugcugc

SEQ ID NO: 2031747 - RNA, 19 nt, Human herpesvirus 5
cgcgcaagugccugcacga

SEQ ID NO: 2031748 - RNA, 15 nt, Human herpesvirus 5
gguuauggcuccgcg

SEQ ID NO: 2031749 - RNA, 18 nt, Human herpesvirus 5
ccacguccacccaucccg

SEQ ID NO: 2031750 - RNA, 15 nt, Human herpesvirus 5
agagacagagaccgc

SEQ ID NO: 2031751 - RNA, 13 nt, Human herpesvirus 5
ccgcagcgguggc

SEQ ID NO: 2031752 - RNA, 18 nt, Human herpesvirus 5
guugacccagggcugcuc

SEQ ID NO: 2031753 - RNA, 13 nt, Human herpesvirus 5
cgucccuggggcu

SEQ ID NO: 2031754 - RNA, 18 nt, Human herpesvirus 5
ugcgauuuggaccuggag

SEQ ID NO: 2031755 - RNA, 14 nt, Human herpesvirus 5
uccuuuuggcgcag

SEQ ID NO: 2031756 - RNA, 12 nt, Human herpesvirus 5
ugcagcugguga

SEQ ID NO: 2031757 - RNA, 19 nt, Human herpesvirus 5
gggcgauggguccgagcug

SEQ ID NO: 2031758 - RNA, 19 nt, Human herpesvirus 5
acgagcgccguccugcaga

SEQ ID NO: 2031759 - RNA, 13 nt, Human herpesvirus 5
gaucaccacccug

SEQ ID NO: 2031760 - RNA, 20 nt, Human herpesvirus 5
caagucccuggccccggcca

SEQ ID NO: 2031761 - RNA, 13 nt, Human herpesvirus 5
gugagaguuuaug

SEQ ID NO: 2031762 - RNA, 19 nt, Human herpesvirus 5
gcgcugguggccgaacagc

SEQ ID NO: 2031763 - RNA, 17 nt, Human herpesvirus 5
gcuguggcuucucugga

SEQ ID NO: 2031764 - RNA, 14 nt, Human herpesvirus 5
gccgcgugccuggg

SEQ ID NO: 2031765 - RNA, 17 nt, Human herpesvirus 5
aguacccaccgauggca

SEQ ID NO: 2031766 - RNA, 13 nt, Human herpesvirus 5
acugcacuuccug

SEQ ID NO: 2031767 - RNA, 14 nt, Human herpesvirus 5
ugaugugccagccg

SEQ ID NO: 2031768 - RNA, 19 nt, Human herpesvirus 5
ccgaagaccucaccaucuc

SEQ ID NO: 2031769 - RNA, 21 nt, Human herpesvirus 5
gacccggcuggcgacccgcag

SEQ ID NO: 2031770 - RNA, 14 nt, Human herpesvirus 5
ccgaccugugcgug

SEQ ID NO: 2031771 - RNA, 15 nt, Human herpesvirus 5
guuccacggccagcg

SEQ ID NO: 2031772 - RNA, 15 nt, Human herpesvirus 5
ccacuaauccgcacc

SEQ ID NO: 2031773 - RNA, 16 nt, Human herpesvirus 5
cagcccauccucgugg

SEQ ID NO: 2031774 - RNA, 13 nt, Human herpesvirus 5
cccucugcugcug

SEQ ID NO: 2031775 - RNA, 20 nt, Human herpesvirus 5
ucugcauagaguuacaugca

SEQ ID NO: 2031776 - RNA, 19 nt, Human herpesvirus 5
aaagccgcgcucgcccccg

SEQ ID NO: 2031777 - RNA, 17 nt, Human herpesvirus 5
accggcucaccacgcag

SEQ ID NO: 2031778 - RNA, 15 nt, Human herpesvirus 5
uggacgacgcgcugg

SEQ ID NO: 2031779 - RNA, 19 nt, Human herpesvirus 5
cgucuucaaaguagcugug

SEQ ID NO: 2031780 - RNA, 22 nt, Human herpesvirus 5
gcucaaaguacuugucggcgug

SEQ ID NO: 2031781 - RNA, 20 nt, Human herpesvirus 5
cggaucaauugcgggcccug

SEQ ID NO: 2031782 - RNA, 12 nt, Human herpesvirus 5
ccagcgccacca

SEQ ID NO: 2031783 - RNA, 21 nt, Human herpesvirus 5
ccaaacgcgugcgggugcaug

SEQ ID NO: 2031784 - RNA, 13 nt, Human herpesvirus 5
ggcagcggaggug

SEQ ID NO: 2031785 - RNA, 13 nt, Human herpesvirus 5
uacauaaaaccac

SEQ ID NO: 2031786 - RNA, 16 nt, Human herpesvirus 5
cuucggaaucgggccc

SEQ ID NO: 2031787 - RNA, 14 nt, Human herpesvirus 5
ugagcgugcugcuc

SEQ ID NO: 2031788 - RNA, 17 nt, Human herpesvirus 5
cuuuguggggcugcuca

SEQ ID NO: 2031789 - RNA, 17 nt, Human herpesvirus 5
ucaacagcagcaacagc

SEQ ID NO: 2031790 - RNA, 16 nt, Human herpesvirus 5
uuuuaaucgucgaaaa

SEQ ID NO: 2031791 - RNA, 13 nt, Human herpesvirus 5
cuggcuuggcucg

SEQ ID NO: 2031792 - RNA, 22 nt, Human herpesvirus 5
ggugucucugcaacgccuggcg

SEQ ID NO: 2031793 - RNA, 18 nt, Human herpesvirus 5
guacggcagcggggagaa

SEQ ID NO: 2031794 - RNA, 12 nt, Human herpesvirus 5
gaugcgcacggc

SEQ ID NO: 2031795 - RNA, 15 nt, Human herpesvirus 5
ggcgugcgcacgccg

SEQ ID NO: 2031796 - RNA, 15 nt, Human herpesvirus 5
gcugcgcaggccgcc

SEQ ID NO: 2031797 - RNA, 14 nt, Human herpesvirus 5
aacgcguggcccug

SEQ ID NO: 2031798 - RNA, 23 nt, Human herpesvirus 5
cacagcuccugaaugagcucuuu

SEQ ID NO: 2031799 - RNA, 18 nt, Human herpesvirus 5
cuggggugucuagcuggc

SEQ ID NO: 2031800 - RNA, 17 nt, Human herpesvirus 5
caguggcaggcccgggu

SEQ ID NO: 2031801 - RNA, 12 nt, Human herpesvirus 5
cccucugcugcu

SEQ ID NO: 2031802 - RNA, 15 nt, Human herpesvirus 5
uaacaauuccacgcc

SEQ ID NO: 2031803 - RNA, 23 nt, Human herpesvirus 5
guacaccgcuggagcuaucugug

SEQ ID NO: 2031804 - RNA, 23 nt, Human herpesvirus 5
cugucggaugaggcaggcgaugc

SEQ ID NO: 2031805 - RNA, 15 nt, Human herpesvirus 5
gucgccaugcuucau

SEQ ID NO: 2031806 - RNA, 18 nt, Human herpesvirus 5
cugauaauaaaggcucuc

SEQ ID NO: 2031807 - RNA, 16 nt, Human herpesvirus 5
cuggucaaccugcuga

SEQ ID NO: 2031808 - RNA, 20 nt, Human herpesvirus 5
ggcgugcugcacgcucaccg

SEQ ID NO: 2031809 - RNA, 23 nt, Human herpesvirus 5
ugauaauaaccgcggugugcuuu

SEQ ID NO: 2031810 - RNA, 13 nt, Human herpesvirus 5
ccggcugcugcac

SEQ ID NO: 2031811 - RNA, 13 nt, Human herpesvirus 5
gccagcggccugg

SEQ ID NO: 2031812 - RNA, 19 nt, Human herpesvirus 5
caagccuguuagaaccgcg

SEQ ID NO: 2031813 - RNA, 19 nt, Human herpesvirus 5
cgaucuggaaggcguggau

SEQ ID NO: 2031814 - RNA, 18 nt, Human herpesvirus 5
gccgccgucaccaccgcc

SEQ ID NO: 2031815 - RNA, 18 nt, Human herpesvirus 5
uggcaaggugcugcaccu

SEQ ID NO: 2031816 - RNA, 22 nt, Human herpesvirus 5
caccguaucagcuaccgccgca

SEQ ID NO: 2031817 - RNA, 20 nt, Human herpesvirus 5
gcaccagacuuggagacaug

SEQ ID NO: 2031818 - RNA, 19 nt, Human herpesvirus 5
cgaccuugagcgacagcag

SEQ ID NO: 2031819 - RNA, 15 nt, Human herpesvirus 5
ugcugcgucugucuu

SEQ ID NO: 2031820 - RNA, 15 nt, Human herpesvirus 5
caucugcggcagcgg

SEQ ID NO: 2031821 - RNA, 18 nt, Human herpesvirus 5
gggcggccgugcagcaag

SEQ ID NO: 2031822 - RNA, 22 nt, Human herpesvirus 5
caaggacuguuuucucaaucug

SEQ ID NO: 2031823 - RNA, 21 nt, Human herpesvirus 5
acugaccaagcuaguagcggc

SEQ ID NO: 2031824 - RNA, 20 nt, Human herpesvirus 5
gcccaucgucugcauguuca

SEQ ID NO: 2031825 - RNA, 17 nt, Human herpesvirus 5
gcacccgucaugguaca

SEQ ID NO: 2031826 - RNA, 16 nt, Human herpesvirus 5
aguagugguggggcug

SEQ ID NO: 2031827 - RNA, 19 nt, Human herpesvirus 5
cgacgggugguaccugcaa

SEQ ID NO: 2031828 - RNA, 14 nt, Human herpesvirus 5
gcaacaacagucgc

SEQ ID NO: 2031829 - RNA, 14 nt, Human herpesvirus 5
cccaccacgggggc

SEQ ID NO: 2031830 - RNA, 18 nt, Human herpesvirus 5
gaguggggcaacugcugc

SEQ ID NO: 2031831 - RNA, 23 nt, Human herpesvirus 5
uccgccgucggugcgcccaucug

SEQ ID NO: 2031832 - RNA, 19 nt, Human herpesvirus 5
ugacgcuaggcggcgccgg

SEQ ID NO: 2031833 - RNA, 13 nt, Human herpesvirus 5
gcggcaggaaggc

SEQ ID NO: 2031834 - RNA, 12 nt, Human herpesvirus 5
ccccggcagcgg

SEQ ID NO: 2031835 - RNA, 12 nt, Human herpesvirus 5
acuaccuccccu

SEQ ID NO: 2031836 - RNA, 13 nt, Human herpesvirus 5
ucgccgccaccuu

SEQ ID NO: 2031837 - RNA, 14 nt, Human herpesvirus 5
ccgacauggagaca

SEQ ID NO: 2031838 - RNA, 14 nt, Human herpesvirus 5
ccgccuccacuucc

SEQ ID NO: 2031839 - RNA, 16 nt, Human herpesvirus 5
aucgcgagccccaucg

SEQ ID NO: 2031840 - RNA, 16 nt, Human herpesvirus 5
augaaaaauaaaaaac

SEQ ID NO: 2031841 - RNA, 15 nt, Human herpesvirus 5
guuggacuccugugu

SEQ ID NO: 2031842 - RNA, 16 nt, Human herpesvirus 5
uaccuggcuggcgcag

SEQ ID NO: 2031843 - RNA, 22 nt, Human herpesvirus 5
cggaaacagcguccacaguuuc

SEQ ID NO: 2031844 - RNA, 14 nt, Human herpesvirus 5
ccucagcuugcccg

SEQ ID NO: 2031845 - RNA, 15 nt, Human herpesvirus 5
ugcgucuggauuugu

SEQ ID NO: 2031846 - RNA, 20 nt, Human herpesvirus 5
gcccggucggucuuccugcu

SEQ ID NO: 2031847 - RNA, 14 nt, Human herpesvirus 5
auuuucuuucuagu

SEQ ID NO: 2031848 - RNA, 16 nt, Human herpesvirus 5
guauguggaacagcuc

SEQ ID NO: 2031849 - RNA, 21 nt, Human herpesvirus 5
gccagcugccaccagggcgac

SEQ ID NO: 2031850 - RNA, 19 nt, Human herpesvirus 5
agguugggagaugcggggu

SEQ ID NO: 2031851 - RNA, 23 nt, Human herpesvirus 5
cggagcggaggaggugaccuggc

SEQ ID NO: 2031852 - RNA, 17 nt, Human herpesvirus 5
cgggcacguucuuucca

SEQ ID NO: 2031853 - RNA, 14 nt, Human herpesvirus 5
gcgacggcagcgcc

SEQ ID NO: 2031854 - RNA, 21 nt, Human herpesvirus 5
gcggaugagcgugcugcucug

SEQ ID NO: 2031855 - RNA, 18 nt, Human herpesvirus 5
ggcgucgcgucgcaggcc

SEQ ID NO: 2031856 - RNA, 15 nt, Human herpesvirus 5
cagcaacaacagucg

SEQ ID NO: 2031857 - RNA, 14 nt, Human herpesvirus 5
guaaauaaaaagcu

SEQ ID NO: 2031858 - RNA, 15 nt, Human herpesvirus 5
cggcgaucgcgcuuu

SEQ ID NO: 2031859 - RNA, 18 nt, Human herpesvirus 5
agaccaugacgacgguga

SEQ ID NO: 2031860 - RNA, 16 nt, Human herpesvirus 5
cgguaccauuucuugg

SEQ ID NO: 2031861 - RNA, 22 nt, Human herpesvirus 5
gucccuggaagcgugugugggc

SEQ ID NO: 2031862 - RNA, 14 nt, Human herpesvirus 5
cguaaagagaguca

SEQ ID NO: 2031863 - RNA, 13 nt, Human herpesvirus 5
ccgcccgagcagg

SEQ ID NO: 2031864 - RNA, 16 nt, Human herpesvirus 5
cggcggccacggccug

SEQ ID NO: 2031865 - RNA, 17 nt, Human herpesvirus 5
cacgccguugccacgag

SEQ ID NO: 2031866 - RNA, 13 nt, Human herpesvirus 5
ccgcaaaggccac

SEQ ID NO: 2031867 - RNA, 15 nt, Human herpesvirus 5
ugcgcggcgacgagg

SEQ ID NO: 2031868 - RNA, 23 nt, Human herpesvirus 5
cgccgccgaagccuggggcaccu

SEQ ID NO: 2031869 - RNA, 16 nt, Human herpesvirus 5
ccucgucgccuuccag

SEQ ID NO: 2031870 - RNA, 20 nt, Human herpesvirus 5
gcgagcgggguucaccugca

SEQ ID NO: 2031871 - RNA, 18 nt, Human herpesvirus 5
aacaguacggacaaguau

SEQ ID NO: 2031872 - RNA, 14 nt, Human herpesvirus 5
ucaauaaaaaccac

SEQ ID NO: 2031873 - RNA, 15 nt, Human herpesvirus 5
cgcaggucacacugg

SEQ ID NO: 2031874 - RNA, 22 nt, Human herpesvirus 5
acgucgaucuugacgcugcugg

SEQ ID NO: 2031875 - RNA, 20 nt, Human herpesvirus 5
cucggucaacgcguccagcu

SEQ ID NO: 2031876 - RNA, 18 nt, Human herpesvirus 5
agaaacgucgcagccacc

SEQ ID NO: 2031877 - RNA, 12 nt, Human herpesvirus 5
gaucaugugcuu

SEQ ID NO: 2031878 - RNA, 18 nt, Human herpesvirus 5
gaagcgcugauguaccug

SEQ ID NO: 2031879 - RNA, 17 nt, Human herpesvirus 5
caagcgccgucacuucc

SEQ ID NO: 2031880 - RNA, 15 nt, Human herpesvirus 5
aauaauggucaauaa

SEQ ID NO: 2031881 - RNA, 13 nt, Human herpesvirus 5
ccagccgcgauuc

SEQ ID NO: 2031882 - RNA, 15 nt, Human herpesvirus 5
cagugucgguguggu

SEQ ID NO: 2031883 - RNA, 19 nt, Human herpesvirus 5
auuguuuuuauuacccgcu

SEQ ID NO: 2031884 - RNA, 13 nt, Human herpesvirus 5
ccuaccgccgccg

SEQ ID NO: 2031885 - RNA, 14 nt, Human herpesvirus 5
uccacggccuccga

SEQ ID NO: 2031886 - RNA, 20 nt, Human herpesvirus 5
uccgacgucggucccaucgc

SEQ ID NO: 2031887 - RNA, 17 nt, Human herpesvirus 5
cauuggaaguaacauca

SEQ ID NO: 2031888 - RNA, 23 nt, Human herpesvirus 5
gcuacuucccccuccccuucugu

SEQ ID NO: 2031889 - RNA, 14 nt, Human herpesvirus 5
guguacagcuaccu

SEQ ID NO: 2031890 - RNA, 19 nt, Human herpesvirus 5
uucuugcccacgccgucgc

SEQ ID NO: 2031891 - RNA, 23 nt, Human herpesvirus 5
cggcagcuaucgugacugggagu

SEQ ID NO: 2031892 - RNA, 20 nt, Human herpesvirus 5
gacaagucguuucagcccaa

SEQ ID NO: 2031893 - RNA, 15 nt, Human herpesvirus 5
cugagacagccacau

SEQ ID NO: 2031894 - RNA, 23 nt, Human herpesvirus 5
cacggccuuauguggcugcgccg

SEQ ID NO: 2031895 - RNA, 20 nt, Human herpesvirus 5
cuccgugcggcccccagagg

SEQ ID NO: 2031896 - RNA, 20 nt, Human herpesvirus 5
cagcgccagcggccuggccu

SEQ ID NO: 2031897 - RNA, 13 nt, Human herpesvirus 5
acgcgugcgggug

SEQ ID NO: 2031898 - RNA, 22 nt, Human herpesvirus 5
gcgaccgucuggagguggccug

SEQ ID NO: 2031899 - RNA, 12 nt, Human herpesvirus 5
acagggugccgc

SEQ ID NO: 2031900 - RNA, 20 nt, Human herpesvirus 5
ccgagacgugcgaccuggac

SEQ ID NO: 2031901 - RNA, 15 nt, Human herpesvirus 5
ugcuugaagauuucc

SEQ ID NO: 2031902 - RNA, 13 nt, Human herpesvirus 5
agugcgcgccgcc

SEQ ID NO: 2031903 - RNA, 17 nt, Human herpesvirus 5
gaagccgccagcggaag

SEQ ID NO: 2031904 - RNA, 16 nt, Human herpesvirus 5
auugccucuacacuug

SEQ ID NO: 2031905 - RNA, 13 nt, Human herpesvirus 5
gcaggccaugggu

SEQ ID NO: 2031906 - RNA, 18 nt, Human herpesvirus 5
gaugaaccuuccccaccc

SEQ ID NO: 2031907 - RNA, 23 nt, Human herpesvirus 5
acaccaguauugguucugggcgc

SEQ ID NO: 2031908 - RNA, 17 nt, Human herpesvirus 5
cgaugugagagccaccu

SEQ ID NO: 2031909 - RNA, 20 nt, Human herpesvirus 5
ucgacgaucuuuaguccgga

SEQ ID NO: 2031910 - RNA, 22 nt, Human herpesvirus 5
uuuaugacgcgcguggccgcgc

SEQ ID NO: 2031911 - RNA, 19 nt, Human herpesvirus 5
ccuguugugguggcuggga

SEQ ID NO: 2031912 - RNA, 13 nt, Human herpesvirus 5
ugugcgucaaugc

SEQ ID NO: 2031913 - RNA, 11 nt, Human herpesvirus 5
cgcggcggugg

SEQ ID NO: 2031914 - RNA, 14 nt, Human herpesvirus 5
ccguggccuguggc

SEQ ID NO: 2031915 - RNA, 15 nt, Human herpesvirus 5
acuuuaggcggcgca

SEQ ID NO: 2031916 - RNA, 22 nt, Human herpesvirus 5
aggggccgcagccguuggugga

SEQ ID NO: 2031917 - RNA, 12 nt, Human herpesvirus 5
gcucuagguuug

SEQ ID NO: 2031918 - RNA, 16 nt, Human herpesvirus 5
cgccuuccuccucugc

SEQ ID NO: 2031919 - RNA, 13 nt, Human herpesvirus 5
cugcaccagcaac

SEQ ID NO: 2031920 - RNA, 19 nt, Human herpesvirus 5
gcaccacggcuugcaaaac

SEQ ID NO: 2031921 - RNA, 17 nt, Human herpesvirus 5
ucucucuggucuucccu

SEQ ID NO: 2031922 - RNA, 16 nt, Human herpesvirus 5
ggacggcgacgaccgc

SEQ ID NO: 2031923 - RNA, 21 nt, Human herpesvirus 5
cuucaucaucaccacccgaga

SEQ ID NO: 2031924 - RNA, 11 nt, Human herpesvirus 5
agccggcagcu

SEQ ID NO: 2031925 - RNA, 15 nt, Human herpesvirus 5
gcuccuaccgccgcc

SEQ ID NO: 2031926 - RNA, 17 nt, Human herpesvirus 5
acguagaauacuggaag

SEQ ID NO: 2031927 - RNA, 15 nt, Human herpesvirus 5
ugcaguccgcuccgg

SEQ ID NO: 2031928 - RNA, 20 nt, Human herpesvirus 5
gacgugaugcgcgucgaccu

SEQ ID NO: 2031929 - RNA, 14 nt, Human herpesvirus 5
gucugcgcuuuccc

SEQ ID NO: 2031930 - RNA, 15 nt, Human herpesvirus 5
uggcugcgcgccucc

SEQ ID NO: 2031931 - RNA, 21 nt, Human herpesvirus 5
ccgcguuuggucgccugccua

SEQ ID NO: 2031932 - RNA, 21 nt, Human herpesvirus 5
uaucgcguguguucuauggcc

SEQ ID NO: 2031933 - RNA, 12 nt, Human herpesvirus 5
gcgaggcggcaa

SEQ ID NO: 2031934 - RNA, 13 nt, Human herpesvirus 5
uuucagucagaga

SEQ ID NO: 2031935 - RNA, 14 nt, Human herpesvirus 5
augugcuuaagcag

SEQ ID NO: 2031936 - RNA, 17 nt, Human herpesvirus 5
ccgauccuuggaagagg

SEQ ID NO: 2031937 - RNA, 20 nt, Human herpesvirus 5
acacgugcuuuuggugcgcc

SEQ ID NO: 2031938 - RNA, 20 nt, Human herpesvirus 5
cagagucgccaguccauggu

SEQ ID NO: 2031939 - RNA, 18 nt, Human herpesvirus 5
gacugagacuggugguga

SEQ ID NO: 2031940 - RNA, 20 nt, Human herpesvirus 5
ucgcucggccucgcucggaa

SEQ ID NO: 2031941 - RNA, 17 nt, Human herpesvirus 5
aucaacgacgccacaca

SEQ ID NO: 2031942 - RNA, 15 nt, Human herpesvirus 5
agauuagcagaagga

SEQ ID NO: 2031943 - RNA, 18 nt, Human herpesvirus 5
gccguuauguucaguguc

SEQ ID NO: 2031944 - RNA, 22 nt, Human herpesvirus 5
gacacggaggaugacgaggagc

SEQ ID NO: 2031945 - RNA, 19 nt, Human herpesvirus 5
cuaaucgcauccugcauca

SEQ ID NO: 2031946 - RNA, 16 nt, Human herpesvirus 5
aucgugccgcuccauc

SEQ ID NO: 2031947 - RNA, 22 nt, Human herpesvirus 5
ucgcggcccuucaacggcacca

SEQ ID NO: 2031948 - RNA, 13 nt, Human herpesvirus 5
cgucacaauaaca

SEQ ID NO: 2031949 - RNA, 15 nt, Human herpesvirus 5
acgugucuucuucgc

SEQ ID NO: 2031950 - RNA, 17 nt, Human herpesvirus 5
aucauggaagagggcgc

SEQ ID NO: 2031951 - RNA, 17 nt, Human herpesvirus 5
uccuccucugccugggc

SEQ ID NO: 2031952 - RNA, 14 nt, Human herpesvirus 5
gaagcggcuguggc

SEQ ID NO: 2031953 - RNA, 11 nt, Human herpesvirus 5
gacggcagcua

SEQ ID NO: 2031954 - RNA, 15 nt, Human herpesvirus 5
acagcuaccucauga

SEQ ID NO: 2031955 - RNA, 15 nt, Human herpesvirus 5
guuauuucgugcgug

SEQ ID NO: 2031956 - RNA, 16 nt, Human herpesvirus 5
cgcaaacucccacucc

SEQ ID NO: 2031957 - RNA, 16 nt, Human herpesvirus 5
cgccuuuugcuggcug

SEQ ID NO: 2031958 - RNA, 16 nt, Human herpesvirus 5
acguaggccuccucuc

SEQ ID NO: 2031959 - RNA, 19 nt, Human herpesvirus 5
auaauaagccggcagcugc

SEQ ID NO: 2031960 - RNA, 14 nt, Human herpesvirus 5
cguaggccuccucu

SEQ ID NO: 2031961 - RNA, 14 nt, Human herpesvirus 5
ccagcagccggagg

SEQ ID NO: 2031962 - RNA, 18 nt, Human herpesvirus 5
gccgugcgcgacgagauc

SEQ ID NO: 2031963 - RNA, 17 nt, Human herpesvirus 5
acucuauguuauacucu

SEQ ID NO: 2031964 - RNA, 17 nt, Human herpesvirus 5
ccgcccuugguggagac

SEQ ID NO: 2031965 - RNA, 18 nt, Human herpesvirus 5
acaagacggaggagacac

SEQ ID NO: 2031966 - RNA, 11 nt, Human herpesvirus 5
uccccugccua

SEQ ID NO: 2031967 - RNA, 18 nt, Human herpesvirus 5
ugcaaugccucauccuua

SEQ ID NO: 2031968 - RNA, 17 nt, Human herpesvirus 5
cugucuugcuuaaugau

SEQ ID NO: 2031969 - RNA, 15 nt, Human herpesvirus 5
agguugcgccgcaag

SEQ ID NO: 2031970 - RNA, 15 nt, Human herpesvirus 5
gaacuugagcacaaa

SEQ ID NO: 2031971 - RNA, 20 nt, Human herpesvirus 5
acgucgcuuuuuacuuugua

SEQ ID NO: 2031972 - RNA, 15 nt, Human herpesvirus 5
aaaccgcaggagcug

SEQ ID NO: 2031973 - RNA, 18 nt, Human herpesvirus 5
gcauccgcuacucccgag

SEQ ID NO: 2031974 - RNA, 17 nt, Human herpesvirus 5
uggcgcguagccaccug

SEQ ID NO: 2031975 - RNA, 20 nt, Human herpesvirus 5
cguugucuauccccaaaaaa

SEQ ID NO: 2031976 - RNA, 21 nt, Human herpesvirus 5
ggacgcucguccucucugucu

SEQ ID NO: 2031977 - RNA, 15 nt, Human herpesvirus 5
ugaggagggugguga

SEQ ID NO: 2031978 - RNA, 14 nt, Human herpesvirus 5
cuguugcucuaccg

SEQ ID NO: 2031979 - RNA, 21 nt, Human herpesvirus 5
guacuuuauuaggucagggau

SEQ ID NO: 2031980 - RNA, 12 nt, Human herpesvirus 5
ggggcugcugcu

SEQ ID NO: 2031981 - RNA, 21 nt, Human herpesvirus 5
uguguuauucagaaccaugua

SEQ ID NO: 2031982 - RNA, 17 nt, Human herpesvirus 5
ucccucagccucugugu

SEQ ID NO: 2031983 - RNA, 19 nt, Human herpesvirus 5
gacgcggugcagguucuga

SEQ ID NO: 2031984 - RNA, 16 nt, Human herpesvirus 5
uccccucugcugcugg

SEQ ID NO: 2031985 - RNA, 21 nt, Human herpesvirus 5
gcugcacacggagcacgggcu

SEQ ID NO: 2031986 - RNA, 23 nt, Human herpesvirus 5
caccuucccucuagagacagacg

SEQ ID NO: 2031987 - RNA, 16 nt, Human herpesvirus 5
uaugauaucuacagca

SEQ ID NO: 2031988 - RNA, 14 nt, Human herpesvirus 5
guuguguuuugcuu

SEQ ID NO: 2031989 - RNA, 22 nt, Human herpesvirus 5
gucaaagccgacaaccugcugc

SEQ ID NO: 2031990 - RNA, 17 nt, Human herpesvirus 5
gaagcgaauaagcgcga

SEQ ID NO: 2031991 - RNA, 17 nt, Human herpesvirus 5
cuugcggcgcuucgagg

SEQ ID NO: 2031992 - RNA, 20 nt, Human herpesvirus 5
gccgcucaggucgcccaggc

SEQ ID NO: 2031993 - RNA, 21 nt, Human herpesvirus 5
ucaauugcgggcccugcugac

SEQ ID NO: 2031994 - RNA, 20 nt, Human herpesvirus 5
uguuguacucguguuuuuua

SEQ ID NO: 2031995 - RNA, 17 nt, Human herpesvirus 5
gcgaccuggacggcuac

SEQ ID NO: 2031996 - RNA, 19 nt, Human herpesvirus 5
cguuuugagauuucugucg

SEQ ID NO: 2031997 - RNA, 17 nt, Human herpesvirus 5
aacaacagcaacaacag

SEQ ID NO: 2031998 - RNA, 18 nt, Human herpesvirus 5
ccuggaccggugguacug

SEQ ID NO: 2031999 - RNA, 16 nt, Human herpesvirus 5
ucaauaaucuccugag

SEQ ID NO: 2032000 - RNA, 15 nt, Human herpesvirus 5
cuaugauccuguggu

SEQ ID NO: 2032001 - RNA, 20 nt, Human herpesvirus 5
cucagcgugcucagcuggug

SEQ ID NO: 2032002 - RNA, 18 nt, Human herpesvirus 5
gaaaccacgcgucagggc

SEQ ID NO: 2032003 - RNA, 21 nt, Human herpesvirus 5
caaggagcgacguaccagcug

SEQ ID NO: 2032004 - RNA, 14 nt, Human herpesvirus 5
cggcugcugcacca

SEQ ID NO: 2032005 - RNA, 15 nt, Human herpesvirus 5
cggcagcggggagaa

SEQ ID NO: 2032006 - RNA, 18 nt, Human herpesvirus 5
gacccacgacccgagccg

SEQ ID NO: 2032007 - RNA, 17 nt, Human herpesvirus 5
acgacagucuccuccug

SEQ ID NO: 2032008 - RNA, 14 nt, Human herpesvirus 5
acugaaaacaccau

SEQ ID NO: 2032009 - RNA, 16 nt, Human herpesvirus 5
agacgggguugaucaa

SEQ ID NO: 2032010 - RNA, 16 nt, Human herpesvirus 5
cccgauaugggccgcu

SEQ ID NO: 2032011 - RNA, 16 nt, Human herpesvirus 5
cgugcccugugggccc

SEQ ID NO: 2032012 - RNA, 14 nt, Human herpesvirus 5
gucuccaccacagu

SEQ ID NO: 2032013 - RNA, 19 nt, Human herpesvirus 5
cgcguguaggcgacuggcu

SEQ ID NO: 2032014 - RNA, 20 nt, Human herpesvirus 5
agucgcuuagccaccaccug

SEQ ID NO: 2032015 - RNA, 22 nt, Human herpesvirus 5
cuacaauguauagauacacgug

SEQ ID NO: 2032016 - RNA, 14 nt, Human herpesvirus 5
gaacggagugguga

SEQ ID NO: 2032017 - RNA, 20 nt, Human herpesvirus 5
acgcggucaugaguuggugc

SEQ ID NO: 2032018 - RNA, 20 nt, Human herpesvirus 5
augccuuccgcgugcuccac

SEQ ID NO: 2032019 - RNA, 18 nt, Human herpesvirus 5
gcugcuuaaugacagcga

SEQ ID NO: 2032020 - RNA, 18 nt, Human herpesvirus 5
uugcauaagcgcggaggu

SEQ ID NO: 2032021 - RNA, 16 nt, Human herpesvirus 5
ugagauacauguucau

SEQ ID NO: 2032022 - RNA, 22 nt, Human herpesvirus 5
cugguagcgcuugcggcacagc

SEQ ID NO: 2032023 - RNA, 15 nt, Human herpesvirus 5
caaacgucacugaca

SEQ ID NO: 2032024 - RNA, 23 nt, Human herpesvirus 5
aggaaugcggcacccggcugcac

SEQ ID NO: 2032025 - RNA, 15 nt, Human herpesvirus 5
caggaaucugggagg

SEQ ID NO: 2032026 - RNA, 22 nt, Human herpesvirus 5
gugagggacccucgucggaagc

SEQ ID NO: 2032027 - RNA, 21 nt, Human herpesvirus 5
acgccggggaagccuccggaa

SEQ ID NO: 2032028 - RNA, 12 nt, Human herpesvirus 5
ucucgagcccca

SEQ ID NO: 2032029 - RNA, 23 nt, Human herpesvirus 5
gaccauuuccaugugcagcuggu

SEQ ID NO: 2032030 - RNA, 17 nt, Human herpesvirus 5
gcguguuuuauaaaaga

SEQ ID NO: 2032031 - RNA, 18 nt, Human herpesvirus 5
uaagcagccucuucgugg

SEQ ID NO: 2032032 - RNA, 12 nt, Human herpesvirus 5
acaagggcuggc

SEQ ID NO: 2032033 - RNA, 15 nt, Human herpesvirus 5
cgacugcgcggccug

SEQ ID NO: 2032034 - RNA, 20 nt, Human herpesvirus 5
uccucggguuccucggccuc

SEQ ID NO: 2032035 - RNA, 17 nt, Human herpesvirus 5
guuggcucucgcagccc

SEQ ID NO: 2032036 - RNA, 21 nt, Human herpesvirus 5
cauguagaagcacccauuaca

SEQ ID NO: 2032037 - RNA, 12 nt, Human herpesvirus 5
gcugagacagga

SEQ ID NO: 2032038 - RNA, 14 nt, Human herpesvirus 5
uugagacacgcgcu

SEQ ID NO: 2032039 - RNA, 17 nt, Human herpesvirus 5
aaccacaagaaacgcug

SEQ ID NO: 2032040 - RNA, 14 nt, Human herpesvirus 5
acugaucgccugga

SEQ ID NO: 2032041 - RNA, 18 nt, Human herpesvirus 5
gacacucuggcccugcug

SEQ ID NO: 2032042 - RNA, 23 nt, Human herpesvirus 5
ccuuccagcuuaccgccaccguc

SEQ ID NO: 2032043 - RNA, 18 nt, Human herpesvirus 5
cgacuggggucaaaagcc

SEQ ID NO: 2032044 - RNA, 11 nt, Human herpesvirus 5
aacucagggaa

SEQ ID NO: 2032045 - RNA, 14 nt, Human herpesvirus 5
ccacugggccucgg

SEQ ID NO: 2032046 - RNA, 15 nt, Human herpesvirus 5
gaccaggagguguug

SEQ ID NO: 2032047 - RNA, 18 nt, Human herpesvirus 5
auaucgagguacaugucc

SEQ ID NO: 2032048 - RNA, 19 nt, Human herpesvirus 5
gcgguuucguguugaaacc

SEQ ID NO: 2032049 - RNA, 15 nt, Human herpesvirus 5
aaucuccugagacac

SEQ ID NO: 2032050 - RNA, 14 nt, Human herpesvirus 5
uggugugucggcaa

SEQ ID NO: 2032051 - RNA, 20 nt, Human herpesvirus 5
ucagaccgcaacaacagcag

SEQ ID NO: 2032052 - RNA, 12 nt, Human herpesvirus 5
cggcugcugcac

SEQ ID NO: 2032053 - RNA, 16 nt, Human herpesvirus 5
ugguggcucaugccgc

SEQ ID NO: 2032054 - RNA, 20 nt, Human herpesvirus 5
auucuguguuacgaccuguu

SEQ ID NO: 2032055 - RNA, 15 nt, Human herpesvirus 5
cguaguuguugcaga

SEQ ID NO: 2032056 - RNA, 17 nt, Human herpesvirus 5
cccuguuccccgugacg

SEQ ID NO: 2032057 - RNA, 16 nt, Human herpesvirus 5
cuuuuggcgcagucgc

SEQ ID NO: 2032058 - RNA, 17 nt, Human herpesvirus 5
caucuccgucucugguc

SEQ ID NO: 2032059 - RNA, 16 nt, Human herpesvirus 5
aacauuccccugggaa

SEQ ID NO: 2032060 - RNA, 12 nt, Human herpesvirus 5
acaucuuaagaa

SEQ ID NO: 2032061 - RNA, 24 nt, Human herpesvirus 5
ugaugcgcgaacaggccgccaucc

SEQ ID NO: 2032062 - RNA, 17 nt, Human herpesvirus 5
cucagcccgcguaagaa

SEQ ID NO: 2032063 - RNA, 15 nt, Human herpesvirus 5
cagcacaccugccuc

SEQ ID NO: 2032064 - RNA, 17 nt, Human herpesvirus 5
ugcaacgccuggcguga

SEQ ID NO: 2032065 - RNA, 21 nt, Human herpesvirus 5
ggauccaaggccuccagcgcc

SEQ ID NO: 2032066 - RNA, 22 nt, Human herpesvirus 5
aacacugaaaacaccauuggaa

SEQ ID NO: 2032067 - RNA, 18 nt, Human herpesvirus 5
ucuacagcauggacuguc

SEQ ID NO: 2032068 - RNA, 17 nt, Human herpesvirus 5
ccgaguccaccucugcu

SEQ ID NO: 2032069 - RNA, 11 nt, Human herpesvirus 5
aacccaucccc

SEQ ID NO: 2032070 - RNA, 12 nt, Human herpesvirus 5
caagacgcauga

SEQ ID NO: 2032071 - RNA, 21 nt, Human herpesvirus 5
ugagcacaaacugcgacacgu

SEQ ID NO: 2032072 - RNA, 15 nt, Human herpesvirus 5
ggccugggcugcugu

SEQ ID NO: 2032073 - RNA, 14 nt, Human herpesvirus 5
agguacggacucua

SEQ ID NO: 2032074 - RNA, 15 nt, Human herpesvirus 5
guggcccuggucugg

SEQ ID NO: 2032075 - RNA, 23 nt, Human herpesvirus 5
augcauaagaagccaagggggug

SEQ ID NO: 2032076 - RNA, 20 nt, Human herpesvirus 5
ggcgcaggucacacugggag

SEQ ID NO: 2032077 - RNA, 12 nt, Human herpesvirus 5
agaccgcugccu

SEQ ID NO: 2032078 - RNA, 20 nt, Human herpesvirus 5
gggcuggggugcgcuuggua

SEQ ID NO: 2032079 - RNA, 23 nt, Human herpesvirus 5
gcggcgcuucgagggcucgugcg

SEQ ID NO: 2032080 - RNA, 17 nt, Human herpesvirus 5
ccugaguuccgucagca

SEQ ID NO: 2032081 - RNA, 19 nt, Human herpesvirus 5
ggagcuacgcgaccagcug

SEQ ID NO: 2032082 - RNA, 19 nt, Human herpesvirus 5
accccccgggccaccagcc

SEQ ID NO: 2032083 - RNA, 12 nt, Human herpesvirus 5
acaccuauggcg

SEQ ID NO: 2032084 - RNA, 16 nt, Human herpesvirus 5
uggggugucuagcugg

SEQ ID NO: 2032085 - RNA, 21 nt, Human herpesvirus 5
gcaugcugugggcccacugcg

SEQ ID NO: 2032086 - RNA, 16 nt, Human herpesvirus 5
ugagcgugcugcucug

SEQ ID NO: 2032087 - RNA, 14 nt, Human herpesvirus 5
cugacgcuggaaac

SEQ ID NO: 2032088 - RNA, 13 nt, Human herpesvirus 5
cugaacaauaaac

SEQ ID NO: 2032089 - RNA, 18 nt, Human herpesvirus 5
ucaggucgcccaggcuca

SEQ ID NO: 2032090 - RNA, 19 nt, Human herpesvirus 5
aaguggauuugggcgugga

SEQ ID NO: 2032091 - RNA, 16 nt, Human herpesvirus 5
gcacgagugggccagc

SEQ ID NO: 2032092 - RNA, 15 nt, Human herpesvirus 5
acgcgcggcuagagc

SEQ ID NO: 2032093 - RNA, 15 nt, Human herpesvirus 5
ccaucgggcccgcca

SEQ ID NO: 2032094 - RNA, 17 nt, Human herpesvirus 5
gaagccgccaauacagc

SEQ ID NO: 2032095 - RNA, 19 nt, Human herpesvirus 5
cugcagcucgaacgucucu

SEQ ID NO: 2032096 - RNA, 20 nt, Human herpesvirus 5
uuccccauaagcuguguacu

SEQ ID NO: 2032097 - RNA, 17 nt, Human herpesvirus 5
ggucggucagccgaccc

SEQ ID NO: 2032098 - RNA, 19 nt, Human herpesvirus 5
gggaggccacaggcggcgc

SEQ ID NO: 2032099 - RNA, 13 nt, Human herpesvirus 5
ugaucugggcagc

SEQ ID NO: 2032100 - RNA, 19 nt, Human herpesvirus 5
ggcacucggcugugccugu

SEQ ID NO: 2032101 - RNA, 12 nt, Human herpesvirus 5
acgucuucugaa

SEQ ID NO: 2032102 - RNA, 20 nt, Human herpesvirus 5
gccguguuuuugcucgagac

SEQ ID NO: 2032103 - RNA, 16 nt, Human herpesvirus 5
aucgugggccaggacc

SEQ ID NO: 2032104 - RNA, 13 nt, Human herpesvirus 5
ucuucagaaaaca

SEQ ID NO: 2032105 - RNA, 23 nt, Human herpesvirus 5
cacguccaugucgcgacacgacc

SEQ ID NO: 2032106 - RNA, 13 nt, Human herpesvirus 5
cucuggcccugcu

SEQ ID NO: 2032107 - RNA, 22 nt, Human herpesvirus 5
gcugcccgggggugacaaggaa

SEQ ID NO: 2032108 - RNA, 15 nt, Human herpesvirus 5
ugcuuaaugaucucc

SEQ ID NO: 2032109 - RNA, 12 nt, Human herpesvirus 5
aagcuguaaggu

SEQ ID NO: 2032110 - RNA, 20 nt, Human herpesvirus 5
gaugcgccuccgguggugcg

SEQ ID NO: 2032111 - RNA, 22 nt, Human herpesvirus 5
gguacggacucgaaggcgcccg

SEQ ID NO: 2032112 - RNA, 18 nt, Human herpesvirus 5
caacucuaucgcgacaga

SEQ ID NO: 2032113 - RNA, 18 nt, Human herpesvirus 5
uaugaugcuccgacuguc

SEQ ID NO: 2032114 - RNA, 16 nt, Human herpesvirus 5
uaagaucguccgagau

SEQ ID NO: 2032115 - RNA, 11 nt, Human herpesvirus 5
gccaugaugac

SEQ ID NO: 2032116 - RNA, 18 nt, Human herpesvirus 5
ggucugggaugugcagca

SEQ ID NO: 2032117 - RNA, 22 nt, Human herpesvirus 5
augaucuccaucgugugccuag

SEQ ID NO: 2032118 - RNA, 13 nt, Human herpesvirus 5
cggcgugcugcac

SEQ ID NO: 2032119 - RNA, 22 nt, Human herpesvirus 5
guccggccgucgcaagggcugc

SEQ ID NO: 2032120 - RNA, 16 nt, Human herpesvirus 5
uggccugcaucuuccc

SEQ ID NO: 2032121 - RNA, 19 nt, Human herpesvirus 5
gccguggccuguggcccga

SEQ ID NO: 2032122 - RNA, 17 nt, Human herpesvirus 5
cuguuggcuuacugccu

SEQ ID NO: 2032123 - RNA, 15 nt, Human herpesvirus 5
ccgcucacuuuccuc

SEQ ID NO: 2032124 - RNA, 19 nt, Human herpesvirus 5
uaaaagggacgucaaagcu

SEQ ID NO: 2032125 - RNA, 20 nt, Human herpesvirus 5
acgggccgcgcuccaggcgg

SEQ ID NO: 2032126 - RNA, 17 nt, Human herpesvirus 5
accgccgccgcccuccc

SEQ ID NO: 2032127 - RNA, 19 nt, Human herpesvirus 5
acacuaagaauaaagaaaa

SEQ ID NO: 2032128 - RNA, 20 nt, Human herpesvirus 5
gccgcaacuucuaccaucuc

SEQ ID NO: 2032129 - RNA, 16 nt, Human herpesvirus 5
acgcgccccccaccua

SEQ ID NO: 2032130 - RNA, 17 nt, Human herpesvirus 5
augggucggaucgccgu

SEQ ID NO: 2032131 - RNA, 15 nt, Human herpesvirus 5
aggccuccagcgccu

SEQ ID NO: 2032132 - RNA, 12 nt, Human herpesvirus 5
cgcagcgcacca

SEQ ID NO: 2032133 - RNA, 21 nt, Human herpesvirus 5
cgcaacaacagcagcaacagc

SEQ ID NO: 2032134 - RNA, 21 nt, Human herpesvirus 5
accuggucaagguagaggaac

SEQ ID NO: 2032135 - RNA, 18 nt, Human herpesvirus 5
ggccuugcgcucccugcu

SEQ ID NO: 2032136 - RNA, 15 nt, Human herpesvirus 5
ccuuccuccucugcc

SEQ ID NO: 2032137 - RNA, 13 nt, Human herpesvirus 5
agcacgcggauga

SEQ ID NO: 2032138 - RNA, 21 nt, Human herpesvirus 5
gcacgcucugucggaugaggc

SEQ ID NO: 2032139 - RNA, 19 nt, Human herpesvirus 5
ccgacugcagcccaccgcc

SEQ ID NO: 2032140 - RNA, 18 nt, Human herpesvirus 5
guggcccuggucuggccc

SEQ ID NO: 2032141 - RNA, 22 nt, Human herpesvirus 5
gauagucaucucauuugcuuuu

SEQ ID NO: 2032142 - RNA, 17 nt, Human herpesvirus 5
gagucacacuuaagaaa

SEQ ID NO: 2032143 - RNA, 14 nt, Human herpesvirus 5
aggacgcgcuggcu

SEQ ID NO: 2032144 - RNA, 13 nt, Human herpesvirus 5
ccuccgcggcccg

SEQ ID NO: 2032145 - RNA, 15 nt, Human herpesvirus 5
gaaucgcgagcuggg

SEQ ID NO: 2032146 - RNA, 19 nt, Human herpesvirus 5
ucucacaccgucagcugcg

SEQ ID NO: 2032147 - RNA, 17 nt, Human herpesvirus 5
caacaacagcagcaaca

SEQ ID NO: 2032148 - RNA, 19 nt, Human herpesvirus 5
ugagcggcaggaaggccuc

SEQ ID NO: 2032149 - RNA, 19 nt, Human herpesvirus 5
gaccagaaucagcagugag

SEQ ID NO: 2032150 - RNA, 15 nt, Human herpesvirus 5
cagcucguggaccuc

SEQ ID NO: 2032151 - RNA, 22 nt, Human herpesvirus 5
gcugcuagaugaccauguucag

SEQ ID NO: 2032152 - RNA, 17 nt, Human herpesvirus 5
ggcggcgccgggcgcca

SEQ ID NO: 2032153 - RNA, 23 nt, Human herpesvirus 5
acacgccauaacaaaccacggac

SEQ ID NO: 2032154 - RNA, 19 nt, Human herpesvirus 5
agcgugcuaccagcugcag

SEQ ID NO: 2032155 - RNA, 22 nt, Human herpesvirus 5
ccugcgcgccuaccugacgccg

SEQ ID NO: 2032156 - RNA, 19 nt, Human herpesvirus 5
aucgggcgcgcaucgccgu

SEQ ID NO: 2032157 - RNA, 18 nt, Human herpesvirus 5
gaccuguuuaccucaugc

SEQ ID NO: 2032158 - RNA, 21 nt, Human herpesvirus 5
gcgagccccaucgggcccgcc

SEQ ID NO: 2032159 - RNA, 17 nt, Human herpesvirus 5
cggcuguggcuucucug

SEQ ID NO: 2032160 - RNA, 20 nt, Human herpesvirus 5
accggcgcaguuugcggcgc

SEQ ID NO: 2032161 - RNA, 19 nt, Human herpesvirus 5
ccagugcgucgcuguugag

SEQ ID NO: 2032162 - RNA, 20 nt, Human herpesvirus 5
ugucacggaacauguccugg

SEQ ID NO: 2032163 - RNA, 16 nt, Human herpesvirus 5
guggccgagcuaugcg

SEQ ID NO: 2032164 - RNA, 13 nt, Human herpesvirus 5
caagagaagaaac

SEQ ID NO: 2032165 - RNA, 17 nt, Human herpesvirus 5
guggcuucucuggagac

SEQ ID NO: 2032166 - RNA, 17 nt, Human herpesvirus 5
gcagaccuacagcaccc

SEQ ID NO: 2032167 - RNA, 21 nt, Human herpesvirus 5
acagcagcaacagcagccacc

SEQ ID NO: 2032168 - RNA, 13 nt, Human herpesvirus 5
uugagcucggaca

SEQ ID NO: 2032169 - RNA, 19 nt, Human herpesvirus 5
ugagcaggguaaaaaccac

SEQ ID NO: 2032170 - RNA, 16 nt, Human herpesvirus 5
gcuggccgccgcugca

SEQ ID NO: 2032171 - RNA, 22 nt, Human herpesvirus 5
ccggccgucgcaagggcugcuc

SEQ ID NO: 2032172 - RNA, 16 nt, Human herpesvirus 5
ugaucgugggccagga

SEQ ID NO: 2032173 - RNA, 11 nt, Human herpesvirus 5
ucuccugugga

SEQ ID NO: 2032174 - RNA, 18 nt, Human herpesvirus 5
aguggauuugggcgugga

SEQ ID NO: 2032175 - RNA, 18 nt, Human herpesvirus 5
cccacaaaggguaucugg

SEQ ID NO: 2032176 - RNA, 12 nt, Human herpesvirus 5
uaccugggcugc

SEQ ID NO: 2032177 - RNA, 22 nt, Human herpesvirus 5
cucuauuguguguacgacagcc

SEQ ID NO: 2032178 - RNA, 21 nt, Human herpesvirus 5
accuccccuaacgucacuuca

SEQ ID NO: 2032179 - RNA, 15 nt, Human herpesvirus 5
agcuuuugcccgcac

SEQ ID NO: 2032180 - RNA, 15 nt, Human herpesvirus 5
ucuggcgaucugccu

SEQ ID NO: 2032181 - RNA, 15 nt, Human herpesvirus 5
cagcgucuggccagc

SEQ ID NO: 2032182 - RNA, 11 nt, Human herpesvirus 5
gggcggcaggg

SEQ ID NO: 2032183 - RNA, 13 nt, Human herpesvirus 5
cugugggcccacu

SEQ ID NO: 2032184 - RNA, 13 nt, Human herpesvirus 5
ucuccgucucugg

SEQ ID NO: 2032185 - RNA, 23 nt, Human herpesvirus 5
ucacuuuuaacagcucaugccuc

SEQ ID NO: 2032186 - RNA, 21 nt, Human herpesvirus 5
cggcacuuuacauaaaaccac

SEQ ID NO: 2032187 - RNA, 16 nt, Human herpesvirus 5
cgaugugcagggacag

SEQ ID NO: 2032188 - RNA, 16 nt, Human herpesvirus 5
guacugcgacggcagc

SEQ ID NO: 2032189 - RNA, 18 nt, Human herpesvirus 5
cauacaaaccccgugucc

SEQ ID NO: 2032190 - RNA, 15 nt, Human herpesvirus 5
cccucagccucugug

SEQ ID NO: 2032191 - RNA, 19 nt, Human herpesvirus 5
ccacggugcuuuucaucua

SEQ ID NO: 2032192 - RNA, 19 nt, Human herpesvirus 5
ggcaaacuccgacauucgc

SEQ ID NO: 2032193 - RNA, 23 nt, Human herpesvirus 5
gccuguggugcgacugcggcgac

SEQ ID NO: 2032194 - RNA, 18 nt, Human herpesvirus 5
cgacaucuuccgcgagca

SEQ ID NO: 2032195 - RNA, 22 nt, Human herpesvirus 5
ccgucgccauggcuauguacac

SEQ ID NO: 2032196 - RNA, 15 nt, Human herpesvirus 5
gagaaacccccaccc

SEQ ID NO: 2032197 - RNA, 14 nt, Human herpesvirus 5
cugcugagacugag

SEQ ID NO: 2032198 - RNA, 19 nt, Human herpesvirus 5
cugugucgcaugagaucca

SEQ ID NO: 2032199 - RNA, 16 nt, Human herpesvirus 5
aguaucaccuggaagg

SEQ ID NO: 2032200 - RNA, 19 nt, Human herpesvirus 5
caacgcgugaaacaagagc

SEQ ID NO: 2032201 - RNA, 14 nt, Human herpesvirus 5
cacguuaauuccag

SEQ ID NO: 2032202 - RNA, 14 nt, Human herpesvirus 5
acaagaaacacagg

SEQ ID NO: 2032203 - RNA, 19 nt, Human herpesvirus 5
acucgcacaaccuguggug

SEQ ID NO: 2032204 - RNA, 19 nt, Human herpesvirus 5
acucuaucgcgacagacau

SEQ ID NO: 2032205 - RNA, 20 nt, Human herpesvirus 5
aagccgacaaccugcugcac

SEQ ID NO: 2032206 - RNA, 16 nt, Human herpesvirus 5
agucaacacuaccaag

SEQ ID NO: 2032207 - RNA, 22 nt, Human herpesvirus 5
augccaugcggauccagcugcu

SEQ ID NO: 2032208 - RNA, 14 nt, Human herpesvirus 5
caccgucccucagc

SEQ ID NO: 2032209 - RNA, 13 nt, Human herpesvirus 5
gcggaggagguga

SEQ ID NO: 2032210 - RNA, 23 nt, Human herpesvirus 5
cuacggaguuuucccucagccuc

SEQ ID NO: 2032211 - RNA, 18 nt, Human herpesvirus 5
uucggccgcggaggugcu

SEQ ID NO: 2032212 - RNA, 13 nt, Human herpesvirus 5
ccgugccagcugg

SEQ ID NO: 2032213 - RNA, 17 nt, Human herpesvirus 5
ucugcgacuccuggacc

SEQ ID NO: 2032214 - RNA, 13 nt, Human herpesvirus 5
ucgugcgaggaca

SEQ ID NO: 2032215 - RNA, 20 nt, Human herpesvirus 5
ccucggguugccuggacgcc

SEQ ID NO: 2032216 - RNA, 17 nt, Human herpesvirus 5
cgaugcugcaaggccuc

SEQ ID NO: 2032217 - RNA, 14 nt, Human herpesvirus 5
ucuccgguuucaaa

SEQ ID NO: 2032218 - RNA, 12 nt, Human herpesvirus 5
uggcagagccac

SEQ ID NO: 2032219 - RNA, 16 nt, Human herpesvirus 5
gccgccaacgccgagc

SEQ ID NO: 2032220 - RNA, 23 nt, Human herpesvirus 5
gccgccuuccaagauacgcgguc

SEQ ID NO: 2032221 - RNA, 15 nt, Human herpesvirus 5
gaugagauaaaagua

SEQ ID NO: 2032222 - RNA, 18 nt, Human herpesvirus 5
acugggagacggccugga

SEQ ID NO: 2032223 - RNA, 14 nt, Human herpesvirus 5
cucugccugggcac

SEQ ID NO: 2032224 - RNA, 17 nt, Human herpesvirus 5
ggcgggcgcgggguggc

SEQ ID NO: 2032225 - RNA, 23 nt, Human herpesvirus 5
acccucaaaacaucaccaccauc

SEQ ID NO: 2032226 - RNA, 20 nt, Human herpesvirus 5
gcggugcgcugcagccggag

SEQ ID NO: 2032227 - RNA, 17 nt, Human herpesvirus 5
ggcgguuucagcuggca

SEQ ID NO: 2032228 - RNA, 24 nt, Human herpesvirus 5
caacuaccgugccaccugcgagga

SEQ ID NO: 2032229 - RNA, 18 nt, Human herpesvirus 5
gugauuauaucuuucuac

SEQ ID NO: 2032230 - RNA, 13 nt, Human herpesvirus 5
cucacuguuugaa

SEQ ID NO: 2032231 - RNA, 19 nt, Human herpesvirus 5
cggucccccccguccaggu

SEQ ID NO: 2032232 - RNA, 16 nt, Human herpesvirus 5
aucgcaacaacagcaa

SEQ ID NO: 2032233 - RNA, 13 nt, Human herpesvirus 5
aacgcuggcucac

SEQ ID NO: 2032234 - RNA, 22 nt, Human herpesvirus 5
gccgagcuaugcgagcggggac

SEQ ID NO: 2032235 - RNA, 14 nt, Human herpesvirus 5
cccccguggccgcu

SEQ ID NO: 2032236 - RNA, 13 nt, Human herpesvirus 5
uaccaagaauaaa

SEQ ID NO: 2032237 - RNA, 13 nt, Human herpesvirus 5
uaacgauaugucg

SEQ ID NO: 2032238 - RNA, 15 nt, Human herpesvirus 5
ggguuggcagcuggc

SEQ ID NO: 2032239 - RNA, 18 nt, Human herpesvirus 5
guccgcggacacccgcgg

SEQ ID NO: 2032240 - RNA, 22 nt, Human herpesvirus 5
acaccaguauugguucugggcg

SEQ ID NO: 2032241 - RNA, 20 nt, Human herpesvirus 5
ugacacagcuccugaaugag

SEQ ID NO: 2032242 - RNA, 17 nt, Human herpesvirus 5
cgccaacgcgagcuggc

SEQ ID NO: 2032243 - RNA, 21 nt, Human herpesvirus 5
gcuggacugacacagcuccug

SEQ ID NO: 2032244 - RNA, 21 nt, Human herpesvirus 5
cuuccuagcgacggcggccau

SEQ ID NO: 2032245 - RNA, 20 nt, Human herpesvirus 5
agcguauuuucuacuccgaa

SEQ ID NO: 2032246 - RNA, 12 nt, Human herpesvirus 5
aguagugguggg

SEQ ID NO: 2032247 - RNA, 14 nt, Human herpesvirus 5
uccccugccaccuc

SEQ ID NO: 2032248 - RNA, 17 nt, Human herpesvirus 5
cggcagcaugggcgaca

SEQ ID NO: 2032249 - RNA, 15 nt, Human herpesvirus 5
uuauaaggaggcaaa

SEQ ID NO: 2032250 - RNA, 21 nt, Human herpesvirus 5
agcauguuuuaggaaugacac

SEQ ID NO: 2032251 - RNA, 16 nt, Human herpesvirus 5
cugcagccggaggaag

SEQ ID NO: 2032252 - RNA, 14 nt, Human herpesvirus 5
ccuggucuggccca

SEQ ID NO: 2032253 - RNA, 23 nt, Human herpesvirus 5
ggccgccugaggaaggggaggag

SEQ ID NO: 2032254 - RNA, 16 nt, Human herpesvirus 5
cguaacgguggaauaa

SEQ ID NO: 2032255 - RNA, 16 nt, Human herpesvirus 5
uguaggcgacuggcua

SEQ ID NO: 2032256 - RNA, 20 nt, Human herpesvirus 5
gcguagucuggcagcguuau

SEQ ID NO: 2032257 - RNA, 15 nt, Human herpesvirus 5
agcuggugcaucacg

SEQ ID NO: 2032258 - RNA, 17 nt, Human herpesvirus 5
uaccaauacugcaucca

SEQ ID NO: 2032259 - RNA, 15 nt, Human herpesvirus 5
gcaucgucaaagccg

SEQ ID NO: 2032260 - RNA, 11 nt, Human herpesvirus 5
ccccgcugucg

SEQ ID NO: 2032261 - RNA, 17 nt, Human herpesvirus 5
uuuggaggauguucugc

SEQ ID NO: 2032262 - RNA, 12 nt, Human herpesvirus 5
gcaucacccgcc

SEQ ID NO: 2032263 - RNA, 20 nt, Human herpesvirus 5
gccggagcuacgcgaccagc

SEQ ID NO: 2032264 - RNA, 19 nt, Human herpesvirus 5
agugcgucuacgaccaaag

SEQ ID NO: 2032265 - RNA, 13 nt, Human herpesvirus 5
cgacucgcugccg

SEQ ID NO: 2032266 - RNA, 13 nt, Human herpesvirus 5
cggccgugcagca

SEQ ID NO: 2032267 - RNA, 13 nt, Human herpesvirus 5
ggcgacagacggc

SEQ ID NO: 2032268 - RNA, 23 nt, Human herpesvirus 5
gaaaccacgccggcgguuacaga

SEQ ID NO: 2032269 - RNA, 12 nt, Human herpesvirus 5
gguacugcugug

SEQ ID NO: 2032270 - RNA, 17 nt, Human herpesvirus 5
cagcccauccucgugga

SEQ ID NO: 2032271 - RNA, 12 nt, Human herpesvirus 5
gacauuccccac

SEQ ID NO: 2032272 - RNA, 16 nt, Human herpesvirus 5
gcugcauaaagggcga

SEQ ID NO: 2032273 - RNA, 19 nt, Human herpesvirus 5
uaaagucuggguuuccaga

SEQ ID NO: 2032274 - RNA, 21 nt, Human herpesvirus 5
gucagcgaacgacgcagugcg

SEQ ID NO: 2032275 - RNA, 20 nt, Human herpesvirus 5
cccuggaagcgugugugggc

SEQ ID NO: 2032276 - RNA, 13 nt, Human herpesvirus 5
gacgucaaagcuc

SEQ ID NO: 2032277 - RNA, 18 nt, Human herpesvirus 5
uacaaucauaauauucua

SEQ ID NO: 2032278 - RNA, 20 nt, Human herpesvirus 5
aacagccccgaagguuagcg

SEQ ID NO: 2032279 - RNA, 23 nt, Human herpesvirus 5
aacaaccuaugauauaaagcggu

SEQ ID NO: 2032280 - RNA, 18 nt, Human herpesvirus 5
aacaacgucacuucugcu

SEQ ID NO: 2032281 - RNA, 13 nt, Human herpesvirus 5
aacacgcaacacg

SEQ ID NO: 2032282 - RNA, 21 nt, Human herpesvirus 5
aacacguaacgucuucugaag

SEQ ID NO: 2032283 - RNA, 16 nt, Human herpesvirus 5
aacacuccucuccccg

SEQ ID NO: 2032284 - RNA, 14 nt, Human herpesvirus 5
aacacuggcugcgc

SEQ ID NO: 2032285 - RNA, 12 nt, Human herpesvirus 5
aacaccgcgagu

SEQ ID NO: 2032286 - RNA, 21 nt, Human herpesvirus 5
aacaccguguucucccgacgu

SEQ ID NO: 2032287 - RNA, 20 nt, Human herpesvirus 5
aaaccgcaggcccucggaag

SEQ ID NO: 2032288 - RNA, 23 nt, Human herpesvirus 5
aaaacaugcgguguuuccgaugg

SEQ ID NO: 2032289 - RNA, 23 nt, Human herpesvirus 5
aaaauuucguaaacgacgucguc

SEQ ID NO: 2032290 - RNA, 21 nt, Human herpesvirus 5
aaacccacgaccauuuccgug

SEQ ID NO: 2032291 - RNA, 20 nt, Human herpesvirus 5
aaacuagcauucuggugaga

SEQ ID NO: 2032292 - RNA, 18 nt, Human herpesvirus 5
aaagggcgaacguccucg

SEQ ID NO: 2032293 - RNA, 22 nt, Human herpesvirus 5
aacagacuugguacgcugacgu

SEQ ID NO: 2032294 - RNA, 14 nt, Human herpesvirus 5
cgcuggcucggcgc

SEQ ID NO: 2032295 - RNA, 18 nt, Human herpesvirus 5
cgcuggcucggcgcggcu

SEQ ID NO: 2032296 - RNA, 13 nt, Human herpesvirus 5
cgcugcugcucuc

SEQ ID NO: 2032297 - RNA, 20 nt, Human herpesvirus 5
cgcugcuucauccagcuccg

SEQ ID NO: 2032298 - RNA, 14 nt, Human herpesvirus 5
cgcccgagacggcg

SEQ ID NO: 2032299 - RNA, 15 nt, Human herpesvirus 5
cgcccgagacggcgg

SEQ ID NO: 2032300 - RNA, 16 nt, Human herpesvirus 5
cgcccgagacggcggc

SEQ ID NO: 2032301 - RNA, 15 nt, Human herpesvirus 5
cgcccgacugcggac

SEQ ID NO: 2032302 - RNA, 21 nt, Human herpesvirus 5
cgccgaacagacuugguacgc

SEQ ID NO: 2032303 - RNA, 15 nt, Human herpesvirus 5
cgcccucgacggcgg

SEQ ID NO: 2032304 - RNA, 16 nt, Human herpesvirus 5
cgcccucgacggcggu

SEQ ID NO: 2032305 - RNA, 24 nt, Human herpesvirus 5
cgcguguuuugucugagcgccgac

SEQ ID NO: 2032306 - RNA, 14 nt, Human herpesvirus 5
cgcccgggccgccu

SEQ ID NO: 2032307 - RNA, 18 nt, Human herpesvirus 5
cgcguuuaccgaggagau

SEQ ID NO: 2032308 - RNA, 18 nt, Human herpesvirus 5
cgcuaagagcuuugacgc

SEQ ID NO: 2032309 - RNA, 16 nt, Human herpesvirus 5
cgcuaggcggcgccgg

SEQ ID NO: 2032310 - RNA, 19 nt, Human herpesvirus 5
cgcguuuguugcgcggcga

SEQ ID NO: 2032311 - RNA, 16 nt, Human herpesvirus 5
cgcucagcgagcucgu

SEQ ID NO: 2032312 - RNA, 13 nt, Human herpesvirus 5
cgcuauggcggcc

SEQ ID NO: 2032313 - RNA, 15 nt, Human herpesvirus 5
cgcuauggcggccau

SEQ ID NO: 2032314 - RNA, 24 nt, Human herpesvirus 5
cgcuccuggaucuuggcggccgag

SEQ ID NO: 2032315 - RNA, 19 nt, Human herpesvirus 5
cgcuacgucggccaacaac

SEQ ID NO: 2032316 - RNA, 16 nt, Human herpesvirus 5
cgcucccugcuccgca

SEQ ID NO: 2032317 - RNA, 17 nt, Human herpesvirus 5
cccggcacccgagcacg

SEQ ID NO: 2032318 - RNA, 20 nt, Human herpesvirus 5
cccgcuucaacgccugcacc

SEQ ID NO: 2032319 - RNA, 13 nt, Human herpesvirus 5
ccgacgacgacga

SEQ ID NO: 2032320 - RNA, 13 nt, Human herpesvirus 5
ccgaccacgacac

SEQ ID NO: 2032321 - RNA, 17 nt, Human herpesvirus 5
ccgacgcgcgaccgcga

SEQ ID NO: 2032322 - RNA, 16 nt, Human herpesvirus 5
ccgacgcggcagcggc

SEQ ID NO: 2032323 - RNA, 20 nt, Human herpesvirus 5
ccgacgcuggcgcugcggcu

SEQ ID NO: 2032324 - RNA, 20 nt, Human herpesvirus 5
ccgacggccaaucgcguggc

SEQ ID NO: 2032325 - RNA, 16 nt, Human herpesvirus 5
ccgacgucgcgucggc

SEQ ID NO: 2032326 - RNA, 15 nt, Human herpesvirus 5
ccgagacggaggaau

SEQ ID NO: 2032327 - RNA, 14 nt, Human herpesvirus 5
ccgagcacguacac

SEQ ID NO: 2032328 - RNA, 19 nt, Human herpesvirus 5
ccgagcaggugcgcguggu

SEQ ID NO: 2032329 - RNA, 14 nt, Human herpesvirus 5
ccgagcccaacuuu

SEQ ID NO: 2032330 - RNA, 19 nt, Human herpesvirus 5
ccgagcccccgucgcccga

SEQ ID NO: 2032331 - RNA, 14 nt, Human herpesvirus 5
ccgaguaacgcgcc

SEQ ID NO: 2032332 - RNA, 16 nt, Human herpesvirus 5
ccgagucggacgacga

SEQ ID NO: 2032333 - RNA, 19 nt, Human herpesvirus 5
cgagcauggaucacgcgcu

SEQ ID NO: 2032334 - RNA, 15 nt, Human herpesvirus 5
cgagcccccgucgcc

SEQ ID NO: 2032335 - RNA, 22 nt, Human herpesvirus 5
cgauguuucggaguaccgagua

SEQ ID NO: 2032336 - RNA, 15 nt, Human herpesvirus 5
cgcaagacgcgccuc

SEQ ID NO: 2032337 - RNA, 14 nt, Human herpesvirus 5
cgcacccgacggcg

SEQ ID NO: 2032338 - RNA, 15 nt, Human herpesvirus 5
cgcaaaggccacgug

SEQ ID NO: 2032339 - RNA, 23 nt, Human herpesvirus 5
cgcaaugggcuucccuccugcag

SEQ ID NO: 2032340 - RNA, 20 nt, Human herpesvirus 5
cgcacaacugguuccugcag

SEQ ID NO: 2032341 - RNA, 14 nt, Human herpesvirus 5
cgcagucgcucauc

SEQ ID NO: 2032342 - RNA, 16 nt, Human herpesvirus 5
cgccaacgccgagcuc

SEQ ID NO: 2032343 - RNA, 15 nt, Human herpesvirus 5
cgcaugggaaaguac

SEQ ID NO: 2032344 - RNA, 15 nt, Human herpesvirus 5
cgccacaacgccguc

SEQ ID NO: 2032345 - RNA, 19 nt, Human herpesvirus 5
cgccaacuaccgugccacc

SEQ ID NO: 2032346 - RNA, 14 nt, Human herpesvirus 5
cgcagccuccucgc

SEQ ID NO: 2032347 - RNA, 17 nt, Human herpesvirus 5
cgcagcccggcuccgcg

SEQ ID NO: 2032348 - RNA, 22 nt, Human herpesvirus 5
augcguguucaguugggcggca

SEQ ID NO: 2032349 - RNA, 17 nt, Human herpesvirus 5
augcggucggucagccg

SEQ ID NO: 2032350 - RNA, 16 nt, Human herpesvirus 5
auggcuaacgucucgg

SEQ ID NO: 2032351 - RNA, 21 nt, Human herpesvirus 5
auggauugggcggacgugcgu

SEQ ID NO: 2032352 - RNA, 13 nt, Human herpesvirus 5
auggccaacagcc

SEQ ID NO: 2032353 - RNA, 13 nt, Human herpesvirus 5
auguaaggcggcg

SEQ ID NO: 2032354 - RNA, 23 nt, Human herpesvirus 5
caaacgccgcgacaacggccgcc

SEQ ID NO: 2032355 - RNA, 20 nt, Human herpesvirus 5
caaacgcgggcccggacgcg

SEQ ID NO: 2032356 - RNA, 14 nt, Human herpesvirus 5
caaacgcugcuugg

SEQ ID NO: 2032357 - RNA, 16 nt, Human herpesvirus 5
caaacacagacaggcg

SEQ ID NO: 2032358 - RNA, 17 nt, Human herpesvirus 5
caaacacagacaggcgg

SEQ ID NO: 2032359 - RNA, 22 nt, Human herpesvirus 5
caaaagacguuaucgaugcugc

SEQ ID NO: 2032360 - RNA, 14 nt, Human herpesvirus 5
caacaaaaaaaagg

SEQ ID NO: 2032361 - RNA, 19 nt, Human herpesvirus 5
caacaaaaaaaaggaggac

SEQ ID NO: 2032362 - RNA, 14 nt, Human herpesvirus 5
caaagaacgaaaac

SEQ ID NO: 2032363 - RNA, 20 nt, Human herpesvirus 5
caaagacgaugauaccgaag

SEQ ID NO: 2032364 - RNA, 22 nt, Human herpesvirus 5
caaaggacucgcucacgucguu

SEQ ID NO: 2032365 - RNA, 13 nt, Human herpesvirus 5
caagcuugguaca

SEQ ID NO: 2032366 - RNA, 16 nt, Human herpesvirus 5
caaggcuccgaaaccg

SEQ ID NO: 2032367 - RNA, 22 nt, Human herpesvirus 5
caaggugauuauuaaaccgccc

SEQ ID NO: 2032368 - RNA, 12 nt, Human herpesvirus 5
caagcggccgcc

SEQ ID NO: 2032369 - RNA, 21 nt, Human herpesvirus 5
caagcucguuucgccggcgcg

SEQ ID NO: 2032370 - RNA, 20 nt, Human herpesvirus 5
caagcgcccgaagccgcgcg

SEQ ID NO: 2032371 - RNA, 12 nt, Human herpesvirus 5
ccaagcacgcca

SEQ ID NO: 2032372 - RNA, 19 nt, Human herpesvirus 5
ccaaaccgcaggagcugcu

SEQ ID NO: 2032373 - RNA, 16 nt, Human herpesvirus 5
ccaaagccgccgccga

SEQ ID NO: 2032374 - RNA, 16 nt, Human herpesvirus 5
cauuggcaacaucacc

SEQ ID NO: 2032375 - RNA, 22 nt, Human herpesvirus 5
cagggaauuuugaaaaccgcgc

SEQ ID NO: 2032376 - RNA, 15 nt, Human herpesvirus 5
ccaaccgacguacga

SEQ ID NO: 2032377 - RNA, 13 nt, Human herpesvirus 5
ccaaccucgccgu

SEQ ID NO: 2032378 - RNA, 12 nt, Human herpesvirus 5
ccaacacguccc

SEQ ID NO: 2032379 - RNA, 15 nt, Human herpesvirus 5
cauguggcguacacg

SEQ ID NO: 2032380 - RNA, 17 nt, Human herpesvirus 5
cauguccggccgucgca

SEQ ID NO: 2032381 - RNA, 16 nt, Human herpesvirus 5
cagggcgcgccggcgc

SEQ ID NO: 2032382 - RNA, 17 nt, Human herpesvirus 5
caggggcuggacguggu

SEQ ID NO: 2032383 - RNA, 12 nt, Human herpesvirus 5
cagggcugcucc

SEQ ID NO: 2032384 - RNA, 17 nt, Human herpesvirus 5
cagggcugcuccaacuu

SEQ ID NO: 2032385 - RNA, 23 nt, Human herpesvirus 5
caggcgcaggaggcuaacgcgcu

SEQ ID NO: 2032386 - RNA, 15 nt, Human herpesvirus 5
caggccgacucgcgg

SEQ ID NO: 2032387 - RNA, 16 nt, Human herpesvirus 5
caggccagcugcgucg

SEQ ID NO: 2032388 - RNA, 16 nt, Human herpesvirus 5
caggcuguucacgcgg

SEQ ID NO: 2032389 - RNA, 17 nt, Human herpesvirus 5
ccccgauaugggccgcu

SEQ ID NO: 2032390 - RNA, 21 nt, Human herpesvirus 5
cccccgcugagcguuggcggc

SEQ ID NO: 2032391 - RNA, 14 nt, Human herpesvirus 5
ccccgauucccaca

SEQ ID NO: 2032392 - RNA, 19 nt, Human herpesvirus 5
cccgccguugcggccgccg

SEQ ID NO: 2032393 - RNA, 18 nt, Human herpesvirus 5
cccccgucgcccgaggcg

SEQ ID NO: 2032394 - RNA, 18 nt, Human herpesvirus 5
ccccgaauuugggcggug

SEQ ID NO: 2032395 - RNA, 16 nt, Human herpesvirus 5
ccccacccaguagaca

SEQ ID NO: 2032396 - RNA, 22 nt, Human herpesvirus 5
ccccaccuucccucuagagaca

SEQ ID NO: 2032397 - RNA, 21 nt, Human herpesvirus 5
cccaugacgcagucgcucauc

SEQ ID NO: 2032398 - RNA, 22 nt, Human herpesvirus 5
ccaggcugucaaucaugccggu

SEQ ID NO: 2032399 - RNA, 21 nt, Human herpesvirus 5
ccaggugucucuacgcuccua

SEQ ID NO: 2032400 - RNA, 12 nt, Human herpesvirus 5
ccaguugcuguu

SEQ ID NO: 2032401 - RNA, 20 nt, Human herpesvirus 5
ccaggauuucaccgccgcua

SEQ ID NO: 2032402 - RNA, 20 nt, Human herpesvirus 5
ucauaaauucugacacggcg

SEQ ID NO: 2032403 - RNA, 21 nt, Human herpesvirus 5
ucauacaaaccccguguccgc

SEQ ID NO: 2032404 - RNA, 19 nt, Human herpesvirus 5
ucaguguacacgcgcccag

SEQ ID NO: 2032405 - RNA, 15 nt, Human herpesvirus 5
uccaaccucgccguc

SEQ ID NO: 2032406 - RNA, 22 nt, Human herpesvirus 5
uccacugccaacccagcagccg

SEQ ID NO: 2032407 - RNA, 14 nt, Human herpesvirus 5
uccagcaccacguc

SEQ ID NO: 2032408 - RNA, 15 nt, Human herpesvirus 5
uccacgccaccgccg

SEQ ID NO: 2032409 - RNA, 15 nt, Human herpesvirus 5
ucgccugcgacggcg

SEQ ID NO: 2032410 - RNA, 21 nt, Human herpesvirus 5
uccacggccuccgacgagcgu

SEQ ID NO: 2032411 - RNA, 17 nt, Human herpesvirus 5
ucgcgccgugcgcgacg

SEQ ID NO: 2032412 - RNA, 12 nt, Human herpesvirus 5
ggcuggaggacu

SEQ ID NO: 2032413 - RNA, 17 nt, Human herpesvirus 5
gggcgcaucacccgccu

SEQ ID NO: 2032414 - RNA, 19 nt, Human herpesvirus 5
ggcguggaugagguacugc

SEQ ID NO: 2032415 - RNA, 16 nt, Human herpesvirus 5
ggcuccaugcugacgu

SEQ ID NO: 2032416 - RNA, 19 nt, Human herpesvirus 5
ggcugccuguuccugcugc

SEQ ID NO: 2032417 - RNA, 18 nt, Human herpesvirus 5
ggcugcgccuccucgucg

SEQ ID NO: 2032418 - RNA, 22 nt, Human herpesvirus 5
ggcugcgcgcucgucuccacgc

SEQ ID NO: 2032419 - RNA, 13 nt, Human herpesvirus 5
ggcugcugcacca

SEQ ID NO: 2032420 - RNA, 20 nt, Human herpesvirus 5
ggcucucggaucugcggcuc

SEQ ID NO: 2032421 - RNA, 15 nt, Human herpesvirus 5
ggcugaccgucgucc

SEQ ID NO: 2032422 - RNA, 21 nt, Human herpesvirus 5
ggccgccgccagcguccgcgc

SEQ ID NO: 2032423 - RNA, 11 nt, Human herpesvirus 5
ggccgccgccc

SEQ ID NO: 2032424 - RNA, 20 nt, Human herpesvirus 5
ggccgccggugcuucuucua

SEQ ID NO: 2032425 - RNA, 19 nt, Human herpesvirus 5
ggcgucuuccuccucgucg

SEQ ID NO: 2032426 - RNA, 21 nt, Human herpesvirus 5
ggcgugaccacgucaccgugc

SEQ ID NO: 2032427 - RNA, 22 nt, Human herpesvirus 5
ggcgguuucagcuggcaacgug

SEQ ID NO: 2032428 - RNA, 14 nt, Human herpesvirus 5
ggcgguggcugcgc

SEQ ID NO: 2032429 - RNA, 20 nt, Human herpesvirus 5
ggcgugcucaggccacccgc

SEQ ID NO: 2032430 - RNA, 17 nt, Human herpesvirus 5
gcgcgcgucuggacgcg

SEQ ID NO: 2032431 - RNA, 18 nt, Human herpesvirus 5
gcgcccgcgccucacgcu

SEQ ID NO: 2032432 - RNA, 19 nt, Human herpesvirus 5
gcgccccccaccuacgagc

SEQ ID NO: 2032433 - RNA, 19 nt, Human herpesvirus 5
gcgccaguacgauccuccg

SEQ ID NO: 2032434 - RNA, 23 nt, Human herpesvirus 5
gcgaggacaaggcuccgaaaccg

SEQ ID NO: 2032435 - RNA, 20 nt, Human herpesvirus 5
gcgcccgaagccgcgcgagc

SEQ ID NO: 2032436 - RNA, 13 nt, Human herpesvirus 5
gcgcccgcagaca

SEQ ID NO: 2032437 - RNA, 19 nt, Human herpesvirus 5
gcgcgcgguuucgccgccg

SEQ ID NO: 2032438 - RNA, 12 nt, Human herpesvirus 5
gcgcgcugcgug

SEQ ID NO: 2032439 - RNA, 24 nt, Human herpesvirus 5
ggcccgagcgguugccgugacgca

SEQ ID NO: 2032440 - RNA, 16 nt, Human herpesvirus 5
ggccgacggcagcgug

SEQ ID NO: 2032441 - RNA, 15 nt, Human herpesvirus 5
cuccgucacgccucu

SEQ ID NO: 2032442 - RNA, 14 nt, Human herpesvirus 5
cuccgucugcguca

SEQ ID NO: 2032443 - RNA, 14 nt, Human herpesvirus 5
cuccucguccucgu

SEQ ID NO: 2032444 - RNA, 14 nt, Human herpesvirus 5
cuccucgucgucgc

SEQ ID NO: 2032445 - RNA, 19 nt, Human herpesvirus 5
cuccucuuccaaaucuccg

SEQ ID NO: 2032446 - RNA, 22 nt, Human herpesvirus 5
cuccgcaguuacaccacacguc

SEQ ID NO: 2032447 - RNA, 22 nt, Human herpesvirus 5
cuccgcaagcgccgccaacgcg

SEQ ID NO: 2032448 - RNA, 22 nt, Human herpesvirus 5
cuccgaaggcggacggaggagu

SEQ ID NO: 2032449 - RNA, 17 nt, Human herpesvirus 5
cuccgacauucgcgucg

SEQ ID NO: 2032450 - RNA, 16 nt, Human herpesvirus 5
cuccgacuuccuccuc

SEQ ID NO: 2032451 - RNA, 16 nt, Human herpesvirus 5
cucgaccaggaggugu

SEQ ID NO: 2032452 - RNA, 15 nt, Human herpesvirus 5
cuccuccaccacggc

SEQ ID NO: 2032453 - RNA, 16 nt, Human herpesvirus 5
gcgcaagugccugcac

SEQ ID NO: 2032454 - RNA, 19 nt, Human herpesvirus 5
gcgauggcccgcuaucgca

SEQ ID NO: 2032455 - RNA, 16 nt, Human herpesvirus 5
gcgaguaucgggccgu

SEQ ID NO: 2032456 - RNA, 18 nt, Human herpesvirus 5
gcgagcggaacccgggcu

SEQ ID NO: 2032457 - RNA, 22 nt, Human herpesvirus 5
gcgagcgggguucaccugcagc

SEQ ID NO: 2032458 - RNA, 13 nt, Human herpesvirus 5
acgccacgucgga

SEQ ID NO: 2032459 - RNA, 16 nt, Human herpesvirus 5
acgccaugcucaagac

SEQ ID NO: 2032460 - RNA, 19 nt, Human herpesvirus 5
acgccaaguaccuaugcgc

SEQ ID NO: 2032461 - RNA, 23 nt, Human herpesvirus 5
acgccaaguaccuaugcgccgua

SEQ ID NO: 2032462 - RNA, 15 nt, Human herpesvirus 5
acgccgugggcggcg

SEQ ID NO: 2032463 - RNA, 16 nt, Human herpesvirus 5
acgccgugggcggcga

SEQ ID NO: 2032464 - RNA, 17 nt, Human herpesvirus 5
acgccgcgcgaacgacg

SEQ ID NO: 2032465 - RNA, 23 nt, Human herpesvirus 5
acgccggcggagacgacggcggu

SEQ ID NO: 2032466 - RNA, 13 nt, Human herpesvirus 5
acgccugggcgcg

SEQ ID NO: 2032467 - RNA, 18 nt, Human herpesvirus 5
acgccgaucauguccgag

SEQ ID NO: 2032468 - RNA, 15 nt, Human herpesvirus 5
acgcgacuggcgucg

SEQ ID NO: 2032469 - RNA, 14 nt, Human herpesvirus 5
acgcgccucauggc

SEQ ID NO: 2032470 - RNA, 18 nt, Human herpesvirus 5
acgcgccucauggcggcg

SEQ ID NO: 2032471 - RNA, 22 nt, Human herpesvirus 5
acgcgauuggccagcacgggga

SEQ ID NO: 2032472 - RNA, 21 nt, Human herpesvirus 5
acgcgcaagugccugcacgac

SEQ ID NO: 2032473 - RNA, 18 nt, Human herpesvirus 5
acgcggugaacgugcgcg

SEQ ID NO: 2032474 - RNA, 21 nt, Human herpesvirus 5
acgcgucagggcggugcggcg

SEQ ID NO: 2032475 - RNA, 23 nt, Human herpesvirus 5
acgcgucagggcggugcggcguu

SEQ ID NO: 2032476 - RNA, 15 nt, Human herpesvirus 5
acgcgcggcggcgga

SEQ ID NO: 2032477 - RNA, 22 nt, Human herpesvirus 5
acgcgcggcuagagcgcgaguu

SEQ ID NO: 2032478 - RNA, 23 nt, Human herpesvirus 5
acgcggaccgaucaccagaaggc

SEQ ID NO: 2032479 - RNA, 22 nt, Human herpesvirus 5
acgcgcgcacggcgcggucccg

SEQ ID NO: 2032480 - RNA, 17 nt, Human herpesvirus 5
acgcgcgcccgcgccuc

SEQ ID NO: 2032481 - RNA, 22 nt, Human herpesvirus 5
acgcgcgccugacccgcggcua

SEQ ID NO: 2032482 - RNA, 21 nt, Human herpesvirus 5
acguacaagaaccacguuguc

SEQ ID NO: 2032483 - RNA, 18 nt, Human herpesvirus 5
acguacgacugcgcggcc

SEQ ID NO: 2032484 - RNA, 22 nt, Human herpesvirus 5
acguacuguuuaaccacguugc

SEQ ID NO: 2032485 - RNA, 22 nt, Human herpesvirus 5
acguagaaaaguaacacacggc

SEQ ID NO: 2032486 - RNA, 21 nt, Human herpesvirus 5
acgucagguucacacgucguu

SEQ ID NO: 2032487 - RNA, 18 nt, Human herpesvirus 5
acgucaguuuaucgagcg

SEQ ID NO: 2032488 - RNA, 20 nt, Human herpesvirus 5
acguaguuccccuacgugac

SEQ ID NO: 2032489 - RNA, 20 nt, Human herpesvirus 5
acggugaugcguguggccgc

SEQ ID NO: 2032490 - RNA, 13 nt, Human herpesvirus 5
acggugcgcggcg

SEQ ID NO: 2032491 - RNA, 14 nt, Human herpesvirus 5
acggugcgcggcga

SEQ ID NO: 2032492 - RNA, 21 nt, Human herpesvirus 5
acggugcgcggcgacaagcug

SEQ ID NO: 2032493 - RNA, 14 nt, Human herpesvirus 5
acgguccgggcaca

SEQ ID NO: 2032494 - RNA, 23 nt, Human herpesvirus 5
acgguccguuauguccgcucgug

SEQ ID NO: 2032495 - RNA, 12 nt, Human herpesvirus 5
acgguggcggcg

SEQ ID NO: 2032496 - RNA, 20 nt, Human herpesvirus 5
acggugucgccaccguugac

SEQ ID NO: 2032497 - RNA, 16 nt, Human herpesvirus 5
acgguuuccacgccac

SEQ ID NO: 2032498 - RNA, 22 nt, Human herpesvirus 5
acgguacgcagucacugcgugu

SEQ ID NO: 2032499 - RNA, 14 nt, Human herpesvirus 5
acgggacggcggcg

SEQ ID NO: 2032500 - RNA, 22 nt, Human herpesvirus 5
acgggucucuuugacacgagcg

SEQ ID NO: 2032501 - RNA, 19 nt, Human herpesvirus 5
acgggggggaccgggggcg

SEQ ID NO: 2032502 - RNA, 21 nt, Human herpesvirus 5
acggccguuaucaaggccacu

SEQ ID NO: 2032503 - RNA, 17 nt, Human herpesvirus 5
acggcggaggagacggc

SEQ ID NO: 2032504 - RNA, 19 nt, Human herpesvirus 5
acggauugcgccaguuguc

SEQ ID NO: 2032505 - RNA, 15 nt, Human herpesvirus 5
acggccgccgacguc

SEQ ID NO: 2032506 - RNA, 19 nt, Human herpesvirus 5
acggcccccuaccugcgcg

SEQ ID NO: 2032507 - RNA, 14 nt, Human herpesvirus 5
acggcaacgagcag

SEQ ID NO: 2032508 - RNA, 15 nt, Human herpesvirus 5
acggagcacgggcug

SEQ ID NO: 2032509 - RNA, 13 nt, Human herpesvirus 5
acggagccguuac

SEQ ID NO: 2032510 - RNA, 22 nt, Human herpesvirus 5
acggagcucccacguuuacgcg

SEQ ID NO: 2032511 - RNA, 13 nt, Human herpesvirus 5
acggcgaaccgcc

SEQ ID NO: 2032512 - RNA, 15 nt, Human herpesvirus 5
acgcugcacgaccug

SEQ ID NO: 2032513 - RNA, 17 nt, Human herpesvirus 5
acgcguggcccuggucu

SEQ ID NO: 2032514 - RNA, 13 nt, Human herpesvirus 5
acgcggcagcggc

SEQ ID NO: 2032515 - RNA, 19 nt, Human herpesvirus 5
acgcggcguauccucaagu

SEQ ID NO: 2032516 - RNA, 18 nt, Human herpesvirus 5
acgcuguuagugguggcg

SEQ ID NO: 2032517 - RNA, 20 nt, Human herpesvirus 5
acgcuucauauuaguauacu

SEQ ID NO: 2032518 - RNA, 14 nt, Human herpesvirus 5
acgcuuccugcgcg

SEQ ID NO: 2032519 - RNA, 13 nt, Human herpesvirus 5
acgcuggaggacg

SEQ ID NO: 2032520 - RNA, 15 nt, Human herpesvirus 5
acggacggcaaggcg

SEQ ID NO: 2032521 - RNA, 17 nt, Human herpesvirus 5
acggacggcaaggcgga

SEQ ID NO: 2032522 - RNA, 23 nt, Human herpesvirus 5
agaccucauguacgccaccgauc

SEQ ID NO: 2032523 - RNA, 19 nt, Human herpesvirus 5
agacaucuuaugaagcuga

SEQ ID NO: 2032524 - RNA, 21 nt, Human herpesvirus 5
agacgaugauaccgaaggcga

SEQ ID NO: 2032525 - RNA, 12 nt, Human herpesvirus 5
agacgcugcgcu

SEQ ID NO: 2032526 - RNA, 21 nt, Human herpesvirus 5
agacggcgugacacagcacgc

SEQ ID NO: 2032527 - RNA, 15 nt, Human herpesvirus 5
agacugguggugaga

SEQ ID NO: 2032528 - RNA, 14 nt, Human herpesvirus 5
agacugugguggga

SEQ ID NO: 2032529 - RNA, 20 nt, Human herpesvirus 5
agagacguugauaauaaccg

SEQ ID NO: 2032530 - RNA, 16 nt, Human herpesvirus 5
caccgacccugcgucc

SEQ ID NO: 2032531 - RNA, 15 nt, Human herpesvirus 5
caccgacgacgacga

SEQ ID NO: 2032532 - RNA, 23 nt, Human herpesvirus 5
caccgacacagcagcaccaggcg

SEQ ID NO: 2032533 - RNA, 18 nt, Human herpesvirus 5
agagaaggguaggugcgc

SEQ ID NO: 2032534 - RNA, 12 nt, Human herpesvirus 5
acguguggcggg

SEQ ID NO: 2032535 - RNA, 22 nt, Human herpesvirus 5
acguguuucgcgaacuggcgcg

SEQ ID NO: 2032536 - RNA, 21 nt, Human herpesvirus 5
acgucggccaacaaccacggc

SEQ ID NO: 2032537 - RNA, 16 nt, Human herpesvirus 5
acgucguugaagacac

SEQ ID NO: 2032538 - RNA, 14 nt, Human herpesvirus 5
acgucuaugagaaa

SEQ ID NO: 2032539 - RNA, 18 nt, Human herpesvirus 5
acguggacguuacacggg

SEQ ID NO: 2032540 - RNA, 17 nt, Human herpesvirus 5
acguggguuucggugac

SEQ ID NO: 2032541 - RNA, 20 nt, Human herpesvirus 5
acgugguaacgauggcggcc

SEQ ID NO: 2032542 - RNA, 15 nt, Human herpesvirus 5
acguguccgcggaca

SEQ ID NO: 2032543 - RNA, 15 nt, Human herpesvirus 5
agaauggaccgucga

SEQ ID NO: 2032544 - RNA, 12 nt, Human herpesvirus 5
agaauguugcga

SEQ ID NO: 2032545 - RNA, 13 nt, Human herpesvirus 5
acggugacgagcg

SEQ ID NO: 2032546 - RNA, 16 nt, Human herpesvirus 5
acguaggccuccucuc

SEQ ID NO: 2032547 - RNA, 22 nt, Human herpesvirus 5
acgucgcagccaccggcgcagu

SEQ ID NO: 2032548 - RNA, 16 nt, Human herpesvirus 5
acgucucggacggacg

SEQ ID NO: 2032549 - RNA, 23 nt, Human herpesvirus 5
acgugcaggauguuacgcgaguc

SEQ ID NO: 2032550 - RNA, 23 nt, Human herpesvirus 5
caccugccucgacaucucgccgu

SEQ ID NO: 2032551 - RNA, 15 nt, Human herpesvirus 5
caccgaaagcgcgcu

SEQ ID NO: 2032552 - RNA, 21 nt, Human herpesvirus 5
cacgacggaguuugacuacga

SEQ ID NO: 2032553 - RNA, 12 nt, Human herpesvirus 5
cacgacggcucc

SEQ ID NO: 2032554 - RNA, 23 nt, Human herpesvirus 5
caccgcgaguaucgggccgucgc

SEQ ID NO: 2032555 - RNA, 19 nt, Human herpesvirus 5
caccgggacggccugggcg

SEQ ID NO: 2032556 - RNA, 20 nt, Human herpesvirus 5
caccgcuuuggucguagacg

SEQ ID NO: 2032557 - RNA, 22 nt, Human herpesvirus 5
caccggccuccgacgacgccga

SEQ ID NO: 2032558 - RNA, 14 nt, Human herpesvirus 5
caccgccuccgacg

SEQ ID NO: 2032559 - RNA, 18 nt, Human herpesvirus 5
caccgugccccacucgcu

SEQ ID NO: 2032560 - RNA, 23 nt, Human herpesvirus 5
caccgucgcguccgacgcgacgg

SEQ ID NO: 2032561 - RNA, 22 nt, Human herpesvirus 5
caccgucggcggggcggacugc

SEQ ID NO: 2032562 - RNA, 14 nt, Human herpesvirus 5
caccgugacaccgg

SEQ ID NO: 2032563 - RNA, 14 nt, Human herpesvirus 5
cacgaccgcgacga

SEQ ID NO: 2032564 - RNA, 17 nt, Human herpesvirus 5
cacgaccaagugucucu

SEQ ID NO: 2032565 - RNA, 14 nt, Human herpesvirus 5
cacgacgaccccgc

SEQ ID NO: 2032566 - RNA, 19 nt, Human herpesvirus 5
cacgaucgcuggugucucu

SEQ ID NO: 2032567 - RNA, 15 nt, Human herpesvirus 5
cacgcacgacaugac

SEQ ID NO: 2032568 - RNA, 23 nt, Human herpesvirus 5
cacgccccugaguucacgcgcgg

SEQ ID NO: 2032569 - RNA, 14 nt, Human herpesvirus 5
cacgccagacuugg

SEQ ID NO: 2032570 - RNA, 19 nt, Human herpesvirus 5
cacucacgcggccgucacg

SEQ ID NO: 2032571 - RNA, 23 nt, Human herpesvirus 5
cacuccacacgccauaacaaacc

SEQ ID NO: 2032572 - RNA, 17 nt, Human herpesvirus 5
cacugcuacccugcgcu

SEQ ID NO: 2032573 - RNA, 17 nt, Human herpesvirus 5
cacgccgaugcuccgcg

SEQ ID NO: 2032574 - RNA, 13 nt, Human herpesvirus 5
cacucgcaccggc

SEQ ID NO: 2032575 - RNA, 15 nt, Human herpesvirus 5
ccuaagacgucgcga

SEQ ID NO: 2032576 - RNA, 19 nt, Human herpesvirus 5
ccguguuuuugcucgagac

SEQ ID NO: 2032577 - RNA, 15 nt, Human herpesvirus 5
ccgcgucagcggccg

SEQ ID NO: 2032578 - RNA, 20 nt, Human herpesvirus 5
ccguggaucagccgccgccu

SEQ ID NO: 2032579 - RNA, 18 nt, Human herpesvirus 5
ccguguaaaaggcguccu

SEQ ID NO: 2032580 - RNA, 16 nt, Human herpesvirus 5
ccgugggucccggcgc

SEQ ID NO: 2032581 - RNA, 20 nt, Human herpesvirus 5
ccgcuuaacaacguguccag

SEQ ID NO: 2032582 - RNA, 21 nt, Human herpesvirus 5
ccguggagaugcaggaggugg

SEQ ID NO: 2032583 - RNA, 23 nt, Human herpesvirus 5
ccgcugauacuaucgggggagau

SEQ ID NO: 2032584 - RNA, 16 nt, Human herpesvirus 5
ccgcguagcgcuccug

SEQ ID NO: 2032585 - RNA, 14 nt, Human herpesvirus 5
ccuaugcgccguag

SEQ ID NO: 2032586 - RNA, 14 nt, Human herpesvirus 5
ccuauggcgccgug

SEQ ID NO: 2032587 - RNA, 16 nt, Human herpesvirus 5
ccuauccgcgcggcua

SEQ ID NO: 2032588 - RNA, 20 nt, Human herpesvirus 5
ccguuguguaugcaugucgc

SEQ ID NO: 2032589 - RNA, 23 nt, Human herpesvirus 5
ccuaucuccgacagcgcgacgag

SEQ ID NO: 2032590 - RNA, 16 nt, Human herpesvirus 5
ccucagcgugcucagc

SEQ ID NO: 2032591 - RNA, 19 nt, Human herpesvirus 5
ccucauguguauggcccug

SEQ ID NO: 2032592 - RNA, 13 nt, Human herpesvirus 5
cgcgagcggcgga

SEQ ID NO: 2032593 - RNA, 14 nt, Human herpesvirus 5
cgcgagcggcggac

SEQ ID NO: 2032594 - RNA, 18 nt, Human herpesvirus 5
cgcgagcuggccagcaaa

SEQ ID NO: 2032595 - RNA, 20 nt, Human herpesvirus 5
cgcgaggucugggaugugca

SEQ ID NO: 2032596 - RNA, 17 nt, Human herpesvirus 5
cgcgaggugucauguuc

SEQ ID NO: 2032597 - RNA, 17 nt, Human herpesvirus 5
cguguuuagucgcggcg

SEQ ID NO: 2032598 - RNA, 20 nt, Human herpesvirus 5
cguuaacuauuccacuagua

SEQ ID NO: 2032599 - RNA, 15 nt, Human herpesvirus 5
cguuacgccgacgug

SEQ ID NO: 2032600 - RNA, 19 nt, Human herpesvirus 5
cgcgcaagugccugcacga

SEQ ID NO: 2032601 - RNA, 15 nt, Human herpesvirus 5
cgcgcgcgaaggugu

SEQ ID NO: 2032602 - RNA, 22 nt, Human herpesvirus 5
cguucuccucgacgcgcggcgg

SEQ ID NO: 2032603 - RNA, 15 nt, Human herpesvirus 5
cguucgcaugucguc

SEQ ID NO: 2032604 - RNA, 18 nt, Human herpesvirus 5
cguucgcgugcacgcgcc

SEQ ID NO: 2032605 - RNA, 16 nt, Human herpesvirus 5
cguugcuuuggcggca

SEQ ID NO: 2032606 - RNA, 20 nt, Human herpesvirus 5
cguuguuucuguacggcguu

SEQ ID NO: 2032607 - RNA, 19 nt, Human herpesvirus 5
cguuccguggagucgucuc

SEQ ID NO: 2032608 - RNA, 19 nt, Human herpesvirus 5
cgcgagccccaucgggccc

SEQ ID NO: 2032609 - RNA, 21 nt, Human herpesvirus 5
cgcgcggucauauagccuccg

SEQ ID NO: 2032610 - RNA, 23 nt, Human herpesvirus 5
cguucacuuuuccguuuuacgug

SEQ ID NO: 2032611 - RNA, 13 nt, Human herpesvirus 5
cuacacuauguuc

SEQ ID NO: 2032612 - RNA, 19 nt, Human herpesvirus 5
cuaccaacgcuuccugcgc

SEQ ID NO: 2032613 - RNA, 21 nt, Human herpesvirus 5
ccgccacgacaaacacuaccg

SEQ ID NO: 2032614 - RNA, 18 nt, Human herpesvirus 5
ccgcggugcaggccgcgc

SEQ ID NO: 2032615 - RNA, 18 nt, Human herpesvirus 5
ccgcagcgaguugcugug

SEQ ID NO: 2032616 - RNA, 21 nt, Human herpesvirus 5
ccgcagcgaguugcugugcac

SEQ ID NO: 2032617 - RNA, 17 nt, Human herpesvirus 5
ccgcaacaacagcagca

SEQ ID NO: 2032618 - RNA, 13 nt, Human herpesvirus 5
ccgcagcgguggc

SEQ ID NO: 2032619 - RNA, 18 nt, Human herpesvirus 5
ccgcagcguggccggcgu

SEQ ID NO: 2032620 - RNA, 18 nt, Human herpesvirus 5
ccgcagcugcuggagcgc

SEQ ID NO: 2032621 - RNA, 15 nt, Human herpesvirus 5
ccgcaagcgccgcca

SEQ ID NO: 2032622 - RNA, 20 nt, Human herpesvirus 5
ccgcacgaccgcgacgaggu

SEQ ID NO: 2032623 - RNA, 18 nt, Human herpesvirus 5
ccgauccgcacgaccgcg

SEQ ID NO: 2032624 - RNA, 14 nt, Human herpesvirus 5
ccgaugcuccgcga

SEQ ID NO: 2032625 - RNA, 15 nt, Human herpesvirus 5
cagccgacacagcgg

SEQ ID NO: 2032626 - RNA, 13 nt, Human herpesvirus 5
cagcauacgggga

SEQ ID NO: 2032627 - RNA, 17 nt, Human herpesvirus 5
cagcauacggggaggag

SEQ ID NO: 2032628 - RNA, 19 nt, Human herpesvirus 5
cagcauacggggaggagac

SEQ ID NO: 2032629 - RNA, 21 nt, Human herpesvirus 5
cagcagggagccagauggcga

SEQ ID NO: 2032630 - RNA, 18 nt, Human herpesvirus 5
cagccaccgacacagcag

SEQ ID NO: 2032631 - RNA, 21 nt, Human herpesvirus 5
cagaccgcaacaacagcagca

SEQ ID NO: 2032632 - RNA, 18 nt, Human herpesvirus 5
cagcaguaugacgugcga

SEQ ID NO: 2032633 - RNA, 17 nt, Human herpesvirus 5
cagaaugaaccuuguaa

SEQ ID NO: 2032634 - RNA, 13 nt, Human herpesvirus 5
cagcccgaggugu

SEQ ID NO: 2032635 - RNA, 23 nt, Human herpesvirus 5
cagcgagcgcacccacucgucgc

SEQ ID NO: 2032636 - RNA, 18 nt, Human herpesvirus 5
cagcgagcucgaggaggg

SEQ ID NO: 2032637 - RNA, 14 nt, Human herpesvirus 5
cagcgagcugcgcg

SEQ ID NO: 2032638 - RNA, 17 nt, Human herpesvirus 5
cagcgacgucccgcgcg

SEQ ID NO: 2032639 - RNA, 21 nt, Human herpesvirus 5
aagccgccaauacagcacgua

SEQ ID NO: 2032640 - RNA, 16 nt, Human herpesvirus 5
aacuggccuggcggcg

SEQ ID NO: 2032641 - RNA, 13 nt, Human herpesvirus 5
aagaaacgcugga

SEQ ID NO: 2032642 - RNA, 20 nt, Human herpesvirus 5
aagaaucuaggaacacugaa

SEQ ID NO: 2032643 - RNA, 23 nt, Human herpesvirus 5
aagcaccguggggucaucgaccg

SEQ ID NO: 2032644 - RNA, 20 nt, Human herpesvirus 5
aagacaucgucacaccuauc

SEQ ID NO: 2032645 - RNA, 14 nt, Human herpesvirus 5
aacguguggugaga

SEQ ID NO: 2032646 - RNA, 19 nt, Human herpesvirus 5
aacgucaucucgccgacgu

SEQ ID NO: 2032647 - RNA, 17 nt, Human herpesvirus 5
agccgagcgggaggcgg

SEQ ID NO: 2032648 - RNA, 18 nt, Human herpesvirus 5
agccgccgacgcuggcgc

SEQ ID NO: 2032649 - RNA, 21 nt, Human herpesvirus 5
agccuguuagaaccgcgggcc

SEQ ID NO: 2032650 - RNA, 11 nt, Human herpesvirus 5
agcgacggcgg

SEQ ID NO: 2032651 - RNA, 20 nt, Human herpesvirus 5
agcgacgucccgcgcggauc

SEQ ID NO: 2032652 - RNA, 21 nt, Human herpesvirus 5
agccguguuuagucgcggcga

SEQ ID NO: 2032653 - RNA, 18 nt, Human herpesvirus 5
agccucaagaauccgucc

SEQ ID NO: 2032654 - RNA, 23 nt, Human herpesvirus 5
agccucgggugcaccgcggcacc

SEQ ID NO: 2032655 - RNA, 20 nt, Human herpesvirus 5
agcgucucauuugucuuuac

SEQ ID NO: 2032656 - RNA, 13 nt, Human herpesvirus 5
agcguuggcggcg

SEQ ID NO: 2032657 - RNA, 22 nt, Human herpesvirus 5
agcuacuuuggaaucacgcaga

SEQ ID NO: 2032658 - RNA, 21 nt, Human herpesvirus 5
agcuccauuaugcaggagacg

SEQ ID NO: 2032659 - RNA, 16 nt, Human herpesvirus 5
agcucgucgccagcgc

SEQ ID NO: 2032660 - RNA, 18 nt, Human herpesvirus 5
agcucguuucgccggcgc

SEQ ID NO: 2032661 - RNA, 14 nt, Human herpesvirus 5
agcucuacgagcug

SEQ ID NO: 2032662 - RNA, 18 nt, Human herpesvirus 5
aggucacacugggagacg

SEQ ID NO: 2032663 - RNA, 18 nt, Human herpesvirus 5
agcugcgcaggccgccgc

SEQ ID NO: 2032664 - RNA, 18 nt, Human herpesvirus 5
agcugcacucacgcggcc

SEQ ID NO: 2032665 - RNA, 16 nt, Human herpesvirus 5
agcugcccgccggcgg

SEQ ID NO: 2032666 - RNA, 14 nt, Human herpesvirus 5
agcucugucggcgc

SEQ ID NO: 2032667 - RNA, 20 nt, Human herpesvirus 5
agcucuuaaaggacgugaug

SEQ ID NO: 2032668 - RNA, 17 nt, Human herpesvirus 5
agguuugucuggcggcu

SEQ ID NO: 2032669 - RNA, 20 nt, Human herpesvirus 5
agguucuaagaccgcggcgc

SEQ ID NO: 2032670 - RNA, 21 nt, Human herpesvirus 5
aguaggcgcgcacccgacggc

SEQ ID NO: 2032671 - RNA, 20 nt, Human herpesvirus 5
aguaugaaaguuggcugcgc

SEQ ID NO: 2032672 - RNA, 12 nt, Human herpesvirus 5
aggucgcgcgua

SEQ ID NO: 2032673 - RNA, 20 nt, Human herpesvirus 5
aggucgucuuggaagccgau

SEQ ID NO: 2032674 - RNA, 12 nt, Human herpesvirus 5
agguggaggaca

SEQ ID NO: 2032675 - RNA, 13 nt, Human herpesvirus 5
agguguggcggca

SEQ ID NO: 2032676 - RNA, 14 nt, Human herpesvirus 5
aggugcuggcggcc

SEQ ID NO: 2032677 - RNA, 22 nt, Human herpesvirus 5
aucguuuacgggggauggcgau

SEQ ID NO: 2032678 - RNA, 20 nt, Human herpesvirus 5
aucuacaacuuaaccacaag

SEQ ID NO: 2032679 - RNA, 18 nt, Human herpesvirus 5
aucgucgcggacugccgg

SEQ ID NO: 2032680 - RNA, 15 nt, Human herpesvirus 5
aucgucuacgucguu

SEQ ID NO: 2032681 - RNA, 19 nt, Human herpesvirus 5
aucgcucgcuuuggagcgc

SEQ ID NO: 2032682 - RNA, 19 nt, Human herpesvirus 5
aguacaaaacaggaaagga

SEQ ID NO: 2032683 - RNA, 21 nt, Human herpesvirus 5
aucggcucucaggcgcgcaga

SEQ ID NO: 2032684 - RNA, 13 nt, Human herpesvirus 5
aguccggaggacg

SEQ ID NO: 2032685 - RNA, 16 nt, Human herpesvirus 5
agucgcgcggucgccg

SEQ ID NO: 2032686 - RNA, 16 nt, Human herpesvirus 5
agucgcucggaaacga

SEQ ID NO: 2032687 - RNA, 22 nt, Human herpesvirus 5
agucguaagaagcgcgaggacg

SEQ ID NO: 2032688 - RNA, 23 nt, Human herpesvirus 5
cauggacccgccgcuaccgucgc

SEQ ID NO: 2032689 - RNA, 23 nt, Human herpesvirus 5
caguguauuggcauauagccaau

SEQ ID NO: 2032690 - RNA, 19 nt, Human herpesvirus 5
cagugacgcuaggcggcgc

SEQ ID NO: 2032691 - RNA, 16 nt, Human herpesvirus 5
caguuaccaccgucgc

SEQ ID NO: 2032692 - RNA, 17 nt, Human herpesvirus 5
caguuaccaccgucgcc

SEQ ID NO: 2032693 - RNA, 20 nt, Human herpesvirus 5
cauaagaauaggaagaaacc

SEQ ID NO: 2032694 - RNA, 21 nt, Human herpesvirus 5
caguuuccgaagaugccgugu

SEQ ID NO: 2032695 - RNA, 20 nt, Human herpesvirus 5
cauaaugccgucaccgucgc

SEQ ID NO: 2032696 - RNA, 22 nt, Human herpesvirus 5
caucgguugccucuggguguug

SEQ ID NO: 2032697 - RNA, 21 nt, Human herpesvirus 5
caugcugagcaaguacacgcg

SEQ ID NO: 2032698 - RNA, 13 nt, Human herpesvirus 5
caucucacggaua

SEQ ID NO: 2032699 - RNA, 15 nt, Human herpesvirus 5
caugacgcacgccgg

SEQ ID NO: 2032700 - RNA, 15 nt, Human herpesvirus 5
augaccggacgugcu

SEQ ID NO: 2032701 - RNA, 18 nt, Human herpesvirus 5
augaggcgguggcugcgc

SEQ ID NO: 2032702 - RNA, 16 nt, Human herpesvirus 5
augaaucuuccccucu

SEQ ID NO: 2032703 - RNA, 15 nt, Human herpesvirus 5
aucuccgacagcgcg

SEQ ID NO: 2032704 - RNA, 21 nt, Human herpesvirus 5
aucugcccuauccgcgcggcu

SEQ ID NO: 2032705 - RNA, 15 nt, Human herpesvirus 5
aucugcugaaacugc

SEQ ID NO: 2032706 - RNA, 19 nt, Human herpesvirus 5
aucugggcagcggcugcgc

SEQ ID NO: 2032707 - RNA, 14 nt, Human herpesvirus 5
aucucaacgucaac

SEQ ID NO: 2032708 - RNA, 15 nt, Human herpesvirus 5
aucucaacgucaacg

SEQ ID NO: 2032709 - RNA, 24 nt, Human herpesvirus 5
aucucgccguacggcaacgagcag

SEQ ID NO: 2032710 - RNA, 23 nt, Human herpesvirus 5
cagcgccgggugcgcgacacggc

SEQ ID NO: 2032711 - RNA, 16 nt, Human herpesvirus 5
cagcgcuacgugcgcg

SEQ ID NO: 2032712 - RNA, 19 nt, Human herpesvirus 5
cagcggaaaaugccgccgc

SEQ ID NO: 2032713 - RNA, 18 nt, Human herpesvirus 5
cagcggaacucgaccucu

SEQ ID NO: 2032714 - RNA, 15 nt, Human herpesvirus 5
cagcgccaggcggcu

SEQ ID NO: 2032715 - RNA, 23 nt, Human herpesvirus 5
cagcgccaggcggcugaucugca

SEQ ID NO: 2032716 - RNA, 20 nt, Human herpesvirus 5
caguacaacaguuaucagca

SEQ ID NO: 2032717 - RNA, 17 nt, Human herpesvirus 5
caggguaaaaaccacgu

SEQ ID NO: 2032718 - RNA, 19 nt, Human herpesvirus 5
caggugugcgcgucggcgc

SEQ ID NO: 2032719 - RNA, 13 nt, Human herpesvirus 5
caguacgauccuc

SEQ ID NO: 2032720 - RNA, 16 nt, Human herpesvirus 5
caguauuuacuucacc

SEQ ID NO: 2032721 - RNA, 15 nt, Human herpesvirus 5
caguaugacgugcga

SEQ ID NO: 2032722 - RNA, 20 nt, Human herpesvirus 5
caguaccgacgacgacaguc

SEQ ID NO: 2032723 - RNA, 12 nt, Human herpesvirus 5
caguccgcuccg

SEQ ID NO: 2032724 - RNA, 21 nt, Human herpesvirus 5
cagcggucguuuuaaccgcag

SEQ ID NO: 2032725 - RNA, 21 nt, Human herpesvirus 5
cagcguauuuucuacuccgaa

SEQ ID NO: 2032726 - RNA, 20 nt, Human herpesvirus 5
cagcguucaaaggaauauua

SEQ ID NO: 2032727 - RNA, 13 nt, Human herpesvirus 5
cagcgucuggcca

SEQ ID NO: 2032728 - RNA, 16 nt, Human herpesvirus 5
cagcgcggaaaccgag

SEQ ID NO: 2032729 - RNA, 17 nt, Human herpesvirus 5
cagcggcggcgguggug

SEQ ID NO: 2032730 - RNA, 13 nt, Human herpesvirus 5
cagcggcugcgcg

SEQ ID NO: 2032731 - RNA, 12 nt, Human herpesvirus 5
cagcggaggugg

SEQ ID NO: 2032732 - RNA, 17 nt, Human herpesvirus 5
cagcggcgacagacggc

SEQ ID NO: 2032733 - RNA, 19 nt, Human herpesvirus 5
cggcacgccguugccacga

SEQ ID NO: 2032734 - RNA, 24 nt, Human herpesvirus 5
cggcacgccguugccacgagcaug

SEQ ID NO: 2032735 - RNA, 17 nt, Human herpesvirus 5
cggcaggaaggccucgu

SEQ ID NO: 2032736 - RNA, 18 nt, Human herpesvirus 5
cggcaggaaggccucguu

SEQ ID NO: 2032737 - RNA, 19 nt, Human herpesvirus 5
cggcagcggaacucgaccu

SEQ ID NO: 2032738 - RNA, 14 nt, Human herpesvirus 5
cggcaaucggugcg

SEQ ID NO: 2032739 - RNA, 21 nt, Human herpesvirus 5
cggcaaucggugcgauauccc

SEQ ID NO: 2032740 - RNA, 18 nt, Human herpesvirus 5
cggcaaggcggaggagag

SEQ ID NO: 2032741 - RNA, 20 nt, Human herpesvirus 5
cggcaccaucggacucgcca

SEQ ID NO: 2032742 - RNA, 15 nt, Human herpesvirus 5
cgccaccgauccgca

SEQ ID NO: 2032743 - RNA, 12 nt, Human herpesvirus 5
cgccagcgcgag

SEQ ID NO: 2032744 - RNA, 13 nt, Human herpesvirus 5
cgccagcggccug

SEQ ID NO: 2032745 - RNA, 14 nt, Human herpesvirus 5
cgccagcguccgcg

SEQ ID NO: 2032746 - RNA, 16 nt, Human herpesvirus 5
cgccacuauguccucc

SEQ ID NO: 2032747 - RNA, 21 nt, Human herpesvirus 5
cgccacauuggugaaggccgu

SEQ ID NO: 2032748 - RNA, 17 nt, Human herpesvirus 5
cgaugucaaggaacgcg

SEQ ID NO: 2032749 - RNA, 21 nt, Human herpesvirus 5
cgaugugugggaccuggucaa

SEQ ID NO: 2032750 - RNA, 18 nt, Human herpesvirus 5
cgaucuugacgcugcugg

SEQ ID NO: 2032751 - RNA, 19 nt, Human herpesvirus 5
cgaugaaccuuccccaccc

SEQ ID NO: 2032752 - RNA, 22 nt, Human herpesvirus 5
cgaugguauuacgcccgacgug

SEQ ID NO: 2032753 - RNA, 13 nt, Human herpesvirus 5
cgccaccgucgcc

SEQ ID NO: 2032754 - RNA, 16 nt, Human herpesvirus 5
cgaucaccagaaggcg

SEQ ID NO: 2032755 - RNA, 21 nt, Human herpesvirus 5
cgaucgcgcuuuugaccgcga

SEQ ID NO: 2032756 - RNA, 18 nt, Human herpesvirus 5
cgaucguaacccaggcgc

SEQ ID NO: 2032757 - RNA, 21 nt, Human herpesvirus 5
cgaucugugauccgugcgcuc

SEQ ID NO: 2032758 - RNA, 20 nt, Human herpesvirus 5
cgaguucggggugcaucauc

SEQ ID NO: 2032759 - RNA, 22 nt, Human herpesvirus 5
cgaguugcaaaagaagcugccc

SEQ ID NO: 2032760 - RNA, 18 nt, Human herpesvirus 5
cgaguuguagucgcggug

SEQ ID NO: 2032761 - RNA, 23 nt, Human herpesvirus 5
cgaguuguagucgcgguggcggc

SEQ ID NO: 2032762 - RNA, 15 nt, Human herpesvirus 5
cgaguccguccucga

SEQ ID NO: 2032763 - RNA, 15 nt, Human herpesvirus 5
cgccggcgggcggcu

SEQ ID NO: 2032764 - RNA, 17 nt, Human herpesvirus 5
cgccggggagacgacga

SEQ ID NO: 2032765 - RNA, 15 nt, Human herpesvirus 5
cgccgugggcggcga

SEQ ID NO: 2032766 - RNA, 18 nt, Human herpesvirus 5
cgccguguguuaccgccg

SEQ ID NO: 2032767 - RNA, 13 nt, Human herpesvirus 5
cgccguccugcag

SEQ ID NO: 2032768 - RNA, 19 nt, Human herpesvirus 5
cgccgucucgucacacggc

SEQ ID NO: 2032769 - RNA, 16 nt, Human herpesvirus 5
cgccgugacguccgcu

SEQ ID NO: 2032770 - RNA, 15 nt, Human herpesvirus 5
cgccgugcgcgacga

SEQ ID NO: 2032771 - RNA, 20 nt, Human herpesvirus 5
cgccucauggcggcggccac

SEQ ID NO: 2032772 - RNA, 17 nt, Human herpesvirus 5
cgccucacgcugcacga

SEQ ID NO: 2032773 - RNA, 19 nt, Human herpesvirus 5
cgccguugcggccgccgcu

SEQ ID NO: 2032774 - RNA, 20 nt, Human herpesvirus 5
cgccguuuugcuguccucgu

SEQ ID NO: 2032775 - RNA, 21 nt, Human herpesvirus 5
cgccucaaaaagcagguggag

SEQ ID NO: 2032776 - RNA, 13 nt, Human herpesvirus 5
cgcucggccucgc

SEQ ID NO: 2032777 - RNA, 15 nt, Human herpesvirus 5
cgccucuucuggccc

SEQ ID NO: 2032778 - RNA, 19 nt, Human herpesvirus 5
cgcucgcuuuggagcgcga

SEQ ID NO: 2032779 - RNA, 14 nt, Human herpesvirus 5
cgccuccgguggug

SEQ ID NO: 2032780 - RNA, 15 nt, Human herpesvirus 5
cgccuccguccucgu

SEQ ID NO: 2032781 - RNA, 15 nt, Human herpesvirus 5
cgcucugccggcugc

SEQ ID NO: 2032782 - RNA, 20 nt, Human herpesvirus 5
cgcucucgucaggcuuguca

SEQ ID NO: 2032783 - RNA, 16 nt, Human herpesvirus 5
cgcucugacgccgcgc

SEQ ID NO: 2032784 - RNA, 19 nt, Human herpesvirus 5
cgcucgucuccacgcucga

SEQ ID NO: 2032785 - RNA, 12 nt, Human herpesvirus 5
cggaucgcggua

SEQ ID NO: 2032786 - RNA, 23 nt, Human herpesvirus 5
cggaggaaucgucggcagagguc

SEQ ID NO: 2032787 - RNA, 23 nt, Human herpesvirus 5
cggagggccgccaauuggcggcg

SEQ ID NO: 2032788 - RNA, 18 nt, Human herpesvirus 5
cggagcagccgccagcga

SEQ ID NO: 2032789 - RNA, 22 nt, Human herpesvirus 5
cggagcaggaaccuccuccgcg

SEQ ID NO: 2032790 - RNA, 23 nt, Human herpesvirus 5
cggagcaggaaccuccuccgcga

SEQ ID NO: 2032791 - RNA, 18 nt, Human herpesvirus 5
cgcugauaacgacguggu

SEQ ID NO: 2032792 - RNA, 19 nt, Human herpesvirus 5
cgcugacagcauacgggga

SEQ ID NO: 2032793 - RNA, 20 nt, Human herpesvirus 5
cgcugacguugaugcggcgc

SEQ ID NO: 2032794 - RNA, 15 nt, Human herpesvirus 5
cgcugccgcucagcg

SEQ ID NO: 2032795 - RNA, 18 nt, Human herpesvirus 5
cgacagcgcgacgagcgc

SEQ ID NO: 2032796 - RNA, 12 nt, Human herpesvirus 5
cgaagugccgcg

SEQ ID NO: 2032797 - RNA, 15 nt, Human herpesvirus 5
cgaauuugggcggug

SEQ ID NO: 2032798 - RNA, 20 nt, Human herpesvirus 5
cgacacacguucgacaugga

SEQ ID NO: 2032799 - RNA, 20 nt, Human herpesvirus 5
cgacguuucgcgaggacaag

SEQ ID NO: 2032800 - RNA, 21 nt, Human herpesvirus 5
cgacuacgguuacuccacaac

SEQ ID NO: 2032801 - RNA, 22 nt, Human herpesvirus 5
cgacgugauuuacgaggucugc

SEQ ID NO: 2032802 - RNA, 17 nt, Human herpesvirus 5
cgagaugaaggaacgca

SEQ ID NO: 2032803 - RNA, 20 nt, Human herpesvirus 5
cgagggcccucgccggcggc

SEQ ID NO: 2032804 - RNA, 18 nt, Human herpesvirus 5
cgagucaccuagacgcaa

SEQ ID NO: 2032805 - RNA, 20 nt, Human herpesvirus 5
cgaguaccgcagcgaguugc

SEQ ID NO: 2032806 - RNA, 17 nt, Human herpesvirus 5
cgagagaugggccgcgg

SEQ ID NO: 2032807 - RNA, 22 nt, Human herpesvirus 5
cgagacggcgugacacagcacg

SEQ ID NO: 2032808 - RNA, 18 nt, Human herpesvirus 5
cgacuuuacggugcgcgg

SEQ ID NO: 2032809 - RNA, 17 nt, Human herpesvirus 5
cgacugcggcgacuggc

SEQ ID NO: 2032810 - RNA, 16 nt, Human herpesvirus 5
cgacuggcucaacuuu

SEQ ID NO: 2032811 - RNA, 14 nt, Human herpesvirus 5
ccacucccaccacg

SEQ ID NO: 2032812 - RNA, 20 nt, Human herpesvirus 5
ccacggaaguuccgacgcga

SEQ ID NO: 2032813 - RNA, 18 nt, Human herpesvirus 5
ccacguagucgcgcgcga

SEQ ID NO: 2032814 - RNA, 18 nt, Human herpesvirus 5
ccacggccugcgggcagg

SEQ ID NO: 2032815 - RNA, 17 nt, Human herpesvirus 5
ccacggcgaaccgccgu

SEQ ID NO: 2032816 - RNA, 20 nt, Human herpesvirus 5
ccacggcugcugaucgccgu

SEQ ID NO: 2032817 - RNA, 13 nt, Human herpesvirus 5
ccacgggccgcgc

SEQ ID NO: 2032818 - RNA, 20 nt, Human herpesvirus 5
caugaaguuguugaucugcu

SEQ ID NO: 2032819 - RNA, 21 nt, Human herpesvirus 5
ccacgcucgagggcuccgucu

SEQ ID NO: 2032820 - RNA, 23 nt, Human herpesvirus 5
ccacgcucgcucugacgccgcgc

SEQ ID NO: 2032821 - RNA, 17 nt, Human herpesvirus 5
ccagaggcccgccgaga

SEQ ID NO: 2032822 - RNA, 18 nt, Human herpesvirus 5
ccugggaacgcgcgcacg

SEQ ID NO: 2032823 - RNA, 20 nt, Human herpesvirus 5
cgaagacgccgucacgcagg

SEQ ID NO: 2032824 - RNA, 16 nt, Human herpesvirus 5
ccuggccuucggcacg

SEQ ID NO: 2032825 - RNA, 18 nt, Human herpesvirus 5
ccuggccuucggcacgcu

SEQ ID NO: 2032826 - RNA, 13 nt, Human herpesvirus 5
ccugcugcuacgc

SEQ ID NO: 2032827 - RNA, 20 nt, Human herpesvirus 5
ccugcagcgcuacgugcgcg

SEQ ID NO: 2032828 - RNA, 18 nt, Human herpesvirus 5
ccugccagucuccgcagu

SEQ ID NO: 2032829 - RNA, 20 nt, Human herpesvirus 5
ccugcacguccaugucgcga

SEQ ID NO: 2032830 - RNA, 17 nt, Human herpesvirus 5
ccugcagaccgaggcgc

SEQ ID NO: 2032831 - RNA, 22 nt, Human herpesvirus 5
ccagcagggcgcgccggcgcca

SEQ ID NO: 2032832 - RNA, 15 nt, Human herpesvirus 5
ccagauacgcguugg

SEQ ID NO: 2032833 - RNA, 21 nt, Human herpesvirus 5
ccugcacgacaucuuccgcga

SEQ ID NO: 2032834 - RNA, 18 nt, Human herpesvirus 5
ccugccgaagaccucacc

SEQ ID NO: 2032835 - RNA, 21 nt, Human herpesvirus 5
ccugccucgacaucucgccgu

SEQ ID NO: 2032836 - RNA, 19 nt, Human herpesvirus 5
ccugcgaggaccguacacg

SEQ ID NO: 2032837 - RNA, 20 nt, Human herpesvirus 5
gucgccagcgcgagcgcucg

SEQ ID NO: 2032838 - RNA, 13 nt, Human herpesvirus 5
gucgccugcgacg

SEQ ID NO: 2032839 - RNA, 15 nt, Human herpesvirus 5
gucgccuacacccgu

SEQ ID NO: 2032840 - RNA, 16 nt, Human herpesvirus 5
gucgcgcccacggucc

SEQ ID NO: 2032841 - RNA, 23 nt, Human herpesvirus 5
guccggaggagcguccgacgccg

SEQ ID NO: 2032842 - RNA, 13 nt, Human herpesvirus 5
guacgcgcacgcc

SEQ ID NO: 2032843 - RNA, 15 nt, Human herpesvirus 5
guccgugaucgccgc

SEQ ID NO: 2032844 - RNA, 16 nt, Human herpesvirus 5
guccgugaucgccgcg

SEQ ID NO: 2032845 - RNA, 16 nt, Human herpesvirus 5
guccucgcccggugag

SEQ ID NO: 2032846 - RNA, 20 nt, Human herpesvirus 5
guccgcucugagccggcucc

SEQ ID NO: 2032847 - RNA, 22 nt, Human herpesvirus 5
guccuucaucucuucgugacgg

SEQ ID NO: 2032848 - RNA, 22 nt, Human herpesvirus 5
gucgccgcgucagcggccgccg

SEQ ID NO: 2032849 - RNA, 12 nt, Human herpesvirus 5
gucgccgucacu

SEQ ID NO: 2032850 - RNA, 15 nt, Human herpesvirus 5
gucgcacaaagaagu

SEQ ID NO: 2032851 - RNA, 15 nt, Human herpesvirus 5
gucgcagucagaccc

SEQ ID NO: 2032852 - RNA, 18 nt, Human herpesvirus 5
gucgcaucaucaacagca

SEQ ID NO: 2032853 - RNA, 21 nt, Human herpesvirus 5
gucgcaucaucaacagcagca

SEQ ID NO: 2032854 - RNA, 14 nt, Human herpesvirus 5
gucgacgacgccgu

SEQ ID NO: 2032855 - RNA, 18 nt, Human herpesvirus 5
gucgaucuugacgcugcu

SEQ ID NO: 2032856 - RNA, 15 nt, Human herpesvirus 5
gucgaugccuguugg

SEQ ID NO: 2032857 - RNA, 18 nt, Human herpesvirus 5
gucgacuguugccgcgug

SEQ ID NO: 2032858 - RNA, 17 nt, Human herpesvirus 5
gucgagacuugcacgcu

SEQ ID NO: 2032859 - RNA, 14 nt, Human herpesvirus 5
gguuucggcgacgu

SEQ ID NO: 2032860 - RNA, 16 nt, Human herpesvirus 5
gguuucgggccgacgu

SEQ ID NO: 2032861 - RNA, 21 nt, Human herpesvirus 5
ggacucgguuucggcgacgug

SEQ ID NO: 2032862 - RNA, 14 nt, Human herpesvirus 5
ggagcucaaguacc

SEQ ID NO: 2032863 - RNA, 21 nt, Human herpesvirus 5
ggagcagcucuuuuccagcgu

SEQ ID NO: 2032864 - RNA, 18 nt, Human herpesvirus 5
gguuguuccggcggcgug

SEQ ID NO: 2032865 - RNA, 13 nt, Human herpesvirus 5
gguucgcugacga

SEQ ID NO: 2032866 - RNA, 17 nt, Human herpesvirus 5
gguuuucggacagagca

SEQ ID NO: 2032867 - RNA, 17 nt, Human herpesvirus 5
guaaaagcugcaugaaa

SEQ ID NO: 2032868 - RNA, 16 nt, Human herpesvirus 5
guaaagcccguggccc

SEQ ID NO: 2032869 - RNA, 11 nt, Human herpesvirus 5
guaaggcggcg

SEQ ID NO: 2032870 - RNA, 19 nt, Human herpesvirus 5
guacagcggcucgccgcag

SEQ ID NO: 2032871 - RNA, 19 nt, Human herpesvirus 5
guaccaacauagaggugag

SEQ ID NO: 2032872 - RNA, 21 nt, Human herpesvirus 5
gcucccacguuuacgcgaaac

SEQ ID NO: 2032873 - RNA, 19 nt, Human herpesvirus 5
gcucaucgucacgcucaag

SEQ ID NO: 2032874 - RNA, 14 nt, Human herpesvirus 5
gcucaugccgccac

SEQ ID NO: 2032875 - RNA, 22 nt, Human herpesvirus 5
gcuccaaaacgacguuaacgac

SEQ ID NO: 2032876 - RNA, 16 nt, Human herpesvirus 5
gcuccacacgcaucug

SEQ ID NO: 2032877 - RNA, 21 nt, Human herpesvirus 5
gcuccagaagauacucgaugg

SEQ ID NO: 2032878 - RNA, 20 nt, Human herpesvirus 5
gcuaucuguguccgcccgag

SEQ ID NO: 2032879 - RNA, 23 nt, Human herpesvirus 5
gcucacguugaugaaaacgaggu

SEQ ID NO: 2032880 - RNA, 21 nt, Human herpesvirus 5
gcuaugcgggaugcugcggcg

SEQ ID NO: 2032881 - RNA, 17 nt, Human herpesvirus 5
gcuaugggaagaaaccg

SEQ ID NO: 2032882 - RNA, 20 nt, Human herpesvirus 5
gcuacuuuccgauccuugga

SEQ ID NO: 2032883 - RNA, 15 nt, Human herpesvirus 5
ggacgaaacagcagg

SEQ ID NO: 2032884 - RNA, 21 nt, Human herpesvirus 5
ggacgacgcaccggccuccga

SEQ ID NO: 2032885 - RNA, 13 nt, Human herpesvirus 5
gcggccguggccu

SEQ ID NO: 2032886 - RNA, 16 nt, Human herpesvirus 5
gcggugggugguaaaa

SEQ ID NO: 2032887 - RNA, 20 nt, Human herpesvirus 5
gcggugggugguaaaaaccg

SEQ ID NO: 2032888 - RNA, 19 nt, Human herpesvirus 5
gcgguguuuccgauggugg

SEQ ID NO: 2032889 - RNA, 13 nt, Human herpesvirus 5
gcguacgguggac

SEQ ID NO: 2032890 - RNA, 17 nt, Human herpesvirus 5
gcgucagaagacgagcu

SEQ ID NO: 2032891 - RNA, 20 nt, Human herpesvirus 5
gcguaugguuaugaccaagc

SEQ ID NO: 2032892 - RNA, 15 nt, Human herpesvirus 5
gcguaggacgacgug

SEQ ID NO: 2032893 - RNA, 23 nt, Human herpesvirus 5
gcuacgguggcgcgacggugaug

SEQ ID NO: 2032894 - RNA, 18 nt, Human herpesvirus 5
gcuacguacgacugcgcg

SEQ ID NO: 2032895 - RNA, 20 nt, Human herpesvirus 5
gcccucgacggcgguacuga

SEQ ID NO: 2032896 - RNA, 11 nt, Human herpesvirus 5
gcccucgccgg

SEQ ID NO: 2032897 - RNA, 22 nt, Human herpesvirus 5
gcccuguaugagcuguuucgac

SEQ ID NO: 2032898 - RNA, 14 nt, Human herpesvirus 5
gccgcgacaacggc

SEQ ID NO: 2032899 - RNA, 19 nt, Human herpesvirus 5
gccgcgacaacggccgccg

SEQ ID NO: 2032900 - RNA, 13 nt, Human herpesvirus 5
gccgccgugacgu

SEQ ID NO: 2032901 - RNA, 15 nt, Human herpesvirus 5
gccgccccgugacga

SEQ ID NO: 2032902 - RNA, 15 nt, Human herpesvirus 5
gccgcccgacgccga

SEQ ID NO: 2032903 - RNA, 15 nt, Human herpesvirus 5
gccgccgcgccacac

SEQ ID NO: 2032904 - RNA, 14 nt, Human herpesvirus 5
gccgccgcggcguu

SEQ ID NO: 2032905 - RNA, 16 nt, Human herpesvirus 5
gcccguucuuccgagu

SEQ ID NO: 2032906 - RNA, 14 nt, Human herpesvirus 5
gcccgggccgccgc

SEQ ID NO: 2032907 - RNA, 19 nt, Human herpesvirus 5
gccgcgcaggccgccgccg

SEQ ID NO: 2032908 - RNA, 12 nt, Human herpesvirus 5
gccggggcccgu

SEQ ID NO: 2032909 - RNA, 15 nt, Human herpesvirus 5
gccggggagacgacg

SEQ ID NO: 2032910 - RNA, 17 nt, Human herpesvirus 5
gccggguuggcacgacg

SEQ ID NO: 2032911 - RNA, 16 nt, Human herpesvirus 5
gccgcggccgcugccg

SEQ ID NO: 2032912 - RNA, 18 nt, Human herpesvirus 5
gccgcggugcgcugcagc

SEQ ID NO: 2032913 - RNA, 18 nt, Human herpesvirus 5
gccggcggagacgacggc

SEQ ID NO: 2032914 - RNA, 14 nt, Human herpesvirus 5
gccggcggcggcgu

SEQ ID NO: 2032915 - RNA, 16 nt, Human herpesvirus 5
gccggcggcggcguca

SEQ ID NO: 2032916 - RNA, 22 nt, Human herpesvirus 5
gccggcuucgaacaucgcgucg

SEQ ID NO: 2032917 - RNA, 17 nt, Human herpesvirus 5
gccggcuugaccgcguu

SEQ ID NO: 2032918 - RNA, 21 nt, Human herpesvirus 5
gccggcguggcggccgacggc

SEQ ID NO: 2032919 - RNA, 13 nt, Human herpesvirus 5
gccgcgacacacg

SEQ ID NO: 2032920 - RNA, 15 nt, Human herpesvirus 5
gcggccgcagaaggc

SEQ ID NO: 2032921 - RNA, 17 nt, Human herpesvirus 5
gcggccgcagaaggcca

SEQ ID NO: 2032922 - RNA, 17 nt, Human herpesvirus 5
gcggugaacgugcgcga

SEQ ID NO: 2032923 - RNA, 18 nt, Human herpesvirus 5
gcgguauggcugcgcgcc

SEQ ID NO: 2032924 - RNA, 19 nt, Human herpesvirus 5
gcgguaugggucacggcgg

SEQ ID NO: 2032925 - RNA, 23 nt, Human herpesvirus 5
gcggucagaaaaagaaaacgccg

SEQ ID NO: 2032926 - RNA, 13 nt, Human herpesvirus 5
gcggcacccggcu

SEQ ID NO: 2032927 - RNA, 15 nt, Human herpesvirus 5
gcggcaccagagaca

SEQ ID NO: 2032928 - RNA, 21 nt, Human herpesvirus 5
gcggcaccaggaacacggugg

SEQ ID NO: 2032929 - RNA, 19 nt, Human herpesvirus 5
gcggccacggccugcgggc

SEQ ID NO: 2032930 - RNA, 13 nt, Human herpesvirus 5
gcggcaaucggug

SEQ ID NO: 2032931 - RNA, 19 nt, Human herpesvirus 5
gcggcagcggaacucgacc

SEQ ID NO: 2032932 - RNA, 13 nt, Human herpesvirus 5
gcgcuccucgagc

SEQ ID NO: 2032933 - RNA, 21 nt, Human herpesvirus 5
gcgcguuuguugcgcggcgac

SEQ ID NO: 2032934 - RNA, 15 nt, Human herpesvirus 5
gcgcuaacgccucgu

SEQ ID NO: 2032935 - RNA, 15 nt, Human herpesvirus 5
gcgcuacgugcgcgc

SEQ ID NO: 2032936 - RNA, 13 nt, Human herpesvirus 5
gcgacguggagga

SEQ ID NO: 2032937 - RNA, 18 nt, Human herpesvirus 5
gcgagccccaucgggccc

SEQ ID NO: 2032938 - RNA, 16 nt, Human herpesvirus 5
gccggggugccgccgc

SEQ ID NO: 2032939 - RNA, 14 nt, Human herpesvirus 5
gccgucaaggccgc

SEQ ID NO: 2032940 - RNA, 21 nt, Human herpesvirus 5
gccgucagagcaucaacgacg

SEQ ID NO: 2032941 - RNA, 17 nt, Human herpesvirus 5
gccgucgaguacgugcu

SEQ ID NO: 2032942 - RNA, 13 nt, Human herpesvirus 5
gccgugacgucgc

SEQ ID NO: 2032943 - RNA, 21 nt, Human herpesvirus 5
gccugggaacgcgcgcacggc

SEQ ID NO: 2032944 - RNA, 19 nt, Human herpesvirus 5
gccgugcucuuggcgccgc

SEQ ID NO: 2032945 - RNA, 22 nt, Human herpesvirus 5
gccuggauuaucacaucggugu

SEQ ID NO: 2032946 - RNA, 21 nt, Human herpesvirus 5
gccuguggugcgacugcggcg

SEQ ID NO: 2032947 - RNA, 20 nt, Human herpesvirus 5
gccuuccagcuuaccgccac

SEQ ID NO: 2032948 - RNA, 19 nt, Human herpesvirus 5
gccuugcgcucccugcucc

SEQ ID NO: 2032949 - RNA, 15 nt, Human herpesvirus 5
gcgaacggcgacggc

SEQ ID NO: 2032950 - RNA, 20 nt, Human herpesvirus 5
gcgaagccagcuacagccac

SEQ ID NO: 2032951 - RNA, 14 nt, Human herpesvirus 5
gcgacggguggcag

SEQ ID NO: 2032952 - RNA, 15 nt, Human herpesvirus 5
gcgacgagggucugc

SEQ ID NO: 2032953 - RNA, 12 nt, Human herpesvirus 5
gcgacacgugcu

SEQ ID NO: 2032954 - RNA, 20 nt, Human herpesvirus 5
gcgacaagcuguggcugcac

SEQ ID NO: 2032955 - RNA, 21 nt, Human herpesvirus 5
gcgacaccguaucagcuaccg

SEQ ID NO: 2032956 - RNA, 16 nt, Human herpesvirus 5
gcgaagguguggcggc

SEQ ID NO: 2032957 - RNA, 13 nt, Human herpesvirus 5
gcgaccagcugcu

SEQ ID NO: 2032958 - RNA, 19 nt, Human herpesvirus 5
gcgacgagaucuacgcugu

SEQ ID NO: 2032959 - RNA, 18 nt, Human herpesvirus 5
gccaaaaucugacgcugu

SEQ ID NO: 2032960 - RNA, 21 nt, Human herpesvirus 5
gcauggagucgcgcggucgcc

SEQ ID NO: 2032961 - RNA, 14 nt, Human herpesvirus 5
gcaguccgcuccgg

SEQ ID NO: 2032962 - RNA, 20 nt, Human herpesvirus 5
gcagugcaucuacguggucg

SEQ ID NO: 2032963 - RNA, 21 nt, Human herpesvirus 5
gcauaagaagccaagggggug

SEQ ID NO: 2032964 - RNA, 17 nt, Human herpesvirus 5
gcagcccgaggugugcg

SEQ ID NO: 2032965 - RNA, 18 nt, Human herpesvirus 5
gcaucaguuucugcggcg

SEQ ID NO: 2032966 - RNA, 22 nt, Human herpesvirus 5
gcauccugcccaccgccuccga

SEQ ID NO: 2032967 - RNA, 15 nt, Human herpesvirus 5
gcagcgcgugcgcau

SEQ ID NO: 2032968 - RNA, 15 nt, Human herpesvirus 5
gcagcggaacucgac

SEQ ID NO: 2032969 - RNA, 23 nt, Human herpesvirus 5
gcagcggaggugggccggggccc

SEQ ID NO: 2032970 - RNA, 14 nt, Human herpesvirus 5
gcagcggcugcgcg

SEQ ID NO: 2032971 - RNA, 15 nt, Human herpesvirus 5
gcagcggcugcgcgc

SEQ ID NO: 2032972 - RNA, 22 nt, Human herpesvirus 5
gcagcgggaaaccgcgucgucg

SEQ ID NO: 2032973 - RNA, 23 nt, Human herpesvirus 5
gcagcggggagaaaaguggcaga

SEQ ID NO: 2032974 - RNA, 17 nt, Human herpesvirus 5
gcagcgucacagagggc

SEQ ID NO: 2032975 - RNA, 22 nt, Human herpesvirus 5
gcagcguggccggcguggcggc

SEQ ID NO: 2032976 - RNA, 23 nt, Human herpesvirus 5
cugccucagucucucggugcgug

SEQ ID NO: 2032977 - RNA, 20 nt, Human herpesvirus 5
cugccugguuaguucgccgu

SEQ ID NO: 2032978 - RNA, 18 nt, Human herpesvirus 5
cugccuuacggcgaccgu

SEQ ID NO: 2032979 - RNA, 14 nt, Human herpesvirus 5
cugcgacacgugcu

SEQ ID NO: 2032980 - RNA, 20 nt, Human herpesvirus 5
cugccggcauguccggccgu

SEQ ID NO: 2032981 - RNA, 15 nt, Human herpesvirus 5
cugccggcugcggcg

SEQ ID NO: 2032982 - RNA, 23 nt, Human herpesvirus 5
cugcccuuuacggugcugcgucu

SEQ ID NO: 2032983 - RNA, 14 nt, Human herpesvirus 5
cugccgcacgcgcu

SEQ ID NO: 2032984 - RNA, 15 nt, Human herpesvirus 5
cugccucucauguuc

SEQ ID NO: 2032985 - RNA, 17 nt, Human herpesvirus 5
cugccucuccuccgucg

SEQ ID NO: 2032986 - RNA, 17 nt, Human herpesvirus 5
cugcgcaggccgccgcu

SEQ ID NO: 2032987 - RNA, 23 nt, Human herpesvirus 5
cugcgagaggaagucgaucugga

SEQ ID NO: 2032988 - RNA, 15 nt, Human herpesvirus 5
cucuaucugcgccag

SEQ ID NO: 2032989 - RNA, 19 nt, Human herpesvirus 5
cucucgagugcggucggug

SEQ ID NO: 2032990 - RNA, 17 nt, Human herpesvirus 5
cucucuauccgguggcg

SEQ ID NO: 2032991 - RNA, 19 nt, Human herpesvirus 5
cucugccugggcacgcgcg

SEQ ID NO: 2032992 - RNA, 14 nt, Human herpesvirus 5
cucguucccagcgc

SEQ ID NO: 2032993 - RNA, 14 nt, Human herpesvirus 5
cucgugcgugucgc

SEQ ID NO: 2032994 - RNA, 14 nt, Human herpesvirus 5
cucuaccgcgacgg

SEQ ID NO: 2032995 - RNA, 16 nt, Human herpesvirus 5
cucuaccgcgacggcg

SEQ ID NO: 2032996 - RNA, 15 nt, Human herpesvirus 5
cucgucgccagcgcg

SEQ ID NO: 2032997 - RNA, 21 nt, Human herpesvirus 5
cucgucgccagcgcgagcgcu

SEQ ID NO: 2032998 - RNA, 20 nt, Human herpesvirus 5
cucgucgcucuaucugcgcg

SEQ ID NO: 2032999 - RNA, 20 nt, Human herpesvirus 5
cucgucggugagacgaggcc

SEQ ID NO: 2033000 - RNA, 18 nt, Human herpesvirus 5
cucgucugagccggggug

SEQ ID NO: 2033001 - RNA, 17 nt, Human herpesvirus 5
cucggcggccacggcgu

SEQ ID NO: 2033002 - RNA, 17 nt, Human herpesvirus 5
cucgggccgaaccccgu

SEQ ID NO: 2033003 - RNA, 17 nt, Human herpesvirus 5
cucgggucggcuggucg

SEQ ID NO: 2033004 - RNA, 16 nt, Human herpesvirus 5
cucgggugcaccgcgg

SEQ ID NO: 2033005 - RNA, 16 nt, Human herpesvirus 5
cucggacggacguaga

SEQ ID NO: 2033006 - RNA, 18 nt, Human herpesvirus 5
cucggagccgccgacgcu

SEQ ID NO: 2033007 - RNA, 15 nt, Human herpesvirus 5
cugugaaacgccaac

SEQ ID NO: 2033008 - RNA, 15 nt, Human herpesvirus 5
cugugaucugcacgu

SEQ ID NO: 2033009 - RNA, 15 nt, Human herpesvirus 5
cugugcgcgccggcc

SEQ ID NO: 2033010 - RNA, 21 nt, Human herpesvirus 5
cuguaccguuauuucgugcgu

SEQ ID NO: 2033011 - RNA, 22 nt, Human herpesvirus 5
cuggucuggcccaaagaccgcu

SEQ ID NO: 2033012 - RNA, 13 nt, Human herpesvirus 5
cugcucgaccgcu

SEQ ID NO: 2033013 - RNA, 16 nt, Human herpesvirus 5
cugggcacgcgcgucg

SEQ ID NO: 2033014 - RNA, 21 nt, Human herpesvirus 5
cugggacgaggaggaggggcc

SEQ ID NO: 2033015 - RNA, 18 nt, Human herpesvirus 5
cuggguccguaaccacgu

SEQ ID NO: 2033016 - RNA, 20 nt, Human herpesvirus 5
cugggcuggcccucgcagug

SEQ ID NO: 2033017 - RNA, 14 nt, Human herpesvirus 5
cuggucaacugcgu

SEQ ID NO: 2033018 - RNA, 22 nt, Human herpesvirus 5
cugcgcgccuccguccucgucg

SEQ ID NO: 2033019 - RNA, 22 nt, Human herpesvirus 5
cugccgcucagcgagcucgucg

SEQ ID NO: 2033020 - RNA, 15 nt, Human herpesvirus 5
cugcgcccguuggug

SEQ ID NO: 2033021 - RNA, 18 nt, Human herpesvirus 5
cugcgccguuuugcuguc

SEQ ID NO: 2033022 - RNA, 16 nt, Human herpesvirus 5
cugcgccuccucgucg

SEQ ID NO: 2033023 - RNA, 22 nt, Human herpesvirus 5
cugcgcgucaccgaugccggcc

SEQ ID NO: 2033024 - RNA, 15 nt, Human herpesvirus 5
cugcuauaagaaggc

SEQ ID NO: 2033025 - RNA, 14 nt, Human herpesvirus 5
gcagagggcgcgcc

SEQ ID NO: 2033026 - RNA, 19 nt, Human herpesvirus 5
gcagcaauagcagccgaca

SEQ ID NO: 2033027 - RNA, 13 nt, Human herpesvirus 5
gcagaccauccuc

SEQ ID NO: 2033028 - RNA, 19 nt, Human herpesvirus 5
gcagaacccgguugcggcc

SEQ ID NO: 2033029 - RNA, 16 nt, Human herpesvirus 5
gcagccgacacagcgg

SEQ ID NO: 2033030 - RNA, 14 nt, Human herpesvirus 5
gcagccgccgcgug

SEQ ID NO: 2033031 - RNA, 21 nt, Human herpesvirus 5
gcagccaccgacacagcagca

SEQ ID NO: 2033032 - RNA, 22 nt, Human herpesvirus 5
gcagccacgagcaucgcaacaa

SEQ ID NO: 2033033 - RNA, 20 nt, Human herpesvirus 5
gcagcaccaugccggagcua

SEQ ID NO: 2033034 - RNA, 22 nt, Human herpesvirus 5
gcagcacgcggcucacguagca

SEQ ID NO: 2033035 - RNA, 20 nt, Human herpesvirus 5
gcagcagcuggugcaucacg

SEQ ID NO: 2033036 - RNA, 15 nt, Human herpesvirus 5
gcagcaucgcgugcg

SEQ ID NO: 2033037 - RNA, 22 nt, Human herpesvirus 5
gcagcaugggcgacaccgccuc

SEQ ID NO: 2033038 - RNA, 13 nt, Human herpesvirus 5
gcacgcggcucac

SEQ ID NO: 2033039 - RNA, 22 nt, Human herpesvirus 5
gcacgggcucgggugacggcga

SEQ ID NO: 2033040 - RNA, 13 nt, Human herpesvirus 5
gcacgggcugcug

SEQ ID NO: 2033041 - RNA, 13 nt, Human herpesvirus 5
gcacguugccggc

SEQ ID NO: 2033042 - RNA, 16 nt, Human herpesvirus 5
gcacguuuuggaaaac

SEQ ID NO: 2033043 - RNA, 16 nt, Human herpesvirus 5
gacgacccaccgccgc

SEQ ID NO: 2033044 - RNA, 23 nt, Human herpesvirus 5
gacgaccuacgggacacgcugau

SEQ ID NO: 2033045 - RNA, 19 nt, Human herpesvirus 5
gacgaagugccgcgccgcc

SEQ ID NO: 2033046 - RNA, 22 nt, Human herpesvirus 5
gacgacgguuuccacgccaccg

SEQ ID NO: 2033047 - RNA, 13 nt, Human herpesvirus 5
gaccgcggcgcag

SEQ ID NO: 2033048 - RNA, 21 nt, Human herpesvirus 5
gaccuugcggauacgccgccg

SEQ ID NO: 2033049 - RNA, 19 nt, Human herpesvirus 5
gacgauuuuaugcgccgcc

SEQ ID NO: 2033050 - RNA, 20 nt, Human herpesvirus 5
gacgauuuuaugcgccgcca

SEQ ID NO: 2033051 - RNA, 14 nt, Human herpesvirus 5
gacgagcaggcucg

SEQ ID NO: 2033052 - RNA, 17 nt, Human herpesvirus 5
gacgagcguugcgcucg

SEQ ID NO: 2033053 - RNA, 18 nt, Human herpesvirus 5
gacgagggucugcgcgac

SEQ ID NO: 2033054 - RNA, 15 nt, Human herpesvirus 5
gacgauaugucgcga

SEQ ID NO: 2033055 - RNA, 16 nt, Human herpesvirus 5
gacgaucccucgccgc

SEQ ID NO: 2033056 - RNA, 16 nt, Human herpesvirus 5
gcacgacgcggcguug

SEQ ID NO: 2033057 - RNA, 17 nt, Human herpesvirus 5
cuuaaaauuucguaaac

SEQ ID NO: 2033058 - RNA, 15 nt, Human herpesvirus 5
cuucaaccacgagua

SEQ ID NO: 2033059 - RNA, 19 nt, Human herpesvirus 5
cuucaaccucacguuaaac

SEQ ID NO: 2033060 - RNA, 15 nt, Human herpesvirus 5
cuguguccgcccgag

SEQ ID NO: 2033061 - RNA, 16 nt, Human herpesvirus 5
cuguggacccugcgcg

SEQ ID NO: 2033062 - RNA, 21 nt, Human herpesvirus 5
cuguggauagauuucugcgug

SEQ ID NO: 2033063 - RNA, 23 nt, Human herpesvirus 5
cuguggcaccgccuccgaacgcu

SEQ ID NO: 2033064 - RNA, 16 nt, Human herpesvirus 5
cugugcuggccgccgc

SEQ ID NO: 2033065 - RNA, 15 nt, Human herpesvirus 5
gaccggcggcugcug

SEQ ID NO: 2033066 - RNA, 16 nt, Human herpesvirus 5
gaccgggaucacgacg

SEQ ID NO: 2033067 - RNA, 20 nt, Human herpesvirus 5
gaccgggaucacgacgacgc

SEQ ID NO: 2033068 - RNA, 15 nt, Human herpesvirus 5
uuuuuauuacccgcu

SEQ ID NO: 2033069 - RNA, 20 nt, Human herpesvirus 5
uuuggcgcagucgcgagcug

SEQ ID NO: 2033070 - RNA, 14 nt, Human herpesvirus 5
uuuugcugcaccag

SEQ ID NO: 2033071 - RNA, 21 nt, Human herpesvirus 5
uuuugggucagcggcacgccg

SEQ ID NO: 2033072 - RNA, 16 nt, Human herpesvirus 5
uuucgcugccaacgcc

SEQ ID NO: 2033073 - RNA, 17 nt, Human herpesvirus 5
uuucugcgucggagcuc

SEQ ID NO: 2033074 - RNA, 23 nt, Human herpesvirus 5
ucguggaaggcaccgcgacagcu

SEQ ID NO: 2033075 - RNA, 13 nt, Human herpesvirus 5
ucgucgugcccgu

SEQ ID NO: 2033076 - RNA, 13 nt, Human herpesvirus 5
uuuaagcugcuca

SEQ ID NO: 2033077 - RNA, 17 nt, Human herpesvirus 5
uuuacgcgaaacgauga

SEQ ID NO: 2033078 - RNA, 15 nt, Human herpesvirus 5
ucgaccgacaaggcg

SEQ ID NO: 2033079 - RNA, 19 nt, Human herpesvirus 5
ucgaccuugagcgacagca

SEQ ID NO: 2033080 - RNA, 12 nt, Human herpesvirus 5
ucgacggcggua

SEQ ID NO: 2033081 - RNA, 20 nt, Human herpesvirus 5
ucgagaccgaagacgccguc

SEQ ID NO: 2033082 - RNA, 19 nt, Human herpesvirus 5
ucgagacuugcacgcuguc

SEQ ID NO: 2033083 - RNA, 21 nt, Human herpesvirus 5
ucgggcgugugguagaagagc

SEQ ID NO: 2033084 - RNA, 15 nt, Human herpesvirus 5
uccuguugcucuccu

SEQ ID NO: 2033085 - RNA, 19 nt, Human herpesvirus 5
ucggugaccacaaccacgu

SEQ ID NO: 2033086 - RNA, 21 nt, Human herpesvirus 5
ucccggauccaagggacgagc

SEQ ID NO: 2033087 - RNA, 18 nt, Human herpesvirus 5
uccgacagcgcgacgagc

SEQ ID NO: 2033088 - RNA, 23 nt, Human herpesvirus 5
uccgaccgggaaaccacgccggc

SEQ ID NO: 2033089 - RNA, 15 nt, Human herpesvirus 5
ucccgucccucuccu

SEQ ID NO: 2033090 - RNA, 14 nt, Human herpesvirus 5
ucccuacagcgacu

SEQ ID NO: 2033091 - RNA, 17 nt, Human herpesvirus 5
ucccuacuaccgucgug

SEQ ID NO: 2033092 - RNA, 12 nt, Human herpesvirus 5
ucccuccugcag

SEQ ID NO: 2033093 - RNA, 15 nt, Human herpesvirus 5
ucccucgcgccgccc

SEQ ID NO: 2033094 - RNA, 15 nt, Human herpesvirus 5
ucgaaaacaaccaca

SEQ ID NO: 2033095 - RNA, 14 nt, Human herpesvirus 5
ucgacgacgccguc

SEQ ID NO: 2033096 - RNA, 22 nt, Human herpesvirus 5
uccgacucgcugucgagacggc

SEQ ID NO: 2033097 - RNA, 14 nt, Human herpesvirus 5
uccgagcugcggua

SEQ ID NO: 2033098 - RNA, 20 nt, Human herpesvirus 5
uccuggaucuuggcggccga

SEQ ID NO: 2033099 - RNA, 16 nt, Human herpesvirus 5
ucgaaauaaccuacgu

SEQ ID NO: 2033100 - RNA, 13 nt, Human herpesvirus 5
uccccgugcccga

SEQ ID NO: 2033101 - RNA, 12 nt, Human herpesvirus 5
uccccuaacguc

SEQ ID NO: 2033102 - RNA, 21 nt, Human herpesvirus 5
uccccuaguaauaccaccguc

SEQ ID NO: 2033103 - RNA, 17 nt, Human herpesvirus 5
uccccgaauuugggcgg

SEQ ID NO: 2033104 - RNA, 17 nt, Human herpesvirus 5
uccccgacuccgcgguc

SEQ ID NO: 2033105 - RNA, 21 nt, Human herpesvirus 5
ucccacuacacuauguucgug

SEQ ID NO: 2033106 - RNA, 15 nt, Human herpesvirus 5
ucccaucucaacguc

SEQ ID NO: 2033107 - RNA, 14 nt, Human herpesvirus 5
uccaucgcagccac

SEQ ID NO: 2033108 - RNA, 13 nt, Human herpesvirus 5
ucccaccacgguu

SEQ ID NO: 2033109 - RNA, 21 nt, Human herpesvirus 5
uccauuucgcaggagcugcug

SEQ ID NO: 2033110 - RNA, 21 nt, Human herpesvirus 5
acugggugcugccgggcggcu

SEQ ID NO: 2033111 - RNA, 16 nt, Human herpesvirus 5
acuggugcuggcggcg

SEQ ID NO: 2033112 - RNA, 15 nt, Human herpesvirus 5
acuggccuggcggcg

SEQ ID NO: 2033113 - RNA, 21 nt, Human herpesvirus 5
acugucgccacuauguccucc

SEQ ID NO: 2033114 - RNA, 14 nt, Human herpesvirus 5
acugacacagcucc

SEQ ID NO: 2033115 - RNA, 19 nt, Human herpesvirus 5
acugcgacggcagcgccag

SEQ ID NO: 2033116 - RNA, 20 nt, Human herpesvirus 5
acugcgauaauaacggcgca

SEQ ID NO: 2033117 - RNA, 15 nt, Human herpesvirus 5
caccaauaggggagu

SEQ ID NO: 2033118 - RNA, 15 nt, Human herpesvirus 5
caccaauugcuuuaa

SEQ ID NO: 2033119 - RNA, 20 nt, Human herpesvirus 5
caccaccgagacgugcgacc

SEQ ID NO: 2033120 - RNA, 13 nt, Human herpesvirus 5
caccaaccgacgu

SEQ ID NO: 2033121 - RNA, 12 nt, Human herpesvirus 5
cacaucggugcc

SEQ ID NO: 2033122 - RNA, 17 nt, Human herpesvirus 5
cacauuagacacacggg

SEQ ID NO: 2033123 - RNA, 19 nt, Human herpesvirus 5
caccagacuuuuugcuuua

SEQ ID NO: 2033124 - RNA, 16 nt, Human herpesvirus 5
caccaggugccggcga

SEQ ID NO: 2033125 - RNA, 21 nt, Human herpesvirus 5
caccaucgugguagcgccgcg

SEQ ID NO: 2033126 - RNA, 18 nt, Human herpesvirus 5
cacccccgcgacccucgc

SEQ ID NO: 2033127 - RNA, 13 nt, Human herpesvirus 5
cacaguuaccacc

SEQ ID NO: 2033128 - RNA, 12 nt, Human herpesvirus 5
cacagcuccuga

SEQ ID NO: 2033129 - RNA, 15 nt, Human herpesvirus 5
cacagcagccgcgcu

SEQ ID NO: 2033130 - RNA, 14 nt, Human herpesvirus 5
acuucaaccacgag

SEQ ID NO: 2033131 - RNA, 23 nt, Human herpesvirus 5
cacacuggcuggaauacguggcg

SEQ ID NO: 2033132 - RNA, 15 nt, Human herpesvirus 5
acuauguggcuccgc

SEQ ID NO: 2033133 - RNA, 19 nt, Human herpesvirus 5
acuacguugggucugcgcu

SEQ ID NO: 2033134 - RNA, 21 nt, Human herpesvirus 5
acuacgacgggacggcggcgc

SEQ ID NO: 2033135 - RNA, 22 nt, Human herpesvirus 5
acucguugggauugacgcgguu

SEQ ID NO: 2033136 - RNA, 18 nt, Human herpesvirus 5
acucgcaccggcagcaca

SEQ ID NO: 2033137 - RNA, 14 nt, Human herpesvirus 5
acguucgucgugac

SEQ ID NO: 2033138 - RNA, 20 nt, Human herpesvirus 5
acguucuccaagggagacau

SEQ ID NO: 2033139 - RNA, 14 nt, Human herpesvirus 5
acguugaugcggcg

SEQ ID NO: 2033140 - RNA, 19 nt, Human herpesvirus 5
cacgguggccaacaagcgg

SEQ ID NO: 2033141 - RNA, 19 nt, Human herpesvirus 5
cacggcggcggccugcucg

SEQ ID NO: 2033142 - RNA, 18 nt, Human herpesvirus 5
cacggucgggcacucggc

SEQ ID NO: 2033143 - RNA, 23 nt, Human herpesvirus 5
cacggugacguagcagcacgcgg

SEQ ID NO: 2033144 - RNA, 14 nt, Human herpesvirus 5
cacgucgaccaggu

SEQ ID NO: 2033145 - RNA, 22 nt, Human herpesvirus 5
cacgucgaccaggugcugucgc

SEQ ID NO: 2033146 - RNA, 20 nt, Human herpesvirus 5
cacgucgccguccaugucgc

SEQ ID NO: 2033147 - RNA, 17 nt, Human herpesvirus 5
cacgucgcugauccgca

SEQ ID NO: 2033148 - RNA, 20 nt, Human herpesvirus 5
cacgucggagccccugcgcg

SEQ ID NO: 2033149 - RNA, 19 nt, Human herpesvirus 5
cacgucggcucgaagaggu

SEQ ID NO: 2033150 - RNA, 21 nt, Human herpesvirus 5
cacgucuagcaggcccaggcc

SEQ ID NO: 2033151 - RNA, 15 nt, Human herpesvirus 5
cacggcgaaccgccg

SEQ ID NO: 2033152 - RNA, 16 nt, Human herpesvirus 5
cacggcgaaccgccgu

SEQ ID NO: 2033153 - RNA, 19 nt, Human herpesvirus 5
cacggcgaaccgccgucgc

SEQ ID NO: 2033154 - RNA, 19 nt, Human herpesvirus 5
cacggcgccggugacccgc

SEQ ID NO: 2033155 - RNA, 22 nt, Human herpesvirus 5
cacgguacgauaaaaacaacgu

SEQ ID NO: 2033156 - RNA, 21 nt, Human herpesvirus 5
cacggcgucuuccuccucguc

SEQ ID NO: 2033157 - RNA, 16 nt, Human herpesvirus 5
cacggcuaccaugcgc

SEQ ID NO: 2033158 - RNA, 17 nt, Human herpesvirus 5
cagagaccgccgccgcg

SEQ ID NO: 2033159 - RNA, 18 nt, Human herpesvirus 5
cagagaccgccgccgcgc

SEQ ID NO: 2033160 - RNA, 18 nt, Human herpesvirus 5
cagacuuucgacgugcgc

SEQ ID NO: 2033161 - RNA, 14 nt, Human herpesvirus 5
cacguccaugucgc

SEQ ID NO: 2033162 - RNA, 19 nt, Human herpesvirus 5
cagagccaccaggugccgg

SEQ ID NO: 2033163 - RNA, 15 nt, Human herpesvirus 5
cagacgucggcgguc

SEQ ID NO: 2033164 - RNA, 11 nt, Human herpesvirus 5
cacgccggcgg

SEQ ID NO: 2033165 - RNA, 15 nt, Human herpesvirus 5
cacgccgugcucgcg

SEQ ID NO: 2033166 - RNA, 21 nt, Human herpesvirus 5
cacgcucgcucugacgccgcg

SEQ ID NO: 2033167 - RNA, 24 nt, Human herpesvirus 5
cacgcuugucauagucacgucgcu

SEQ ID NO: 2033168 - RNA, 19 nt, Human herpesvirus 5
cacggaacauguccuggcg

SEQ ID NO: 2033169 - RNA, 19 nt, Human herpesvirus 5
cacggccuccgacgagcgu

SEQ ID NO: 2033170 - RNA, 12 nt, Human herpesvirus 5
cacggccugcgg

SEQ ID NO: 2033171 - RNA, 19 nt, Human herpesvirus 5
cacggccugcgggcaggcg

SEQ ID NO: 2033172 - RNA, 14 nt, Human herpesvirus 5
cacgcgcgacuugg

SEQ ID NO: 2033173 - RNA, 15 nt, Human herpesvirus 5
cagcagccaccgaca

SEQ ID NO: 2033174 - RNA, 23 nt, Human herpesvirus 5
cagcagccaccgacacagcagca

SEQ ID NO: 2033175 - RNA, 13 nt, Human herpesvirus 5
cagcaaugucgua

SEQ ID NO: 2033176 - RNA, 21 nt, Human herpesvirus 5
cagaucguguuucggcggcug

SEQ ID NO: 2033177 - RNA, 17 nt, Human herpesvirus 5
cagaggucgccgcugau

SEQ ID NO: 2033178 - RNA, 20 nt, Human herpesvirus 5
cagaugacgagcgccggcga

SEQ ID NO: 2033179 - RNA, 16 nt, Human herpesvirus 5
cagaugcucccggcgc

SEQ ID NO: 2033180 - RNA, 20 nt, Human herpesvirus 5
cagauuuacagcccggcggu

SEQ ID NO: 2033181 - RNA, 23 nt, Human herpesvirus 5
cagcacauuguaugccgauacac

SEQ ID NO: 2033182 - RNA, 17 nt, Human herpesvirus 5
cuaggcuacuccgccgu

SEQ ID NO: 2033183 - RNA, 14 nt, Human herpesvirus 5
cuaguaaaaaaagu

SEQ ID NO: 2033184 - RNA, 19 nt, Human herpesvirus 5
cuaguuagauuuccugugu

SEQ ID NO: 2033185 - RNA, 14 nt, Human herpesvirus 5
cuacggcugcaucg

SEQ ID NO: 2033186 - RNA, 21 nt, Human herpesvirus 5
gaggagugucagacacagccg

SEQ ID NO: 2033187 - RNA, 18 nt, Human herpesvirus 5
gaggacauggacucgcca

SEQ ID NO: 2033188 - RNA, 18 nt, Human herpesvirus 5
gaggaacccugcggcgcc

SEQ ID NO: 2033189 - RNA, 15 nt, Human herpesvirus 5
gaggaagcgggggug

SEQ ID NO: 2033190 - RNA, 15 nt, Human herpesvirus 5
gaggacgacagcucg

SEQ ID NO: 2033191 - RNA, 14 nt, Human herpesvirus 5
gauucgguuacgaa

SEQ ID NO: 2033192 - RNA, 21 nt, Human herpesvirus 5
gauguaguacaucgcgugcga

SEQ ID NO: 2033193 - RNA, 19 nt, Human herpesvirus 5
gauuaccuacgucaaagcg

SEQ ID NO: 2033194 - RNA, 15 nt, Human herpesvirus 5
gauucaggacgagga

SEQ ID NO: 2033195 - RNA, 19 nt, Human herpesvirus 5
gaggccgagacgcugcgcu

SEQ ID NO: 2033196 - RNA, 18 nt, Human herpesvirus 5
gcaaaucacgugugugcg

SEQ ID NO: 2033197 - RNA, 23 nt, Human herpesvirus 5
gcaaaaacuuguccuugcgcgcg

SEQ ID NO: 2033198 - RNA, 17 nt, Human herpesvirus 5
cuacgcgugcacgcgcu

SEQ ID NO: 2033199 - RNA, 17 nt, Human herpesvirus 5
cuacgcuacgaccuggc

SEQ ID NO: 2033200 - RNA, 15 nt, Human herpesvirus 5
cuacucacguuggug

SEQ ID NO: 2033201 - RNA, 21 nt, Human herpesvirus 5
cuacucgcacaaccuguggug

SEQ ID NO: 2033202 - RNA, 15 nt, Human herpesvirus 5
cuagaaagaccaaga

SEQ ID NO: 2033203 - RNA, 16 nt, Human herpesvirus 5
cgugcucgugcccauc

SEQ ID NO: 2033204 - RNA, 18 nt, Human herpesvirus 5
cgugcugauucgcgccgu

SEQ ID NO: 2033205 - RNA, 22 nt, Human herpesvirus 5
cgugcugauucgcgccgugcgc

SEQ ID NO: 2033206 - RNA, 15 nt, Human herpesvirus 5
cuacccucaaguacg

SEQ ID NO: 2033207 - RNA, 15 nt, Human herpesvirus 5
cuaccgcgacggcga

SEQ ID NO: 2033208 - RNA, 16 nt, Human herpesvirus 5
cgugccugggaacgcg

SEQ ID NO: 2033209 - RNA, 18 nt, Human herpesvirus 5
cgugcgaccuggacggcu

SEQ ID NO: 2033210 - RNA, 14 nt, Human herpesvirus 5
cgugcgaggacaac

SEQ ID NO: 2033211 - RNA, 14 nt, Human herpesvirus 5
cgugcgcacgccgc

SEQ ID NO: 2033212 - RNA, 16 nt, Human herpesvirus 5
cgugcgcacgccgcgc

SEQ ID NO: 2033213 - RNA, 12 nt, Human herpesvirus 5
cgugccaccugc

SEQ ID NO: 2033214 - RNA, 20 nt, Human herpesvirus 5
cgugcccguuuucacagcag

SEQ ID NO: 2033215 - RNA, 13 nt, Human herpesvirus 5
cgugccgagcugc

SEQ ID NO: 2033216 - RNA, 17 nt, Human herpesvirus 5
cgugccaggcuguucac

SEQ ID NO: 2033217 - RNA, 20 nt, Human herpesvirus 5
cgugccaucaaucgcguccg

SEQ ID NO: 2033218 - RNA, 14 nt, Human herpesvirus 5
cgugauaggcggcg

SEQ ID NO: 2033219 - RNA, 18 nt, Human herpesvirus 5
cgugcaacggcgacgcgg

SEQ ID NO: 2033220 - RNA, 19 nt, Human herpesvirus 5
cgugcaacggcgacgcggu

SEQ ID NO: 2033221 - RNA, 14 nt, Human herpesvirus 5
cgugcaucugccga

SEQ ID NO: 2033222 - RNA, 21 nt, Human herpesvirus 5
cgucguuuuguucaccgucgc

SEQ ID NO: 2033223 - RNA, 22 nt, Human herpesvirus 5
cgucuccaugauugugccgcgu

SEQ ID NO: 2033224 - RNA, 15 nt, Human herpesvirus 5
cgucuggacgcgcgg

SEQ ID NO: 2033225 - RNA, 17 nt, Human herpesvirus 5
cgucuggacgcgcggcu

SEQ ID NO: 2033226 - RNA, 19 nt, Human herpesvirus 5
cgcgccacaacgccguccg

SEQ ID NO: 2033227 - RNA, 14 nt, Human herpesvirus 5
cgugacuuggggcg

SEQ ID NO: 2033228 - RNA, 18 nt, Human herpesvirus 5
cgugaaugggcacgccgu

SEQ ID NO: 2033229 - RNA, 20 nt, Human herpesvirus 5
ccgucgcuacauucgccgca

SEQ ID NO: 2033230 - RNA, 22 nt, Human herpesvirus 5
ccgucggaaacccgacgagaca

SEQ ID NO: 2033231 - RNA, 12 nt, Human herpesvirus 5
ccgucgccgcga

SEQ ID NO: 2033232 - RNA, 22 nt, Human herpesvirus 5
ccgucccucuccucccuccgcg

SEQ ID NO: 2033233 - RNA, 20 nt, Human herpesvirus 5
ccguacuaagucucccgugu

SEQ ID NO: 2033234 - RNA, 18 nt, Human herpesvirus 5
ccguacacgcacgcuggu

SEQ ID NO: 2033235 - RNA, 22 nt, Human herpesvirus 5
ccggugucuggcuuuaccgccg

SEQ ID NO: 2033236 - RNA, 16 nt, Human herpesvirus 5
ccggugcgcgaccgca

SEQ ID NO: 2033237 - RNA, 18 nt, Human herpesvirus 5
ccggucacuggacucggu

SEQ ID NO: 2033238 - RNA, 20 nt, Human herpesvirus 5
ccgguauucggaaacagcgu

SEQ ID NO: 2033239 - RNA, 20 nt, Human herpesvirus 5
ccgguaaaggaacaacccgu

SEQ ID NO: 2033240 - RNA, 19 nt, Human herpesvirus 5
ccgguaacguggacgacgc

SEQ ID NO: 2033241 - RNA, 19 nt, Human herpesvirus 5
cgcgccucauggcggcggc

SEQ ID NO: 2033242 - RNA, 15 nt, Human herpesvirus 5
cgcgccgggcggcuu

SEQ ID NO: 2033243 - RNA, 21 nt, Human herpesvirus 5
cgcgccucucggagccgccga

SEQ ID NO: 2033244 - RNA, 14 nt, Human herpesvirus 5
cgucggccaacaac

SEQ ID NO: 2033245 - RNA, 16 nt, Human herpesvirus 5
cgucggcggggcggac

SEQ ID NO: 2033246 - RNA, 11 nt, Human herpesvirus 5
cgucgguggaa

SEQ ID NO: 2033247 - RNA, 13 nt, Human herpesvirus 5
cgucgucccagca

SEQ ID NO: 2033248 - RNA, 15 nt, Human herpesvirus 5
cgucgugcccgucgg

SEQ ID NO: 2033249 - RNA, 14 nt, Human herpesvirus 5
cgcgcccgacagcu

SEQ ID NO: 2033250 - RNA, 23 nt, Human herpesvirus 5
cgcgcccucuucuuugccggcuc

SEQ ID NO: 2033251 - RNA, 13 nt, Human herpesvirus 5
cgcgcccgucgcg

SEQ ID NO: 2033252 - RNA, 15 nt, Human herpesvirus 5
ccgugaucgccgcgg

SEQ ID NO: 2033253 - RNA, 16 nt, Human herpesvirus 5
ccgugagugacgcggu

SEQ ID NO: 2033254 - RNA, 20 nt, Human herpesvirus 5
ccgugauaacggucaagaag

SEQ ID NO: 2033255 - RNA, 20 nt, Human herpesvirus 5
ccgugcucuuggcgccgcgg

SEQ ID NO: 2033256 - RNA, 14 nt, Human herpesvirus 5
gcaacucgguguug

SEQ ID NO: 2033257 - RNA, 19 nt, Human herpesvirus 5
gcaaucgcuucaccgucgc

SEQ ID NO: 2033258 - RNA, 21 nt, Human herpesvirus 5
gcaaggccucuaucugcgcca

SEQ ID NO: 2033259 - RNA, 21 nt, Human herpesvirus 5
gcacaccugccucgacaucuc

SEQ ID NO: 2033260 - RNA, 19 nt, Human herpesvirus 5
gcacaacugguuccugcag

SEQ ID NO: 2033261 - RNA, 17 nt, Human herpesvirus 5
gcacaaacugcgacacg

SEQ ID NO: 2033262 - RNA, 13 nt, Human herpesvirus 5
uuguagcaacugg

SEQ ID NO: 2033263 - RNA, 17 nt, Human herpesvirus 5
uugucauuaaacaggcu

SEQ ID NO: 2033264 - RNA, 13 nt, Human herpesvirus 5
uugcugcaacggc

SEQ ID NO: 2033265 - RNA, 16 nt, Human herpesvirus 5
uuccggucucggcucg

SEQ ID NO: 2033266 - RNA, 22 nt, Human herpesvirus 5
uucgacagcggcaacaacgacg

SEQ ID NO: 2033267 - RNA, 16 nt, Human herpesvirus 5
uucgaguccguccucg

SEQ ID NO: 2033268 - RNA, 19 nt, Human herpesvirus 5
uucgcgaggacaaggcucc

SEQ ID NO: 2033269 - RNA, 15 nt, Human herpesvirus 5
uucggacgaccuccg

SEQ ID NO: 2033270 - RNA, 15 nt, Human herpesvirus 5
uucggccggcugcug

SEQ ID NO: 2033271 - RNA, 12 nt, Human herpesvirus 5
uugcccgcaaaa

SEQ ID NO: 2033272 - RNA, 20 nt, Human herpesvirus 5
uugcaaaagaagcugcccgc

SEQ ID NO: 2033273 - RNA, 15 nt, Human herpesvirus 5
uucuucgccggaggc

SEQ ID NO: 2033274 - RNA, 14 nt, Human herpesvirus 5
uucuucgcggaggc

SEQ ID NO: 2033275 - RNA, 19 nt, Human herpesvirus 5
uuaucaucugcucccgcug

SEQ ID NO: 2033276 - RNA, 21 nt, Human herpesvirus 5
uuaucaucugcucccgcugcu

SEQ ID NO: 2033277 - RNA, 20 nt, Human herpesvirus 5
uuaugauaucuacagcagau

SEQ ID NO: 2033278 - RNA, 18 nt, Human herpesvirus 5
uuaugauucugcacagau

SEQ ID NO: 2033279 - RNA, 21 nt, Human herpesvirus 5
uuaccgccgccgcccgacgcc

SEQ ID NO: 2033280 - RNA, 13 nt, Human herpesvirus 5
uuauuacccgcua

SEQ ID NO: 2033281 - RNA, 22 nt, Human herpesvirus 5
uucacggggagaagaaacaaga

SEQ ID NO: 2033282 - RNA, 17 nt, Human herpesvirus 5
uucagaccgcaacaaca

SEQ ID NO: 2033283 - RNA, 18 nt, Human herpesvirus 5
uucaaccucacguuaaac

SEQ ID NO: 2033284 - RNA, 22 nt, Human herpesvirus 5
uuccaaagccgacgucccugau

SEQ ID NO: 2033285 - RNA, 10 nt, Human herpesvirus 5
uuccacgccg

SEQ ID NO: 2033286 - RNA, 17 nt, Human herpesvirus 5
uucagcguccggccucg

SEQ ID NO: 2033287 - RNA, 23 nt, Human herpesvirus 5
uucccaccgcgacccagcgacag

SEQ ID NO: 2033288 - RNA, 20 nt, Human herpesvirus 5
uuccccaccuucccucuaga

SEQ ID NO: 2033289 - RNA, 20 nt, Human herpesvirus 5
uggcggcgguggagggcgcg

SEQ ID NO: 2033290 - RNA, 19 nt, Human herpesvirus 5
uggcgcuuggugcgcgacg

SEQ ID NO: 2033291 - RNA, 16 nt, Human herpesvirus 5
uggcgcguagccaccu

SEQ ID NO: 2033292 - RNA, 22 nt, Human herpesvirus 5
uggcggcagcggaggugggccg

SEQ ID NO: 2033293 - RNA, 14 nt, Human herpesvirus 5
uggcugcgcgccuc

SEQ ID NO: 2033294 - RNA, 22 nt, Human herpesvirus 5
ugggaguuuuuagcgcgugacc

SEQ ID NO: 2033295 - RNA, 19 nt, Human herpesvirus 5
ugggcacgcgcgucggccg

SEQ ID NO: 2033296 - RNA, 22 nt, Human herpesvirus 5
uggccgcacaccuguuggagca

SEQ ID NO: 2033297 - RNA, 17 nt, Human herpesvirus 5
uggcccuggucuggccc

SEQ ID NO: 2033298 - RNA, 17 nt, Human herpesvirus 5
ugcgggaugcugcggcg

SEQ ID NO: 2033299 - RNA, 14 nt, Human herpesvirus 5
ugcggggucgacug

SEQ ID NO: 2033300 - RNA, 15 nt, Human herpesvirus 5
ugcgggguggugcuc

SEQ ID NO: 2033301 - RNA, 18 nt, Human herpesvirus 5
ugcggcguucgcgugcac

SEQ ID NO: 2033302 - RNA, 14 nt, Human herpesvirus 5
ugcgcuucugcagc

SEQ ID NO: 2033303 - RNA, 14 nt, Human herpesvirus 5
ugcggaucgcggua

SEQ ID NO: 2033304 - RNA, 14 nt, Human herpesvirus 5
ugcggcgcagacgu

SEQ ID NO: 2033305 - RNA, 14 nt, Human herpesvirus 5
ugcagacgguggug

SEQ ID NO: 2033306 - RNA, 13 nt, Human herpesvirus 5
ugcgcgucaaccg

SEQ ID NO: 2033307 - RNA, 13 nt, Human herpesvirus 5
ugcgcgucgaccu

SEQ ID NO: 2033308 - RNA, 15 nt, Human herpesvirus 5
ugcggcacagcgucg

SEQ ID NO: 2033309 - RNA, 13 nt, Human herpesvirus 5
uggggugggcgcg

SEQ ID NO: 2033310 - RNA, 18 nt, Human herpesvirus 5
uggucgagcgcgaccgcc

SEQ ID NO: 2033311 - RNA, 18 nt, Human herpesvirus 5
ugggucugcgcugccccg

SEQ ID NO: 2033312 - RNA, 13 nt, Human herpesvirus 5
ugggugaaaccga

SEQ ID NO: 2033313 - RNA, 19 nt, Human herpesvirus 5
ugggcauacgcgauaucug

SEQ ID NO: 2033314 - RNA, 13 nt, Human herpesvirus 5
uggggcugcgucg

SEQ ID NO: 2033315 - RNA, 11 nt, Human herpesvirus 5
uggggcugcug

SEQ ID NO: 2033316 - RNA, 23 nt, Human herpesvirus 5
ugggccaggacccguacugcgac

SEQ ID NO: 2033317 - RNA, 15 nt, Human herpesvirus 5
ugggcgcccccaccc

SEQ ID NO: 2033318 - RNA, 19 nt, Human herpesvirus 5
uguugacccagggcugcuc

SEQ ID NO: 2033319 - RNA, 13 nt, Human herpesvirus 5
uguggggcugcuc

SEQ ID NO: 2033320 - RNA, 16 nt, Human herpesvirus 5
uguacguaccacggua

SEQ ID NO: 2033321 - RNA, 23 nt, Human herpesvirus 5
ugguuuauaagaagacuccaccg

SEQ ID NO: 2033322 - RNA, 21 nt, Human herpesvirus 5
uguccgcggcgugaccacguc

SEQ ID NO: 2033323 - RNA, 14 nt, Human herpesvirus 5
uguccaccgacgcg

SEQ ID NO: 2033324 - RNA, 15 nt, Human herpesvirus 5
uguccucuccuccuu

SEQ ID NO: 2033325 - RNA, 22 nt, Human herpesvirus 5
ugucgccacuauguccuccgca

SEQ ID NO: 2033326 - RNA, 16 nt, Human herpesvirus 5
ugucgcgacaaucgcc

SEQ ID NO: 2033327 - RNA, 16 nt, Human herpesvirus 5
ugucgcguccacgggc

SEQ ID NO: 2033328 - RNA, 23 nt, Human herpesvirus 5
ugucggcgugaaugggcacgccg

SEQ ID NO: 2033329 - RNA, 16 nt, Human herpesvirus 5
ugucguccgaaucgcc

SEQ ID NO: 2033330 - RNA, 16 nt, Human herpesvirus 5
guggagaugaggcggc

SEQ ID NO: 2033331 - RNA, 14 nt, Human herpesvirus 5
guggcaccgccucc

SEQ ID NO: 2033332 - RNA, 21 nt, Human herpesvirus 5
guggcggcgguggagggcgcg

SEQ ID NO: 2033333 - RNA, 11 nt, Human herpesvirus 5
gugcuguugga

SEQ ID NO: 2033334 - RNA, 23 nt, Human herpesvirus 5
guggccgcgcuggcucgcgacga

SEQ ID NO: 2033335 - RNA, 15 nt, Human herpesvirus 5
gugcguggaccagac

SEQ ID NO: 2033336 - RNA, 22 nt, Human herpesvirus 5
gugcugauucgcgccgugcgcg

SEQ ID NO: 2033337 - RNA, 22 nt, Human herpesvirus 5
gugcucgacuuuacggugcgcg

SEQ ID NO: 2033338 - RNA, 16 nt, Human herpesvirus 5
uaccgaggcgccgcca

SEQ ID NO: 2033339 - RNA, 13 nt, Human herpesvirus 5
uaccgccccaccg

SEQ ID NO: 2033340 - RNA, 16 nt, Human herpesvirus 5
uaccgccccaccgccg

SEQ ID NO: 2033341 - RNA, 15 nt, Human herpesvirus 5
guucacacgucguua

SEQ ID NO: 2033342 - RNA, 19 nt, Human herpesvirus 5
guucacgcgcggaacccac

SEQ ID NO: 2033343 - RNA, 21 nt, Human herpesvirus 5
guucaucacguacacguuggg

SEQ ID NO: 2033344 - RNA, 17 nt, Human herpesvirus 5
guucaucgucuacgucg

SEQ ID NO: 2033345 - RNA, 19 nt, Human herpesvirus 5
guucaucgucuacgucguu

SEQ ID NO: 2033346 - RNA, 16 nt, Human herpesvirus 5
guguucuuacuccguc

SEQ ID NO: 2033347 - RNA, 18 nt, Human herpesvirus 5
guguuucgguccgaugua

SEQ ID NO: 2033348 - RNA, 17 nt, Human herpesvirus 5
guguuuucaccgacgug

SEQ ID NO: 2033349 - RNA, 20 nt, Human herpesvirus 5
guguuuuucccauucccugu

SEQ ID NO: 2033350 - RNA, 12 nt, Human herpesvirus 5
gugucgugacgu

SEQ ID NO: 2033351 - RNA, 15 nt, Human herpesvirus 5
guuacggcaacagcg

SEQ ID NO: 2033352 - RNA, 21 nt, Human herpesvirus 5
guuagcuuuugcccgcacgcc

SEQ ID NO: 2033353 - RNA, 22 nt, Human herpesvirus 5
guggggcugcgucgccugcgac

SEQ ID NO: 2033354 - RNA, 16 nt, Human herpesvirus 5
gugggaaugguaaaga

SEQ ID NO: 2033355 - RNA, 22 nt, Human herpesvirus 5
gugggcaagaugggcaccgucu

SEQ ID NO: 2033356 - RNA, 13 nt, Human herpesvirus 5
guggugacggugg

SEQ ID NO: 2033357 - RNA, 13 nt, Human herpesvirus 5
guggugaucgugg

SEQ ID NO: 2033358 - RNA, 13 nt, Human herpesvirus 5
guggucccggaua

SEQ ID NO: 2033359 - RNA, 17 nt, Human herpesvirus 5
guguaccaucuggcgca

SEQ ID NO: 2033360 - RNA, 18 nt, Human herpesvirus 5
guguagauuuauggaaaa

SEQ ID NO: 2033361 - RNA, 23 nt, Human herpesvirus 5
uagaccaaaccggacgcugccuc

SEQ ID NO: 2033362 - RNA, 22 nt, Human herpesvirus 5
uagccagcuguguauaguuugu

SEQ ID NO: 2033363 - RNA, 19 nt, Human herpesvirus 5
uacgagaucagccgugaga

SEQ ID NO: 2033364 - RNA, 18 nt, Human herpesvirus 5
guuaacccccgacgagca

SEQ ID NO: 2033365 - RNA, 13 nt, Human herpesvirus 5
uaccccgccgccg

SEQ ID NO: 2033366 - RNA, 14 nt, Human herpesvirus 5
uaccacuacuaccu

SEQ ID NO: 2033367 - RNA, 19 nt, Human herpesvirus 5
uacgcgccuuuugaucgcc

SEQ ID NO: 2033368 - RNA, 20 nt, Human herpesvirus 5
uacgauaauugcuacgucac

SEQ ID NO: 2033369 - RNA, 14 nt, Human herpesvirus 5
uacgcacgucgccg

SEQ ID NO: 2033370 - RNA, 14 nt, Human herpesvirus 5
ugccugggcacgcg

SEQ ID NO: 2033371 - RNA, 18 nt, Human herpesvirus 5
ugcgcaccuucggcggua

SEQ ID NO: 2033372 - RNA, 13 nt, Human herpesvirus 5
ugcgccuuccagu

SEQ ID NO: 2033373 - RNA, 14 nt, Human herpesvirus 5
ugcgcgacacggcu

SEQ ID NO: 2033374 - RNA, 20 nt, Human herpesvirus 5
ugccugcacgaccugcucca

SEQ ID NO: 2033375 - RNA, 20 nt, Human herpesvirus 5
ugccuggacgccugggcgcg

SEQ ID NO: 2033376 - RNA, 23 nt, Human herpesvirus 5
ugcgccgagcggccguugcccgg

SEQ ID NO: 2033377 - RNA, 17 nt, Human herpesvirus 5
ugcagcugcaccacggc

SEQ ID NO: 2033378 - RNA, 24 nt, Human herpesvirus 5
ugccggucuacagacugggcgacg

SEQ ID NO: 2033379 - RNA, 19 nt, Human herpesvirus 5
ugccgugacgucgcggcac

SEQ ID NO: 2033380 - RNA, 22 nt, Human herpesvirus 5
ugcagcgaauugagcaacaaac

SEQ ID NO: 2033381 - RNA, 23 nt, Human herpesvirus 5
ucugaccuugcugaugugccagc

SEQ ID NO: 2033382 - RNA, 19 nt, Human herpesvirus 5
ucugacgcugucuugcuua

SEQ ID NO: 2033383 - RNA, 14 nt, Human herpesvirus 5
ucuugcccacgccg

SEQ ID NO: 2033384 - RNA, 16 nt, Human herpesvirus 5
ucuugcccacgccguc

SEQ ID NO: 2033385 - RNA, 21 nt, Human herpesvirus 5
ucuugcgauguagcagaaaac

SEQ ID NO: 2033386 - RNA, 15 nt, Human herpesvirus 5
ugcaacgcgugaaac

SEQ ID NO: 2033387 - RNA, 22 nt, Human herpesvirus 5
ugcaccuggguggaacgagcgc

SEQ ID NO: 2033388 - RNA, 20 nt, Human herpesvirus 5
ucuggugcuauggcugcuca

SEQ ID NO: 2033389 - RNA, 23 nt, Human herpesvirus 5
ucugccggcugcggcggcacucg

SEQ ID NO: 2033390 - RNA, 12 nt, Human herpesvirus 5
ucucaccgugcu

SEQ ID NO: 2033391 - RNA, 13 nt, Human herpesvirus 5
ucucgcguucgug

SEQ ID NO: 2033392 - RNA, 19 nt, Human herpesvirus 5
ucuccuccgucgcggccag

SEQ ID NO: 2033393 - RNA, 14 nt, Human herpesvirus 5
ucucgcgcaucgcc

SEQ ID NO: 2033394 - RNA, 13 nt, Human herpesvirus 5
ucuacgcgugcac

SEQ ID NO: 2033395 - RNA, 17 nt, Human herpesvirus 5
ucuagcuggcggccucu

SEQ ID NO: 2033396 - RNA, 23 nt, Human herpesvirus 5
ucuauaggcgguacuuacgucac

SEQ ID NO: 2033397 - RNA, 13 nt, Human herpesvirus 5
ucuaucuguuggc

SEQ ID NO: 2033398 - RNA, 23 nt, Human herpesvirus 5
uaucagaggccacccacccggug

SEQ ID NO: 2033399 - RNA, 21 nt, Human herpesvirus 5
uauagcaaucuccgucacgcc

SEQ ID NO: 2033400 - RNA, 15 nt, Human herpesvirus 5
uaucgggauaucgcc

SEQ ID NO: 2033401 - RNA, 13 nt, Human herpesvirus 5
ucguguacuaccg

SEQ ID NO: 2033402 - RNA, 22 nt, Human herpesvirus 5
uauacaaucauaauauucuaua

SEQ ID NO: 2033403 - RNA, 16 nt, Human herpesvirus 5
uauacaucuccgucuc

SEQ ID NO: 2033404 - RNA, 19 nt, Human herpesvirus 5
uagguguggcgaaagccuc

SEQ ID NO: 2033405 - RNA, 22 nt, Human herpesvirus 5
uaguaauggaaaguaucgucac

SEQ ID NO: 2033406 - RNA, 12 nt, Human herpesvirus 5
uaggagacgagc

SEQ ID NO: 2033407 - RNA, 15 nt, Human herpesvirus 5
uaguauccacgucac

SEQ ID NO: 2033408 - RNA, 13 nt, Human herpesvirus 5
uaguauucugcgu

SEQ ID NO: 2033409 - RNA, 14 nt, Human herpesvirus 5
gccgaccgccgccg

SEQ ID NO: 2033410 - RNA, 11 nt, Human herpesvirus 5
gccgacgaggc

SEQ ID NO: 2033411 - RNA, 16 nt, Human herpesvirus 5
gccgcucagcgagcuc

SEQ ID NO: 2033412 - RNA, 21 nt, Human herpesvirus 5
gccgcucgggaacagacccga

SEQ ID NO: 2033413 - RNA, 18 nt, Human herpesvirus 5
gccgcuggacugacacag

SEQ ID NO: 2033414 - RNA, 14 nt, Human herpesvirus 5
gccgcugccgccgc

SEQ ID NO: 2033415 - RNA, 17 nt, Human herpesvirus 5
gccgcuuuucagaccgc

SEQ ID NO: 2033416 - RNA, 22 nt, Human herpesvirus 5
gccgcuuuucagaccgcaacaa

SEQ ID NO: 2033417 - RNA, 15 nt, Human herpesvirus 5
gccggacggcagcgu

SEQ ID NO: 2033418 - RNA, 22 nt, Human herpesvirus 5
gccguguaaugggggugggcga

SEQ ID NO: 2033419 - RNA, 20 nt, Human herpesvirus 5
gccguguguuaccgccgccg

SEQ ID NO: 2033420 - RNA, 21 nt, Human herpesvirus 5
gccguguguuaccgccgccgc

SEQ ID NO: 2033421 - RNA, 22 nt, Human herpesvirus 5
gccguguguuggcuacggcgga

SEQ ID NO: 2033422 - RNA, 16 nt, Human herpesvirus 5
gccuaccugacgccga

SEQ ID NO: 2033423 - RNA, 19 nt, Human herpesvirus 5
gccggccguuacgccgacg

SEQ ID NO: 2033424 - RNA, 16 nt, Human herpesvirus 5
gccggcggagacgacg

SEQ ID NO: 2033425 - RNA, 22 nt, Human herpesvirus 5
gccgugcucuuggcgccgcggu

SEQ ID NO: 2033426 - RNA, 18 nt, Human herpesvirus 5
gccggcgacugacgccgg

SEQ ID NO: 2033427 - RNA, 18 nt, Human herpesvirus 5
gccggcgagcgacgcggc

SEQ ID NO: 2033428 - RNA, 13 nt, Human herpesvirus 5
gccgacucgcugc

SEQ ID NO: 2033429 - RNA, 14 nt, Human herpesvirus 5
gccgagacgcugcg

SEQ ID NO: 2033430 - RNA, 13 nt, Human herpesvirus 5
gccgagacggcgu

SEQ ID NO: 2033431 - RNA, 14 nt, Human herpesvirus 5
gccgagacggcgug

SEQ ID NO: 2033432 - RNA, 15 nt, Human herpesvirus 5
gccgagacggcguga

SEQ ID NO: 2033433 - RNA, 14 nt, Human herpesvirus 5
gccgacaaccugcu

SEQ ID NO: 2033434 - RNA, 17 nt, Human herpesvirus 5
gcccuuuacggugcugc

SEQ ID NO: 2033435 - RNA, 19 nt, Human herpesvirus 5
gccgacgcgcgcccgcgcc

SEQ ID NO: 2033436 - RNA, 17 nt, Human herpesvirus 5
gccgauccacgggccgc

SEQ ID NO: 2033437 - RNA, 20 nt, Human herpesvirus 5
gccgauccacgggccgcgcu

SEQ ID NO: 2033438 - RNA, 11 nt, Human herpesvirus 5
gccgcaacagc

SEQ ID NO: 2033439 - RNA, 14 nt, Human herpesvirus 5
gccgcaacagcggc

SEQ ID NO: 2033440 - RNA, 18 nt, Human herpesvirus 5
gccgaggcuacugcugcu

SEQ ID NO: 2033441 - RNA, 12 nt, Human herpesvirus 5
gccgagucuccg

SEQ ID NO: 2033442 - RNA, 19 nt, Human herpesvirus 5
gccgagucuccgcgcaaca

SEQ ID NO: 2033443 - RNA, 16 nt, Human herpesvirus 5
gccgagcuaugcgagc

SEQ ID NO: 2033444 - RNA, 20 nt, Human herpesvirus 5
gccgcgucgcaaacgcugcu

SEQ ID NO: 2033445 - RNA, 14 nt, Human herpesvirus 5
gccgccaacgccga

SEQ ID NO: 2033446 - RNA, 15 nt, Human herpesvirus 5
gccgccaacgcgagc

SEQ ID NO: 2033447 - RNA, 17 nt, Human herpesvirus 5
gccgccaccacccgacu

SEQ ID NO: 2033448 - RNA, 22 nt, Human herpesvirus 5
gccgccaccacccgacugcagc

SEQ ID NO: 2033449 - RNA, 20 nt, Human herpesvirus 5
gccgcacgcgcuuaggacga

SEQ ID NO: 2033450 - RNA, 11 nt, Human herpesvirus 5
gugccaacaau

SEQ ID NO: 2033451 - RNA, 17 nt, Human herpesvirus 5
gugcaugacaacgggaa

SEQ ID NO: 2033452 - RNA, 22 nt, Human herpesvirus 5
gugcagcaagaguugcaacgcg

SEQ ID NO: 2033453 - RNA, 23 nt, Human herpesvirus 5
gugcagcaucgcgugcgccuccg

SEQ ID NO: 2033454 - RNA, 23 nt, Human herpesvirus 5
gugacgcagucugcccugcgcag

SEQ ID NO: 2033455 - RNA, 19 nt, Human herpesvirus 5
gugacgcuaggcggcgccg

SEQ ID NO: 2033456 - RNA, 13 nt, Human herpesvirus 5
gugaacgugcgcg

SEQ ID NO: 2033457 - RNA, 13 nt, Human herpesvirus 5
gugaauggaaaua

SEQ ID NO: 2033458 - RNA, 16 nt, Human herpesvirus 5
gugaauucuggcaaga

SEQ ID NO: 2033459 - RNA, 14 nt, Human herpesvirus 5
gugagcaacagucg

SEQ ID NO: 2033460 - RNA, 14 nt, Human herpesvirus 5
gucuuuugcacgcg

SEQ ID NO: 2033461 - RNA, 15 nt, Human herpesvirus 5
gucuggcccaaagac

SEQ ID NO: 2033462 - RNA, 20 nt, Human herpesvirus 5
gucuggcuuuaccgccgucg

SEQ ID NO: 2033463 - RNA, 17 nt, Human herpesvirus 5
gucguguccgugaucac

SEQ ID NO: 2033464 - RNA, 22 nt, Human herpesvirus 5
gucucuaccaacgcuuccugcg

SEQ ID NO: 2033465 - RNA, 14 nt, Human herpesvirus 5
gucugagcgccgac

SEQ ID NO: 2033466 - RNA, 20 nt, Human herpesvirus 5
gucuagauagucccacaggg

SEQ ID NO: 2033467 - RNA, 13 nt, Human herpesvirus 5
gucuccaccacag

SEQ ID NO: 2033468 - RNA, 22 nt, Human herpesvirus 5
gucuccaugauugugccgcguu

SEQ ID NO: 2033469 - RNA, 21 nt, Human herpesvirus 5
gucucgcgucuucgcgagguc

SEQ ID NO: 2033470 - RNA, 22 nt, Human herpesvirus 5
ggaaccaccguagcacugcgca

SEQ ID NO: 2033471 - RNA, 22 nt, Human herpesvirus 5
ggaagcuuuggucgccugcacu

SEQ ID NO: 2033472 - RNA, 21 nt, Human herpesvirus 5
ggaagccggucgucugcgacu

SEQ ID NO: 2033473 - RNA, 16 nt, Human herpesvirus 5
ggaagcgaauaagcgc

SEQ ID NO: 2033474 - RNA, 15 nt, Human herpesvirus 5
ggacaaguacagcgg

SEQ ID NO: 2033475 - RNA, 20 nt, Human herpesvirus 5
guagcgcuugcggcacagcg

SEQ ID NO: 2033476 - RNA, 20 nt, Human herpesvirus 5
ggacccguacugcgacggca

SEQ ID NO: 2033477 - RNA, 15 nt, Human herpesvirus 5
ggaccgacacggagg

SEQ ID NO: 2033478 - RNA, 16 nt, Human herpesvirus 5
ggacauggacucgcca

SEQ ID NO: 2033479 - RNA, 18 nt, Human herpesvirus 5
ggacauggacucgccacg

SEQ ID NO: 2033480 - RNA, 19 nt, Human herpesvirus 5
guacucgcaggugugcgcg

SEQ ID NO: 2033481 - RNA, 13 nt, Human herpesvirus 5
guaggaggcgcgc

SEQ ID NO: 2033482 - RNA, 14 nt, Human herpesvirus 5
guaggaguggcgcc

SEQ ID NO: 2033483 - RNA, 15 nt, Human herpesvirus 5
guaggaucuucgucg

SEQ ID NO: 2033484 - RNA, 16 nt, Human herpesvirus 5
guauccauuggagaac

SEQ ID NO: 2033485 - RNA, 12 nt, Human herpesvirus 5
guauggcugcgc

SEQ ID NO: 2033486 - RNA, 19 nt, Human herpesvirus 5
guauucccccggacgggca

SEQ ID NO: 2033487 - RNA, 19 nt, Human herpesvirus 5
guauucaucgggucgucuc

SEQ ID NO: 2033488 - RNA, 14 nt, Human herpesvirus 5
gucacgcaggugag

SEQ ID NO: 2033489 - RNA, 20 nt, Human herpesvirus 5
gucaccaguuccugcgcgcc

SEQ ID NO: 2033490 - RNA, 17 nt, Human herpesvirus 5
gucaccucucgggccga

SEQ ID NO: 2033491 - RNA, 19 nt, Human herpesvirus 5
gucacgcguuauacgccga

SEQ ID NO: 2033492 - RNA, 19 nt, Human herpesvirus 5
gucaacacuaccaaguacc

SEQ ID NO: 2033493 - RNA, 17 nt, Human herpesvirus 5
gucaacaucaucagcgc

SEQ ID NO: 2033494 - RNA, 20 nt, Human herpesvirus 5
gucaaccacccgccggaacg

SEQ ID NO: 2033495 - RNA, 14 nt, Human herpesvirus 5
gucaagacgcugaa

SEQ ID NO: 2033496 - RNA, 20 nt, Human herpesvirus 5
gucaaggcucgcaaagacgu

SEQ ID NO: 2033497 - RNA, 14 nt, Human herpesvirus 5
gucgcuccgcgucg

SEQ ID NO: 2033498 - RNA, 15 nt, Human herpesvirus 5
gucgcuucgccgcca

SEQ ID NO: 2033499 - RNA, 11 nt, Human herpesvirus 5
gucggaaacgg

SEQ ID NO: 2033500 - RNA, 18 nt, Human herpesvirus 5
gucgcgucggcguaacaa

SEQ ID NO: 2033501 - RNA, 15 nt, Human herpesvirus 5
gucgcguguaggcga

SEQ ID NO: 2033502 - RNA, 16 nt, Human herpesvirus 5
gucggcgguccuccag

SEQ ID NO: 2033503 - RNA, 18 nt, Human herpesvirus 5
gucggagccccugcgcgc

SEQ ID NO: 2033504 - RNA, 17 nt, Human herpesvirus 5
gucggccugggcugcug

SEQ ID NO: 2033505 - RNA, 13 nt, Human herpesvirus 5
gucggcgccgccg

SEQ ID NO: 2033506 - RNA, 13 nt, Human herpesvirus 5
gucggcgccgccu

SEQ ID NO: 2033507 - RNA, 19 nt, Human herpesvirus 5
gucggucccaucgcccaca

SEQ ID NO: 2033508 - RNA, 22 nt, Human herpesvirus 5
gucgugagcagcgugcaccugc

SEQ ID NO: 2033509 - RNA, 16 nt, Human herpesvirus 5
gucgugcucuugacgg

SEQ ID NO: 2033510 - RNA, 13 nt, Human herpesvirus 5
gucggugcgccca

SEQ ID NO: 2033511 - RNA, 17 nt, Human herpesvirus 5
gucgguggaaccgugcc

SEQ ID NO: 2033512 - RNA, 22 nt, Human herpesvirus 5
gucgguuuuuucaccgucgucg

SEQ ID NO: 2033513 - RNA, 14 nt, Human herpesvirus 5
gucgggccgucgcg

SEQ ID NO: 2033514 - RNA, 13 nt, Human herpesvirus 5
gccuccucgcugg

SEQ ID NO: 2033515 - RNA, 13 nt, Human herpesvirus 5
gccucggguugcc

SEQ ID NO: 2033516 - RNA, 17 nt, Human herpesvirus 5
gccuccgacgacgccga

SEQ ID NO: 2033517 - RNA, 19 nt, Human herpesvirus 5
gccuaggucuguugcguug

SEQ ID NO: 2033518 - RNA, 23 nt, Human herpesvirus 5
gccugccgcacgcgcuagccuuu

SEQ ID NO: 2033519 - RNA, 16 nt, Human herpesvirus 5
gccucgauccauccug

SEQ ID NO: 2033520 - RNA, 17 nt, Human herpesvirus 5
gccugcaccaaccgacg

SEQ ID NO: 2033521 - RNA, 16 nt, Human herpesvirus 5
gccugcacgaccugcu

SEQ ID NO: 2033522 - RNA, 19 nt, Human herpesvirus 5
gcgggcacuggggacggug

SEQ ID NO: 2033523 - RNA, 14 nt, Human herpesvirus 5
gcguggccggcgug

SEQ ID NO: 2033524 - RNA, 17 nt, Human herpesvirus 5
gcguggcggccgacggc

SEQ ID NO: 2033525 - RNA, 21 nt, Human herpesvirus 5
gcguucgugauucguaggcag

SEQ ID NO: 2033526 - RNA, 19 nt, Human herpesvirus 5
gcguggaccagacggcguc

SEQ ID NO: 2033527 - RNA, 14 nt, Human herpesvirus 5
gcguggacugggac

SEQ ID NO: 2033528 - RNA, 19 nt, Human herpesvirus 5
gcguguggaggacggggug

SEQ ID NO: 2033529 - RNA, 17 nt, Human herpesvirus 5
gcgugugggugaaaccg

SEQ ID NO: 2033530 - RNA, 21 nt, Human herpesvirus 5
gcgggggaaaaacaaagaagu

SEQ ID NO: 2033531 - RNA, 15 nt, Human herpesvirus 5
gcgguaucgcgcaca

SEQ ID NO: 2033532 - RNA, 17 nt, Human herpesvirus 5
gcgguacccgacgcggc

SEQ ID NO: 2033533 - RNA, 16 nt, Human herpesvirus 5
gcgguacugaagccgc

SEQ ID NO: 2033534 - RNA, 13 nt, Human herpesvirus 5
gcgguagagcucg

SEQ ID NO: 2033535 - RNA, 19 nt, Human herpesvirus 5
gcggguccauuggagccgc

SEQ ID NO: 2033536 - RNA, 16 nt, Human herpesvirus 5
gcguuguuuacccccg

SEQ ID NO: 2033537 - RNA, 15 nt, Human herpesvirus 5
gcuccucggagcacg

SEQ ID NO: 2033538 - RNA, 14 nt, Human herpesvirus 5
gcguuuggucgccu

SEQ ID NO: 2033539 - RNA, 17 nt, Human herpesvirus 5
gcuaagaugaacgggug

SEQ ID NO: 2033540 - RNA, 20 nt, Human herpesvirus 5
gcuaccucaugacgcacgcc

SEQ ID NO: 2033541 - RNA, 13 nt, Human herpesvirus 5
gcucgcucgcgcc

SEQ ID NO: 2033542 - RNA, 17 nt, Human herpesvirus 5
gcucgcucugacgccgc

SEQ ID NO: 2033543 - RNA, 18 nt, Human herpesvirus 5
gcucggacacagcgccgc

SEQ ID NO: 2033544 - RNA, 19 nt, Human herpesvirus 5
gcucggaccgugacggugg

SEQ ID NO: 2033545 - RNA, 18 nt, Human herpesvirus 5
gcugcucggcguggucaa

SEQ ID NO: 2033546 - RNA, 19 nt, Human herpesvirus 5
gcugcugagacugagacug

SEQ ID NO: 2033547 - RNA, 17 nt, Human herpesvirus 5
gcugccgcucagcgagc

SEQ ID NO: 2033548 - RNA, 20 nt, Human herpesvirus 5
gcugcgcaauaugacgcuga

SEQ ID NO: 2033549 - RNA, 19 nt, Human herpesvirus 5
gcuuuauccgacucgcugu

SEQ ID NO: 2033550 - RNA, 19 nt, Human herpesvirus 5
gcuuucgcgucuuuuuucu

SEQ ID NO: 2033551 - RNA, 17 nt, Human herpesvirus 5
gcuuuuggugcgccacg

SEQ ID NO: 2033552 - RNA, 20 nt, Human herpesvirus 5
ggaaaugcccgccaccaugc

SEQ ID NO: 2033553 - RNA, 17 nt, Human herpesvirus 5
ggaacaacccgucgucg

SEQ ID NO: 2033554 - RNA, 20 nt, Human herpesvirus 5
gcugcuguugugggugcgga

SEQ ID NO: 2033555 - RNA, 14 nt, Human herpesvirus 5
gcugcuucauccag

SEQ ID NO: 2033556 - RNA, 16 nt, Human herpesvirus 5
gcugcuuucgcacgca

SEQ ID NO: 2033557 - RNA, 17 nt, Human herpesvirus 5
cgggcgcgcaucgccgu

SEQ ID NO: 2033558 - RNA, 15 nt, Human herpesvirus 5
cggggugccgccgcu

SEQ ID NO: 2033559 - RNA, 20 nt, Human herpesvirus 5
cgguaugggucacggcggcg

SEQ ID NO: 2033560 - RNA, 13 nt, Human herpesvirus 5
cgguacacguccc

SEQ ID NO: 2033561 - RNA, 14 nt, Human herpesvirus 5
cgguaccacuacua

SEQ ID NO: 2033562 - RNA, 14 nt, Human herpesvirus 5
cgguaccagacgcg

SEQ ID NO: 2033563 - RNA, 22 nt, Human herpesvirus 5
cgguacgcagucacugcguguc

SEQ ID NO: 2033564 - RNA, 18 nt, Human herpesvirus 5
cgguacugaagccgccgu

SEQ ID NO: 2033565 - RNA, 13 nt, Human herpesvirus 5
cgggugacggcga

SEQ ID NO: 2033566 - RNA, 14 nt, Human herpesvirus 5
cgggugacggcgac

SEQ ID NO: 2033567 - RNA, 14 nt, Human herpesvirus 5
cgguaaaaccacgu

SEQ ID NO: 2033568 - RNA, 17 nt, Human herpesvirus 5
cgcgugcacgcgcugcu

SEQ ID NO: 2033569 - RNA, 17 nt, Human herpesvirus 5
cgggcucgaccggcggc

SEQ ID NO: 2033570 - RNA, 18 nt, Human herpesvirus 5
cgucaucucgccgacgug

SEQ ID NO: 2033571 - RNA, 20 nt, Human herpesvirus 5
cgucaucucgccgacguggu

SEQ ID NO: 2033572 - RNA, 21 nt, Human herpesvirus 5
cgucagccucgggugcaccgc

SEQ ID NO: 2033573 - RNA, 22 nt, Human herpesvirus 5
cgucacucuuggcacggggaau

SEQ ID NO: 2033574 - RNA, 16 nt, Human herpesvirus 5
cgucacuucaaccacg

SEQ ID NO: 2033575 - RNA, 16 nt, Human herpesvirus 5
cgucacaauugacgug

SEQ ID NO: 2033576 - RNA, 20 nt, Human herpesvirus 5
cgucccgcgcggaucggaca

SEQ ID NO: 2033577 - RNA, 21 nt, Human herpesvirus 5
cgucaugccuuggcgcucugg

SEQ ID NO: 2033578 - RNA, 20 nt, Human herpesvirus 5
cguccgggcuuuccuuguca

SEQ ID NO: 2033579 - RNA, 21 nt, Human herpesvirus 5
cguccgaaucgccggcuugcu

SEQ ID NO: 2033580 - RNA, 21 nt, Human herpesvirus 5
cggucugagcuccgacgcagg

SEQ ID NO: 2033581 - RNA, 22 nt, Human herpesvirus 5
cgguccgcggugucuccucgcg

SEQ ID NO: 2033582 - RNA, 22 nt, Human herpesvirus 5
cggugcguggaccagacggcgu

SEQ ID NO: 2033583 - RNA, 18 nt, Human herpesvirus 5
cggugaggaggacggcga

SEQ ID NO: 2033584 - RNA, 15 nt, Human herpesvirus 5
cggugcaggccgcgc

SEQ ID NO: 2033585 - RNA, 14 nt, Human herpesvirus 5
cggugagacgaggc

SEQ ID NO: 2033586 - RNA, 16 nt, Human herpesvirus 5
cgucgccgccgucgcg

SEQ ID NO: 2033587 - RNA, 14 nt, Human herpesvirus 5
cgucgacaugucgc

SEQ ID NO: 2033588 - RNA, 13 nt, Human herpesvirus 5
cgucgacggugaa

SEQ ID NO: 2033589 - RNA, 13 nt, Human herpesvirus 5
cucuugcgcccuc

SEQ ID NO: 2033590 - RNA, 18 nt, Human herpesvirus 5
cgucgccugcgacggcgg

SEQ ID NO: 2033591 - RNA, 22 nt, Human herpesvirus 5
cgucgaccuugagcgacagcag

SEQ ID NO: 2033592 - RNA, 14 nt, Human herpesvirus 5
cguccucguggcgg

SEQ ID NO: 2033593 - RNA, 19 nt, Human herpesvirus 5
cgucgcagccaccggcgca

SEQ ID NO: 2033594 - RNA, 20 nt, Human herpesvirus 5
cgucgcaucaucaacagcag

SEQ ID NO: 2033595 - RNA, 15 nt, Human herpesvirus 5
cgucgagcacccguc

SEQ ID NO: 2033596 - RNA, 14 nt, Human herpesvirus 5
cgucgagcggcgug

SEQ ID NO: 2033597 - RNA, 23 nt, Human herpesvirus 5
cugaccgguaaggcggaaaaaga

SEQ ID NO: 2033598 - RNA, 23 nt, Human herpesvirus 5
cugauggccgacgaggccggcgg

SEQ ID NO: 2033599 - RNA, 19 nt, Human herpesvirus 5
cugcaacggcaucauguuc

SEQ ID NO: 2033600 - RNA, 17 nt, Human herpesvirus 5
cugcaccaaccgacgua

SEQ ID NO: 2033601 - RNA, 18 nt, Human herpesvirus 5
cugcaccucgugcgagga

SEQ ID NO: 2033602 - RNA, 22 nt, Human herpesvirus 5
cugcacgacaucuuccgcgagc

SEQ ID NO: 2033603 - RNA, 23 nt, Human herpesvirus 5
cugcacgacaucuuccgcgagca

SEQ ID NO: 2033604 - RNA, 20 nt, Human herpesvirus 5
cugacguggugcgcugcguu

SEQ ID NO: 2033605 - RNA, 22 nt, Human herpesvirus 5
cugacguggugcgcugcguucg

SEQ ID NO: 2033606 - RNA, 20 nt, Human herpesvirus 5
cucuuggcgccgcggugguc

SEQ ID NO: 2033607 - RNA, 16 nt, Human herpesvirus 5
cugaagccgccgucga

SEQ ID NO: 2033608 - RNA, 18 nt, Human herpesvirus 5
cuuguucucgaccacgua

SEQ ID NO: 2033609 - RNA, 17 nt, Human herpesvirus 5
cuuuggcuacgguggug

SEQ ID NO: 2033610 - RNA, 21 nt, Human herpesvirus 5
cuuucacaccgauuuucgcgg

SEQ ID NO: 2033611 - RNA, 20 nt, Human herpesvirus 5
cuuggcggccgagucuccgc

SEQ ID NO: 2033612 - RNA, 12 nt, Human herpesvirus 5
cuugcccggcgu

SEQ ID NO: 2033613 - RNA, 19 nt, Human herpesvirus 5
cuugguacgcugacguggu

SEQ ID NO: 2033614 - RNA, 23 nt, Human herpesvirus 5
cuuggucacggcuauaaaaaaga

SEQ ID NO: 2033615 - RNA, 19 nt, Human herpesvirus 5
cuucuaccuggcuggcgca

SEQ ID NO: 2033616 - RNA, 14 nt, Human herpesvirus 5
cuugcccacgccgu

SEQ ID NO: 2033617 - RNA, 17 nt, Human herpesvirus 5
cuggcgcggucugcgug

SEQ ID NO: 2033618 - RNA, 14 nt, Human herpesvirus 5
cuucugcagcuccg

SEQ ID NO: 2033619 - RNA, 21 nt, Human herpesvirus 5
cuugcgcuucugcagcuccgc

SEQ ID NO: 2033620 - RNA, 22 nt, Human herpesvirus 5
cugcacgccgccgugacugcga

SEQ ID NO: 2033621 - RNA, 21 nt, Human herpesvirus 5
cuggacgcggugaacgugcgc

SEQ ID NO: 2033622 - RNA, 15 nt, Human herpesvirus 5
cuggacgcugcgucg

SEQ ID NO: 2033623 - RNA, 16 nt, Human herpesvirus 5
cugcagguacggcccg

SEQ ID NO: 2033624 - RNA, 15 nt, Human herpesvirus 5
cuggccgagacggcg

SEQ ID NO: 2033625 - RNA, 16 nt, Human herpesvirus 5
cuggccgagacggcgu

SEQ ID NO: 2033626 - RNA, 18 nt, Human herpesvirus 5
cugcuuuucgggccgcgg

SEQ ID NO: 2033627 - RNA, 17 nt, Human herpesvirus 5
cuggccgccgcugcacg

SEQ ID NO: 2033628 - RNA, 19 nt, Human herpesvirus 5
cuggagaagcgcagcgucg

SEQ ID NO: 2033629 - RNA, 16 nt, Human herpesvirus 5
cuggaucuuggcggcc

SEQ ID NO: 2033630 - RNA, 16 nt, Human herpesvirus 5
cuggcaacgugccacg

SEQ ID NO: 2033631 - RNA, 18 nt, Human herpesvirus 5
cuggcaacgugccacgug

SEQ ID NO: 2033632 - RNA, 17 nt, Human herpesvirus 5
cuggcaauuacgugggu

SEQ ID NO: 2033633 - RNA, 20 nt, Human herpesvirus 5
cuuuguuauuuuccucguaa

SEQ ID NO: 2033634 - RNA, 17 nt, Human herpesvirus 5
gaagauggccaucacgg

SEQ ID NO: 2033635 - RNA, 20 nt, Human herpesvirus 5
gaagcggagugcaucucgag

SEQ ID NO: 2033636 - RNA, 14 nt, Human herpesvirus 5
gaaggaacgcacgc

SEQ ID NO: 2033637 - RNA, 14 nt, Human herpesvirus 5
gacagcaaggccgc

SEQ ID NO: 2033638 - RNA, 19 nt, Human herpesvirus 5
gacagcaaggccgccgccg

SEQ ID NO: 2033639 - RNA, 23 nt, Human herpesvirus 5
gaagaccaugacgacggugacga

SEQ ID NO: 2033640 - RNA, 18 nt, Human herpesvirus 5
gaacuuuguagugcgcgc

SEQ ID NO: 2033641 - RNA, 13 nt, Human herpesvirus 5
gaagacggagcuc

SEQ ID NO: 2033642 - RNA, 23 nt, Human herpesvirus 5
gacagguaugggcgguggucggc

SEQ ID NO: 2033643 - RNA, 19 nt, Human herpesvirus 5
gacaggaggcugugcgcgc

SEQ ID NO: 2033644 - RNA, 15 nt, Human herpesvirus 5
gacaggcucgucgug

SEQ ID NO: 2033645 - RNA, 14 nt, Human herpesvirus 5
gacaucacggucac

SEQ ID NO: 2033646 - RNA, 17 nt, Human herpesvirus 5
gaccacguagucgcgcg

SEQ ID NO: 2033647 - RNA, 23 nt, Human herpesvirus 5
gaccaagugucucuaaacgccac

SEQ ID NO: 2033648 - RNA, 13 nt, Human herpesvirus 5
gaacgcgugcgcg

SEQ ID NO: 2033649 - RNA, 19 nt, Human herpesvirus 5
gacauuuuuucggccgcgg

SEQ ID NO: 2033650 - RNA, 18 nt, Human herpesvirus 5
gacauggagacaguuucc

SEQ ID NO: 2033651 - RNA, 17 nt, Human herpesvirus 5
gacauggagcccacgcc

SEQ ID NO: 2033652 - RNA, 16 nt, Human herpesvirus 5
gacccguacugcgacg

SEQ ID NO: 2033653 - RNA, 16 nt, Human herpesvirus 5
gaccgcaacaacagca

SEQ ID NO: 2033654 - RNA, 23 nt, Human herpesvirus 5
gacggcggcgcguugccacagcg

SEQ ID NO: 2033655 - RNA, 16 nt, Human herpesvirus 5
gacggcgacaucacgg

SEQ ID NO: 2033656 - RNA, 15 nt, Human herpesvirus 5
gccccacaugcugcu

SEQ ID NO: 2033657 - RNA, 13 nt, Human herpesvirus 5
gcccaaagaccgc

SEQ ID NO: 2033658 - RNA, 17 nt, Human herpesvirus 5
gcccagcaucuccucgc

SEQ ID NO: 2033659 - RNA, 22 nt, Human herpesvirus 5
gccaguacagcgccgacgugcu

SEQ ID NO: 2033660 - RNA, 14 nt, Human herpesvirus 5
gcccaccgccuccg

SEQ ID NO: 2033661 - RNA, 14 nt, Human herpesvirus 5
gcccacgaaggcgc

SEQ ID NO: 2033662 - RNA, 21 nt, Human herpesvirus 5
gacgggucucuuugacacgag

SEQ ID NO: 2033663 - RNA, 18 nt, Human herpesvirus 5
gacggugaugcguguggc

SEQ ID NO: 2033664 - RNA, 17 nt, Human herpesvirus 5
gacggcguuuuggcgcc

SEQ ID NO: 2033665 - RNA, 15 nt, Human herpesvirus 5
gacgugacgguguuu

SEQ ID NO: 2033666 - RNA, 18 nt, Human herpesvirus 5
gacggugguuuccgcgcc

SEQ ID NO: 2033667 - RNA, 15 nt, Human herpesvirus 5
gacgguuuccacgcc

SEQ ID NO: 2033668 - RNA, 17 nt, Human herpesvirus 5
gacgguuuccacgccac

SEQ ID NO: 2033669 - RNA, 20 nt, Human herpesvirus 5
gacgguuuccacgccaccgc

SEQ ID NO: 2033670 - RNA, 21 nt, Human herpesvirus 5
gacguagaaaaguaacacacg

SEQ ID NO: 2033671 - RNA, 16 nt, Human herpesvirus 5
gacguagguaccgacu

SEQ ID NO: 2033672 - RNA, 15 nt, Human herpesvirus 5
gacguugaugcggcg

SEQ ID NO: 2033673 - RNA, 23 nt, Human herpesvirus 5
gacguuagagaaagagcagcgcg

SEQ ID NO: 2033674 - RNA, 23 nt, Human herpesvirus 5
gacgugcgaugguauuacgcccg

SEQ ID NO: 2033675 - RNA, 20 nt, Human herpesvirus 5
gacuaugagggccugcggcg

SEQ ID NO: 2033676 - RNA, 13 nt, Human herpesvirus 5
aaaaaaaagagag

SEQ ID NO: 2033677 - RNA, 13 nt, Human herpesvirus 5
aaaaaaaggcguu

SEQ ID NO: 2033678 - RNA, 15 nt, Human herpesvirus 5
aaaaacacagagacg

SEQ ID NO: 2033679 - RNA, 19 nt, Human herpesvirus 5
aaaaacacgacgaaagcgu

SEQ ID NO: 2033680 - RNA, 14 nt, Human herpesvirus 5
caggaccacgucca

SEQ ID NO: 2033681 - RNA, 17 nt, Human herpesvirus 5
caggacgucaaccacgu

SEQ ID NO: 2033682 - RNA, 14 nt, Human herpesvirus 5
cacaagcgcccgaa

SEQ ID NO: 2033683 - RNA, 19 nt, Human herpesvirus 5
cagcugcuggagcgcggcc

SEQ ID NO: 2033684 - RNA, 19 nt, Human herpesvirus 5
cagcuggugaucggccgcg

SEQ ID NO: 2033685 - RNA, 14 nt, Human herpesvirus 5
cagcuuaccgccac

SEQ ID NO: 2033686 - RNA, 20 nt, Human herpesvirus 5
cagcuuaccgccaccgucgc

SEQ ID NO: 2033687 - RNA, 16 nt, Human herpesvirus 5
cacaccugccucgaca

SEQ ID NO: 2033688 - RNA, 14 nt, Human herpesvirus 5
cacacgcaucugca

SEQ ID NO: 2033689 - RNA, 15 nt, Human herpesvirus 5
cagcucgcgcuggcu

SEQ ID NO: 2033690 - RNA, 14 nt, Human herpesvirus 5
caauuccacgccgc

SEQ ID NO: 2033691 - RNA, 21 nt, Human herpesvirus 5
cacaacggccgccgacgucgc

SEQ ID NO: 2033692 - RNA, 23 nt, Human herpesvirus 5
cacacgguccgugggagacgcgg

SEQ ID NO: 2033693 - RNA, 18 nt, Human herpesvirus 5
aggccgcacuggacgacg

SEQ ID NO: 2033694 - RNA, 14 nt, Human herpesvirus 5
aggcgauccggacc

SEQ ID NO: 2033695 - RNA, 18 nt, Human herpesvirus 5
aggcggugacggcgcucu

SEQ ID NO: 2033696 - RNA, 11 nt, Human herpesvirus 5
aggcgcucgug

SEQ ID NO: 2033697 - RNA, 18 nt, Human herpesvirus 5
aggcggaggagccggcgg

SEQ ID NO: 2033698 - RNA, 19 nt, Human herpesvirus 5
agggcgcgcgucuggacgc

SEQ ID NO: 2033699 - RNA, 17 nt, Human herpesvirus 5
agggacacguagauccc

SEQ ID NO: 2033700 - RNA, 15 nt, Human herpesvirus 5
acgcaaacgcgggcc

SEQ ID NO: 2033701 - RNA, 19 nt, Human herpesvirus 5
acgaguaucucgacgacug

SEQ ID NO: 2033702 - RNA, 14 nt, Human herpesvirus 5
acgauaugucgcga

SEQ ID NO: 2033703 - RNA, 22 nt, Human herpesvirus 5
acgaucguaacccaggcgcgua

SEQ ID NO: 2033704 - RNA, 20 nt, Human herpesvirus 5
acgagcgccguccugcagac

SEQ ID NO: 2033705 - RNA, 11 nt, Human herpesvirus 5
acgaggaggag

SEQ ID NO: 2033706 - RNA, 21 nt, Human herpesvirus 5
acgagcaucgcaacaacagca

SEQ ID NO: 2033707 - RNA, 20 nt, Human herpesvirus 5
acgacgucguccagucguug

SEQ ID NO: 2033708 - RNA, 21 nt, Human herpesvirus 5
aucgccgauagagauggcgau

SEQ ID NO: 2033709 - RNA, 14 nt, Human herpesvirus 5
aucgccgcggacgc

SEQ ID NO: 2033710 - RNA, 17 nt, Human herpesvirus 5
caaccacgucggggcug

SEQ ID NO: 2033711 - RNA, 23 nt, Human herpesvirus 5
caacccguaucugagcggcggcg

SEQ ID NO: 2033712 - RNA, 15 nt, Human herpesvirus 5
aucaccuggcgacgu

SEQ ID NO: 2033713 - RNA, 16 nt, Human herpesvirus 5
aucaccuggcgacguc

SEQ ID NO: 2033714 - RNA, 16 nt, Human herpesvirus 5
auaugcaucggaaaau

SEQ ID NO: 2033715 - RNA, 22 nt, Human herpesvirus 5
aucagcuaccgccgcaacagcg

SEQ ID NO: 2033716 - RNA, 21 nt, Human herpesvirus 5
aucaguguacacgcgcccaga

SEQ ID NO: 2033717 - RNA, 18 nt, Human herpesvirus 5
aucaacagcagcaacagc

SEQ ID NO: 2033718 - RNA, 15 nt, Human herpesvirus 5
aucacaucacccaac

SEQ ID NO: 2033719 - RNA, 16 nt, Human herpesvirus 5
caacguucacgcugcu

SEQ ID NO: 2033720 - RNA, 15 nt, Human herpesvirus 5
caacgcgaccaccgu

SEQ ID NO: 2033721 - RNA, 21 nt, Human herpesvirus 5
caaguucgaucucaugucgcu

SEQ ID NO: 2033722 - RNA, 22 nt, Human herpesvirus 5
caaguuggugguggaaugcggu

SEQ ID NO: 2033723 - RNA, 17 nt, Human herpesvirus 5
caagugcaagcgccgcg

SEQ ID NO: 2033724 - RNA, 14 nt, Human herpesvirus 5
caagugccugcacg

SEQ ID NO: 2033725 - RNA, 18 nt, Human herpesvirus 5
caagaguugcaacgcgcc

SEQ ID NO: 2033726 - RNA, 22 nt, Human herpesvirus 5
aaggcagugacgcuaggcggcg

SEQ ID NO: 2033727 - RNA, 17 nt, Human herpesvirus 5
aaggccgugccgccgcg

SEQ ID NO: 2033728 - RNA, 13 nt, Human herpesvirus 5
aaggucguucucc

SEQ ID NO: 2033729 - RNA, 15 nt, Human herpesvirus 5
aaggcggcggccgca

SEQ ID NO: 2033730 - RNA, 18 nt, Human herpesvirus 5
aagggcaaggaggcggcg

SEQ ID NO: 2033731 - RNA, 18 nt, Human herpesvirus 5
aagggcgaaaacguuucg

SEQ ID NO: 2033732 - RNA, 14 nt, Human herpesvirus 5
aauaccaacguauc

SEQ ID NO: 2033733 - RNA, 16 nt, Human herpesvirus 5
acagacaggacaccgc

SEQ ID NO: 2033734 - RNA, 17 nt, Human herpesvirus 5
acacugcuacccugcgc

SEQ ID NO: 2033735 - RNA, 21 nt, Human herpesvirus 5
acacuugaauaaauaaaccgg

SEQ ID NO: 2033736 - RNA, 19 nt, Human herpesvirus 5
acaccuguuggagcaacgg

SEQ ID NO: 2033737 - RNA, 13 nt, Human herpesvirus 5
acacgacgaaagc

SEQ ID NO: 2033738 - RNA, 21 nt, Human herpesvirus 5
acacguuguuugucugcgacg

SEQ ID NO: 2033739 - RNA, 23 nt, Human herpesvirus 5
acacucgugacgucaaucaaauc

SEQ ID NO: 2033740 - RNA, 20 nt, Human herpesvirus 5
acagacuuuauaaaccguag

SEQ ID NO: 2033741 - RNA, 16 nt, Human herpesvirus 5
acagcaacaacagucg

SEQ ID NO: 2033742 - RNA, 17 nt, Human herpesvirus 5
aaucagcagugaguaca

SEQ ID NO: 2033743 - RNA, 22 nt, Human herpesvirus 5
acacggugacguagcagcacgc

SEQ ID NO: 2033744 - RNA, 15 nt, Human herpesvirus 5
acaggcgccgcaaac

SEQ ID NO: 2033745 - RNA, 17 nt, Human herpesvirus 5
acagcggcgacagacgg

SEQ ID NO: 2033746 - RNA, 16 nt, Human herpesvirus 5
acaucugucaccucac

SEQ ID NO: 2033747 - RNA, 13 nt, Human herpesvirus 5
accagacggcguc

SEQ ID NO: 2033748 - RNA, 18 nt, Human herpesvirus 5
accagaugcucccggcgc

SEQ ID NO: 2033749 - RNA, 19 nt, Human herpesvirus 5
accagcaguaugacgugcg

SEQ ID NO: 2033750 - RNA, 16 nt, Human herpesvirus 5
accacgucaccgugcc

SEQ ID NO: 2033751 - RNA, 18 nt, Human herpesvirus 5
accacguacaucggcguc

SEQ ID NO: 2033752 - RNA, 22 nt, Human herpesvirus 5
accacccuguuccccgugacgu

SEQ ID NO: 2033753 - RNA, 20 nt, Human herpesvirus 5
accacaacggccgccgacgu

SEQ ID NO: 2033754 - RNA, 15 nt, Human herpesvirus 5
acauguccuggcgcg

SEQ ID NO: 2033755 - RNA, 21 nt, Human herpesvirus 5
accaagucuugccgugacguc

SEQ ID NO: 2033756 - RNA, 17 nt, Human herpesvirus 5
acauuuuuucggccgcg

SEQ ID NO: 2033757 - RNA, 21 nt, Human herpesvirus 5
accaacugagcuucggagguc

SEQ ID NO: 2033758 - RNA, 16 nt, Human herpesvirus 5
accagcugcaggcagg

SEQ ID NO: 2033759 - RNA, 14 nt, Human herpesvirus 5
accgagacggagga

SEQ ID NO: 2033760 - RNA, 18 nt, Human herpesvirus 5
accgcagguuagcggcga

SEQ ID NO: 2033761 - RNA, 13 nt, Human herpesvirus 5
accgcgacggcga

SEQ ID NO: 2033762 - RNA, 14 nt, Human herpesvirus 5
accgcgagcggcgg

SEQ ID NO: 2033763 - RNA, 15 nt, Human herpesvirus 5
accgcgagcggcgga

SEQ ID NO: 2033764 - RNA, 13 nt, Human herpesvirus 5
accgcggcgcagg

SEQ ID NO: 2033765 - RNA, 20 nt, Human herpesvirus 5
accgccuccgaacgcucgug

SEQ ID NO: 2033766 - RNA, 17 nt, Human herpesvirus 5
accgccucggcgacguc

SEQ ID NO: 2033767 - RNA, 23 nt, Human herpesvirus 5
accgcaacaacagcagcaacagc

SEQ ID NO: 2033768 - RNA, 12 nt, Human herpesvirus 5
accgcugcggca

SEQ ID NO: 2033769 - RNA, 21 nt, Human herpesvirus 5
accgucgcguccgacgcgacg

SEQ ID NO: 2033770 - RNA, 20 nt, Human herpesvirus 5
accgucgcuacauucgccgc

SEQ ID NO: 2033771 - RNA, 16 nt, Human herpesvirus 5
accucgugcgaggaca

SEQ ID NO: 2033772 - RNA, 16 nt, Human herpesvirus 5
acgacgggacggcggc

SEQ ID NO: 2033773 - RNA, 12 nt, Human herpesvirus 5
accgggucgccu

SEQ ID NO: 2033774 - RNA, 19 nt, Human herpesvirus 5
accgcuacaacgcgcgccu

SEQ ID NO: 2033775 - RNA, 23 nt, Human herpesvirus 5
accgucgauguuggacgaaacgu

SEQ ID NO: 2033776 - RNA, 14 nt, Human herpesvirus 5
accgugcacgcgcu

SEQ ID NO: 2033777 - RNA, 14 nt, Human herpesvirus 5
accgugcucgugcc

SEQ ID NO: 2033778 - RNA, 17 nt, Human herpesvirus 5
cggaaguuccgacgcga

SEQ ID NO: 2033779 - RNA, 14 nt, Human herpesvirus 5
cggaaaaaccgcgc

SEQ ID NO: 2033780 - RNA, 12 nt, Human herpesvirus 5
cggaaacagcgu

SEQ ID NO: 2033781 - RNA, 19 nt, Human herpesvirus 5
cggacacuaggcguccgcg

SEQ ID NO: 2033782 - RNA, 17 nt, Human herpesvirus 5
cgcuuccucagcuugcc

SEQ ID NO: 2033783 - RNA, 18 nt, Human herpesvirus 5
cgcuucugcagcuccgcg

SEQ ID NO: 2033784 - RNA, 18 nt, Human herpesvirus 5
cgcuuuaagcugcucaug

SEQ ID NO: 2033785 - RNA, 13 nt, Human herpesvirus 5
cgcuuuccgccgc

SEQ ID NO: 2033786 - RNA, 15 nt, Human herpesvirus 5
cgcgugccugggaac

SEQ ID NO: 2033787 - RNA, 18 nt, Human herpesvirus 5
cgcgugccugggaacgcg

SEQ ID NO: 2033788 - RNA, 20 nt, Human herpesvirus 5
cgcgucggcguaacaacggc

SEQ ID NO: 2033789 - RNA, 22 nt, Human herpesvirus 5
cgcgucggucgccgccuccgcg

SEQ ID NO: 2033790 - RNA, 16 nt, Human herpesvirus 5
cgcgucuucgcgaggu

SEQ ID NO: 2033791 - RNA, 16 nt, Human herpesvirus 5
cgcguccgggcuuucc

SEQ ID NO: 2033792 - RNA, 14 nt, Human herpesvirus 5
cgcguagaaggcaa

SEQ ID NO: 2033793 - RNA, 15 nt, Human herpesvirus 5
cgcguacggacgagu

SEQ ID NO: 2033794 - RNA, 12 nt, Human herpesvirus 5
cgcguacggugg

SEQ ID NO: 2033795 - RNA, 16 nt, Human herpesvirus 5
cgcguagcgcuccugg

SEQ ID NO: 2033796 - RNA, 15 nt, Human herpesvirus 5
cgcguaggacgacgu

SEQ ID NO: 2033797 - RNA, 15 nt, Human herpesvirus 5
cgcggguggccggcg

SEQ ID NO: 2033798 - RNA, 17 nt, Human herpesvirus 5
cgcggguucacgcgucg

SEQ ID NO: 2033799 - RNA, 16 nt, Human herpesvirus 5
cgcguaagaaaccgcg

SEQ ID NO: 2033800 - RNA, 22 nt, Human herpesvirus 5
cgccgacgugauccaggaggug

SEQ ID NO: 2033801 - RNA, 21 nt, Human herpesvirus 5
cgcagcagagccaccaggugc

SEQ ID NO: 2033802 - RNA, 21 nt, Human herpesvirus 5
cgaggcggaggagccggcggc

SEQ ID NO: 2033803 - RNA, 17 nt, Human herpesvirus 5
cgccgacgugcuucgcg

SEQ ID NO: 2033804 - RNA, 18 nt, Human herpesvirus 5
cgccgcaacagcggcgac

SEQ ID NO: 2033805 - RNA, 11 nt, Human herpesvirus 5
cgccgcagacc

SEQ ID NO: 2033806 - RNA, 18 nt, Human herpesvirus 5
cgccgauagagauggcga

SEQ ID NO: 2033807 - RNA, 15 nt, Human herpesvirus 5
cgccgauagaggcga

SEQ ID NO: 2033808 - RNA, 16 nt, Human herpesvirus 5
cgccgcccgacgccga

SEQ ID NO: 2033809 - RNA, 18 nt, Human herpesvirus 5
cgccgccgaagcuucgcg

SEQ ID NO: 2033810 - RNA, 15 nt, Human herpesvirus 5
cgccgccgacucgcu

SEQ ID NO: 2033811 - RNA, 15 nt, Human herpesvirus 5
cgccgccagcgcggu

SEQ ID NO: 2033812 - RNA, 17 nt, Human herpesvirus 5
cgccgcgaucgaggcgg

SEQ ID NO: 2033813 - RNA, 21 nt, Human herpesvirus 5
cgccgcgaucgaggcggcggc

SEQ ID NO: 2033814 - RNA, 13 nt, Human herpesvirus 5
cgccgccgucacc

SEQ ID NO: 2033815 - RNA, 15 nt, Human herpesvirus 5
cgccgcgacaacggc

SEQ ID NO: 2033816 - RNA, 21 nt, Human herpesvirus 5
cgccgcgacaacggccgccgc

SEQ ID NO: 2033817 - RNA, 16 nt, Human herpesvirus 5
cgcggggacgcgugac

SEQ ID NO: 2033818 - RNA, 20 nt, Human herpesvirus 5
cgccgcgccguaguucuccg

SEQ ID NO: 2033819 - RNA, 22 nt, Human herpesvirus 5
cgccgcucauaaugccgucacc

SEQ ID NO: 2033820 - RNA, 12 nt, Human herpesvirus 5
cgccgcggcguu

SEQ ID NO: 2033821 - RNA, 22 nt, Human herpesvirus 5
cgcggcuacguacgacugcgcg

SEQ ID NO: 2033822 - RNA, 19 nt, Human herpesvirus 5
cgaggcgcuggacgccauc

SEQ ID NO: 2033823 - RNA, 13 nt, Human herpesvirus 5
cgcacgaccgcga

SEQ ID NO: 2033824 - RNA, 20 nt, Human herpesvirus 5
cgcacgaccgcgacgagguc

SEQ ID NO: 2033825 - RNA, 20 nt, Human herpesvirus 5
cgcacgacuggccagagguc

SEQ ID NO: 2033826 - RNA, 14 nt, Human herpesvirus 5
cgcacgagacgcga

SEQ ID NO: 2033827 - RNA, 23 nt, Human herpesvirus 5
cgcacgagacgcgacuccugcag

SEQ ID NO: 2033828 - RNA, 18 nt, Human herpesvirus 5
cgcacgcuggaggacgcg

SEQ ID NO: 2033829 - RNA, 16 nt, Human herpesvirus 5
cgagcggcggacuugg

SEQ ID NO: 2033830 - RNA, 17 nt, Human herpesvirus 5
cgagcguugcgcucgcg

SEQ ID NO: 2033831 - RNA, 14 nt, Human herpesvirus 5
cgaggaacccgcga

SEQ ID NO: 2033832 - RNA, 18 nt, Human herpesvirus 5
cgagcgcggcacgccguu

SEQ ID NO: 2033833 - RNA, 13 nt, Human herpesvirus 5
cgagcgcucggcg

SEQ ID NO: 2033834 - RNA, 20 nt, Human herpesvirus 5
cgagcucgucgccagcgcga

SEQ ID NO: 2033835 - RNA, 15 nt, Human herpesvirus 5
cgacgagcgcugcga

SEQ ID NO: 2033836 - RNA, 16 nt, Human herpesvirus 5
cgaccguuguccccgc

SEQ ID NO: 2033837 - RNA, 15 nt, Human herpesvirus 5
cgacgaaggacggga

SEQ ID NO: 2033838 - RNA, 16 nt, Human herpesvirus 5
cgacgcagugcguggc

SEQ ID NO: 2033839 - RNA, 13 nt, Human herpesvirus 5
cgacgccgucgcu

SEQ ID NO: 2033840 - RNA, 12 nt, Human herpesvirus 5
cgacgcgcgacc

SEQ ID NO: 2033841 - RNA, 16 nt, Human herpesvirus 5
cgacgcgcgaccgcga

SEQ ID NO: 2033842 - RNA, 14 nt, Human herpesvirus 5
cgacgcgcggcggc

SEQ ID NO: 2033843 - RNA, 22 nt, Human herpesvirus 5
cgacguacgaaaugaccguggc

SEQ ID NO: 2033844 - RNA, 14 nt, Human herpesvirus 5
cgacgggacggcgg

SEQ ID NO: 2033845 - RNA, 15 nt, Human herpesvirus 5
cgacgggacggcggc

SEQ ID NO: 2033846 - RNA, 19 nt, Human herpesvirus 5
cgacgggacggcggcgcgu

SEQ ID NO: 2033847 - RNA, 22 nt, Human herpesvirus 5
cgacggucaccaucgugccgcu

SEQ ID NO: 2033848 - RNA, 12 nt, Human herpesvirus 5
cgacggacgcga

SEQ ID NO: 2033849 - RNA, 22 nt, Human herpesvirus 5
cgacggcagcuaucgugacugg

SEQ ID NO: 2033850 - RNA, 19 nt, Human herpesvirus 5
cgacguagguuaccgcgug

SEQ ID NO: 2033851 - RNA, 20 nt, Human herpesvirus 5
cgacguagguuaccgcgugc

SEQ ID NO: 2033852 - RNA, 16 nt, Human herpesvirus 5
cgagcgcgaacgccgc

SEQ ID NO: 2033853 - RNA, 18 nt, Human herpesvirus 5
cgagcgcgaacgccgcgc

SEQ ID NO: 2033854 - RNA, 14 nt, Human herpesvirus 5
ccucccuccgcggc

SEQ ID NO: 2033855 - RNA, 16 nt, Human herpesvirus 5
ccuccgacgacgccga

SEQ ID NO: 2033856 - RNA, 16 nt, Human herpesvirus 5
ccuccgcgaacggcga

SEQ ID NO: 2033857 - RNA, 14 nt, Human herpesvirus 5
ccuccgcggcccgu

SEQ ID NO: 2033858 - RNA, 13 nt, Human herpesvirus 5
ccuccggcuguca

SEQ ID NO: 2033859 - RNA, 21 nt, Human herpesvirus 5
ccuccucgucgucgccgccgu

SEQ ID NO: 2033860 - RNA, 13 nt, Human herpesvirus 5
ccucggacaccgg

SEQ ID NO: 2033861 - RNA, 21 nt, Human herpesvirus 5
ccucugccugggcacgcgcgu

SEQ ID NO: 2033862 - RNA, 20 nt, Human herpesvirus 5
ccucuccuccgucgcggcca

SEQ ID NO: 2033863 - RNA, 17 nt, Human herpesvirus 5
ccucggagcacgggcga

SEQ ID NO: 2033864 - RNA, 15 nt, Human herpesvirus 5
ccugacccgcggcua

SEQ ID NO: 2033865 - RNA, 23 nt, Human herpesvirus 5
ccugguuaguucgccgucgccgc

SEQ ID NO: 2033866 - RNA, 15 nt, Human herpesvirus 5
ccugguugcugccgc

SEQ ID NO: 2033867 - RNA, 13 nt, Human herpesvirus 5
ccuugcgcgcggu

SEQ ID NO: 2033868 - RNA, 20 nt, Human herpesvirus 5
ccuugcgcucccugcuccgc

SEQ ID NO: 2033869 - RNA, 22 nt, Human herpesvirus 5
ccuugcgcucccugcuccgcaa

SEQ ID NO: 2033870 - RNA, 16 nt, Human herpesvirus 5
ccuucggcacgcuggc

SEQ ID NO: 2033871 - RNA, 21 nt, Human herpesvirus 5
ccuucugcuacgcggcgcccg

SEQ ID NO: 2033872 - RNA, 21 nt, Human herpesvirus 5
ccucggguugccuggacgccu

SEQ ID NO: 2033873 - RNA, 21 nt, Human herpesvirus 5
ccugucgucgacaugucgcga

SEQ ID NO: 2033874 - RNA, 19 nt, Human herpesvirus 5
ccuguugugucgcacgccc

SEQ ID NO: 2033875 - RNA, 15 nt, Human herpesvirus 5
ccuguuucggauguu

SEQ ID NO: 2033876 - RNA, 20 nt, Human herpesvirus 5
cgaaagcuucggccggcugc

SEQ ID NO: 2033877 - RNA, 13 nt, Human herpesvirus 5
cgaccggcggcug

SEQ ID NO: 2033878 - RNA, 14 nt, Human herpesvirus 5
cgaacguccucgga

SEQ ID NO: 2033879 - RNA, 15 nt, Human herpesvirus 5
cgaacggcgacggca

SEQ ID NO: 2033880 - RNA, 13 nt, Human herpesvirus 5
ccccguggccgcu

SEQ ID NO: 2033881 - RNA, 19 nt, Human herpesvirus 5
cccgcacgacgaccccgcu

SEQ ID NO: 2033882 - RNA, 23 nt, Human herpesvirus 5
cccgauaaucggcucucaggcgc

SEQ ID NO: 2033883 - RNA, 14 nt, Human herpesvirus 5
cccgagacggcggc

SEQ ID NO: 2033884 - RNA, 22 nt, Human herpesvirus 5
cccgaggucuuuugcacgcgcg

SEQ ID NO: 2033885 - RNA, 23 nt, Human herpesvirus 5
cccgaggucuuuugcacgcgcga

SEQ ID NO: 2033886 - RNA, 17 nt, Human herpesvirus 5
ccgacaaccugcugcac

SEQ ID NO: 2033887 - RNA, 17 nt, Human herpesvirus 5
ccgacauucgcgucggc

SEQ ID NO: 2033888 - RNA, 19 nt, Human herpesvirus 5
ccgaagguuagcgccgcgg

SEQ ID NO: 2033889 - RNA, 15 nt, Human herpesvirus 5
ccgaacgcgacuggc

SEQ ID NO: 2033890 - RNA, 22 nt, Human herpesvirus 5
ccgaacgcucgugagcaacagu

SEQ ID NO: 2033891 - RNA, 12 nt, Human herpesvirus 5
ccgaacgcugcu

SEQ ID NO: 2033892 - RNA, 14 nt, Human herpesvirus 5
ccgaacagacuugg

SEQ ID NO: 2033893 - RNA, 12 nt, Human herpesvirus 5
cccuccacaggc

SEQ ID NO: 2033894 - RNA, 15 nt, Human herpesvirus 5
cccuggucuggccca

SEQ ID NO: 2033895 - RNA, 20 nt, Human herpesvirus 5
cccucucgcgcccgcagaca

SEQ ID NO: 2033896 - RNA, 18 nt, Human herpesvirus 5
cccucuucuuugccggcu

SEQ ID NO: 2033897 - RNA, 23 nt, Human herpesvirus 5
cccucuucuuugccggcucuccu

SEQ ID NO: 2033898 - RNA, 19 nt, Human herpesvirus 5
cccugaguucacgcgcgga

SEQ ID NO: 2033899 - RNA, 15 nt, Human herpesvirus 5
cccugccagucuccg

SEQ ID NO: 2033900 - RNA, 17 nt, Human herpesvirus 5
cccuauggcacgucgcu

SEQ ID NO: 2033901 - RNA, 18 nt, Human herpesvirus 5
cccguggaucagccgccg

SEQ ID NO: 2033902 - RNA, 19 nt, Human herpesvirus 5
cccguggaucagccgccgc

SEQ ID NO: 2033903 - RNA, 17 nt, Human herpesvirus 5
cccgucaaaacacacgc

SEQ ID NO: 2033904 - RNA, 19 nt, Human herpesvirus 5
cccgucaaaacacacgcga

SEQ ID NO: 2033905 - RNA, 17 nt, Human herpesvirus 5
cccgccggagcccgguc

SEQ ID NO: 2033906 - RNA, 18 nt, Human herpesvirus 5
cccgccggcgggcggcug

SEQ ID NO: 2033907 - RNA, 14 nt, Human herpesvirus 5
cccgccguugcggc

SEQ ID NO: 2033908 - RNA, 20 nt, Human herpesvirus 5
cccguuacgccggaggccgc

SEQ ID NO: 2033909 - RNA, 20 nt, Human herpesvirus 5
cccaaaagaagaaaaaaggc

SEQ ID NO: 2033910 - RNA, 23 nt, Human herpesvirus 5
cccacgacuguucgucgagcacc

SEQ ID NO: 2033911 - RNA, 15 nt, Human herpesvirus 5
ccaugaugacggcga

SEQ ID NO: 2033912 - RNA, 16 nt, Human herpesvirus 5
ccaucgguacgaacgc

SEQ ID NO: 2033913 - RNA, 17 nt, Human herpesvirus 5
ccaugaagcggaugauu

SEQ ID NO: 2033914 - RNA, 18 nt, Human herpesvirus 5
ccaugccggagcuacgcg

SEQ ID NO: 2033915 - RNA, 15 nt, Human herpesvirus 5
ccaugccuuccgcgu

SEQ ID NO: 2033916 - RNA, 14 nt, Human herpesvirus 5
ccaugacgcgccuc

SEQ ID NO: 2033917 - RNA, 14 nt, Human herpesvirus 5
ccaugagcggcagg

SEQ ID NO: 2033918 - RNA, 15 nt, Human herpesvirus 5
ccaucucgcguaacg

SEQ ID NO: 2033919 - RNA, 15 nt, Human herpesvirus 5
ucgcccucgacggcg

SEQ ID NO: 2033920 - RNA, 18 nt, Human herpesvirus 5
ucgccgaggcuacugcug

SEQ ID NO: 2033921 - RNA, 18 nt, Human herpesvirus 5
ucgccgccgucgcgccuu

SEQ ID NO: 2033922 - RNA, 22 nt, Human herpesvirus 5
uccgugugcugugguacgucaa

SEQ ID NO: 2033923 - RNA, 15 nt, Human herpesvirus 5
uccguuaccacgguu

SEQ ID NO: 2033924 - RNA, 12 nt, Human herpesvirus 5
ucgagcgcgacc

SEQ ID NO: 2033925 - RNA, 19 nt, Human herpesvirus 5
ucgccaacuaccgugccac

SEQ ID NO: 2033926 - RNA, 17 nt, Human herpesvirus 5
ucgauuaccuacgucaa

SEQ ID NO: 2033927 - RNA, 20 nt, Human herpesvirus 5
ucgauccucucucacgcguc

SEQ ID NO: 2033928 - RNA, 16 nt, Human herpesvirus 5
ucgagccaagucgccg

SEQ ID NO: 2033929 - RNA, 22 nt, Human herpesvirus 5
uccucggacgaaggggaggacg

SEQ ID NO: 2033930 - RNA, 18 nt, Human herpesvirus 5
uccucggagcacgggcga

SEQ ID NO: 2033931 - RNA, 14 nt, Human herpesvirus 5
uccucggugcccgc

SEQ ID NO: 2033932 - RNA, 16 nt, Human herpesvirus 5
ggcgcguuguccucgc

SEQ ID NO: 2033933 - RNA, 15 nt, Human herpesvirus 5
uccgcggcccccacg

SEQ ID NO: 2033934 - RNA, 19 nt, Human herpesvirus 5
uccgcgucggucgccgccu

SEQ ID NO: 2033935 - RNA, 20 nt, Human herpesvirus 5
ggcgcguuauaagcaccgug

SEQ ID NO: 2033936 - RNA, 19 nt, Human herpesvirus 5
ggcggccgagucuccgcgc

SEQ ID NO: 2033937 - RNA, 14 nt, Human herpesvirus 5
ggcggcgaucgcgc

SEQ ID NO: 2033938 - RNA, 23 nt, Human herpesvirus 5
ggcggcgggguuaagcguccucg

SEQ ID NO: 2033939 - RNA, 16 nt, Human herpesvirus 5
uccgcaagcgccgcca

SEQ ID NO: 2033940 - RNA, 17 nt, Human herpesvirus 5
ggcgcccgggccgccug

SEQ ID NO: 2033941 - RNA, 14 nt, Human herpesvirus 5
gcgcguguacuugc

SEQ ID NO: 2033942 - RNA, 21 nt, Human herpesvirus 5
ggcgccuuuuucuucgccucg

SEQ ID NO: 2033943 - RNA, 13 nt, Human herpesvirus 5
gcgcguacggugg

SEQ ID NO: 2033944 - RNA, 14 nt, Human herpesvirus 5
gcgcgacacggugg

SEQ ID NO: 2033945 - RNA, 14 nt, Human herpesvirus 5
gcgcgguguuagac

SEQ ID NO: 2033946 - RNA, 21 nt, Human herpesvirus 5
gcgcgucaaccgccagcgagc

SEQ ID NO: 2033947 - RNA, 16 nt, Human herpesvirus 5
gcgcguccacagcgug

SEQ ID NO: 2033948 - RNA, 12 nt, Human herpesvirus 5
gcgcgcagacgc

SEQ ID NO: 2033949 - RNA, 16 nt, Human herpesvirus 5
gcgcgcacccgacggc

SEQ ID NO: 2033950 - RNA, 18 nt, Human herpesvirus 5
gcgcgcacccgacggcgg

SEQ ID NO: 2033951 - RNA, 14 nt, Human herpesvirus 5
gcgccguccugcag

SEQ ID NO: 2033952 - RNA, 15 nt, Human herpesvirus 5
gcgcgaacaggccgc

SEQ ID NO: 2033953 - RNA, 19 nt, Human herpesvirus 5
gcgccugguugcugccgcg

SEQ ID NO: 2033954 - RNA, 20 nt, Human herpesvirus 5
gcgccugguugcugccgcgu

SEQ ID NO: 2033955 - RNA, 16 nt, Human herpesvirus 5
gcgccguaguucuccg

SEQ ID NO: 2033956 - RNA, 14 nt, Human herpesvirus 5
gcgccgucagagca

SEQ ID NO: 2033957 - RNA, 15 nt, Human herpesvirus 5
gcgccgugcucagcg

SEQ ID NO: 2033958 - RNA, 20 nt, Human herpesvirus 5
gcgccgugcucagcggcgug

SEQ ID NO: 2033959 - RNA, 22 nt, Human herpesvirus 5
gcgccgugcucuuggcgccgcg

SEQ ID NO: 2033960 - RNA, 14 nt, Human herpesvirus 5
gagcgccggcgagc

SEQ ID NO: 2033961 - RNA, 20 nt, Human herpesvirus 5
gagcgccggggagacgacga

SEQ ID NO: 2033962 - RNA, 16 nt, Human herpesvirus 5
gagcgcgaccgccuca

SEQ ID NO: 2033963 - RNA, 18 nt, Human herpesvirus 5
gagcgggcggcgguggug

SEQ ID NO: 2033964 - RNA, 14 nt, Human herpesvirus 5
gagcguccgacgcc

SEQ ID NO: 2033965 - RNA, 22 nt, Human herpesvirus 5
gaugaacguggugaggggcgug

SEQ ID NO: 2033966 - RNA, 15 nt, Human herpesvirus 5
gaucgcgccgccucg

SEQ ID NO: 2033967 - RNA, 14 nt, Human herpesvirus 5
gaucgggcggucga

SEQ ID NO: 2033968 - RNA, 17 nt, Human herpesvirus 5
gaucguacccaccaccu

SEQ ID NO: 2033969 - RNA, 16 nt, Human herpesvirus 5
gaucgcagccuccucg

SEQ ID NO: 2033970 - RNA, 23 nt, Human herpesvirus 5
gaucgccgcggacgccugcgacg

SEQ ID NO: 2033971 - RNA, 13 nt, Human herpesvirus 5
gaucgccuggagc

SEQ ID NO: 2033972 - RNA, 20 nt, Human herpesvirus 5
gauccgcucaccacguacga

SEQ ID NO: 2033973 - RNA, 17 nt, Human herpesvirus 5
gauccacgggccgcgcu

SEQ ID NO: 2033974 - RNA, 17 nt, Human herpesvirus 5
gauccugggacaccacg

SEQ ID NO: 2033975 - RNA, 17 nt, Human herpesvirus 5
gaucagccgccgccucc

SEQ ID NO: 2033976 - RNA, 23 nt, Human herpesvirus 5
gaucaucuguuuuugcugcaacg

SEQ ID NO: 2033977 - RNA, 15 nt, Human herpesvirus 5
gaugacagcgagcuc

SEQ ID NO: 2033978 - RNA, 17 nt, Human herpesvirus 5
gaugcgcaccuucggcg

SEQ ID NO: 2033979 - RNA, 15 nt, Human herpesvirus 5
gaugcuauccgcugc

SEQ ID NO: 2033980 - RNA, 20 nt, Human herpesvirus 5
gaugcuauccgcugcgacua

SEQ ID NO: 2033981 - RNA, 18 nt, Human herpesvirus 5
gauggaaaugcccgccac

SEQ ID NO: 2033982 - RNA, 17 nt, Human herpesvirus 5
gauggaggucugcgaga

SEQ ID NO: 2033983 - RNA, 20 nt, Human herpesvirus 5
gagccgccgacgcuggcgcu

SEQ ID NO: 2033984 - RNA, 18 nt, Human herpesvirus 5
cucccgacaggcucgucg

SEQ ID NO: 2033985 - RNA, 13 nt, Human herpesvirus 5
cuccacggccucc

SEQ ID NO: 2033986 - RNA, 14 nt, Human herpesvirus 5
cucaggcgcgcaga

SEQ ID NO: 2033987 - RNA, 18 nt, Human herpesvirus 5
cucagucucucggugcgu

SEQ ID NO: 2033988 - RNA, 15 nt, Human herpesvirus 5
cucaucggcauguuc

SEQ ID NO: 2033989 - RNA, 16 nt, Human herpesvirus 5
cucaucucagccucgu

SEQ ID NO: 2033990 - RNA, 19 nt, Human herpesvirus 5
cucaccuggaccgguggua

SEQ ID NO: 2033991 - RNA, 17 nt, Human herpesvirus 5
cuauugccacacgcgcu

SEQ ID NO: 2033992 - RNA, 22 nt, Human herpesvirus 5
cuauuggcagaagcauagcgau

SEQ ID NO: 2033993 - RNA, 20 nt, Human herpesvirus 5
cgcgcuggcaaacuccgaca

SEQ ID NO: 2033994 - RNA, 14 nt, Human herpesvirus 5
cgcgcuggcucgcg

SEQ ID NO: 2033995 - RNA, 19 nt, Human herpesvirus 5
cgcgcuggcuuuccucggg

SEQ ID NO: 2033996 - RNA, 14 nt, Human herpesvirus 5
cgcgcuucuggucg

SEQ ID NO: 2033997 - RNA, 18 nt, Human herpesvirus 5
cgcgcuuugcgccgccgc

SEQ ID NO: 2033998 - RNA, 19 nt, Human herpesvirus 5
cgcgcuuuugaccgcgagc

SEQ ID NO: 2033999 - RNA, 15 nt, Human herpesvirus 5
cgcggaaacgacgga

SEQ ID NO: 2034000 - RNA, 16 nt, Human herpesvirus 5
cgcggaaacgacggac

SEQ ID NO: 2034001 - RNA, 17 nt, Human herpesvirus 5
cuauguggcuccgccgg

SEQ ID NO: 2034002 - RNA, 14 nt, Human herpesvirus 5
cgcgcugcuccucg

SEQ ID NO: 2034003 - RNA, 16 nt, Human herpesvirus 5
cgcgcugcuccucgga

SEQ ID NO: 2034004 - RNA, 19 nt, Human herpesvirus 5
cgcgcucuguaccguuauu

SEQ ID NO: 2034005 - RNA, 12 nt, Human herpesvirus 5
ccgcggaggugc

SEQ ID NO: 2034006 - RNA, 18 nt, Human herpesvirus 5
ccgcggacgccugcgacg

SEQ ID NO: 2034007 - RNA, 14 nt, Human herpesvirus 5
ccggcgcgguguua

SEQ ID NO: 2034008 - RNA, 22 nt, Human herpesvirus 5
ccggcgcgguguuagacauggg

SEQ ID NO: 2034009 - RNA, 13 nt, Human herpesvirus 5
ccggcggcgugca

SEQ ID NO: 2034010 - RNA, 13 nt, Human herpesvirus 5
ccggcuacgucga

SEQ ID NO: 2034011 - RNA, 15 nt, Human herpesvirus 5
ccggcguucagucgc

SEQ ID NO: 2034012 - RNA, 21 nt, Human herpesvirus 5
ccggcguugccgccaugucgc

SEQ ID NO: 2034013 - RNA, 14 nt, Human herpesvirus 5
ccggcgucgcuggc

SEQ ID NO: 2034014 - RNA, 13 nt, Human herpesvirus 5
ccggcuccgccgu

SEQ ID NO: 2034015 - RNA, 15 nt, Human herpesvirus 5
ccggcugcacguggc

SEQ ID NO: 2034016 - RNA, 18 nt, Human herpesvirus 5
ccgggccaccagccgcga

SEQ ID NO: 2034017 - RNA, 16 nt, Human herpesvirus 5
ccgggcaacgcguggc

SEQ ID NO: 2034018 - RNA, 18 nt, Human herpesvirus 5
ccgggcggcuuugccguc

SEQ ID NO: 2034019 - RNA, 15 nt, Human herpesvirus 5
cgccugcgacggcgg

SEQ ID NO: 2034020 - RNA, 16 nt, Human herpesvirus 5
cgccugcgacggcggg

SEQ ID NO: 2034021 - RNA, 19 nt, Human herpesvirus 5
cgccugguugcugccgcgu

SEQ ID NO: 2034022 - RNA, 13 nt, Human herpesvirus 5
cgcgaacgccgcg

SEQ ID NO: 2034023 - RNA, 12 nt, Human herpesvirus 5
cgcgaacggcga

SEQ ID NO: 2034024 - RNA, 13 nt, Human herpesvirus 5
cgcgacacggugg

SEQ ID NO: 2034025 - RNA, 16 nt, Human herpesvirus 5
cgcgacacacguucga

SEQ ID NO: 2034026 - RNA, 20 nt, Human herpesvirus 5
cgcgaccgggaucacgacga

SEQ ID NO: 2034027 - RNA, 23 nt, Human herpesvirus 5
cgcgaccagcugcuggacgacgu

SEQ ID NO: 2034028 - RNA, 20 nt, Human herpesvirus 5
cgcgacguguugcgggaccu

SEQ ID NO: 2034029 - RNA, 22 nt, Human herpesvirus 5
cgcgcgucuggucaacugcgug

SEQ ID NO: 2034030 - RNA, 14 nt, Human herpesvirus 5
ccgcgacccucgcg

SEQ ID NO: 2034031 - RNA, 14 nt, Human herpesvirus 5
ccgcgaacggcgac

SEQ ID NO: 2034032 - RNA, 20 nt, Human herpesvirus 5
ccgcgacaacggccgccgca

SEQ ID NO: 2034033 - RNA, 18 nt, Human herpesvirus 5
ccgccaugucgcuccgcg

SEQ ID NO: 2034034 - RNA, 18 nt, Human herpesvirus 5
ccgcgcccgucgcgcacg

SEQ ID NO: 2034035 - RNA, 17 nt, Human herpesvirus 5
ccgcgacccagcgacag

SEQ ID NO: 2034036 - RNA, 23 nt, Human herpesvirus 5
ccgccucggaucuacucaucggc

SEQ ID NO: 2034037 - RNA, 17 nt, Human herpesvirus 5
ccgccucuucuggcccu

SEQ ID NO: 2034038 - RNA, 17 nt, Human herpesvirus 5
ccgccguugcggccgcc

SEQ ID NO: 2034039 - RNA, 12 nt, Human herpesvirus 5
ccgccgcggcgu

SEQ ID NO: 2034040 - RNA, 19 nt, Human herpesvirus 5
ccgccccucuuuuccccgu

SEQ ID NO: 2034041 - RNA, 13 nt, Human herpesvirus 5
ccgccgccgcgcu

SEQ ID NO: 2034042 - RNA, 16 nt, Human herpesvirus 5
ccgccgccgcgcuggc

SEQ ID NO: 2034043 - RNA, 15 nt, Human herpesvirus 5
uggagcgggucgccg

SEQ ID NO: 2034044 - RNA, 19 nt, Human herpesvirus 5
uggagaaaacgccggcgga

SEQ ID NO: 2034045 - RNA, 14 nt, Human herpesvirus 5
uggagcccacgccg

SEQ ID NO: 2034046 - RNA, 12 nt, Human herpesvirus 5
uggaggucgacg

SEQ ID NO: 2034047 - RNA, 20 nt, Human herpesvirus 5
uggcacguuuuggaaaacgu

SEQ ID NO: 2034048 - RNA, 16 nt, Human herpesvirus 5
gcccccguggccgcuu

SEQ ID NO: 2034049 - RNA, 16 nt, Human herpesvirus 5
gccagcugcgucguca

SEQ ID NO: 2034050 - RNA, 18 nt, Human herpesvirus 5
gccacguucuugcguccu

SEQ ID NO: 2034051 - RNA, 22 nt, Human herpesvirus 5
gccagcgaacaccaucucgcgg

SEQ ID NO: 2034052 - RNA, 14 nt, Human herpesvirus 5
gccagcguccgcgc

SEQ ID NO: 2034053 - RNA, 21 nt, Human herpesvirus 5
gccccgaagguuagcgccgcg

SEQ ID NO: 2034054 - RNA, 21 nt, Human herpesvirus 5
gcccgacugcggacgccgacg

SEQ ID NO: 2034055 - RNA, 23 nt, Human herpesvirus 5
gcccgaggaucuggcggccgccg

SEQ ID NO: 2034056 - RNA, 15 nt, Human herpesvirus 5
gcagcuggugaucgg

SEQ ID NO: 2034057 - RNA, 16 nt, Human herpesvirus 5
gcaggccgcgcaggcc

SEQ ID NO: 2034058 - RNA, 19 nt, Human herpesvirus 5
gcaggucucgcgcaucgcc

SEQ ID NO: 2034059 - RNA, 15 nt, Human herpesvirus 5
gcaggugugcgcguc

SEQ ID NO: 2034060 - RNA, 20 nt, Human herpesvirus 5
gcaggggcuggacgugguua

SEQ ID NO: 2034061 - RNA, 18 nt, Human herpesvirus 5
gccaagaugcugcgggcc

SEQ ID NO: 2034062 - RNA, 12 nt, Human herpesvirus 5
gccacacgcgcu

SEQ ID NO: 2034063 - RNA, 16 nt, Human herpesvirus 5
gccaccaggugccggc

SEQ ID NO: 2034064 - RNA, 21 nt, Human herpesvirus 5
gcagcucuuuuccagcgugcg

SEQ ID NO: 2034065 - RNA, 23 nt, Human herpesvirus 5
gcaggagcugcuuuucgggccgc

SEQ ID NO: 2034066 - RNA, 15 nt, Human herpesvirus 5
gagaccgccgccgcg

SEQ ID NO: 2034067 - RNA, 15 nt, Human herpesvirus 5
gagacgugcgaccug

SEQ ID NO: 2034068 - RNA, 16 nt, Human herpesvirus 5
gagacgcucacccguu

SEQ ID NO: 2034069 - RNA, 21 nt, Human herpesvirus 5
gacuugaguaccaagugccgc

SEQ ID NO: 2034070 - RNA, 22 nt, Human herpesvirus 5
gacuugaguaccaagugccgcc

SEQ ID NO: 2034071 - RNA, 21 nt, Human herpesvirus 5
gagaacuuuguagugcgcgcc

SEQ ID NO: 2034072 - RNA, 18 nt, Human herpesvirus 5
cgguggucgaugcugauc

SEQ ID NO: 2034073 - RNA, 21 nt, Human herpesvirus 5
cgguggucggcugccgccgcu

SEQ ID NO: 2034074 - RNA, 15 nt, Human herpesvirus 5
cgguugcggcuuggu

SEQ ID NO: 2034075 - RNA, 14 nt, Human herpesvirus 5
cgguuuccacgcca

SEQ ID NO: 2034076 - RNA, 18 nt, Human herpesvirus 5
cggugcugcugcgcgaca

SEQ ID NO: 2034077 - RNA, 20 nt, Human herpesvirus 5
cgguggagggcgcgcggcaa

SEQ ID NO: 2034078 - RNA, 11 nt, Human herpesvirus 5
cgguggcggcc

SEQ ID NO: 2034079 - RNA, 13 nt, Human herpesvirus 5
cguauauucuaca

SEQ ID NO: 2034080 - RNA, 14 nt, Human herpesvirus 5
cguauccuggucaa

SEQ ID NO: 2034081 - RNA, 18 nt, Human herpesvirus 5
cguagugagcuuugacgu

SEQ ID NO: 2034082 - RNA, 20 nt, Human herpesvirus 5
cguauacaacaguucuauca

SEQ ID NO: 2034083 - RNA, 15 nt, Human herpesvirus 5
cguagcagcacgcgg

SEQ ID NO: 2034084 - RNA, 16 nt, Human herpesvirus 5
cguacgccguguacca

SEQ ID NO: 2034085 - RNA, 16 nt, Human herpesvirus 5
cguacugcgacggcag

SEQ ID NO: 2034086 - RNA, 22 nt, Human herpesvirus 5
cguacuucaugccccgaugaac

SEQ ID NO: 2034087 - RNA, 14 nt, Human herpesvirus 5
gaaacagcagcucg

SEQ ID NO: 2034088 - RNA, 21 nt, Human herpesvirus 5
gaaacagcguccacaguuucc

SEQ ID NO: 2034089 - RNA, 16 nt, Human herpesvirus 5
cguauuccguuugcgc

SEQ ID NO: 2034090 - RNA, 20 nt, Human herpesvirus 5
gaaaacgccggacgagcugg

SEQ ID NO: 2034091 - RNA, 15 nt, Human herpesvirus 5
gaaacuacgugcaac

SEQ ID NO: 2034092 - RNA, 22 nt, Human herpesvirus 5
gaaacuacgugcaacggcgacg

SEQ ID NO: 2034093 - RNA, 13 nt, Human herpesvirus 5
gaaaaagaaaccc

SEQ ID NO: 2034094 - RNA, 21 nt, Human herpesvirus 5
gaaaccguacuaagucucccg

SEQ ID NO: 2034095 - RNA, 18 nt, Human herpesvirus 5
gaaagcucuacgagcugg

SEQ ID NO: 2034096 - RNA, 14 nt, Human herpesvirus 5
gaaaguuguccgcg

SEQ ID NO: 2034097 - RNA, 19 nt, Human herpesvirus 5
gaacaaauucagcaacacu

SEQ ID NO: 2034098 - RNA, 23 nt, Human herpesvirus 5
gaacagugccgccuucgaaacgg

SEQ ID NO: 2034099 - RNA, 13 nt, Human herpesvirus 5
gaacauguccugg

SEQ ID NO: 2034100 - RNA, 15 nt, Human herpesvirus 5
gaaccgccgucgccg

SEQ ID NO: 2034101 - RNA, 21 nt, Human herpesvirus 5
gaaccgcucauauagaccaaa

SEQ ID NO: 2034102 - RNA, 20 nt, Human herpesvirus 5
gacggagccguuaccgccuc

SEQ ID NO: 2034103 - RNA, 12 nt, Human herpesvirus 5
gacggaggagac

SEQ ID NO: 2034104 - RNA, 13 nt, Human herpesvirus 5
gacucgaaggcgc

SEQ ID NO: 2034105 - RNA, 14 nt, Human herpesvirus 5
gacucgcggaugac

SEQ ID NO: 2034106 - RNA, 18 nt, Human herpesvirus 5
gacgcucggccuugcgcu

SEQ ID NO: 2034107 - RNA, 20 nt, Human herpesvirus 5
gacucuaacacccaggccgc

SEQ ID NO: 2034108 - RNA, 16 nt, Human herpesvirus 5
gacugcagcccaccgc

SEQ ID NO: 2034109 - RNA, 18 nt, Human herpesvirus 5
gacugcagcccaccgccc

SEQ ID NO: 2034110 - RNA, 18 nt, Human herpesvirus 5
gacgcgccccccaccuac

SEQ ID NO: 2034111 - RNA, 17 nt, Human herpesvirus 5
gacgcggaacgugacgg

SEQ ID NO: 2034112 - RNA, 13 nt, Human herpesvirus 5
gacaaccgcaucc

SEQ ID NO: 2034113 - RNA, 19 nt, Human herpesvirus 5
gacaacggccgccgcagcc

SEQ ID NO: 2034114 - RNA, 23 nt, Human herpesvirus 5
gacaccguaucagcuaccgccgc

SEQ ID NO: 2034115 - RNA, 22 nt, Human herpesvirus 5
gacaccgucgccgugcccgaag

SEQ ID NO: 2034116 - RNA, 15 nt, Human herpesvirus 5
gaaucaccgucggcg

SEQ ID NO: 2034117 - RNA, 22 nt, Human herpesvirus 5
gaagucuucaucaucgucgucg

SEQ ID NO: 2034118 - RNA, 15 nt, Human herpesvirus 5
gacagagaccgccgc

SEQ ID NO: 2034119 - RNA, 16 nt, Human herpesvirus 5
gacagagaccgccgcc

SEQ ID NO: 2034120 - RNA, 17 nt, Human herpesvirus 5
gacagagaccgccgccg

SEQ ID NO: 2034121 - RNA, 15 nt, Human herpesvirus 5
gacacggcgagaccg

SEQ ID NO: 2034122 - RNA, 19 nt, Human herpesvirus 5
gacacuaggcguccgcgcc

SEQ ID NO: 2034123 - RNA, 19 nt, Human herpesvirus 5
gacacggugcugcugcgcg

SEQ ID NO: 2034124 - RNA, 17 nt, Human herpesvirus 5
gacgccugggcgcgacg

SEQ ID NO: 2034125 - RNA, 14 nt, Human herpesvirus 5
gacagacgaugaac

SEQ ID NO: 2034126 - RNA, 13 nt, Human herpesvirus 5
gacagaugcggcg

SEQ ID NO: 2034127 - RNA, 13 nt, Human herpesvirus 5
cggccgccggcgg

SEQ ID NO: 2034128 - RNA, 13 nt, Human herpesvirus 5
cggccgaccccgc

SEQ ID NO: 2034129 - RNA, 16 nt, Human herpesvirus 5
cggccgacggcagcgu

SEQ ID NO: 2034130 - RNA, 16 nt, Human herpesvirus 5
cggccgagucuccgcg

SEQ ID NO: 2034131 - RNA, 22 nt, Human herpesvirus 5
cggccgucacgacgcuccgucg

SEQ ID NO: 2034132 - RNA, 18 nt, Human herpesvirus 5
cggccguuaucaaggcca

SEQ ID NO: 2034133 - RNA, 22 nt, Human herpesvirus 5
cggccgucgcaagggcugcucg

SEQ ID NO: 2034134 - RNA, 13 nt, Human herpesvirus 5
cggccgugcagca

SEQ ID NO: 2034135 - RNA, 18 nt, Human herpesvirus 5
cggcgacagacggcgucg

SEQ ID NO: 2034136 - RNA, 22 nt, Human herpesvirus 5
cggcgagcgaagguagaggagu

SEQ ID NO: 2034137 - RNA, 15 nt, Human herpesvirus 5
cggcgauaaccgccg

SEQ ID NO: 2034138 - RNA, 17 nt, Human herpesvirus 5
cggcgauggucauguuc

SEQ ID NO: 2034139 - RNA, 21 nt, Human herpesvirus 5
cggcgcaacuucugucucggc

SEQ ID NO: 2034140 - RNA, 19 nt, Human herpesvirus 5
cggcaugccguuggcggcg

SEQ ID NO: 2034141 - RNA, 19 nt, Human herpesvirus 5
cggcagucuuuuccgugac

SEQ ID NO: 2034142 - RNA, 15 nt, Human herpesvirus 5
cggcauagugccagc

SEQ ID NO: 2034143 - RNA, 13 nt, Human herpesvirus 5
cggcauccucggg

SEQ ID NO: 2034144 - RNA, 22 nt, Human herpesvirus 5
cggcauccucgggcuuuccggc

SEQ ID NO: 2034145 - RNA, 12 nt, Human herpesvirus 5
cggcgccguccg

SEQ ID NO: 2034146 - RNA, 16 nt, Human herpesvirus 5
cggcgccugcugcucg

SEQ ID NO: 2034147 - RNA, 20 nt, Human herpesvirus 5
cggcggcuguucgacagcgg

SEQ ID NO: 2034148 - RNA, 20 nt, Human herpesvirus 5
cggcgucuuccuccucgucg

SEQ ID NO: 2034149 - RNA, 20 nt, Human herpesvirus 5
cggcgugaaugggcacgccg

SEQ ID NO: 2034150 - RNA, 21 nt, Human herpesvirus 5
cggcgguggagggcgcgcggc

SEQ ID NO: 2034151 - RNA, 15 nt, Human herpesvirus 5
cggcguguuggacgc

SEQ ID NO: 2034152 - RNA, 15 nt, Human herpesvirus 5
cggcugcuguugcac

SEQ ID NO: 2034153 - RNA, 15 nt, Human herpesvirus 5
cgggaaaccacgccg

SEQ ID NO: 2034154 - RNA, 16 nt, Human herpesvirus 5
cgggaaaccacgccgg

SEQ ID NO: 2034155 - RNA, 17 nt, Human herpesvirus 5
cggcguucgcgugcacg

SEQ ID NO: 2034156 - RNA, 15 nt, Human herpesvirus 5
cggcucaccacgcag

SEQ ID NO: 2034157 - RNA, 18 nt, Human herpesvirus 5
guuucuggggugggcgcg

SEQ ID NO: 2034158 - RNA, 21 nt, Human herpesvirus 5
guuuccagagaacgcagcgca

SEQ ID NO: 2034159 - RNA, 20 nt, Human herpesvirus 5
guuucggaguaccgaguaga

SEQ ID NO: 2034160 - RNA, 15 nt, Human herpesvirus 5
guuucucgcuuacgu

SEQ ID NO: 2034161 - RNA, 15 nt, Human herpesvirus 5
guugugggugcggac

SEQ ID NO: 2034162 - RNA, 20 nt, Human herpesvirus 5
guugaagacaccuggaaaga

SEQ ID NO: 2034163 - RNA, 18 nt, Human herpesvirus 5
guucgcccugucugcagc

SEQ ID NO: 2034164 - RNA, 14 nt, Human herpesvirus 5
guucgccgucgccg

SEQ ID NO: 2034165 - RNA, 17 nt, Human herpesvirus 5
guucccggucgucgugu

SEQ ID NO: 2034166 - RNA, 18 nt, Human herpesvirus 5
guuccgcguuuggucgcc

SEQ ID NO: 2034167 - RNA, 15 nt, Human herpesvirus 5
guucugcacggcguc

SEQ ID NO: 2034168 - RNA, 18 nt, Human herpesvirus 5
guucuccugccgagacga

SEQ ID NO: 2034169 - RNA, 19 nt, Human herpesvirus 5
guugcagcaacgcgugcuc

SEQ ID NO: 2034170 - RNA, 13 nt, Human herpesvirus 5
uaacgccacggug

SEQ ID NO: 2034171 - RNA, 20 nt, Human herpesvirus 5
uaacuagccuucccgugaga

SEQ ID NO: 2034172 - RNA, 15 nt, Human herpesvirus 5
uaaccuacguccgug

SEQ ID NO: 2034173 - RNA, 11 nt, Human herpesvirus 5
uaaccgcaaag

SEQ ID NO: 2034174 - RNA, 18 nt, Human herpesvirus 5
uaaccacguugcgucgug

SEQ ID NO: 2034175 - RNA, 17 nt, Human herpesvirus 5
guuugcggcgcagacgu

SEQ ID NO: 2034176 - RNA, 11 nt, Human herpesvirus 5
guuugcgucuc

SEQ ID NO: 2034177 - RNA, 12 nt, Human herpesvirus 5
guucugggcgcg

SEQ ID NO: 2034178 - RNA, 15 nt, Human herpesvirus 5
uaaaacaccgacgcu

SEQ ID NO: 2034179 - RNA, 20 nt, Human herpesvirus 5
uacaccaguucguagaucac

SEQ ID NO: 2034180 - RNA, 21 nt, Human herpesvirus 5
uacaucacugacaagucguuu

SEQ ID NO: 2034181 - RNA, 15 nt, Human herpesvirus 5
uacagcccggcggug

SEQ ID NO: 2034182 - RNA, 19 nt, Human herpesvirus 5
uacacccugucaccgaaag

SEQ ID NO: 2034183 - RNA, 23 nt, Human herpesvirus 5
uacaaggagcgacguaccagcug

SEQ ID NO: 2034184 - RNA, 21 nt, Human herpesvirus 5
uaauaagccggcagcugcuuu

SEQ ID NO: 2034185 - RNA, 14 nt, Human herpesvirus 5
uaugggcggugguc

SEQ ID NO: 2034186 - RNA, 14 nt, Human herpesvirus 5
uaugggggaacgcc

SEQ ID NO: 2034187 - RNA, 13 nt, Human herpesvirus 5
uauguggcugcgc

SEQ ID NO: 2034188 - RNA, 22 nt, Human herpesvirus 5
ucaacacggcauucucuacgaa

SEQ ID NO: 2034189 - RNA, 17 nt, Human herpesvirus 5
ucaacacggucauguuu

SEQ ID NO: 2034190 - RNA, 20 nt, Human herpesvirus 5
ucaaccacgaguaacaccgu

SEQ ID NO: 2034191 - RNA, 17 nt, Human herpesvirus 5
uauugguucugggcgcg

SEQ ID NO: 2034192 - RNA, 19 nt, Human herpesvirus 5
ucacacaggccagcugcca

SEQ ID NO: 2034193 - RNA, 23 nt, Human herpesvirus 5
ucaaucagacuuucgacgugcgc

SEQ ID NO: 2034194 - RNA, 14 nt, Human herpesvirus 5
ucaccaccacggua

SEQ ID NO: 2034195 - RNA, 20 nt, Human herpesvirus 5
ucaccagaaugcuaguuugu

SEQ ID NO: 2034196 - RNA, 20 nt, Human herpesvirus 5
ucaccgaguccaucauguuc

SEQ ID NO: 2034197 - RNA, 18 nt, Human herpesvirus 5
ucaccuagacgcaaacgc

SEQ ID NO: 2034198 - RNA, 21 nt, Human herpesvirus 5
ucacgaaaggcaccggcagcc

SEQ ID NO: 2034199 - RNA, 18 nt, Human herpesvirus 5
ugcccauuccgcaacguc

SEQ ID NO: 2034200 - RNA, 16 nt, Human herpesvirus 5
ugagcuguuucgacgu

SEQ ID NO: 2034201 - RNA, 17 nt, Human herpesvirus 5
ugcgugcuguacgucac

SEQ ID NO: 2034202 - RNA, 11 nt, Human herpesvirus 5
ugccgccgcca

SEQ ID NO: 2034203 - RNA, 15 nt, Human herpesvirus 5
ugccggagcuacgcg

SEQ ID NO: 2034204 - RNA, 19 nt, Human herpesvirus 5
uggacgccugggcgcgacg

SEQ ID NO: 2034205 - RNA, 16 nt, Human herpesvirus 5
uggaccagacggcguc

SEQ ID NO: 2034206 - RNA, 17 nt, Human herpesvirus 5
uggaaacuacgugcaac

SEQ ID NO: 2034207 - RNA, 24 nt, Human herpesvirus 5
uggaaauucaauaaaaaccaccgu

SEQ ID NO: 2034208 - RNA, 16 nt, Human herpesvirus 5
uggaacgagcgccguc

SEQ ID NO: 2034209 - RNA, 14 nt, Human herpesvirus 5
uggaacgcgugcgc

SEQ ID NO: 2034210 - RNA, 21 nt, Human herpesvirus 5
uggaagcgaauaagcgcgacc

SEQ ID NO: 2034211 - RNA, 23 nt, Human herpesvirus 5
ugcugcaaggccucuaucugcgc

SEQ ID NO: 2034212 - RNA, 15 nt, Human herpesvirus 5
ugcucgcgcacguag

SEQ ID NO: 2034213 - RNA, 13 nt, Human herpesvirus 5
ugacacggcgguu

SEQ ID NO: 2034214 - RNA, 14 nt, Human herpesvirus 5
ugacagacgauaug

SEQ ID NO: 2034215 - RNA, 22 nt, Human herpesvirus 5
ucagcggcguguacagcuaccu

SEQ ID NO: 2034216 - RNA, 20 nt, Human herpesvirus 5
ucacgggaaggcuaguuaga

SEQ ID NO: 2034217 - RNA, 18 nt, Human herpesvirus 5
ucacgggacccgccgccg

SEQ ID NO: 2034218 - RNA, 13 nt, Human herpesvirus 5
ucagccgccgccu

SEQ ID NO: 2034219 - RNA, 13 nt, Human herpesvirus 5
ucagcgaggccga

SEQ ID NO: 2034220 - RNA, 18 nt, Human herpesvirus 5
ucacgccuugcgcggccg

SEQ ID NO: 2034221 - RNA, 21 nt, Human herpesvirus 5
ucagaaagcaccagaacccgu

SEQ ID NO: 2034222 - RNA, 22 nt, Human herpesvirus 5
ucagaaagcaccagaacccguc

SEQ ID NO: 2034223 - RNA, 19 nt, Human herpesvirus 5
ugagacagccacaucaaca

SEQ ID NO: 2034224 - RNA, 21 nt, Human herpesvirus 5
ugacggauaaacacgacaucc

SEQ ID NO: 2034225 - RNA, 20 nt, Human herpesvirus 5
ugacggcgcucuuucagcgu

SEQ ID NO: 2034226 - RNA, 15 nt, Human herpesvirus 5
ugacguggugcgcug

SEQ ID NO: 2034227 - RNA, 23 nt, Human herpesvirus 5
ugacuacgaugaagacgcgacuc

SEQ ID NO: 2034228 - RNA, 14 nt, Human herpesvirus 5
gugcgcguccacag

SEQ ID NO: 2034229 - RNA, 13 nt, Human herpesvirus 5
gugcgcgccgccg

SEQ ID NO: 2034230 - RNA, 17 nt, Human herpesvirus 5
gugcgcccaucugcggc

SEQ ID NO: 2034231 - RNA, 22 nt, Human herpesvirus 5
gugcgcgaccgcaaccgcgagc

SEQ ID NO: 2034232 - RNA, 13 nt, Human herpesvirus 5
gugccucccgcgc

SEQ ID NO: 2034233 - RNA, 13 nt, Human herpesvirus 5
gugcgacgccaug

SEQ ID NO: 2034234 - RNA, 14 nt, Human herpesvirus 5
gugcgcacgccgcg

SEQ ID NO: 2034235 - RNA, 18 nt, Human herpesvirus 5
gcggccgugguggccgug

SEQ ID NO: 2034236 - RNA, 19 nt, Human herpesvirus 5
gcgcuuucccaccgcgacc

SEQ ID NO: 2034237 - RNA, 16 nt, Human herpesvirus 5
gcgcuucugcagcucc

SEQ ID NO: 2034238 - RNA, 14 nt, Human herpesvirus 5
gcgcuugcggcaca

SEQ ID NO: 2034239 - RNA, 21 nt, Human herpesvirus 5
gcggaccgaucaccagaaggc

SEQ ID NO: 2034240 - RNA, 22 nt, Human herpesvirus 5
gcggacgccgucgguaccgucu

SEQ ID NO: 2034241 - RNA, 15 nt, Human herpesvirus 5
gcggacgccugcgac

SEQ ID NO: 2034242 - RNA, 20 nt, Human herpesvirus 5
gcgucgucaaggacggcgug

SEQ ID NO: 2034243 - RNA, 22 nt, Human herpesvirus 5
gcgugcaccugcugccgccacu

SEQ ID NO: 2034244 - RNA, 12 nt, Human herpesvirus 5
gcucuacgcgug

SEQ ID NO: 2034245 - RNA, 16 nt, Human herpesvirus 5
gcucucgcagcccgag

SEQ ID NO: 2034246 - RNA, 18 nt, Human herpesvirus 5
gcucucggaucugcggcu

SEQ ID NO: 2034247 - RNA, 15 nt, Human herpesvirus 5
gcucuuggcgccgcg

SEQ ID NO: 2034248 - RNA, 19 nt, Human herpesvirus 5
gcucggcggccacggcguc

SEQ ID NO: 2034249 - RNA, 21 nt, Human herpesvirus 5
gcucgggaacagacccgauac

SEQ ID NO: 2034250 - RNA, 16 nt, Human herpesvirus 5
gcggcgugcgcacgcc

SEQ ID NO: 2034251 - RNA, 23 nt, Human herpesvirus 5
gcggcuguauuauuagacgccgg

SEQ ID NO: 2034252 - RNA, 15 nt, Human herpesvirus 5
gcggcugcgcgcucg

SEQ ID NO: 2034253 - RNA, 14 nt, Human herpesvirus 5
gcguccgacgccgg

SEQ ID NO: 2034254 - RNA, 17 nt, Human herpesvirus 5
gcguccgacgccggguu

SEQ ID NO: 2034255 - RNA, 22 nt, Human herpesvirus 5
gcgucgccaguaccgacgacga

SEQ ID NO: 2034256 - RNA, 17 nt, Human herpesvirus 5
gcgucgcccucgacggc

SEQ ID NO: 2034257 - RNA, 22 nt, Human herpesvirus 5
gcgucgcccucgacggcgguac

SEQ ID NO: 2034258 - RNA, 19 nt, Human herpesvirus 5
gcgucgccugcgacggcgg

SEQ ID NO: 2034259 - RNA, 17 nt, Human herpesvirus 5
gcgucgaccccaaccuu

SEQ ID NO: 2034260 - RNA, 13 nt, Human herpesvirus 5
gcggcggcacucg

SEQ ID NO: 2034261 - RNA, 12 nt, Human herpesvirus 5
gcggcgguggag

SEQ ID NO: 2034262 - RNA, 15 nt, Human herpesvirus 5
gcggcgguggccguc

SEQ ID NO: 2034263 - RNA, 20 nt, Human herpesvirus 5
gcggcguaccuacggaccgc

SEQ ID NO: 2034264 - RNA, 11 nt, Human herpesvirus 5
gcggcgugcau

SEQ ID NO: 2034265 - RNA, 13 nt, Human herpesvirus 5
ggucgacugcgug

SEQ ID NO: 2034266 - RNA, 17 nt, Human herpesvirus 5
ggucguuguccuccucg

SEQ ID NO: 2034267 - RNA, 16 nt, Human herpesvirus 5
ggucucacugugacgu

SEQ ID NO: 2034268 - RNA, 17 nt, Human herpesvirus 5
ggucguagugcggcgug

SEQ ID NO: 2034269 - RNA, 21 nt, Human herpesvirus 5
ggucuucgacgucgcugccgu

SEQ ID NO: 2034270 - RNA, 14 nt, Human herpesvirus 5
ggugacauccucgc

SEQ ID NO: 2034271 - RNA, 16 nt, Human herpesvirus 5
gguuaccccucgcugg

SEQ ID NO: 2034272 - RNA, 15 nt, Human herpesvirus 5
gucacgucgggacga

SEQ ID NO: 2034273 - RNA, 18 nt, Human herpesvirus 5
gucacuaaggaccgacac

SEQ ID NO: 2034274 - RNA, 23 nt, Human herpesvirus 5
gucacuucugcugucaccaccac

SEQ ID NO: 2034275 - RNA, 15 nt, Human herpesvirus 5
gguggcgggcugcgu

SEQ ID NO: 2034276 - RNA, 18 nt, Human herpesvirus 5
ggugugcgugcuguacgu

SEQ ID NO: 2034277 - RNA, 20 nt, Human herpesvirus 5
ggugcggugaaacucuaugg

SEQ ID NO: 2034278 - RNA, 14 nt, Human herpesvirus 5
gguggcucuugcgc

SEQ ID NO: 2034279 - RNA, 19 nt, Human herpesvirus 5
gucccagcagggcgcgccg

SEQ ID NO: 2034280 - RNA, 16 nt, Human herpesvirus 5
gucccgcgcggaucgg

SEQ ID NO: 2034281 - RNA, 20 nt, Human herpesvirus 5
gucccgcgcggaucggacac

SEQ ID NO: 2034282 - RNA, 12 nt, Human herpesvirus 5
gucccgugaugg

SEQ ID NO: 2034283 - RNA, 21 nt, Human herpesvirus 5
gucccuacucaccaaagccgc

SEQ ID NO: 2034284 - RNA, 17 nt, Human herpesvirus 5
guccaaccucgccgucg

SEQ ID NO: 2034285 - RNA, 18 nt, Human herpesvirus 5
gucagcggcacgccgccg

SEQ ID NO: 2034286 - RNA, 13 nt, Human herpesvirus 5
gucagucagaagu

SEQ ID NO: 2034287 - RNA, 17 nt, Human herpesvirus 5
gucaguuuaucgagcgc

SEQ ID NO: 2034288 - RNA, 21 nt, Human herpesvirus 5
guccagauagcccggucgguc

SEQ ID NO: 2034289 - RNA, 21 nt, Human herpesvirus 5
guccagaucgucuacggcucc

SEQ ID NO: 2034290 - RNA, 19 nt, Human herpesvirus 5
gucccgaaaugauauccgu

SEQ ID NO: 2034291 - RNA, 14 nt, Human herpesvirus 5
guccgcggaaacga

SEQ ID NO: 2034292 - RNA, 12 nt, Human herpesvirus 5
guccgcggacac

SEQ ID NO: 2034293 - RNA, 21 nt, Human herpesvirus 5
guccgcggacacccgcggccg

SEQ ID NO: 2034294 - RNA, 21 nt, Human herpesvirus 5
guccgcgccugcacgccgccg

SEQ ID NO: 2034295 - RNA, 16 nt, Human herpesvirus 5
gugcccgucaucagcc

SEQ ID NO: 2034296 - RNA, 17 nt, Human herpesvirus 5
gugccgagaccgucgcc

SEQ ID NO: 2034297 - RNA, 15 nt, Human herpesvirus 5
gugccgccgcugccg

SEQ ID NO: 2034298 - RNA, 20 nt, Human herpesvirus 5
gcuguccauagugcgccaag

SEQ ID NO: 2034299 - RNA, 21 nt, Human herpesvirus 5
gcuguccauagugcgccaagc

SEQ ID NO: 2034300 - RNA, 13 nt, Human herpesvirus 5
gcuggcgggccga

SEQ ID NO: 2034301 - RNA, 21 nt, Human herpesvirus 5
gcuggcgguauggcugcgcgc

SEQ ID NO: 2034302 - RNA, 15 nt, Human herpesvirus 5
gcugugcaacgcgug

SEQ ID NO: 2034303 - RNA, 16 nt, Human herpesvirus 5
gcugggauccgccgcc

SEQ ID NO: 2034304 - RNA, 17 nt, Human herpesvirus 5
gcugggauccgccgcca

SEQ ID NO: 2034305 - RNA, 19 nt, Human herpesvirus 5
gcuuagacauuccccaccu

SEQ ID NO: 2034306 - RNA, 14 nt, Human herpesvirus 5
gcuguucacgcgga

SEQ ID NO: 2034307 - RNA, 18 nt, Human herpesvirus 5
gcuguuguugacgcugcu

SEQ ID NO: 2034308 - RNA, 18 nt, Human herpesvirus 5
gcuuaaaggcgcacuugu

SEQ ID NO: 2034309 - RNA, 14 nt, Human herpesvirus 5
gcugccaccagggc

SEQ ID NO: 2034310 - RNA, 16 nt, Human herpesvirus 5
gcugaucgccgucacu

SEQ ID NO: 2034311 - RNA, 16 nt, Human herpesvirus 5
gcugauucgcgccgug

SEQ ID NO: 2034312 - RNA, 18 nt, Human herpesvirus 5
gcugcccgucaagaccga

SEQ ID NO: 2034313 - RNA, 23 nt, Human herpesvirus 5
ggaggauccaaggccuccagcgc

SEQ ID NO: 2034314 - RNA, 20 nt, Human herpesvirus 5
ggaucauuuucuuggccgug

SEQ ID NO: 2034315 - RNA, 20 nt, Human herpesvirus 5
ggauccaaggccuccagcgc

SEQ ID NO: 2034316 - RNA, 19 nt, Human herpesvirus 5
ggauagguguggcgaaagc

SEQ ID NO: 2034317 - RNA, 16 nt, Human herpesvirus 5
ggagucuaccuccugc

SEQ ID NO: 2034318 - RNA, 19 nt, Human herpesvirus 5
ggaggugaccuggcugcuu

SEQ ID NO: 2034319 - RNA, 15 nt, Human herpesvirus 5
ggauugggcggacgu

SEQ ID NO: 2034320 - RNA, 19 nt, Human herpesvirus 5
ggauugggcggacgugcgu

SEQ ID NO: 2034321 - RNA, 13 nt, Human herpesvirus 5
ggaugacgagcgu

SEQ ID NO: 2034322 - RNA, 20 nt, Human herpesvirus 5
aaccucuaccucguccgccu

SEQ ID NO: 2034323 - RNA, 21 nt, Human herpesvirus 5
aaccaagucuugccgugacgu

SEQ ID NO: 2034324 - RNA, 14 nt, Human herpesvirus 5
aaccgugguccgcu

SEQ ID NO: 2034325 - RNA, 21 nt, Human herpesvirus 5
aacccaaguagcggcgcgccc

SEQ ID NO: 2034326 - RNA, 16 nt, Human herpesvirus 5
aaccccguguccgccc

SEQ ID NO: 2034327 - RNA, 19 nt, Human herpesvirus 5
aacccguaucugagcggcg

SEQ ID NO: 2034328 - RNA, 23 nt, Human herpesvirus 5
aacccugggcuauaugcaucgga

SEQ ID NO: 2034329 - RNA, 18 nt, Human herpesvirus 5
aacagccuucccuuguaa

SEQ ID NO: 2034330 - RNA, 22 nt, Human herpesvirus 5
aacagcggguguccucggugcc

SEQ ID NO: 2034331 - RNA, 14 nt, Human herpesvirus 5
accccgcgcgacgu

SEQ ID NO: 2034332 - RNA, 16 nt, Human herpesvirus 5
acccucgcgcggaguc

SEQ ID NO: 2034333 - RNA, 17 nt, Human herpesvirus 5
accgacaaggcgcggcg

SEQ ID NO: 2034334 - RNA, 18 nt, Human herpesvirus 5
accgacaaggcgcggcga

SEQ ID NO: 2034335 - RNA, 17 nt, Human herpesvirus 5
accgacauggagcccac

SEQ ID NO: 2034336 - RNA, 22 nt, Human herpesvirus 5
accucuuuccauucuuccgugu

SEQ ID NO: 2034337 - RNA, 15 nt, Human herpesvirus 5
accugagacuggucu

SEQ ID NO: 2034338 - RNA, 17 nt, Human herpesvirus 5
acccuguuccccgugac

SEQ ID NO: 2034339 - RNA, 13 nt, Human herpesvirus 5
accccaagccaaa

SEQ ID NO: 2034340 - RNA, 13 nt, Human herpesvirus 5
acccccacccgug

SEQ ID NO: 2034341 - RNA, 17 nt, Human herpesvirus 5
acccgacugcagcccac

SEQ ID NO: 2034342 - RNA, 18 nt, Human herpesvirus 5
acaaaaaaaaggaggaca

SEQ ID NO: 2034343 - RNA, 19 nt, Human herpesvirus 5
aauugcaacuuaacgcgca

SEQ ID NO: 2034344 - RNA, 20 nt, Human herpesvirus 5
aauugcucuacugcaacugc

SEQ ID NO: 2034345 - RNA, 11 nt, Human herpesvirus 5
acacccugcgg

SEQ ID NO: 2034346 - RNA, 20 nt, Human herpesvirus 5
accauccucaccccgcgcga

SEQ ID NO: 2034347 - RNA, 15 nt, Human herpesvirus 5
accaucuggcgcaga

SEQ ID NO: 2034348 - RNA, 23 nt, Human herpesvirus 5
acaccugccucgacaucucgccg

SEQ ID NO: 2034349 - RNA, 18 nt, Human herpesvirus 5
acaaccacggcgaaccgc

SEQ ID NO: 2034350 - RNA, 19 nt, Human herpesvirus 5
acaagcuguggcugcacac

SEQ ID NO: 2034351 - RNA, 13 nt, Human herpesvirus 5
agugucgauacuu

SEQ ID NO: 2034352 - RNA, 13 nt, Human herpesvirus 5
agugcgcgcggcg

SEQ ID NO: 2034353 - RNA, 14 nt, Human herpesvirus 5
agugcgcgcggcgc

SEQ ID NO: 2034354 - RNA, 17 nt, Human herpesvirus 5
agugacgcuaggcggcg

SEQ ID NO: 2034355 - RNA, 18 nt, Human herpesvirus 5
agugacgcuaggcggcgc

SEQ ID NO: 2034356 - RNA, 14 nt, Human herpesvirus 5
agugauacguuguu

SEQ ID NO: 2034357 - RNA, 20 nt, Human herpesvirus 5
agugccgcgccgccuggagu

SEQ ID NO: 2034358 - RNA, 18 nt, Human herpesvirus 5
aggacagcaaggccgccg

SEQ ID NO: 2034359 - RNA, 11 nt, Human herpesvirus 5
aggcacacggu

SEQ ID NO: 2034360 - RNA, 16 nt, Human herpesvirus 5
auaacaacacaucaac

SEQ ID NO: 2034361 - RNA, 23 nt, Human herpesvirus 5
aguugggucccagcgagcugcgc

SEQ ID NO: 2034362 - RNA, 15 nt, Human herpesvirus 5
aguuggugcagcugc

SEQ ID NO: 2034363 - RNA, 17 nt, Human herpesvirus 5
aguuggugcagcugcgc

SEQ ID NO: 2034364 - RNA, 22 nt, Human herpesvirus 5
aguuguagucgcgguggcggcc

SEQ ID NO: 2034365 - RNA, 14 nt, Human herpesvirus 5
aguucgccgucgcc

SEQ ID NO: 2034366 - RNA, 20 nt, Human herpesvirus 5
aguucaccguauggcugcgc

SEQ ID NO: 2034367 - RNA, 20 nt, Human herpesvirus 5
aguuaucagcaauaaaagca

SEQ ID NO: 2034368 - RNA, 21 nt, Human herpesvirus 5
aggacgggaugcacagcgucu

SEQ ID NO: 2034369 - RNA, 18 nt, Human herpesvirus 5
aggacucgcucacgucgu

SEQ ID NO: 2034370 - RNA, 21 nt, Human herpesvirus 5
agcgccgugcucagcggcgug

SEQ ID NO: 2034371 - RNA, 17 nt, Human herpesvirus 5
agcguagucuggcagcg

SEQ ID NO: 2034372 - RNA, 14 nt, Human herpesvirus 5
aggaagcggcggua

SEQ ID NO: 2034373 - RNA, 15 nt, Human herpesvirus 5
aggaauucaucuauc

SEQ ID NO: 2034374 - RNA, 15 nt, Human herpesvirus 5
aggagacaccgucgc

SEQ ID NO: 2034375 - RNA, 16 nt, Human herpesvirus 5
aggauguucugcacgg

SEQ ID NO: 2034376 - RNA, 16 nt, Human herpesvirus 5
agcgccguccugcaga

SEQ ID NO: 2034377 - RNA, 18 nt, Human herpesvirus 5
agcggcgcgccccggcgu

SEQ ID NO: 2034378 - RNA, 20 nt, Human herpesvirus 5
agcgcguuuguugcgcggcg

SEQ ID NO: 2034379 - RNA, 21 nt, Human herpesvirus 5
agcgcguuuguugcgcggcga

SEQ ID NO: 2034380 - RNA, 13 nt, Human herpesvirus 5
agcgcuacgugcg

SEQ ID NO: 2034381 - RNA, 18 nt, Human herpesvirus 5
agcuucugguaggaggcg

SEQ ID NO: 2034382 - RNA, 15 nt, Human herpesvirus 5
agcgguaccagacgc

SEQ ID NO: 2034383 - RNA, 18 nt, Human herpesvirus 5
agcggcucgccgcagacc

SEQ ID NO: 2034384 - RNA, 17 nt, Human herpesvirus 5
agcggcucgggcuggcg

SEQ ID NO: 2034385 - RNA, 18 nt, Human herpesvirus 5
agcaagaguugcaacgcg

SEQ ID NO: 2034386 - RNA, 21 nt, Human herpesvirus 5
agcaucaguuucugcggcgua

SEQ ID NO: 2034387 - RNA, 21 nt, Human herpesvirus 5
agcagaaggaauaauccgugc

SEQ ID NO: 2034388 - RNA, 13 nt, Human herpesvirus 5
agcagcucgcgcu

SEQ ID NO: 2034389 - RNA, 17 nt, Human herpesvirus 5
agcgcccgaagccgcgc

SEQ ID NO: 2034390 - RNA, 19 nt, Human herpesvirus 5
agcgcccgaagccgcgcga

SEQ ID NO: 2034391 - RNA, 14 nt, Human herpesvirus 5
agccacgcggcgua

SEQ ID NO: 2034392 - RNA, 17 nt, Human herpesvirus 5
agccacggaggagacga

SEQ ID NO: 2034393 - RNA, 14 nt, Human herpesvirus 5
agcgcggcggcagc

SEQ ID NO: 2034394 - RNA, 20 nt, Human herpesvirus 5
agaugcggggucgacugcgu

SEQ ID NO: 2034395 - RNA, 13 nt, Human herpesvirus 5
agaugcuauccgc

SEQ ID NO: 2034396 - RNA, 18 nt, Human herpesvirus 5
agagggcgcgcgucugga

SEQ ID NO: 2034397 - RNA, 22 nt, Human herpesvirus 5
accuugagcgacagcagcauca

SEQ ID NO: 2034398 - RNA, 22 nt, Human herpesvirus 5
acgaccuccgcgucggucgccg

SEQ ID NO: 2034399 - RNA, 12 nt, Human herpesvirus 5
acgacggcgguu

SEQ ID NO: 2034400 - RNA, 12 nt, Human herpesvirus 5
acgacgcggcgu

SEQ ID NO: 2034401 - RNA, 13 nt, Human herpesvirus 5
acgacgcggcguu

SEQ ID NO: 2034402 - RNA, 17 nt, Human herpesvirus 5
agagcucggucaacgcg

SEQ ID NO: 2034403 - RNA, 18 nt, Human herpesvirus 5
accuugucuccccggugu

SEQ ID NO: 2034404 - RNA, 24 nt, Human herpesvirus 5
accugugugaucugggcagcggcu

SEQ ID NO: 2034405 - RNA, 19 nt, Human herpesvirus 5
accuguuuaccucaugcgg

SEQ ID NO: 2034406 - RNA, 15 nt, Human herpesvirus 5
accuggacgcgguga

SEQ ID NO: 2034407 - RNA, 23 nt, Human herpesvirus 5
acgaagaagaacaagacggagga

SEQ ID NO: 2034408 - RNA, 13 nt, Human herpesvirus 5
acgaagaggacac

SEQ ID NO: 2034409 - RNA, 21 nt, Human herpesvirus 5
acgaagaugccgaugugugac

SEQ ID NO: 2034410 - RNA, 16 nt, Human herpesvirus 5
acgaacgacguacguc

SEQ ID NO: 2034411 - RNA, 21 nt, Human herpesvirus 5
acgacaucuuccgcgagcacc

SEQ ID NO: 2034412 - RNA, 17 nt, Human herpesvirus 5
caucgcagccacgcgcu

SEQ ID NO: 2034413 - RNA, 20 nt, Human herpesvirus 5
ccacaacgaggaacccgcga

SEQ ID NO: 2034414 - RNA, 13 nt, Human herpesvirus 5
ccaccgacaugga

SEQ ID NO: 2034415 - RNA, 14 nt, Human herpesvirus 5
ccaccgacgcgcga

SEQ ID NO: 2034416 - RNA, 16 nt, Human herpesvirus 5
ccaccgagacgugcga

SEQ ID NO: 2034417 - RNA, 14 nt, Human herpesvirus 5
ccacaggcgccgca

SEQ ID NO: 2034418 - RNA, 19 nt, Human herpesvirus 5
ccacagcgccaggcggcug

SEQ ID NO: 2034419 - RNA, 15 nt, Human herpesvirus 5
ccacagagccgcgug

SEQ ID NO: 2034420 - RNA, 22 nt, Human herpesvirus 5
ccaccgauccgcacgaccgcga

SEQ ID NO: 2034421 - RNA, 16 nt, Human herpesvirus 5
cauccugcccaccgcc

SEQ ID NO: 2034422 - RNA, 13 nt, Human herpesvirus 5
ccaccgucgccgu

SEQ ID NO: 2034423 - RNA, 16 nt, Human herpesvirus 5
ccacgagugacgacga

SEQ ID NO: 2034424 - RNA, 13 nt, Human herpesvirus 5
ccacgacaaacac

SEQ ID NO: 2034425 - RNA, 19 nt, Human herpesvirus 5
ccacgacgcagaaagaggg

SEQ ID NO: 2034426 - RNA, 17 nt, Human herpesvirus 5
ccacgccgaugcuccgc

SEQ ID NO: 2034427 - RNA, 13 nt, Human herpesvirus 5
auaauaccacaac

SEQ ID NO: 2034428 - RNA, 11 nt, Human herpesvirus 5
auacacacgga

SEQ ID NO: 2034429 - RNA, 15 nt, Human herpesvirus 5
auguggaacagcucg

SEQ ID NO: 2034430 - RNA, 11 nt, Human herpesvirus 5
auguggucgcg

SEQ ID NO: 2034431 - RNA, 18 nt, Human herpesvirus 5
auguccgcucguguucca

SEQ ID NO: 2034432 - RNA, 14 nt, Human herpesvirus 5
auugggcggacgug

SEQ ID NO: 2034433 - RNA, 22 nt, Human herpesvirus 5
auucaucgugcaguaccucaac

SEQ ID NO: 2034434 - RNA, 20 nt, Human herpesvirus 5
auucuaaagccacgcggcgu

SEQ ID NO: 2034435 - RNA, 22 nt, Human herpesvirus 5
auucugagggccgauggcugcc

SEQ ID NO: 2034436 - RNA, 16 nt, Human herpesvirus 5
caucaucagcgccgug

SEQ ID NO: 2034437 - RNA, 15 nt, Human herpesvirus 5
caucaccgacccugc

SEQ ID NO: 2034438 - RNA, 23 nt, Human herpesvirus 5
caucacgugccacguucuugcgu

SEQ ID NO: 2034439 - RNA, 18 nt, Human herpesvirus 5
cauccagcuccguucgcg

SEQ ID NO: 2034440 - RNA, 21 nt, Human herpesvirus 5
caucgccgucgaguacgugcu

SEQ ID NO: 2034441 - RNA, 20 nt, Human herpesvirus 5
auuuuccucguaaacuuaug

SEQ ID NO: 2034442 - RNA, 17 nt, Human herpesvirus 5
caaaaaaaaaucggugg

SEQ ID NO: 2034443 - RNA, 23 nt, Human herpesvirus 5
caucaccaacguuaccuccgacu

SEQ ID NO: 2034444 - RNA, 23 nt, Human herpesvirus 5
ucggcgugaaugggcacgccgug

SEQ ID NO: 2034445 - RNA, 17 nt, Human herpesvirus 5
ucggcgguccuccagca

SEQ ID NO: 2034446 - RNA, 22 nt, Human herpesvirus 5
ucggcacgcuggcgggccgacc

SEQ ID NO: 2034447 - RNA, 13 nt, Human herpesvirus 5
ucggccgaaacau

SEQ ID NO: 2034448 - RNA, 15 nt, Human herpesvirus 5
ucggccgaccccguc

SEQ ID NO: 2034449 - RNA, 18 nt, Human herpesvirus 5
ucggccggaccgugcacg

SEQ ID NO: 2034450 - RNA, 19 nt, Human herpesvirus 5
ucggccggaccgugcacgc

SEQ ID NO: 2034451 - RNA, 16 nt, Human herpesvirus 5
ucggaaucgggcccgc

SEQ ID NO: 2034452 - RNA, 18 nt, Human herpesvirus 5
ucggauacagggugccgc

SEQ ID NO: 2034453 - RNA, 21 nt, Human herpesvirus 5
ucggauacagggugccgccac

SEQ ID NO: 2034454 - RNA, 18 nt, Human herpesvirus 5
gggugggcgcgacggcaa

SEQ ID NO: 2034455 - RNA, 22 nt, Human herpesvirus 5
gguacaugucccgcauauuuug

SEQ ID NO: 2034456 - RNA, 13 nt, Human herpesvirus 5
gguacgcugacgu

SEQ ID NO: 2034457 - RNA, 19 nt, Human herpesvirus 5
gguccguuauguccgcucg

SEQ ID NO: 2034458 - RNA, 16 nt, Human herpesvirus 5
ucgcgguggcggccgc

SEQ ID NO: 2034459 - RNA, 15 nt, Human herpesvirus 5
ggcgacaccgccucg

SEQ ID NO: 2034460 - RNA, 23 nt, Human herpesvirus 5
ggccuccgacgacgccgaggacg

SEQ ID NO: 2034461 - RNA, 21 nt, Human herpesvirus 5
ggccugcaucuuccccgcgca

SEQ ID NO: 2034462 - RNA, 16 nt, Human herpesvirus 5
ggccgucggcgucgcg

SEQ ID NO: 2034463 - RNA, 22 nt, Human herpesvirus 5
ggccgucggcgucgcgucgcag

SEQ ID NO: 2034464 - RNA, 18 nt, Human herpesvirus 5
gggaaaaacaaagaaguc

SEQ ID NO: 2034465 - RNA, 22 nt, Human herpesvirus 5
gggaaacggacacuaggcgucc

SEQ ID NO: 2034466 - RNA, 15 nt, Human herpesvirus 5
ggcgcagucgcgagc

SEQ ID NO: 2034467 - RNA, 14 nt, Human herpesvirus 5
gggaccgcagcgug

SEQ ID NO: 2034468 - RNA, 14 nt, Human herpesvirus 5
gggguggugcgcga

SEQ ID NO: 2034469 - RNA, 19 nt, Human herpesvirus 5
gggcacggaccgcaacgug

SEQ ID NO: 2034470 - RNA, 20 nt, Human herpesvirus 5
gcgcgccacaacgccguccg

SEQ ID NO: 2034471 - RNA, 16 nt, Human herpesvirus 5
gcgcgcaucgccgucg

SEQ ID NO: 2034472 - RNA, 20 nt, Human herpesvirus 5
gcgcagacgucggcgguccu

SEQ ID NO: 2034473 - RNA, 16 nt, Human herpesvirus 5
gcgcacggcgcggucc

SEQ ID NO: 2034474 - RNA, 12 nt, Human herpesvirus 5
gcgcacggcguc

SEQ ID NO: 2034475 - RNA, 20 nt, Human herpesvirus 5
gcgcgccuaccugacgccga

SEQ ID NO: 2034476 - RNA, 13 nt, Human herpesvirus 5
ggcacgcgcgucg

SEQ ID NO: 2034477 - RNA, 14 nt, Human herpesvirus 5
gcgcgcggcgcguu

SEQ ID NO: 2034478 - RNA, 19 nt, Human herpesvirus 5
ggccaacaaccacggcgaa

SEQ ID NO: 2034479 - RNA, 22 nt, Human herpesvirus 5
ggcagcgucucuugcggcgccg

SEQ ID NO: 2034480 - RNA, 18 nt, Human herpesvirus 5
ggcagcccauccucgugg

SEQ ID NO: 2034481 - RNA, 21 nt, Human herpesvirus 5
ggcaccuaucuccgacagcgc

SEQ ID NO: 2034482 - RNA, 14 nt, Human herpesvirus 5
ggcagaggucgccg

SEQ ID NO: 2034483 - RNA, 19 nt, Human herpesvirus 5
gagggcgcgcggcaacucg

SEQ ID NO: 2034484 - RNA, 16 nt, Human herpesvirus 5
gagcaucgcaacaaca

SEQ ID NO: 2034485 - RNA, 17 nt, Human herpesvirus 5
gaggucgacgacgccgu

SEQ ID NO: 2034486 - RNA, 19 nt, Human herpesvirus 5
gagggucuuucuacgcccu

SEQ ID NO: 2034487 - RNA, 16 nt, Human herpesvirus 5
gagguacugcagcacg

SEQ ID NO: 2034488 - RNA, 19 nt, Human herpesvirus 5
gagcagcaaaacgaccaga

SEQ ID NO: 2034489 - RNA, 16 nt, Human herpesvirus 5
gagcaggucucgcgca

SEQ ID NO: 2034490 - RNA, 20 nt, Human herpesvirus 5
gcaccgagggcagaacuggu

SEQ ID NO: 2034491 - RNA, 22 nt, Human herpesvirus 5
gcaccacgucgauucccaucuc

SEQ ID NO: 2034492 - RNA, 18 nt, Human herpesvirus 5
gagucgcggggacgcgug

SEQ ID NO: 2034493 - RNA, 16 nt, Human herpesvirus 5
gauaacuacaacagcg

SEQ ID NO: 2034494 - RNA, 16 nt, Human herpesvirus 5
gauacagggugccgcc

SEQ ID NO: 2034495 - RNA, 18 nt, Human herpesvirus 5
gauacagggugccgccac

SEQ ID NO: 2034496 - RNA, 12 nt, Human herpesvirus 5
gauaucugcggg

SEQ ID NO: 2034497 - RNA, 22 nt, Human herpesvirus 5
gauaaaauuugauuacuccgug

SEQ ID NO: 2034498 - RNA, 17 nt, Human herpesvirus 5
gaguucaaagccgcgug

SEQ ID NO: 2034499 - RNA, 16 nt, Human herpesvirus 5
gcaccggccuccgacg

SEQ ID NO: 2034500 - RNA, 20 nt, Human herpesvirus 5
gcaccggccuccgacgacgc

SEQ ID NO: 2034501 - RNA, 13 nt, Human herpesvirus 5
gcaccuaucuccg

SEQ ID NO: 2034502 - RNA, 17 nt, Human herpesvirus 5
gcaccugcugccgccac

SEQ ID NO: 2034503 - RNA, 19 nt, Human herpesvirus 5
cucgcaaagacgugccacg

SEQ ID NO: 2034504 - RNA, 17 nt, Human herpesvirus 5
cguguucucccgacguc

SEQ ID NO: 2034505 - RNA, 19 nt, Human herpesvirus 5
cguguugccgacggcggcg

SEQ ID NO: 2034506 - RNA, 17 nt, Human herpesvirus 5
cgugucgucuccacgua

SEQ ID NO: 2034507 - RNA, 15 nt, Human herpesvirus 5
cgugucugauaccgg

SEQ ID NO: 2034508 - RNA, 16 nt, Human herpesvirus 5
cgugguagcgccgcga

SEQ ID NO: 2034509 - RNA, 23 nt, Human herpesvirus 5
cgugucgcugggcuggcccucgc

SEQ ID NO: 2034510 - RNA, 18 nt, Human herpesvirus 5
cgugugguagaagagcac

SEQ ID NO: 2034511 - RNA, 23 nt, Human herpesvirus 5
cgugugguagaagagcacgcgga

SEQ ID NO: 2034512 - RNA, 21 nt, Human herpesvirus 5
cguguguuggcuacggcggac

SEQ ID NO: 2034513 - RNA, 18 nt, Human herpesvirus 5
cguggacugggacgagga

SEQ ID NO: 2034514 - RNA, 20 nt, Human herpesvirus 5
cguggacugggacgaggagg

SEQ ID NO: 2034515 - RNA, 22 nt, Human herpesvirus 5
cgugcuuuuggugcgccacgua

SEQ ID NO: 2034516 - RNA, 18 nt, Human herpesvirus 5
cguggaccucacguugaa

SEQ ID NO: 2034517 - RNA, 19 nt, Human herpesvirus 5
cguggcuuucuccgacgug

SEQ ID NO: 2034518 - RNA, 15 nt, Human herpesvirus 5
cguggcgcgggcacg

SEQ ID NO: 2034519 - RNA, 19 nt, Human herpesvirus 5
cucgcuuacgucuacagca

SEQ ID NO: 2034520 - RNA, 16 nt, Human herpesvirus 5
cucgcucgcgcccgcu

SEQ ID NO: 2034521 - RNA, 19 nt, Human herpesvirus 5
cucgcucuacgcgugcacg

SEQ ID NO: 2034522 - RNA, 13 nt, Human herpesvirus 5
cucgcucucgucg

SEQ ID NO: 2034523 - RNA, 22 nt, Human herpesvirus 5
gagauccaguuacacucgcucu

SEQ ID NO: 2034524 - RNA, 16 nt, Human herpesvirus 5
gagcacaaacugcgac

SEQ ID NO: 2034525 - RNA, 17 nt, Human herpesvirus 5
gagcacaaacugcgaca

SEQ ID NO: 2034526 - RNA, 15 nt, Human herpesvirus 5
cucgccgacguggug

SEQ ID NO: 2034527 - RNA, 20 nt, Human herpesvirus 5
cucgcgucuuagacgcgcgg

SEQ ID NO: 2034528 - RNA, 21 nt, Human herpesvirus 5
cucgcgacgagggucugcgcg

SEQ ID NO: 2034529 - RNA, 16 nt, Human herpesvirus 5
cucgcgcccgcuccuu

SEQ ID NO: 2034530 - RNA, 22 nt, Human herpesvirus 5
ccggcgcaguuugcggcgcaga

SEQ ID NO: 2034531 - RNA, 22 nt, Human herpesvirus 5
ccggccgcggugccggcggcua

SEQ ID NO: 2034532 - RNA, 15 nt, Human herpesvirus 5
ccggccuugcugugu

SEQ ID NO: 2034533 - RNA, 18 nt, Human herpesvirus 5
ccggcgccugguugcugc

SEQ ID NO: 2034534 - RNA, 22 nt, Human herpesvirus 5
cgcgcgaagguguggcggcagc

SEQ ID NO: 2034535 - RNA, 12 nt, Human herpesvirus 5
cgcgcgaccgcg

SEQ ID NO: 2034536 - RNA, 12 nt, Human herpesvirus 5
cgcgcgcccgcg

SEQ ID NO: 2034537 - RNA, 13 nt, Human herpesvirus 5
cgcgcgcccgcgc

SEQ ID NO: 2034538 - RNA, 18 nt, Human herpesvirus 5
cgcggcccccacggcggc

SEQ ID NO: 2034539 - RNA, 13 nt, Human herpesvirus 5
cgcggccgucacg

SEQ ID NO: 2034540 - RNA, 14 nt, Human herpesvirus 5
cgcggcgacgagga

SEQ ID NO: 2034541 - RNA, 15 nt, Human herpesvirus 5
cgcggcgacgggugg

SEQ ID NO: 2034542 - RNA, 17 nt, Human herpesvirus 5
cgcggcgagguggucaa

SEQ ID NO: 2034543 - RNA, 14 nt, Human herpesvirus 5
cgcggcagcggcgc

SEQ ID NO: 2034544 - RNA, 17 nt, Human herpesvirus 5
cgcgccuuccuccucug

SEQ ID NO: 2034545 - RNA, 14 nt, Human herpesvirus 5
cgcgcgagcgugcg

SEQ ID NO: 2034546 - RNA, 17 nt, Human herpesvirus 5
cgcggacgccugcgacg

SEQ ID NO: 2034547 - RNA, 15 nt, Human herpesvirus 5
cgcggaggacagcaa

SEQ ID NO: 2034548 - RNA, 23 nt, Human herpesvirus 5
cgcggagguuugucuggcggcuu

SEQ ID NO: 2034549 - RNA, 15 nt, Human herpesvirus 5
ccggaaacaccgcga

SEQ ID NO: 2034550 - RNA, 20 nt, Human herpesvirus 5
ccggacgugcuuggacuggu

SEQ ID NO: 2034551 - RNA, 14 nt, Human herpesvirus 5
ccggaccgugcacg

SEQ ID NO: 2034552 - RNA, 17 nt, Human herpesvirus 5
ccggaacgcuguuacga

SEQ ID NO: 2034553 - RNA, 13 nt, Human
aagugguauagaa

SEQ ID NO: 2034554 - RNA, 17 nt, Human
aagugguauagaaaugc

SEQ ID NO: 2034555 - RNA, 15 nt, Human
aaguuguuaauaaaa

SEQ ID NO: 2034556 - RNA, 21 nt, Human
aagaaauuuccacucaggucu

SEQ ID NO: 2034557 - RNA, 16 nt, Human
aaagggaacugaacau

SEQ ID NO: 2034558 - RNA, 21 nt, Human
aaagggaacugaacauuccag

SEQ ID NO: 2034559 - RNA, 12 nt, Human
aaagugcuggga

SEQ ID NO: 2034560 - RNA, 23 nt, Human
aaagugagacuuugaggguguau

SEQ ID NO: 2034561 - RNA, 15 nt, Human
aacugaauuuugucu

SEQ ID NO: 2034562 - RNA, 14 nt, Human
aacugaauuuuguc

SEQ ID NO: 2034563 - RNA, 20 nt, Human
aacuuuuuuuuaaguuacac

SEQ ID NO: 2034564 - RNA, 14 nt, Human
aacuuuuuuuuaag

SEQ ID NO: 2034565 - RNA, 19 nt, Human
acgugauuuugcuguagaa

SEQ ID NO: 2034566 - RNA, 15 nt, Human
acuuauuuauauaaa

SEQ ID NO: 2034567 - RNA, 20 nt, Human
agaaaagggaacugaacauu

SEQ ID NO: 2034568 - RNA, 24 nt, Human
acaacuugcacguauuuuaauagc

SEQ ID NO: 2034569 - RNA, 17 nt, Human
auaugcaguuuuccuua

SEQ ID NO: 2034570 - RNA, 23 nt, Human
aguuguuaauaaaaguacauguu

SEQ ID NO: 2034571 - RNA, 16 nt, Human
aguccacaguggaacc

SEQ ID NO: 2034572 - RNA, 15 nt, Human
aucucucuucuuuuc

SEQ ID NO: 2034573 - RNA, 11 nt, Human
agccuccugag

SEQ ID NO: 2034574 - RNA, 19 nt, Human
agccuccugaguagcugga

SEQ ID NO: 2034575 - RNA, 20 nt, Human
agcccaaagugguauagaaa

SEQ ID NO: 2034576 - RNA, 23 nt, Human
agcccaaagugguauagaaaugc

SEQ ID NO: 2034577 - RNA, 20 nt, Human
agggacucaucauuuccauu

SEQ ID NO: 2034578 - RNA, 21 nt, Human
cucgugguaggacuguagaaa

SEQ ID NO: 2034579 - RNA, 20 nt, Human
cugaguagcuggauuacagg

SEQ ID NO: 2034580 - RNA, 19 nt, Human
cugaguagcuggauuacag

SEQ ID NO: 2034581 - RNA, 18 nt, Human
cgugauuuugcuguagaa

SEQ ID NO: 2034582 - RNA, 17 nt, Human
cgacugccaucuuggac

SEQ ID NO: 2034583 - RNA, 13 nt, Human
cuacaguguacag

SEQ ID NO: 2034584 - RNA, 14 nt, Human
cuacaguguacagu

SEQ ID NO: 2034585 - RNA, 14 nt, Human
cucaaacuccugac

SEQ ID NO: 2034586 - RNA, 13 nt, Human
cucaaacuccuga

SEQ ID NO: 2034587 - RNA, 23 nt, Human
ccgcaggauuugggcucuuggaa

SEQ ID NO: 2034588 - RNA, 11 nt, Human
cccagcuguuu

SEQ ID NO: 2034589 - RNA, 15 nt, Human
auuucagauuuguga

SEQ ID NO: 2034590 - RNA, 13 nt, Human
auuguacaguuuu

SEQ ID NO: 2034591 - RNA, 20 nt, Human
auuuuuaaagaaaaguuuug

SEQ ID NO: 2034592 - RNA, 13 nt, Human
auuuuuaaagaaa

SEQ ID NO: 2034593 - RNA, 22 nt, Human
caaguaauccaccugccucggc

SEQ ID NO: 2034594 - RNA, 14 nt, Human
cacauuuuucagau

SEQ ID NO: 2034595 - RNA, 18 nt, Human
cacauuuuucagauauaa

SEQ ID NO: 2034596 - RNA, 23 nt, Human
caccuacaguguacagucuugua

SEQ ID NO: 2034597 - RNA, 21 nt, Human
cagcuguuuaugcauagauaa

SEQ ID NO: 2034598 - RNA, 16 nt, Human
cauguuggccaggcug

SEQ ID NO: 2034599 - RNA, 14 nt, Human
cugguuuuucaguu

SEQ ID NO: 2034600 - RNA, 15 nt, Human
cugguuuuucaguuu

SEQ ID NO: 2034601 - RNA, 16 nt, Human
cugguuuuucaguuuu

SEQ ID NO: 2034602 - RNA, 14 nt, Human
cuuuuuuuuaaguu

SEQ ID NO: 2034603 - RNA, 14 nt, Human
ggauuuuugucuug

SEQ ID NO: 2034604 - RNA, 16 nt, Human
ggauuuuugucuugug

SEQ ID NO: 2034605 - RNA, 15 nt, Human
aaaaucugcuaggga

SEQ ID NO: 2034606 - RNA, 13 nt, Human
gguauagaaaugc

SEQ ID NO: 2034607 - RNA, 16 nt, Human
guaaagcuagaaauga

SEQ ID NO: 2034608 - RNA, 15 nt, Human
guaaagcuagaaaug

SEQ ID NO: 2034609 - RNA, 14 nt, Human
aaagcuagaaauga

SEQ ID NO: 2034610 - RNA, 16 nt, Human
aaagugguauagaaau

SEQ ID NO: 2034611 - RNA, 17 nt, Human
aaagugguauagaaaug

SEQ ID NO: 2034612 - RNA, 20 nt, Human
aaagugguauagaaaugcug

SEQ ID NO: 2034613 - RNA, 21 nt, Human
aaaguauccugcuucugauau

SEQ ID NO: 2034614 - RNA, 23 nt, Human
aagauggcacuuauaaccaaagc

SEQ ID NO: 2034615 - RNA, 13 nt, Human
guguuucuuuagu

SEQ ID NO: 2034616 - RNA, 16 nt, Human
guguuucuuuaguuuu

SEQ ID NO: 2034617 - RNA, 12 nt, Human
guuaauaaaagu

SEQ ID NO: 2034618 - RNA, 16 nt, Human
guucuuaagacgugau

SEQ ID NO: 2034619 - RNA, 14 nt, Human
aaguuacacauuuu

SEQ ID NO: 2034620 - RNA, 21 nt, Human
aagugauucuccugccucagc

SEQ ID NO: 2034621 - RNA, 20 nt, Human
uaaaaguacauguuaaacuu

SEQ ID NO: 2034622 - RNA, 23 nt, Human
gucuaggcaggaccuguggccaa

SEQ ID NO: 2034623 - RNA, 17 nt, Human
aaauuucucuacugucu

SEQ ID NO: 2034624 - RNA, 20 nt, Human
gucuuguguuucuuuaguuu

SEQ ID NO: 2034625 - RNA, 17 nt, Human
aacguuuuuccuguucu

SEQ ID NO: 2034626 - RNA, 19 nt, Human
gugaaguuuaauugacuua

SEQ ID NO: 2034627 - RNA, 19 nt, Human
aagaaagcccuuaggaaga

SEQ ID NO: 2034628 - RNA, 13 nt, Human
uaggacuguagaa

SEQ ID NO: 2034629 - RNA, 14 nt, Human
uaggacuguagaaa

SEQ ID NO: 2034630 - RNA, 21 nt, Human
uagcuuacaagccagcuggag

SEQ ID NO: 2034631 - RNA, 21 nt, Human
uagugaaucacguaaagcuag

SEQ ID NO: 2034632 - RNA, 14 nt, Human
aauugacuuauuua

SEQ ID NO: 2034633 - RNA, 19 nt, Human
uaauagcgucauaacuaga

SEQ ID NO: 2034634 - RNA, 13 nt, Human
aaugacacagucu

SEQ ID NO: 2034635 - RNA, 13 nt, Human
aaucuuucugcag

SEQ ID NO: 2034636 - RNA, 21 nt, Human
aauccuggggaacauagaacu

SEQ ID NO: 2034637 - RNA, 14 nt, Human
aauccuggggaaca

SEQ ID NO: 2034638 - RNA, 18 nt, Human
uaacauggugugcuucuu

SEQ ID NO: 2034639 - RNA, 12 nt, Human
uaacuagaacug

SEQ ID NO: 2034640 - RNA, 14 nt, Human
uaacuagaacugaa

SEQ ID NO: 2034641 - RNA, 17 nt, Human
uaacuagaacugaauuu

SEQ ID NO: 2034642 - RNA, 20 nt, Human
uaacuagaacugaauuuugu

SEQ ID NO: 2034643 - RNA, 12 nt, Human
aauauuccagag

SEQ ID NO: 2034644 - RNA, 14 nt, Human
aauauuguacaguu

SEQ ID NO: 2034645 - RNA, 15 nt, Human
aauauuguacaguuu

SEQ ID NO: 2034646 - RNA, 17 nt, Human
aauauuguacaguuuuu

SEQ ID NO: 2034647 - RNA, 23 nt, Human
aauauuguacaguuuuuauugcu

SEQ ID NO: 2034648 - RNA, 21 nt, Human
ucaccauguuggccaggcugg

SEQ ID NO: 2034649 - RNA, 15 nt, Human
ucaccauguuggcca

SEQ ID NO: 2034650 - RNA, 19 nt, Human
ucacguaaagcuagaaaug

SEQ ID NO: 2034651 - RNA, 20 nt, Human
ucacguaaagcuagaaauga

SEQ ID NO: 2034652 - RNA, 18 nt, Human
ucacguaaagcuagaaau

SEQ ID NO: 2034653 - RNA, 11 nt, Human
acauuuuguau

SEQ ID NO: 2034654 - RNA, 15 nt, Human
acauugcaauagaaa

SEQ ID NO: 2034655 - RNA, 16 nt, Human
acauugcaauagaaau

SEQ ID NO: 2034656 - RNA, 14 nt, Human
acauugcaauagaa

SEQ ID NO: 2034657 - RNA, 12 nt, Human
acccuucuuuuc

SEQ ID NO: 2034658 - RNA, 16 nt, Human
ucaguuuucaggagug

SEQ ID NO: 2034659 - RNA, 17 nt, Human
acguaaagcuagaaaug

SEQ ID NO: 2034660 - RNA, 18 nt, Human
acguaaagcuagaaauga

SEQ ID NO: 2034661 - RNA, 16 nt, Human
acugcaacuucugccu

SEQ ID NO: 2034662 - RNA, 14 nt, Human
acugcaacuucugc

SEQ ID NO: 2034663 - RNA, 13 nt, Human
acugaacauucca

SEQ ID NO: 2034664 - RNA, 16 nt, Human
acugaacauuccagag

SEQ ID NO: 2034665 - RNA, 22 nt, Human
agaaagcccuuaggaagaauuu

SEQ ID NO: 2034666 - RNA, 20 nt, Human
agaaagcccuuaggaagaau

SEQ ID NO: 2034667 - RNA, 16 nt, Human
ucuguugcccaggcug

SEQ ID NO: 2034668 - RNA, 19 nt, Human
ugacuauuuuucagaaucu

SEQ ID NO: 2034669 - RNA, 19 nt, Human
ugaccugccaggcacacug

SEQ ID NO: 2034670 - RNA, 16 nt, Human
ugaccugccaggcaca

SEQ ID NO: 2034671 - RNA, 16 nt, Human
agaucguucucugccu

SEQ ID NO: 2034672 - RNA, 22 nt, Human
agcaccuacaguguacagucuu

SEQ ID NO: 2034673 - RNA, 14 nt, Human
agcaccuacagugu

SEQ ID NO: 2034674 - RNA, 15 nt, Human
agcaccuacagugua

SEQ ID NO: 2034675 - RNA, 19 nt, Human
agcaccuacaguguacagu

SEQ ID NO: 2034676 - RNA, 21 nt, Human
agcaccuacaguguacagucu

SEQ ID NO: 2034677 - RNA, 23 nt, Human
ucuuuuuuuuuuuuuaaagacag

SEQ ID NO: 2034678 - RNA, 17 nt, Human
aguagcuggauuacagg

SEQ ID NO: 2034679 - RNA, 21 nt, Human
uguauuaaguuguuaauaaaa

SEQ ID NO: 2034680 - RNA, 18 nt, Human
ugucuuguguuucuuuag

SEQ ID NO: 2034681 - RNA, 21 nt, Human
ugucucgugguaggacuguag

SEQ ID NO: 2034682 - RNA, 18 nt, Human
ugucucgugguaggacug

SEQ ID NO: 2034683 - RNA, 19 nt, Human
ugucucgugguaggacugu

SEQ ID NO: 2034684 - RNA, 20 nt, Human
ugucucgugguaggacugua

SEQ ID NO: 2034685 - RNA, 15 nt, Human
agucuuuuccaugaa

SEQ ID NO: 2034686 - RNA, 13 nt, Human
agucuuuuccaug

SEQ ID NO: 2034687 - RNA, 15 nt, Human
uggugaacauugcaa

SEQ ID NO: 2034688 - RNA, 20 nt, Human
uggugaacauugcaauagaa

SEQ ID NO: 2034689 - RNA, 20 nt, Human
auaaccaaagcccaaagugg

SEQ ID NO: 2034690 - RNA, 17 nt, Human
aguguacagucuuguau

SEQ ID NO: 2034691 - RNA, 16 nt, Human
uguucuuaagacguga

SEQ ID NO: 2034692 - RNA, 13 nt, Human
aguguacagucuu

SEQ ID NO: 2034693 - RNA, 15 nt, Human
aguguacagucuugu

SEQ ID NO: 2034694 - RNA, 16 nt, Human
aguguacagucuugua

SEQ ID NO: 2034695 - RNA, 21 nt, Human
ugauuucagcaccuacagugu

SEQ ID NO: 2034696 - RNA, 20 nt, Human
ugauuucagcaccuacagug

SEQ ID NO: 2034697 - RNA, 13 nt, Human
ugauucuccugcc

SEQ ID NO: 2034698 - RNA, 17 nt, Human
ugccucagccuccugag

SEQ ID NO: 2034699 - RNA, 16 nt, Human
uggccaaguucuuagu

SEQ ID NO: 2034700 - RNA, 13 nt, Human
aggccaaaaaaau

SEQ ID NO: 2034701 - RNA, 22 nt, Human
aggccaacccaaaauaagcagg

SEQ ID NO: 2034702 - RNA, 13 nt, Human
auccaauuggaua

SEQ ID NO: 2034703 - RNA, 19 nt, Human
auccugcuucugauaugca

SEQ ID NO: 2034704 - RNA, 21 nt, Human
auccugcuucugauaugcagu

SEQ ID NO: 2034705 - RNA, 13 nt, Human
auauuguacaguu

SEQ ID NO: 2034706 - RNA, 14 nt, Human
auauuguacaguuu

SEQ ID NO: 2034707 - RNA, 12 nt, Human
auauuguacagu

SEQ ID NO: 2034708 - RNA, 16 nt, Human
aucaauucauaucuau

SEQ ID NO: 2034709 - RNA, 20 nt, Human
uucauaucuauuuauuaaau

SEQ ID NO: 2034710 - RNA, 22 nt, Human
uucagauauaaaagacugacca

SEQ ID NO: 2034711 - RNA, 15 nt, Human
uuucaguuuucagga

SEQ ID NO: 2034712 - RNA, 19 nt, Human
uuuauuaaauguagaaagu

SEQ ID NO: 2034713 - RNA, 13 nt, Human
uuuaaagaaaagu

SEQ ID NO: 2034714 - RNA, 15 nt, Human
uuuaaagaaaaguuu

SEQ ID NO: 2034715 - RNA, 17 nt, Human
uuuaaagaaaaguuuug

SEQ ID NO: 2034716 - RNA, 21 nt, Human
uuuaaagaaaaguuuuguaaa

SEQ ID NO: 2034717 - RNA, 19 nt, Human
uuuccuuaaauuaucuaaa

SEQ ID NO: 2034718 - RNA, 21 nt, Human
uuucuuuaguuuuugugaagu

SEQ ID NO: 2034719 - RNA, 14 nt, Human
uuucucaaagaaau

SEQ ID NO: 2034720 - RNA, 15 nt, Human
uuucucaaagaaauu

SEQ ID NO: 2034721 - RNA, 16 nt, Human
uuucucaaagaaauuu

SEQ ID NO: 2034722 - RNA, 18 nt, Human
augagccaccgcgcccag

SEQ ID NO: 2034723 - RNA, 21 nt, Human
augagccaccgcgcccagccu

SEQ ID NO: 2034724 - RNA, 13 nt, Human
aucuuucugcaga

SEQ ID NO: 2034725 - RNA, 17 nt, Human
auuuuacuuuuuccugg

SEQ ID NO: 2034726 - RNA, 16 nt, Human
auuuuacuuuuuccug

SEQ ID NO: 2034727 - RNA, 22 nt, Human
auuuccacucaggucuguuuuc

SEQ ID NO: 2034728 - RNA, 18 nt, Human
auucuccugccucagccu

SEQ ID NO: 2034729 - RNA, 14 nt, Human
uuuucaguuuucag

SEQ ID NO: 2034730 - RNA, 12 nt, Human
uuuucaguuuuc

SEQ ID NO: 2034731 - RNA, 20 nt, Human
uuuuaggccaaaaaaaugua

SEQ ID NO: 2034732 - RNA, 21 nt, Human
auguuaaacuuacuuaguguu

SEQ ID NO: 2034733 - RNA, 14 nt, Human
auuaaguuguuaau

SEQ ID NO: 2034734 - RNA, 19 nt, Human
auuaaguuguuaauaaaag

SEQ ID NO: 2034735 - RNA, 20 nt, Human
auuaaguuguuaauaaaagu

SEQ ID NO: 2034736 - RNA, 12 nt, Human
uuuuguuucaua

SEQ ID NO: 2034737 - RNA, 19 nt, Human
uuuuguuucauauugaugu

SEQ ID NO: 2034738 - RNA, 13 nt, Human
uuuugcuguagaa

SEQ ID NO: 2034739 - RNA, 14 nt, Human
uuuugcuguagaag

SEQ ID NO: 2034740 - RNA, 14 nt, Human
caauauuguacagu

SEQ ID NO: 2034741 - RNA, 14 nt, Human
caagccagcuggag

SEQ ID NO: 2034742 - RNA, 19 nt, Human
caaagugcugggauuacag

SEQ ID NO: 2034743 - RNA, 20 nt, Human
caaagugcugggauuacagg

SEQ ID NO: 2034744 - RNA, 16 nt, Human
cacugcaacuucugcc

SEQ ID NO: 2034745 - RNA, 17 nt, Human
cacugcaacuucugccu

SEQ ID NO: 2034746 - RNA, 16 nt, Human
cacucaggucuguuuu

SEQ ID NO: 2034747 - RNA, 23 nt, Human
cagagucucgcucuguugcccag

SEQ ID NO: 2034748 - RNA, 20 nt, Human
cagccuccugaguagcugga

SEQ ID NO: 2034749 - RNA, 18 nt, Human
cagcuggagaaauauggu

SEQ ID NO: 2034750 - RNA, 17 nt, Human
caggaccuguggccaag

SEQ ID NO: 2034751 - RNA, 16 nt, Human
cagucuuggcucacug

SEQ ID NO: 2034752 - RNA, 17 nt, Human
cagucuuguauuaaguu

SEQ ID NO: 2034753 - RNA, 17 nt, Human
caggaguggguugauuu

SEQ ID NO: 2034754 - RNA, 23 nt, Human
caggcuggucucaaacuccugac

SEQ ID NO: 2034755 - RNA, 14 nt, Human
cauguguuccaagg

SEQ ID NO: 2034756 - RNA, 22 nt, Human
cauuaaaaaaaaaaaaaaaagu

SEQ ID NO: 2034757 - RNA, 22 nt, Human
cauuuacccuucuuuucugacu

SEQ ID NO: 2034758 - RNA, 17 nt, Human
cauuuuacuuuuuccug

SEQ ID NO: 2034759 - RNA, 20 nt, Human
cauuuuacuuuuuccuggcu

SEQ ID NO: 2034760 - RNA, 22 nt, Human
cauuuuacuuuuuccuggcuca

SEQ ID NO: 2034761 - RNA, 20 nt, Human
cccaaagugguauagaaaug

SEQ ID NO: 2034762 - RNA, 21 nt, Human
cccaaagugguauagaaaugc

SEQ ID NO: 2034763 - RNA, 19 nt, Human
ccagccucaucucuuuguu

SEQ ID NO: 2034764 - RNA, 14 nt, Human
ccuuagaaguggaa

SEQ ID NO: 2034765 - RNA, 17 nt, Human
cccgucgacguagaacc

SEQ ID NO: 2034766 - RNA, 16 nt, Human
cuuagaaguggaagua

SEQ ID NO: 2034767 - RNA, 18 nt, Human
cuguucuuaagacgugau

SEQ ID NO: 2034768 - RNA, 17 nt, Human
cuuuauuaaauguagaa

SEQ ID NO: 2034769 - RNA, 13 nt, Human
cuuuaguuuuugu

SEQ ID NO: 2034770 - RNA, 15 nt, Human
cuuuaguuuuuguga

SEQ ID NO: 2034771 - RNA, 23 nt, Human
cuuguuggauuuuugucuugugu

SEQ ID NO: 2034772 - RNA, 21 nt, Human
cuuguguuucuuuaguuuuug

SEQ ID NO: 2034773 - RNA, 21 nt, Human
cuuguuggauuuuugucuugu

SEQ ID NO: 2034774 - RNA, 18 nt, Human
cuuuguucuaaagaugga

SEQ ID NO: 2034775 - RNA, 18 nt, Human
gaaguuuaauugacuuau

SEQ ID NO: 2034776 - RNA, 23 nt, Human
gaaaugcugguuuuucaguuuuc

SEQ ID NO: 2034777 - RNA, 20 nt, Human
cucuguugcccaggcuggag

SEQ ID NO: 2034778 - RNA, 22 nt, Human
cucuguugcccaggcuggagug

SEQ ID NO: 2034779 - RNA, 20 nt, Human
cucuuuguucuaaagaugga

SEQ ID NO: 2034780 - RNA, 15 nt, Human
cugaacauuccagag

SEQ ID NO: 2034781 - RNA, 21 nt, Human
cuccugccucagccuccugag

SEQ ID NO: 2034782 - RNA, 13 nt, Human
cuccuuagaagug

SEQ ID NO: 2034783 - RNA, 17 nt, Human
cuccuuagaaguggaag

SEQ ID NO: 2034784 - RNA, 20 nt, Human
cuccuuagaaguggaaguag

SEQ ID NO: 2034785 - RNA, 13 nt, Human
cucauuaaaaaaa

SEQ ID NO: 2034786 - RNA, 23 nt, Human
cuccaaguccacaguggaaccag

SEQ ID NO: 2034787 - RNA, 14 nt, Human
cucaagacuuccag

SEQ ID NO: 2034788 - RNA, 16 nt, Human
cucaagacuuccagag

SEQ ID NO: 2034789 - RNA, 20 nt, Human
gaggcggccccggccggggu

SEQ ID NO: 2034790 - RNA, 18 nt, Human
gagccaccgcgcccagcc

SEQ ID NO: 2034791 - RNA, 12 nt, Human
gaguagcuggau

SEQ ID NO: 2034792 - RNA, 21 nt, Human
gauggcacuuauaaccaaagc

SEQ ID NO: 2034793 - RNA, 17 nt, Human
gccaccgcgcccagccu

SEQ ID NO: 2034794 - RNA, 12 nt, Human
gccaaguucuua

SEQ ID NO: 2034795 - RNA, 14 nt, Human
gcuuguuggauuuu

SEQ ID NO: 2034796 - RNA, 20 nt, Human
gcuggucucaaacuccugac

SEQ ID NO: 2034797 - RNA, 19 nt, Human
gcuggucucaaacuccuga

SEQ ID NO: 2034798 - RNA, 21 nt, Human
ucagggagugggcuaagcacg

SEQ ID NO: 2034799 - RNA, 20 nt, Human
ucagccuccugaguagcugg

SEQ ID NO: 2034800 - RNA, 13 nt, Human
ucagccuccugag

SEQ ID NO: 2034801 - RNA, 21 nt, Human
ucagccuccugaguagcugga

SEQ ID NO: 2034802 - RNA, 18 nt, Human
ucagauauaaaagacuga

SEQ ID NO: 2034803 - RNA, 20 nt, Human
ucagauauaaaagacugacc

SEQ ID NO: 2034804 - RNA, 14 nt, Human
ucagauauaaaaga

SEQ ID NO: 2034805 - RNA, 17 nt, Human
ucagauauaaaagacug

SEQ ID NO: 2034806 - RNA, 19 nt, Human
uauugcuuguuggauuuuu

SEQ ID NO: 2034807 - RNA, 21 nt, Human
uauugcuugcacaaaccaauu

SEQ ID NO: 2034808 - RNA, 19 nt, Human
ucaagugauucuccugccu

SEQ ID NO: 2034809 - RNA, 18 nt, Human
ucaagugauucuccugcc

SEQ ID NO: 2034810 - RNA, 13 nt, Human
uauuuauauaaau

SEQ ID NO: 2034811 - RNA, 15 nt, Human
ucaaaugagaaaaug

SEQ ID NO: 2034812 - RNA, 12 nt, Human
ucaaagaaauuu

SEQ ID NO: 2034813 - RNA, 13 nt, Human
ucaaagaaauuuc

SEQ ID NO: 2034814 - RNA, 19 nt, Human
ucaaagaaauuuccacuca

SEQ ID NO: 2034815 - RNA, 20 nt, Human
ucaaagaaauuuccacucag

SEQ ID NO: 2034816 - RNA, 19 nt, Human
ucuucuuuuugcuucaaaa

SEQ ID NO: 2034817 - RNA, 21 nt, Human
ucucgugguaggacuguagaa

SEQ ID NO: 2034818 - RNA, 19 nt, Human
ucucgugguaggacuguag

SEQ ID NO: 2034819 - RNA, 16 nt, Human
ucgagguuucucaaag

SEQ ID NO: 2034820 - RNA, 22 nt, Human
ucgagguuucucaaagaaauuu

SEQ ID NO: 2034821 - RNA, 19 nt, Human
ucucaaagaaauuuccacu

SEQ ID NO: 2034822 - RNA, 21 nt, Human
ucucaaagaaauuuccacuca

SEQ ID NO: 2034823 - RNA, 22 nt, Human
ucucaaagaaauuuccacucag

SEQ ID NO: 2034824 - RNA, 14 nt, Human
uccugccucagccu

SEQ ID NO: 2034825 - RNA, 16 nt, Human
ucccguggaacguuuu

SEQ ID NO: 2034826 - RNA, 22 nt, Human
ucccguggaacguuuuuccugu

SEQ ID NO: 2034827 - RNA, 23 nt, Human
ucccguggaacguuuuuccuguu

SEQ ID NO: 2034828 - RNA, 13 nt, Human
uccccuucacucc

SEQ ID NO: 2034829 - RNA, 16 nt, Human
ugguuuuucaguuuuc

SEQ ID NO: 2034830 - RNA, 20 nt, Human
ugguggggcugccaggggag

SEQ ID NO: 2034831 - RNA, 17 nt, Human
ugucuaggcaggaccug

SEQ ID NO: 2034832 - RNA, 19 nt, Human
ugucuaggcaggaccugug

SEQ ID NO: 2034833 - RNA, 13 nt, Human
uggccuccaaguc

SEQ ID NO: 2034834 - RNA, 23 nt, Human
uggccuccaaguccacaguggaa

SEQ ID NO: 2034835 - RNA, 19 nt, Human
ugauaugcaguuuuccuua

SEQ ID NO: 2034836 - RNA, 21 nt, Human
ugcaaugacacagucuuggcu

SEQ ID NO: 2034837 - RNA, 19 nt, Human
ugauuuuuaaagaaaaguu

SEQ ID NO: 2034838 - RNA, 17 nt, Human
ugauuuugcuguagaag

SEQ ID NO: 2034839 - RNA, 19 nt, Human
ugauuuugcuguagaagau

SEQ ID NO: 2034840 - RNA, 14 nt, Human
ugauuuugcuguag

SEQ ID NO: 2034841 - RNA, 16 nt, Human
ugauuuugcuguagaa

SEQ ID NO: 2034842 - RNA, 13 nt, Human
ugcaacuucugcc

SEQ ID NO: 2034843 - RNA, 14 nt, Human
ugcaacuucugccu

SEQ ID NO: 2034844 - RNA, 15 nt, Human
uuuucagauauaaaa

SEQ ID NO: 2034845 - RNA, 12 nt, Human
uuuuucaguuuu

SEQ ID NO: 2034846 - RNA, 15 nt, Human
uuuuucaguuuucag

SEQ ID NO: 2034847 - RNA, 18 nt, Human
uuuuuaaguuacacauuu

SEQ ID NO: 2034848 - RNA, 17 nt, Human
uuuuuaauaaagacagg

SEQ ID NO: 2034849 - RNA, 20 nt, Human
uuuuuaauaaagacaggguu

SEQ ID NO: 2034850 - RNA, 19 nt, Human
uugcacguauuuuaauagc

SEQ ID NO: 2034851 - RNA, 21 nt, Human
uuggugaacauugcaauagaa

SEQ ID NO: 2034852 - RNA, 19 nt, Human
uuguguuucuuuaguuuuu

SEQ ID NO: 2034853 - RNA, 21 nt, Human
uuguuaauaaaaguacauguu

SEQ ID NO: 2034854 - RNA, 14 nt, Human
uuguuaauaaaagu

SEQ ID NO: 2034855 - RNA, 19 nt, Human
uuguuaauaaaaguacaug

SEQ ID NO: 2034856 - RNA, 18 nt, Human
uuuaaguuacacauuuuu

SEQ ID NO: 2034857 - RNA, 22 nt, Human
uuuaauagcgucauaacuagaa

SEQ ID NO: 2034858 - RNA, 21 nt, Human
uuuaauagcgucauaacuaga

SEQ ID NO: 2034859 - RNA, 14 nt, Human
uuucagauauaaaa

SEQ ID NO: 2034860 - RNA, 16 nt, Human
uuucagauauaaaaga

SEQ ID NO: 2034861 - RNA, 18 nt, Human
uuucagauauaaaagacu

SEQ ID NO: 2034862 - RNA, 23 nt, Human
uuucagcaccuacaguguacagu

SEQ ID NO: 2034863 - RNA, 22 nt, Human
uucugauaugcaguuuuccuua

SEQ ID NO: 2034864 - RNA, 14 nt, Human
uucuuaguugcugu

SEQ ID NO: 2034865 - RNA, 15 nt, Human
uucuuaguugcugua

SEQ ID NO: 2034866 - RNA, 23 nt, Human
uucuuaguugcuguaugucucgu

SEQ ID NO: 2034867 - RNA, 19 nt, Human
uucagauauaaaagacuga

SEQ ID NO: 2034868 - RNA, 14 nt, Human
uucagauauaaaag

SEQ ID NO: 2034869 - RNA, 15 nt, Human
uucagauauaaaaga

SEQ ID NO: 2034870 - RNA, 12 nt, Human
uucagauauaaa

SEQ ID NO: 2034871 - RNA, 13 nt, Human
uuccagagccuca

SEQ ID NO: 2034872 - RNA, 16 nt, Human
uuaugauuuuuaaaga

SEQ ID NO: 2034873 - RNA, 19 nt, Human
uuaugauuuuuaaagaaaa

SEQ ID NO: 2034874 - RNA, 14 nt, Human
acuauuuuucagaa

SEQ ID NO: 2034875 - RNA, 18 nt, Human
acuauuuuucagaaucuc

SEQ ID NO: 2034876 - RNA, 14 nt, Human
acacauuuuucaga

SEQ ID NO: 2034877 - RNA, 15 nt, Human
accagcccagacccu

SEQ ID NO: 2034878 - RNA, 17 nt, Human
aaauuuuuuuuguuuca

SEQ ID NO: 2034879 - RNA, 18 nt, Human
aaauuuuuuuuguuucau

SEQ ID NO: 2034880 - RNA, 19 nt, Human
aaagcccuuaggaagaauu

SEQ ID NO: 2034881 - RNA, 14 nt, Human
aaguccacagugga

SEQ ID NO: 2034882 - RNA, 19 nt, Human
aaguccacaguggaaccag

SEQ ID NO: 2034883 - RNA, 18 nt, Human
aaguauccugcuucugau

SEQ ID NO: 2034884 - RNA, 15 nt, Human
aaguaguggagcccc

SEQ ID NO: 2034885 - RNA, 13 nt, Human
aauguuuccuuua

SEQ ID NO: 2034886 - RNA, 12 nt, Human
aauguuuccuuu

SEQ ID NO: 2034887 - RNA, 16 nt, Human
aaugauccccagcugu

SEQ ID NO: 2034888 - RNA, 22 nt, Human
aaugauccccagcuguuuaugc

SEQ ID NO: 2034889 - RNA, 19 nt, Human
aaugauccccagcuguuua

SEQ ID NO: 2034890 - RNA, 20 nt, Human
aaugauccccagcuguuuau

SEQ ID NO: 2034891 - RNA, 16 nt, Human
aaucucuccauucccg

SEQ ID NO: 2034892 - RNA, 17 nt, Human
agacgugauuuugcugu

SEQ ID NO: 2034893 - RNA, 18 nt, Human
aggaguggguugauuuca

SEQ ID NO: 2034894 - RNA, 19 nt, Human
auaaauuuuuuuuguuuca

SEQ ID NO: 2034895 - RNA, 22 nt, Human
auaaauuuuuuuuguuucauau

SEQ ID NO: 2034896 - RNA, 11 nt, Human
auaaagacagg

SEQ ID NO: 2034897 - RNA, 16 nt, Human
aguuguuaauaaaagu

SEQ ID NO: 2034898 - RNA, 15 nt, Human
cucgugguaggacug

SEQ ID NO: 2034899 - RNA, 16 nt, Human
cucgugguaggacugu

SEQ ID NO: 2034900 - RNA, 17 nt, Human
cucgugguaggacugua

SEQ ID NO: 2034901 - RNA, 14 nt, Human
cuauuuuucagaau

SEQ ID NO: 2034902 - RNA, 22 nt, Human
cucaaagaaauuuccacucagg

SEQ ID NO: 2034903 - RNA, 21 nt, Human
cgagguuucucaaagaaauuu

SEQ ID NO: 2034904 - RNA, 20 nt, Human
cccaggcuggagugcaauga

SEQ ID NO: 2034905 - RNA, 21 nt, Human
ccucgagguuucucaaagaaa

SEQ ID NO: 2034906 - RNA, 14 nt, Human
ccucaaaugagaaa

SEQ ID NO: 2034907 - RNA, 22 nt, Human
cauagcuuacaagccagcugga

SEQ ID NO: 2034908 - RNA, 20 nt, Human
cagcaccuacaguguacagu

SEQ ID NO: 2034909 - RNA, 15 nt, Human
cagcaccuacagugu

SEQ ID NO: 2034910 - RNA, 14 nt, Human
auugcuugcacaaa

SEQ ID NO: 2034911 - RNA, 16 nt, Human
auugcuuguuggauuu

SEQ ID NO: 2034912 - RNA, 22 nt, Human
caaaugagaaaaugucuuuauu

SEQ ID NO: 2034913 - RNA, 20 nt, Human
cagaaagguuuucuucuuuu

SEQ ID NO: 2034914 - RNA, 12 nt, Human
caagauuucaga

SEQ ID NO: 2034915 - RNA, 15 nt, Human
gccccugcucuggug

SEQ ID NO: 2034916 - RNA, 9 nt, Human
aaagacaga

SEQ ID NO: 2034917 - RNA, 19 nt, Human
aaagacugaccaauauugu

SEQ ID NO: 2034918 - RNA, 15 nt, Human
guaauccaccugccu

SEQ ID NO: 2034919 - RNA, 16 nt, Human
aaaguacauguuaaac

SEQ ID NO: 2034920 - RNA, 14 nt, Human
guacucauuaaaaa

SEQ ID NO: 2034921 - RNA, 12 nt, Human
guagaagauggc

SEQ ID NO: 2034922 - RNA, 17 nt, Human
gacaggguuucaccaug

SEQ ID NO: 2034923 - RNA, 18 nt, Human
gcaccuacaguguacagu

SEQ ID NO: 2034924 - RNA, 19 nt, Human
gcaccuacaguguacaguc

SEQ ID NO: 2034925 - RNA, 21 nt, Human
gcaccuacaguguacagucuu

SEQ ID NO: 2034926 - RNA, 22 nt, Human
gauggaaaaaccacccccaaau

SEQ ID NO: 2034927 - RNA, 23 nt, Human
cuuggguucaagugauucuccug

SEQ ID NO: 2034928 - RNA, 15 nt, Human
cuuaggaagaauuuu

SEQ ID NO: 2034929 - RNA, 16 nt, Human
cuuacaagccagcugg

SEQ ID NO: 2034930 - RNA, 17 nt, Human
cuuacaagccagcugga

SEQ ID NO: 2034931 - RNA, 20 nt, Human
cuuacauuuuacuuuuuccu

SEQ ID NO: 2034932 - RNA, 19 nt, Human
cuguagaaaagggaacuga

SEQ ID NO: 2034933 - RNA, 15 nt, Human
aacugaacauuccag

SEQ ID NO: 2034934 - RNA, 17 nt, Human
aacuagaacugaauuuu

SEQ ID NO: 2034935 - RNA, 16 nt, Human
gucucaaacuccugac

SEQ ID NO: 2034936 - RNA, 16 nt, Human
aaccaaauauuccaga

SEQ ID NO: 2034937 - RNA, 16 nt, Human
aagcaagauuucagau

SEQ ID NO: 2034938 - RNA, 14 nt, Human
aacuuggaaauagu

SEQ ID NO: 2034939 - RNA, 15 nt, Human
aagaaaaguuuugua

SEQ ID NO: 2034940 - RNA, 16 nt, Human
aagaaaaguuuuguaa

SEQ ID NO: 2034941 - RNA, 21 nt, Human
aagaaaaguuuuguaaauuuc

SEQ ID NO: 2034942 - RNA, 22 nt, Human
aagaaaaguuuuguaaauuucu

SEQ ID NO: 2034943 - RNA, 19 nt, Human
uaaauuuuuuuuguuucau

SEQ ID NO: 2034944 - RNA, 13 nt, Human
uaaauaacuuuuu

SEQ ID NO: 2034945 - RNA, 19 nt, Human
uaaacccaguaguggugac

SEQ ID NO: 2034946 - RNA, 10 nt, Human
uaaagacaga

SEQ ID NO: 2034947 - RNA, 9 nt, Human
uaaagacag

SEQ ID NO: 2034948 - RNA, 13 nt, Human
uaaagauggaaaa

SEQ ID NO: 2034949 - RNA, 17 nt, Human
aaguuacacauuuuuca

SEQ ID NO: 2034950 - RNA, 14 nt, Human
aaguuuaauugacu

SEQ ID NO: 2034951 - RNA, 13 nt, Human
uacagucuuguau

SEQ ID NO: 2034952 - RNA, 12 nt, Human
uacagucuugua

SEQ ID NO: 2034953 - RNA, 18 nt, Human
uacaagccagcuggagaa

SEQ ID NO: 2034954 - RNA, 22 nt, Human
uaauuuuuguguuuuuaauaaa

SEQ ID NO: 2034955 - RNA, 13 nt, Human
uaauuuuuuacua

SEQ ID NO: 2034956 - RNA, 13 nt, Human
acaagccagcugg

SEQ ID NO: 2034957 - RNA, 15 nt, Human
acaagccagcuggag

SEQ ID NO: 2034958 - RNA, 18 nt, Human
uagaagauggcacuuaua

SEQ ID NO: 2034959 - RNA, 13 nt, Human
uagaacugaauuu

SEQ ID NO: 2034960 - RNA, 17 nt, Human
uagaacugaauuuuguc

SEQ ID NO: 2034961 - RNA, 22 nt, Human
uagaacugaauuuugucuuuau

SEQ ID NO: 2034962 - RNA, 21 nt, Human
uagaaccucgagguuucucaa

SEQ ID NO: 2034963 - RNA, 16 nt, Human
aauuucucuacugucu

SEQ ID NO: 2034964 - RNA, 15 nt, Human
acagucuuguauuaa

SEQ ID NO: 2034965 - RNA, 18 nt, Human
acagucuuguauuaaguu

SEQ ID NO: 2034966 - RNA, 22 nt, Human
acagucuuguauuaaguuguua

SEQ ID NO: 2034967 - RNA, 14 nt, Human
acagucuuguauua

SEQ ID NO: 2034968 - RNA, 11 nt, Human
uauuguacagu

SEQ ID NO: 2034969 - RNA, 12 nt, Human
uauuguacaguu

SEQ ID NO: 2034970 - RNA, 13 nt, Human
uauuguacaguuu

SEQ ID NO: 2034971 - RNA, 14 nt, Human
uauuguacaguuuu

SEQ ID NO: 2034972 - RNA, 15 nt, Human
uauuguacaguuuuu

SEQ ID NO: 2034973 - RNA, 17 nt, Human
uauuguacaguuuuuau

SEQ ID NO: 2034974 - RNA, 15 nt, Human
acuccugaccucaag

SEQ ID NO: 2034975 - RNA, 17 nt, Human
acucaagacuuccagag

SEQ ID NO: 2034976 - RNA, 20 nt, Human
acucaagacuuccagagccu

SEQ ID NO: 2034977 - RNA, 23 nt, Human
acuguagaaaagggaacugaaca

SEQ ID NO: 2034978 - RNA, 19 nt, Human
uccuguucuuaagacguga

SEQ ID NO: 2034979 - RNA, 19 nt, Human
uccugaguagcuggauuac

SEQ ID NO: 2034980 - RNA, 16 nt, Human
uccacaguggaaccag

SEQ ID NO: 2034981 - RNA, 20 nt, Human
uccacaguggaaccagccca

SEQ ID NO: 2034982 - RNA, 14 nt, Human
uccacagugacucc

SEQ ID NO: 2034983 - RNA, 20 nt, Human
ugacuuauuuauauaaauuu

SEQ ID NO: 2034984 - RNA, 17 nt, Human
ugacuuauuuauauaaa

SEQ ID NO: 2034985 - RNA, 21 nt, Human
ugacuuauuuauauaaauuuu

SEQ ID NO: 2034986 - RNA, 21 nt, Human
agcaaaaccaaauauuccaga

SEQ ID NO: 2034987 - RNA, 19 nt, Human
agaccuaacgagaaauaga

SEQ ID NO: 2034988 - RNA, 19 nt, Human
agacaggguuucaccaugu

SEQ ID NO: 2034989 - RNA, 21 nt, Human
agaacucaugacggaagaguu

SEQ ID NO: 2034990 - RNA, 15 nt, Human
ucugcagaaacagaa

SEQ ID NO: 2034991 - RNA, 15 nt, Human
agaaagaagaugaau

SEQ ID NO: 2034992 - RNA, 15 nt, Human
acuuuuuuuuaaguu

SEQ ID NO: 2034993 - RNA, 19 nt, Human
acuuugaggguguauauuu

SEQ ID NO: 2034994 - RNA, 12 nt, Human
ugcaguuuuccu

SEQ ID NO: 2034995 - RNA, 17 nt, Human
ugcacguauuuuaauag

SEQ ID NO: 2034996 - RNA, 17 nt, Human
agcuggagaaauauggu

SEQ ID NO: 2034997 - RNA, 17 nt, Human
uggaaguaguggagccc

SEQ ID NO: 2034998 - RNA, 14 nt, Human
uggaaguaguggag

SEQ ID NO: 2034999 - RNA, 21 nt, Human
uggcucacugcaacuucugcc

SEQ ID NO: 2035000 - RNA, 19 nt, Human
agguuucucaaagaaauuu

SEQ ID NO: 2035001 - RNA, 16 nt, Human
agguuucucaaagaaa

SEQ ID NO: 2035002 - RNA, 12 nt, Human
uguacaguuuuu

SEQ ID NO: 2035003 - RNA, 22 nt, Human
uguagugaaucacguaaagcua

SEQ ID NO: 2035004 - RNA, 13 nt, Human
uguuaauaaaagu

SEQ ID NO: 2035005 - RNA, 18 nt, Human
uguuaauaaaaguacaug

SEQ ID NO: 2035006 - RNA, 19 nt, Human
uguuaauaaaaguacaugu

SEQ ID NO: 2035007 - RNA, 14 nt, Human
agugguauagaaau

SEQ ID NO: 2035008 - RNA, 15 nt, Human
agugguauagaaaug

SEQ ID NO: 2035009 - RNA, 16 nt, Human
agugguauagaaaugc

SEQ ID NO: 2035010 - RNA, 18 nt, Human
agugguauagaaaugcug

SEQ ID NO: 2035011 - RNA, 19 nt, Human
agucucgcucuguugccca

SEQ ID NO: 2035012 - RNA, 13 nt, Human
auagaaaugcugg

SEQ ID NO: 2035013 - RNA, 19 nt, Human
auagaaaugcugguuuuuc

SEQ ID NO: 2035014 - RNA, 22 nt, Human
auagaaaugcugguuuuucagu

SEQ ID NO: 2035015 - RNA, 13 nt, Human
auacgauaaauaa

SEQ ID NO: 2035016 - RNA, 20 nt, Human
aguuuuuauugcuuguugga

SEQ ID NO: 2035017 - RNA, 16 nt, Human
uuaauaaaaguacaug

SEQ ID NO: 2035018 - RNA, 20 nt, Human
uuacagggaugagccaccgc

SEQ ID NO: 2035019 - RNA, 18 nt, Human
auaacuuuuuuuuaaguu

SEQ ID NO: 2035020 - RNA, 18 nt, Human
uuaguuuuugugaaguuu

SEQ ID NO: 2035021 - RNA, 21 nt, Human
uuaguuuuugugaaguuuaau

SEQ ID NO: 2035022 - RNA, 20 nt, Human
aucugcuagggaauaucaau

SEQ ID NO: 2035023 - RNA, 14 nt, Human
aucguucucugccu

SEQ ID NO: 2035024 - RNA, 23 nt, Human
uucccguggaacguuuuuccugu

SEQ ID NO: 2035025 - RNA, 21 nt, Human
uucuuaagacgugauuuugcu

SEQ ID NO: 2035026 - RNA, 23 nt, Human
uucuuaagacgugauuuugcugu

SEQ ID NO: 2035027 - RNA, 17 nt, Human
uucuucuuuuugcuuca

SEQ ID NO: 2035028 - RNA, 21 nt, Human
uucuucuuuuugcuucaaaaa

SEQ ID NO: 2035029 - RNA, 18 nt, Human
aucaguagccagcaucug

SEQ ID NO: 2035030 - RNA, 19 nt, Human
auguaugaggaauuucugu

SEQ ID NO: 2035031 - RNA, 19 nt, Human
augucucgugguaggacug

SEQ ID NO: 2035032 - RNA, 15 nt, Human
augucucgugguagg

SEQ ID NO: 2035033 - RNA, 16 nt, Human
augucucgugguagga

SEQ ID NO: 2035034 - RNA, 21 nt, Human
uuugucuuguguuucuuuagu

SEQ ID NO: 2035035 - RNA, 19 nt, Human
uuugucuuuggugaacauu

SEQ ID NO: 2035036 - RNA, 17 nt, Human
auguaaaagacuuuuuu

SEQ ID NO: 2035037 - RNA, 14 nt, Human
uuucugcagaaaca

SEQ ID NO: 2035038 - RNA, 19 nt, Human
auuaucuaaaaucugcuag

SEQ ID NO: 2035039 - RNA, 19 nt, Human
auuccagagcguguaguga

SEQ ID NO: 2035040 - RNA, 14 nt, Human
auuuuugucuugug

SEQ ID NO: 2035041 - RNA, 16 nt, Human
auuuuucagauauaaa

SEQ ID NO: 2035042 - RNA, 12 nt, Human
auuuugucuuua

SEQ ID NO: 2035043 - RNA, 18 nt, Human
auuuuguauauuuguauu

SEQ ID NO: 2035044 - RNA, 20 nt, Human
auuuugcuguagaagauggc

SEQ ID NO: 2035045 - RNA, 14 nt, Human
auuguacaguuuuu

SEQ ID NO: 2035046 - RNA, 15 nt, Human
auuguacaguuuuua

SEQ ID NO: 2035047 - RNA, 21 nt, Human
auuguacaguuuuuauugcuu

SEQ ID NO: 2035048 - RNA, 16 nt, Human
auuggauuugucuuug

SEQ ID NO: 2035049 - RNA, 16 nt, Human
auuuccacucaggucu

SEQ ID NO: 2035050 - RNA, 15 nt, Human
auuugucaacaaagu

SEQ ID NO: 2035051 - RNA, 13 nt, Human
auuugucaacaaa

SEQ ID NO: 2035052 - RNA, 14 nt, Human
caaugacacagucu

SEQ ID NO: 2035053 - RNA, 19 nt, Human
caaugacacagucuuggcu

SEQ ID NO: 2035054 - RNA, 21 nt, Human
caaugacacagucuuggcuca

SEQ ID NO: 2035055 - RNA, 16 nt, Human
caagugauucuccugc

SEQ ID NO: 2035056 - RNA, 22 nt, Human
caagugauucuccugccucagc

SEQ ID NO: 2035057 - RNA, 21 nt, Human
caagugauucuccugccucag

SEQ ID NO: 2035058 - RNA, 14 nt, Human
caagugauucuccu

SEQ ID NO: 2035059 - RNA, 14 nt, Human
ccaggcuggucuca

SEQ ID NO: 2035060 - RNA, 20 nt, Human
ccagagccucaaaugagaaa

SEQ ID NO: 2035061 - RNA, 23 nt, Human
ccagagccucaaaugagaaaaug

SEQ ID NO: 2035062 - RNA, 16 nt, Human
ccuacaguguacaguc

SEQ ID NO: 2035063 - RNA, 20 nt, Human
ccuacaguguacagucuugu

SEQ ID NO: 2035064 - RNA, 15 nt, Human
ccuacaguguacagu

SEQ ID NO: 2035065 - RNA, 22 nt, Human
cuccaaguccacaguggaacca

SEQ ID NO: 2035066 - RNA, 13 nt, Human
ccugccucagccu

SEQ ID NO: 2035067 - RNA, 19 nt, Human
gaaaaguuuuguaaauuuc

SEQ ID NO: 2035068 - RNA, 20 nt, Human
cuucuccuuagaaguggaag

SEQ ID NO: 2035069 - RNA, 16 nt, Human
cuguggccaaguucuu

SEQ ID NO: 2035070 - RNA, 18 nt, Human
cuguggccaaguucuuag

SEQ ID NO: 2035071 - RNA, 19 nt, Human
cuggcaguggaacuaagaa

SEQ ID NO: 2035072 - RNA, 21 nt, Human
gagccagcagccuggcucucc

SEQ ID NO: 2035073 - RNA, 18 nt, Human
gauuacagggaugagcca

SEQ ID NO: 2035074 - RNA, 20 nt, Human
gauuacagggaugagccacc

SEQ ID NO: 2035075 - RNA, 16 nt, Human
gauuuugcuguagaag

SEQ ID NO: 2035076 - RNA, 18 nt, Human
gauuacaggcaugugcca

SEQ ID NO: 2035077 - RNA, 20 nt, Human
gagguuucucaaagaaauuu

SEQ ID NO: 2035078 - RNA, 15 nt, Human
gaguggguugauuuc

SEQ ID NO: 2035079 - RNA, 20 nt, Human
ggagugcaaugacacagucu

SEQ ID NO: 2035080 - RNA, 16 nt, Human
gccucagccuccugag

SEQ ID NO: 2035081 - RNA, 18 nt, Human
gccucagccuccugagua

SEQ ID NO: 2035082 - RNA, 20 nt, Human
guagaaaagggaacugaaca

SEQ ID NO: 2035083 - RNA, 12 nt, Human
guacaguuuuua

SEQ ID NO: 2035084 - RNA, 13 nt, Human
guacaguuuuuau

SEQ ID NO: 2035085 - RNA, 16 nt, Human
guacagucuuguauua

SEQ ID NO: 2035086 - RNA, 13 nt, Human
guacagucuugua

SEQ ID NO: 2035087 - RNA, 14 nt, Human
guacagucuuguau

SEQ ID NO: 2035088 - RNA, 15 nt, Human
guaaaagacuuuuuu

SEQ ID NO: 2035089 - RNA, 19 nt, Human
guaagaucguucucugccu

SEQ ID NO: 2035090 - RNA, 14 nt, Human
ggugaacauugcaa

SEQ ID NO: 2035091 - RNA, 20 nt, Human
ggguuucaccauguuggcca

SEQ ID NO: 2035092 - RNA, 14 nt, Human
ggggcugccagggg

SEQ ID NO: 2035093 - RNA, 22 nt, Human
gucauaacuagaacugaauuuu

SEQ ID NO: 2035094 - RNA, 17 nt, Human
gucauaacuagaacuga

SEQ ID NO: 2035095 - RNA, 13 nt, Human
gucucgugguagg

SEQ ID NO: 2035096 - RNA, 13 nt, Human
gugauucuccugc

SEQ ID NO: 2035097 - RNA, 16 nt, Human
gugauuuugcuguaga

SEQ ID NO: 2035098 - RNA, 16 nt, Human
gugaaucacguaaagc

SEQ ID NO: 2035099 - RNA, 18 nt, Human
gugaaucacguaaagcua

SEQ ID NO: 2035100 - RNA, 16 nt, Human
gugagcuccuaagcca

SEQ ID NO: 2035101 - RNA, 22 nt, Human
guggaacguuuuuccuguucuu

SEQ ID NO: 2035102 - RNA, 14 nt, Human
guggccaaguucuu

SEQ ID NO: 2035103 - RNA, 12 nt, Human
uaugaauaacau

SEQ ID NO: 2035104 - RNA, 12 nt, Human
uaugauuuuuaa

SEQ ID NO: 2035105 - RNA, 23 nt, Human
uaugauuuuuaaagaaaaguuuu

SEQ ID NO: 2035106 - RNA, 23 nt, Human
uauauaaauuuuuuuuguuucau

SEQ ID NO: 2035107 - RNA, 18 nt, Human
uauacgauaaauaacuuu

SEQ ID NO: 2035108 - RNA, 18 nt, Human
uauguugguagauucuaa

SEQ ID NO: 2035109 - RNA, 15 nt, Human
uauuaaguuguuaau

SEQ ID NO: 2035110 - RNA, 22 nt, Human
uauugcagcgauuaauaacagg

SEQ ID NO: 2035111 - RNA, 15 nt, Human
uauugcuugcacaaa

SEQ ID NO: 2035112 - RNA, 14 nt, Human
uccuuagaagugga

SEQ ID NO: 2035113 - RNA, 14 nt, Human
ucgugguaggacug

SEQ ID NO: 2035114 - RNA, 15 nt, Human
ucgugguaggacugu

SEQ ID NO: 2035115 - RNA, 20 nt, Human
ucgugguaggacuguagaaa

SEQ ID NO: 2035116 - RNA, 12 nt, Human
ucuuguguuucu

SEQ ID NO: 2035117 - RNA, 18 nt, Human
ugaacauugcaauagaaa

SEQ ID NO: 2035118 - RNA, 16 nt, Human
ugcugguuuuucaguu

SEQ ID NO: 2035119 - RNA, 18 nt, Human
ugcugguuuuucaguuuu

SEQ ID NO: 2035120 - RNA, 12 nt, Human
ugcugguuuuuc

SEQ ID NO: 2035121 - RNA, 15 nt, Human
ugcugguuuuucagu

SEQ ID NO: 2035122 - RNA, 13 nt, Human
uggccaggcuggu

SEQ ID NO: 2035123 - RNA, 17 nt, Human
uggauuuuugucuugug

SEQ ID NO: 2035124 - RNA, 11 nt, Human
uuaaagacaga

SEQ ID NO: 2035125 - RNA, 12 nt, Human
uuaaagacagag

SEQ ID NO: 2035126 - RNA, 20 nt, Human
uguuucauauugaugugugu

SEQ ID NO: 2035127 - RNA, 22 nt, Human
uuaggccaaaaaaauguaagau

SEQ ID NO: 2035128 - RNA, 15 nt, Human
uucuaaagauggaaa

SEQ ID NO: 2035129 - RNA, 18 nt, Human
uuccacucaggucuguuu

SEQ ID NO: 2035130 - RNA, 19 nt, Human
uuauugcagcgauuaauaa

SEQ ID NO: 2035131 - RNA, 14 nt, Human
uuaugcauagauaa

SEQ ID NO: 2035132 - RNA, 13 nt, Human
uuaguugcuguau

SEQ ID NO: 2035133 - RNA, 15 nt, Human
uuaguugcuguaugu

SEQ ID NO: 2035134 - RNA, 21 nt, Human
uuugaggguguauauuuucug

SEQ ID NO: 2035135 - RNA, 17 nt, Human
uuuccacucaggucugu

SEQ ID NO: 2035136 - RNA, 19 nt, Human
uugucuuuggugaacauug

SEQ ID NO: 2035137 - RNA, 19 nt, Human
uugcagcgauuaauaacag

SEQ ID NO: 2035138 - RNA, 18 nt, Human
uugcagcgauuaauaaca

SEQ ID NO: 2035139 - RNA, 13 nt, Human
uucugugcagcca

SEQ ID NO: 2035140 - RNA, 16 nt, Human
auaugcaguuuuccuu

SEQ ID NO: 2035141 - RNA, 22 nt, Human
agacugaccaauauuguacagu

SEQ ID NO: 2035142 - RNA, 14 nt, Human
agagccucaaauga

SEQ ID NO: 2035143 - RNA, 17 nt, Human
agagccucaaaugagaa

SEQ ID NO: 2035144 - RNA, 11 nt, Human
agacagagucu

SEQ ID NO: 2035145 - RNA, 22 nt, Human
aggcuggucucaaacuccugac

SEQ ID NO: 2035146 - RNA, 16 nt, Human
aggaccuguggccaag

SEQ ID NO: 2035147 - RNA, 18 nt, Human
aaagcccaaagugguaua

SEQ ID NO: 2035148 - RNA, 15 nt, Human
aaguucuuaguugcu

SEQ ID NO: 2035149 - RNA, 22 nt, Human
aaguucuuaguugcuguauguc

SEQ ID NO: 2035150 - RNA, 17 nt, Human
aauagaaauggggaacu

SEQ ID NO: 2035151 - RNA, 16 nt, Human
aauagaaauccaauug

SEQ ID NO: 2035152 - RNA, 18 nt, Human
aauccaccugccucggcc

SEQ ID NO: 2035153 - RNA, 19 nt, Human
aauccaccugccucggccu

SEQ ID NO: 2035154 - RNA, 14 nt, Human
aacuuacuuagugu

SEQ ID NO: 2035155 - RNA, 12 nt, Human
acaguguacagu

SEQ ID NO: 2035156 - RNA, 13 nt, Human
acaguguacaguc

SEQ ID NO: 2035157 - RNA, 18 nt, Human
acaguguacagucuugua

SEQ ID NO: 2035158 - RNA, 15 nt, Human
acaguguacagucuu

SEQ ID NO: 2035159 - RNA, 17 nt, Human
acaguguacagucuugu

SEQ ID NO: 2035160 - RNA, 22 nt, Human
acugaccaauauuguacaguuu

SEQ ID NO: 2035161 - RNA, 20 nt, Human
acugaccaauauuguacagu

SEQ ID NO: 2035162 - RNA, 21 nt, Human
acugaccaauauuguacaguu

SEQ ID NO: 2035163 - RNA, 13 nt, Human
acuucugccucuu

SEQ ID NO: 2035164 - RNA, 17 nt, Human
acuauugcuugcacaaa

SEQ ID NO: 2035165 - RNA, 14 nt, Human
acuaaucuuucugc

SEQ ID NO: 2035166 - RNA, 18 nt, Human
accuguggccaaguucuu

SEQ ID NO: 2035167 - RNA, 19 nt, Human
accuguggccaaguucuua

SEQ ID NO: 2035168 - RNA, 14 nt, Human
cucagccuccugag

SEQ ID NO: 2035169 - RNA, 22 nt, Human
cucagccuccugaguagcugga

SEQ ID NO: 2035170 - RNA, 20 nt, Human
ccuucugaaaaaguauccug

SEQ ID NO: 2035171 - RNA, 23 nt, Human
cuagaaaugauccccagcuguuu

SEQ ID NO: 2035172 - RNA, 15 nt, Human
cuagaacugaauuuu

SEQ ID NO: 2035173 - RNA, 20 nt, Human
cuacaguguacagucuugua

SEQ ID NO: 2035174 - RNA, 15 nt, Human
cuacaguguacaguc

SEQ ID NO: 2035175 - RNA, 16 nt, Human
cuacaguguacagucu

SEQ ID NO: 2035176 - RNA, 17 nt, Human
cuacaguguacagucuu

SEQ ID NO: 2035177 - RNA, 17 nt, Human
cggcucuggccuccaag

SEQ ID NO: 2035178 - RNA, 20 nt, Human
ccugaguagcuggauuacag

SEQ ID NO: 2035179 - RNA, 15 nt, Human
ccugaguagcuggau

SEQ ID NO: 2035180 - RNA, 19 nt, Human
ccugaguagcuggauuaca

SEQ ID NO: 2035181 - RNA, 14 nt, Human
ccucagccuccuga

SEQ ID NO: 2035182 - RNA, 18 nt, Human
ccuccaaguccacagugg

SEQ ID NO: 2035183 - RNA, 21 nt, Human
ccuccaaguccacaguggaac

SEQ ID NO: 2035184 - RNA, 19 nt, Human
auuagcauuugucaacaaa

SEQ ID NO: 2035185 - RNA, 20 nt, Human
caccuacaguguacagucuu

SEQ ID NO: 2035186 - RNA, 13 nt, Human
caccuacagugua

SEQ ID NO: 2035187 - RNA, 16 nt, Human
caccuacaguguacag

SEQ ID NO: 2035188 - RNA, 17 nt, Human
caccuacaguguacagu

SEQ ID NO: 2035189 - RNA, 23 nt, Human
caccugccucggccucccaaagu

SEQ ID NO: 2035190 - RNA, 17 nt, Human
caaguccacaguggaac

SEQ ID NO: 2035191 - RNA, 19 nt, Human
ccaaagugguauagaaaug

SEQ ID NO: 2035192 - RNA, 22 nt, Human
ccaaagugguauagaaaugcug

SEQ ID NO: 2035193 - RNA, 22 nt, Human
ccaaagugcugggauuacaggg

SEQ ID NO: 2035194 - RNA, 11 nt, Human
gcuagaaauga

SEQ ID NO: 2035195 - RNA, 16 nt, Human
gccauguguuccaagg

SEQ ID NO: 2035196 - RNA, 15 nt, Human
gccauguguuccaag

SEQ ID NO: 2035197 - RNA, 17 nt, Human
ggaacugaacauuccag

SEQ ID NO: 2035198 - RNA, 13 nt, Human
gcuuacaagccag

SEQ ID NO: 2035199 - RNA, 19 nt, Human
gcuuacaagccagcuggag

SEQ ID NO: 2035200 - RNA, 22 nt, Human
gcuuacaagccagcuggagaaa

SEQ ID NO: 2035201 - RNA, 23 nt, Human
ggccuccaaguccacaguggaac

SEQ ID NO: 2035202 - RNA, 13 nt, Human
aaaaugucuuuau

SEQ ID NO: 2035203 - RNA, 19 nt, Human
gguuucaccauguuggcca

SEQ ID NO: 2035204 - RNA, 17 nt, Human
gauacgacaacuugcac

SEQ ID NO: 2035205 - RNA, 18 nt, Human
gauaugcaguuuuccuua

SEQ ID NO: 2035206 - RNA, 22 nt, Human
cuuuuuuuuuuuuuaaagacag

SEQ ID NO: 2035207 - RNA, 23 nt, Human
cuuuuuuuuuuuuuaaagacaga

SEQ ID NO: 2035208 - RNA, 13 nt, Human
cuggcucaucucu

SEQ ID NO: 2035209 - RNA, 22 nt, Human
aacuucuccccugguagaaaga

SEQ ID NO: 2035210 - RNA, 21 nt, Human
aaccucgagguuucucaaaga

SEQ ID NO: 2035211 - RNA, 22 nt, Human
aaccucgagguuucucaaagaa

SEQ ID NO: 2035212 - RNA, 16 nt, Human
gucuuuggugaacauu

SEQ ID NO: 2035213 - RNA, 22 nt, Human
guauauuuguauuuaaaugaaa

SEQ ID NO: 2035214 - RNA, 14 nt, Human
aaauguaagaucgu

SEQ ID NO: 2035215 - RNA, 22 nt, Human
aaauguaagaucguucucugcc

SEQ ID NO: 2035216 - RNA, 13 nt, Human
gucauaacuagaa

SEQ ID NO: 2035217 - RNA, 14 nt, Human
guuucucaaagaaa

SEQ ID NO: 2035218 - RNA, 17 nt, Human
guuucucaaagaaauuu

SEQ ID NO: 2035219 - RNA, 18 nt, Human
guuucucaaagaaauuuc

SEQ ID NO: 2035220 - RNA, 19 nt, Human
guuuuuccuguucuuaaga

SEQ ID NO: 2035221 - RNA, 14 nt, Human
guuuuucaguuuuc

SEQ ID NO: 2035222 - RNA, 18 nt, Human
aagugagacuuugagggu

SEQ ID NO: 2035223 - RNA, 21 nt, Human
aaguaauccaccugccucggc

SEQ ID NO: 2035224 - RNA, 13 nt, Human
uaaaagacuuuuu

SEQ ID NO: 2035225 - RNA, 16 nt, Human
aagaucguucucugcc

SEQ ID NO: 2035226 - RNA, 17 nt, Human
aagaucguucucugccu

SEQ ID NO: 2035227 - RNA, 23 nt, Human
aagacgugauuuugcuguagaag

SEQ ID NO: 2035228 - RNA, 16 nt, Human
aagacgugauuuugcu

SEQ ID NO: 2035229 - RNA, 22 nt, Human
aagacgugauuuugcuguagaa

SEQ ID NO: 2035230 - RNA, 16 nt, Human
aagacuuccagagccu

SEQ ID NO: 2035231 - RNA, 18 nt, Human
aagacuuccagagccuca

SEQ ID NO: 2035232 - RNA, 18 nt, Human
aauagcgucauaacuaga

SEQ ID NO: 2035233 - RNA, 21 nt, Human
aaucacguaaagcuagaaaug

SEQ ID NO: 2035234 - RNA, 20 nt, Human
aaucacguaaagcuagaaau

SEQ ID NO: 2035235 - RNA, 21 nt, Human
uaaguuacacauuuuucagau

SEQ ID NO: 2035236 - RNA, 18 nt, Human
aaugcugguuuuucaguu

SEQ ID NO: 2035237 - RNA, 20 nt, Human
aaugagaaaaugucuuuauu

SEQ ID NO: 2035238 - RNA, 21 nt, Human
uaugucucgugguaggacugu

SEQ ID NO: 2035239 - RNA, 16 nt, Human
acagaaagguuuucuu

SEQ ID NO: 2035240 - RNA, 14 nt, Human
uaggcaggaccugu

SEQ ID NO: 2035241 - RNA, 15 nt, Human
uaggcaggaccugug

SEQ ID NO: 2035242 - RNA, 16 nt, Human
acuagaacugaauuuu

SEQ ID NO: 2035243 - RNA, 17 nt, Human
acuagaacugaauuuug

SEQ ID NO: 2035244 - RNA, 18 nt, Human
acuagaacugaauuuugu

SEQ ID NO: 2035245 - RNA, 19 nt, Human
acuagaacugaauuuuguc

SEQ ID NO: 2035246 - RNA, 23 nt, Human
acuagaacugaauuuugucuuua

SEQ ID NO: 2035247 - RNA, 20 nt, Human
ucccaaagugcugggauuac

SEQ ID NO: 2035248 - RNA, 16 nt, Human
ucacagccacuuggga

SEQ ID NO: 2035249 - RNA, 17 nt, Human
ucaagcaagauuucaga

SEQ ID NO: 2035250 - RNA, 19 nt, Human
ucaaguaauccaccugccu

SEQ ID NO: 2035251 - RNA, 21 nt, Human
acauuuuucagauauaaaaga

SEQ ID NO: 2035252 - RNA, 18 nt, Human
acauuuuacuuuuuccug

SEQ ID NO: 2035253 - RNA, 15 nt, Human
ucauaacuagaacug

SEQ ID NO: 2035254 - RNA, 13 nt, Human
ucauaacuagaac

SEQ ID NO: 2035255 - RNA, 17 nt, Human
ucacugcaacuucugcc

SEQ ID NO: 2035256 - RNA, 18 nt, Human
ucacugcaacuucugccu

SEQ ID NO: 2035257 - RNA, 13 nt, Human
ucguucucugccu

SEQ ID NO: 2035258 - RNA, 21 nt, Human
ucgcucuguugcccaggcugg

SEQ ID NO: 2035259 - RNA, 23 nt, Human
acuuugaggguguauauuuucug

SEQ ID NO: 2035260 - RNA, 15 nt, Human
ucuccuuagaagugg

SEQ ID NO: 2035261 - RNA, 21 nt, Human
ucuccuuagaaguggaaguag

SEQ ID NO: 2035262 - RNA, 17 nt, Human
ucucgcucuguugccca

SEQ ID NO: 2035263 - RNA, 14 nt, Human
ucucuccauucccg

SEQ ID NO: 2035264 - RNA, 20 nt, Human
agaaaugcugguuuuucagu

SEQ ID NO: 2035265 - RNA, 21 nt, Human
agaaaugcugguuuuucaguu

SEQ ID NO: 2035266 - RNA, 21 nt, Human
agaacugaauuuugucuuuau

SEQ ID NO: 2035267 - RNA, 22 nt, Human
ugaaaaaguauccugcuucuga

SEQ ID NO: 2035268 - RNA, 21 nt, Human
ucuuucugcagaaacagaaag

SEQ ID NO: 2035269 - RNA, 16 nt, Human
ucuuuggugaacauug

SEQ ID NO: 2035270 - RNA, 22 nt, Human
ucuuuggugaacauugcaauag

SEQ ID NO: 2035271 - RNA, 16 nt, Human
ucuuuaugauuuuuaa

SEQ ID NO: 2035272 - RNA, 17 nt, Human
ucuuuauuaaauguaga

SEQ ID NO: 2035273 - RNA, 21 nt, Human
ucuuuauuaaauguagaaagu

SEQ ID NO: 2035274 - RNA, 22 nt, Human
ugacacagucuuggcucacugc

SEQ ID NO: 2035275 - RNA, 23 nt, Human
ugacacagucuuggcucacugca

SEQ ID NO: 2035276 - RNA, 14 nt, Human
agcaagauuucaga

SEQ ID NO: 2035277 - RNA, 19 nt, Human
ugauauguugguagauucu

SEQ ID NO: 2035278 - RNA, 13 nt, Human
ugaguagcuggau

SEQ ID NO: 2035279 - RNA, 12 nt, Human
agcuagaaauga

SEQ ID NO: 2035280 - RNA, 11 nt, Human
agcuagaaaug

SEQ ID NO: 2035281 - RNA, 19 nt, Human
ugauucuccugccucagcc

SEQ ID NO: 2035282 - RNA, 12 nt, Human
agccucaucucu

SEQ ID NO: 2035283 - RNA, 13 nt, Human
uggauuggauuug

SEQ ID NO: 2035284 - RNA, 13 nt, Human
ugcuucaaaaaca

SEQ ID NO: 2035285 - RNA, 21 nt, Human
ugcuucaaaaacauucuuaca

SEQ ID NO: 2035286 - RNA, 18 nt, Human
uggucucaaacuccugac

SEQ ID NO: 2035287 - RNA, 17 nt, Human
ugguacucauuaaaaaa

SEQ ID NO: 2035288 - RNA, 14 nt, Human
aguaauccaccugc

SEQ ID NO: 2035289 - RNA, 19 nt, Human
uguaagaucguucucugcc

SEQ ID NO: 2035290 - RNA, 20 nt, Human
uguaagaucguucucugccu

SEQ ID NO: 2035291 - RNA, 17 nt, Human
agugcugggauuacagg

SEQ ID NO: 2035292 - RNA, 19 nt, Human
ugugucuaggcaggaccug

SEQ ID NO: 2035293 - RNA, 20 nt, Human
ugugucuaggcaggaccugu

SEQ ID NO: 2035294 - RNA, 18 nt, Human
agugcaaugacacagucu

SEQ ID NO: 2035295 - RNA, 16 nt, Human
agugcaaugacacagu

SEQ ID NO: 2035296 - RNA, 22 nt, Human
agugauucuccugccucagccu

SEQ ID NO: 2035297 - RNA, 15 nt, Human
uguugcccaggcugg

SEQ ID NO: 2035298 - RNA, 14 nt, Human
uguugcccaggcug

SEQ ID NO: 2035299 - RNA, 21 nt, Human
uguugcccaggcuggagugca

SEQ ID NO: 2035300 - RNA, 16 nt, Human
aguggaaccagcccag

SEQ ID NO: 2035301 - RNA, 15 nt, Human
aguuuuuauugcuug

SEQ ID NO: 2035302 - RNA, 12 nt, Human
aguuuuguaaau

SEQ ID NO: 2035303 - RNA, 15 nt, Human
aguuuuguaaauuuc

SEQ ID NO: 2035304 - RNA, 21 nt, Human
uuaauugacuuauuuauauaa

SEQ ID NO: 2035305 - RNA, 18 nt, Human
aguuuaauugacuuauuu

SEQ ID NO: 2035306 - RNA, 14 nt, Human
aguuuaauugacuu

SEQ ID NO: 2035307 - RNA, 15 nt, Human
aguuuaauugacuua

SEQ ID NO: 2035308 - RNA, 18 nt, Human
auaaucucuccauucccg

SEQ ID NO: 2035309 - RNA, 15 nt, Human
uuugcuucaaaaaca

SEQ ID NO: 2035310 - RNA, 13 nt, Human
uuugcuguagaag

SEQ ID NO: 2035311 - RNA, 21 nt, Human
uuugcuguagaagauggcacu

SEQ ID NO: 2035312 - RNA, 16 nt, Human
auguuggccaggcugg

SEQ ID NO: 2035313 - RNA, 21 nt, Human
uuuuaaguuacacauuuuuca

SEQ ID NO: 2035314 - RNA, 22 nt, Human
uuuuaaguuacacauuuuucag

SEQ ID NO: 2035315 - RNA, 22 nt, Human
uuuucagauauaaaagacugac

SEQ ID NO: 2035316 - RNA, 19 nt, Human
uuuucagauauaaaagacu

SEQ ID NO: 2035317 - RNA, 21 nt, Human
uuuucagauauaaaagacuga

SEQ ID NO: 2035318 - RNA, 17 nt, Human
uuuucagauauaaaaga

SEQ ID NO: 2035319 - RNA, 19 nt, Human
auuuacccuucuuuucuga

SEQ ID NO: 2035320 - RNA, 12 nt, Human
auugcaauagaa

SEQ ID NO: 2035321 - RNA, 16 nt, Human
auauaaaagacugacc

SEQ ID NO: 2035322 - RNA, 14 nt, Human
augauuuuuaaaga

SEQ ID NO: 2035323 - RNA, 16 nt, Human
augauuuuuaaagaaa

SEQ ID NO: 2035324 - RNA, 15 nt, Human
augcaguuuuccuua

SEQ ID NO: 2035325 - RNA, 22 nt, Human
uuuaugggucagaguuccgacu

SEQ ID NO: 2035326 - RNA, 13 nt, Human
augcugguuuuuc

SEQ ID NO: 2035327 - RNA, 17 nt, Human
augagaaaaugucuuua

SEQ ID NO: 2035328 - RNA, 19 nt, Human
uugcacaaaccaauuaaac

SEQ ID NO: 2035329 - RNA, 16 nt, Human
uugaugugugucuagg

SEQ ID NO: 2035330 - RNA, 12 nt, Human
caaagaaauuuc

SEQ ID NO: 2035331 - RNA, 18 nt, Human
caaagaaauuuccacuca

SEQ ID NO: 2035332 - RNA, 19 nt, Human
caaagaaauuuccacucag

SEQ ID NO: 2035333 - RNA, 19 nt, Human
caauagauauuuaccuuuu

SEQ ID NO: 2035334 - RNA, 13 nt, Human
cacaguggaacca

SEQ ID NO: 2035335 - RNA, 19 nt, Human
cacaguggaaccagcccag

SEQ ID NO: 2035336 - RNA, 13 nt, Human
cauaacuagaacu

SEQ ID NO: 2035337 - RNA, 15 nt, Human
caguuuuuauugcuu

SEQ ID NO: 2035338 - RNA, 17 nt, Human
caguguacagucuugua

SEQ ID NO: 2035339 - RNA, 18 nt, Human
caguguacagucuuguau

SEQ ID NO: 2035340 - RNA, 12 nt, Human
caguguacaguc

SEQ ID NO: 2035341 - RNA, 15 nt, Human
caguguacagucuug

SEQ ID NO: 2035342 - RNA, 16 nt, Human
caguggaaccagccca

SEQ ID NO: 2035343 - RNA, 13 nt, Human
cauugcaauagaa

SEQ ID NO: 2035344 - RNA, 15 nt, Human
cauugcaauagaaau

SEQ ID NO: 2035345 - RNA, 14 nt, Human
cauugcaauagaaa

SEQ ID NO: 2035346 - RNA, 14 nt, Human
ccaauauuguacag

SEQ ID NO: 2035347 - RNA, 15 nt, Human
ccaauauuguacagu

SEQ ID NO: 2035348 - RNA, 16 nt, Human
ccaauauuguacaguu

SEQ ID NO: 2035349 - RNA, 18 nt, Human
ccaauauuguacaguuuu

SEQ ID NO: 2035350 - RNA, 23 nt, Human
ccauguuggccaggcuggucuca

SEQ ID NO: 2035351 - RNA, 23 nt, Human
ccucccaaagugcugggauuaca

SEQ ID NO: 2035352 - RNA, 11 nt, Human
cccuucuuuuu

SEQ ID NO: 2035353 - RNA, 20 nt, Human
cuaagcacgggccauaugaa

SEQ ID NO: 2035354 - RNA, 23 nt, Human
cuaagcacgggccauaugaauaa

SEQ ID NO: 2035355 - RNA, 15 nt, Human
cuaggcaggaccugu

SEQ ID NO: 2035356 - RNA, 16 nt, Human
cuaggcaggaccugug

SEQ ID NO: 2035357 - RNA, 20 nt, Human
cucacauagcuuacaagcca

SEQ ID NO: 2035358 - RNA, 20 nt, Human
cguggaacguuuuuccuguu

SEQ ID NO: 2035359 - RNA, 15 nt, Human
cguggaacguuuuuc

SEQ ID NO: 2035360 - RNA, 16 nt, Human
cgucgacguagaaccu

SEQ ID NO: 2035361 - RNA, 16 nt, Human
cgggguggauuggauu

SEQ ID NO: 2035362 - RNA, 22 nt, Human
cucccaaagugcugggauuaca

SEQ ID NO: 2035363 - RNA, 15 nt, Human
cugaccaauauugua

SEQ ID NO: 2035364 - RNA, 18 nt, Human
cugaccaauauuguacag

SEQ ID NO: 2035365 - RNA, 19 nt, Human
cugaccaauauuguacagu

SEQ ID NO: 2035366 - RNA, 20 nt, Human
cugaccaauauuguacaguu

SEQ ID NO: 2035367 - RNA, 21 nt, Human
cugaccaauauuguacaguuu

SEQ ID NO: 2035368 - RNA, 19 nt, Human
cucuuggguucaagugauu

SEQ ID NO: 2035369 - RNA, 20 nt, Human
cuguaugucucgugguagga

SEQ ID NO: 2035370 - RNA, 19 nt, Human
cuugcacguauuuuaauag

SEQ ID NO: 2035371 - RNA, 22 nt, Human
cuuguauuaaguuguuaauaaa

SEQ ID NO: 2035372 - RNA, 23 nt, Human
cuuguauuaaguuguuaauaaaa

SEQ ID NO: 2035373 - RNA, 13 nt, Human
cuuguauuaaguu

SEQ ID NO: 2035374 - RNA, 17 nt, Human
cuuguauuaaguuguua

SEQ ID NO: 2035375 - RNA, 24 nt, Human
cuuggcucacugcaacuucugccu

SEQ ID NO: 2035376 - RNA, 20 nt, Human
gaaauuuccacucaggucug

SEQ ID NO: 2035377 - RNA, 19 nt, Human
gaaauuuccacucaggucu

SEQ ID NO: 2035378 - RNA, 14 nt, Human
gcacguauuuuaau

SEQ ID NO: 2035379 - RNA, 15 nt, Human
gcacguauuuuaaua

SEQ ID NO: 2035380 - RNA, 16 nt, Human
gauaaauaacuuuuuu

SEQ ID NO: 2035381 - RNA, 21 nt, Human
gauaaauaacuuuuuuuuaag

SEQ ID NO: 2035382 - RNA, 14 nt, Human
gauccccagcuguu

SEQ ID NO: 2035383 - RNA, 20 nt, Human
gauuugucuuuggugaacau

SEQ ID NO: 2035384 - RNA, 22 nt, Human
gauuugucuuuggugaacauug

SEQ ID NO: 2035385 - RNA, 15 nt, Human
gauuuuugucuugug

SEQ ID NO: 2035386 - RNA, 15 nt, Human
gcccaggcuggagug

SEQ ID NO: 2035387 - RNA, 13 nt, Human
gccagcuggagaa

SEQ ID NO: 2035388 - RNA, 13 nt, Human
uuuugucuugugu

SEQ ID NO: 2035389 - RNA, 12 nt, Human
uuuuuaaagaaa

SEQ ID NO: 2035390 - RNA, 20 nt, Human
uuuuuaaagaaaaguuuugu

SEQ ID NO: 2035391 - RNA, 17 nt, Human
uuuuuaaagacagaguc

SEQ ID NO: 2035392 - RNA, 12 nt, Human
uuuuuuguuuca

SEQ ID NO: 2035393 - RNA, 13 nt, Human
uuuuuuguuucau

SEQ ID NO: 2035394 - RNA, 23 nt, Human
uuuggugaacauugcaauagaaa

SEQ ID NO: 2035395 - RNA, 22 nt, Human
uuuggugaacauugcaauagaa

SEQ ID NO: 2035396 - RNA, 15 nt, Human
uuuuaaagaaaaguu

SEQ ID NO: 2035397 - RNA, 14 nt, Human
uuuuaaagaaaagu

SEQ ID NO: 2035398 - RNA, 23 nt, Human
guauagaaaugcugguuuuucag

SEQ ID NO: 2035399 - RNA, 15 nt, Human
guauagaaaugcugg

SEQ ID NO: 2035400 - RNA, 22 nt, Human
guauagaaaugcugguuuuuca

SEQ ID NO: 2035401 - RNA, 14 nt, Human
guauagaaaugcug

SEQ ID NO: 2035402 - RNA, 16 nt, Human
guccacaguggaacca

SEQ ID NO: 2035403 - RNA, 19 nt, Human
guccacaguggaaccagcc

SEQ ID NO: 2035404 - RNA, 21 nt, Human
guccacaguggaaccagccca

SEQ ID NO: 2035405 - RNA, 22 nt, Human
guauuaaguuguuaauaaaagu

SEQ ID NO: 2035406 - RNA, 19 nt, Human
gucucgugguaggacugua

SEQ ID NO: 2035407 - RNA, 19 nt, Human
gugucuaggcaggaccugu

SEQ ID NO: 2035408 - RNA, 19 nt, Human
guuaaacuuacuuaguguu

SEQ ID NO: 2035409 - RNA, 16 nt, Human
guuacacauuuuucag

SEQ ID NO: 2035410 - RNA, 17 nt, Human
guuacacauuuuucaga

SEQ ID NO: 2035411 - RNA, 13 nt, Human
guguacagucuug

SEQ ID NO: 2035412 - RNA, 16 nt, Human
guguacagucuuguau

SEQ ID NO: 2035413 - RNA, 22 nt, Human
guguacagucuuguauuaaguu

SEQ ID NO: 2035414 - RNA, 14 nt, Human
gugguauagaaaug

SEQ ID NO: 2035415 - RNA, 12 nt, Human
gugggcuaagca

SEQ ID NO: 2035416 - RNA, 23 nt, Human
guucuaaagauggaaaaaccacc

SEQ ID NO: 2035417 - RNA, 17 nt, Human
guucuaaagauggaaaa

SEQ ID NO: 2035418 - RNA, 20 nt, Human
guucuaaagauggaaaaacc

SEQ ID NO: 2035419 - RNA, 14 nt, Human
guucuaaagaugga

SEQ ID NO: 2035420 - RNA, 23 nt, Human
guugauuucagcaccuacagugu

SEQ ID NO: 2035421 - RNA, 14 nt, Human
guuggauuuuuguc

SEQ ID NO: 2035422 - RNA, 20 nt, Human
guuggauuuuugucuugugu

SEQ ID NO: 2035423 - RNA, 16 nt, Human
guuucuuuaguuuuug

SEQ ID NO: 2035424 - RNA, 24 nt, Human
guuuucaggaguggguugauuuca

SEQ ID NO: 2035425 - RNA, 12 nt, Human
guuuuguaaauu

SEQ ID NO: 2035426 - RNA, 14 nt, Human
guuuuguaaauuuc

SEQ ID NO: 2035427 - RNA, 15 nt, Human
guuguuaauaaaagu

SEQ ID NO: 2035428 - RNA, 17 nt, Human
guuuuuaauaaagacag

SEQ ID NO: 2035429 - RNA, 16 nt, Human
uaaagaaaaguuuugu

SEQ ID NO: 2035430 - RNA, 22 nt, Human
uaaagaaaaguuuuguaaauuu

SEQ ID NO: 2035431 - RNA, 15 nt, Human
uaaauguagaaagug

SEQ ID NO: 2035432 - RNA, 11 nt, Human
uaauguuuccu

SEQ ID NO: 2035433 - RNA, 15 nt, Human
uaagccaugggagac

SEQ ID NO: 2035434 - RNA, 11 nt, Human
uauagaaaugc

SEQ ID NO: 2035435 - RNA, 23 nt, Human
ugaaucacguaaagcuagaaaug

SEQ ID NO: 2035436 - RNA, 17 nt, Human
ugaaucacguaaagcua

SEQ ID NO: 2035437 - RNA, 19 nt, Human
ugacucuuggcacagcaug

SEQ ID NO: 2035438 - RNA, 14 nt, Human
ugacucuuggcaca

SEQ ID NO: 2035439 - RNA, 20 nt, Human
ucugccucacauagcuuaca

SEQ ID NO: 2035440 - RNA, 20 nt, Human
ucagcaccuacaguguacag

SEQ ID NO: 2035441 - RNA, 21 nt, Human
ucagcaccuacaguguacagu

SEQ ID NO: 2035442 - RNA, 22 nt, Human
ucagcaccuacaguguacaguc

SEQ ID NO: 2035443 - RNA, 21 nt, Human
uggaacguuuuuccuguucuu

SEQ ID NO: 2035444 - RNA, 13 nt, Human
ugguauagaaaug

SEQ ID NO: 2035445 - RNA, 22 nt, Human
ugguauagaaaugcugguuuuu

SEQ ID NO: 2035446 - RNA, 14 nt, Human
ugguauagaaaugc

SEQ ID NO: 2035447 - RNA, 16 nt, Human
ugguauagaaaugcug

SEQ ID NO: 2035448 - RNA, 21 nt, Human
ugggauuacagggaugagcca

SEQ ID NO: 2035449 - RNA, 18 nt, Human
ugcccaggcuggagugca

SEQ ID NO: 2035450 - RNA, 20 nt, Human
ugcccaggcuggagugcaau

SEQ ID NO: 2035451 - RNA, 13 nt, Human
ugcccaggcugga

SEQ ID NO: 2035452 - RNA, 21 nt, Human
uguacagucuuguauuaaguu

SEQ ID NO: 2035453 - RNA, 15 nt, Human
uuaaauguagaaagu

SEQ ID NO: 2035454 - RNA, 20 nt, Human
uuaauagcgucauaacuaga

SEQ ID NO: 2035455 - RNA, 17 nt, Human
uuacacauuuuucagau

SEQ ID NO: 2035456 - RNA, 23 nt, Human
uuacacauuuuucagauauaaaa

SEQ ID NO: 2035457 - RNA, 15 nt, Human
uuacacauuuuucag

SEQ ID NO: 2035458 - RNA, 18 nt, Human
uuaaagaaaaguuuugua

SEQ ID NO: 2035459 - RNA, 22 nt, Human
ugugugucuaggcaggaccugu

SEQ ID NO: 2035460 - RNA, 15 nt, Human
uguguuuuuaauaaa

SEQ ID NO: 2035461 - RNA, 20 nt, Human
uguguuuuuaauaaagacag

SEQ ID NO: 2035462 - RNA, 15 nt, Human
aaagcccaaaguggu

SEQ ID NO: 2035463 - RNA, 22 nt, Human
aaaugcugguuuuucaguuuuc

SEQ ID NO: 2035464 - RNA, 15 nt, Human
aaucacguaaagcua

SEQ ID NO: 2035465 - RNA, 11 nt, Human
aauaaagacag

SEQ ID NO: 2035466 - RNA, 12 nt, Human
aauaaagacagg

SEQ ID NO: 2035467 - RNA, 13 nt, Human
aagcuagaaauga

SEQ ID NO: 2035468 - RNA, 12 nt, Human
aagacagagucu

SEQ ID NO: 2035469 - RNA, 20 nt, Human
acugauguaugaggaauuuc

SEQ ID NO: 2035470 - RNA, 17 nt, Human
accuguggccaaguucu

SEQ ID NO: 2035471 - RNA, 18 nt, Human
acaguggaaccagcccag

SEQ ID NO: 2035472 - RNA, 17 nt, Human
acauguuaaacuuacuu

SEQ ID NO: 2035473 - RNA, 22 nt, Human
aauuggauacgacaacuugcac

SEQ ID NO: 2035474 - RNA, 21 nt, Human
aauuuccacucaggucuguuu

SEQ ID NO: 2035475 - RNA, 19 nt, Human
agugauucuccugccucag

SEQ ID NO: 2035476 - RNA, 13 nt, Human
aguuacacauuuu

SEQ ID NO: 2035477 - RNA, 16 nt, Human
aguuacacauuuuuca

SEQ ID NO: 2035478 - RNA, 19 nt, Human
aguuacacauuuuucagau

SEQ ID NO: 2035479 - RNA, 15 nt, Human
agauauaaaagacug

SEQ ID NO: 2035480 - RNA, 18 nt, Human
agaagaugaaugagcaaa

SEQ ID NO: 2035481 - RNA, 19 nt, Human
agaagauggcacuuauaac

SEQ ID NO: 2035482 - RNA, 21 nt, Human
agacugaccaauauuguacag

SEQ ID NO: 2035483 - RNA, 12 nt, Human
agacugaccaau

SEQ ID NO: 2035484 - RNA, 22 nt, Human
aggcaugugccacccacccaac

SEQ ID NO: 2035485 - RNA, 17 nt, Human
cguaaagcuagaaauga

SEQ ID NO: 2035486 - RNA, 16 nt, Human
cguaaagcuagaaaug

SEQ ID NO: 2035487 - RNA, 19 nt, Human
cgcucuguugcccaggcug

SEQ ID NO: 2035488 - RNA, 22 nt, Human
cgcucuguugcccaggcuggag

SEQ ID NO: 2035489 - RNA, 22 nt, Human
cuaagaaagcccuuaggaagaa

SEQ ID NO: 2035490 - RNA, 16 nt, Human
ccucgagguuucucaa

SEQ ID NO: 2035491 - RNA, 15 nt, Human
ccucagccuccugag

SEQ ID NO: 2035492 - RNA, 20 nt, Human
caauuggauacgacaacuug

SEQ ID NO: 2035493 - RNA, 17 nt, Human
caauauuguacaguuuu

SEQ ID NO: 2035494 - RNA, 18 nt, Human
caauauuguacaguuuuu

SEQ ID NO: 2035495 - RNA, 15 nt, Human
caauauuguacaguu

SEQ ID NO: 2035496 - RNA, 16 nt, Human
caauauuguacaguuu

SEQ ID NO: 2035497 - RNA, 15 nt, Human
auuuauauaaauuuu

SEQ ID NO: 2035498 - RNA, 15 nt, Human
auuuuuuuuguuuca

SEQ ID NO: 2035499 - RNA, 22 nt, Human
cagauauaaaagacugaccaau

SEQ ID NO: 2035500 - RNA, 11 nt, Human
caguuuuccuu

SEQ ID NO: 2035501 - RNA, 15 nt, Human
gcucuggccuccaag

SEQ ID NO: 2035502 - RNA, 17 nt, Human
gcucuggccuccaaguc

SEQ ID NO: 2035503 - RNA, 15 nt, Human
gcugguuuuucaguu

SEQ ID NO: 2035504 - RNA, 14 nt, Human
gcugguuuuucagu

SEQ ID NO: 2035505 - RNA, 17 nt, Human
gcugggauuacagggau

SEQ ID NO: 2035506 - RNA, 13 nt, Human
ggccucccaaagu

SEQ ID NO: 2035507 - RNA, 18 nt, Human
aaaagggaacugaacauu

SEQ ID NO: 2035508 - RNA, 11 nt, Human
aaacuccugac

SEQ ID NO: 2035509 - RNA, 13 nt, Human
aaagcuagaaaug

SEQ ID NO: 2035510 - RNA, 11 nt, Human
gacuguagaaa

SEQ ID NO: 2035511 - RNA, 21 nt, Human
gaagggcuuggacucaagcaa

SEQ ID NO: 2035512 - RNA, 19 nt, Human
gagugcaaugacacagucu

SEQ ID NO: 2035513 - RNA, 18 nt, Human
gauucuccugccucagcc

SEQ ID NO: 2035514 - RNA, 18 nt, Human
gauguaaaagacuuuuuu

SEQ ID NO: 2035515 - RNA, 15 nt, Human
cuuuggugaacauug

SEQ ID NO: 2035516 - RNA, 18 nt, Human
cuuuuaggccaaaaaaau

SEQ ID NO: 2035517 - RNA, 16 nt, Human
cuuuuaggccaaaaaa

SEQ ID NO: 2035518 - RNA, 15 nt, Human
cugcaacuucugccu

SEQ ID NO: 2035519 - RNA, 14 nt, Human
cugcaacuucugcc

SEQ ID NO: 2035520 - RNA, 22 nt, Human
aaauuuccacucaggucuguuu

SEQ ID NO: 2035521 - RNA, 14 nt, Human
aaauuuccacucag

SEQ ID NO: 2035522 - RNA, 15 nt, Human
guaggacuguagaaa

SEQ ID NO: 2035523 - RNA, 17 nt, Human
guagcuggauuacaggc

SEQ ID NO: 2035524 - RNA, 14 nt, Human
aaaugaaagugaga

SEQ ID NO: 2035525 - RNA, 23 nt, Human
aaaugauccccagcuguuuaugc

SEQ ID NO: 2035526 - RNA, 17 nt, Human
aacauugcaauagaaau

SEQ ID NO: 2035527 - RNA, 14 nt, Human
aacauugcaauaga

SEQ ID NO: 2035528 - RNA, 15 nt, Human
aacauugcaauagaa

SEQ ID NO: 2035529 - RNA, 16 nt, Human
aacauugcaauagaaa

SEQ ID NO: 2035530 - RNA, 19 nt, Human
guucuuaguugcuguaugu

SEQ ID NO: 2035531 - RNA, 14 nt, Human
guucuucaucuaag

SEQ ID NO: 2035532 - RNA, 15 nt, Human
aagcaagauuucaga

SEQ ID NO: 2035533 - RNA, 19 nt, Human
guggaaguaguggagcccc

SEQ ID NO: 2035534 - RNA, 15 nt, Human
uacacauuuuucaga

SEQ ID NO: 2035535 - RNA, 17 nt, Human
uacacauuuuucagaua

SEQ ID NO: 2035536 - RNA, 21 nt, Human
uacacauuuuucagauauaaa

SEQ ID NO: 2035537 - RNA, 19 nt, Human
uacacauuuuucagauaua

SEQ ID NO: 2035538 - RNA, 14 nt, Human
aaugugacucaaga

SEQ ID NO: 2035539 - RNA, 21 nt, Human
uaauagcgucauaacuagaac

SEQ ID NO: 2035540 - RNA, 17 nt, Human
uaauaaaaguacauguu

SEQ ID NO: 2035541 - RNA, 13 nt, Human
aauauuguacagu

SEQ ID NO: 2035542 - RNA, 12 nt, Human
aauaacuuuuuu

SEQ ID NO: 2035543 - RNA, 15 nt, Human
aaguuuuguaaauuu

SEQ ID NO: 2035544 - RNA, 13 nt, Human
uacuuuuuccugg

SEQ ID NO: 2035545 - RNA, 21 nt, Human
aauugacuuauuuauauaaau

SEQ ID NO: 2035546 - RNA, 20 nt, Human
acagauguaaaagacuuuuu

SEQ ID NO: 2035547 - RNA, 10 nt, Human
uaguuuuugu

SEQ ID NO: 2035548 - RNA, 14 nt, Human
uauaaaagacugac

SEQ ID NO: 2035549 - RNA, 19 nt, Human
acacagucuuggcucacug

SEQ ID NO: 2035550 - RNA, 18 nt, Human
accaauauuguacaguuu

SEQ ID NO: 2035551 - RNA, 19 nt, Human
accaauauuguacaguuuu

SEQ ID NO: 2035552 - RNA, 15 nt, Human
accaauauuguacag

SEQ ID NO: 2035553 - RNA, 14 nt, Human
accaauauuguaca

SEQ ID NO: 2035554 - RNA, 16 nt, Human
accaauauuguacagu

SEQ ID NO: 2035555 - RNA, 17 nt, Human
accaauauuguacaguu

SEQ ID NO: 2035556 - RNA, 17 nt, Human
ucagaaucucucuucuu

SEQ ID NO: 2035557 - RNA, 16 nt, Human
acccccaaauuuucuu

SEQ ID NO: 2035558 - RNA, 15 nt, Human
ucaagacuuccagag

SEQ ID NO: 2035559 - RNA, 21 nt, Human
acauagcuuacaagccagcug

SEQ ID NO: 2035560 - RNA, 15 nt, Human
acaguuuuuauugcu

SEQ ID NO: 2035561 - RNA, 19 nt, Human
uccaaguccacaguggaac

SEQ ID NO: 2035562 - RNA, 17 nt, Human
uccacucaggucuguuu

SEQ ID NO: 2035563 - RNA, 14 nt, Human
uccagagacuggga

SEQ ID NO: 2035564 - RNA, 15 nt, Human
accuacaguguacag

SEQ ID NO: 2035565 - RNA, 16 nt, Human
accuacaguguacagu

SEQ ID NO: 2035566 - RNA, 17 nt, Human
accuacaguguacaguc

SEQ ID NO: 2035567 - RNA, 18 nt, Human
accuacaguguacagucu

SEQ ID NO: 2035568 - RNA, 20 nt, Human
accuacaguguacagucuug

SEQ ID NO: 2035569 - RNA, 21 nt, Human
uccuuuaauuuuuuacuauuu

SEQ ID NO: 2035570 - RNA, 16 nt, Human
agaaauuuccacucag

SEQ ID NO: 2035571 - RNA, 22 nt, Human
agaaauuuccacucaggucugu

SEQ ID NO: 2035572 - RNA, 15 nt, Human
agacuuccagagccu

SEQ ID NO: 2035573 - RNA, 22 nt, Human
ucuuucugcagaaacagaaagg

SEQ ID NO: 2035574 - RNA, 15 nt, Human
ucuuuaguuuuugug

SEQ ID NO: 2035575 - RNA, 17 nt, Human
ugaccaauauuguacag

SEQ ID NO: 2035576 - RNA, 18 nt, Human
ugaccaauauuguacagu

SEQ ID NO: 2035577 - RNA, 19 nt, Human
ugaccaauauuguacaguu

SEQ ID NO: 2035578 - RNA, 21 nt, Human
ugaccaauauuguacaguuuu

SEQ ID NO: 2035579 - RNA, 16 nt, Human
agcauuugucaacaaa

SEQ ID NO: 2035580 - RNA, 21 nt, Human
aggaccuguggccaaguucuu

SEQ ID NO: 2035581 - RNA, 17 nt, Human
uggagugcaaugacaca

SEQ ID NO: 2035582 - RNA, 13 nt, Human
agcuguuuaugca

SEQ ID NO: 2035583 - RNA, 15 nt, Human
agcuuacaagccagc

SEQ ID NO: 2035584 - RNA, 17 nt, Human
agcuuacaagccagcug

SEQ ID NO: 2035585 - RNA, 19 nt, Human
agcuuacaagccagcugga

SEQ ID NO: 2035586 - RNA, 18 nt, Human
uguaugucucgugguagg

SEQ ID NO: 2035587 - RNA, 23 nt, Human
uguagaaaagggaacugaacauu

SEQ ID NO: 2035588 - RNA, 18 nt, Human
uguagaaaagggaacuga

SEQ ID NO: 2035589 - RNA, 19 nt, Human
uguagaaaagggaacugaa

SEQ ID NO: 2035590 - RNA, 20 nt, Human
uguagaaaagggaacugaac

SEQ ID NO: 2035591 - RNA, 21 nt, Human
uguagaaaagggaacugaaca

SEQ ID NO: 2035592 - RNA, 14 nt, Human
aguacauguuaaac

SEQ ID NO: 2035593 - RNA, 13 nt, Human
uuaauaaagacag

SEQ ID NO: 2035594 - RNA, 14 nt, Human
uuaauaaagacagg

SEQ ID NO: 2035595 - RNA, 22 nt, Human
uuaaguuacacauuuuucagau

SEQ ID NO: 2035596 - RNA, 15 nt, Human
auaaaaguacauguu

SEQ ID NO: 2035597 - RNA, 21 nt, Human
auaaaaguacauguuaaacuu

SEQ ID NO: 2035598 - RNA, 19 nt, Human
auaacuagaacugaauuuu

SEQ ID NO: 2035599 - RNA, 12 nt, Human
auaaauaacuuu

SEQ ID NO: 2035600 - RNA, 14 nt, Human
auaaauaacuuuuu

SEQ ID NO: 2035601 - RNA, 20 nt, Human
aguucuuaguugcuguaugu

SEQ ID NO: 2035602 - RNA, 21 nt, Human
aguucuuaguugcuguauguc

SEQ ID NO: 2035603 - RNA, 15 nt, Human
uuaaauuucuaccgc

SEQ ID NO: 2035604 - RNA, 16 nt, Human
aguucuuaguugcugu

SEQ ID NO: 2035605 - RNA, 17 nt, Human
aguggaaguaguggagc

SEQ ID NO: 2035606 - RNA, 15 nt, Human
ugucuuguguuucuu

SEQ ID NO: 2035607 - RNA, 22 nt, Human
agucuuguauuaaguuguuaau

SEQ ID NO: 2035608 - RNA, 15 nt, Human
agucuuggcucacug

SEQ ID NO: 2035609 - RNA, 16 nt, Human
agucuuguauuaaguu

SEQ ID NO: 2035610 - RNA, 18 nt, Human
agucuuguauuaaguugu

SEQ ID NO: 2035611 - RNA, 18 nt, Human
uguggccaaguucuuagu

SEQ ID NO: 2035612 - RNA, 20 nt, Human
auauuuguauuuaaaugaaa

SEQ ID NO: 2035613 - RNA, 13 nt, Human
auauugaugugug

SEQ ID NO: 2035614 - RNA, 14 nt, Human
aucacguaaagcua

SEQ ID NO: 2035615 - RNA, 21 nt, Human
aucacguaaagcuagaaauga

SEQ ID NO: 2035616 - RNA, 20 nt, Human
uuccuguucuuaagacguga

SEQ ID NO: 2035617 - RNA, 20 nt, Human
auagcgucauaacuagaacu

SEQ ID NO: 2035618 - RNA, 18 nt, Human
auagcgucauaacuagaa

SEQ ID NO: 2035619 - RNA, 20 nt, Human
uucaagugauucuccugccu

SEQ ID NO: 2035620 - RNA, 22 nt, Human
auagcuuacaagccagcuggag

SEQ ID NO: 2035621 - RNA, 23 nt, Human
uucagcaccuacaguguacaguc

SEQ ID NO: 2035622 - RNA, 22 nt, Human
uucagcaccuacaguguacagu

SEQ ID NO: 2035623 - RNA, 17 nt, Human
auauaaauuuuuuuugu

SEQ ID NO: 2035624 - RNA, 22 nt, Human
auauaaauuuuuuuuguuucau

SEQ ID NO: 2035625 - RNA, 14 nt, Human
uuguaaauuucucu

SEQ ID NO: 2035626 - RNA, 16 nt, Human
augaaagugagacuuu

SEQ ID NO: 2035627 - RNA, 22 nt, Human
aucucuuuguucuaaagaugga

SEQ ID NO: 2035628 - RNA, 22 nt, Human
uugcaauagaaauccaauugga

SEQ ID NO: 2035629 - RNA, 15 nt, Human
uugcaauagaaaucc

SEQ ID NO: 2035630 - RNA, 20 nt, Human
uuuacccuucuuuucugacu

SEQ ID NO: 2035631 - RNA, 13 nt, Human
uuuaaaugaaagu

SEQ ID NO: 2035632 - RNA, 21 nt, Human
uuuaaaugaaagugagacuuu

SEQ ID NO: 2035633 - RNA, 13 nt, Human
auuaaguuguuaa

SEQ ID NO: 2035634 - RNA, 21 nt, Human
uuuugugaaguuuaauugacu

SEQ ID NO: 2035635 - RNA, 13 nt, Human
uuuguuucauauu

SEQ ID NO: 2035636 - RNA, 19 nt, Human
caccauguuggccaggcug

SEQ ID NO: 2035637 - RNA, 18 nt, Human
caaagugguauagaaaug

SEQ ID NO: 2035638 - RNA, 19 nt, Human
caaagugguauagaaaugc

SEQ ID NO: 2035639 - RNA, 17 nt, Human
caaauauuccagagacu

SEQ ID NO: 2035640 - RNA, 13 nt, Human
caaauauuccaga

SEQ ID NO: 2035641 - RNA, 19 nt, Human
caaagcccaaagugguaua

SEQ ID NO: 2035642 - RNA, 17 nt, Human
caaagcccaaaguggua

SEQ ID NO: 2035643 - RNA, 20 nt, Human
caagugauucuccugccuca

SEQ ID NO: 2035644 - RNA, 18 nt, Human
cauuuuucagauauaaaa

SEQ ID NO: 2035645 - RNA, 20 nt, Human
cauuuuucagauauaaaaga

SEQ ID NO: 2035646 - RNA, 17 nt, Human
ccaaauuuucuuuuuau

SEQ ID NO: 2035647 - RNA, 20 nt, Human
ccacaguggaaccagcccag

SEQ ID NO: 2035648 - RNA, 11 nt, Human
ccacucagguc

SEQ ID NO: 2035649 - RNA, 16 nt, Human
ccacucaggucuguuu

SEQ ID NO: 2035650 - RNA, 24 nt, Human
ccagcuggagaaauaugguacuca

SEQ ID NO: 2035651 - RNA, 14 nt, Human
cggccucccaaagu

SEQ ID NO: 2035652 - RNA, 14 nt, Human
cgucauaacuagaa

SEQ ID NO: 2035653 - RNA, 16 nt, Human
cgucauaacuagaacu

SEQ ID NO: 2035654 - RNA, 17 nt, Human
cgucauaacuagaacug

SEQ ID NO: 2035655 - RNA, 12 nt, Human
cguucucugccu

SEQ ID NO: 2035656 - RNA, 20 nt, Human
ccuguggccaaguucuuagu

SEQ ID NO: 2035657 - RNA, 18 nt, Human
cuggucucaaacuccuga

SEQ ID NO: 2035658 - RNA, 21 nt, Human
cuccugaguagcuggauuaca

SEQ ID NO: 2035659 - RNA, 17 nt, Human
cucgagguuucucaaag

SEQ ID NO: 2035660 - RNA, 15 nt, Human
cucaggucuguuuuc

SEQ ID NO: 2035661 - RNA, 24 nt, Human
cuccauucccguggaacguuuuuc

SEQ ID NO: 2035662 - RNA, 21 nt, Human
cucuccauucccguggaacgu

SEQ ID NO: 2035663 - RNA, 14 nt, Human
cuuacuuaguguua

SEQ ID NO: 2035664 - RNA, 15 nt, Human
cuuucugcagaaaca

SEQ ID NO: 2035665 - RNA, 18 nt, Human
gaaaagggaacugaacau

SEQ ID NO: 2035666 - RNA, 17 nt, Human
gaccaauauuguacagu

SEQ ID NO: 2035667 - RNA, 18 nt, Human
gaccaauauuguacaguu

SEQ ID NO: 2035668 - RNA, 19 nt, Human
gaccaauauuguacaguuu

SEQ ID NO: 2035669 - RNA, 21 nt, Human
gaccaauauuguacaguuuuu

SEQ ID NO: 2035670 - RNA, 21 nt, Human
gacugaccaauauuguacagu

SEQ ID NO: 2035671 - RNA, 22 nt, Human
gacugaccaauauuguacaguu

SEQ ID NO: 2035672 - RNA, 16 nt, Human
gacuuauuuauauaaa

SEQ ID NO: 2035673 - RNA, 19 nt, Human
gaccuguggccaaguucuu

SEQ ID NO: 2035674 - RNA, 17 nt, Human
gacgugauuuugcugua

SEQ ID NO: 2035675 - RNA, 16 nt, Human
gacgugauuuugcugu

SEQ ID NO: 2035676 - RNA, 12 nt, Human
gaacguuuuucc

SEQ ID NO: 2035677 - RNA, 15 nt, Human
gaacguuuuuccugu

SEQ ID NO: 2035678 - RNA, 13 nt, Human
gaacauugcaaua

SEQ ID NO: 2035679 - RNA, 15 nt, Human
gaacauugcaauaga

SEQ ID NO: 2035680 - RNA, 17 nt, Human
gaacauugcaauagaaa

SEQ ID NO: 2035681 - RNA, 23 nt, Human
gaaguaguggagccccugcucug

SEQ ID NO: 2035682 - RNA, 18 nt, Human
gauauaaaagacugacca

SEQ ID NO: 2035683 - RNA, 19 nt, Human
gcccaaagugguauagaaa

SEQ ID NO: 2035684 - RNA, 12 nt, Human
gccgggguggau

SEQ ID NO: 2035685 - RNA, 17 nt, Human
ggucucaaacuccugac

SEQ ID NO: 2035686 - RNA, 19 nt, Human
ggaaaaaccacccccaaau

SEQ ID NO: 2035687 - RNA, 16 nt, Human
gcuggauuacaggcau

SEQ ID NO: 2035688 - RNA, 12 nt, Human
ggccaaguucuu

SEQ ID NO: 2035689 - RNA, 17 nt, Human
uauaaauuuuuuuuguu

SEQ ID NO: 2035690 - RNA, 21 nt, Human
uauaaauuuuuuuuguuucau

SEQ ID NO: 2035691 - RNA, 22 nt, Human
uauccugcuucugauaugcagu

SEQ ID NO: 2035692 - RNA, 13 nt, Human
uacaguguacagu

SEQ ID NO: 2035693 - RNA, 22 nt, Human
uacaguguacagucuuguauua

SEQ ID NO: 2035694 - RNA, 15 nt, Human
uacaguguacagucu

SEQ ID NO: 2035695 - RNA, 16 nt, Human
uacaguguacagucuu

SEQ ID NO: 2035696 - RNA, 21 nt, Human
uacauuuuguauauuuguauu

SEQ ID NO: 2035697 - RNA, 14 nt, Human
uacgacaacuugca

SEQ ID NO: 2035698 - RNA, 15 nt, Human
uacgacaacuugcac

SEQ ID NO: 2035699 - RNA, 15 nt, Human
uagaaagaagaugaa

SEQ ID NO: 2035700 - RNA, 13 nt, Human
uaauaaagacagg

SEQ ID NO: 2035701 - RNA, 18 nt, Human
uaagaucguucucugccu

SEQ ID NO: 2035702 - RNA, 14 nt, Human
uaaagcuagaaaug

SEQ ID NO: 2035703 - RNA, 15 nt, Human
uaaagcuagaaauga

SEQ ID NO: 2035704 - RNA, 12 nt, Human
guuuuucaguuu

SEQ ID NO: 2035705 - RNA, 15 nt, Human
ucaaaaacauucuua

SEQ ID NO: 2035706 - RNA, 15 nt, Human
uccccagcuguuuau

SEQ ID NO: 2035707 - RNA, 14 nt, Human
uccccagcuguuua

SEQ ID NO: 2035708 - RNA, 21 nt, Human
ucccaaagugcugggauuaca

SEQ ID NO: 2035709 - RNA, 17 nt, Human
ucucuuuguucuaaaga

SEQ ID NO: 2035710 - RNA, 21 nt, Human
ucucuacugucucaguuuaca

SEQ ID NO: 2035711 - RNA, 14 nt, Human
ucucaaacuccuga

SEQ ID NO: 2035712 - RNA, 17 nt, Human
ucucaaagaaauuucca

SEQ ID NO: 2035713 - RNA, 13 nt, Human
ugaacauuccaga

SEQ ID NO: 2035714 - RNA, 14 nt, Human
ugaacauuccagag

SEQ ID NO: 2035715 - RNA, 15 nt, Human
ugaacauugcaauag

SEQ ID NO: 2035716 - RNA, 17 nt, Human
ugaacauugcaauagaa

SEQ ID NO: 2035717 - RNA, 16 nt, Human
ucuuuuuauacuauua

SEQ ID NO: 2035718 - RNA, 16 nt, Human
ucuuguauuaaguugu

SEQ ID NO: 2035719 - RNA, 18 nt, Human
ucuuguauuaaguuguua

SEQ ID NO: 2035720 - RNA, 22 nt, Human
ucuuguauuaaguuguuaauaa

SEQ ID NO: 2035721 - RNA, 20 nt, Human
uggaaaaaccacccccaaau

SEQ ID NO: 2035722 - RNA, 14 nt, Human
ugcuuguuggauuu

SEQ ID NO: 2035723 - RNA, 19 nt, Human
uggauacgacaacuugcac

SEQ ID NO: 2035724 - RNA, 14 nt, Human
uguuggccaggcug

SEQ ID NO: 2035725 - RNA, 20 nt, Human
uguuggauuuuugucuugug

SEQ ID NO: 2035726 - RNA, 17 nt, Human
uguuggauuuuugucuu

SEQ ID NO: 2035727 - RNA, 15 nt, Human
uguauuuaaaugaaa

SEQ ID NO: 2035728 - RNA, 17 nt, Human
uguacagucuuguauua

SEQ ID NO: 2035729 - RNA, 14 nt, Human
uguacagucuugua

SEQ ID NO: 2035730 - RNA, 15 nt, Human
uguacagucuuguau

SEQ ID NO: 2035731 - RNA, 12 nt, Human
uguacagucuug

SEQ ID NO: 2035732 - RNA, 17 nt, Human
ugguaggacuguagaaa

SEQ ID NO: 2035733 - RNA, 18 nt, Human
ugguaggacuguagaaaa

SEQ ID NO: 2035734 - RNA, 16 nt, Human
uuguacaguuuuuauu

SEQ ID NO: 2035735 - RNA, 12 nt, Human
uuguacaguuuu

SEQ ID NO: 2035736 - RNA, 13 nt, Human
uuguacaguuuuu

SEQ ID NO: 2035737 - RNA, 18 nt, Human
uuggauuuuugucuugug

SEQ ID NO: 2035738 - RNA, 20 nt, Human
uugcuguagaagauggcacu

SEQ ID NO: 2035739 - RNA, 13 nt, Human
uucucaaagaaau

SEQ ID NO: 2035740 - RNA, 15 nt, Human
uucucaaagaaauuu

SEQ ID NO: 2035741 - RNA, 19 nt, Human
uucucaaagaaauuuccac

SEQ ID NO: 2035742 - RNA, 20 nt, Human
uucucaaagaaauuuccacu

SEQ ID NO: 2035743 - RNA, 13 nt, Human
uucuaaagaugga

SEQ ID NO: 2035744 - RNA, 12 nt, Human
uucaguuuucag

SEQ ID NO: 2035745 - RNA, 13 nt, Human
uuuauugcuuguu

SEQ ID NO: 2035746 - RNA, 23 nt, Human
uuguauuuaaaugaaagugagac

SEQ ID NO: 2035747 - RNA, 19 nt, Human
ugaggaauuucuguucuuc

SEQ ID NO: 2035748 - RNA, 15 nt, Human
ucaaaugagaaaaug

SEQ ID NO: 2035749 - RNA, 22 nt, Human
guaaauucucuauuuuuuguaa

SEQ ID NO: 2035750 - RNA, 17 nt, Human
gcucuguugcccaggcu

SEQ ID NO: 2035751 - RNA, 18 nt, Human
uuugaugcuucuuugaaa

SEQ ID NO: 2035752 - RNA, 19 nt, Human
uucauaucacacuguuaaa

SEQ ID NO: 2035753 - RNA, 14 nt, Human
uuacauuuuguaua

SEQ ID NO: 2035754 - RNA, 22 nt, Human
uuuaaaaaauggacucuugaaa

SEQ ID NO: 2035755 - RNA, 13 nt, Human
ugcaauagaaauc

SEQ ID NO: 2035756 - RNA, 18 nt, Human
ucuggaaguuuguuuaaa

SEQ ID NO: 2035757 - RNA, 20 nt, Human
guauauuuguauuuaaauga

SEQ ID NO: 2035758 - RNA, 20 nt, Human
uaaaauuguacauuuggaga

SEQ ID NO: 2035759 - RNA, 23 nt, Human
uaaauguuccuuuccuuuguagu

SEQ ID NO: 2035760 - RNA, 17 nt, Human
gccaccgcgcccagccu

SEQ ID NO: 2035761 - RNA, 17 nt, Human
uuauauuuucuuuguaa

SEQ ID NO: 2035762 - RNA, 19 nt, Human
uuaaagaaaaguuuuguaa

SEQ ID NO: 2035763 - RNA, 16 nt, Human
uggaaauagugauuuc

SEQ ID NO: 2035764 - RNA, 12 nt, Human
auuuauauaaau

SEQ ID NO: 2035765 - RNA, 18 nt, Human
aguauccugcuucugaua

SEQ ID NO: 2035766 - RNA, 18 nt, Human
auuaucuaaaaucugcua

SEQ ID NO: 2035767 - RNA, 14 nt, Human
agugguauagaaau

SEQ ID NO: 2035768 - RNA, 21 nt, Human
gaaaaugucuuuauuaaaugu

SEQ ID NO: 2035769 - RNA, 19 nt, Human
gauaaugguguuuuuuaga

SEQ ID NO: 2035770 - RNA, 12 nt, Human herpesvirus 6
uuuuaauuccaa

SEQ ID NO: 2035771 - RNA, 19 nt, Human herpesvirus 6
aacaaaaagcuuuaaagca

SEQ ID NO: 2035772 - RNA, 16 nt, Human herpesvirus 6
uuaaaccucuguagau

SEQ ID NO: 2035773 - RNA, 24 nt, Human herpesvirus 6
agcagucugcuggaugcugaugaa

SEQ ID NO: 2035774 - RNA, 14 nt, Human herpesvirus 6
aggauaagaugauu

SEQ ID NO: 2035775 - RNA, 11 nt, Human herpesvirus 6
agcagaugcuu

SEQ ID NO: 2035776 - RNA, 22 nt, Human herpesvirus 6
uaaaauccacgaacguagacag

SEQ ID NO: 2035777 - RNA, 21 nt, Human herpesvirus 6
gcccuaucuccgauaacgaaa

SEQ ID NO: 2035778 - RNA, 14 nt, Human herpesvirus 6
gucugcaaaaaugu

SEQ ID NO: 2035779 - RNA, 14 nt, Human herpesvirus 6
uaaaugugaacauu

SEQ ID NO: 2035780 - RNA, 16 nt, Human herpesvirus 6
ugucggccgugaugca

SEQ ID NO: 2035781 - RNA, 21 nt, Human herpesvirus 6
cgccaagaaaaagaaauuaau

SEQ ID NO: 2035782 - RNA, 21 nt, Human herpesvirus 6
agcauacagauguguauuaug

SEQ ID NO: 2035783 - RNA, 17 nt, Human herpesvirus 6
uggcaaacguaugcagu

SEQ ID NO: 2035784 - RNA, 16 nt, Human herpesvirus 6
aaaacucgcaccucug

SEQ ID NO: 2035785 - RNA, 22 nt, Human herpesvirus 6
cugauuccuucaauguucuuca

SEQ ID NO: 2035786 - RNA, 18 nt, Human herpesvirus 6
uuugaauaacaaacuaua

SEQ ID NO: 2035787 - RNA, 20 nt, Human herpesvirus 6
caaauguaacuuuuuguauu

SEQ ID NO: 2035788 - RNA, 17 nt, Human herpesvirus 6
gcaacucaucaaauccu

SEQ ID NO: 2035789 - RNA, 21 nt, Human herpesvirus 6
guuccuccgcgggaccuggcg

SEQ ID NO: 2035790 - RNA, 15 nt, Human herpesvirus 6
uaugaaugagauguu

SEQ ID NO: 2035791 - RNA, 17 nt, Human herpesvirus 6
gacgucauguguggaca

SEQ ID NO: 2035792 - RNA, 14 nt, Human herpesvirus 6
ucuuauauuucaga

SEQ ID NO: 2035793 - RNA, 14 nt, Human herpesvirus 6
ggaaaccaccggcu

SEQ ID NO: 2035794 - RNA, 20 nt, Human herpesvirus 6
uuuaguaugggugagugcau

SEQ ID NO: 2035795 - RNA, 22 nt, Human herpesvirus 6
gcgcaauucuucucuacaucga

SEQ ID NO: 2035796 - RNA, 13 nt, Human herpesvirus 6
gaucauuauauca

SEQ ID NO: 2035797 - RNA, 16 nt, Human herpesvirus 6
agaaucugcagauuuu

SEQ ID NO: 2035798 - RNA, 20 nt, Human herpesvirus 6
caggaucguccccuuggcuc

SEQ ID NO: 2035799 - RNA, 16 nt, Human herpesvirus 6
gaggacggugagaaga

SEQ ID NO: 2035800 - RNA, 22 nt, Human herpesvirus 6
auucauauuauauuuaaaugaa

SEQ ID NO: 2035801 - RNA, 21 nt, Human herpesvirus 6
auacagauguguauuauguaa

SEQ ID NO: 2035802 - RNA, 14 nt, Human herpesvirus 6
uugccuuguaaauc

SEQ ID NO: 2035803 - RNA, 14 nt, Human herpesvirus 6
cuucgacuucaaac

SEQ ID NO: 2035804 - RNA, 22 nt, Human herpesvirus 6
gcggcaaccgcaguuccuguuu

SEQ ID NO: 2035805 - RNA, 17 nt, Human herpesvirus 6
uugcuaguuguaugacu

SEQ ID NO: 2035806 - RNA, 22 nt, Human herpesvirus 6
cccauccaccuucccucccacc

SEQ ID NO: 2035807 - RNA, 14 nt, Human herpesvirus 6
aauguguuuuucuu

SEQ ID NO: 2035808 - RNA, 13 nt, Human herpesvirus 6
cacaaaaacaggg

SEQ ID NO: 2035809 - RNA, 13 nt, Human herpesvirus 6
aguuaugugcugu

SEQ ID NO: 2035810 - RNA, 16 nt, Human herpesvirus 6
uugugcgucagcuuug

SEQ ID NO: 2035811 - RNA, 20 nt, Human herpesvirus 6
augcuuuuuaaaaaaacacu

SEQ ID NO: 2035812 - RNA, 11 nt, Human herpesvirus 6
cacccaucucc

SEQ ID NO: 2035813 - RNA, 20 nt, Human herpesvirus 6
ugggauguccauuucuucga

SEQ ID NO: 2035814 - RNA, 12 nt, Human herpesvirus 6
aauaacagauga

SEQ ID NO: 2035815 - RNA, 19 nt, Human herpesvirus 6
uucagaagagaugaaagac

SEQ ID NO: 2035816 - RNA, 17 nt, Human herpesvirus 6
ugaacgcacuggacauc

SEQ ID NO: 2035817 - RNA, 23 nt, Human herpesvirus 6
uuacaucaacuauuuaacaucca

SEQ ID NO: 2035818 - RNA, 22 nt, Human herpesvirus 6
gucgucgccuccccgggugcuc

SEQ ID NO: 2035819 - RNA, 14 nt, Human herpesvirus 6
auuguaaaagggaa

SEQ ID NO: 2035820 - RNA, 12 nt, Human herpesvirus 6
uaacaacaacaa

SEQ ID NO: 2035821 - RNA, 16 nt, Human herpesvirus 6
aaugcaauuuaaaaga

SEQ ID NO: 2035822 - RNA, 16 nt, Human herpesvirus 6
cuacugcacuuucgau

SEQ ID NO: 2035823 - RNA, 20 nt, Human herpesvirus 6
uucuuuggagaugauuccaa

SEQ ID NO: 2035824 - RNA, 14 nt, Human herpesvirus 6
cacgcccccaccuc

SEQ ID NO: 2035825 - RNA, 11 nt, Human herpesvirus 6
ugauuaacaaa

SEQ ID NO: 2035826 - RNA, 15 nt, Human herpesvirus 6
aaggacuaucugaga

SEQ ID NO: 2035827 - RNA, 14 nt, Human herpesvirus 6
ucagaauccaccaa

SEQ ID NO: 2035828 - RNA, 14 nt, Human herpesvirus 6
cuauagucaauguu

SEQ ID NO: 2035829 - RNA, 17 nt, Human herpesvirus 6
uuuuaguuuuuagagaa

SEQ ID NO: 2035830 - RNA, 14 nt, Human herpesvirus 6
gauucuuuaaagau

SEQ ID NO: 2035831 - RNA, 17 nt, Human herpesvirus 6
gaaaauguuuuucauaa

SEQ ID NO: 2035832 - RNA, 21 nt, Human herpesvirus 6
cuucaacauaucacuuguauu

SEQ ID NO: 2035833 - RNA, 19 nt, Human herpesvirus 6
aggugucucaaccuucauu

SEQ ID NO: 2035834 - RNA, 23 nt, Human herpesvirus 6
aauucucuggaugcuuuuagaug

SEQ ID NO: 2035835 - RNA, 20 nt, Human herpesvirus 6
gcugcgcugauccugacugg

SEQ ID NO: 2035836 - RNA, 12 nt, Human herpesvirus 6
gaugaaauugug

SEQ ID NO: 2035837 - RNA, 12 nt, Human herpesvirus 6
aguauugaagaa

SEQ ID NO: 2035838 - RNA, 16 nt, Human herpesvirus 6
cuguuuuucucauaaa

SEQ ID NO: 2035839 - RNA, 19 nt, Human herpesvirus 6
aaaacacagacggauucaa

SEQ ID NO: 2035840 - RNA, 14 nt, Human herpesvirus 6
ucccuaauaaaugu

SEQ ID NO: 2035841 - RNA, 18 nt, Human herpesvirus 6
guggucaugaucugcuug

SEQ ID NO: 2035842 - RNA, 19 nt, Human herpesvirus 6
agagcgagucuugugugaa

SEQ ID NO: 2035843 - RNA, 12 nt, Human herpesvirus 6
cccuguccccuc

SEQ ID NO: 2035844 - RNA, 20 nt, Human herpesvirus 6
gguaccgcgguuggggucuu

SEQ ID NO: 2035845 - RNA, 20 nt, Human herpesvirus 6
caucgguggcagaggggaag

SEQ ID NO: 2035846 - RNA, 13 nt, Human herpesvirus 6
guucguuaaaaac

SEQ ID NO: 2035847 - RNA, 14 nt, Human herpesvirus 6
aaagcacauaaggc

SEQ ID NO: 2035848 - RNA, 22 nt, Human herpesvirus 6
ucuauccaugaaacucuuugaa

SEQ ID NO: 2035849 - RNA, 15 nt, Human herpesvirus 6
ucagauuuggagaaa

SEQ ID NO: 2035850 - RNA, 22 nt, Human herpesvirus 6
gucuauaacgagucgaagagag

SEQ ID NO: 2035851 - RNA, 18 nt, Human herpesvirus 6
acugcgaauccgucuccg

SEQ ID NO: 2035852 - RNA, 21 nt, Human herpesvirus 6
aauuucuaaccauuuugaaaa

SEQ ID NO: 2035853 - RNA, 14 nt, Human herpesvirus 6
uuccugcccaggcg

SEQ ID NO: 2035854 - RNA, 16 nt, Human herpesvirus 6
accgcagcagcuagau

SEQ ID NO: 2035855 - RNA, 15 nt, Human herpesvirus 6
caggcgaacgaaaac

SEQ ID NO: 2035856 - RNA, 21 nt, Human herpesvirus 6
gaacuuuguccuuacaaaucu

SEQ ID NO: 2035857 - RNA, 23 nt, Human herpesvirus 6
cacccuacaaucuguccagcuug

SEQ ID NO: 2035858 - RNA, 22 nt, Human herpesvirus 6
uccaacggccuuucuguuuuaa

SEQ ID NO: 2035859 - RNA, 13 nt, Human herpesvirus 6
uccuauugguuug

SEQ ID NO: 2035860 - RNA, 14 nt, Human herpesvirus 6
cgcaguggacggcg

SEQ ID NO: 2035861 - RNA, 20 nt, Human herpesvirus 6
ugugauuccuucggggacag

SEQ ID NO: 2035862 - RNA, 13 nt, Human herpesvirus 6
gucgcucuuucua

SEQ ID NO: 2035863 - RNA, 24 nt, Human herpesvirus 6
ggcagcugcaugguccacagaugu

SEQ ID NO: 2035864 - RNA, 20 nt, Human herpesvirus 6
cccaggcaaacgagaacucu

SEQ ID NO: 2035865 - RNA, 20 nt, Human herpesvirus 6
ugauggguuuggccaugccg

SEQ ID NO: 2035866 - RNA, 21 nt, Human herpesvirus 6
uucucugacuauuucaaaaga

SEQ ID NO: 2035867 - RNA, 15 nt, Human herpesvirus 6
ugcauuaacccuggg

SEQ ID NO: 2035868 - RNA, 20 nt, Human herpesvirus 6
agggauggcagaucuugaaa

SEQ ID NO: 2035869 - RNA, 22 nt, Human herpesvirus 6
auacgaaccucaugaguguuua

SEQ ID NO: 2035870 - RNA, 15 nt, Human herpesvirus 6
uacggagaacgggca

SEQ ID NO: 2035871 - RNA, 21 nt, Human herpesvirus 6
ggagcggaggggcgcgagaca

SEQ ID NO: 2035872 - RNA, 18 nt, Human herpesvirus 6
guguuaugaucuagcuau

SEQ ID NO: 2035873 - RNA, 11 nt, Human herpesvirus 6
gucuuuccugc

SEQ ID NO: 2035874 - RNA, 20 nt, Human herpesvirus 6
ccacggggauuuaguacagu

SEQ ID NO: 2035875 - RNA, 14 nt, Human herpesvirus 6
cauuuauguuucuu

SEQ ID NO: 2035876 - RNA, 15 nt, Human herpesvirus 6
cggacaaugcagaac

SEQ ID NO: 2035877 - RNA, 15 nt, Human herpesvirus 6
ucgaaacgaaagcug

SEQ ID NO: 2035878 - RNA, 14 nt, Human herpesvirus 6
cgaagugcuucucu

SEQ ID NO: 2035879 - RNA, 18 nt, Human herpesvirus 6
cuccuacuauccgcccuc

SEQ ID NO: 2035880 - RNA, 14 nt, Human herpesvirus 6
uuguacaaacuuuu

SEQ ID NO: 2035881 - RNA, 18 nt, Human herpesvirus 6
aauauauuuauugaaaga

SEQ ID NO: 2035882 - RNA, 18 nt, Human herpesvirus 6
cuggcggacaccgagggc

SEQ ID NO: 2035883 - RNA, 17 nt, Human herpesvirus 6
uggcccuacuacagugg

SEQ ID NO: 2035884 - RNA, 12 nt, Human herpesvirus 6
aauuaauacaaa

SEQ ID NO: 2035885 - RNA, 13 nt, Human herpesvirus 6
cauguugcaguuu

SEQ ID NO: 2035886 - RNA, 13 nt, Human herpesvirus 6
cuaaauacauuca

SEQ ID NO: 2035887 - RNA, 20 nt, Human herpesvirus 6
cgugccuguuuuggugaaca

SEQ ID NO: 2035888 - RNA, 14 nt, Human herpesvirus 6
auuaauaaaucgcu

SEQ ID NO: 2035889 - RNA, 17 nt, Human herpesvirus 6
ggugccaaaggaaacca

SEQ ID NO: 2035890 - RNA, 18 nt, Human herpesvirus 6
uccuccccuguccccucg

SEQ ID NO: 2035891 - RNA, 17 nt, Human herpesvirus 6
cauaacauagaaaaaug

SEQ ID NO: 2035892 - RNA, 13 nt, Human herpesvirus 6
cgcuguccgccug

SEQ ID NO: 2035893 - RNA, 21 nt, Human herpesvirus 6
agcagaacggcgguaacgugg

SEQ ID NO: 2035894 - RNA, 13 nt, Human herpesvirus 6
uauuuccugccca

SEQ ID NO: 2035895 - RNA, 16 nt, Human herpesvirus 6
cccacgguggccuggc

SEQ ID NO: 2035896 - RNA, 13 nt, Human herpesvirus 6
uguguucaagaac

SEQ ID NO: 2035897 - RNA, 15 nt, Human herpesvirus 6
gacgcaaagagacca

SEQ ID NO: 2035898 - RNA, 17 nt, Human herpesvirus 6
aagaaugggauugugau

SEQ ID NO: 2035899 - RNA, 16 nt, Human herpesvirus 6
auaaaauaucccgcgu

SEQ ID NO: 2035900 - RNA, 20 nt, Human herpesvirus 6
uguuugaggcguugugcuga

SEQ ID NO: 2035901 - RNA, 16 nt, Human herpesvirus 6
agauuacggcaacaua

SEQ ID NO: 2035902 - RNA, 11 nt, Human herpesvirus 6
uuucuuuggag

SEQ ID NO: 2035903 - RNA, 21 nt, Human herpesvirus 6
uaaucgauuacaaaacaaucu

SEQ ID NO: 2035904 - RNA, 23 nt, Human herpesvirus 6
acacaccugccuagaauucuccc

SEQ ID NO: 2035905 - RNA, 13 nt, Human herpesvirus 6
ugaacuguuucca

SEQ ID NO: 2035906 - RNA, 16 nt, Human herpesvirus 6
uauuuaacauccaaaa

SEQ ID NO: 2035907 - RNA, 15 nt, Human herpesvirus 6
cgauuugcugguaaa

SEQ ID NO: 2035908 - RNA, 22 nt, Human herpesvirus 6
caucgcgcgcgacgugccaccg

SEQ ID NO: 2035909 - RNA, 23 nt, Human herpesvirus 6
auaaaugguagcuauuaugugaa

SEQ ID NO: 2035910 - RNA, 13 nt, Human herpesvirus 6
ggagggacccaca

SEQ ID NO: 2035911 - RNA, 23 nt, Human herpesvirus 6
acguuauaucuaaagucagagau

SEQ ID NO: 2035912 - RNA, 20 nt, Human herpesvirus 6
cuacaauacgguuugucucg

SEQ ID NO: 2035913 - RNA, 11 nt, Human herpesvirus 6
gugaagaucac

SEQ ID NO: 2035914 - RNA, 16 nt, Human herpesvirus 6
accgucugggacccac

SEQ ID NO: 2035915 - RNA, 13 nt, Human herpesvirus 6
aaaaaaacacuag

SEQ ID NO: 2035916 - RNA, 10 nt, Human herpesvirus 6
cuuuccugcc

SEQ ID NO: 2035917 - RNA, 12 nt, Human herpesvirus 6
cuuuuuguauua

SEQ ID NO: 2035918 - RNA, 23 nt, Human herpesvirus 6
gcagucaguaaugauauaaaaga

SEQ ID NO: 2035919 - RNA, 16 nt, Human herpesvirus 6
cuguaccauugucaac

SEQ ID NO: 2035920 - RNA, 16 nt, Human herpesvirus 6
caguucaacgcugucu

SEQ ID NO: 2035921 - RNA, 15 nt, Human herpesvirus 6
agguguuugcagaug

SEQ ID NO: 2035922 - RNA, 23 nt, Human herpesvirus 6
uuucacgugcacgagaucuguuc

SEQ ID NO: 2035923 - RNA, 22 nt, Human herpesvirus 6
aaacaccgguaagcaucugcug

SEQ ID NO: 2035924 - RNA, 15 nt, Human herpesvirus 6
auauaucaaagaugu

SEQ ID NO: 2035925 - RNA, 19 nt, Human herpesvirus 6
gauugcaacauuuuccucu

SEQ ID NO: 2035926 - RNA, 24 nt, Human herpesvirus 6
ccgucaaaucucgccgaacuagaa

SEQ ID NO: 2035927 - RNA, 19 nt, Human herpesvirus 6
aaagcauuuuuguugugau

SEQ ID NO: 2035928 - RNA, 20 nt, Human herpesvirus 6
gucuccgccuuuucuuauau

SEQ ID NO: 2035929 - RNA, 19 nt, Human herpesvirus 6
caaaacauaucgagccaaa

SEQ ID NO: 2035930 - RNA, 13 nt, Human herpesvirus 6
ggccuggcacggu

SEQ ID NO: 2035931 - RNA, 19 nt, Human herpesvirus 6
uauaauguguuggucauuu

SEQ ID NO: 2035932 - RNA, 18 nt, Human herpesvirus 6
auuguaaauagguaaacu

SEQ ID NO: 2035933 - RNA, 15 nt, Human herpesvirus 6
uucuauguacuuauu

SEQ ID NO: 2035934 - RNA, 15 nt, Human herpesvirus 6
uguaguuuuuaaauc

SEQ ID NO: 2035935 - RNA, 20 nt, Human herpesvirus 6
auaacgauauauaaaaaacu

SEQ ID NO: 2035936 - RNA, 22 nt, Human herpesvirus 6
augagggggagggacccacagg

SEQ ID NO: 2035937 - RNA, 20 nt, Human herpesvirus 6
gggaagaaaauccagcaaug

SEQ ID NO: 2035938 - RNA, 15 nt, Human herpesvirus 6
ucaugauauuccaga

SEQ ID NO: 2035939 - RNA, 20 nt, Human herpesvirus 6
ggcgcgagacagcggacagc

SEQ ID NO: 2035940 - RNA, 11 nt, Human herpesvirus 6
gccaaauguau

SEQ ID NO: 2035941 - RNA, 18 nt, Human herpesvirus 6
ugaagaaccugaaaucug

SEQ ID NO: 2035942 - RNA, 15 nt, Human herpesvirus 6
cuugauguuuccuga

SEQ ID NO: 2035943 - RNA, 18 nt, Human herpesvirus 6
cgacaagaaaauaaaaaa

SEQ ID NO: 2035944 - RNA, 12 nt, Human herpesvirus 6
gaaacaagaaag

SEQ ID NO: 2035945 - RNA, 20 nt, Human herpesvirus 6
auuacucaacauuaaaaaaa

SEQ ID NO: 2035946 - RNA, 22 nt, Human herpesvirus 6
auaacgauagcagcucugcaau

SEQ ID NO: 2035947 - RNA, 23 nt, Human herpesvirus 6
aacaguuuaccuauuuacaaugu

SEQ ID NO: 2035948 - RNA, 17 nt, Human herpesvirus 6
cagagacgguguuuuca

SEQ ID NO: 2035949 - RNA, 21 nt, Human herpesvirus 6
gacucauagauuucauacugu

SEQ ID NO: 2035950 - RNA, 18 nt, Human herpesvirus 6
gauuagaaauuacauaag

SEQ ID NO: 2035951 - RNA, 23 nt, Human herpesvirus 6
cgcgguuggggucuuuccugcac

SEQ ID NO: 2035952 - RNA, 18 nt, Human herpesvirus 6
ugauugugacaaggaaug

SEQ ID NO: 2035953 - RNA, 18 nt, Human herpesvirus 6
aauguuuuugacaaauaa

SEQ ID NO: 2035954 - RNA, 20 nt, Human herpesvirus 6
gacaucgaccgccggaggua

SEQ ID NO: 2035955 - RNA, 12 nt, Human herpesvirus 6
aaagcaaacaug

SEQ ID NO: 2035956 - RNA, 14 nt, Human herpesvirus 6
aucauuguuugaau

SEQ ID NO: 2035957 - RNA, 18 nt, Human herpesvirus 6
cucggauucaaagaaagu

SEQ ID NO: 2035958 - RNA, 16 nt, Human herpesvirus 6
uaguuuuuuuucuuua

SEQ ID NO: 2035959 - RNA, 17 nt, Human herpesvirus 6
auaucuugaaaucuacu

SEQ ID NO: 2035960 - RNA, 12 nt, Human herpesvirus 6
agcuggcugaca

SEQ ID NO: 2035961 - RNA, 22 nt, Human herpesvirus 6
gcuucgcaagacgccacgggca

SEQ ID NO: 2035962 - RNA, 21 nt, Human herpesvirus 6
auacauuccuuaagaaugaaa

SEQ ID NO: 2035963 - RNA, 23 nt, Human herpesvirus 6
gggucguacacgcauuugcaauu

SEQ ID NO: 2035964 - RNA, 13 nt, Human herpesvirus 6
auagaccuugauc

SEQ ID NO: 2035965 - RNA, 21 nt, Human herpesvirus 6
uuuaccaccagucaggaaaaa

SEQ ID NO: 2035966 - RNA, 15 nt, Human herpesvirus 6
acccaugaaaaucau

SEQ ID NO: 2035967 - RNA, 17 nt, Human herpesvirus 6
ucgggagaggaccaaga

SEQ ID NO: 2035968 - RNA, 14 nt, Human herpesvirus 6
auaaaagaaucauu

SEQ ID NO: 2035969 - RNA, 20 nt, Human herpesvirus 6
gaaugucgguaaacuuacca

SEQ ID NO: 2035970 - RNA, 23 nt, Human herpesvirus 6
uucaacauccuauugagauucuc

SEQ ID NO: 2035971 - RNA, 19 nt, Human herpesvirus 6
gacgugccaccgucuggga

SEQ ID NO: 2035972 - RNA, 20 nt, Human herpesvirus 6
cgagaacucuaaaagcugcu

SEQ ID NO: 2035973 - RNA, 13 nt, Human herpesvirus 6
aauaauaaaaagu

SEQ ID NO: 2035974 - RNA, 12 nt, Human herpesvirus 6
acgggaaaagau

SEQ ID NO: 2035975 - RNA, 17 nt, Human herpesvirus 6
ugaaacuccccagagaa

SEQ ID NO: 2035976 - RNA, 20 nt, Human herpesvirus 6
cgagacagcggacagcgggg

SEQ ID NO: 2035977 - RNA, 18 nt, Human herpesvirus 6
ggagaauaggaaaagaua

SEQ ID NO: 2035978 - RNA, 20 nt, Human herpesvirus 6
acguaucccuaauaaauguc

SEQ ID NO: 2035979 - RNA, 23 nt, Human herpesvirus 6
aaaaaguuagcggggagucucca

SEQ ID NO: 2035980 - RNA, 18 nt, Human herpesvirus 6
cagccgguagagaguggg

SEQ ID NO: 2035981 - RNA, 17 nt, Human herpesvirus 6
aacagucugacauggaa

SEQ ID NO: 2035982 - RNA, 19 nt, Human herpesvirus 6
gaaaucuacuguacaaaau

SEQ ID NO: 2035983 - RNA, 16 nt, Human herpesvirus 6
uaacaacaaccacagc

SEQ ID NO: 2035984 - RNA, 15 nt, Human herpesvirus 6
ggugaauguuucuga

SEQ ID NO: 2035985 - RNA, 18 nt, Human herpesvirus 6
aucaacugacuuauaagu

SEQ ID NO: 2035986 - RNA, 22 nt, Human herpesvirus 6
uaccacggggauuuaguacagu

SEQ ID NO: 2035987 - RNA, 15 nt, Human herpesvirus 6
uacauaagcaaaugu

SEQ ID NO: 2035988 - RNA, 14 nt, Human herpesvirus 6
uugcagaucuaauu

SEQ ID NO: 2035989 - RNA, 15 nt, Human herpesvirus 6
acucgacuucuuuca

SEQ ID NO: 2035990 - RNA, 21 nt, Human herpesvirus 6
augaucucacgucacaguuuu

SEQ ID NO: 2035991 - RNA, 13 nt, Human herpesvirus 6
uuaugauuucgga

SEQ ID NO: 2035992 - RNA, 16 nt, Human herpesvirus 6
aggggcgcgagacagc

SEQ ID NO: 2035993 - RNA, 20 nt, Human herpesvirus 6
guuuuaagagcagacaagga

SEQ ID NO: 2035994 - RNA, 16 nt, Human herpesvirus 6
uauaauuaaaauagaa

SEQ ID NO: 2035995 - RNA, 17 nt, Human herpesvirus 6
uuugcgucuucuauauu

SEQ ID NO: 2035996 - RNA, 15 nt, Human herpesvirus 6
acaaauaaaaaauuc

SEQ ID NO: 2035997 - RNA, 15 nt, Human herpesvirus 6
uuuaccgguuuggug

SEQ ID NO: 2035998 - RNA, 14 nt, Human herpesvirus 6
aagauguagcugga

SEQ ID NO: 2035999 - RNA, 20 nt, Human herpesvirus 6
aauuacgcuguccgccuguu

SEQ ID NO: 2036000 - RNA, 10 nt, Human herpesvirus 6
agagaggaaa

SEQ ID NO: 2036001 - RNA, 21 nt, Human herpesvirus 6
auugacuacagcugcaggggu

SEQ ID NO: 2036002 - RNA, 17 nt, Human herpesvirus 6
gcgaauuuguuaagcaa

SEQ ID NO: 2036003 - RNA, 20 nt, Human herpesvirus 6
augagggguaugucugugca

SEQ ID NO: 2036004 - RNA, 19 nt, Human herpesvirus 6
aguccgcugggaauugcau

SEQ ID NO: 2036005 - RNA, 19 nt, Human herpesvirus 6
caaccugaaacuccccaga

SEQ ID NO: 2036006 - RNA, 11 nt, Human herpesvirus 6
cucggaaaauu

SEQ ID NO: 2036007 - RNA, 22 nt, Human herpesvirus 6
aaaacacaaaccaucaauuuua

SEQ ID NO: 2036008 - RNA, 13 nt, Human herpesvirus 6
acauguuaacaau

SEQ ID NO: 2036009 - RNA, 22 nt, Human herpesvirus 6
uuaaugcauucacaaggaaugu

SEQ ID NO: 2036010 - RNA, 18 nt, Human herpesvirus 6
ggacgacgggcggggcgg

SEQ ID NO: 2036011 - RNA, 12 nt, Human herpesvirus 6
gucuuuccugca

SEQ ID NO: 2036012 - RNA, 19 nt, Human herpesvirus 6
guuacauucguauacuucc

SEQ ID NO: 2036013 - RNA, 16 nt, Human herpesvirus 6
ucuccugagaagcugg

SEQ ID NO: 2036014 - RNA, 20 nt, Human herpesvirus 6
aauuugaaauaucagaaaua

SEQ ID NO: 2036015 - RNA, 15 nt, Human herpesvirus 6
acucgugugucuuug

SEQ ID NO: 2036016 - RNA, 18 nt, Human herpesvirus 6
aucgccccugucugugau

SEQ ID NO: 2036017 - RNA, 13 nt, Human herpesvirus 6
uacuacacaaacg

SEQ ID NO: 2036018 - RNA, 15 nt, Human herpesvirus 6
uaaugauauaaaaga

SEQ ID NO: 2036019 - RNA, 16 nt, Human herpesvirus 6
agugcugugcucuuua

SEQ ID NO: 2036020 - RNA, 12 nt, Human herpesvirus 6
accgaucuguga

SEQ ID NO: 2036021 - RNA, 15 nt, Human herpesvirus 6
aauuuuccaaacauu

SEQ ID NO: 2036022 - RNA, 13 nt, Human herpesvirus 6
ccccgcagcuccu

SEQ ID NO: 2036023 - RNA, 13 nt, Human herpesvirus 6
caauacacagaaa

SEQ ID NO: 2036024 - RNA, 22 nt, Human herpesvirus 6
ucacaagcuguccaucuucaga

SEQ ID NO: 2036025 - RNA, 15 nt, Human herpesvirus 6
cauaugucuguuaua

SEQ ID NO: 2036026 - RNA, 17 nt, Human herpesvirus 6
uuuaccuuuggaaaaua

SEQ ID NO: 2036027 - RNA, 14 nt, Human herpesvirus 6
acucaauuuugaaa

SEQ ID NO: 2036028 - RNA, 19 nt, Human herpesvirus 6
uuagccuuuauucuguuuu

SEQ ID NO: 2036029 - RNA, 19 nt, Human herpesvirus 6
ggccuccgccacugcgagg

SEQ ID NO: 2036030 - RNA, 22 nt, Human herpesvirus 6
ugacggcgacaaccgccgccgc

SEQ ID NO: 2036031 - RNA, 14 nt, Human herpesvirus 6
cgcgcgccggugcg

SEQ ID NO: 2036032 - RNA, 21 nt, Human herpesvirus 6
ugcaagccaugacaagaaagg

SEQ ID NO: 2036033 - RNA, 14 nt, Human herpesvirus 6
ggaccuggcggaca

SEQ ID NO: 2036034 - RNA, 23 nt, Human herpesvirus 6
uagacacgcuaaaaacagacgaa

SEQ ID NO: 2036035 - RNA, 17 nt, Human herpesvirus 6
uccgccuuuucuuauau

SEQ ID NO: 2036036 - RNA, 17 nt, Human herpesvirus 6
aucgcgaagccuguccg

SEQ ID NO: 2036037 - RNA, 14 nt, Human herpesvirus 6
acauuaaacacuaa

SEQ ID NO: 2036038 - RNA, 12 nt, Human herpesvirus 6
aacgaaaaagaa

SEQ ID NO: 2036039 - RNA, 21 nt, Human herpesvirus 6
gcacacacaagaacagagaga

SEQ ID NO: 2036040 - RNA, 18 nt, Human herpesvirus 6
cggccggagugccguuga

SEQ ID NO: 2036041 - RNA, 22 nt, Human herpesvirus 6
uaaaccguuuaucgaugugcga

SEQ ID NO: 2036042 - RNA, 16 nt, Human herpesvirus 6
cggaaaacuaaaaguc

SEQ ID NO: 2036043 - RNA, 15 nt, Human herpesvirus 6
aacggcuucaagaau

SEQ ID NO: 2036044 - RNA, 11 nt, Human herpesvirus 6
cguauauugug

SEQ ID NO: 2036045 - RNA, 24 nt, Human herpesvirus 6
caucgcgcgcgacgugccaccguc

SEQ ID NO: 2036046 - RNA, 20 nt, Human herpesvirus 6
caaaguucaguaacauuuaa

SEQ ID NO: 2036047 - RNA, 15 nt, Human herpesvirus 6
acucgacuaaaagac

SEQ ID NO: 2036048 - RNA, 16 nt, Human herpesvirus 6
caacauuuauguuucu

SEQ ID NO: 2036049 - RNA, 18 nt, Human herpesvirus 6
aucaccuuacaaauaaua

SEQ ID NO: 2036050 - RNA, 17 nt, Human herpesvirus 6
uuuuucuucaggugucu

SEQ ID NO: 2036051 - RNA, 19 nt, Human herpesvirus 6
cuugucuuacacucuccac

SEQ ID NO: 2036052 - RNA, 13 nt, Human herpesvirus 6
agggacccacagg

SEQ ID NO: 2036053 - RNA, 16 nt, Human herpesvirus 6
gccaccgucugggacc

SEQ ID NO: 2036054 - RNA, 18 nt, Human herpesvirus 6
gagcacgguccacacgcc

SEQ ID NO: 2036055 - RNA, 22 nt, Human herpesvirus 6
uguaguuuaguaugggugagug

SEQ ID NO: 2036056 - RNA, 14 nt, Human herpesvirus 6
cauaacgauagcag

SEQ ID NO: 2036057 - RNA, 23 nt, Human herpesvirus 6
uauacgaaauaaucgauuacaaa

SEQ ID NO: 2036058 - RNA, 13 nt, Human herpesvirus 6
aggggaagggaau

SEQ ID NO: 2036059 - RNA, 23 nt, Human herpesvirus 6
aguuaggauuacacuuucuugua

SEQ ID NO: 2036060 - RNA, 18 nt, Human herpesvirus 6
gacgcaccuccuuuguau

SEQ ID NO: 2036061 - RNA, 13 nt, Human herpesvirus 6
caucugcaaaaaa

SEQ ID NO: 2036062 - RNA, 22 nt, Human herpesvirus 6
aguguaaaguucucgaauuguu

SEQ ID NO: 2036063 - RNA, 19 nt, Human herpesvirus 6
cugaucacagagcagagag

SEQ ID NO: 2036064 - RNA, 17 nt, Human herpesvirus 6
cagugaaggcugccaug

SEQ ID NO: 2036065 - RNA, 14 nt, Human herpesvirus 6
auguuauguaaaga

SEQ ID NO: 2036066 - RNA, 11 nt, Human herpesvirus 6
uacuaggaaag

SEQ ID NO: 2036067 - RNA, 16 nt, Human herpesvirus 6
cagaagaacagcuaau

SEQ ID NO: 2036068 - RNA, 14 nt, Human herpesvirus 6
cuguugaauuccag

SEQ ID NO: 2036069 - RNA, 12 nt, Human herpesvirus 6
cgcuuuuacuga

SEQ ID NO: 2036070 - RNA, 21 nt, Human herpesvirus 6
agaucgcuuuugaaauugaaa

SEQ ID NO: 2036071 - RNA, 20 nt, Human herpesvirus 6
aaucucgccgaacuagaaaa

SEQ ID NO: 2036072 - RNA, 11 nt, Human herpesvirus 6
ggcgggcagau

SEQ ID NO: 2036073 - RNA, 13 nt, Human herpesvirus 6
uuauuaacuguaa

SEQ ID NO: 2036074 - RNA, 15 nt, Human herpesvirus 6
ccucguuguuucaua

SEQ ID NO: 2036075 - RNA, 13 nt, Human herpesvirus 6
aaaguuuaaagau

SEQ ID NO: 2036076 - RNA, 18 nt, Human herpesvirus 6
aaaguuaagaaaacauga

SEQ ID NO: 2036077 - RNA, 15 nt, Human herpesvirus 6
gguauuuuagauaua

SEQ ID NO: 2036078 - RNA, 13 nt, Human herpesvirus 6
augucuugccucu

SEQ ID NO: 2036079 - RNA, 16 nt, Human herpesvirus 6
ucacaaggaaugugca

SEQ ID NO: 2036080 - RNA, 16 nt, Human herpesvirus 6
gccauauccuagcauu

SEQ ID NO: 2036081 - RNA, 13 nt, Human herpesvirus 6
caaucuuaaauau

SEQ ID NO: 2036082 - RNA, 22 nt, Human herpesvirus 6
aagacguuugcuguuuucacca

SEQ ID NO: 2036083 - RNA, 13 nt, Human herpesvirus 6
cuugaauguuuaa

SEQ ID NO: 2036084 - RNA, 16 nt, Human herpesvirus 6
caauguaauaauugau

SEQ ID NO: 2036085 - RNA, 15 nt, Human herpesvirus 6
cgaaucucaagcaca

SEQ ID NO: 2036086 - RNA, 16 nt, Human herpesvirus 6
ggcgcugauuccugua

SEQ ID NO: 2036087 - RNA, 19 nt, Human herpesvirus 6
gcaaucauuagcauacaga

SEQ ID NO: 2036088 - RNA, 14 nt, Human herpesvirus 6
uaauauacgaaaua

SEQ ID NO: 2036089 - RNA, 21 nt, Human herpesvirus 6
agaugaaaccuagauguaaau

SEQ ID NO: 2036090 - RNA, 16 nt, Human herpesvirus 6
cagcaauguaauaauu

SEQ ID NO: 2036091 - RNA, 16 nt, Human herpesvirus 6
accucugaaacacugu

SEQ ID NO: 2036092 - RNA, 18 nt, Human herpesvirus 6
uuccccacaauaagaaaa

SEQ ID NO: 2036093 - RNA, 15 nt, Human herpesvirus 6
ucacauauaugaugc

SEQ ID NO: 2036094 - RNA, 22 nt, Human herpesvirus 6
cguuccucucucggcugacaac

SEQ ID NO: 2036095 - RNA, 14 nt, Human herpesvirus 6
uguguauuauguaa

SEQ ID NO: 2036096 - RNA, 20 nt, Human herpesvirus 6
gggcuccgcgccguuucaaa

SEQ ID NO: 2036097 - RNA, 21 nt, Human herpesvirus 6
aaaucgcgucguucguuguau

SEQ ID NO: 2036098 - RNA, 15 nt, Human herpesvirus 6
uccaugcgaguagau

SEQ ID NO: 2036099 - RNA, 14 nt, Human herpesvirus 6
cagaaaaaaaucag

SEQ ID NO: 2036100 - RNA, 15 nt, Human herpesvirus 6
agauacauagauuuu

SEQ ID NO: 2036101 - RNA, 12 nt, Human herpesvirus 6
ggaauuucuucc

SEQ ID NO: 2036102 - RNA, 20 nt, Human herpesvirus 6
aagcacugaauuagaauaau

SEQ ID NO: 2036103 - RNA, 13 nt, Human herpesvirus 6
acugaauagguuu

SEQ ID NO: 2036104 - RNA, 14 nt, Human herpesvirus 6
agaucuaauucaca

SEQ ID NO: 2036105 - RNA, 14 nt, Human herpesvirus 6
cagcauguuuucuc

SEQ ID NO: 2036106 - RNA, 20 nt, Human herpesvirus 6
acgggucgggggucugcaaa

SEQ ID NO: 2036107 - RNA, 20 nt, Human herpesvirus 6
gaucuuuacaaaagacacaa

SEQ ID NO: 2036108 - RNA, 23 nt, Human herpesvirus 6
gcagaggggaagggaauaacaga

SEQ ID NO: 2036109 - RNA, 16 nt, Human herpesvirus 6
gcacaucuauguguau

SEQ ID NO: 2036110 - RNA, 23 nt, Human herpesvirus 6
ugggaucuucugcuaauucauag

SEQ ID NO: 2036111 - RNA, 15 nt, Human herpesvirus 6
ggcggauggagcccg

SEQ ID NO: 2036112 - RNA, 18 nt, Human herpesvirus 6
ugcauuaacccuggguga

SEQ ID NO: 2036113 - RNA, 17 nt, Human herpesvirus 6
uuaauaaaggauguuug

SEQ ID NO: 2036114 - RNA, 21 nt, Human herpesvirus 6
ucucugcgccaaccuucuaau

SEQ ID NO: 2036115 - RNA, 14 nt, Human herpesvirus 6
aucauauccugaaa

SEQ ID NO: 2036116 - RNA, 21 nt, Human herpesvirus 6
guuguugaucguguuguggac

SEQ ID NO: 2036117 - RNA, 17 nt, Human herpesvirus 6
guaaacacgaaauugcu

SEQ ID NO: 2036118 - RNA, 19 nt, Human herpesvirus 6
uuacaacccccgauucaga

SEQ ID NO: 2036119 - RNA, 16 nt, Human herpesvirus 6
guguuuuugaugugcc

SEQ ID NO: 2036120 - RNA, 16 nt, Human herpesvirus 6
guugaaguauguacaa

SEQ ID NO: 2036121 - RNA, 11 nt, Human herpesvirus 6
uuuaacauuuu

SEQ ID NO: 2036122 - RNA, 10 nt, Human herpesvirus 6
aauuaaaggu

SEQ ID NO: 2036123 - RNA, 23 nt, Human herpesvirus 6
auguguuuuucuuuuacaggaag

SEQ ID NO: 2036124 - RNA, 20 nt, Human herpesvirus 6
ugaaagacuuaaaauuuaug

SEQ ID NO: 2036125 - RNA, 22 nt, Human herpesvirus 6
gaacaugugacacgauuucuga

SEQ ID NO: 2036126 - RNA, 14 nt, Human herpesvirus 6
ggacggacaggggg

SEQ ID NO: 2036127 - RNA, 19 nt, Human herpesvirus 6
uucacugaccguuguaaga

SEQ ID NO: 2036128 - RNA, 17 nt, Human herpesvirus 6
cggagauuaaaacauca

SEQ ID NO: 2036129 - RNA, 21 nt, Human herpesvirus 6
aggaaaguguguucuuacaau

SEQ ID NO: 2036130 - RNA, 19 nt, Human herpesvirus 6
gcgcgagacagcggacagc

SEQ ID NO: 2036131 - RNA, 16 nt, Human herpesvirus 6
ucuccuauaaauacug

SEQ ID NO: 2036132 - RNA, 20 nt, Human herpesvirus 6
ggacacgcgcaguggacggc

SEQ ID NO: 2036133 - RNA, 15 nt, Human herpesvirus 6
cgcaaauucucucua

SEQ ID NO: 2036134 - RNA, 23 nt, Human herpesvirus 6
uucuggcacaggcauagcagcaa

SEQ ID NO: 2036135 - RNA, 13 nt, Human herpesvirus 6
aaguuucacauau

SEQ ID NO: 2036136 - RNA, 15 nt, Human herpesvirus 6
gcgcgacgugccacc

SEQ ID NO: 2036137 - RNA, 14 nt, Human herpesvirus 6
ugcuugucucacaa

SEQ ID NO: 2036138 - RNA, 21 nt, Human herpesvirus 6
ucuaccgagagauuuacuguu

SEQ ID NO: 2036139 - RNA, 13 nt, Human herpesvirus 6
uuacagauacaua

SEQ ID NO: 2036140 - RNA, 21 nt, Human herpesvirus 6
gauucuuaauucuuaaagcgu

SEQ ID NO: 2036141 - RNA, 17 nt, Human herpesvirus 6
cacucggaagaaaagcu

SEQ ID NO: 2036142 - RNA, 21 nt, Human herpesvirus 6
gcagcuuccacgcgacagauc

SEQ ID NO: 2036143 - RNA, 18 nt, Human herpesvirus 6
caaucgcaaaaacauguu

SEQ ID NO: 2036144 - RNA, 15 nt, Human herpesvirus 6
uuacaauacacagaa

SEQ ID NO: 2036145 - RNA, 22 nt, Human herpesvirus 6
uuccauugucgccucgaaacaa

SEQ ID NO: 2036146 - RNA, 17 nt, Human herpesvirus 6
gagaacucuaaaagcug

SEQ ID NO: 2036147 - RNA, 20 nt, Human herpesvirus 6
uucuuauuuaccuuccugag

SEQ ID NO: 2036148 - RNA, 20 nt, Human herpesvirus 6
gucgagaaccaccagagaca

SEQ ID NO: 2036149 - RNA, 20 nt, Human herpesvirus 6
cuaugcgcuuuuauuucugg

SEQ ID NO: 2036150 - RNA, 17 nt, Human herpesvirus 6
aacaacaucuuaaaaga

SEQ ID NO: 2036151 - RNA, 22 nt, Human herpesvirus 6
uuuaaccauucguuuuauugaa

SEQ ID NO: 2036152 - RNA, 16 nt, Human herpesvirus 6
cacuuagacacggccg

SEQ ID NO: 2036153 - RNA, 15 nt, Human herpesvirus 6
uguguauuauguaaa

SEQ ID NO: 2036154 - RNA, 15 nt, Human herpesvirus 6
aauaauuauccucuc

SEQ ID NO: 2036155 - RNA, 20 nt, Human herpesvirus 6
cgggcagguuaucggaagca

SEQ ID NO: 2036156 - RNA, 15 nt, Human herpesvirus 6
cgcuccuccccuguc

SEQ ID NO: 2036157 - RNA, 23 nt, Human herpesvirus 6
cagaggaagauagcagaauagag

SEQ ID NO: 2036158 - RNA, 14 nt, Human herpesvirus 6
aggcuuaaugaaug

SEQ ID NO: 2036159 - RNA, 18 nt, Human herpesvirus 6
ugaauucucauuugaaag

SEQ ID NO: 2036160 - RNA, 23 nt, Human herpesvirus 6
aggaaaacucgcaccucugaaac

SEQ ID NO: 2036161 - RNA, 20 nt, Human herpesvirus 6
ggcgaugaucucggcgccgg

SEQ ID NO: 2036162 - RNA, 19 nt, Human herpesvirus 6
acgccacgggcauuccucg

SEQ ID NO: 2036163 - RNA, 20 nt, Human herpesvirus 6
uacauguuuguugugaucuu

SEQ ID NO: 2036164 - RNA, 20 nt, Human herpesvirus 6
ucgcuaaguguugacugauc

SEQ ID NO: 2036165 - RNA, 13 nt, Human herpesvirus 6
gauauaaauaugg

SEQ ID NO: 2036166 - RNA, 15 nt, Human herpesvirus 6
aauucuuaccaagaa

SEQ ID NO: 2036167 - RNA, 16 nt, Human herpesvirus 6
ucacguauaccauucc

SEQ ID NO: 2036168 - RNA, 19 nt, Human herpesvirus 6
augcuuugguuucaguagu

SEQ ID NO: 2036169 - RNA, 21 nt, Human herpesvirus 6
uaaggaagauucagagugaau

SEQ ID NO: 2036170 - RNA, 18 nt, Human herpesvirus 6
uguaauaguauugucuga

SEQ ID NO: 2036171 - RNA, 15 nt, Human herpesvirus 6
cggggacggacaggg

SEQ ID NO: 2036172 - RNA, 21 nt, Human herpesvirus 6
aauuauccuauugguuugcau

SEQ ID NO: 2036173 - RNA, 21 nt, Human herpesvirus 6
cagggggaucgacgggcagga

SEQ ID NO: 2036174 - RNA, 19 nt, Human herpesvirus 6
agugauuauggugccucag

SEQ ID NO: 2036175 - RNA, 14 nt, Human herpesvirus 6
cagaacaacagcau

SEQ ID NO: 2036176 - RNA, 18 nt, Human herpesvirus 6
uguccucuuugaauuuua

SEQ ID NO: 2036177 - RNA, 17 nt, Human herpesvirus 6
uaagauaggcaaaccau

SEQ ID NO: 2036178 - RNA, 16 nt, Human herpesvirus 6
cggccauuuaacggaa

SEQ ID NO: 2036179 - RNA, 19 nt, Human herpesvirus 6
ucuguauuuuucuuugcag

SEQ ID NO: 2036180 - RNA, 15 nt, Human herpesvirus 6
ggugccaaaggaaac

SEQ ID NO: 2036181 - RNA, 13 nt, Human herpesvirus 6
gauguuugaagau

SEQ ID NO: 2036182 - RNA, 18 nt, Human herpesvirus 6
cuacguccuuauacacga

SEQ ID NO: 2036183 - RNA, 17 nt, Human herpesvirus 6
ccucuaaacccagaccu

SEQ ID NO: 2036184 - RNA, 18 nt, Human herpesvirus 6
acacgcgcaguggacggc

SEQ ID NO: 2036185 - RNA, 18 nt, Human herpesvirus 6
ugggugaguuuuaucacu

SEQ ID NO: 2036186 - RNA, 20 nt, Human herpesvirus 6
agacucgccgaugaaacugu

SEQ ID NO: 2036187 - RNA, 22 nt, Human herpesvirus 6
gucggacgacgggcggggcgga

SEQ ID NO: 2036188 - RNA, 17 nt, Human herpesvirus 6
ucgugauaacaaugcau

SEQ ID NO: 2036189 - RNA, 23 nt, Human herpesvirus 6
ggagggaugucggucagacagug

SEQ ID NO: 2036190 - RNA, 17 nt, Human herpesvirus 6
aaaccuagauguaaauu

SEQ ID NO: 2036191 - RNA, 22 nt, Human herpesvirus 6
ucagucuucaauaaaaacucaa

SEQ ID NO: 2036192 - RNA, 15 nt, Human herpesvirus 6
accggaaaagagaag

SEQ ID NO: 2036193 - RNA, 18 nt, Human herpesvirus 6
ggacaaaaaaaaaacguc

SEQ ID NO: 2036194 - RNA, 18 nt, Human herpesvirus 6
aaauaaaguuaaauugau

SEQ ID NO: 2036195 - RNA, 19 nt, Human herpesvirus 6
gggcgcgagacagcggaca

SEQ ID NO: 2036196 - RNA, 20 nt, Human herpesvirus 6
ugaccggagaaaaucaugca

SEQ ID NO: 2036197 - RNA, 19 nt, Human herpesvirus 6
acguaucccuaauaaaugu

SEQ ID NO: 2036198 - RNA, 12 nt, Human herpesvirus 6
aaucaugagagc

SEQ ID NO: 2036199 - RNA, 14 nt, Human herpesvirus 6
caagcuaacaagaa

SEQ ID NO: 2036200 - RNA, 11 nt, Human herpesvirus 6
ucugaaagaca

SEQ ID NO: 2036201 - RNA, 22 nt, Human herpesvirus 6
aaagacaucacauuauaagaca

SEQ ID NO: 2036202 - RNA, 20 nt, Human herpesvirus 6
uuguugcuauagauuagaaa

SEQ ID NO: 2036203 - RNA, 19 nt, Human herpesvirus 6
aucuucggauucgcaagcu

SEQ ID NO: 2036204 - RNA, 18 nt, Human herpesvirus 6
uucuccuaccauguugcu

SEQ ID NO: 2036205 - RNA, 15 nt, Human herpesvirus 6
cacgaucuacacacc

SEQ ID NO: 2036206 - RNA, 21 nt, Human herpesvirus 6
uagcaucuuaccuucaaagug

SEQ ID NO: 2036207 - RNA, 21 nt, Human herpesvirus 6
ccgagcggcggauggagcccg

SEQ ID NO: 2036208 - RNA, 17 nt, Human herpesvirus 6
cagagacgacucgcgga

SEQ ID NO: 2036209 - RNA, 19 nt, Human herpesvirus 6
ucuuuugucguuauaaaau

SEQ ID NO: 2036210 - RNA, 20 nt, Human herpesvirus 6
ggcuacgacacgcuggagca

SEQ ID NO: 2036211 - RNA, 19 nt, Human herpesvirus 6
cagggggggucucuguucu

SEQ ID NO: 2036212 - RNA, 14 nt, Human herpesvirus 6
cugaacuguuucca

SEQ ID NO: 2036213 - RNA, 14 nt, Human herpesvirus 6
caucucaaaaaaca

SEQ ID NO: 2036214 - RNA, 19 nt, Human herpesvirus 6
agcuuagcgauuaguuugu

SEQ ID NO: 2036215 - RNA, 23 nt, Human herpesvirus 6
aaauaaaguuuaaagauguguua

SEQ ID NO: 2036216 - RNA, 15 nt, Human herpesvirus 6
cagucugcuggaugc

SEQ ID NO: 2036217 - RNA, 15 nt, Human herpesvirus 6
cauaugcagacugcu

SEQ ID NO: 2036218 - RNA, 13 nt, Human herpesvirus 6
guucaguaacauu

SEQ ID NO: 2036219 - RNA, 20 nt, Human herpesvirus 6
caaauuaauuaagugcgcug

SEQ ID NO: 2036220 - RNA, 17 nt, Human herpesvirus 6
uaucuuuuucuguguuu

SEQ ID NO: 2036221 - RNA, 16 nt, Human herpesvirus 6
cguaagaaaaaaaacg

SEQ ID NO: 2036222 - RNA, 18 nt, Human herpesvirus 6
aaagcugacuauucaggc

SEQ ID NO: 2036223 - RNA, 16 nt, Human herpesvirus 6
gaaauaucagaaauaa

SEQ ID NO: 2036224 - RNA, 14 nt, Human herpesvirus 6
gccacgacgugcug

SEQ ID NO: 2036225 - RNA, 14 nt, Human herpesvirus 6
gucucucagcuggc

SEQ ID NO: 2036226 - RNA, 22 nt, Human herpesvirus 6
ucggaaaauuaaaagucagugg

SEQ ID NO: 2036227 - RNA, 22 nt, Human herpesvirus 6
uucagaccucauauaagaacca

SEQ ID NO: 2036228 - RNA, 12 nt, Human herpesvirus 6
guuguucuugga

SEQ ID NO: 2036229 - RNA, 19 nt, Human herpesvirus 6
uccagugagaacguauaaa

SEQ ID NO: 2036230 - RNA, 16 nt, Human herpesvirus 6
cggcggauggagcccg

SEQ ID NO: 2036231 - RNA, 11 nt, Human herpesvirus 6
aagcaaacaug

SEQ ID NO: 2036232 - RNA, 21 nt, Human herpesvirus 6
gaagaucuuuauggagggaau

SEQ ID NO: 2036233 - RNA, 23 nt, Human herpesvirus 6
cuugaucacaacauaaaaauaca

SEQ ID NO: 2036234 - RNA, 20 nt, Human herpesvirus 6
gcaugucgaacagcuuuuca

SEQ ID NO: 2036235 - RNA, 17 nt, Human herpesvirus 6
uguauugaacuuuguaa

SEQ ID NO: 2036236 - RNA, 18 nt, Human herpesvirus 6
aguacauagaauuucuaa

SEQ ID NO: 2036237 - RNA, 14 nt, Human herpesvirus 6
uagcgauaauuaag

SEQ ID NO: 2036238 - RNA, 14 nt, Human herpesvirus 6
cagggaacuugaug

SEQ ID NO: 2036239 - RNA, 14 nt, Human herpesvirus 6
aaaagcgccugccu

SEQ ID NO: 2036240 - RNA, 14 nt, Human herpesvirus 6
auacagauguguau

SEQ ID NO: 2036241 - RNA, 23 nt, Human herpesvirus 6
acaucaacuauuuaacauccaaa

SEQ ID NO: 2036242 - RNA, 15 nt, Human herpesvirus 6
gaaagccggugaccg

SEQ ID NO: 2036243 - RNA, 12 nt, Human herpesvirus 6
gauuuugugaau

SEQ ID NO: 2036244 - RNA, 15 nt, Human herpesvirus 6
ccuuacggggagcuu

SEQ ID NO: 2036245 - RNA, 17 nt, Human herpesvirus 6
cagaggaagauagcaga

SEQ ID NO: 2036246 - RNA, 14 nt, Human herpesvirus 6
aucgcccugcuccg

SEQ ID NO: 2036247 - RNA, 18 nt, Human herpesvirus 6
aggggagagacauccauu

SEQ ID NO: 2036248 - RNA, 18 nt, Human herpesvirus 6
cuuuuuucggauuuugaa

SEQ ID NO: 2036249 - RNA, 20 nt, Human herpesvirus 6
ucgcacacacaagaacagag

SEQ ID NO: 2036250 - RNA, 17 nt, Human herpesvirus 6
cgguccaaccccuccca

SEQ ID NO: 2036251 - RNA, 20 nt, Human herpesvirus 6
ggccuccgccacugcgaggc

SEQ ID NO: 2036252 - RNA, 13 nt, Human herpesvirus 6
ggccccagagacg

SEQ ID NO: 2036253 - RNA, 23 nt, Human herpesvirus 6
ucaugaucucacgucacaguuuu

SEQ ID NO: 2036254 - RNA, 14 nt, Human herpesvirus 6
cucggaacauaauu

SEQ ID NO: 2036255 - RNA, 18 nt, Human herpesvirus 6
ucggacagcaaggaacaa

SEQ ID NO: 2036256 - RNA, 16 nt, Human herpesvirus 6
aaucuguccagcuugc

SEQ ID NO: 2036257 - RNA, 13 nt, Human herpesvirus 6
cucuguucugcca

SEQ ID NO: 2036258 - RNA, 20 nt, Human herpesvirus 6
agucccaucuauacacccug

SEQ ID NO: 2036259 - RNA, 18 nt, Human herpesvirus 6
aagucacgggcagcugca

SEQ ID NO: 2036260 - RNA, 20 nt, Human herpesvirus 6
ucgauuugcugguaaauuuu

SEQ ID NO: 2036261 - RNA, 18 nt, Human herpesvirus 6
uggcgcgcauguugcagu

SEQ ID NO: 2036262 - RNA, 14 nt, Human herpesvirus 6
cgccuuguauuuca

SEQ ID NO: 2036263 - RNA, 18 nt, Human herpesvirus 6
aacgcagacuaauccaua

SEQ ID NO: 2036264 - RNA, 22 nt, Human herpesvirus 6
ucagcgacucccggcccagaga

SEQ ID NO: 2036265 - RNA, 22 nt, Human herpesvirus 6
aaaacaguuuaccuauuuacaa

SEQ ID NO: 2036266 - RNA, 13 nt, Human herpesvirus 6
cgugauguuuucc

SEQ ID NO: 2036267 - RNA, 13 nt, Human herpesvirus 6
aagcgccugccua

SEQ ID NO: 2036268 - RNA, 21 nt, Human herpesvirus 6
uuucuaugaguauauaaaaaa

SEQ ID NO: 2036269 - RNA, 12 nt, Human herpesvirus 6
uguauuauguaa

SEQ ID NO: 2036270 - RNA, 15 nt, Human herpesvirus 6
augcaacgcaucaca

SEQ ID NO: 2036271 - RNA, 17 nt, Human herpesvirus 6
uucgucgaguuguauua

SEQ ID NO: 2036272 - RNA, 18 nt, Human herpesvirus 6
aaugagcccgguuuaaga

SEQ ID NO: 2036273 - RNA, 12 nt, Human herpesvirus 6
ccaagugguggu

SEQ ID NO: 2036274 - RNA, 18 nt, Human herpesvirus 6
uacguuuuguguuaaaau

SEQ ID NO: 2036275 - RNA, 15 nt, Human herpesvirus 6
ccgcaagauacuggu

SEQ ID NO: 2036276 - RNA, 18 nt, Human herpesvirus 6
acaccucacaaucuaaua

SEQ ID NO: 2036277 - RNA, 22 nt, Human herpesvirus 6
aucguuugagauucuuuaacuu

SEQ ID NO: 2036278 - RNA, 19 nt, Human herpesvirus 6
accaccagucaggaaaaag

SEQ ID NO: 2036279 - RNA, 21 nt, Human herpesvirus 6
agaaauuacauaagcaaaugu

SEQ ID NO: 2036280 - RNA, 14 nt, Human herpesvirus 6
aauauaucuugaaa

SEQ ID NO: 2036281 - RNA, 20 nt, Human herpesvirus 6
cgguugagguguuuccugcc

SEQ ID NO: 2036282 - RNA, 16 nt, Human herpesvirus 6
uuuugggauacauaau

SEQ ID NO: 2036283 - RNA, 16 nt, Human herpesvirus 6
ggcggacaccgagggc

SEQ ID NO: 2036284 - RNA, 16 nt, Human herpesvirus 6
aagaaacauuauaccu

SEQ ID NO: 2036285 - RNA, 14 nt, Human herpesvirus 6
guuuccugcccagg

SEQ ID NO: 2036286 - RNA, 16 nt, Human herpesvirus 6
accuaauaaacugugu

SEQ ID NO: 2036287 - RNA, 23 nt, Human herpesvirus 6
uucaagauuguguuucugucuuu

SEQ ID NO: 2036288 - RNA, 17 nt, Human herpesvirus 6
ggagacggguuggaaau

SEQ ID NO: 2036289 - RNA, 12 nt, Human herpesvirus 6
guaauacaucaa

SEQ ID NO: 2036290 - RNA, 17 nt, Human herpesvirus 6
uugaaaaaccuuauaca

SEQ ID NO: 2036291 - RNA, 19 nt, Human herpesvirus 6
accgucuacugcacuuucg

SEQ ID NO: 2036292 - RNA, 14 nt, Human herpesvirus 6
cugucgaauauguu

SEQ ID NO: 2036293 - RNA, 13 nt, Human herpesvirus 6
uacccggaagcuu

SEQ ID NO: 2036294 - RNA, 20 nt, Human herpesvirus 6
aguagcacaaaccaaaauga

SEQ ID NO: 2036295 - RNA, 15 nt, Human herpesvirus 6
uuaaaauagaagucu

SEQ ID NO: 2036296 - RNA, 16 nt, Human herpesvirus 6
ccugaaacuccccaga

SEQ ID NO: 2036297 - RNA, 22 nt, Human herpesvirus 6
uagaugaaaccuagauguaaau

SEQ ID NO: 2036298 - RNA, 17 nt, Human herpesvirus 6
guggcagaggggaaggg

SEQ ID NO: 2036299 - RNA, 17 nt, Human herpesvirus 6
gucaaauugauuaugau

SEQ ID NO: 2036300 - RNA, 14 nt, Human herpesvirus 6
ucgcggaguggagu

SEQ ID NO: 2036301 - RNA, 14 nt, Human herpesvirus 6
ccucaauuaauaca

SEQ ID NO: 2036302 - RNA, 22 nt, Human herpesvirus 6
ccuguccgugacacacagaaua

SEQ ID NO: 2036303 - RNA, 16 nt, Human herpesvirus 6
gcacuguuugaaacug

SEQ ID NO: 2036304 - RNA, 16 nt, Human herpesvirus 6
aguggucguuggauua

SEQ ID NO: 2036305 - RNA, 15 nt, Human herpesvirus 6
ucacucagauuucag

SEQ ID NO: 2036306 - RNA, 22 nt, Human herpesvirus 6
cuguggcgcgaccgaccccugc

SEQ ID NO: 2036307 - RNA, 13 nt, Human herpesvirus 6
cuacggaaaaucu

SEQ ID NO: 2036308 - RNA, 13 nt, Human herpesvirus 6
agaaguuacaaga

SEQ ID NO: 2036309 - RNA, 22 nt, Human herpesvirus 6
uugucauuacgaagcuucgcaa

SEQ ID NO: 2036310 - RNA, 18 nt, Human herpesvirus 6
auacuguuguaaaauaua

SEQ ID NO: 2036311 - RNA, 17 nt, Human herpesvirus 6
uucaguaucuguuuuua

SEQ ID NO: 2036312 - RNA, 19 nt, Human herpesvirus 6
acgccguguuucgccaaga

SEQ ID NO: 2036313 - RNA, 13 nt, Human herpesvirus 6
agugaaauucaaa

SEQ ID NO: 2036314 - RNA, 19 nt, Human herpesvirus 6
uucaugcgcuucuguuuug

SEQ ID NO: 2036315 - RNA, 21 nt, Human herpesvirus 6
aaucugagcucuccugggcau

SEQ ID NO: 2036316 - RNA, 21 nt, Human herpesvirus 6
ugcauuauacgugucggugau

SEQ ID NO: 2036317 - RNA, 16 nt, Human herpesvirus 6
uaaaagucagugggua

SEQ ID NO: 2036318 - RNA, 12 nt, Human herpesvirus 6
aaccuaaauaca

SEQ ID NO: 2036319 - RNA, 20 nt, Human herpesvirus 6
auuaccgguaaagaacccau

SEQ ID NO: 2036320 - RNA, 13 nt, Human herpesvirus 6
auucaaagaaagu

SEQ ID NO: 2036321 - RNA, 17 nt, Human herpesvirus 6
uccugggagcucucccu

SEQ ID NO: 2036322 - RNA, 15 nt, Human herpesvirus 6
uaaauacauucacau

SEQ ID NO: 2036323 - RNA, 19 nt, Human herpesvirus 6
gaacuggugucugucuauu

SEQ ID NO: 2036324 - RNA, 19 nt, Human herpesvirus 6
caaaagauuacggcaacau

SEQ ID NO: 2036325 - RNA, 16 nt, Human herpesvirus 6
cuuuccugcacaggcg

SEQ ID NO: 2036326 - RNA, 16 nt, Human herpesvirus 6
cuaugaguucucugau

SEQ ID NO: 2036327 - RNA, 19 nt, Human herpesvirus 6
ggaaccuccaguuuggauu

SEQ ID NO: 2036328 - RNA, 12 nt, Human herpesvirus 6
uuuauaaugagu

SEQ ID NO: 2036329 - RNA, 14 nt, Human herpesvirus 6
ucaagcacaaaacc

SEQ ID NO: 2036330 - RNA, 15 nt, Human herpesvirus 6
gaacucuaaaagcug

SEQ ID NO: 2036331 - RNA, 12 nt, Human herpesvirus 6
uccugcacaggc

SEQ ID NO: 2036332 - RNA, 23 nt, Human herpesvirus 6
guuagaaauuuuaccuuuggaaa

SEQ ID NO: 2036333 - RNA, 23 nt, Human herpesvirus 6
uucacaguccccacccucuuuuu

SEQ ID NO: 2036334 - RNA, 17 nt, Human herpesvirus 6
aacuaagauugugcagu

SEQ ID NO: 2036335 - RNA, 16 nt, Human herpesvirus 6
aauguguucacagagc

SEQ ID NO: 2036336 - RNA, 17 nt, Human herpesvirus 6
ccuggcacggugccaaa

SEQ ID NO: 2036337 - RNA, 20 nt, Human herpesvirus 6
caaaaugguuaugacaaagg

SEQ ID NO: 2036338 - RNA, 16 nt, Human herpesvirus 6
ccggcuaacccuaacc

SEQ ID NO: 2036339 - RNA, 18 nt, Human herpesvirus 6
aguuuuuccgauacagca

SEQ ID NO: 2036340 - RNA, 16 nt, Human herpesvirus 6
cgcgaccgaccccugc

SEQ ID NO: 2036341 - RNA, 15 nt, Human herpesvirus 6
ggauaucucaaauuu

SEQ ID NO: 2036342 - RNA, 17 nt, Human herpesvirus 6
auaugaaaagcuggaaa

SEQ ID NO: 2036343 - RNA, 16 nt, Human herpesvirus 6
cguaucuuaaaguugg

SEQ ID NO: 2036344 - RNA, 17 nt, Human herpesvirus 6
cgugugcgauuuacugg

SEQ ID NO: 2036345 - RNA, 16 nt, Human herpesvirus 6
aaagggaagauuugua

SEQ ID NO: 2036346 - RNA, 14 nt, Human herpesvirus 6
uccaguauugaaga

SEQ ID NO: 2036347 - RNA, 15 nt, Human herpesvirus 6
ggacgacacgugggg

SEQ ID NO: 2036348 - RNA, 14 nt, Human herpesvirus 6
cgauguacaguuuc

SEQ ID NO: 2036349 - RNA, 14 nt, Human herpesvirus 6
acuaguuuucacac

SEQ ID NO: 2036350 - RNA, 22 nt, Human herpesvirus 6
uuauaacaagcacugaauuaga

SEQ ID NO: 2036351 - RNA, 20 nt, Human herpesvirus 6
aaguaauauagacauugcuu

SEQ ID NO: 2036352 - RNA, 24 nt, Human herpesvirus 6
gcaacaaaaagcuuuaaagcagcu

SEQ ID NO: 2036353 - RNA, 13 nt, Human herpesvirus 6
caaagagaccaau

SEQ ID NO: 2036354 - RNA, 17 nt, Human herpesvirus 6
auaucgagccaaagaaa

SEQ ID NO: 2036355 - RNA, 17 nt, Human herpesvirus 6
cagaucuaucacaggcg

SEQ ID NO: 2036356 - RNA, 22 nt, Human herpesvirus 6
guuuacccgggcgaguagacuc

SEQ ID NO: 2036357 - RNA, 19 nt, Human herpesvirus 6
uucgaauucuuaccaagaa

SEQ ID NO: 2036358 - RNA, 16 nt, Human herpesvirus 6
ccguucaucauuccag

SEQ ID NO: 2036359 - RNA, 15 nt, Human herpesvirus 6
augcguugcauuuug

SEQ ID NO: 2036360 - RNA, 22 nt, Human herpesvirus 6
gguaccgcgguuugggggucuu

SEQ ID NO: 2036361 - RNA, 21 nt, Human herpesvirus 6
guuuaagaagggcuuuaaaac

SEQ ID NO: 2036362 - RNA, 14 nt, Human herpesvirus 6
cgaaaucaaugagu

SEQ ID NO: 2036363 - RNA, 17 nt, Human herpesvirus 6
cggcagcuauauggcga

SEQ ID NO: 2036364 - RNA, 14 nt, Human herpesvirus 6
caccaucuguugau

SEQ ID NO: 2036365 - RNA, 15 nt, Human herpesvirus 6
cugccaucccuuccu

SEQ ID NO: 2036366 - RNA, 20 nt, Human herpesvirus 6
uauauucguggauaacgucg

SEQ ID NO: 2036367 - RNA, 11 nt, Human herpesvirus 6
aggaauugcuu

SEQ ID NO: 2036368 - RNA, 15 nt, Human herpesvirus 6
gcaacaauccauguu

SEQ ID NO: 2036369 - RNA, 17 nt, Human herpesvirus 6
uuuuugucagguuugaa

SEQ ID NO: 2036370 - RNA, 17 nt, Human herpesvirus 6
agauaaaaagagaggaa

SEQ ID NO: 2036371 - RNA, 18 nt, Human herpesvirus 6
uguaaaucaaaaaaauga

SEQ ID NO: 2036372 - RNA, 23 nt, Human herpesvirus 6
uccccucgguccaaccccuccca

SEQ ID NO: 2036373 - RNA, 14 nt, Human herpesvirus 6
cugagauucacucc

SEQ ID NO: 2036374 - RNA, 17 nt, Human herpesvirus 6
aucugaucgaaauacuu

SEQ ID NO: 2036375 - RNA, 17 nt, Human herpesvirus 6
auaauuccgacuguguu

SEQ ID NO: 2036376 - RNA, 14 nt, Human herpesvirus 6
cauaaacaccccga

SEQ ID NO: 2036377 - RNA, 20 nt, Human herpesvirus 6
ugacuguaccauugucaaca

SEQ ID NO: 2036378 - RNA, 13 nt, Human herpesvirus 6
uucuucugugacu

SEQ ID NO: 2036379 - RNA, 15 nt, Human herpesvirus 6
acugauuaguuuuca

SEQ ID NO: 2036380 - RNA, 15 nt, Human herpesvirus 6
gaccuggcggacacc

SEQ ID NO: 2036381 - RNA, 21 nt, Human herpesvirus 6
cuuugucacgagucgcuucua

SEQ ID NO: 2036382 - RNA, 18 nt, Human herpesvirus 6
aagacgaaaaauuuuacg

SEQ ID NO: 2036383 - RNA, 16 nt, Human herpesvirus 6
auaaccucacuacuga

SEQ ID NO: 2036384 - RNA, 15 nt, Human herpesvirus 6
aucguccccuuggcu

SEQ ID NO: 2036385 - RNA, 17 nt, Human herpesvirus 6
auuuuaauuuugaaaua

SEQ ID NO: 2036386 - RNA, 22 nt, Human herpesvirus 6
aggcuaugugucuccgccuuuu

SEQ ID NO: 2036387 - RNA, 22 nt, Human herpesvirus 6
cuuucuacgguaggcagggaaa

SEQ ID NO: 2036388 - RNA, 14 nt, Human herpesvirus 6
ucacucagauuuca

SEQ ID NO: 2036389 - RNA, 17 nt, Human herpesvirus 6
uucauaugaaaagcugg

SEQ ID NO: 2036390 - RNA, 18 nt, Human herpesvirus 6
ucugauucgacaaaucau

SEQ ID NO: 2036391 - RNA, 14 nt, Human herpesvirus 6
cagucaguaaugau

SEQ ID NO: 2036392 - RNA, 16 nt, Human herpesvirus 6
uuuacaauguucaauu

SEQ ID NO: 2036393 - RNA, 19 nt, Human herpesvirus 6
agauguguauuauguaaau

SEQ ID NO: 2036394 - RNA, 16 nt, Human herpesvirus 6
uuucgccgugugugua

SEQ ID NO: 2036395 - RNA, 20 nt, Human herpesvirus 6
cacguuaccgaagauuacuu

SEQ ID NO: 2036396 - RNA, 13 nt, Human herpesvirus 6
acgguggccuggc

SEQ ID NO: 2036397 - RNA, 16 nt, Human herpesvirus 6
ccaccaacacaccugc

SEQ ID NO: 2036398 - RNA, 20 nt, Human herpesvirus 6
ccgugcuucuggcacaggca

SEQ ID NO: 2036399 - RNA, 22 nt, Human herpesvirus 6
auuuaacaacaucuuaaaagac

SEQ ID NO: 2036400 - RNA, 20 nt, Human herpesvirus 6
cucaacauuaaaaaaaauag

SEQ ID NO: 2036401 - RNA, 15 nt, Human herpesvirus 6
cacaucuauguguau

SEQ ID NO: 2036402 - RNA, 16 nt, Human herpesvirus 6
gcugauuuuguuuucu

SEQ ID NO: 2036403 - RNA, 18 nt, Human herpesvirus 6
cggggggacgggcggagc

SEQ ID NO: 2036404 - RNA, 15 nt, Human herpesvirus 6
aaaacaguauaacgg

SEQ ID NO: 2036405 - RNA, 15 nt, Human herpesvirus 6
gcccggggacggaca

SEQ ID NO: 2036406 - RNA, 16 nt, Human herpesvirus 6
uaaaacaguaaauuca

SEQ ID NO: 2036407 - RNA, 19 nt, Human herpesvirus 6
ugucucacaagcuguccau

SEQ ID NO: 2036408 - RNA, 13 nt, Human herpesvirus 6
gccugcucagagc

SEQ ID NO: 2036409 - RNA, 18 nt, Human herpesvirus 6
gcuacgacacgcuggagc

SEQ ID NO: 2036410 - RNA, 17 nt, Human herpesvirus 6
ugauugucuuuucugga

SEQ ID NO: 2036411 - RNA, 18 nt, Human herpesvirus 6
gacauccagaaaagcaaa

SEQ ID NO: 2036412 - RNA, 16 nt, Human herpesvirus 6
aaauggauuugguauu

SEQ ID NO: 2036413 - RNA, 18 nt, Human herpesvirus 6
gggacccacgguggccug

SEQ ID NO: 2036414 - RNA, 20 nt, Human herpesvirus 6
gaaagaguguuuggauaaug

SEQ ID NO: 2036415 - RNA, 15 nt, Human herpesvirus 6
caaagaaacaguaaa

SEQ ID NO: 2036416 - RNA, 14 nt, Human herpesvirus 6
cguagacagucaca

SEQ ID NO: 2036417 - RNA, 18 nt, Human herpesvirus 6
augguucgauugcgcgau

SEQ ID NO: 2036418 - RNA, 21 nt, Human herpesvirus 6
cacgcuuggaguuuuuuaugc

SEQ ID NO: 2036419 - RNA, 15 nt, Human herpesvirus 6
uauuuacggacaaac

SEQ ID NO: 2036420 - RNA, 14 nt, Human herpesvirus 6
cuaauaugaacaau

SEQ ID NO: 2036421 - RNA, 11 nt, Human herpesvirus 6
gaucagugggu

SEQ ID NO: 2036422 - RNA, 23 nt, Human herpesvirus 6
gguaaaauggcugugcuaucuga

SEQ ID NO: 2036423 - RNA, 20 nt, Human herpesvirus 6
uaaaaagaaugggauuguga

SEQ ID NO: 2036424 - RNA, 15 nt, Human herpesvirus 6
ccaguagacaagaaa

SEQ ID NO: 2036425 - RNA, 20 nt, Human herpesvirus 6
aggagauuucagguaauauu

SEQ ID NO: 2036426 - RNA, 23 nt, Human herpesvirus 6
accucacuacugaaaccaaagca

SEQ ID NO: 2036427 - RNA, 15 nt, Human herpesvirus 6
ccggccggagugccg

SEQ ID NO: 2036428 - RNA, 21 nt, Human herpesvirus 6
uguuucgccaagaaaaagaaa

SEQ ID NO: 2036429 - RNA, 22 nt, Human herpesvirus 6
aauuaucacaguugauaaacau

SEQ ID NO: 2036430 - RNA, 15 nt, Human herpesvirus 6
uguaccuagcagcaa

SEQ ID NO: 2036431 - RNA, 18 nt, Human herpesvirus 6
cuugaucaaauaucugaa

SEQ ID NO: 2036432 - RNA, 15 nt, Human herpesvirus 6
ugaacuacugagugc

SEQ ID NO: 2036433 - RNA, 16 nt, Human herpesvirus 6
auucaggcuuuaacua

SEQ ID NO: 2036434 - RNA, 17 nt, Human herpesvirus 6
gagggggagggacccac

SEQ ID NO: 2036435 - RNA, 13 nt, Human herpesvirus 6
cgccauaauggaa

SEQ ID NO: 2036436 - RNA, 16 nt, Human herpesvirus 6
ccugaucacagagcag

SEQ ID NO: 2036437 - RNA, 21 nt, Human herpesvirus 6
cccaucccccuccccggagca

SEQ ID NO: 2036438 - RNA, 15 nt, Human herpesvirus 6
gacgacgggcggggc

SEQ ID NO: 2036439 - RNA, 17 nt, Human herpesvirus 6
ugcaauucgguucagcc

SEQ ID NO: 2036440 - RNA, 17 nt, Human herpesvirus 6
uuuagaaacauuugcug

SEQ ID NO: 2036441 - RNA, 22 nt, Human herpesvirus 6
uaauacgcaguugucuggcagc

SEQ ID NO: 2036442 - RNA, 16 nt, Human herpesvirus 6
ccagcuuucuuagaga

SEQ ID NO: 2036443 - RNA, 15 nt, Human herpesvirus 6
cgacacgcuggagca

SEQ ID NO: 2036444 - RNA, 16 nt, Human herpesvirus 6
auauucuucuguaaau

SEQ ID NO: 2036445 - RNA, 16 nt, Human herpesvirus 6
gaugccugcauaugca

SEQ ID NO: 2036446 - RNA, 18 nt, Human herpesvirus 6
gauggaguauuuguuuua

SEQ ID NO: 2036447 - RNA, 12 nt, Human herpesvirus 6
ggcuaacccuaa

SEQ ID NO: 2036448 - RNA, 15 nt, Human herpesvirus 6
ucggccgugaugcac

SEQ ID NO: 2036449 - RNA, 18 nt, Human herpesvirus 6
ugcuccguuuccuccucg

SEQ ID NO: 2036450 - RNA, 14 nt, Human herpesvirus 6
ucgcugacucgccu

SEQ ID NO: 2036451 - RNA, 10 nt, Human herpesvirus 6
ccugcccagg

SEQ ID NO: 2036452 - RNA, 16 nt, Human herpesvirus 6
ucucuguucugccacg

SEQ ID NO: 2036453 - RNA, 20 nt, Human herpesvirus 6
gaauuuguccguauacagcu

SEQ ID NO: 2036454 - RNA, 20 nt, Human herpesvirus 6
uggcggaaacgacggaacga

SEQ ID NO: 2036455 - RNA, 15 nt, Human herpesvirus 6
cccaggcgaacgaga

SEQ ID NO: 2036456 - RNA, 16 nt, Human herpesvirus 6
ccgucucugaagcaaa

SEQ ID NO: 2036457 - RNA, 19 nt, Human herpesvirus 6
aguuagaaauuuuaccuuu

SEQ ID NO: 2036458 - RNA, 13 nt, Human herpesvirus 6
gcccgauccgccc

SEQ ID NO: 2036459 - RNA, 14 nt, Human herpesvirus 6
accucucgccgacc

SEQ ID NO: 2036460 - RNA, 14 nt, Human herpesvirus 6
guauggagauguua

SEQ ID NO: 2036461 - RNA, 15 nt, Human herpesvirus 6
uaacacgugugacac

SEQ ID NO: 2036462 - RNA, 20 nt, Human herpesvirus 6
aauacauuuccaugcauauc

SEQ ID NO: 2036463 - RNA, 23 nt, Human herpesvirus 6
ggagugccguugagugccucaga

SEQ ID NO: 2036464 - RNA, 16 nt, Human herpesvirus 6
ucucugacuauuucaa

SEQ ID NO: 2036465 - RNA, 17 nt, Human herpesvirus 6
acugguuuacagcacuu

SEQ ID NO: 2036466 - RNA, 14 nt, Human herpesvirus 6
gaucuucugcuaau

SEQ ID NO: 2036467 - RNA, 16 nt, Human herpesvirus 6
uggaccgaggggacag

SEQ ID NO: 2036468 - RNA, 16 nt, Human herpesvirus 6
auuuuauaacgacaaa

SEQ ID NO: 2036469 - RNA, 17 nt, Human herpesvirus 6
augaucgacauuuguau

SEQ ID NO: 2036470 - RNA, 21 nt, Human herpesvirus 6
ucugagguuuccgucucgccu

SEQ ID NO: 2036471 - RNA, 15 nt, Human herpesvirus 6
aaaccauagguguuu

SEQ ID NO: 2036472 - RNA, 15 nt, Human herpesvirus 6
uugccgucacacucu

SEQ ID NO: 2036473 - RNA, 20 nt, Human herpesvirus 6
acgucgaaacgaaagcugau

SEQ ID NO: 2036474 - RNA, 20 nt, Human herpesvirus 6
gugaacgcaagucacgggca

SEQ ID NO: 2036475 - RNA, 16 nt, Human herpesvirus 6
guuuaaacuaugcaaa

SEQ ID NO: 2036476 - RNA, 12 nt, Human herpesvirus 6
acacacccagca

SEQ ID NO: 2036477 - RNA, 18 nt, Human herpesvirus 6
ugcacuccguuaaucuaa

SEQ ID NO: 2036478 - RNA, 15 nt, Human herpesvirus 6
ucuaacaucucguaa

SEQ ID NO: 2036479 - RNA, 18 nt, Human herpesvirus 6
agggugagucacauagau

SEQ ID NO: 2036480 - RNA, 15 nt, Human herpesvirus 6
gucacacguguuaaa

SEQ ID NO: 2036481 - RNA, 18 nt, Human herpesvirus 6
uacauuuauaauuaaaau

SEQ ID NO: 2036482 - RNA, 13 nt, Human herpesvirus 6
gcgcccauaccug

SEQ ID NO: 2036483 - RNA, 21 nt, Human herpesvirus 6
uuuuaacaaaaugguuaugac

SEQ ID NO: 2036484 - RNA, 22 nt, Human herpesvirus 6
ucgcgguccaacacagcaugca

SEQ ID NO: 2036485 - RNA, 16 nt, Human herpesvirus 6
ccacggaagaagagaa

SEQ ID NO: 2036486 - RNA, 13 nt, Human herpesvirus 6
gcaggaaucaugu

SEQ ID NO: 2036487 - RNA, 14 nt, Human herpesvirus 6
ggacucauagauuu

SEQ ID NO: 2036488 - RNA, 13 nt, Human herpesvirus 6
ggaucaacagaug

SEQ ID NO: 2036489 - RNA, 11 nt, Human herpesvirus 6
cagcuggcuga

SEQ ID NO: 2036490 - RNA, 13 nt, Human herpesvirus 6
auaaaaacucaca

SEQ ID NO: 2036491 - RNA, 18 nt, Human herpesvirus 6
acuuucuucgccuguaaa

SEQ ID NO: 2036492 - RNA, 19 nt, Human herpesvirus 6
ucacguuuugggaaaucug

SEQ ID NO: 2036493 - RNA, 18 nt, Human herpesvirus 6
cccacgguggccuggcac

SEQ ID NO: 2036494 - RNA, 15 nt, Human herpesvirus 6
acuagcgaaugaauu

SEQ ID NO: 2036495 - RNA, 15 nt, Human herpesvirus 6
aggaacgauaugcug

SEQ ID NO: 2036496 - RNA, 13 nt, Human herpesvirus 6
cuuugaaggacua

SEQ ID NO: 2036497 - RNA, 17 nt, Human herpesvirus 6
gauugaugaaagcuuca

SEQ ID NO: 2036498 - RNA, 20 nt, Human herpesvirus 6
uaugaacaggugcuucuuuu

SEQ ID NO: 2036499 - RNA, 18 nt, Human herpesvirus 6
uauuaacgcagcaacaau

SEQ ID NO: 2036500 - RNA, 17 nt, Human herpesvirus 6
cugauuccuucaauguu

SEQ ID NO: 2036501 - RNA, 23 nt, Human herpesvirus 6
guuuuuuaauccauauuuggaag

SEQ ID NO: 2036502 - RNA, 18 nt, Human herpesvirus 6
cacgaagacgaagaggaa

SEQ ID NO: 2036503 - RNA, 16 nt, Human herpesvirus 6
guauaaauuuaacuaa

SEQ ID NO: 2036504 - RNA, 17 nt, Human herpesvirus 6
uaauagccaaacaaggg

SEQ ID NO: 2036505 - RNA, 21 nt, Human herpesvirus 6
auaacuuuacauuaaacacua

SEQ ID NO: 2036506 - RNA, 21 nt, Human herpesvirus 6
cugcuaaaagcuauguaugaa

SEQ ID NO: 2036507 - RNA, 20 nt, Human herpesvirus 6
aauguuuuucauaaauggua

SEQ ID NO: 2036508 - RNA, 16 nt, Human herpesvirus 6
ccucauuguuucacuu

SEQ ID NO: 2036509 - RNA, 22 nt, Human herpesvirus 6
gacaccucaauuaauacaaaau

SEQ ID NO: 2036510 - RNA, 14 nt, Human herpesvirus 6
acuacguuuugugu

SEQ ID NO: 2036511 - RNA, 13 nt, Human herpesvirus 6
auaucauuaaauu

SEQ ID NO: 2036512 - RNA, 15 nt, Human herpesvirus 6
ggacguucugucugc

SEQ ID NO: 2036513 - RNA, 20 nt, Human herpesvirus 6
aaaaacaucguaauggcauu

SEQ ID NO: 2036514 - RNA, 12 nt, Human herpesvirus 6
auauuuccugcc

SEQ ID NO: 2036515 - RNA, 13 nt, Human herpesvirus 6
gucgaaauucacc

SEQ ID NO: 2036516 - RNA, 22 nt, Human herpesvirus 6
gaaaauauuuccaugacuguga

SEQ ID NO: 2036517 - RNA, 20 nt, Human herpesvirus 6
uuaacuaagauugugcaguu

SEQ ID NO: 2036518 - RNA, 21 nt, Human herpesvirus 6
gguggccuggcacggugccaa

SEQ ID NO: 2036519 - RNA, 12 nt, Human herpesvirus 6
guggccuggcac

SEQ ID NO: 2036520 - RNA, 20 nt, Human herpesvirus 6
cuuuaauggguuuguuuucu

SEQ ID NO: 2036521 - RNA, 12 nt, Human herpesvirus 6
aacuuuuaacuu

SEQ ID NO: 2036522 - RNA, 23 nt, Human herpesvirus 6
ccgcaguuccuguuuuucucgga

SEQ ID NO: 2036523 - RNA, 20 nt, Human herpesvirus 6
uccugggcauuaguguauaa

SEQ ID NO: 2036524 - RNA, 16 nt, Human herpesvirus 6
aucuucccuuuuacaa

SEQ ID NO: 2036525 - RNA, 17 nt, Human herpesvirus 6
ugugcaugaaaauauca

SEQ ID NO: 2036526 - RNA, 21 nt, Human herpesvirus 6
auguaguuaaugcugcugcug

SEQ ID NO: 2036527 - RNA, 14 nt, Human herpesvirus 6
caaaaauacugcag

SEQ ID NO: 2036528 - RNA, 12 nt, Human herpesvirus 6
aauaagauguug

SEQ ID NO: 2036529 - RNA, 13 nt, Human herpesvirus 6
ugaaagcagucag

SEQ ID NO: 2036530 - RNA, 16 nt, Human herpesvirus 6
aggcuaugugucuccg

SEQ ID NO: 2036531 - RNA, 17 nt, Human herpesvirus 6
aucggacaaugcagaac

SEQ ID NO: 2036532 - RNA, 22 nt, Human herpesvirus 6
gguggccuggcacggugccaaa

SEQ ID NO: 2036533 - RNA, 21 nt, Human herpesvirus 6
aaauuuugaugccaaagcuuu

SEQ ID NO: 2036534 - RNA, 22 nt, Human herpesvirus 6
uggacggcggggggacgggcgg

SEQ ID NO: 2036535 - RNA, 16 nt, Human herpesvirus 6
augaagaaguuaacua

SEQ ID NO: 2036536 - RNA, 22 nt, Human herpesvirus 6
ggauuucccuuguaaucaauca

SEQ ID NO: 2036537 - RNA, 20 nt, Human herpesvirus 6
gccuccgccacugcgaggcc

SEQ ID NO: 2036538 - RNA, 23 nt, Human herpesvirus 6
aaaaucaucucgugcaaaagcug

SEQ ID NO: 2036539 - RNA, 14 nt, Human herpesvirus 6
cggaaaacuaaaag

SEQ ID NO: 2036540 - RNA, 15 nt, Human herpesvirus 6
gggucuuuccugcac

SEQ ID NO: 2036541 - RNA, 14 nt, Human herpesvirus 6
gaacccuagacaca

SEQ ID NO: 2036542 - RNA, 19 nt, Human herpesvirus 6
cuucgaauacuuucaugau

SEQ ID NO: 2036543 - RNA, 14 nt, Human herpesvirus 6
cauagcgaauuuga

SEQ ID NO: 2036544 - RNA, 23 nt, Human herpesvirus 6
ccgcaguuccuguuuuucucaua

SEQ ID NO: 2036545 - RNA, 19 nt, Human herpesvirus 6
guuuggggucuuuccugca

SEQ ID NO: 2036546 - RNA, 16 nt, Human herpesvirus 6
gccagcgcaagauucu

SEQ ID NO: 2036547 - RNA, 19 nt, Human herpesvirus 6
ucaaugaaaaaaaaugaag

SEQ ID NO: 2036548 - RNA, 18 nt, Human herpesvirus 6
uaacccuaacccuaaccc

SEQ ID NO: 2036549 - RNA, 15 nt, Human herpesvirus 6
ugguuuacagcacuu

SEQ ID NO: 2036550 - RNA, 22 nt, Human herpesvirus 6
ucuuauuaauuuccugaucaca

SEQ ID NO: 2036551 - RNA, 19 nt, Human herpesvirus 6
cgcgacagggugagucaca

SEQ ID NO: 2036552 - RNA, 13 nt, Human herpesvirus 6
ugagcucuccugg

SEQ ID NO: 2036553 - RNA, 23 nt, Human herpesvirus 6
aaauauuuccaugacugugaggu

SEQ ID NO: 2036554 - RNA, 18 nt, Human herpesvirus 6
caucccccuccccggagc

SEQ ID NO: 2036555 - RNA, 17 nt, Human herpesvirus 6
cuacugaaaccaaagca

SEQ ID NO: 2036556 - RNA, 23 nt, Human herpesvirus 6
cuaguagccuaggccuucaccug

SEQ ID NO: 2036557 - RNA, 14 nt, Human herpesvirus 6
guggacgugccggg

SEQ ID NO: 2036558 - RNA, 17 nt, Human herpesvirus 6
auucuaaaauuguaauu

SEQ ID NO: 2036559 - RNA, 16 nt, Human herpesvirus 6
cggcccauccaccuuc

SEQ ID NO: 2036560 - RNA, 20 nt, Human herpesvirus 6
guucggagauaucauaaucu

SEQ ID NO: 2036561 - RNA, 19 nt, Human herpesvirus 6
augccccgguuaaaguaga

SEQ ID NO: 2036562 - RNA, 19 nt, Human herpesvirus 6
cuggguuucgaagaauccu

SEQ ID NO: 2036563 - RNA, 23 nt, Human herpesvirus 6
auacgacaaauaaaagcauuuuu

SEQ ID NO: 2036564 - RNA, 19 nt, Human herpesvirus 6
cuauuauaagcaaacaugu

SEQ ID NO: 2036565 - RNA, 18 nt, Human herpesvirus 6
uggcacggugccaaagga

SEQ ID NO: 2036566 - RNA, 16 nt, Human herpesvirus 6
cuauuuaaaauggacu

SEQ ID NO: 2036567 - RNA, 20 nt, Human herpesvirus 6
auauaacgcuucuaacaaua

SEQ ID NO: 2036568 - RNA, 17 nt, Human herpesvirus 6
gucuucaagcaaagaca

SEQ ID NO: 2036569 - RNA, 23 nt, Human herpesvirus 6
uacggggaagaucuaugggagug

SEQ ID NO: 2036570 - RNA, 22 nt, Human herpesvirus 6
ggaaaauuaaaggucagugggu

SEQ ID NO: 2036571 - RNA, 13 nt, Human herpesvirus 6
acuacagcuaaga

SEQ ID NO: 2036572 - RNA, 16 nt, Human herpesvirus 6
uccgcgauacccagcg

SEQ ID NO: 2036573 - RNA, 21 nt, Human herpesvirus 6
caaaauugacuacagcugcag

SEQ ID NO: 2036574 - RNA, 18 nt, Human herpesvirus 6
agaauaauuauggacaac

SEQ ID NO: 2036575 - RNA, 13 nt, Human herpesvirus 6
aucccccuccccg

SEQ ID NO: 2036576 - RNA, 19 nt, Human herpesvirus 6
cucacacccauggcgagaa

SEQ ID NO: 2036577 - RNA, 15 nt, Human herpesvirus 6
auucuucuguaaaua

SEQ ID NO: 2036578 - RNA, 20 nt, Human herpesvirus 6
aguuccaaaacuucuauaug

SEQ ID NO: 2036579 - RNA, 16 nt, Human herpesvirus 6
gucaucgguggcagag

SEQ ID NO: 2036580 - RNA, 18 nt, Human herpesvirus 6
aauuuguaaaaaaacauu

SEQ ID NO: 2036581 - RNA, 22 nt, Human herpesvirus 6
aaccaccggcuaacccuaaccc

SEQ ID NO: 2036582 - RNA, 17 nt, Human herpesvirus 6
aaaacguuuuuguuauu

SEQ ID NO: 2036583 - RNA, 13 nt, Human herpesvirus 6
ugucaaguuucac

SEQ ID NO: 2036584 - RNA, 15 nt, Human herpesvirus 6
aucuuauucaaaaau

SEQ ID NO: 2036585 - RNA, 15 nt, Human herpesvirus 6
agguuuugucguuug

SEQ ID NO: 2036586 - RNA, 20 nt, Human herpesvirus 6
cacucggauucaaagaaagu

SEQ ID NO: 2036587 - RNA, 14 nt, Human herpesvirus 6
caggcgaacgagaa

SEQ ID NO: 2036588 - RNA, 20 nt, Human herpesvirus 6
aaucaaaaaaauuuugaugc

SEQ ID NO: 2036589 - RNA, 16 nt, Human herpesvirus 6
gaagauaauaaaacaa

SEQ ID NO: 2036590 - RNA, 17 nt, Human herpesvirus 6
auaaguacauagaauuu

SEQ ID NO: 2036591 - RNA, 13 nt, Human herpesvirus 6
acguauaccuaga

SEQ ID NO: 2036592 - RNA, 20 nt, Human herpesvirus 6
acgugccaccgucugggacc

SEQ ID NO: 2036593 - RNA, 15 nt, Human herpesvirus 6
aacagauaguguuuu

SEQ ID NO: 2036594 - RNA, 14 nt, Human herpesvirus 6
aaacacagaugguu

SEQ ID NO: 2036595 - RNA, 19 nt, Human herpesvirus 6
aacauuuaauaaagaacau

SEQ ID NO: 2036596 - RNA, 15 nt, Human herpesvirus 6
ucagagugaauuccu

SEQ ID NO: 2036597 - RNA, 17 nt, Human herpesvirus 6
ggaaugcugagcugcag

SEQ ID NO: 2036598 - RNA, 20 nt, Human herpesvirus 6
acauuuaauaaagaacaugu

SEQ ID NO: 2036599 - RNA, 23 nt, Human herpesvirus 6
gucaaauguucgaugauuauucu

SEQ ID NO: 2036600 - RNA, 23 nt, Human herpesvirus 6
caaguuugaauuuauacugugug

SEQ ID NO: 2036601 - RNA, 12 nt, Human herpesvirus 6
cuuaccaagaaa

SEQ ID NO: 2036602 - RNA, 19 nt, Human herpesvirus 6
acagaauucuucugugacu

SEQ ID NO: 2036603 - RNA, 17 nt, Human herpesvirus 6
cuaaaauuguaauuuug

SEQ ID NO: 2036604 - RNA, 13 nt, Human herpesvirus 6
agaaaaacaacga

SEQ ID NO: 2036605 - RNA, 22 nt, Human herpesvirus 6
agaacguggccguuacaguuuc

SEQ ID NO: 2036606 - RNA, 17 nt, Human herpesvirus 6
gcagaacaacagcaugu

SEQ ID NO: 2036607 - RNA, 14 nt, Human herpesvirus 6
augcaauuuaaaag

SEQ ID NO: 2036608 - RNA, 15 nt, Human herpesvirus 6
uaacuaagauugugc

SEQ ID NO: 2036609 - RNA, 18 nt, Human herpesvirus 6
ucaugagccagcgcaaga

SEQ ID NO: 2036610 - RNA, 21 nt, Human herpesvirus 6
gcaaaccauaaaaaaucuugu

SEQ ID NO: 2036611 - RNA, 21 nt, Human herpesvirus 6
ggccacguccucgugcucugc

SEQ ID NO: 2036612 - RNA, 21 nt, Human herpesvirus 6
gccaaacuuguugcaagcagc

SEQ ID NO: 2036613 - RNA, 14 nt, Human herpesvirus 6
guaacgcugucguu

SEQ ID NO: 2036614 - RNA, 13 nt, Human herpesvirus 6
ucguaauggcauu

SEQ ID NO: 2036615 - RNA, 14 nt, Human herpesvirus 6
ccguuacaguuucc

SEQ ID NO: 2036616 - RNA, 18 nt, Human herpesvirus 6
acagagcgcaucuuuaac

SEQ ID NO: 2036617 - RNA, 15 nt, Human herpesvirus 6
uugcaguguguuuuu

SEQ ID NO: 2036618 - RNA, 13 nt, Human herpesvirus 6
acaaagcuuuacu

SEQ ID NO: 2036619 - RNA, 17 nt, Human herpesvirus 6
aacaguuauacuggcaa

SEQ ID NO: 2036620 - RNA, 21 nt, Human herpesvirus 6
caaacuacggaaaaucucaaa

SEQ ID NO: 2036621 - RNA, 18 nt, Human herpesvirus 6
auuuugaugccaaagcuu

SEQ ID NO: 2036622 - RNA, 16 nt, Human herpesvirus 6
auggaauggaauuucu

SEQ ID NO: 2036623 - RNA, 14 nt, Human herpesvirus 6
cuaaauuggucucu

SEQ ID NO: 2036624 - RNA, 22 nt, Human herpesvirus 6
ggggaucgggcccggggacgga

SEQ ID NO: 2036625 - RNA, 12 nt, Human herpesvirus 6
uuccugcacagg

SEQ ID NO: 2036626 - RNA, 21 nt, Human herpesvirus 6
ggaauaacagaugagggggag

SEQ ID NO: 2036627 - RNA, 20 nt, Human herpesvirus 6
augaucaacggccuggagua

SEQ ID NO: 2036628 - RNA, 15 nt, Human herpesvirus 6
ucagaccucauauaa

SEQ ID NO: 2036629 - RNA, 14 nt, Human herpesvirus 6
uagggaugguggau

SEQ ID NO: 2036630 - RNA, 17 nt, Human herpesvirus 6
caauuacucaacauuaa

SEQ ID NO: 2036631 - RNA, 15 nt, Human herpesvirus 6
auuaugguuaucauc

SEQ ID NO: 2036632 - RNA, 14 nt, Human herpesvirus 6
uguguuauaaggaa

SEQ ID NO: 2036633 - RNA, 18 nt, Human herpesvirus 6
caggauuauaaaaacaca

SEQ ID NO: 2036634 - RNA, 18 nt, Human herpesvirus 6
acaucaccgauaaaaacu

SEQ ID NO: 2036635 - RNA, 13 nt, Human herpesvirus 6
aaaaacucacaca

SEQ ID NO: 2036636 - RNA, 15 nt, Human herpesvirus 6
auugaauuguauaua

SEQ ID NO: 2036637 - RNA, 20 nt, Human herpesvirus 6
acgaauacuucucuuuauag

SEQ ID NO: 2036638 - RNA, 18 nt, Human herpesvirus 6
cggagguaacggagcccg

SEQ ID NO: 2036639 - RNA, 14 nt, Human herpesvirus 6
cuccgcgccccucg

SEQ ID NO: 2036640 - RNA, 23 nt, Human herpesvirus 6
uaaucgcgguccaacacagcaug

SEQ ID NO: 2036641 - RNA, 19 nt, Human herpesvirus 6
aguagaaacuauggggcug

SEQ ID NO: 2036642 - RNA, 15 nt, Human herpesvirus 6
aacaaccacaaacau

SEQ ID NO: 2036643 - RNA, 20 nt, Human herpesvirus 6
caccgcugacaaccuccgca

SEQ ID NO: 2036644 - RNA, 16 nt, Human herpesvirus 6
cuguuuuucucggaaa

SEQ ID NO: 2036645 - RNA, 22 nt, Human herpesvirus 6
acaaucgucggaucaacagaug

SEQ ID NO: 2036646 - RNA, 15 nt, Human herpesvirus 6
gauguucuaaaggau

SEQ ID NO: 2036647 - RNA, 12 nt, Human herpesvirus 6
aacucuaccugg

SEQ ID NO: 2036648 - RNA, 20 nt, Human herpesvirus 6
acucuucgauccaauaagaa

SEQ ID NO: 2036649 - RNA, 19 nt, Human herpesvirus 6
caauucauuguacgauaau

SEQ ID NO: 2036650 - RNA, 18 nt, Human herpesvirus 6
uaaucguuacaaaauuga

SEQ ID NO: 2036651 - RNA, 18 nt, Human herpesvirus 6
aacucuaaaagcugcuaa

SEQ ID NO: 2036652 - RNA, 14 nt, Human herpesvirus 6
uccugagaguaaau

SEQ ID NO: 2036653 - RNA, 14 nt, Human herpesvirus 6
uuucgucuccuggg

SEQ ID NO: 2036654 - RNA, 18 nt, Human herpesvirus 6
uacggcacgcucguuuuu

SEQ ID NO: 2036655 - RNA, 15 nt, Human herpesvirus 6
cucccggcccagaga

SEQ ID NO: 2036656 - RNA, 20 nt, Human herpesvirus 6
ccagauacauaaacaccccg

SEQ ID NO: 2036657 - RNA, 17 nt, Human herpesvirus 6
auaacgaugcuuuuauu

SEQ ID NO: 2036658 - RNA, 19 nt, Human herpesvirus 6
ggcccggggacggacaggg

SEQ ID NO: 2036659 - RNA, 24 nt, Human herpesvirus 6
aaaucaaacucaccgcauauauca

SEQ ID NO: 2036660 - RNA, 23 nt, Human herpesvirus 6
gggcgucaucgguggcagagggg

SEQ ID NO: 2036661 - RNA, 14 nt, Human herpesvirus 6
augaggauuugcuu

SEQ ID NO: 2036662 - RNA, 18 nt, Human herpesvirus 6
caucauauaauauuucca

SEQ ID NO: 2036663 - RNA, 16 nt, Human herpesvirus 6
aaaaaaucagaaucca

SEQ ID NO: 2036664 - RNA, 14 nt, Human herpesvirus 6
cccagcucaccacc

SEQ ID NO: 2036665 - RNA, 13 nt, Human herpesvirus 6
ggacgggcggagc

SEQ ID NO: 2036666 - RNA, 15 nt, Human herpesvirus 6
ucgcacacacaagaa

SEQ ID NO: 2036667 - RNA, 16 nt, Human herpesvirus 6
cuuacauuuuguacaa

SEQ ID NO: 2036668 - RNA, 18 nt, Human herpesvirus 6
ugugauucaguaucuguu

SEQ ID NO: 2036669 - RNA, 16 nt, Human herpesvirus 6
caccuacggccagaga

SEQ ID NO: 2036670 - RNA, 16 nt, Human herpesvirus 6
cgucaucgguggcaga

SEQ ID NO: 2036671 - RNA, 16 nt, Human herpesvirus 6
aauaaaaaguuugugc

SEQ ID NO: 2036672 - RNA, 11 nt, Human herpesvirus 6
ccaacacaccu

SEQ ID NO: 2036673 - RNA, 17 nt, Human herpesvirus 6
cauacauuuugggcagu

SEQ ID NO: 2036674 - RNA, 15 nt, Human herpesvirus 6
acugcacgcugggcu

SEQ ID NO: 2036675 - RNA, 16 nt, Human herpesvirus 6
uggaaaacuaugugca

SEQ ID NO: 2036676 - RNA, 21 nt, Human herpesvirus 6
accaccggcuaacccuaaccc

SEQ ID NO: 2036677 - RNA, 19 nt, Human herpesvirus 6
uaaaaaaugaaugugcuga

SEQ ID NO: 2036678 - RNA, 13 nt, Human herpesvirus 6
gcguuccucucuc

SEQ ID NO: 2036679 - RNA, 16 nt, Human herpesvirus 6
auggauaaacgugucu

SEQ ID NO: 2036680 - RNA, 15 nt, Human herpesvirus 6
acauccuaacaagac

SEQ ID NO: 2036681 - RNA, 18 nt, Human herpesvirus 6
auaguguuuucugauugu

SEQ ID NO: 2036682 - RNA, 17 nt, Human herpesvirus 6
ugcagacgcugaaauca

SEQ ID NO: 2036683 - RNA, 21 nt, Human herpesvirus 6
cuaacgcggcaaccgcaguuc

SEQ ID NO: 2036684 - RNA, 19 nt, Human herpesvirus 6
uguaaauagguaaacuguu

SEQ ID NO: 2036685 - RNA, 19 nt, Human herpesvirus 6
uaccgcgguuggggucuuu

SEQ ID NO: 2036686 - RNA, 12 nt, Human herpesvirus 6
ugaguaauugaa

SEQ ID NO: 2036687 - RNA, 20 nt, Human herpesvirus 6
aauaaucgauuacaaaacaa

SEQ ID NO: 2036688 - RNA, 16 nt, Human herpesvirus 6
uuucuaaaaucaaaaa

SEQ ID NO: 2036689 - RNA, 20 nt, Human herpesvirus 6
auggacaacgguguggagac

SEQ ID NO: 2036690 - RNA, 21 nt, Human herpesvirus 6
gcacuuccgcgauacccagcg

SEQ ID NO: 2036691 - RNA, 22 nt, Human herpesvirus 6
agaagcgguagaguggaguugu

SEQ ID NO: 2036692 - RNA, 18 nt, Human herpesvirus 6
gcggagcggaggggcgcg

SEQ ID NO: 2036693 - RNA, 16 nt, Human herpesvirus 6
uacgccaguguggaua

SEQ ID NO: 2036694 - RNA, 13 nt, Human herpesvirus 6
ccgugacacacag

SEQ ID NO: 2036695 - RNA, 13 nt, Human herpesvirus 6
ucuuuuuaacuag

SEQ ID NO: 2036696 - RNA, 20 nt, Human herpesvirus 6
acuuugguucggagagguuu

SEQ ID NO: 2036697 - RNA, 16 nt, Human herpesvirus 6
cggaggcgacgaaaga

SEQ ID NO: 2036698 - RNA, 18 nt, Human herpesvirus 6
cgugcugcaaggccgacu

SEQ ID NO: 2036699 - RNA, 22 nt, Human herpesvirus 6
ccgaggggcggauccgcuccgc

SEQ ID NO: 2036700 - RNA, 16 nt, Human herpesvirus 6
cuggaaaacgacacag

SEQ ID NO: 2036701 - RNA, 17 nt, Human herpesvirus 6
aaacucaauuuugaaau

SEQ ID NO: 2036702 - RNA, 14 nt, Human herpesvirus 6
uguuguuuuuugga

SEQ ID NO: 2036703 - RNA, 19 nt, Human herpesvirus 6
ccguauagguguuuuugga

SEQ ID NO: 2036704 - RNA, 21 nt, Human herpesvirus 6
gaaucuacugagaucauaaau

SEQ ID NO: 2036705 - RNA, 22 nt, Human herpesvirus 6
uauacgaaaauaaaaaaaacaa

SEQ ID NO: 2036706 - RNA, 16 nt, Human herpesvirus 6
accgauucagaaaguu

SEQ ID NO: 2036707 - RNA, 12 nt, Human herpesvirus 6
aagauuaaaugu

SEQ ID NO: 2036708 - RNA, 13 nt, Human herpesvirus 6
uaauagccaaaca

SEQ ID NO: 2036709 - RNA, 12 nt, Human herpesvirus 6
cgggcaggaauc

SEQ ID NO: 2036710 - RNA, 13 nt, Human herpesvirus 6
cuuugacauuuau

SEQ ID NO: 2036711 - RNA, 15 nt, Human herpesvirus 6
gucuuuccugcccaa

SEQ ID NO: 2036712 - RNA, 19 nt, Human herpesvirus 6
caguucaacgcugucuuuu

SEQ ID NO: 2036713 - RNA, 19 nt, Human herpesvirus 6
aaacuggucugcuugcaaa

SEQ ID NO: 2036714 - RNA, 20 nt, Human herpesvirus 6
gacccgagguccgacacgcc

SEQ ID NO: 2036715 - RNA, 23 nt, Human herpesvirus 6
ugucagauacugaucguuuuuua

SEQ ID NO: 2036716 - RNA, 16 nt, Human herpesvirus 6
gcaagucacgggcagc

SEQ ID NO: 2036717 - RNA, 21 nt, Human herpesvirus 6
uuguacaggaggcuauggcuu

SEQ ID NO: 2036718 - RNA, 14 nt, Human herpesvirus 6
agucauuaacgaga

SEQ ID NO: 2036719 - RNA, 14 nt, Human herpesvirus 6
cgccaguguggaua

SEQ ID NO: 2036720 - RNA, 13 nt, Human herpesvirus 6
uaaauuguuuuac

SEQ ID NO: 2036721 - RNA, 17 nt, Human herpesvirus 6
cccagcguggaauuugu

SEQ ID NO: 2036722 - RNA, 22 nt, Human herpesvirus 6
uauggaaacacuuucuucgccu

SEQ ID NO: 2036723 - RNA, 17 nt, Human herpesvirus 6
cgauucuaauaaaagac

SEQ ID NO: 2036724 - RNA, 17 nt, Human herpesvirus 6
uuaaauguuacugaacu

SEQ ID NO: 2036725 - RNA, 19 nt, Human herpesvirus 6
cucuauuccccauuccuag

SEQ ID NO: 2036726 - RNA, 21 nt, Human herpesvirus 6
cguggggcacacauguauuua

SEQ ID NO: 2036727 - RNA, 22 nt, Human herpesvirus 6
cuuauacacgaacuaaauaaga

SEQ ID NO: 2036728 - RNA, 20 nt, Human herpesvirus 6
cgccggagguaacggagccc

SEQ ID NO: 2036729 - RNA, 15 nt, Human herpesvirus 6
auguguucacagagc

SEQ ID NO: 2036730 - RNA, 22 nt, Human herpesvirus 6
agucgcacacacaagaacagag

SEQ ID NO: 2036731 - RNA, 16 nt, Human herpesvirus 6
uccgugacacacagaa

SEQ ID NO: 2036732 - RNA, 18 nt, Human herpesvirus 6
gaagauacgagaacaaaa

SEQ ID NO: 2036733 - RNA, 18 nt, Human herpesvirus 6
augacaccgauucagaaa

SEQ ID NO: 2036734 - RNA, 20 nt, Human herpesvirus 6
gaaacacugaguucuguggc

SEQ ID NO: 2036735 - RNA, 20 nt, Human herpesvirus 6
gugaucugauucgacaaauc

SEQ ID NO: 2036736 - RNA, 14 nt, Human herpesvirus 6
gaacucucacggcc

SEQ ID NO: 2036737 - RNA, 17 nt, Human herpesvirus 6
auggugaguaccuguac

SEQ ID NO: 2036738 - RNA, 14 nt, Human herpesvirus 6
auaaguacauagaa

SEQ ID NO: 2036739 - RNA, 16 nt, Human herpesvirus 6
acaaccgccgccgccg

SEQ ID NO: 2036740 - RNA, 18 nt, Human herpesvirus 6
uugcuauagauuagaaau

SEQ ID NO: 2036741 - RNA, 18 nt, Human herpesvirus 6
gcuagacuauacuuuucu

SEQ ID NO: 2036742 - RNA, 18 nt, Human herpesvirus 6
aaaaucuucuuugugcgu

SEQ ID NO: 2036743 - RNA, 13 nt, Human herpesvirus 6
uacauaaacaccc

SEQ ID NO: 2036744 - RNA, 23 nt, Human herpesvirus 6
auauuuaacaacaucuuaaaaga

SEQ ID NO: 2036745 - RNA, 16 nt, Human herpesvirus 6
accgacuuauaucgaa

SEQ ID NO: 2036746 - RNA, 14 nt, Human herpesvirus 6
acacaauauacgua

SEQ ID NO: 2036747 - RNA, 13 nt, Human herpesvirus 6
acaaaacaaucua

SEQ ID NO: 2036748 - RNA, 17 nt, Human herpesvirus 6
cguccucgugcucugcc

SEQ ID NO: 2036749 - RNA, 13 nt, Human herpesvirus 6
aaaagggagauga

SEQ ID NO: 2036750 - RNA, 16 nt, Human herpesvirus 6
ucgcgauagucaugca

SEQ ID NO: 2036751 - RNA, 19 nt, Human herpesvirus 6
cagucaaauugauuaugau

SEQ ID NO: 2036752 - RNA, 14 nt, Human herpesvirus 6
caauauaaaagauu

SEQ ID NO: 2036753 - RNA, 18 nt, Human herpesvirus 6
cacauaugccgaggcuua

SEQ ID NO: 2036754 - RNA, 17 nt, Human herpesvirus 6
aacuauauugcugcuag

SEQ ID NO: 2036755 - RNA, 15 nt, Human herpesvirus 6
cgcacaucgauaaac

SEQ ID NO: 2036756 - RNA, 15 nt, Human herpesvirus 6
uuguguuucugucuu

SEQ ID NO: 2036757 - RNA, 14 nt, Human herpesvirus 6
agagauguuucccg

SEQ ID NO: 2036758 - RNA, 11 nt, Human herpesvirus 6
uccugcccagg

SEQ ID NO: 2036759 - RNA, 15 nt, Human herpesvirus 6
ucccggcccagagac

SEQ ID NO: 2036760 - RNA, 15 nt, Human herpesvirus 6
uugugcgaauugugu

SEQ ID NO: 2036761 - RNA, 14 nt, Human herpesvirus 6
auagaggaauugcu

SEQ ID NO: 2036762 - RNA, 19 nt, Human herpesvirus 6
aaaugucaaagaaacagua

SEQ ID NO: 2036763 - RNA, 15 nt, Human herpesvirus 6
ccgguaacgcugucg

SEQ ID NO: 2036764 - RNA, 13 nt, Human herpesvirus 6
aaaugaauguguu

SEQ ID NO: 2036765 - RNA, 17 nt, Human herpesvirus 6
caguugucuggcagcua

SEQ ID NO: 2036766 - RNA, 13 nt, Human herpesvirus 6
ucuuuccugccca

SEQ ID NO: 2036767 - RNA, 16 nt, Human herpesvirus 6
cacgaucuacacaccg

SEQ ID NO: 2036768 - RNA, 19 nt, Human herpesvirus 6
uggaggccuucaugagcca

SEQ ID NO: 2036769 - RNA, 16 nt, Human herpesvirus 6
cauuaacccuggguga

SEQ ID NO: 2036770 - RNA, 21 nt, Human herpesvirus 6
guggugguuuugggcgcaauc

SEQ ID NO: 2036771 - RNA, 13 nt, Human herpesvirus 6
gucugggacccac

SEQ ID NO: 2036772 - RNA, 21 nt, Human herpesvirus 6
gaaaaaaaauugccuuguaaa

SEQ ID NO: 2036773 - RNA, 22 nt, Human herpesvirus 6
cggagaacguggccguuacagu

SEQ ID NO: 2036774 - RNA, 18 nt, Human herpesvirus 6
ucagaaauaaaauuucga

SEQ ID NO: 2036775 - RNA, 21 nt, Human herpesvirus 6
cauuaaauuguuuuacaaauu

SEQ ID NO: 2036776 - RNA, 14 nt, Human herpesvirus 6
uuuugaaaaaacag

SEQ ID NO: 2036777 - RNA, 23 nt, Human herpesvirus 6
aaaaaguuuucuaaaaggcucug

SEQ ID NO: 2036778 - RNA, 20 nt, Human herpesvirus 6
gagaauaggaaaagauaggc

SEQ ID NO: 2036779 - RNA, 13 nt, Human herpesvirus 6
cacauaacugcau

SEQ ID NO: 2036780 - RNA, 15 nt, Human herpesvirus 6
agccuuuauucuguu

SEQ ID NO: 2036781 - RNA, 19 nt, Human herpesvirus 6
uguugaguaauugaacauu

SEQ ID NO: 2036782 - RNA, 22 nt, Human herpesvirus 6
cacaggauuauaaaaacacacc

SEQ ID NO: 2036783 - RNA, 16 nt, Human herpesvirus 6
acucaacccaaaaugc

SEQ ID NO: 2036784 - RNA, 17 nt, Human herpesvirus 6
cuggagcagucugcugg

SEQ ID NO: 2036785 - RNA, 22 nt, Human herpesvirus 6
cgugguuuuuuuuuucuuacac

SEQ ID NO: 2036786 - RNA, 17 nt, Human herpesvirus 6
aagucagagauuauuca

SEQ ID NO: 2036787 - RNA, 13 nt, Human herpesvirus 6
cgguacucuuuuc

SEQ ID NO: 2036788 - RNA, 22 nt, Human herpesvirus 6
gacagauccgucucucagcugg

SEQ ID NO: 2036789 - RNA, 19 nt, Human herpesvirus 6
aggaucguccccuuggcuc

SEQ ID NO: 2036790 - RNA, 21 nt, Human herpesvirus 6
aaaucuauccgcuaaaacgac

SEQ ID NO: 2036791 - RNA, 14 nt, Human herpesvirus 6
uaacgcagcaacaa

SEQ ID NO: 2036792 - RNA, 17 nt, Human herpesvirus 6
ugagauguucuaaagga

SEQ ID NO: 2036793 - RNA, 14 nt, Human herpesvirus 6
uguaauaauugaug

SEQ ID NO: 2036794 - RNA, 18 nt, Human herpesvirus 6
cgcuaaggugagccagau

SEQ ID NO: 2036795 - RNA, 14 nt, Human herpesvirus 6
cgucauguguggac

SEQ ID NO: 2036796 - RNA, 23 nt, Human herpesvirus 6
auaacaacaaccacagcagcagc

SEQ ID NO: 2036797 - RNA, 13 nt, Human herpesvirus 6
aauaaaggucagu

SEQ ID NO: 2036798 - RNA, 15 nt, Human herpesvirus 6
uaauaaacuuuuaaa

SEQ ID NO: 2036799 - RNA, 16 nt, Human herpesvirus 6
gcaccucugaaacacu

SEQ ID NO: 2036800 - RNA, 15 nt, Human herpesvirus 6
aaagaaucaaugaaa

SEQ ID NO: 2036801 - RNA, 18 nt, Human herpesvirus 6
aggagacaacaacgaaaa

SEQ ID NO: 2036802 - RNA, 19 nt, Human herpesvirus 6
aaaacagacgaaucacauc

SEQ ID NO: 2036803 - RNA, 14 nt, Human herpesvirus 6
uacuauuuguuuaa

SEQ ID NO: 2036804 - RNA, 20 nt, Human herpesvirus 6
aggaaauaaaaacaccucua

SEQ ID NO: 2036805 - RNA, 22 nt, Human herpesvirus 6
uuuguacacuuuaucgauguag

SEQ ID NO: 2036806 - RNA, 21 nt, Human herpesvirus 6
ccuugaauuauuuauauugga

SEQ ID NO: 2036807 - RNA, 16 nt, Human herpesvirus 6
ggaagagaggaagaaa

SEQ ID NO: 2036808 - RNA, 23 nt, Human herpesvirus 6
uaucagcacccuaugcaagcuca

SEQ ID NO: 2036809 - RNA, 14 nt, Human herpesvirus 6
cucaaaaaacauau

SEQ ID NO: 2036810 - RNA, 22 nt, Human herpesvirus 6
aucagugaaggcugccaugaaa

SEQ ID NO: 2036811 - RNA, 13 nt, Human herpesvirus 6
gauaacuuuuguu

SEQ ID NO: 2036812 - RNA, 22 nt, Human herpesvirus 6
ucgcugcuaucgucuauaacaa

SEQ ID NO: 2036813 - RNA, 16 nt, Human herpesvirus 6
aucaacuauuuaacau

SEQ ID NO: 2036814 - RNA, 15 nt, Human herpesvirus 6
agguccgacacgccc

SEQ ID NO: 2036815 - RNA, 22 nt, Human herpesvirus 6
cuucugccugaaaaugaagaga

SEQ ID NO: 2036816 - RNA, 17 nt, Human herpesvirus 6
cggguaagcagcagaac

SEQ ID NO: 2036817 - RNA, 16 nt, Human herpesvirus 6
ggaacgauaugcugcc

SEQ ID NO: 2036818 - RNA, 17 nt, Human herpesvirus 6
ggauggcuagugugccu

SEQ ID NO: 2036819 - RNA, 23 nt, Human herpesvirus 6
agcgccaacgaaaagcaucucaa

SEQ ID NO: 2036820 - RNA, 12 nt, Human herpesvirus 6
auuauguaaaua

SEQ ID NO: 2036821 - RNA, 16 nt, Human herpesvirus 6
auuguauauauagcug

SEQ ID NO: 2036822 - RNA, 24 nt, Human herpesvirus 6
ugucgugguggucuuguuaucuua

SEQ ID NO: 2036823 - RNA, 22 nt, Human herpesvirus 6
gccagacaucgaccgccggagg

SEQ ID NO: 2036824 - RNA, 17 nt, Human herpesvirus 6
uaaacaugauuguaaua

SEQ ID NO: 2036825 - RNA, 13 nt, Human herpesvirus 6
ggccagagacgug

SEQ ID NO: 2036826 - RNA, 19 nt, Human herpesvirus 6
guggaaaaaagucaccugu

SEQ ID NO: 2036827 - RNA, 12 nt, Human herpesvirus 6
aucuuuaacaug

SEQ ID NO: 2036828 - RNA, 14 nt, Human herpesvirus 6
ugcaaacccgacaa

SEQ ID NO: 2036829 - RNA, 19 nt, Human herpesvirus 6
uuaacgcgucaacaaacaa

SEQ ID NO: 2036830 - RNA, 22 nt, Human herpesvirus 6
aagcgccugccuacacugcgaa

SEQ ID NO: 2036831 - RNA, 16 nt, Human herpesvirus 6
guuaaauaacucagau

SEQ ID NO: 2036832 - RNA, 21 nt, Human herpesvirus 6
uucccgugcuccguaagaaau

SEQ ID NO: 2036833 - RNA, 19 nt, Human herpesvirus 6
uuuuuaaugcaaguuugaa

SEQ ID NO: 2036834 - RNA, 14 nt, Human herpesvirus 6
agugcgcuggcuua

SEQ ID NO: 2036835 - RNA, 15 nt, Human herpesvirus 6
cuuagcauauuuugg

SEQ ID NO: 2036836 - RNA, 22 nt, Human herpesvirus 6
aacauaucgagccaaagaaaca

SEQ ID NO: 2036837 - RNA, 16 nt, Human herpesvirus 6
gcaauuuccugucaug

SEQ ID NO: 2036838 - RNA, 12 nt, Human herpesvirus 6
uuaauaagaaag

SEQ ID NO: 2036839 - RNA, 15 nt, Human herpesvirus 6
cucgugcucugccuc

SEQ ID NO: 2036840 - RNA, 13 nt, Human herpesvirus 6
acagacagaggaa

SEQ ID NO: 2036841 - RNA, 16 nt, Human herpesvirus 6
cucugcaaaacaaagg

SEQ ID NO: 2036842 - RNA, 23 nt, Human herpesvirus 6
auuucuguuacugcgagcccgua

SEQ ID NO: 2036843 - RNA, 18 nt, Human herpesvirus 6
cgaucuuauauuaaagau

SEQ ID NO: 2036844 - RNA, 15 nt, Human herpesvirus 6
aagaauuuuuguagc

SEQ ID NO: 2036845 - RNA, 17 nt, Human herpesvirus 6
uauuuccugcccaggca

SEQ ID NO: 2036846 - RNA, 21 nt, Human herpesvirus 6
caaaucuguaagauuaaaugu

SEQ ID NO: 2036847 - RNA, 23 nt, Human herpesvirus 6
acaaccuccgcauaucgccccca

SEQ ID NO: 2036848 - RNA, 18 nt, Human herpesvirus 6
gcuucaacuaaauauguu

SEQ ID NO: 2036849 - RNA, 14 nt, Human herpesvirus 6
accgauucagaaag

SEQ ID NO: 2036850 - RNA, 20 nt, Human herpesvirus 6
gaacaaaaugaggggaacac

SEQ ID NO: 2036851 - RNA, 20 nt, Human herpesvirus 6
acggcgacaaccgccgccgc

SEQ ID NO: 2036852 - RNA, 16 nt, Human herpesvirus 6
ccaaccucuuccuaga

SEQ ID NO: 2036853 - RNA, 19 nt, Human herpesvirus 6
cuggcgcgcauguugcagu

SEQ ID NO: 2036854 - RNA, 13 nt, Human herpesvirus 6
cacaggcggggau

SEQ ID NO: 2036855 - RNA, 16 nt, Human herpesvirus 6
caacaacaauaacaac

SEQ ID NO: 2036856 - RNA, 15 nt, Human herpesvirus 6
uuauuaaauguuacu

SEQ ID NO: 2036857 - RNA, 13 nt, Human herpesvirus 6
cuauuauauugua

SEQ ID NO: 2036858 - RNA, 14 nt, Human herpesvirus 6
uaaaauuguaauuu

SEQ ID NO: 2036859 - RNA, 19 nt, Human herpesvirus 6
aaguuuacauagaaauuac

SEQ ID NO: 2036860 - RNA, 22 nt, Human herpesvirus 6
ccgucgauaauaauucagucug

SEQ ID NO: 2036861 - RNA, 15 nt, Human herpesvirus 6
gaaacuccccagaga

SEQ ID NO: 2036862 - RNA, 18 nt, Human herpesvirus 6
aguaguugcuaaguguga

SEQ ID NO: 2036863 - RNA, 23 nt, Human herpesvirus 6
cucggauauauacuuacuugagu

SEQ ID NO: 2036864 - RNA, 23 nt, Human herpesvirus 6
auuuuuuuuuuauuuacaaaaaa

SEQ ID NO: 2036865 - RNA, 16 nt, Human herpesvirus 6
aaguucuacaaaaagu

SEQ ID NO: 2036866 - RNA, 20 nt, Human herpesvirus 6
cauauuguguaacucuuuuu

SEQ ID NO: 2036867 - RNA, 14 nt, Human herpesvirus 6
cuaguuuucacacg

SEQ ID NO: 2036868 - RNA, 22 nt, Human herpesvirus 6
gugccucagaggugaguaggag

SEQ ID NO: 2036869 - RNA, 21 nt, Human herpesvirus 6
cuguggacgugccgggacccc

SEQ ID NO: 2036870 - RNA, 13 nt, Human herpesvirus 6
uuaaucggaaugu

SEQ ID NO: 2036871 - RNA, 22 nt, Human herpesvirus 6
ggagaugauuccaagugguggu

SEQ ID NO: 2036872 - RNA, 19 nt, Human herpesvirus 6
aauaaugcccagaugugga

SEQ ID NO: 2036873 - RNA, 14 nt, Human herpesvirus 6
aauggaagaaggcu

SEQ ID NO: 2036874 - RNA, 18 nt, Human herpesvirus 6
cgccaaaaaaauacagua

SEQ ID NO: 2036875 - RNA, 16 nt, Human herpesvirus 6
cugggacccacggugg

SEQ ID NO: 2036876 - RNA, 21 nt, Human herpesvirus 6
agaugauuccaaguggugguu

SEQ ID NO: 2036877 - RNA, 19 nt, Human herpesvirus 6
uacugaaaccaaagcauac

SEQ ID NO: 2036878 - RNA, 14 nt, Human herpesvirus 6
cucauaaaauuaaa

SEQ ID NO: 2036879 - RNA, 16 nt, Human herpesvirus 6
cauagagcauggcgca

SEQ ID NO: 2036880 - RNA, 19 nt, Human herpesvirus 6
aggaacaacuauacgguga

SEQ ID NO: 2036881 - RNA, 15 nt, Human herpesvirus 6
agaaaaaaacuguga

SEQ ID NO: 2036882 - RNA, 19 nt, Human herpesvirus 6
uuaccuaucguccuuaaua

SEQ ID NO: 2036883 - RNA, 19 nt, Human herpesvirus 6
uuggccuucgguacaguga

SEQ ID NO: 2036884 - RNA, 20 nt, Human herpesvirus 6
agcuacgccaaaacuacaaa

SEQ ID NO: 2036885 - RNA, 15 nt, Human herpesvirus 6
acugaaaccaaagca

SEQ ID NO: 2036886 - RNA, 13 nt, Human herpesvirus 6
uuauuaaauguua

SEQ ID NO: 2036887 - RNA, 19 nt, Human herpesvirus 6
agucccaucuauacacccu

SEQ ID NO: 2036888 - RNA, 17 nt, Human herpesvirus 6
auggcagaucuugaaaa

SEQ ID NO: 2036889 - RNA, 19 nt, Human herpesvirus 6
ugucacugucgaauauguu

SEQ ID NO: 2036890 - RNA, 22 nt, Human herpesvirus 6
uugaaaagguguuguguuugag

SEQ ID NO: 2036891 - RNA, 20 nt, Human herpesvirus 6
ggggaucgggcccggggacg

SEQ ID NO: 2036892 - RNA, 20 nt, Human herpesvirus 6
uuguaagaagaaaaaaacac

SEQ ID NO: 2036893 - RNA, 15 nt, Human herpesvirus 6
uccugaucacagagc

SEQ ID NO: 2036894 - RNA, 17 nt, Human herpesvirus 6
ccaacgcgacaggguga

SEQ ID NO: 2036895 - RNA, 21 nt, Human herpesvirus 6
ucuacugcaguccagaagucc

SEQ ID NO: 2036896 - RNA, 21 nt, Human herpesvirus 6
aaaaacaccucuaaaacaaga

SEQ ID NO: 2036897 - RNA, 17 nt, Human herpesvirus 6
agaggaaauaaaaacac

SEQ ID NO: 2036898 - RNA, 13 nt, Human herpesvirus 6
ccaccaacacacc

SEQ ID NO: 2036899 - RNA, 12 nt, Human herpesvirus 6
uaaaguuuucau

SEQ ID NO: 2036900 - RNA, 21 nt, Human herpesvirus 6
ucggcgcugauuccuguaagg

SEQ ID NO: 2036901 - RNA, 15 nt, Human herpesvirus 6
agaucuuuauggagg

SEQ ID NO: 2036902 - RNA, 22 nt, Human herpesvirus 6
cuuuuuuaaaccucuguagauc

SEQ ID NO: 2036903 - RNA, 14 nt, Human herpesvirus 6
ccacccccgcucga

SEQ ID NO: 2036904 - RNA, 15 nt, Human herpesvirus 6
gggcggaaguugguu

SEQ ID NO: 2036905 - RNA, 11 nt, Human herpesvirus 6
cgacccacucc

SEQ ID NO: 2036906 - RNA, 16 nt, Human herpesvirus 6
agaaaauccagcaaug

SEQ ID NO: 2036907 - RNA, 21 nt, Human herpesvirus 6
gggggaucgacgggcaggaau

SEQ ID NO: 2036908 - RNA, 16 nt, Human herpesvirus 6
gacaugcauuuuguau

SEQ ID NO: 2036909 - RNA, 17 nt, Human herpesvirus 6
caugucuugccucuccg

SEQ ID NO: 2036910 - RNA, 22 nt, Human herpesvirus 6
acuacguuuuguguuaaaauaa

SEQ ID NO: 2036911 - RNA, 22 nt, Human herpesvirus 6
uuacuugaaaaaguaguugcua

SEQ ID NO: 2036912 - RNA, 13 nt, Human herpesvirus 6
gaaaaaaaucaga

SEQ ID NO: 2036913 - RNA, 13 nt, Human herpesvirus 6
augcauucacaag

SEQ ID NO: 2036914 - RNA, 23 nt, Human herpesvirus 6
cgggacaaaaccgaggcagagca

SEQ ID NO: 2036915 - RNA, 22 nt, Human herpesvirus 6
gagauaaaaagagaggaaagaa

SEQ ID NO: 2036916 - RNA, 14 nt, Human herpesvirus 6
caauaauugcauuc

SEQ ID NO: 2036917 - RNA, 16 nt, Human herpesvirus 6
aucuuccacugaagca

SEQ ID NO: 2036918 - RNA, 15 nt, Human herpesvirus 6
caccgucucugaagc

SEQ ID NO: 2036919 - RNA, 15 nt, Human herpesvirus 6
cuaggacguacagaa

SEQ ID NO: 2036920 - RNA, 20 nt, Human herpesvirus 6
gcgagucuugugugaaagua

SEQ ID NO: 2036921 - RNA, 22 nt, Human herpesvirus 6
uguagggugcuuugcuucagug

SEQ ID NO: 2036922 - RNA, 14 nt, Human herpesvirus 6
caaaggaaaccacc

SEQ ID NO: 2036923 - RNA, 21 nt, Human herpesvirus 6
gggauuaauaaaggauguuug

SEQ ID NO: 2036924 - RNA, 13 nt, Human herpesvirus 6
agauuguuauuag

SEQ ID NO: 2036925 - RNA, 16 nt, Human herpesvirus 6
aauuuuuuauuucuga

SEQ ID NO: 2036926 - RNA, 17 nt, Human herpesvirus 6
aaacaaauggaaacugg

SEQ ID NO: 2036927 - RNA, 16 nt, Human herpesvirus 6
ggggcggacggggacg

SEQ ID NO: 2036928 - RNA, 14 nt, Human herpesvirus 6
uaaccggaaaagag

SEQ ID NO: 2036929 - RNA, 18 nt, Human herpesvirus 6
uuacuguuuuaaccgaua

SEQ ID NO: 2036930 - RNA, 18 nt, Human herpesvirus 6
gaugauuauucugucuug

SEQ ID NO: 2036931 - RNA, 17 nt, Human herpesvirus 6
uaaauauaucaaagaug

SEQ ID NO: 2036932 - RNA, 21 nt, Human herpesvirus 6
gaacaggcggaagaacacgaa

SEQ ID NO: 2036933 - RNA, 20 nt, Human herpesvirus 6
uaaaauuugcuaacggggca

SEQ ID NO: 2036934 - RNA, 20 nt, Human herpesvirus 6
caugauuguaauaaaguguc

SEQ ID NO: 2036935 - RNA, 19 nt, Human herpesvirus 6
uccguuuuucucugcaaaa

SEQ ID NO: 2036936 - RNA, 20 nt, Human herpesvirus 6
gaucaucuccaauaaaauau

SEQ ID NO: 2036937 - RNA, 23 nt, Human herpesvirus 6
acgugccaccgucugggacccac

SEQ ID NO: 2036938 - RNA, 17 nt, Human herpesvirus 6
agcgaagugaagaauuu

SEQ ID NO: 2036939 - RNA, 20 nt, Human herpesvirus 6
accuaacgcgggauauuuua

SEQ ID NO: 2036940 - RNA, 11 nt, Human herpesvirus 6
agucagugggu

SEQ ID NO: 2036941 - RNA, 20 nt, Human herpesvirus 6
cauuuguuuuuuaaagcaca

SEQ ID NO: 2036942 - RNA, 19 nt, Human herpesvirus 6
aggcaugugauugucuuuu

SEQ ID NO: 2036943 - RNA, 17 nt, Human herpesvirus 6
gagcuuguuaggacacu

SEQ ID NO: 2036944 - RNA, 13 nt, Human herpesvirus 6
ugcaccuguuacu

SEQ ID NO: 2036945 - RNA, 15 nt, Human herpesvirus 6
uaacugguucagaau

SEQ ID NO: 2036946 - RNA, 20 nt, Human herpesvirus 6
acagagcgcaucuuuaacau

SEQ ID NO: 2036947 - RNA, 13 nt, Human herpesvirus 6
ugccaaaggaaac

SEQ ID NO: 2036948 - RNA, 21 nt, Human herpesvirus 6
ccacagaugucccggggggaa

SEQ ID NO: 2036949 - RNA, 19 nt, Human herpesvirus 6
uuuauuuucguauaaaaug

SEQ ID NO: 2036950 - RNA, 19 nt, Human herpesvirus 6
gugcuucuggcacaggcau

SEQ ID NO: 2036951 - RNA, 20 nt, Human herpesvirus 6
cacgacgugcugcaaggccg

SEQ ID NO: 2036952 - RNA, 17 nt, Human herpesvirus 6
ugugaaaguauuuuacu

SEQ ID NO: 2036953 - RNA, 18 nt, Human herpesvirus 6
ggccugacacaaucagaa

SEQ ID NO: 2036954 - RNA, 14 nt, Human herpesvirus 6
uaacuuauguuucu

SEQ ID NO: 2036955 - RNA, 20 nt, Human herpesvirus 6
gacccacgguggccuggcac

SEQ ID NO: 2036956 - RNA, 13 nt, Human herpesvirus 6
auucuaacgucug

SEQ ID NO: 2036957 - RNA, 13 nt, Human herpesvirus 6
aacaugaacauug

SEQ ID NO: 2036958 - RNA, 20 nt, Human herpesvirus 6
ccuuguggaggauuucugag

SEQ ID NO: 2036959 - RNA, 12 nt, Human herpesvirus 6
aaaguuuucuaa

SEQ ID NO: 2036960 - RNA, 16 nt, Human herpesvirus 6
aaucauggugucuuug

SEQ ID NO: 2036961 - RNA, 18 nt, Human herpesvirus 6
ucgacgaaauaauugaua

SEQ ID NO: 2036962 - RNA, 23 nt, Human herpesvirus 6
uucuuaacucaucgacuucuguc

SEQ ID NO: 2036963 - RNA, 21 nt, Human herpesvirus 6
auccaaucacaacaaaaaugc

SEQ ID NO: 2036964 - RNA, 13 nt, Human herpesvirus 6
gggccuccgccac

SEQ ID NO: 2036965 - RNA, 18 nt, Human herpesvirus 6
agaucuguucgaaaaagu

SEQ ID NO: 2036966 - RNA, 16 nt, Human herpesvirus 6
cuauguuauguaaaga

SEQ ID NO: 2036967 - RNA, 13 nt, Human herpesvirus 6
uucgcuucuuaua

SEQ ID NO: 2036968 - RNA, 21 nt, Human herpesvirus 6
gccacgacgugcugcaaggcc

SEQ ID NO: 2036969 - RNA, 20 nt, Human herpesvirus 6
uauaucaaacuuuuuuugaa

SEQ ID NO: 2036970 - RNA, 19 nt, Human herpesvirus 6
acauuuugguuucccucag

SEQ ID NO: 2036971 - RNA, 17 nt, Human herpesvirus 6
gugccaccgucugggac

SEQ ID NO: 2036972 - RNA, 19 nt, Human herpesvirus 6
cggauucaaagaaaguuuc

SEQ ID NO: 2036973 - RNA, 15 nt, Human herpesvirus 6
ucuaaaaggcucugu

SEQ ID NO: 2036974 - RNA, 21 nt, Human herpesvirus 6
ucacaaaguuuaaguuuucac

SEQ ID NO: 2036975 - RNA, 17 nt, Human herpesvirus 6
gcgcgcauguugcaguu

SEQ ID NO: 2036976 - RNA, 19 nt, Human herpesvirus 6
auuugcucgcacgaaauga

SEQ ID NO: 2036977 - RNA, 15 nt, Human herpesvirus 6
cccuaugcaagcuca

SEQ ID NO: 2036978 - RNA, 14 nt, Human herpesvirus 6
acaaauaaaagcau

SEQ ID NO: 2036979 - RNA, 15 nt, Human herpesvirus 6
acgcggcaaccgcag

SEQ ID NO: 2036980 - RNA, 22 nt, Human herpesvirus 6
gccaccgucugggacccacggu

SEQ ID NO: 2036981 - RNA, 18 nt, Human herpesvirus 6
aaacucuaaaagcugcua

SEQ ID NO: 2036982 - RNA, 18 nt, Human herpesvirus 6
uuuaaugagaggacaguc

SEQ ID NO: 2036983 - RNA, 20 nt, Human herpesvirus 6
caagccaugacaagaaaggu

SEQ ID NO: 2036984 - RNA, 18 nt, Human herpesvirus 6
auacaauaguaacuucuc

SEQ ID NO: 2036985 - RNA, 18 nt, Human herpesvirus 6
gggugaguuuuaucacuu

SEQ ID NO: 2036986 - RNA, 22 nt, Human herpesvirus 6
aagcaaaaacagauuaaauaua

SEQ ID NO: 2036987 - RNA, 12 nt, Human herpesvirus 6
aaaaaaaugaua

SEQ ID NO: 2036988 - RNA, 16 nt, Human herpesvirus 6
caagacgccacgggca

SEQ ID NO: 2036989 - RNA, 22 nt, Human herpesvirus 6
ucguacacgcauuugcaauugu

SEQ ID NO: 2036990 - RNA, 17 nt, Human herpesvirus 6
uucucugcaaaacaaag

SEQ ID NO: 2036991 - RNA, 17 nt, Human herpesvirus 6
ugagguguuuccugccc

SEQ ID NO: 2036992 - RNA, 18 nt, Human herpesvirus 6
aacgcgguaacgccacag

SEQ ID NO: 2036993 - RNA, 12 nt, Human herpesvirus 6
aaaaucucaaac

SEQ ID NO: 2036994 - RNA, 21 nt, Human herpesvirus 6
uggccauauuaggcugcagcc

SEQ ID NO: 2036995 - RNA, 22 nt, Human herpesvirus 6
ucuccucguggucauugguguu

SEQ ID NO: 2036996 - RNA, 23 nt, Human herpesvirus 6
uuaaagcagcuagagaaauugga

SEQ ID NO: 2036997 - RNA, 21 nt, Human herpesvirus 6
cgguccaaggauuaugaucau

SEQ ID NO: 2036998 - RNA, 18 nt, Human herpesvirus 6
agccacugcggaguuuua

SEQ ID NO: 2036999 - RNA, 14 nt, Human herpesvirus 6
auccgcccuccccg

SEQ ID NO: 2037000 - RNA, 23 nt, Human herpesvirus 6
caaagacgauugcuuuaguagug

SEQ ID NO: 2037001 - RNA, 15 nt, Human herpesvirus 6
ccccggaguacacgu

SEQ ID NO: 2037002 - RNA, 17 nt, Human herpesvirus 6
gagcuaauaugaacaau

SEQ ID NO: 2037003 - RNA, 21 nt, Human herpesvirus 6
uauuccaaacuacggaaaauc

SEQ ID NO: 2037004 - RNA, 23 nt, Human herpesvirus 6
gucgggaaauaaaaaauauuaau

SEQ ID NO: 2037005 - RNA, 20 nt, Human herpesvirus 6
ugaaaaaaaaugaaggggaa

SEQ ID NO: 2037006 - RNA, 11 nt, Human herpesvirus 6
ccuuguuuucu

SEQ ID NO: 2037007 - RNA, 19 nt, Human herpesvirus 6
uaucuugaaaucuacugua

SEQ ID NO: 2037008 - RNA, 21 nt, Human herpesvirus 6
gagacuuagcuagaugugucu

SEQ ID NO: 2037009 - RNA, 14 nt, Human herpesvirus 6
agccuaagaaauuu

SEQ ID NO: 2037010 - RNA, 16 nt, Human herpesvirus 6
agggacccacaggcgg

SEQ ID NO: 2037011 - RNA, 14 nt, Human herpesvirus 6
acccgcguccucca

SEQ ID NO: 2037012 - RNA, 14 nt, Human herpesvirus 6
ucugacgaaguuuu

SEQ ID NO: 2037013 - RNA, 15 nt, Human herpesvirus 6
uauaaaaaacuaaaa

SEQ ID NO: 2037014 - RNA, 15 nt, Human herpesvirus 6
guuaaugcugcugcu

SEQ ID NO: 2037015 - RNA, 16 nt, Human herpesvirus 6
gcuguccaucuucaga

SEQ ID NO: 2037016 - RNA, 18 nt, Human herpesvirus 6
caccuucccucccacccc

SEQ ID NO: 2037017 - RNA, 13 nt, Human herpesvirus 6
gcacaggcgaacg

SEQ ID NO: 2037018 - RNA, 22 nt, Human herpesvirus 6
gacgggcgucaucgguggcaga

SEQ ID NO: 2037019 - RNA, 19 nt, Human herpesvirus 6
uucuaagacgagauguuuc

SEQ ID NO: 2037020 - RNA, 15 nt, Human herpesvirus 6
uugauguauggagau

SEQ ID NO: 2037021 - RNA, 13 nt, Human herpesvirus 6
gcggauggagccc

SEQ ID NO: 2037022 - RNA, 12 nt, Human herpesvirus 6
guaaacuucugc

SEQ ID NO: 2037023 - RNA, 20 nt, Human herpesvirus 6
cgcgguuugggggucuuucc

SEQ ID NO: 2037024 - RNA, 18 nt, Human herpesvirus 6
ucaccgauaaaaacucac

SEQ ID NO: 2037025 - RNA, 15 nt, Human herpesvirus 6
auccgcuccgcgccc

SEQ ID NO: 2037026 - RNA, 20 nt, Human herpesvirus 6
aacaagauccaaucacaaca

SEQ ID NO: 2037027 - RNA, 22 nt, Human herpesvirus 6
agguggcaucagaauccagaaa

SEQ ID NO: 2037028 - RNA, 21 nt, Human herpesvirus 6
ucuacguaugaaaguccucaa

SEQ ID NO: 2037029 - RNA, 21 nt, Human herpesvirus 6
gcugugacgaagauggaugug

SEQ ID NO: 2037030 - RNA, 18 nt, Human herpesvirus 6
cuucugcuaauucauagu

SEQ ID NO: 2037031 - RNA, 12 nt, Human herpesvirus 6
agaaaugaccug

SEQ ID NO: 2037032 - RNA, 17 nt, Human herpesvirus 6
uaugaucauaugaggau

SEQ ID NO: 2037033 - RNA, 17 nt, Human herpesvirus 6
uaugcuuauacuguugu

SEQ ID NO: 2037034 - RNA, 17 nt, Human herpesvirus 6
cagaccucauauaagaa

SEQ ID NO: 2037035 - RNA, 17 nt, Human herpesvirus 6
cuaauaugaacaaugac

SEQ ID NO: 2037036 - RNA, 14 nt, Human herpesvirus 6
uucuacaaaaauac

SEQ ID NO: 2037037 - RNA, 17 nt, Human herpesvirus 6
uugacgguuuauaugca

SEQ ID NO: 2037038 - RNA, 21 nt, Human herpesvirus 6
ggaagaacaggcggaagaaca

SEQ ID NO: 2037039 - RNA, 23 nt, Human herpesvirus 6
gaaugcuauucguuuuuuuucuu

SEQ ID NO: 2037040 - RNA, 18 nt, Human herpesvirus 6
ggaugccugcauaugcag

SEQ ID NO: 2037041 - RNA, 21 nt, Human herpesvirus 6
cacuccgacucgccgcugcag

SEQ ID NO: 2037042 - RNA, 15 nt, Human herpesvirus 6
aguaaaacuauugac

SEQ ID NO: 2037043 - RNA, 18 nt, Human herpesvirus 6
ucaucaaauccucuacgu

SEQ ID NO: 2037044 - RNA, 14 nt, Human herpesvirus 6
uccgcccuccccga

SEQ ID NO: 2037045 - RNA, 22 nt, Human herpesvirus 6
uucagguucuucaaaaaaagaa

SEQ ID NO: 2037046 - RNA, 14 nt, Human herpesvirus 6
uuuacugcaugcua

SEQ ID NO: 2037047 - RNA, 15 nt, Human herpesvirus 6
cagguauaagaacug

SEQ ID NO: 2037048 - RNA, 14 nt, Human herpesvirus 6
aaagcagaucgagu

SEQ ID NO: 2037049 - RNA, 19 nt, Human herpesvirus 6
ucagauacugaucguuuuu

SEQ ID NO: 2037050 - RNA, 14 nt, Human herpesvirus 6
agcucuccugggca

SEQ ID NO: 2037051 - RNA, 22 nt, Human herpesvirus 6
ggcgaugaccgcuaaauugaua

SEQ ID NO: 2037052 - RNA, 12 nt, Human herpesvirus 6
cuggaaaacuau

SEQ ID NO: 2037053 - RNA, 20 nt, Human herpesvirus 6
aggaagaaacggacacgcgc

SEQ ID NO: 2037054 - RNA, 19 nt, Human herpesvirus 6
caccgagauccccaagagg

SEQ ID NO: 2037055 - RNA, 15 nt, Human herpesvirus 6
ccucgugcucugccu

SEQ ID NO: 2037056 - RNA, 12 nt, Human herpesvirus 6
aggcugaaauuu

SEQ ID NO: 2037057 - RNA, 18 nt, Human herpesvirus 6
auggcgcauaacggaaaa

SEQ ID NO: 2037058 - RNA, 14 nt, Human herpesvirus 6
ccaaucacaacaaa

SEQ ID NO: 2037059 - RNA, 16 nt, Human herpesvirus 6
aaauuguuuuacaaau

SEQ ID NO: 2037060 - RNA, 14 nt, Human herpesvirus 6
uccccacaauaaga

SEQ ID NO: 2037061 - RNA, 16 nt, Human herpesvirus 6
uguucaacgucuucaa

SEQ ID NO: 2037062 - RNA, 17 nt, Human herpesvirus 6
ucaagguggagguuucu

SEQ ID NO: 2037063 - RNA, 18 nt, Human herpesvirus 6
uguaagauuaaaugugaa

SEQ ID NO: 2037064 - RNA, 17 nt, Human herpesvirus 6
guuuaccuauuuacaau

SEQ ID NO: 2037065 - RNA, 22 nt, Human herpesvirus 6
gagcgugccguaaaucugcguc

SEQ ID NO: 2037066 - RNA, 22 nt, Human herpesvirus 6
cauuuauuucguauguuuggau

SEQ ID NO: 2037067 - RNA, 14 nt, Human herpesvirus 6
cugugucuguucaa

SEQ ID NO: 2037068 - RNA, 20 nt, Human herpesvirus 6
gcgaucgcugacucgccuuu

SEQ ID NO: 2037069 - RNA, 22 nt, Human herpesvirus 6
aaccgccgugcuucuggcacag

SEQ ID NO: 2037070 - RNA, 18 nt, Human herpesvirus 6
auuucaagagaacaugau

SEQ ID NO: 2037071 - RNA, 22 nt, Human herpesvirus 6
gcuaaaucaaaugauuuuacaa

SEQ ID NO: 2037072 - RNA, 14 nt, Human herpesvirus 6
aucgcgcaccgcug

SEQ ID NO: 2037073 - RNA, 18 nt, Human herpesvirus 6
acccacgguggccuggca

SEQ ID NO: 2037074 - RNA, 10 nt, Human herpesvirus 6
agagaggaag

SEQ ID NO: 2037075 - RNA, 23 nt, Human herpesvirus 6
gguuugaaacacugcaagguuuc

SEQ ID NO: 2037076 - RNA, 24 nt, Human herpesvirus 6
uuccacgaguggaucgaaugcuag

SEQ ID NO: 2037077 - RNA, 22 nt, Human herpesvirus 6
ggacccgagguccgacacgccc

SEQ ID NO: 2037078 - RNA, 18 nt, Human herpesvirus 6
ugugacgaagauggaugu

SEQ ID NO: 2037079 - RNA, 22 nt, Human herpesvirus 6
cugcccaggcgaacgagaacuc

SEQ ID NO: 2037080 - RNA, 18 nt, Human herpesvirus 6
cguuaguuuuuuguuuca

SEQ ID NO: 2037081 - RNA, 23 nt, Human herpesvirus 6
guguuaaaggaugcggacucuga

SEQ ID NO: 2037082 - RNA, 12 nt, Human herpesvirus 6
gaucagugggua

SEQ ID NO: 2037083 - RNA, 19 nt, Human herpesvirus 6
cagagccuagaccaagaau

SEQ ID NO: 2037084 - RNA, 19 nt, Human herpesvirus 6
ugcagacgcugaaaucauu

SEQ ID NO: 2037085 - RNA, 13 nt, Human herpesvirus 6
cggaguugcagug

SEQ ID NO: 2037086 - RNA, 20 nt, Human herpesvirus 6
agacugguugaguuuccugc

SEQ ID NO: 2037087 - RNA, 22 nt, Human herpesvirus 6
ucugcauuuauaucaaacuuuu

SEQ ID NO: 2037088 - RNA, 20 nt, Human herpesvirus 6
uugagagcuaauaugaacaa

SEQ ID NO: 2037089 - RNA, 15 nt, Human herpesvirus 6
caaagaaaagaugua

SEQ ID NO: 2037090 - RNA, 20 nt, Human herpesvirus 6
uauuguguguacaaugacug

SEQ ID NO: 2037091 - RNA, 16 nt, Human herpesvirus 6
auuaacaaauuacaau

SEQ ID NO: 2037092 - RNA, 15 nt, Human herpesvirus 6
gguuagagcugggga

SEQ ID NO: 2037093 - RNA, 20 nt, Human herpesvirus 6
uuucacgugaaauaaaguuu

SEQ ID NO: 2037094 - RNA, 21 nt, Human herpesvirus 6
augauuauaucgcaagcaaaa

SEQ ID NO: 2037095 - RNA, 20 nt, Human herpesvirus 6
agaaaaaaaaauaaguacau

SEQ ID NO: 2037096 - RNA, 17 nt, Human herpesvirus 6
uuggauucaggcuuuaa

SEQ ID NO: 2037097 - RNA, 19 nt, Human herpesvirus 6
gaauaacgguguugaguuu

SEQ ID NO: 2037098 - RNA, 20 nt, Human herpesvirus 6
gagucuggcaucugcggcuc

SEQ ID NO: 2037099 - RNA, 15 nt, Human herpesvirus 6
agauguuucccguau

SEQ ID NO: 2037100 - RNA, 13 nt, Human herpesvirus 6
cauaaacagacag

SEQ ID NO: 2037101 - RNA, 14 nt, Human herpesvirus 6
ugggggucuuuccu

SEQ ID NO: 2037102 - RNA, 19 nt, Human herpesvirus 6
ugcuacccacaugaaauca

SEQ ID NO: 2037103 - RNA, 13 nt, Human herpesvirus 6
gaccaggacaauc

SEQ ID NO: 2037104 - RNA, 16 nt, Human herpesvirus 6
uaaaucugagguuucc

SEQ ID NO: 2037105 - RNA, 14 nt, Human herpesvirus 6
ccuuuaaccauguu

SEQ ID NO: 2037106 - RNA, 19 nt, Human herpesvirus 6
aagguguuaaacgaaaacu

SEQ ID NO: 2037107 - RNA, 22 nt, Human herpesvirus 6
cugcccaggcaaacgagaacuc

SEQ ID NO: 2037108 - RNA, 17 nt, Human herpesvirus 6
aguguguucuuacaaug

SEQ ID NO: 2037109 - RNA, 13 nt, Human herpesvirus 6
agcuuagggccaa

SEQ ID NO: 2037110 - RNA, 14 nt, Human herpesvirus 6
gcagcaaauaaaua

SEQ ID NO: 2037111 - RNA, 18 nt, Human herpesvirus 6
auucaaaacgacaucgcg

SEQ ID NO: 2037112 - RNA, 12 nt, Human herpesvirus 6
uggcagagggga

SEQ ID NO: 2037113 - RNA, 15 nt, Human herpesvirus 6
agauguagcuggaua

SEQ ID NO: 2037114 - RNA, 17 nt, Human herpesvirus 6
uuaacagugucuguuuu

SEQ ID NO: 2037115 - RNA, 21 nt, Human herpesvirus 6
gagaggaagaaacggacacgc

SEQ ID NO: 2037116 - RNA, 15 nt, Human herpesvirus 6
cuccguuuccuccuc

SEQ ID NO: 2037117 - RNA, 21 nt, Human herpesvirus 6
acaccgauucagaaaguucua

SEQ ID NO: 2037118 - RNA, 17 nt, Human herpesvirus 6
uacaaagugaaagagac

SEQ ID NO: 2037119 - RNA, 20 nt, Human herpesvirus 6
augauagggaauauguuguu

SEQ ID NO: 2037120 - RNA, 15 nt, Human herpesvirus 6
cugccauaucacaca

SEQ ID NO: 2037121 - RNA, 14 nt, Human herpesvirus 6
agaacaaaaugagg

SEQ ID NO: 2037122 - RNA, 20 nt, Human herpesvirus 6
aucgaaaucguauacguuaa

SEQ ID NO: 2037123 - RNA, 22 nt, Human herpesvirus 6
agacuccuacaauacgguuugu

SEQ ID NO: 2037124 - RNA, 17 nt, Human herpesvirus 6
cuaugucgauguggaua

SEQ ID NO: 2037125 - RNA, 18 nt, Human herpesvirus 6
cagucacacacagggugc

SEQ ID NO: 2037126 - RNA, 17 nt, Human herpesvirus 6
uuaugcgacugcaagag

SEQ ID NO: 2037127 - RNA, 14 nt, Human herpesvirus 6
aaagcugcuaacgc

SEQ ID NO: 2037128 - RNA, 14 nt, Human herpesvirus 6
cagaccacaccccu

SEQ ID NO: 2037129 - RNA, 22 nt, Human herpesvirus 6
gaaauuacaagguacacaauau

SEQ ID NO: 2037130 - RNA, 13 nt, Human herpesvirus 6
uuuaaggauaaga

SEQ ID NO: 2037131 - RNA, 21 nt, Human herpesvirus 6
ucagaagagaugaaagacaga

SEQ ID NO: 2037132 - RNA, 14 nt, Human herpesvirus 6
caugucggccucug

SEQ ID NO: 2037133 - RNA, 21 nt, Human herpesvirus 6
accagcauguuuucuccucaa

SEQ ID NO: 2037134 - RNA, 21 nt, Human herpesvirus 6
uuuuucucguuccccaugucu

SEQ ID NO: 2037135 - RNA, 20 nt, Human herpesvirus 6
ggaaagaagauuuuccuagu

SEQ ID NO: 2037136 - RNA, 19 nt, Human herpesvirus 6
aacgcgucaacaaacaauu

SEQ ID NO: 2037137 - RNA, 22 nt, Human herpesvirus 6
ucggaaaacuaaaagucagugg

SEQ ID NO: 2037138 - RNA, 23 nt, Human herpesvirus 6
aacacgugggucagauaguugau

SEQ ID NO: 2037139 - RNA, 21 nt, Human herpesvirus 6
acaaauucuuacauuuuguac

SEQ ID NO: 2037140 - RNA, 18 nt, Human herpesvirus 6
aaacuuuuaaaacaggaa

SEQ ID NO: 2037141 - RNA, 16 nt, Human herpesvirus 6
cauauaauauuuccau

SEQ ID NO: 2037142 - RNA, 14 nt, Human herpesvirus 6
uauugucgaagaac

SEQ ID NO: 2037143 - RNA, 16 nt, Human herpesvirus 6
augaauguaacugguu

SEQ ID NO: 2037144 - RNA, 12 nt, Human herpesvirus 6
agaggaaagaau

SEQ ID NO: 2037145 - RNA, 14 nt, Human herpesvirus 6
aacacagcacauaa

SEQ ID NO: 2037146 - RNA, 19 nt, Human herpesvirus 6
cguuauucguaagugggua

SEQ ID NO: 2037147 - RNA, 18 nt, Human herpesvirus 6
cuuuaacuuauguuucua

SEQ ID NO: 2037148 - RNA, 22 nt, Human herpesvirus 6
gauuucaagauuguguuucugu

SEQ ID NO: 2037149 - RNA, 22 nt, Human herpesvirus 6
caaaauuugaaauaucagaaau

SEQ ID NO: 2037150 - RNA, 21 nt, Human herpesvirus 6
uaaugcgguucgacagagaua

SEQ ID NO: 2037151 - RNA, 19 nt, Human herpesvirus 6
uuaaugaaugugcuuugga

SEQ ID NO: 2037152 - RNA, 15 nt, Human herpesvirus 6
uccaaccccucccau

SEQ ID NO: 2037153 - RNA, 15 nt, Human herpesvirus 6
gcuaauaugaacaau

SEQ ID NO: 2037154 - RNA, 16 nt, Human herpesvirus 6
ggcaucugcggcucug

SEQ ID NO: 2037155 - RNA, 19 nt, Human herpesvirus 6
aaucuguaagauuaaaugu

SEQ ID NO: 2037156 - RNA, 20 nt, Human herpesvirus 6
agcguguuauuucgggacaa

SEQ ID NO: 2037157 - RNA, 15 nt, Human herpesvirus 6
ucugucugcagcuua

SEQ ID NO: 2037158 - RNA, 23 nt, Human herpesvirus 6
gggguguguaugcguggggugcg

SEQ ID NO: 2037159 - RNA, 20 nt, Human herpesvirus 6
uaauuuaguguuuaauguaa

SEQ ID NO: 2037160 - RNA, 20 nt, Human herpesvirus 6
ucauaaagauaaagaucagu

SEQ ID NO: 2037161 - RNA, 18 nt, Human herpesvirus 6
gagcgggcuaauguaugc

SEQ ID NO: 2037162 - RNA, 20 nt, Human herpesvirus 6
agacauugcuuucucuuuuu

SEQ ID NO: 2037163 - RNA, 14 nt, Human herpesvirus 6
ccgaugaauucugg

SEQ ID NO: 2037164 - RNA, 14 nt, Human herpesvirus 6
gaacaaaaugaggg

SEQ ID NO: 2037165 - RNA, 21 nt, Human herpesvirus 6
cggggcggacggggacgacac

SEQ ID NO: 2037166 - RNA, 18 nt, Human herpesvirus 6
gugauuucacgugaaaua

SEQ ID NO: 2037167 - RNA, 23 nt, Human herpesvirus 6
aacugguguaaauacccuggggu

SEQ ID NO: 2037168 - RNA, 23 nt, Human herpesvirus 6
aauaaggaaaaauaucgaaauaa

SEQ ID NO: 2037169 - RNA, 20 nt, Human herpesvirus 6
ggggucuuuccugcacaggc

SEQ ID NO: 2037170 - RNA, 13 nt, Human herpesvirus 6
uacuaauguggau

SEQ ID NO: 2037171 - RNA, 16 nt, Human herpesvirus 6
ucuaaaacaagacaga

SEQ ID NO: 2037172 - RNA, 17 nt, Human herpesvirus 6
gaagcgguagaguggag

SEQ ID NO: 2037173 - RNA, 14 nt, Human herpesvirus 6
uuauaaaaccgauc

SEQ ID NO: 2037174 - RNA, 16 nt, Human herpesvirus 6
acaagguucgucgaga

SEQ ID NO: 2037175 - RNA, 11 nt, Human herpesvirus 6
gaaaacaaugc

SEQ ID NO: 2037176 - RNA, 14 nt, Human herpesvirus 6
aagcacaaaaccag

SEQ ID NO: 2037177 - RNA, 18 nt, Human herpesvirus 6
gaucaacggccuggagua

SEQ ID NO: 2037178 - RNA, 15 nt, Human herpesvirus 6
ccaguauugaagaaa

SEQ ID NO: 2037179 - RNA, 15 nt, Human herpesvirus 6
guuugaaacacugca

SEQ ID NO: 2037180 - RNA, 15 nt, Human herpesvirus 6
gagacgaaacauagu

SEQ ID NO: 2037181 - RNA, 16 nt, Human herpesvirus 6
ccugggagcucucccu

SEQ ID NO: 2037182 - RNA, 18 nt, Human herpesvirus 6
uaaggaagauucagagug

SEQ ID NO: 2037183 - RNA, 20 nt, Human herpesvirus 6
caguuauuacauuuuuggau

SEQ ID NO: 2037184 - RNA, 14 nt, Human herpesvirus 6
caagaaaagaaaca

SEQ ID NO: 2037185 - RNA, 23 nt, Human herpesvirus 6
aggugacucuucucuaaaaacua

SEQ ID NO: 2037186 - RNA, 18 nt, Human herpesvirus 6
cguccgaguuagcagaag

SEQ ID NO: 2037187 - RNA, 19 nt, Human herpesvirus 6
agggugcuuugcuucagug

SEQ ID NO: 2037188 - RNA, 17 nt, Human herpesvirus 6
uguaauacaucaacaaa

SEQ ID NO: 2037189 - RNA, 19 nt, Human herpesvirus 6
gccuugucaucaugugugc

SEQ ID NO: 2037190 - RNA, 15 nt, Human herpesvirus 6
aagauguugcaauaa

SEQ ID NO: 2037191 - RNA, 17 nt, Human herpesvirus 6
agagcgcaucuuuaaca

SEQ ID NO: 2037192 - RNA, 22 nt, Human herpesvirus 6
uugucugauauggcaaauuuua

SEQ ID NO: 2037193 - RNA, 19 nt, Human herpesvirus 6
gucggacgacgggcggggc

SEQ ID NO: 2037194 - RNA, 22 nt, Human herpesvirus 6
ugacggaggcgacgaaagagga

SEQ ID NO: 2037195 - RNA, 14 nt, Human herpesvirus 6
gagaguggggacaa

SEQ ID NO: 2037196 - RNA, 15 nt, Human herpesvirus 6
acacgcuggagcagc

SEQ ID NO: 2037197 - RNA, 12 nt, Human herpesvirus 6
guaauacaucau

SEQ ID NO: 2037198 - RNA, 20 nt, Human herpesvirus 6
ccagcauguuuucuccucaa

SEQ ID NO: 2037199 - RNA, 22 nt, Human herpesvirus 6
uuaucgcccgguaaauuacuag

SEQ ID NO: 2037200 - RNA, 23 nt, Human herpesvirus 6
accgcaguuucuguuuuucucgg

SEQ ID NO: 2037201 - RNA, 20 nt, Human herpesvirus 6
uccaauccaauauaacuuua

SEQ ID NO: 2037202 - RNA, 20 nt, Human herpesvirus 6
uucgacaacggaccaggaca

SEQ ID NO: 2037203 - RNA, 22 nt, Human herpesvirus 6
uuggcgccaaaaaaauacagua

SEQ ID NO: 2037204 - RNA, 14 nt, Human herpesvirus 6
ccgcaguuccuguu

SEQ ID NO: 2037205 - RNA, 18 nt, Human herpesvirus 6
uaaaauuucgauguggag

SEQ ID NO: 2037206 - RNA, 16 nt, Human herpesvirus 6
acgugcuugucucaca

SEQ ID NO: 2037207 - RNA, 13 nt, Human herpesvirus 6
uaacuuuuuguau

SEQ ID NO: 2037208 - RNA, 21 nt, Human herpesvirus 6
augcuacccacaugaaaucac

SEQ ID NO: 2037209 - RNA, 15 nt, Human herpesvirus 6
uguaauaaaguguca

SEQ ID NO: 2037210 - RNA, 17 nt, Human herpesvirus 6
agucaguuuaauaguuu

SEQ ID NO: 2037211 - RNA, 18 nt, Human herpesvirus 6
cccagauuuguguucaag

SEQ ID NO: 2037212 - RNA, 15 nt, Human herpesvirus 6
ucugcauuuauauca

SEQ ID NO: 2037213 - RNA, 15 nt, Human herpesvirus 6
ugcaaguuugaauuu

SEQ ID NO: 2037214 - RNA, 20 nt, Human herpesvirus 6
ugugaugcguugcauuuugg

SEQ ID NO: 2037215 - RNA, 18 nt, Human herpesvirus 6
uucuuacacaaauugacc

SEQ ID NO: 2037216 - RNA, 21 nt, Human herpesvirus 6
uuaguaugggugagugcauua

SEQ ID NO: 2037217 - RNA, 18 nt, Human herpesvirus 6
aauauaacaguaggagau

SEQ ID NO: 2037218 - RNA, 19 nt, Human herpesvirus 6
gagacgacucgcggagugg

SEQ ID NO: 2037219 - RNA, 19 nt, Human herpesvirus 6
ggcuacgacacgcuggagc

SEQ ID NO: 2037220 - RNA, 19 nt, Human herpesvirus 6
cuuaaaaaaacacaguauu

SEQ ID NO: 2037221 - RNA, 16 nt, Human herpesvirus 6
agugaaagcagucagu

SEQ ID NO: 2037222 - RNA, 22 nt, Human herpesvirus 6
agucaggaaaaaguuaagaaaa

SEQ ID NO: 2037223 - RNA, 20 nt, Human herpesvirus 6
gguauaucucggacucauag

SEQ ID NO: 2037224 - RNA, 19 nt, Human herpesvirus 6
uggcgcgcauguugcaguu

SEQ ID NO: 2037225 - RNA, 13 nt, Human herpesvirus 6
ucagacauccaga

SEQ ID NO: 2037226 - RNA, 15 nt, Human herpesvirus 6
uuuucggauuuugaa

SEQ ID NO: 2037227 - RNA, 21 nt, Human herpesvirus 6
gcgccuuguguaucugugaac

SEQ ID NO: 2037228 - RNA, 15 nt, Human herpesvirus 6
ucgcuggacuuagug

SEQ ID NO: 2037229 - RNA, 18 nt, Human herpesvirus 6
ugucgaagucuucuuggg

SEQ ID NO: 2037230 - RNA, 23 nt, Human herpesvirus 6
guagaacggaaaaaaaaucuauc

SEQ ID NO: 2037231 - RNA, 16 nt, Human herpesvirus 6
auuguaauuuugaauu

SEQ ID NO: 2037232 - RNA, 22 nt, Human herpesvirus 6
caucucgugcaaaagcugacua

SEQ ID NO: 2037233 - RNA, 13 nt, Human herpesvirus 6
cggcggggggacg

SEQ ID NO: 2037234 - RNA, 18 nt, Human herpesvirus 6
acguugguaucaguggau

SEQ ID NO: 2037235 - RNA, 17 nt, Human herpesvirus 6
gcgcggagcacgcacga

SEQ ID NO: 2037236 - RNA, 14 nt, Human herpesvirus 6
aguaucgagauuuu

SEQ ID NO: 2037237 - RNA, 23 nt, Human herpesvirus 6
acuuuccccauauuguguaacuc

SEQ ID NO: 2037238 - RNA, 14 nt, Human herpesvirus 6
caauuaguccauua

SEQ ID NO: 2037239 - RNA, 23 nt, Human herpesvirus 6
auacggcagcggaagugaaagca

SEQ ID NO: 2037240 - RNA, 13 nt, Human herpesvirus 6
auguuuggauaau

SEQ ID NO: 2037241 - RNA, 21 nt, Human herpesvirus 6
gcggaauguuuguuuuuguca

SEQ ID NO: 2037242 - RNA, 13 nt, Human herpesvirus 6
ccgagggcggacg

SEQ ID NO: 2037243 - RNA, 15 nt, Human herpesvirus 6
ccgccggcccaucca

SEQ ID NO: 2037244 - RNA, 20 nt, Human herpesvirus 6
caucaauuccggccuaggac

SEQ ID NO: 2037245 - RNA, 12 nt, Human herpesvirus 6
ugugauaugcaa

SEQ ID NO: 2037246 - RNA, 17 nt, Human herpesvirus 6
acuauugacauaggaau

SEQ ID NO: 2037247 - RNA, 21 nt, Human herpesvirus 6
ugcuaagggugccguuauucc

SEQ ID NO: 2037248 - RNA, 17 nt, Human herpesvirus 6
aauucgucgaguuguau

SEQ ID NO: 2037249 - RNA, 15 nt, Human herpesvirus 6
augucggccucugcc

SEQ ID NO: 2037250 - RNA, 10 nt, Human herpesvirus 6
ugcacaggcg

SEQ ID NO: 2037251 - RNA, 14 nt, Human herpesvirus 6
agacgccacgggca

SEQ ID NO: 2037252 - RNA, 22 nt, Human herpesvirus 6
uauuuacugagcaaagaaauga

SEQ ID NO: 2037253 - RNA, 16 nt, Human herpesvirus 6
aggcgaacgagaacuc

SEQ ID NO: 2037254 - RNA, 18 nt, Human herpesvirus 6
gaaaaagguggcaucaga

SEQ ID NO: 2037255 - RNA, 14 nt, Human herpesvirus 6
uauuuccugcccag

SEQ ID NO: 2037256 - RNA, 12 nt, Human herpesvirus 6
gaccagccagau

SEQ ID NO: 2037257 - RNA, 16 nt, Human herpesvirus 6
cugacuguaccauugu

SEQ ID NO: 2037258 - RNA, 12 nt, Human herpesvirus 6
aucccuaauaaa

SEQ ID NO: 2037259 - RNA, 17 nt, Human herpesvirus 6
caugcauuuuguauuua

SEQ ID NO: 2037260 - RNA, 14 nt, Human herpesvirus 6
aaaacuaugugcau

SEQ ID NO: 2037261 - RNA, 21 nt, Human herpesvirus 6
cggguaaacgcgcgccggugc

SEQ ID NO: 2037262 - RNA, 13 nt, Human herpesvirus 6
ccaagaaaaagaa

SEQ ID NO: 2037263 - RNA, 23 nt, Human herpesvirus 6
ccuuucucugcgccaaccuucua

SEQ ID NO: 2037264 - RNA, 14 nt, Human herpesvirus 6
ugcauugugugggg

SEQ ID NO: 2037265 - RNA, 14 nt, Human herpesvirus 6
gaggggaacacgcc

SEQ ID NO: 2037266 - RNA, 23 nt, Human herpesvirus 6
augauaaauugaugaaauuguga

SEQ ID NO: 2037267 - RNA, 21 nt, Human herpesvirus 6
accucuaaaacaagacagacc

SEQ ID NO: 2037268 - RNA, 13 nt, Human herpesvirus 6
cguaacgcggcaa

SEQ ID NO: 2037269 - RNA, 17 nt, Human herpesvirus 6
auuuuauuggcaaccug

SEQ ID NO: 2037270 - RNA, 23 nt, Human herpesvirus 6
acgggcgucaucgguggcagagg

SEQ ID NO: 2037271 - RNA, 16 nt, Human herpesvirus 6
aaaaucuauugaagau

SEQ ID NO: 2037272 - RNA, 12 nt, Human herpesvirus 6
gcuuuaaagcag

SEQ ID NO: 2037273 - RNA, 19 nt, Human herpesvirus 6
ugacgccuugauguuuccu

SEQ ID NO: 2037274 - RNA, 19 nt, Human herpesvirus 6
ugauugucuuuucuggaaa

SEQ ID NO: 2037275 - RNA, 14 nt, Human herpesvirus 6
auuuuguacaguag

SEQ ID NO: 2037276 - RNA, 21 nt, Human herpesvirus 6
auuuuuuggaagaaauugcaa

SEQ ID NO: 2037277 - RNA, 14 nt, Human herpesvirus 6
guugauuacgucaa

SEQ ID NO: 2037278 - RNA, 14 nt, Human herpesvirus 6
cugugcucuuuaua

SEQ ID NO: 2037279 - RNA, 16 nt, Human herpesvirus 6
gguuggggucuuuccu

SEQ ID NO: 2037280 - RNA, 15 nt, Human herpesvirus 6
auuaacaaauuacaa

SEQ ID NO: 2037281 - RNA, 23 nt, Human herpesvirus 6
aauuuuauuaacuguaaaaagug

SEQ ID NO: 2037282 - RNA, 16 nt, Human herpesvirus 6
acauaucgagccaaag

SEQ ID NO: 2037283 - RNA, 15 nt, Human herpesvirus 6
ucaucacaaaguuua

SEQ ID NO: 2037284 - RNA, 22 nt, Human herpesvirus 6
accaucagcccccagcugaaau

SEQ ID NO: 2037285 - RNA, 16 nt, Human herpesvirus 6
gcagaucuaucacagg

SEQ ID NO: 2037286 - RNA, 16 nt, Human herpesvirus 6
aaccuguuuccagaau

SEQ ID NO: 2037287 - RNA, 19 nt, Human herpesvirus 6
aacagauaguguuuucuga

SEQ ID NO: 2037288 - RNA, 18 nt, Human herpesvirus 6
gaguaacggaaaacgagu

SEQ ID NO: 2037289 - RNA, 16 nt, Human herpesvirus 6
acagcagcagcauuaa

SEQ ID NO: 2037290 - RNA, 20 nt, Human herpesvirus 6
caaucaaucuucuggguggg

SEQ ID NO: 2037291 - RNA, 17 nt, Human herpesvirus 6
ccucgugcucugccucg

SEQ ID NO: 2037292 - RNA, 18 nt, Human herpesvirus 6
auagcucucccuuaaaga

SEQ ID NO: 2037293 - RNA, 19 nt, Human herpesvirus 6
ugucggucagacagugagu

SEQ ID NO: 2037294 - RNA, 17 nt, Human herpesvirus 6
auacugaaguuaauagg

SEQ ID NO: 2037295 - RNA, 23 nt, Human herpesvirus 6
uuuacauuaaacacuaaauuacc

SEQ ID NO: 2037296 - RNA, 16 nt, Human herpesvirus 6
agguguuuccugccca

SEQ ID NO: 2037297 - RNA, 21 nt, Human herpesvirus 6
gagcacgcacgacaacacgcc

SEQ ID NO: 2037298 - RNA, 19 nt, Human herpesvirus 6
accaccaacacaccugccu

SEQ ID NO: 2037299 - RNA, 13 nt, Human herpesvirus 6
aauauuuccugcc

SEQ ID NO: 2037300 - RNA, 18 nt, Human herpesvirus 6
uauucacggcuaauauga

SEQ ID NO: 2037301 - RNA, 18 nt, Human herpesvirus 6
agcccuaauguuaaauaa

SEQ ID NO: 2037302 - RNA, 13 nt, Human herpesvirus 6
uaagauuaaaugu

SEQ ID NO: 2037303 - RNA, 18 nt, Human herpesvirus 6
aguaauauaggauuuccc

SEQ ID NO: 2037304 - RNA, 15 nt, Human herpesvirus 6
cuuuaacuuuuugca

SEQ ID NO: 2037305 - RNA, 23 nt, Human herpesvirus 6
uaccacaucaccgauaaaaacuc

SEQ ID NO: 2037306 - RNA, 15 nt, Human herpesvirus 6
aaccuuauacagaug

SEQ ID NO: 2037307 - RNA, 21 nt, Human herpesvirus 6
uuguauauuuuuuuuuauuuu

SEQ ID NO: 2037308 - RNA, 15 nt, Human herpesvirus 6
ucuuuauuaaauguu

SEQ ID NO: 2037309 - RNA, 18 nt, Human herpesvirus 6
cuucugccugaaaaugaa

SEQ ID NO: 2037310 - RNA, 18 nt, Human herpesvirus 6
aauuacaagguacacaau

SEQ ID NO: 2037311 - RNA, 17 nt, Human herpesvirus 6
uuucgccaagaaaaaga

SEQ ID NO: 2037312 - RNA, 14 nt, Human herpesvirus 6
uucagucucagcaa

SEQ ID NO: 2037313 - RNA, 15 nt, Human herpesvirus 6
cuagcuuuucauaug

SEQ ID NO: 2037314 - RNA, 20 nt, Human herpesvirus 6
gguaauuuaguguuuaaugu

SEQ ID NO: 2037315 - RNA, 19 nt, Human herpesvirus 6
agugaaaaagguggcauca

SEQ ID NO: 2037316 - RNA, 16 nt, Human herpesvirus 6
uucaaugcguuucuuc

SEQ ID NO: 2037317 - RNA, 23 nt, Human herpesvirus 6
gcgguauaaugcaugauggugcg

SEQ ID NO: 2037318 - RNA, 13 nt, Human herpesvirus 6
aaaaaacaacuuu

SEQ ID NO: 2037319 - RNA, 22 nt, Human herpesvirus 6
uguauuguagcagcuggcgaaa

SEQ ID NO: 2037320 - RNA, 21 nt, Human herpesvirus 6
cauuguaaauagguaaacugu

SEQ ID NO: 2037321 - RNA, 15 nt, Human herpesvirus 6
cauagaaaaaugaga

SEQ ID NO: 2037322 - RNA, 15 nt, Human herpesvirus 6
cuuuuuaaucaugau

SEQ ID NO: 2037323 - RNA, 15 nt, Human herpesvirus 6
aaguaagcaccuuag

SEQ ID NO: 2037324 - RNA, 22 nt, Human herpesvirus 6
aggggaacacgccggggaccga

SEQ ID NO: 2037325 - RNA, 19 nt, Human herpesvirus 6
aguuccuguuuuucucgga

SEQ ID NO: 2037326 - RNA, 20 nt, Human herpesvirus 6
caggggaggagcguugccgu

SEQ ID NO: 2037327 - RNA, 21 nt, Human herpesvirus 6
aacuuuuuucggauuuugaau

SEQ ID NO: 2037328 - RNA, 19 nt, Human herpesvirus 6
gccuggcacggugccaaag

SEQ ID NO: 2037329 - RNA, 19 nt, Human herpesvirus 6
uggagcagcuuccacgcga

SEQ ID NO: 2037330 - RNA, 13 nt, Human herpesvirus 6
uggcagguaacca

SEQ ID NO: 2037331 - RNA, 24 nt, Human herpesvirus 6
gccuguuccacgcgcgugucggcu

SEQ ID NO: 2037332 - RNA, 18 nt, Human herpesvirus 6
caaugcagaacaacagca

SEQ ID NO: 2037333 - RNA, 21 nt, Human herpesvirus 6
aaauaaaaacaccucuaaaac

SEQ ID NO: 2037334 - RNA, 17 nt, Human herpesvirus 6
ucuucgauccaauaaga

SEQ ID NO: 2037335 - RNA, 12 nt, Human herpesvirus 6
gcuggagcagcu

SEQ ID NO: 2037336 - RNA, 20 nt, Human herpesvirus 6
gaagacauuaauacugguuu

SEQ ID NO: 2037337 - RNA, 13 nt, Human herpesvirus 6
uucuucuguaaau

SEQ ID NO: 2037338 - RNA, 21 nt, Human herpesvirus 6
aaucggacaaugcagaacaac

SEQ ID NO: 2037339 - RNA, 15 nt, Human herpesvirus 6
guuuauugucaaaua

SEQ ID NO: 2037340 - RNA, 20 nt, Human herpesvirus 6
cuaucauuuuuuugauuuac

SEQ ID NO: 2037341 - RNA, 19 nt, Human herpesvirus 6
aucaaaucggacaaugcag

SEQ ID NO: 2037342 - RNA, 14 nt, Human herpesvirus 6
aaucugagugaucu

SEQ ID NO: 2037343 - RNA, 17 nt, Human herpesvirus 6
auguuuaaguaaaacaa

SEQ ID NO: 2037344 - RNA, 14 nt, Human herpesvirus 6
aaucauuguuugaa

SEQ ID NO: 2037345 - RNA, 14 nt, Human herpesvirus 6
gaauugguuugcuu

SEQ ID NO: 2037346 - RNA, 12 nt, Human herpesvirus 6
cugcaaaacaaa

SEQ ID NO: 2037347 - RNA, 21 nt, Human herpesvirus 6
cuguucgauguacaguuucuc

SEQ ID NO: 2037348 - RNA, 14 nt, Human herpesvirus 6
uauaaauguagcau

SEQ ID NO: 2037349 - RNA, 21 nt, Human herpesvirus 6
uuuaguaugggugagugcauu

SEQ ID NO: 2037350 - RNA, 14 nt, Human herpesvirus 6
uggaucgaaugcua

SEQ ID NO: 2037351 - RNA, 16 nt, Human herpesvirus 6
aaauauggcagagcug

SEQ ID NO: 2037352 - RNA, 17 nt, Human herpesvirus 6
ucucgugguacaauaaa

SEQ ID NO: 2037353 - RNA, 22 nt, Human herpesvirus 6
aaugccucuccuauaaauacug

SEQ ID NO: 2037354 - RNA, 15 nt, Human herpesvirus 6
uggagggaauuguau

SEQ ID NO: 2037355 - RNA, 22 nt, Human herpesvirus 6
agcagcagaguccggcgcacgc

SEQ ID NO: 2037356 - RNA, 15 nt, Human herpesvirus 6
uucaguaucuguuuu

SEQ ID NO: 2037357 - RNA, 14 nt, Human herpesvirus 6
cagauaaccucacu

SEQ ID NO: 2037358 - RNA, 19 nt, Human herpesvirus 6
cgguccacacgccaguccg

SEQ ID NO: 2037359 - RNA, 24 nt, Human herpesvirus 6
uacaucaucgccuuuuacuuacau

SEQ ID NO: 2037360 - RNA, 18 nt, Human herpesvirus 6
auguucuuuauuaaaugu

SEQ ID NO: 2037361 - RNA, 14 nt, Human herpesvirus 6
aacugaauuugcau

SEQ ID NO: 2037362 - RNA, 14 nt, Human herpesvirus 6
agaaaaaacgauau

SEQ ID NO: 2037363 - RNA, 17 nt, Human herpesvirus 6
uacacgaaaaacauuuc

SEQ ID NO: 2037364 - RNA, 19 nt, Human herpesvirus 6
uguaauacaucaacaaaca

SEQ ID NO: 2037365 - RNA, 21 nt, Human herpesvirus 6
guguucguuaaaaaaaaugug

SEQ ID NO: 2037366 - RNA, 11 nt, Human herpesvirus 6
cucggaaaaua

SEQ ID NO: 2037367 - RNA, 15 nt, Human herpesvirus 6
ucgggcuuugugaaa

SEQ ID NO: 2037368 - RNA, 20 nt, Human herpesvirus 6
uaaaaucucguaacgcggca

SEQ ID NO: 2037369 - RNA, 14 nt, Human herpesvirus 6
auuuuuuauuucca

SEQ ID NO: 2037370 - RNA, 15 nt, Human herpesvirus 6
ucuaugagacuguuu

SEQ ID NO: 2037371 - RNA, 16 nt, Human herpesvirus 6
caugucggccucugcc

SEQ ID NO: 2037372 - RNA, 16 nt, Human herpesvirus 6
augucggccucugccg

SEQ ID NO: 2037373 - RNA, 14 nt, Human herpesvirus 6
auuugcugaugcga

SEQ ID NO: 2037374 - RNA, 22 nt, Human herpesvirus 6
gugccaccgucugggacccacg

SEQ ID NO: 2037375 - RNA, 20 nt, Human herpesvirus 6
acuuuguccuuacaaaucuu

SEQ ID NO: 2037376 - RNA, 15 nt, Human herpesvirus 6
aaaaauugacaauga

SEQ ID NO: 2037377 - RNA, 14 nt, Human herpesvirus 6
cauuguguggggug

SEQ ID NO: 2037378 - RNA, 18 nt, Human herpesvirus 6
aaugacugggagaauaag

SEQ ID NO: 2037379 - RNA, 18 nt, Human herpesvirus 6
uaggugggucagugcuua

SEQ ID NO: 2037380 - RNA, 12 nt, Human herpesvirus 6
cugccaucccuu

SEQ ID NO: 2037381 - RNA, 14 nt, Human herpesvirus 6
aagcuggaaaacua

SEQ ID NO: 2037382 - RNA, 21 nt, Human herpesvirus 6
acaucgagauucuuuaaagau

SEQ ID NO: 2037383 - RNA, 14 nt, Human herpesvirus 6
cauagaauuucuaa

SEQ ID NO: 2037384 - RNA, 19 nt, Human herpesvirus 6
cggcggggggacgggcgga

SEQ ID NO: 2037385 - RNA, 22 nt, Human herpesvirus 6
aggacuucguucuugacagaga

SEQ ID NO: 2037386 - RNA, 14 nt, Human herpesvirus 6
cuuuauuaaauguu

SEQ ID NO: 2037387 - RNA, 22 nt, Human herpesvirus 6
gaaucagaucacucagauuuca

SEQ ID NO: 2037388 - RNA, 17 nt, Human herpesvirus 6
gcguggaauuuguggaa

SEQ ID NO: 2037389 - RNA, 20 nt, Human herpesvirus 6
uaacaucucguaacgcggca

SEQ ID NO: 2037390 - RNA, 21 nt, Human herpesvirus 6
uaccuaauaauuacaauacaa

SEQ ID NO: 2037391 - RNA, 23 nt, Human herpesvirus 6
uccuucaugauauuccagacaau

SEQ ID NO: 2037392 - RNA, 18 nt, Human herpesvirus 6
gaagcgguuagagcuggg

SEQ ID NO: 2037393 - RNA, 13 nt, Human herpesvirus 6
uccauccucgaau

SEQ ID NO: 2037394 - RNA, 18 nt, Human herpesvirus 6
uauuguguaccuuguaau

SEQ ID NO: 2037395 - RNA, 13 nt, Human herpesvirus 6
aaacucaccgcau

SEQ ID NO: 2037396 - RNA, 22 nt, Human herpesvirus 6
cgcgauuuaaacaacacagcac

SEQ ID NO: 2037397 - RNA, 22 nt, Human herpesvirus 6
uuuagccuauuaagcagccgcg

SEQ ID NO: 2037398 - RNA, 19 nt, Human herpesvirus 6
aguuucuguuuuucucgga

SEQ ID NO: 2037399 - RNA, 21 nt, Human herpesvirus 6
aacggcgguaacguggauaaa

SEQ ID NO: 2037400 - RNA, 17 nt, Human herpesvirus 6
agcgugugauucaguau

SEQ ID NO: 2037401 - RNA, 13 nt, Human herpesvirus 6
aucuucuuugugc

SEQ ID NO: 2037402 - RNA, 18 nt, Human herpesvirus 6
cgaaaggugaaaugaaug

SEQ ID NO: 2037403 - RNA, 13 nt, Human herpesvirus 6
cugguuuacagca

SEQ ID NO: 2037404 - RNA, 22 nt, Human herpesvirus 6
cucgcuuaccguucaucauucc

SEQ ID NO: 2037405 - RNA, 13 nt, Human herpesvirus 6
ugccauaauuucu

SEQ ID NO: 2037406 - RNA, 22 nt, Human herpesvirus 6
aucuaaauuucuacaaaaauac

SEQ ID NO: 2037407 - RNA, 18 nt, Human herpesvirus 6
uaugugcgcguguuagaa

SEQ ID NO: 2037408 - RNA, 19 nt, Human herpesvirus 6
ccaggucuuauauuucaga

SEQ ID NO: 2037409 - RNA, 19 nt, Human herpesvirus 6
cucauguugccucuggaca

SEQ ID NO: 2037410 - RNA, 16 nt, Human herpesvirus 6
acauaguggcuaugaa

SEQ ID NO: 2037411 - RNA, 16 nt, Human herpesvirus 6
cuuaucguucacugac

SEQ ID NO: 2037412 - RNA, 13 nt, Human herpesvirus 6
aguauuaacuagu

SEQ ID NO: 2037413 - RNA, 18 nt, Human herpesvirus 6
cuuccaguauugaagaaa

SEQ ID NO: 2037414 - RNA, 16 nt, Human herpesvirus 6
cgaaggagauuucagg

SEQ ID NO: 2037415 - RNA, 18 nt, Human herpesvirus 6
aaauaaaaaauauuaauu

SEQ ID NO: 2037416 - RNA, 23 nt, Human herpesvirus 6
gacucuauggugaguaccuguac

SEQ ID NO: 2037417 - RNA, 14 nt, Human herpesvirus 6
acauuguagaaaga

SEQ ID NO: 2037418 - RNA, 22 nt, Human herpesvirus 6
cucucucggcugacaacaaagg

SEQ ID NO: 2037419 - RNA, 13 nt, Human herpesvirus 6
aaaaaucagaauc

SEQ ID NO: 2037420 - RNA, 13 nt, Human herpesvirus 6
cugagaacgggca

SEQ ID NO: 2037421 - RNA, 19 nt, Human herpesvirus 6
agucucacgcgaucuaaua

SEQ ID NO: 2037422 - RNA, 16 nt, Human herpesvirus 6
aaaccuuauacagaug

SEQ ID NO: 2037423 - RNA, 15 nt, Human herpesvirus 6
ccgaauguucucaga

SEQ ID NO: 2037424 - RNA, 16 nt, Human herpesvirus 6
agagcuggggaguugc

SEQ ID NO: 2037425 - RNA, 16 nt, Human herpesvirus 6
augggugagugcauua

SEQ ID NO: 2037426 - RNA, 20 nt, Human herpesvirus 6
ugacuguccgcaugagcgac

SEQ ID NO: 2037427 - RNA, 18 nt, Human herpesvirus 6
caauaucaccuuacaaau

SEQ ID NO: 2037428 - RNA, 16 nt, Human herpesvirus 6
cgacuaccacaucacc

SEQ ID NO: 2037429 - RNA, 14 nt, Human herpesvirus 6
cucuaaaagcugcu

SEQ ID NO: 2037430 - RNA, 21 nt, Human herpesvirus 6
gugauuccucaaaugaauuua

SEQ ID NO: 2037431 - RNA, 16 nt, Human herpesvirus 6
gcaaccuugacagaua

SEQ ID NO: 2037432 - RNA, 15 nt, Human herpesvirus 6
gagguguuuccugcc

SEQ ID NO: 2037433 - RNA, 17 nt, Human herpesvirus 6
acauuuugguuucccuc

SEQ ID NO: 2037434 - RNA, 19 nt, Human herpesvirus 6
ggucugcaaaaaugucugc

SEQ ID NO: 2037435 - RNA, 22 nt, Human herpesvirus 6
caagauuguguuucugucuuua

SEQ ID NO: 2037436 - RNA, 12 nt, Human herpesvirus 6
cgggcggggcgg

SEQ ID NO: 2037437 - RNA, 21 nt, Human herpesvirus 6
aacgagaacgcucuugccgaa

SEQ ID NO: 2037438 - RNA, 13 nt, Human herpesvirus 6
cuaaacuuuacau

SEQ ID NO: 2037439 - RNA, 20 nt, Human herpesvirus 6
ugagagaaugcaacauccug

SEQ ID NO: 2037440 - RNA, 21 nt, Human herpesvirus 6
cgaaaacucuaaaagcugcua

SEQ ID NO: 2037441 - RNA, 21 nt, Human herpesvirus 6
aucaaauaucugaaacacuga

SEQ ID NO: 2037442 - RNA, 18 nt, Human herpesvirus 6
uucggagugcguccguuu

SEQ ID NO: 2037443 - RNA, 16 nt, Human herpesvirus 6
ugccaccgucugggac

SEQ ID NO: 2037444 - RNA, 23 nt, Human herpesvirus 6
uaaaagacguuugcuguuuucac

SEQ ID NO: 2037445 - RNA, 16 nt, Human herpesvirus 6
cuaagauugugcaguu

SEQ ID NO: 2037446 - RNA, 16 nt, Human herpesvirus 6
auucacauuaccucug

SEQ ID NO: 2037447 - RNA, 17 nt, Human herpesvirus 6
gacccacgguggccugg

SEQ ID NO: 2037448 - RNA, 19 nt, Human herpesvirus 6
uaaguggguacaaugaaaa

SEQ ID NO: 2037449 - RNA, 20 nt, Human herpesvirus 6
agcgaucauaaaacugccaa

SEQ ID NO: 2037450 - RNA, 19 nt, Human herpesvirus 6
gacaguauuuacugagcaa

SEQ ID NO: 2037451 - RNA, 14 nt, Human herpesvirus 6
cugaaaccaaagca

SEQ ID NO: 2037452 - RNA, 19 nt, Human herpesvirus 6
uaaaaaaguguaacauccc

SEQ ID NO: 2037453 - RNA, 21 nt, Human herpesvirus 6
aauuguggauuuucagacaua

SEQ ID NO: 2037454 - RNA, 18 nt, Human herpesvirus 6
uacacgcauuugcaauug

SEQ ID NO: 2037455 - RNA, 16 nt, Human herpesvirus 6
gcuauggcuuccggaa

SEQ ID NO: 2037456 - RNA, 22 nt, Human herpesvirus 6
gaaucaaugaaaaaaaaugaag

SEQ ID NO: 2037457 - RNA, 21 nt, Human herpesvirus 6
aauacuucucuuuauagagca

SEQ ID NO: 2037458 - RNA, 15 nt, Human herpesvirus 6
uuuccagguagaguu

SEQ ID NO: 2037459 - RNA, 19 nt, Human herpesvirus 6
gcauugacuauuaaacuaa

SEQ ID NO: 2037460 - RNA, 19 nt, Human herpesvirus 6
uaauuaugcauuucuuggu

SEQ ID NO: 2037461 - RNA, 19 nt, Human herpesvirus 6
uuuaaugcaaguuugaauu

SEQ ID NO: 2037462 - RNA, 19 nt, Human herpesvirus 6
uccggcugagcggagugga

SEQ ID NO: 2037463 - RNA, 18 nt, Human herpesvirus 6
uauucaagcgaagugaag

SEQ ID NO: 2037464 - RNA, 21 nt, Human herpesvirus 6
cacgacaaaacaaucagccug

SEQ ID NO: 2037465 - RNA, 17 nt, Human herpesvirus 6
gucguuggauuaaauca

SEQ ID NO: 2037466 - RNA, 20 nt, Human herpesvirus 6
agacuggaaaacuaugugca

SEQ ID NO: 2037467 - RNA, 16 nt, Human herpesvirus 6
uuaauucuuaaagcgu

SEQ ID NO: 2037468 - RNA, 15 nt, Human herpesvirus 6
gcccccauacacacc

SEQ ID NO: 2037469 - RNA, 16 nt, Human herpesvirus 6
aaaauuaaaggucagu

SEQ ID NO: 2037470 - RNA, 15 nt, Human herpesvirus 6
aacaucugcuaacgc

SEQ ID NO: 2037471 - RNA, 13 nt, Human herpesvirus 6
cggagaacgggca

SEQ ID NO: 2037472 - RNA, 20 nt, Human herpesvirus 6
accgagagccggaaaacaau

SEQ ID NO: 2037473 - RNA, 14 nt, Human herpesvirus 6
acauuuauguuucu

SEQ ID NO: 2037474 - RNA, 14 nt, Human herpesvirus 6
caaaauugacuuac

SEQ ID NO: 2037475 - RNA, 20 nt, Human herpesvirus 6
gagaucuggugaauguuucu

SEQ ID NO: 2037476 - RNA, 15 nt, Human herpesvirus 6
gucaccuguauagau

SEQ ID NO: 2037477 - RNA, 23 nt, Human herpesvirus 6
ccgcagaggcggcgaccgcagcg

SEQ ID NO: 2037478 - RNA, 18 nt, Human herpesvirus 6
caaaacauaucgagccaa

SEQ ID NO: 2037479 - RNA, 19 nt, Human herpesvirus 6
ugcauugugacagaauucu

SEQ ID NO: 2037480 - RNA, 17 nt, Human herpesvirus 6
cgcgacgugccaccguc

SEQ ID NO: 2037481 - RNA, 18 nt, Human herpesvirus 6
cggauuuaaaauggauua

SEQ ID NO: 2037482 - RNA, 20 nt, Human herpesvirus 6
cugaagaugagcagcuuugg

SEQ ID NO: 2037483 - RNA, 16 nt, Human herpesvirus 6
cagucucgggagagga

SEQ ID NO: 2037484 - RNA, 15 nt, Human herpesvirus 6
uacuacagugacuuu

SEQ ID NO: 2037485 - RNA, 22 nt, Human herpesvirus 6
agguacaaaacauggacaacuu

SEQ ID NO: 2037486 - RNA, 16 nt, Human herpesvirus 6
auauuugccugccgac

SEQ ID NO: 2037487 - RNA, 17 nt, Human herpesvirus 6
aaugaauuuauuuucaa

SEQ ID NO: 2037488 - RNA, 16 nt, Human herpesvirus 6
caagauacugguuuac

SEQ ID NO: 2037489 - RNA, 21 nt, Human herpesvirus 6
ucuuccguacuguaaguaagc

SEQ ID NO: 2037490 - RNA, 21 nt, Human herpesvirus 6
gugaucugauucgacaaauca

SEQ ID NO: 2037491 - RNA, 21 nt, Human herpesvirus 6
agaaucaaugaaaaaaaauga

SEQ ID NO: 2037492 - RNA, 16 nt, Human herpesvirus 6
cuuguguaucugugaa

SEQ ID NO: 2037493 - RNA, 16 nt, Human herpesvirus 6
accgauuuuucagugu

SEQ ID NO: 2037494 - RNA, 21 nt, Human herpesvirus 6
aagauuguguuucugucuuua

SEQ ID NO: 2037495 - RNA, 18 nt, Human herpesvirus 6
ccgaacuagaaaaacaac

SEQ ID NO: 2037496 - RNA, 17 nt, Human herpesvirus 6
gaagaccuauauguguu

SEQ ID NO: 2037497 - RNA, 15 nt, Human herpesvirus 6
agcuggggaguugcu

SEQ ID NO: 2037498 - RNA, 18 nt, Human herpesvirus 6
ggacugugaaguaaaacu

SEQ ID NO: 2037499 - RNA, 15 nt, Human herpesvirus 6
gccgccguuacuguc

SEQ ID NO: 2037500 - RNA, 18 nt, Human herpesvirus 6
acaaaagacaaaacucau

SEQ ID NO: 2037501 - RNA, 19 nt, Human herpesvirus 6
ggcucuguuuucccaggua

SEQ ID NO: 2037502 - RNA, 16 nt, Human herpesvirus 6
aacuacgguagaagcu

SEQ ID NO: 2037503 - RNA, 15 nt, Human herpesvirus 6
cacauaagacuuaua

SEQ ID NO: 2037504 - RNA, 13 nt, Human herpesvirus 6
uuuuuaauuaaaa

SEQ ID NO: 2037505 - RNA, 13 nt, Human herpesvirus 6
auaugaaaagcug

SEQ ID NO: 2037506 - RNA, 21 nt, Human herpesvirus 6
ucgcccugcuccguuuccucc

SEQ ID NO: 2037507 - RNA, 15 nt, Human herpesvirus 6
auaaaguuuaaagau

SEQ ID NO: 2037508 - RNA, 22 nt, Human herpesvirus 6
gacgugccaccgucugggaccc

SEQ ID NO: 2037509 - RNA, 13 nt, Human herpesvirus 6
gccgucaaagaca

SEQ ID NO: 2037510 - RNA, 15 nt, Human herpesvirus 6
aaauacuagcuaaaa

SEQ ID NO: 2037511 - RNA, 23 nt, Human herpesvirus 6
agaucauaaauaaaugaauagau

SEQ ID NO: 2037512 - RNA, 17 nt, Human herpesvirus 6
cguuuuccaugugaauc

SEQ ID NO: 2037513 - RNA, 15 nt, Human herpesvirus 6
uugggauguccauuu

SEQ ID NO: 2037514 - RNA, 22 nt, Human herpesvirus 6
acggccuuucuguuuuaauuaa

SEQ ID NO: 2037515 - RNA, 11 nt, Human herpesvirus 6
uucccucccac

SEQ ID NO: 2037516 - RNA, 13 nt, Human herpesvirus 6
uaauucuuaaagc

SEQ ID NO: 2037517 - RNA, 17 nt, Human herpesvirus 6
ucacgaucuacacaccg

SEQ ID NO: 2037518 - RNA, 23 nt, Human herpesvirus 6
ggucgcguucuaacccaugaaaa

SEQ ID NO: 2037519 - RNA, 21 nt, Human herpesvirus 6
gaucuaaauuucuacaaaaau

SEQ ID NO: 2037520 - RNA, 21 nt, Human herpesvirus 6
aucauauccugaaaauaaaca

SEQ ID NO: 2037521 - RNA, 20 nt, Human herpesvirus 6
cuuuuguuguuuuuuggaau

SEQ ID NO: 2037522 - RNA, 14 nt, Human herpesvirus 6
cgaaaagcaucuca

SEQ ID NO: 2037523 - RNA, 17 nt, Human herpesvirus 6
aauguccgcaaguaaaa

SEQ ID NO: 2037524 - RNA, 12 nt, Human herpesvirus 6
uucagaggugcu

SEQ ID NO: 2037525 - RNA, 17 nt, Human herpesvirus 6
ucacaauauuucacaua

SEQ ID NO: 2037526 - RNA, 14 nt, Human herpesvirus 6
ccguuucaaauagu

SEQ ID NO: 2037527 - RNA, 12 nt, Human herpesvirus 6
uccgucauacaa

SEQ ID NO: 2037528 - RNA, 18 nt, Human herpesvirus 6
uaucccuaauaaauguca

SEQ ID NO: 2037529 - RNA, 23 nt, Human herpesvirus 6
uuguaaauagguaaacuguuuuu

SEQ ID NO: 2037530 - RNA, 18 nt, Human herpesvirus 6
gguuugggggucuuuccu

SEQ ID NO: 2037531 - RNA, 22 nt, Human herpesvirus 6
acauuguaaauagguaaacugu

SEQ ID NO: 2037532 - RNA, 22 nt, Human herpesvirus 6
aacgagaacucuaaaaucucgu

SEQ ID NO: 2037533 - RNA, 14 nt, Human herpesvirus 6
gaaaacuaaaaguc

SEQ ID NO: 2037534 - RNA, 16 nt, Human herpesvirus 6
cugugaauccagacua

SEQ ID NO: 2037535 - RNA, 23 nt, Human herpesvirus 6
cuuuauauuuucgguguguauuu

SEQ ID NO: 2037536 - RNA, 17 nt, Human herpesvirus 6
uccgcauaucgccccca

SEQ ID NO: 2037537 - RNA, 17 nt, Human herpesvirus 6
uacgacgaaaacuuuua

SEQ ID NO: 2037538 - RNA, 18 nt, Human herpesvirus 6
augcgaguagauucuccg

SEQ ID NO: 2037539 - RNA, 17 nt, Human herpesvirus 6
uuccuuaauucuaaaua

SEQ ID NO: 2037540 - RNA, 16 nt, Human herpesvirus 6
ugaacuuuguaaagaa

SEQ ID NO: 2037541 - RNA, 16 nt, Human herpesvirus 6
agacaguaaaaugugu

SEQ ID NO: 2037542 - RNA, 20 nt, Human herpesvirus 6
accuguuuuagaaacauuug

SEQ ID NO: 2037543 - RNA, 20 nt, Human herpesvirus 6
gacucaaucccuuucaguuc

SEQ ID NO: 2037544 - RNA, 19 nt, Human herpesvirus 6
ggaagauacacugcaagaa

SEQ ID NO: 2037545 - RNA, 18 nt, Human herpesvirus 6
acaggaggcuauggcuuc

SEQ ID NO: 2037546 - RNA, 18 nt, Human herpesvirus 6
uuguaauuucuauguaaa

SEQ ID NO: 2037547 - RNA, 12 nt, Human herpesvirus 6
ucaaagaaaguu

SEQ ID NO: 2037548 - RNA, 14 nt, Human herpesvirus 6
gcgaacgaaaacuc

SEQ ID NO: 2037549 - RNA, 15 nt, Human herpesvirus 6
uaagagugcaacaaa

SEQ ID NO: 2037550 - RNA, 19 nt, Human herpesvirus 6
ccacaugacaccucaauua

SEQ ID NO: 2037551 - RNA, 21 nt, Human herpesvirus 6
cgugccaccgucugggaccca

SEQ ID NO: 2037552 - RNA, 22 nt, Human herpesvirus 6
ucucucaguaauuuguguaauu

SEQ ID NO: 2037553 - RNA, 22 nt, Human herpesvirus 6
acccuacaaucuguccagcuug

SEQ ID NO: 2037554 - RNA, 15 nt, Human herpesvirus 6
uacauuuucaaauuu

SEQ ID NO: 2037555 - RNA, 17 nt, Human herpesvirus 6
uuuugggaaaucuggca

SEQ ID NO: 2037556 - RNA, 14 nt, Human herpesvirus 6
cugcaaaaaacaaa

SEQ ID NO: 2037557 - RNA, 15 nt, Human herpesvirus 6
cauaagcaaauguaa

SEQ ID NO: 2037558 - RNA, 16 nt, Human herpesvirus 6
auuaggggacagagcc

SEQ ID NO: 2037559 - RNA, 15 nt, Human herpesvirus 6
aguuugugugccuuu

SEQ ID NO: 2037560 - RNA, 12 nt, Human herpesvirus 6
cugcgucaaugc

SEQ ID NO: 2037561 - RNA, 16 nt, Human herpesvirus 6
cgcaguuccuguuuuu

SEQ ID NO: 2037562 - RNA, 15 nt, Human herpesvirus 6
uguuugcaucaguga

SEQ ID NO: 2037563 - RNA, 20 nt, Human herpesvirus 6
cugcuaguuuuuuuucuuua

SEQ ID NO: 2037564 - RNA, 22 nt, Human herpesvirus 6
ugucggaggguuuuuucaucau

SEQ ID NO: 2037565 - RNA, 14 nt, Human herpesvirus 6
uggcagucugcucg

SEQ ID NO: 2037566 - RNA, 22 nt, Human herpesvirus 6
acucaacgcguaucgauuuaac

SEQ ID NO: 2037567 - RNA, 13 nt, Human herpesvirus 6
cuugcgaccuggc

SEQ ID NO: 2037568 - RNA, 15 nt, Human herpesvirus 6
cugacaaccuccgca

SEQ ID NO: 2037569 - RNA, 22 nt, Human herpesvirus 6
accaagaaucguuaaaugagau

SEQ ID NO: 2037570 - RNA, 20 nt, Human herpesvirus 6
cuccccgggugcuccgccac

SEQ ID NO: 2037571 - RNA, 23 nt, Human herpesvirus 6
aacaaugaaaauucaguuuuuau

SEQ ID NO: 2037572 - RNA, 19 nt, Human herpesvirus 6
uguuuucgguuuucuuaca

SEQ ID NO: 2037573 - RNA, 12 nt, Human herpesvirus 6
caauaagaaaca

SEQ ID NO: 2037574 - RNA, 20 nt, Human herpesvirus 6
aucuacgccuauuccaaacu

SEQ ID NO: 2037575 - RNA, 16 nt, Human herpesvirus 6
acagcaccaucaauaa

SEQ ID NO: 2037576 - RNA, 18 nt, Human herpesvirus 6
agaucacguucaggauga

SEQ ID NO: 2037577 - RNA, 16 nt, Human herpesvirus 6
cccccggaguacacgu

SEQ ID NO: 2037578 - RNA, 19 nt, Human herpesvirus 6
gaaaauauuuccugcccag

SEQ ID NO: 2037579 - RNA, 12 nt, Human herpesvirus 6
auaugaugcugu

SEQ ID NO: 2037580 - RNA, 14 nt, Human herpesvirus 6
agaaaagaaacaau

SEQ ID NO: 2037581 - RNA, 21 nt, Human herpesvirus 6
cgcauuagucacagccuugau

SEQ ID NO: 2037582 - RNA, 22 nt, Human herpesvirus 6
acuuucauaggaaguaaauaca

SEQ ID NO: 2037583 - RNA, 21 nt, Human herpesvirus 6
caaucaugugcaugaaaauau

SEQ ID NO: 2037584 - RNA, 22 nt, Human herpesvirus 6
ggcagguaaccaaaaaaacgua

SEQ ID NO: 2037585 - RNA, 22 nt, Human herpesvirus 6
auguuggcgccaaaaaaauaca

SEQ ID NO: 2037586 - RNA, 21 nt, Human herpesvirus 6
uaaaugaauagauaauaauca

SEQ ID NO: 2037587 - RNA, 18 nt, Human herpesvirus 6
gcgauucuaauaaaagac

SEQ ID NO: 2037588 - RNA, 16 nt, Human herpesvirus 6
uaauaaagugucacuc

SEQ ID NO: 2037589 - RNA, 21 nt, Human herpesvirus 6
uaccuguaaacuggucugcuu

SEQ ID NO: 2037590 - RNA, 16 nt, Human herpesvirus 6
aaaacucuaaaagcug

SEQ ID NO: 2037591 - RNA, 20 nt, Human herpesvirus 6
ugacgccuugauguuuccug

SEQ ID NO: 2037592 - RNA, 20 nt, Human herpesvirus 6
uuaucgcaacacacagugaa

SEQ ID NO: 2037593 - RNA, 11 nt, Human herpesvirus 6
gagauuucagg

SEQ ID NO: 2037594 - RNA, 15 nt, Human herpesvirus 6
caaucacauaguuuc

SEQ ID NO: 2037595 - RNA, 19 nt, Human herpesvirus 6
gcgacucccggcccagaga

SEQ ID NO: 2037596 - RNA, 15 nt, Human herpesvirus 6
ccaugugcggagaaa

SEQ ID NO: 2037597 - RNA, 17 nt, Human herpesvirus 6
cgcggucauaaacagac

SEQ ID NO: 2037598 - RNA, 21 nt, Human herpesvirus 6
aaucugaucgaaauacuucuc

SEQ ID NO: 2037599 - RNA, 22 nt, Human herpesvirus 6
guaacgccacagccuguucuug

SEQ ID NO: 2037600 - RNA, 15 nt, Human herpesvirus 6
aauaaaucgcuuaaa

SEQ ID NO: 2037601 - RNA, 22 nt, Human herpesvirus 6
auuacauaagcaaauguaacuu

SEQ ID NO: 2037602 - RNA, 15 nt, Human herpesvirus 6
gcacggugccaaagg

SEQ ID NO: 2037603 - RNA, 12 nt, Human herpesvirus 6
uuugccaaagcu

SEQ ID NO: 2037604 - RNA, 22 nt, Human herpesvirus 6
agaugaaaccuagauguaaauu

SEQ ID NO: 2037605 - RNA, 22 nt, Human herpesvirus 6
cuucacuuugggcgauggaugu

SEQ ID NO: 2037606 - RNA, 16 nt, Human herpesvirus 6
uacuaguuuucacacg

SEQ ID NO: 2037607 - RNA, 12 nt, Human herpesvirus 6
cggaguugcagu

SEQ ID NO: 2037608 - RNA, 15 nt, Human herpesvirus 6
acugugucuguucaa

SEQ ID NO: 2037609 - RNA, 22 nt, Human herpesvirus 6
agaacaugugacacgauuucug

SEQ ID NO: 2037610 - RNA, 22 nt, Human herpesvirus 6
accgcggccguucucucuccuc

SEQ ID NO: 2037611 - RNA, 15 nt, Human herpesvirus 6
auauaaaagcuaaau

SEQ ID NO: 2037612 - RNA, 22 nt, Human herpesvirus 6
uucccgccaaggcuaugugucu

SEQ ID NO: 2037613 - RNA, 18 nt, Human herpesvirus 6
cgcugcggucgccgccuc

SEQ ID NO: 2037614 - RNA, 20 nt, Human herpesvirus 6
auucgacgaucgcgaagccu

SEQ ID NO: 2037615 - RNA, 16 nt, Human herpesvirus 6
aaggugaaaugaaugu

SEQ ID NO: 2037616 - RNA, 16 nt, Human herpesvirus 6
caaauguaacuuuuug

SEQ ID NO: 2037617 - RNA, 22 nt, Human herpesvirus 6
aauucgauggguuagugaaaaa

SEQ ID NO: 2037618 - RNA, 13 nt, Human herpesvirus 6
gacgaagaggaag

SEQ ID NO: 2037619 - RNA, 12 nt, Human herpesvirus 6
aucucuacuugu

SEQ ID NO: 2037620 - RNA, 18 nt, Human herpesvirus 6
acgccuugauguuuccug

SEQ ID NO: 2037621 - RNA, 23 nt, Human herpesvirus 6
aaccgcaguuccuguuuuucuca

SEQ ID NO: 2037622 - RNA, 12 nt, Human herpesvirus 6
auuuuuuaagag

SEQ ID NO: 2037623 - RNA, 17 nt, Human herpesvirus 6
cucuauugguuaaaagg

SEQ ID NO: 2037624 - RNA, 22 nt, Human herpesvirus 6
cucuaaccguuguucuuggaga

SEQ ID NO: 2037625 - RNA, 15 nt, Human herpesvirus 6
uuaaauccuguuuug

SEQ ID NO: 2037626 - RNA, 17 nt, Human herpesvirus 6
gugcuugucucacaagc

SEQ ID NO: 2037627 - RNA, 20 nt, Human herpesvirus 6
cagaaguuucggcaacugaa

SEQ ID NO: 2037628 - RNA, 13 nt, Human herpesvirus 6
uaacuuuacauua

SEQ ID NO: 2037629 - RNA, 14 nt, Human herpesvirus 6
cagaggguuuagaa

SEQ ID NO: 2037630 - RNA, 23 nt, Human herpesvirus 6
gagaccaauuuaugucauuucau

SEQ ID NO: 2037631 - RNA, 15 nt, Human herpesvirus 6
agauuucagguucuu

SEQ ID NO: 2037632 - RNA, 22 nt, Human herpesvirus 6
cguaacgcggcaaccgcaguuc

SEQ ID NO: 2037633 - RNA, 13 nt, Human herpesvirus 6
ccaccaaaacgac

SEQ ID NO: 2037634 - RNA, 15 nt, Human herpesvirus 6
ugaauguguucacag

SEQ ID NO: 2037635 - RNA, 16 nt, Human herpesvirus 6
uuccgauaguagauuu

SEQ ID NO: 2037636 - RNA, 20 nt, Human herpesvirus 6
ugaaaauaucauuaaauugu

SEQ ID NO: 2037637 - RNA, 14 nt, Human herpesvirus 6
ccugggaaaagggu

SEQ ID NO: 2037638 - RNA, 18 nt, Human herpesvirus 6
uuugaaacugaggaacug

SEQ ID NO: 2037639 - RNA, 16 nt, Human herpesvirus 6
agcagcuagagaaauu

SEQ ID NO: 2037640 - RNA, 17 nt, Human herpesvirus 6
auuaacuguaaaaagug

SEQ ID NO: 2037641 - RNA, 15 nt, Human herpesvirus 6
cgacagggugaguca

SEQ ID NO: 2037642 - RNA, 20 nt, Human herpesvirus 6
acugccgguaacgcugucgu

SEQ ID NO: 2037643 - RNA, 15 nt, Human herpesvirus 6
aacugcuggcugaga

SEQ ID NO: 2037644 - RNA, 24 nt, Human herpesvirus 6
uuuauuuugucagucaacgcaauu

SEQ ID NO: 2037645 - RNA, 15 nt, Human herpesvirus 6
ccaggcgaacgagaa

SEQ ID NO: 2037646 - RNA, 15 nt, Human herpesvirus 6
aaauaacucagauuc

SEQ ID NO: 2037647 - RNA, 15 nt, Human herpesvirus 6
gcacuccgugucgcu

SEQ ID NO: 2037648 - RNA, 17 nt, Human herpesvirus 6
ccucugcaauagcagaa

SEQ ID NO: 2037649 - RNA, 21 nt, Human herpesvirus 6
gaaacggacacgcgcagugga

SEQ ID NO: 2037650 - RNA, 16 nt, Human herpesvirus 6
gaaagaggacgggaag

SEQ ID NO: 2037651 - RNA, 20 nt, Human herpesvirus 6
aauccagaaacuugcuccug

SEQ ID NO: 2037652 - RNA, 13 nt, Human herpesvirus 6
gagcacacacgcc

SEQ ID NO: 2037653 - RNA, 17 nt, Human herpesvirus 6
ugaguuuaucgugcaau

SEQ ID NO: 2037654 - RNA, 12 nt, Human herpesvirus 6
aaaauuaaaagu

SEQ ID NO: 2037655 - RNA, 22 nt, Human herpesvirus 6
guaauuucuauguaaacuucug

SEQ ID NO: 2037656 - RNA, 23 nt, Human herpesvirus 6
cugaauggaguaaauuaaaguuu

SEQ ID NO: 2037657 - RNA, 23 nt, Human herpesvirus 6
gagauacguguuuuugaugugcc

SEQ ID NO: 2037658 - RNA, 10 nt, Human herpesvirus 6
uguggcucuc

SEQ ID NO: 2037659 - RNA, 19 nt, Human herpesvirus 6
agauucuaaugauaaauug

SEQ ID NO: 2037660 - RNA, 16 nt, Human herpesvirus 6
aaagaucgcuuuugaa

SEQ ID NO: 2037661 - RNA, 23 nt, Human herpesvirus 6
cuaacaucugcuaacgcggcaac

SEQ ID NO: 2037662 - RNA, 16 nt, Human herpesvirus 6
guuuaaagauguguua

SEQ ID NO: 2037663 - RNA, 22 nt, Human herpesvirus 6
uguaucggcaguguaaaguucu

SEQ ID NO: 2037664 - RNA, 16 nt, Human herpesvirus 6
uuucaaaauugaguuu

SEQ ID NO: 2037665 - RNA, 21 nt, Human herpesvirus 6
agaugaauugugcguguaauu

SEQ ID NO: 2037666 - RNA, 21 nt, Human herpesvirus 6
gacaauucaaaacgacaucgc

SEQ ID NO: 2037667 - RNA, 14 nt, Human herpesvirus 6
cuauuaugugaaug

SEQ ID NO: 2037668 - RNA, 20 nt, Human herpesvirus 6
uuuuaucaugcccgaaugug

SEQ ID NO: 2037669 - RNA, 22 nt, Human herpesvirus 6
acaguuuaccuauuuacaaugu

SEQ ID NO: 2037670 - RNA, 15 nt, Human herpesvirus 6
uaagauugugcaguu

SEQ ID NO: 2037671 - RNA, 19 nt, Human herpesvirus 6
guuaggacacuuucaaaau

SEQ ID NO: 2037672 - RNA, 21 nt, Human herpesvirus 6
uucuuguugaguuucagcaga

SEQ ID NO: 2037673 - RNA, 20 nt, Human herpesvirus 6
auuacacuuucuuguaguau

SEQ ID NO: 2037674 - RNA, 12 nt, Human herpesvirus 6
acagcggacagc

SEQ ID NO: 2037675 - RNA, 18 nt, Human herpesvirus 6
uguuuuauguauuaauuu

SEQ ID NO: 2037676 - RNA, 16 nt, Human herpesvirus 6
ucucuuuuuaauucca

SEQ ID NO: 2037677 - RNA, 13 nt, Human herpesvirus 6
aguuuucuaaaag

SEQ ID NO: 2037678 - RNA, 19 nt, Human herpesvirus 6
guaaacuuauugaggaaau

SEQ ID NO: 2037679 - RNA, 18 nt, Human herpesvirus 6
ccaaaggaaaccaccggc

SEQ ID NO: 2037680 - RNA, 23 nt, Human herpesvirus 6
uagggauacguauauuguguacc

SEQ ID NO: 2037681 - RNA, 13 nt, Human herpesvirus 6
cuguaaacugguc

SEQ ID NO: 2037682 - RNA, 18 nt, Human herpesvirus 6
gugccaaaggaaaccacc

SEQ ID NO: 2037683 - RNA, 18 nt, Human herpesvirus 6
ggcucuuugcugacugua

SEQ ID NO: 2037684 - RNA, 19 nt, Human herpesvirus 6
ucgauuuaaccuuuucacu

SEQ ID NO: 2037685 - RNA, 15 nt, Human herpesvirus 6
ccucuaaacccagac

SEQ ID NO: 2037686 - RNA, 14 nt, Human herpesvirus 6
gaucuugaucaaau

SEQ ID NO: 2037687 - RNA, 15 nt, Human herpesvirus 6
gucuuuccugcacag

SEQ ID NO: 2037688 - RNA, 13 nt, Human herpesvirus 6
acgagagcugacu

SEQ ID NO: 2037689 - RNA, 14 nt, Human herpesvirus 6
cccauggcgagaaa

SEQ ID NO: 2037690 - RNA, 16 nt, Human herpesvirus 6
uuuguacaaacuuuuu

SEQ ID NO: 2037691 - RNA, 18 nt, Human herpesvirus 6
cauaguugggaucuucug

SEQ ID NO: 2037692 - RNA, 18 nt, Human herpesvirus 6
uuucguuuacgaauucaa

SEQ ID NO: 2037693 - RNA, 20 nt, Human herpesvirus 6
cuuguccuuuuuuacuaguu

SEQ ID NO: 2037694 - RNA, 22 nt, Human herpesvirus 6
agauauauacuuucaaguguuu

SEQ ID NO: 2037695 - RNA, 16 nt, Human herpesvirus 6
ucuucaagcaaagaca

SEQ ID NO: 2037696 - RNA, 18 nt, Human herpesvirus 6
ucuuuauaaacuuaaaac

SEQ ID NO: 2037697 - RNA, 19 nt, Human herpesvirus 6
guugagaaugauuuuaagu

SEQ ID NO: 2037698 - RNA, 18 nt, Human herpesvirus 6
caggaucguccccuuggc

SEQ ID NO: 2037699 - RNA, 23 nt, Human herpesvirus 6
gacuuacagagcuuuuaaagaau

SEQ ID NO: 2037700 - RNA, 11 nt, Human herpesvirus 6
ugcgaccuggc

SEQ ID NO: 2037701 - RNA, 19 nt, Human herpesvirus 6
agucuuuccccagcacacc

SEQ ID NO: 2037702 - RNA, 17 nt, Human herpesvirus 6
agguguuuccugcccag

SEQ ID NO: 2037703 - RNA, 11 nt, Human herpesvirus 6
acgaaaaauuu

SEQ ID NO: 2037704 - RNA, 24 nt, Human herpesvirus 6
aagggcuuuucaagaucugccauc

SEQ ID NO: 2037705 - RNA, 18 nt, Human herpesvirus 6
gucuucuugggcuccgcg

SEQ ID NO: 2037706 - RNA, 17 nt, Human herpesvirus 6
acccacgguggccuggc

SEQ ID NO: 2037707 - RNA, 23 nt, Human herpesvirus 6
uuuccuacccaggcgaacgagaa

SEQ ID NO: 2037708 - RNA, 23 nt, Human herpesvirus 6
uuuccugcccaggcaaacgagaa

SEQ ID NO: 2037709 - RNA, 22 nt, Human herpesvirus 6
ucgaccuaaaaaaguguaacau

SEQ ID NO: 2037710 - RNA, 19 nt, Human herpesvirus 6
cacggggauuuaguacagu

SEQ ID NO: 2037711 - RNA, 15 nt, Human herpesvirus 6
cauuuugaaaaaaca

SEQ ID NO: 2037712 - RNA, 16 nt, Human herpesvirus 6
cuacaacagaaaaugc

SEQ ID NO: 2037713 - RNA, 21 nt, Human herpesvirus 6
uauaaaaaaagcaaauacuau

SEQ ID NO: 2037714 - RNA, 13 nt, Human herpesvirus 6
aggucagugggua

SEQ ID NO: 2037715 - RNA, 19 nt, Human herpesvirus 6
gaguuuuuaucggugaugu

SEQ ID NO: 2037716 - RNA, 15 nt, Human herpesvirus 6
uaaugcaaguuugaa

SEQ ID NO: 2037717 - RNA, 19 nt, Human herpesvirus 6
gaugcaaucgaugugacaa

SEQ ID NO: 2037718 - RNA, 16 nt, Human herpesvirus 6
uugaugccaaagcuuu

SEQ ID NO: 2037719 - RNA, 19 nt, Human herpesvirus 6
uuccacgcauagacaaacc

SEQ ID NO: 2037720 - RNA, 23 nt, Human herpesvirus 6
gcuccguguuacugauggcaggu

SEQ ID NO: 2037721 - RNA, 17 nt, Human herpesvirus 6
cuucaauaaaaacucaa

SEQ ID NO: 2037722 - RNA, 17 nt, Human herpesvirus 6
aaguaauauagacauug

SEQ ID NO: 2037723 - RNA, 20 nt, Human herpesvirus 6
cggugagaagaucugcguga

SEQ ID NO: 2037724 - RNA, 18 nt, Human herpesvirus 6
auuagccauuuuuuucuu

SEQ ID NO: 2037725 - RNA, 16 nt, Human herpesvirus 6
caucagaauccagaaa

SEQ ID NO: 2037726 - RNA, 17 nt, Human herpesvirus 6
uuacaagguacacaaua

SEQ ID NO: 2037727 - RNA, 22 nt, Human herpesvirus 6
cucaguaauuuguguaauuuaa

SEQ ID NO: 2037728 - RNA, 15 nt, Human herpesvirus 6
aguaaauuaaaguuu

SEQ ID NO: 2037729 - RNA, 15 nt, Human herpesvirus 6
gacucauagauuuca

SEQ ID NO: 2037730 - RNA, 20 nt, Human herpesvirus 6
aaccgguacgcuuuuacuga

SEQ ID NO: 2037731 - RNA, 14 nt, Human herpesvirus 6
caugacaagaaagg

SEQ ID NO: 2037732 - RNA, 14 nt, Human herpesvirus 6
uuuaucgauguaga

SEQ ID NO: 2037733 - RNA, 17 nt, Human herpesvirus 6
ugauuaugccaaaugua

SEQ ID NO: 2037734 - RNA, 19 nt, Human herpesvirus 6
agaacucuaaaagcugcua

SEQ ID NO: 2037735 - RNA, 21 nt, Human herpesvirus 6
gcagcaucauguucggagaua

SEQ ID NO: 2037736 - RNA, 14 nt, Human herpesvirus 6
agggucaaaaaacu

SEQ ID NO: 2037737 - RNA, 12 nt, Human herpesvirus 6
aaacauguuguu

SEQ ID NO: 2037738 - RNA, 17 nt, Human herpesvirus 6
cuaaauuauuuuuaaug

SEQ ID NO: 2037739 - RNA, 23 nt, Human herpesvirus 6
gaccacaccccuguacgcgcaua

SEQ ID NO: 2037740 - RNA, 20 nt, Human herpesvirus 6
acauauaaauccgauagcca

SEQ ID NO: 2037741 - RNA, 16 nt, Human herpesvirus 6
ccuuguguaucuguga

SEQ ID NO: 2037742 - RNA, 17 nt, Human herpesvirus 6
uugugcgucagcuuuga

SEQ ID NO: 2037743 - RNA, 21 nt, Human herpesvirus 6
gggucuuuccugcacaggcga

SEQ ID NO: 2037744 - RNA, 14 nt, Human herpesvirus 6
acaguaaaaugugu

SEQ ID NO: 2037745 - RNA, 13 nt, Human herpesvirus 6
guuucuguccaau

SEQ ID NO: 2037746 - RNA, 21 nt, Human herpesvirus 6
cgguuaaagaaucugcagauu

SEQ ID NO: 2037747 - RNA, 20 nt, Human herpesvirus 6
auuaucacaguugauaaaca

SEQ ID NO: 2037748 - RNA, 23 nt, Human herpesvirus 6
gauguaaauugauuagcaaucau

SEQ ID NO: 2037749 - RNA, 22 nt, Human herpesvirus 6
uacuguacaaaaucaaacucac

SEQ ID NO: 2037750 - RNA, 18 nt, Human herpesvirus 6
aggaucgaacucuucgau

SEQ ID NO: 2037751 - RNA, 17 nt, Human herpesvirus 6
augacaccgauucagaa

SEQ ID NO: 2037752 - RNA, 22 nt, Human herpesvirus 6
aguuguauuuaacuugauguau

SEQ ID NO: 2037753 - RNA, 14 nt, Human herpesvirus 6
uagagcaacucauc

SEQ ID NO: 2037754 - RNA, 15 nt, Human herpesvirus 6
guaaaaaaacauucu

SEQ ID NO: 2037755 - RNA, 22 nt, Human herpesvirus 6
cuauuuacaauguucaauuacu

SEQ ID NO: 2037756 - RNA, 20 nt, Human herpesvirus 6
ggucacguauaccauuccca

SEQ ID NO: 2037757 - RNA, 18 nt, Human herpesvirus 6
uagaucaauauaucgucu

SEQ ID NO: 2037758 - RNA, 14 nt, Human herpesvirus 6
gauauuaacacagu

SEQ ID NO: 2037759 - RNA, 22 nt, Human herpesvirus 6
gugggaggcauuacauuaugaa

SEQ ID NO: 2037760 - RNA, 21 nt, Human herpesvirus 6
acaccacucuguuuuuuugca

SEQ ID NO: 2037761 - RNA, 22 nt, Human herpesvirus 6
cgaugacggcgauacguuucug

SEQ ID NO: 2037762 - RNA, 13 nt, Human herpesvirus 6
uguuuccagaaua

SEQ ID NO: 2037763 - RNA, 17 nt, Human herpesvirus 6
cagcggacagcggggug

SEQ ID NO: 2037764 - RNA, 15 nt, Human herpesvirus 6
uauuuuuuauuucca

SEQ ID NO: 2037765 - RNA, 22 nt, Human herpesvirus 6
acaaucagccugcucagagcug

SEQ ID NO: 2037766 - RNA, 16 nt, Human herpesvirus 6
aucagucaaaaucuga

SEQ ID NO: 2037767 - RNA, 21 nt, Human herpesvirus 6
auuccaagacauguacaucaa

SEQ ID NO: 2037768 - RNA, 23 nt, Human herpesvirus 6
uucacugaccguuguaagaagaa

SEQ ID NO: 2037769 - RNA, 16 nt, Human herpesvirus 6
uuguccaacacuuuua

SEQ ID NO: 2037770 - RNA, 19 nt, Human herpesvirus 6
cuccugggagcucucccuc

SEQ ID NO: 2037771 - RNA, 17 nt, Human herpesvirus 6
uucuuaucaaaucgagu

SEQ ID NO: 2037772 - RNA, 20 nt, Human herpesvirus 6
cauaaacagagacugguuga

SEQ ID NO: 2037773 - RNA, 20 nt, Human herpesvirus 6
ucaccgauaaaaacucacac

SEQ ID NO: 2037774 - RNA, 16 nt, Human herpesvirus 6
cucuauauccugucgc

SEQ ID NO: 2037775 - RNA, 15 nt, Human herpesvirus 6
uccggccccagagac

SEQ ID NO: 2037776 - RNA, 12 nt, Human herpesvirus 6
uuccgaaaucaa

SEQ ID NO: 2037777 - RNA, 22 nt, Human herpesvirus 6
auacgccuugggacauguauau

SEQ ID NO: 2037778 - RNA, 17 nt, Human herpesvirus 6
gaaaacucuaaaagcug

SEQ ID NO: 2037779 - RNA, 18 nt, Human herpesvirus 6
aaaucuacuguacaaaau

SEQ ID NO: 2037780 - RNA, 14 nt, Human herpesvirus 6
cgacagaugugugu

SEQ ID NO: 2037781 - RNA, 19 nt, Human herpesvirus 6
ucacaguuuuuuuuuucau

SEQ ID NO: 2037782 - RNA, 15 nt, Human herpesvirus 6
cgacgauuguccugg

SEQ ID NO: 2037783 - RNA, 19 nt, Human herpesvirus 6
caagcacaaaaccaggaau

SEQ ID NO: 2037784 - RNA, 19 nt, Human herpesvirus 6
aaaucgguuaaagaaucug

SEQ ID NO: 2037785 - RNA, 18 nt, Human herpesvirus 6
uaaccucacuacugaaac

SEQ ID NO: 2037786 - RNA, 19 nt, Human herpesvirus 6
caaucuaucuccgcaaacc

SEQ ID NO: 2037787 - RNA, 23 nt, Human herpesvirus 6
ccgcaguuccuguucuucucaga

SEQ ID NO: 2037788 - RNA, 14 nt, Human herpesvirus 6
acaaucaugugcau

SEQ ID NO: 2037789 - RNA, 19 nt, Human herpesvirus 6
uauaagaacuggugucugu

SEQ ID NO: 2037790 - RNA, 19 nt, Human herpesvirus 6
gccgucacacucuuaacua

SEQ ID NO: 2037791 - RNA, 16 nt, Human herpesvirus 6
acagaagacgacauac

SEQ ID NO: 2037792 - RNA, 21 nt, Human herpesvirus 6
uaucgccccugucugugauuu

SEQ ID NO: 2037793 - RNA, 17 nt, Human herpesvirus 6
aauuuuauuaacuguaa

SEQ ID NO: 2037794 - RNA, 15 nt, Human herpesvirus 6
acucaauuuugaaau

SEQ ID NO: 2037795 - RNA, 19 nt, Human herpesvirus 6
gucugaucccuuagaagcu

SEQ ID NO: 2037796 - RNA, 15 nt, Human herpesvirus 6
gcacacauguauuua

SEQ ID NO: 2037797 - RNA, 23 nt, Human herpesvirus 6
ggggacagugauuagaauguuug

SEQ ID NO: 2037798 - RNA, 21 nt, Human herpesvirus 6
aacaacuuuuuagcuuuuuaa

SEQ ID NO: 2037799 - RNA, 15 nt, Human herpesvirus 6
cugggacccacggug

SEQ ID NO: 2037800 - RNA, 18 nt, Human herpesvirus 6
uggaaacacuuucuucgc

SEQ ID NO: 2037801 - RNA, 18 nt, Human herpesvirus 6
gccgcuucggacccgagg

SEQ ID NO: 2037802 - RNA, 19 nt, Human herpesvirus 6
caauuccuuaauucuaaau

SEQ ID NO: 2037803 - RNA, 16 nt, Human herpesvirus 6
agaaucguuaaaugag

SEQ ID NO: 2037804 - RNA, 18 nt, Human herpesvirus 6
acauuuauaauuaaaaua

SEQ ID NO: 2037805 - RNA, 21 nt, Human herpesvirus 6
ugucugcaguggucaugaucu

SEQ ID NO: 2037806 - RNA, 14 nt, Human herpesvirus 6
uucggccgacagca

SEQ ID NO: 2037807 - RNA, 14 nt, Human herpesvirus 6
ugccgauuaaugug

SEQ ID NO: 2037808 - RNA, 16 nt, Human herpesvirus 6
agugauuauggugccu

SEQ ID NO: 2037809 - RNA, 19 nt, Human herpesvirus 6
gauuucacuuaagccagcu

SEQ ID NO: 2037810 - RNA, 23 nt, Human herpesvirus 6
cuuaaucaacugguuuaguuugg

SEQ ID NO: 2037811 - RNA, 13 nt, Human herpesvirus 6
caacaaccacagc

SEQ ID NO: 2037812 - RNA, 14 nt, Human herpesvirus 6
guuuaauaguuuua

SEQ ID NO: 2037813 - RNA, 23 nt, Human herpesvirus 6
cuugaauguuuaaaguuuuguga

SEQ ID NO: 2037814 - RNA, 17 nt, Human herpesvirus 6
ugauggcagguaaccaa

SEQ ID NO: 2037815 - RNA, 21 nt, Human herpesvirus 6
ucucaagcacaaaaccaggaa

SEQ ID NO: 2037816 - RNA, 21 nt, Human herpesvirus 6
cuuuccgagcggugugcaguu

SEQ ID NO: 2037817 - RNA, 22 nt, Human herpesvirus 6
accgaccccugccgagccugug

SEQ ID NO: 2037818 - RNA, 15 nt, Human herpesvirus 6
gcggugcagaacauc

SEQ ID NO: 2037819 - RNA, 17 nt, Human herpesvirus 6
uuguaaucaaucaaggu

SEQ ID NO: 2037820 - RNA, 15 nt, Human herpesvirus 6
ccauccaccuucccu

SEQ ID NO: 2037821 - RNA, 15 nt, Human herpesvirus 6
aagcaaguuccauuu

SEQ ID NO: 2037822 - RNA, 13 nt, Human herpesvirus 6
uguaauaagaaaa

SEQ ID NO: 2037823 - RNA, 17 nt, Human herpesvirus 6
uuauagcucaguguuug

SEQ ID NO: 2037824 - RNA, 19 nt, Human herpesvirus 6
aagcuuuaaagcagcuaga

SEQ ID NO: 2037825 - RNA, 18 nt, Human herpesvirus 6
uauaucuucguaauggga

SEQ ID NO: 2037826 - RNA, 20 nt, Human herpesvirus 6
gagaacucuaaaagcugcua

SEQ ID NO: 2037827 - RNA, 14 nt, Human herpesvirus 6
cuaaugcaaagaug

SEQ ID NO: 2037828 - RNA, 16 nt, Human herpesvirus 6
uuaacagugucuguuu

SEQ ID NO: 2037829 - RNA, 20 nt, Human herpesvirus 6
aguuuuuauugaagacugaa

SEQ ID NO: 2037830 - RNA, 22 nt, Human herpesvirus 6
ugcagaacaacagcauguaaua

SEQ ID NO: 2037831 - RNA, 19 nt, Human herpesvirus 6
auaaacauuucauugaaua

SEQ ID NO: 2037832 - RNA, 16 nt, Human herpesvirus 6
uucaaaauaaauacua

SEQ ID NO: 2037833 - RNA, 18 nt, Human herpesvirus 6
caaagacauucaacauuc

SEQ ID NO: 2037834 - RNA, 14 nt, Human herpesvirus 6
caacugaauuugca

SEQ ID NO: 2037835 - RNA, 16 nt, Human herpesvirus 6
ugauuauucugucuug

SEQ ID NO: 2037836 - RNA, 13 nt, Human herpesvirus 6
aacagacuuuacu

SEQ ID NO: 2037837 - RNA, 14 nt, Human herpesvirus 6
gcgggaugccauaa

SEQ ID NO: 2037838 - RNA, 23 nt, Human herpesvirus 6
ucuuccaguauugaagaaaauug

SEQ ID NO: 2037839 - RNA, 20 nt, Human herpesvirus 6
uuuuuaaaaaaaaauaaaac

SEQ ID NO: 2037840 - RNA, 18 nt, Human herpesvirus 6
aacacgaagacgaagagg

SEQ ID NO: 2037841 - RNA, 19 nt, Human herpesvirus 6
uugcagacgcugaaaucau

SEQ ID NO: 2037842 - RNA, 20 nt, Human herpesvirus 6
augcuuugggaccuucagga

SEQ ID NO: 2037843 - RNA, 15 nt, Human herpesvirus 6
aucuaauucacauau

SEQ ID NO: 2037844 - RNA, 19 nt, Human herpesvirus 6
caaaggaaaccaccggcua

SEQ ID NO: 2037845 - RNA, 14 nt, Human herpesvirus 6
cauaugaaaagcug

SEQ ID NO: 2037846 - RNA, 16 nt, Human herpesvirus 6
cauucagucucagcaa

SEQ ID NO: 2037847 - RNA, 23 nt, Human herpesvirus 6
ggaagcgagcgggcuaauguaug

SEQ ID NO: 2037848 - RNA, 17 nt, Human herpesvirus 6
cuuuauagagcaacuca

SEQ ID NO: 2037849 - RNA, 21 nt, Human herpesvirus 6
ugacacgggucgggggucugc

SEQ ID NO: 2037850 - RNA, 19 nt, Human herpesvirus 6
agcaaguugcuaccgcugg

SEQ ID NO: 2037851 - RNA, 16 nt, Human herpesvirus 6
uuauaagauuuacaga

SEQ ID NO: 2037852 - RNA, 20 nt, Human herpesvirus 6
agcaauaggcaccuaucuag

SEQ ID NO: 2037853 - RNA, 17 nt, Human herpesvirus 6
aauuguauucuugaaaa

SEQ ID NO: 2037854 - RNA, 15 nt, Human herpesvirus 6
cagaaguuuacauag

SEQ ID NO: 2037855 - RNA, 23 nt, Human herpesvirus 6
ggcaacuccccauucaacauccu

SEQ ID NO: 2037856 - RNA, 18 nt, Human herpesvirus 6
gugaaagaccguagcaaa

SEQ ID NO: 2037857 - RNA, 18 nt, Human herpesvirus 6
auauuauuuucccacaga

SEQ ID NO: 2037858 - RNA, 21 nt, Human herpesvirus 6
uuguaaauagguaaacuguuu

SEQ ID NO: 2037859 - RNA, 14 nt, Human herpesvirus 6
agcagcucugcaau

SEQ ID NO: 2037860 - RNA, 12 nt, Human herpesvirus 6
aguugguuuaaa

SEQ ID NO: 2037861 - RNA, 11 nt, Human herpesvirus 6
acgaaaaccau

SEQ ID NO: 2037862 - RNA, 18 nt, Human herpesvirus 6
gaaaugaugaguaauaca

SEQ ID NO: 2037863 - RNA, 18 nt, Human herpesvirus 6
ugacaacaaaggagugag

SEQ ID NO: 2037864 - RNA, 14 nt, Human herpesvirus 6
guauugaagaaaau

SEQ ID NO: 2037865 - RNA, 16 nt, Human herpesvirus 6
ugacguauccucagaa

SEQ ID NO: 2037866 - RNA, 14 nt, Human herpesvirus 6
agaacaacagcaug

SEQ ID NO: 2037867 - RNA, 21 nt, Human herpesvirus 6
cauguucggagauaucauaau

SEQ ID NO: 2037868 - RNA, 18 nt, Human herpesvirus 6
cuuagacuuggugaugau

SEQ ID NO: 2037869 - RNA, 22 nt, Human herpesvirus 6
aacgagaacucuaacaucucgu

SEQ ID NO: 2037870 - RNA, 23 nt, Human herpesvirus 6
ucggcucuuugcugacuguacgc

SEQ ID NO: 2037871 - RNA, 19 nt, Human herpesvirus 6
aauuccuuaauucuaaaua

SEQ ID NO: 2037872 - RNA, 21 nt, Human herpesvirus 6
uugauguuuccugaauuaaaa

SEQ ID NO: 2037873 - RNA, 21 nt, Human herpesvirus 6
aagaacacgaagacgaagagg

SEQ ID NO: 2037874 - RNA, 13 nt, Human herpesvirus 6
uugguuguguaua

SEQ ID NO: 2037875 - RNA, 13 nt, Human herpesvirus 6
cauauaugaugcu

SEQ ID NO: 2037876 - RNA, 19 nt, Human herpesvirus 6
caguuuaccuauuuacaau

SEQ ID NO: 2037877 - RNA, 18 nt, Human herpesvirus 6
cugaagaugagcagcuuu

SEQ ID NO: 2037878 - RNA, 17 nt, Human herpesvirus 6
auaauucagucugcuaa

SEQ ID NO: 2037879 - RNA, 16 nt, Human herpesvirus 6
ugucaucaugugugcc

SEQ ID NO: 2037880 - RNA, 14 nt, Human herpesvirus 6
gucuagaugcaaau

SEQ ID NO: 2037881 - RNA, 21 nt, Human herpesvirus 6
gcaaucaaucuucuggguggg

SEQ ID NO: 2037882 - RNA, 14 nt, Human herpesvirus 6
caaucauguuuauu

SEQ ID NO: 2037883 - RNA, 17 nt, Human herpesvirus 6
uguacaauauaauuucu

SEQ ID NO: 2037884 - RNA, 16 nt, Human herpesvirus 6
gacgugccaccgucug

SEQ ID NO: 2037885 - RNA, 17 nt, Human herpesvirus 6
uaauaaguccugugcuc

SEQ ID NO: 2037886 - RNA, 23 nt, Human herpesvirus 6
acuuucguuuacgaauucaaugu

SEQ ID NO: 2037887 - RNA, 22 nt, Human herpesvirus 6
uguguauauugaauuguauaua

SEQ ID NO: 2037888 - RNA, 11 nt, Human herpesvirus 6
uuuccugccca

SEQ ID NO: 2037889 - RNA, 17 nt, Human herpesvirus 6
uccaccuucccucccac

SEQ ID NO: 2037890 - RNA, 21 nt, Human herpesvirus 6
agcuuugccacauacaggugg

SEQ ID NO: 2037891 - RNA, 15 nt, Human herpesvirus 6
caguauuaauguuuu

SEQ ID NO: 2037892 - RNA, 16 nt, Human herpesvirus 6
uguccuuacaaaucuu

SEQ ID NO: 2037893 - RNA, 14 nt, Human herpesvirus 6
gugagaagaucugc

SEQ ID NO: 2037894 - RNA, 19 nt, Human herpesvirus 6
gcugacaacaaaggaguga

SEQ ID NO: 2037895 - RNA, 18 nt, Human herpesvirus 6
augaucgccgcuaggcag

SEQ ID NO: 2037896 - RNA, 19 nt, Human herpesvirus 6
cagcuuccguaucacacuu

SEQ ID NO: 2037897 - RNA, 16 nt, Human herpesvirus 6
uccuauugguuugcau

SEQ ID NO: 2037898 - RNA, 14 nt, Human herpesvirus 6
gaaaauuaaaaguc

SEQ ID NO: 2037899 - RNA, 19 nt, Human herpesvirus 6
ucgaaaguucaucuuucaa

SEQ ID NO: 2037900 - RNA, 19 nt, Human herpesvirus 6
ugccaaaggaaaccaccgg

SEQ ID NO: 2037901 - RNA, 21 nt, Human herpesvirus 6
ccagcauaacuggaaucauga

SEQ ID NO: 2037902 - RNA, 14 nt, Human herpesvirus 6
acaaucaaaugggu

SEQ ID NO: 2037903 - RNA, 22 nt, Human herpesvirus 6
aucuucccuuuuacaauacaca

SEQ ID NO: 2037904 - RNA, 13 nt, Human herpesvirus 6
acccuaacccuaa

SEQ ID NO: 2037905 - RNA, 14 nt, Human herpesvirus 6
uuuaaccggaaaaa

SEQ ID NO: 2037906 - RNA, 18 nt, Human herpesvirus 6
uguuuccagagcauacau

SEQ ID NO: 2037907 - RNA, 16 nt, Human herpesvirus 6
ucuucaauaaaaacuc

SEQ ID NO: 2037908 - RNA, 13 nt, Human herpesvirus 6
guccacacgccag

SEQ ID NO: 2037909 - RNA, 15 nt, Human herpesvirus 6
aagaucuacagagua

SEQ ID NO: 2037910 - RNA, 20 nt, Human herpesvirus 6
acuaucguuuauaaaaauag

SEQ ID NO: 2037911 - RNA, 15 nt, Human herpesvirus 6
gcugcggucgccgcc

SEQ ID NO: 2037912 - RNA, 22 nt, Human herpesvirus 6
auucuucgaauaaaaaguuugu

SEQ ID NO: 2037913 - RNA, 15 nt, Human herpesvirus 6
cagaaaagcaaacau

SEQ ID NO: 2037914 - RNA, 16 nt, Human herpesvirus 6
aaagauguuugaagau

SEQ ID NO: 2037915 - RNA, 15 nt, Human herpesvirus 6
agaauuaagaugucu

SEQ ID NO: 2037916 - RNA, 20 nt, Human herpesvirus 6
gccaccgucugggacccacg

SEQ ID NO: 2037917 - RNA, 18 nt, Human herpesvirus 6
auuaaucguuacaaaauu

SEQ ID NO: 2037918 - RNA, 16 nt, Human herpesvirus 6
gggugucggacgacgg

SEQ ID NO: 2037919 - RNA, 13 nt, Human herpesvirus 6
acguuaauguuua

SEQ ID NO: 2037920 - RNA, 20 nt, Human herpesvirus 6
acuaaaaaaaaaaacacaaa

SEQ ID NO: 2037921 - RNA, 15 nt, Human herpesvirus 6
agaccuauauguguu

SEQ ID NO: 2037922 - RNA, 21 nt, Human herpesvirus 6
uaugcuuauacuguuguaaaa

SEQ ID NO: 2037923 - RNA, 17 nt, Human herpesvirus 6
accuggaaaaacugacu

SEQ ID NO: 2037924 - RNA, 21 nt, Human herpesvirus 6
gaaaacuaaaagucagugggu

SEQ ID NO: 2037925 - RNA, 13 nt, Human herpesvirus 6
acgcauagacaaa

SEQ ID NO: 2037926 - RNA, 22 nt, Human herpesvirus 6
augacuguacacaagagccgua

SEQ ID NO: 2037927 - RNA, 23 nt, Human herpesvirus 6
cuccccgagcacgguccacacgc

SEQ ID NO: 2037928 - RNA, 18 nt, Human herpesvirus 6
aacccuaaaauuugcuaa

SEQ ID NO: 2037929 - RNA, 16 nt, Human herpesvirus 6
uacaacugaaacuuca

SEQ ID NO: 2037930 - RNA, 15 nt, Human herpesvirus 6
gcuguccaucuucag

SEQ ID NO: 2037931 - RNA, 17 nt, Human herpesvirus 6
aauucaaaauaaauacu

SEQ ID NO: 2037932 - RNA, 17 nt, Human herpesvirus 6
auaaaucgcuuaaagcg

SEQ ID NO: 2037933 - RNA, 15 nt, Human herpesvirus 6
gaaaauauuuccugc

SEQ ID NO: 2037934 - RNA, 17 nt, Human herpesvirus 6
ucgaaacgaaagcugau

SEQ ID NO: 2037935 - RNA, 20 nt, Human herpesvirus 6
auaucugaaacacugaguuc

SEQ ID NO: 2037936 - RNA, 19 nt, Human herpesvirus 6
acggccaaccucuuccuag

SEQ ID NO: 2037937 - RNA, 17 nt, Human herpesvirus 6
gaauuuauuuucaauau

SEQ ID NO: 2037938 - RNA, 19 nt, Human herpesvirus 6
ggggucucuguucugccac

SEQ ID NO: 2037939 - RNA, 13 nt, Human herpesvirus 6
uaaggucaaauau

SEQ ID NO: 2037940 - RNA, 13 nt, Human herpesvirus 6
acaucgauccaaa

SEQ ID NO: 2037941 - RNA, 21 nt, Human herpesvirus 6
acaaugcaugucgaacagcuu

SEQ ID NO: 2037942 - RNA, 18 nt, Human herpesvirus 6
auuagucuuaaucaacug

SEQ ID NO: 2037943 - RNA, 21 nt, Human herpesvirus 6
uaagaagaaaaaaacacaaau

SEQ ID NO: 2037944 - RNA, 17 nt, Human herpesvirus 6
agcuguccaucuucaga

SEQ ID NO: 2037945 - RNA, 18 nt, Human herpesvirus 6
gacgcacucggaagaaaa

SEQ ID NO: 2037946 - RNA, 20 nt, Human herpesvirus 6
cugaaagaaaaauauuuugu

SEQ ID NO: 2037947 - RNA, 20 nt, Human herpesvirus 6
guaaacuggucugcuugcaa

SEQ ID NO: 2037948 - RNA, 12 nt, Human herpesvirus 6
uaugugcauucc

SEQ ID NO: 2037949 - RNA, 15 nt, Human herpesvirus 6
ccguucucucuccuc

SEQ ID NO: 2037950 - RNA, 16 nt, Human herpesvirus 6
agaaaacuauauugcc

SEQ ID NO: 2037951 - RNA, 19 nt, Human herpesvirus 6
augucguucuuaacucauc

SEQ ID NO: 2037952 - RNA, 17 nt, Human herpesvirus 6
cgugcuucuggcacagg

SEQ ID NO: 2037953 - RNA, 17 nt, Human herpesvirus 6
auaaccucacuacugaa

SEQ ID NO: 2037954 - RNA, 19 nt, Human herpesvirus 6
uggaaaucaguucuccggg

SEQ ID NO: 2037955 - RNA, 19 nt, Human herpesvirus 6
aauuacucaacauuaaaaa

SEQ ID NO: 2037956 - RNA, 16 nt, Human herpesvirus 6
agucaaauugauuaug

SEQ ID NO: 2037957 - RNA, 21 nt, Human herpesvirus 6
acaaugcagaacaacagcaug

SEQ ID NO: 2037958 - RNA, 19 nt, Human herpesvirus 6
ugcccacaccaucuucagc

SEQ ID NO: 2037959 - RNA, 16 nt, Human herpesvirus 6
auugaaagaguguuug

SEQ ID NO: 2037960 - RNA, 13 nt, Human herpesvirus 6
ugcacuguuugaa

SEQ ID NO: 2037961 - RNA, 23 nt, Human herpesvirus 6
aagcuauguaugaacaggugcuu

SEQ ID NO: 2037962 - RNA, 17 nt, Human herpesvirus 6
uaacgcggcaaccgcag

SEQ ID NO: 2037963 - RNA, 19 nt, Human herpesvirus 6
uuuuggaauauauaaauag

SEQ ID NO: 2037964 - RNA, 16 nt, Human herpesvirus 6
aacuuacuaaugugga

SEQ ID NO: 2037965 - RNA, 15 nt, Human herpesvirus 6
uucagagugaauucc

SEQ ID NO: 2037966 - RNA, 22 nt, Human herpesvirus 6
gaccccugccgagccuguggac

SEQ ID NO: 2037967 - RNA, 15 nt, Human herpesvirus 6
caacgcuccuccccu

SEQ ID NO: 2037968 - RNA, 20 nt, Human herpesvirus 6
aaucauuagcauacagaugu

SEQ ID NO: 2037969 - RNA, 11 nt, Human herpesvirus 6
guuaauguuua

SEQ ID NO: 2037970 - RNA, 13 nt, Human herpesvirus 6
uauaaauacugaa

SEQ ID NO: 2037971 - RNA, 19 nt, Human herpesvirus 6
aauguaaacacgaaauugc

SEQ ID NO: 2037972 - RNA, 16 nt, Human herpesvirus 6
guaaaaucacccgagg

SEQ ID NO: 2037973 - RNA, 15 nt, Human herpesvirus 6
guaauuuguguaauu

SEQ ID NO: 2037974 - RNA, 12 nt, Human herpesvirus 6
aucuguccagcu

SEQ ID NO: 2037975 - RNA, 19 nt, Human herpesvirus 6
aauuugaaauaucagaaau

SEQ ID NO: 2037976 - RNA, 15 nt, Human herpesvirus 6
accuaauuacaauuu

SEQ ID NO: 2037977 - RNA, 20 nt, Human herpesvirus 6
guaagauacgaaccucauga

SEQ ID NO: 2037978 - RNA, 17 nt, Human herpesvirus 6
accuauuagguguccuu

SEQ ID NO: 2037979 - RNA, 20 nt, Human herpesvirus 6
gagaauaagaucuacagagu

SEQ ID NO: 2037980 - RNA, 22 nt, Human herpesvirus 6
agccucgacguccaccuggaaa

SEQ ID NO: 2037981 - RNA, 17 nt, Human herpesvirus 6
auacuggcaaagcaaag

SEQ ID NO: 2037982 - RNA, 21 nt, Human herpesvirus 6
caaaauugggaaucaugugua

SEQ ID NO: 2037983 - RNA, 17 nt, Human herpesvirus 6
ugccaccgucugggacc

SEQ ID NO: 2037984 - RNA, 21 nt, Human herpesvirus 6
cuguacaaaaucaaacucacc

SEQ ID NO: 2037985 - RNA, 15 nt, Human herpesvirus 6
acaaaccaaaaugac

SEQ ID NO: 2037986 - RNA, 17 nt, Human herpesvirus 6
guuaaaaaaacggccaa

SEQ ID NO: 2037987 - RNA, 13 nt, Human herpesvirus 6
guuuagaaaugca

SEQ ID NO: 2037988 - RNA, 14 nt, Human herpesvirus 6
caugauugcaucaa

SEQ ID NO: 2037989 - RNA, 21 nt, Human herpesvirus 6
caaaaaaccuuuaacuuuuug

SEQ ID NO: 2037990 - RNA, 13 nt, Human herpesvirus 6
uuuuuuuuucaua

SEQ ID NO: 2037991 - RNA, 16 nt, Human herpesvirus 6
uggcacggugccaaag

SEQ ID NO: 2037992 - RNA, 14 nt, Human herpesvirus 6
acgguggccuggca

SEQ ID NO: 2037993 - RNA, 20 nt, Human herpesvirus 6
gauucgaucgagaaucuucc

SEQ ID NO: 2037994 - RNA, 13 nt, Human herpesvirus 6
cacaugaaaucac

SEQ ID NO: 2037995 - RNA, 19 nt, Human herpesvirus 6
uacagaaccagauaucucu

SEQ ID NO: 2037996 - RNA, 14 nt, Human herpesvirus 6
gcgacgugccaccg

SEQ ID NO: 2037997 - RNA, 17 nt, Human herpesvirus 6
ggcggacggggacgaca

SEQ ID NO: 2037998 - RNA, 21 nt, Human herpesvirus 6
gcuccguguuacugauggcag

SEQ ID NO: 2037999 - RNA, 19 nt, Human herpesvirus 6
gacucagguuuagaugcuu

SEQ ID NO: 2038000 - RNA, 20 nt, Human herpesvirus 6
uaauggcgcauaacggaaaa

SEQ ID NO: 2038001 - RNA, 20 nt, Human herpesvirus 6
gggagugaagagauguuucc

SEQ ID NO: 2038002 - RNA, 21 nt, Human herpesvirus 6
acaaauaaaaaauucuugaau

SEQ ID NO: 2038003 - RNA, 18 nt, Human herpesvirus 6
uguuauaacacaacaagu

SEQ ID NO: 2038004 - RNA, 14 nt, Human herpesvirus 6
cuccacaugacacc

SEQ ID NO: 2038005 - RNA, 19 nt, Human herpesvirus 6
agucaccuguauagauuua

SEQ ID NO: 2038006 - RNA, 17 nt, Human herpesvirus 6
agacuacagacucccca

SEQ ID NO: 2038007 - RNA, 22 nt, Human herpesvirus 6
agugguuuuuuggauaagcaga

SEQ ID NO: 2038008 - RNA, 20 nt, Human herpesvirus 6
caggcgguauaacuuccgga

SEQ ID NO: 2038009 - RNA, 12 nt, Human herpesvirus 6
guguacaaugac

SEQ ID NO: 2038010 - RNA, 23 nt, Human herpesvirus 6
ccagcgggcuccgucgccgcuuc

SEQ ID NO: 2038011 - RNA, 22 nt, Human herpesvirus 6
ucauaaagauaaagaucagugg

SEQ ID NO: 2038012 - RNA, 15 nt, Human herpesvirus 6
gagcggugugcaguu

SEQ ID NO: 2038013 - RNA, 14 nt, Human herpesvirus 6
ugguuaugacaaag

SEQ ID NO: 2038014 - RNA, 21 nt, Human herpesvirus 6
gauuucagguaauauuccgaa

SEQ ID NO: 2038015 - RNA, 17 nt, Human herpesvirus 6
aaggacuacaucccucu

SEQ ID NO: 2038016 - RNA, 19 nt, Human herpesvirus 6
cauccuaacaagacagaag

SEQ ID NO: 2038017 - RNA, 12 nt, Human herpesvirus 6
cuaaaaggcucu

SEQ ID NO: 2038018 - RNA, 14 nt, Human herpesvirus 6
gaaagaaaaauauu

SEQ ID NO: 2038019 - RNA, 21 nt, Human herpesvirus 6
aaacaguaauuuuagggaugg

SEQ ID NO: 2038020 - RNA, 21 nt, Human herpesvirus 6
uaagcaaauguaacuuuuugu

SEQ ID NO: 2038021 - RNA, 15 nt, Human herpesvirus 6
uacaauacacagaaa

SEQ ID NO: 2038022 - RNA, 16 nt, Human herpesvirus 6
acgagaacucuaaaag

SEQ ID NO: 2038023 - RNA, 22 nt, Human herpesvirus 6
acaucgcgcgcgacgugccacc

SEQ ID NO: 2038024 - RNA, 14 nt, Human herpesvirus 6
ggauaagcagaaga

SEQ ID NO: 2038025 - RNA, 11 nt, Human herpesvirus 6
ucgucuccugg

SEQ ID NO: 2038026 - RNA, 19 nt, Human herpesvirus 6
acacuuuaucgauguagau

SEQ ID NO: 2038027 - RNA, 16 nt, Human herpesvirus 6
auucagagugaauucc

SEQ ID NO: 2038028 - RNA, 15 nt, Human herpesvirus 6
uccgcgggaccuggc

SEQ ID NO: 2038029 - RNA, 22 nt, Human herpesvirus 6
augcaguaaaugaauguguuca

SEQ ID NO: 2038030 - RNA, 19 nt, Human herpesvirus 6
agugcgagacuggaaaacu

SEQ ID NO: 2038031 - RNA, 13 nt, Human herpesvirus 6
aggcuaugugucu

SEQ ID NO: 2038032 - RNA, 22 nt, Human herpesvirus 6
agcaaguugcuaccgcugggcc

SEQ ID NO: 2038033 - RNA, 13 nt, Human herpesvirus 6
gaagaucuaaauu

SEQ ID NO: 2038034 - RNA, 19 nt, Human herpesvirus 6
caaaguucaguaacauuua

SEQ ID NO: 2038035 - RNA, 16 nt, Human herpesvirus 6
cggucagacagugagu

SEQ ID NO: 2038036 - RNA, 15 nt, Human herpesvirus 6
cccgcagcuccuuuc

SEQ ID NO: 2038037 - RNA, 14 nt, Human herpesvirus 6
cgcccuccccgagc

SEQ ID NO: 2038038 - RNA, 15 nt, Human herpesvirus 6
cuuuacagucuuuaa

SEQ ID NO: 2038039 - RNA, 21 nt, Human herpesvirus 6
caaaacuacaaagugaaagag

SEQ ID NO: 2038040 - RNA, 13 nt, Human herpesvirus 6
ggacgggaagaac

SEQ ID NO: 2038041 - RNA, 16 nt, Human herpesvirus 6
gcgaccgaccccugcc

SEQ ID NO: 2038042 - RNA, 17 nt, Human herpesvirus 6
acauuuuguacaaacuu

SEQ ID NO: 2038043 - RNA, 14 nt, Human herpesvirus 6
agcagcuagagaaa

SEQ ID NO: 2038044 - RNA, 22 nt, Human herpesvirus 6
auuauuaaggccgucaaagaca

SEQ ID NO: 2038045 - RNA, 18 nt, Human herpesvirus 6
uacagauacauagauuuu

SEQ ID NO: 2038046 - RNA, 16 nt, Human herpesvirus 6
aagguaucaaagaaca

SEQ ID NO: 2038047 - RNA, 15 nt, Human herpesvirus 6
uauguuuucaaaaau

SEQ ID NO: 2038048 - RNA, 15 nt, Human herpesvirus 6
acauggugaaagacu

SEQ ID NO: 2038049 - RNA, 20 nt, Human herpesvirus 6
uuacacaccuuaaacaugua

SEQ ID NO: 2038050 - RNA, 16 nt, Human herpesvirus 6
gacuuuuuaacaaaau

SEQ ID NO: 2038051 - RNA, 20 nt, Human herpesvirus 6
gagccuguggacgugccggg

SEQ ID NO: 2038052 - RNA, 15 nt, Human herpesvirus 6
aaaaaguauccuaaa

SEQ ID NO: 2038053 - RNA, 19 nt, Human herpesvirus 6
gccgguagagaguggggac

SEQ ID NO: 2038054 - RNA, 18 nt, Human herpesvirus 6
uuuaaaugaagauaaaag

SEQ ID NO: 2038055 - RNA, 17 nt, Human herpesvirus 6
accgcaguuucuguuuu

SEQ ID NO: 2038056 - RNA, 17 nt, Human herpesvirus 6
guauaaugcaugauggu

SEQ ID NO: 2038057 - RNA, 15 nt, Human herpesvirus 6
aggcaugugauuguc

SEQ ID NO: 2038058 - RNA, 13 nt, Human herpesvirus 6
acgucugcgucgc

SEQ ID NO: 2038059 - RNA, 14 nt, Human herpesvirus 6
aacaucugcuaacg

SEQ ID NO: 2038060 - RNA, 17 nt, Human herpesvirus 6
uggggucuuuccugcac

SEQ ID NO: 2038061 - RNA, 18 nt, Human herpesvirus 6
agguccgacacgccccca

SEQ ID NO: 2038062 - RNA, 22 nt, Human herpesvirus 6
uuuuccgaaaggugaaaugaau

SEQ ID NO: 2038063 - RNA, 13 nt, Human herpesvirus 6
ugcucgcauuucu

SEQ ID NO: 2038064 - RNA, 12 nt, Human herpesvirus 6
augaauguguuc

SEQ ID NO: 2038065 - RNA, 21 nt, Human herpesvirus 6
gaaacaguucguagaacggaa

SEQ ID NO: 2038066 - RNA, 23 nt, Human herpesvirus 6
ucuuuauagagcaacucaucaaa

SEQ ID NO: 2038067 - RNA, 22 nt, Human herpesvirus 6
aggggagagacauccauugagu

SEQ ID NO: 2038068 - RNA, 21 nt, Human herpesvirus 6
uuucuaacagaggguuuagaa

SEQ ID NO: 2038069 - RNA, 21 nt, Human herpesvirus 6
uaucucaaauuuuccaaacau

SEQ ID NO: 2038070 - RNA, 14 nt, Human herpesvirus 6
auauuguguaacuc

SEQ ID NO: 2038071 - RNA, 16 nt, Human herpesvirus 6
uaacuaagauugugca

SEQ ID NO: 2038072 - RNA, 14 nt, Human herpesvirus 6
gaaagacagaggaa

SEQ ID NO: 2038073 - RNA, 19 nt, Human herpesvirus 6
uugcagaucuaauucacau

SEQ ID NO: 2038074 - RNA, 20 nt, Human herpesvirus 6
uuuaucgcaacacacaguga

SEQ ID NO: 2038075 - RNA, 21 nt, Human herpesvirus 6
agauuacggcaacauacccuu

SEQ ID NO: 2038076 - RNA, 19 nt, Human herpesvirus 6
gcauacguuugccaaagcu

SEQ ID NO: 2038077 - RNA, 23 nt, Human herpesvirus 6
gagauucuuuaacuuauguuucu

SEQ ID NO: 2038078 - RNA, 16 nt, Human herpesvirus 6
uccaugucuucuuggg

SEQ ID NO: 2038079 - RNA, 15 nt, Human herpesvirus 6
uuuaaugcaaguuug

SEQ ID NO: 2038080 - RNA, 22 nt, Human herpesvirus 6
cuaaaacgacuauacgaaauaa

SEQ ID NO: 2038081 - RNA, 20 nt, Human herpesvirus 6
acauguucuuuauuaaaugu

SEQ ID NO: 2038082 - RNA, 20 nt, Human herpesvirus 6
acccaucuccucaacacucu

SEQ ID NO: 2038083 - RNA, 22 nt, Human herpesvirus 6
cauaaggcgcgaguuggugcua

SEQ ID NO: 2038084 - RNA, 21 nt, Human herpesvirus 6
ucugcuauuuuuuuuaauguu

SEQ ID NO: 2038085 - RNA, 19 nt, Human herpesvirus 6
ugaucagcauucacucuuc

SEQ ID NO: 2038086 - RNA, 23 nt, Human herpesvirus 6
caucuaucgcgcaccgcuguggc

SEQ ID NO: 2038087 - RNA, 14 nt, Human herpesvirus 6
ggaauugcauccaa

SEQ ID NO: 2038088 - RNA, 17 nt, Human herpesvirus 6
uguaagaagaaaaaaac

SEQ ID NO: 2038089 - RNA, 16 nt, Human herpesvirus 6
auguaucguuugagau

SEQ ID NO: 2038090 - RNA, 17 nt, Human herpesvirus 6
acaaacugucacuuucc

SEQ ID NO: 2038091 - RNA, 20 nt, Human herpesvirus 6
cgucucucagcuggcugaca

SEQ ID NO: 2038092 - RNA, 14 nt, Human herpesvirus 6
cagucaggaaaaag

SEQ ID NO: 2038093 - RNA, 17 nt, Human herpesvirus 6
agacaaaccagcaaguu

SEQ ID NO: 2038094 - RNA, 18 nt, Human herpesvirus 6
cguagacaguaaaaugug

SEQ ID NO: 2038095 - RNA, 12 nt, Human herpesvirus 6
aucuaauucaca

SEQ ID NO: 2038096 - RNA, 23 nt, Human herpesvirus 6
gcggcaaccgcaguuccuguucu

SEQ ID NO: 2038097 - RNA, 13 nt, Human herpesvirus 6
caugaaaucacgu

SEQ ID NO: 2038098 - RNA, 15 nt, Human herpesvirus 6
ucuaaccauuuugaa

SEQ ID NO: 2038099 - RNA, 14 nt, Human herpesvirus 6
cggcaacgcuccuc

SEQ ID NO: 2038100 - RNA, 16 nt, Human herpesvirus 6
gcgguauaaugcauga

SEQ ID NO: 2038101 - RNA, 23 nt, Human herpesvirus 6
caauaaaaaccgacuuauaucga

SEQ ID NO: 2038102 - RNA, 16 nt, Human herpesvirus 6
auauuuccugcccagg

SEQ ID NO: 2038103 - RNA, 15 nt, Human herpesvirus 6
gugcugagacucuac

SEQ ID NO: 2038104 - RNA, 18 nt, Human herpesvirus 6
gaugaauuaccuguuuua

SEQ ID NO: 2038105 - RNA, 17 nt, Human herpesvirus 6
uagacauuuugugauuc

SEQ ID NO: 2038106 - RNA, 12 nt, Human herpesvirus 6
ccaauauugugg

SEQ ID NO: 2038107 - RNA, 15 nt, Human herpesvirus 6
acacguguuaaauaa

SEQ ID NO: 2038108 - RNA, 17 nt, Human herpesvirus 6
cugagaucauaaauaaa

SEQ ID NO: 2038109 - RNA, 17 nt, Human herpesvirus 6
aacaucaguaacaccgu

SEQ ID NO: 2038110 - RNA, 17 nt, Human herpesvirus 6
cuaugugucuccgccuu

SEQ ID NO: 2038111 - RNA, 15 nt, Human herpesvirus 6
auuucuauguaaacu

SEQ ID NO: 2038112 - RNA, 19 nt, Human herpesvirus 6
ucggcugacaacaaaggag

SEQ ID NO: 2038113 - RNA, 14 nt, Human herpesvirus 6
cuggaugcugauga

SEQ ID NO: 2038114 - RNA, 13 nt, Human herpesvirus 6
ccccucccauccc

SEQ ID NO: 2038115 - RNA, 23 nt, Human herpesvirus 6
uggagagaacugucuugcagcug

SEQ ID NO: 2038116 - RNA, 15 nt, Human herpesvirus 6
acguuugccaaagcu

SEQ ID NO: 2038117 - RNA, 16 nt, Human herpesvirus 6
aauucuaaaauuguaa

SEQ ID NO: 2038118 - RNA, 17 nt, Human herpesvirus 6
gugcuuuuaaaauuaug

SEQ ID NO: 2038119 - RNA, 22 nt, Human herpesvirus 6
aagauccaaucacaacaaaaau

SEQ ID NO: 2038120 - RNA, 19 nt, Human herpesvirus 6
acgugauuccucaaaugaa

SEQ ID NO: 2038121 - RNA, 21 nt, Human herpesvirus 6
acugguguaaauacccugggg

SEQ ID NO: 2038122 - RNA, 15 nt, Human herpesvirus 6
gacacgcuggagcag

SEQ ID NO: 2038123 - RNA, 12 nt, Human herpesvirus 6
ucacggauggag

SEQ ID NO: 2038124 - RNA, 19 nt, Human herpesvirus 6
cggggaggaggaggaggaa

SEQ ID NO: 2038125 - RNA, 15 nt, Human herpesvirus 6
uucaacgucuucaaa

SEQ ID NO: 2038126 - RNA, 23 nt, Human herpesvirus 6
ucgccuggccucccauguaugca

SEQ ID NO: 2038127 - RNA, 21 nt, Human herpesvirus 6
auuccacgugcuugucucaca

SEQ ID NO: 2038128 - RNA, 12 nt, Human herpesvirus 6
uuaaugcauuca

SEQ ID NO: 2038129 - RNA, 17 nt, Human herpesvirus 6
ugccuuguuuucuuaug

SEQ ID NO: 2038130 - RNA, 23 nt, Human herpesvirus 6
uaucccccguacaagcuuaauaa

SEQ ID NO: 2038131 - RNA, 17 nt, Human herpesvirus 6
uggaagaaccaaagaca

SEQ ID NO: 2038132 - RNA, 20 nt, Human herpesvirus 6
cggaggcgacgaaagaggac

SEQ ID NO: 2038133 - RNA, 17 nt, Human herpesvirus 6
caccagcauaacuggaa

SEQ ID NO: 2038134 - RNA, 20 nt, Human herpesvirus 6
cggucgagaauacgcugugu

SEQ ID NO: 2038135 - RNA, 21 nt, Human herpesvirus 6
gaaacucuuauaacaagcacu

SEQ ID NO: 2038136 - RNA, 17 nt, Human herpesvirus 6
uauauucgaauguugaa

SEQ ID NO: 2038137 - RNA, 19 nt, Human herpesvirus 6
uucagccugagaacgggca

SEQ ID NO: 2038138 - RNA, 15 nt, Human herpesvirus 6
gucuagauucuaaug

SEQ ID NO: 2038139 - RNA, 14 nt, Human herpesvirus 6
ugacaguucgagcc

SEQ ID NO: 2038140 - RNA, 16 nt, Human herpesvirus 6
uaaagaacaugugaca

SEQ ID NO: 2038141 - RNA, 15 nt, Human herpesvirus 6
aagcagucaguaaug

SEQ ID NO: 2038142 - RNA, 16 nt, Human herpesvirus 6
guucgaugauuauucu

SEQ ID NO: 2038143 - RNA, 21 nt, Human herpesvirus 6
guucugccacgacgugcugca

SEQ ID NO: 2038144 - RNA, 22 nt, Human herpesvirus 6
agaguuggauuuuuuuaauugg

SEQ ID NO: 2038145 - RNA, 19 nt, Human herpesvirus 6
auucuuaccaagaaaucau

SEQ ID NO: 2038146 - RNA, 19 nt, Human herpesvirus 6
ucauuuuuuugauuuacaa

SEQ ID NO: 2038147 - RNA, 15 nt, Human herpesvirus 6
aguccugugcuccac

SEQ ID NO: 2038148 - RNA, 22 nt, Human herpesvirus 6
auaucccgcguuagguguaaau

SEQ ID NO: 2038149 - RNA, 16 nt, Human herpesvirus 6
cuuuaacuuauguuuc

SEQ ID NO: 2038150 - RNA, 22 nt, Human herpesvirus 6
ucugggacccacgguggccugg

SEQ ID NO: 2038151 - RNA, 19 nt, Human herpesvirus 6
agcgguagaguggaguugu

SEQ ID NO: 2038152 - RNA, 14 nt, Human herpesvirus 6
ggaggaggaagaga

SEQ ID NO: 2038153 - RNA, 20 nt, Human herpesvirus 6
uucucuuuuuuuuaaugcaa

SEQ ID NO: 2038154 - RNA, 14 nt, Human herpesvirus 6
cacgguggccuggc

SEQ ID NO: 2038155 - RNA, 15 nt, Human herpesvirus 6
uuuuacaauacacag

SEQ ID NO: 2038156 - RNA, 19 nt, Human herpesvirus 6
gaaaaaacaacgacuauca

SEQ ID NO: 2038157 - RNA, 20 nt, Human herpesvirus 6
cugaucacagagaaaaaaca

SEQ ID NO: 2038158 - RNA, 18 nt, Human herpesvirus 6
ggacggcggggggacggg

SEQ ID NO: 2038159 - RNA, 13 nt, Human herpesvirus 6
uuucgcaauuugg

SEQ ID NO: 2038160 - RNA, 15 nt, Human herpesvirus 6
cgcaaaccaccccaa

SEQ ID NO: 2038161 - RNA, 22 nt, Human herpesvirus 6
ucgcccccauacacacccagca

SEQ ID NO: 2038162 - RNA, 18 nt, Human herpesvirus 6
acgucugcgucgcccccc

SEQ ID NO: 2038163 - RNA, 12 nt, Human herpesvirus 6
acuaauguggau

SEQ ID NO: 2038164 - RNA, 17 nt, Human herpesvirus 6
cgcgguaacgccacagc

SEQ ID NO: 2038165 - RNA, 13 nt, Human herpesvirus 6
gacccggccggag

SEQ ID NO: 2038166 - RNA, 17 nt, Human herpesvirus 6
gggccuccgccacugcg

SEQ ID NO: 2038167 - RNA, 13 nt, Human herpesvirus 6
uauauuaaauugu

SEQ ID NO: 2038168 - RNA, 23 nt, Human herpesvirus 6
cccacgaaaaauaaaauccacga

SEQ ID NO: 2038169 - RNA, 19 nt, Human herpesvirus 6
uauaaacaauuguauucuu

SEQ ID NO: 2038170 - RNA, 12 nt, Human herpesvirus 6
ccauuauugugu

SEQ ID NO: 2038171 - RNA, 18 nt, Human herpesvirus 6
aaaugaugaguaauacau

SEQ ID NO: 2038172 - RNA, 12 nt, Human herpesvirus 6
ucaucaguuucc

SEQ ID NO: 2038173 - RNA, 18 nt, Human herpesvirus 6
gacguuagcucgggguga

SEQ ID NO: 2038174 - RNA, 13 nt, Human herpesvirus 6
uccuagcauuucc

SEQ ID NO: 2038175 - RNA, 15 nt, Human herpesvirus 6
cccacgguggccugg

SEQ ID NO: 2038176 - RNA, 16 nt, Human herpesvirus 6
cggaaaauuaaaaguc

SEQ ID NO: 2038177 - RNA, 15 nt, Human herpesvirus 6
augcgaaucugccga

SEQ ID NO: 2038178 - RNA, 20 nt, Human herpesvirus 6
cauuucaagagaacaugauu

SEQ ID NO: 2038179 - RNA, 23 nt, Human herpesvirus 6
uugucagguuugaaacacugcaa

SEQ ID NO: 2038180 - RNA, 22 nt, Human herpesvirus 6
aacucacacaaccauccagaua

SEQ ID NO: 2038181 - RNA, 14 nt, Human herpesvirus 6
acaauauuucacau

SEQ ID NO: 2038182 - RNA, 21 nt, Human herpesvirus 6
ugcaaaacuguuaaaagagaa

SEQ ID NO: 2038183 - RNA, 17 nt, Human herpesvirus 6
gaugauuauucugucuu

SEQ ID NO: 2038184 - RNA, 21 nt, Human herpesvirus 6
acauccugcguguuaaugaau

SEQ ID NO: 2038185 - RNA, 23 nt, Human herpesvirus 6
acuggccauauuaggcugcagcc

SEQ ID NO: 2038186 - RNA, 20 nt, Human herpesvirus 6
acauguuguucuugucuuuu

SEQ ID NO: 2038187 - RNA, 18 nt, Human herpesvirus 6
aggaacaaaacuuucauc

SEQ ID NO: 2038188 - RNA, 15 nt, Human herpesvirus 6
aaaauaaguacauag

SEQ ID NO: 2038189 - RNA, 19 nt, Human herpesvirus 6
caguuuuuuuuuucauaug

SEQ ID NO: 2038190 - RNA, 20 nt, Human herpesvirus 6
cgagcggcggauggagcccg

SEQ ID NO: 2038191 - RNA, 12 nt, Human herpesvirus 6
aguaugcuuugg

SEQ ID NO: 2038192 - RNA, 19 nt, Human herpesvirus 6
ggaagaagauacgagaaca

SEQ ID NO: 2038193 - RNA, 14 nt, Human herpesvirus 6
auaaaguuaaaggu

SEQ ID NO: 2038194 - RNA, 19 nt, Human herpesvirus 6
auuuucggugcacauggaa

SEQ ID NO: 2038195 - RNA, 14 nt, Human herpesvirus 6
ccuacaagggcagg

SEQ ID NO: 2038196 - RNA, 23 nt, Human herpesvirus 6
uucucggaaaacuaaaagucagu

SEQ ID NO: 2038197 - RNA, 18 nt, Human herpesvirus 6
uuguggacaauauaaaag

SEQ ID NO: 2038198 - RNA, 16 nt, Human herpesvirus 6
uaccuauuuacaaugu

SEQ ID NO: 2038199 - RNA, 16 nt, Human herpesvirus 6
uucaggaugaagaaaa

SEQ ID NO: 2038200 - RNA, 23 nt, Human herpesvirus 6
ucgggaacauagagaaacgagag

SEQ ID NO: 2038201 - RNA, 17 nt, Human herpesvirus 6
uucuguuuugagagcua

SEQ ID NO: 2038202 - RNA, 14 nt, Human herpesvirus 6
guaugcaucaucaa

SEQ ID NO: 2038203 - RNA, 20 nt, Human herpesvirus 6
cgaaaacucuaaaagcugcu

SEQ ID NO: 2038204 - RNA, 16 nt, Human herpesvirus 6
uuuaacuauccauuuu

SEQ ID NO: 2038205 - RNA, 18 nt, Human herpesvirus 6
gggaggaggaggaggaag

SEQ ID NO: 2038206 - RNA, 20 nt, Human herpesvirus 6
uugcauauuauuaacaauga

SEQ ID NO: 2038207 - RNA, 12 nt, Human herpesvirus 6
uuauaauacacu

SEQ ID NO: 2038208 - RNA, 15 nt, Human herpesvirus 6
gccugcucagagcug

SEQ ID NO: 2038209 - RNA, 17 nt, Human herpesvirus 6
agaaacguuaauguuua

SEQ ID NO: 2038210 - RNA, 18 nt, Human herpesvirus 6
auuucaaacugguguaaa

SEQ ID NO: 2038211 - RNA, 17 nt, Human herpesvirus 6
gaagucuugcuuggaaa

SEQ ID NO: 2038212 - RNA, 17 nt, Human herpesvirus 6
acugaaucggaaacuga

SEQ ID NO: 2038213 - RNA, 13 nt, Human herpesvirus 6
aaacaguaaauuc

SEQ ID NO: 2038214 - RNA, 14 nt, Human herpesvirus 6
aucuauuauaagca

SEQ ID NO: 2038215 - RNA, 15 nt, Human herpesvirus 6
gauguuuuccuuuau

SEQ ID NO: 2038216 - RNA, 14 nt, Human herpesvirus 6
ccaucuucagacau

SEQ ID NO: 2038217 - RNA, 14 nt, Human herpesvirus 6
cucggaaaauuaaa

SEQ ID NO: 2038218 - RNA, 22 nt, Human herpesvirus 6
gaggcgacgaaagaggacggga

SEQ ID NO: 2038219 - RNA, 20 nt, Human herpesvirus 6
ccgcgguuggggucuuuccu

SEQ ID NO: 2038220 - RNA, 16 nt, Human herpesvirus 6
acucauacacaggauu

SEQ ID NO: 2038221 - RNA, 22 nt, Human herpesvirus 6
gacccacuccuacuauccgccc

SEQ ID NO: 2038222 - RNA, 16 nt, Human herpesvirus 6
cgcccccauacacacc

SEQ ID NO: 2038223 - RNA, 15 nt, Human herpesvirus 6
uuuaauaaggaaaaa

SEQ ID NO: 2038224 - RNA, 17 nt, Human herpesvirus 6
guccagaaguccuucau

SEQ ID NO: 2038225 - RNA, 22 nt, Human herpesvirus 6
augcauucacaaggaaugugca

SEQ ID NO: 2038226 - RNA, 22 nt, Human herpesvirus 6
gauccgucucucagcuggcuga

SEQ ID NO: 2038227 - RNA, 14 nt, Human herpesvirus 6
ugcuccggggaggg

SEQ ID NO: 2038228 - RNA, 15 nt, Human herpesvirus 6
caaauaaaagcauuu

SEQ ID NO: 2038229 - RNA, 22 nt, Human herpesvirus 6
aguuaugcgucuguuuauugcc

SEQ ID NO: 2038230 - RNA, 17 nt, Human herpesvirus 6
aagacagaccacacccc

SEQ ID NO: 2038231 - RNA, 15 nt, Human herpesvirus 6
uugaaaucacaccaa

SEQ ID NO: 2038232 - RNA, 15 nt, Human herpesvirus 6
caccucuaaaacaag

SEQ ID NO: 2038233 - RNA, 18 nt, Human herpesvirus 6
gccaaaggaaaccaccgg

SEQ ID NO: 2038234 - RNA, 12 nt, Human herpesvirus 6
ccugcacaggcg

SEQ ID NO: 2038235 - RNA, 21 nt, Human herpesvirus 6
caaaaaugcacaauuuagccu

SEQ ID NO: 2038236 - RNA, 18 nt, Human herpesvirus 6
ucuaaaaucucguaacgc

SEQ ID NO: 2038237 - RNA, 19 nt, Human herpesvirus 6
ucagaagagaugaaagaca

SEQ ID NO: 2038238 - RNA, 17 nt, Human herpesvirus 6
cacguuuugggaaaucu

SEQ ID NO: 2038239 - RNA, 14 nt, Human herpesvirus 6
aauuauuuugugau

SEQ ID NO: 2038240 - RNA, 16 nt, Human herpesvirus 6
agaauuuuuguagcaa

SEQ ID NO: 2038241 - RNA, 18 nt, Human herpesvirus 6
cuguagaaacguuaaugu

SEQ ID NO: 2038242 - RNA, 23 nt, Human herpesvirus 6
uuaauuuaucgcagcaucauguu

SEQ ID NO: 2038243 - RNA, 16 nt, Human herpesvirus 6
gauagguagaauuacu

SEQ ID NO: 2038244 - RNA, 18 nt, Human herpesvirus 6
aucgcgcgcgacgugcca

SEQ ID NO: 2038245 - RNA, 18 nt, Human herpesvirus 6
ggcgaaaagugcugugcu

SEQ ID NO: 2038246 - RNA, 15 nt, Human herpesvirus 6
acgugcuugucucac

SEQ ID NO: 2038247 - RNA, 13 nt, Human herpesvirus 6
cgggcggggcgga

SEQ ID NO: 2038248 - RNA, 14 nt, Human herpesvirus 6
agaaccaccagaga

SEQ ID NO: 2038249 - RNA, 20 nt, Human herpesvirus 6
auccacgaacguagacaguc

SEQ ID NO: 2038250 - RNA, 15 nt, Human herpesvirus 6
cuccuauaaauacug

SEQ ID NO: 2038251 - RNA, 23 nt, Human herpesvirus 6
ucagucaauuuuacuaaaaaagc

SEQ ID NO: 2038252 - RNA, 19 nt, Human herpesvirus 6
ccggagguaacggagcccg

SEQ ID NO: 2038253 - RNA, 19 nt, Human herpesvirus 6
gauaaaaaacucaacugcu

SEQ ID NO: 2038254 - RNA, 11 nt, Human herpesvirus 6
ccguuuaugcg

SEQ ID NO: 2038255 - RNA, 18 nt, Human herpesvirus 6
cgcggaguggaguccagu

SEQ ID NO: 2038256 - RNA, 20 nt, Human herpesvirus 6
uuaagcaacugauuaagauu

SEQ ID NO: 2038257 - RNA, 16 nt, Human herpesvirus 6
auguggagaagaucua

SEQ ID NO: 2038258 - RNA, 16 nt, Human herpesvirus 6
cacuuuuaaaauaccg

SEQ ID NO: 2038259 - RNA, 20 nt, Human herpesvirus 6
auuguacgauaauaaaaguu

SEQ ID NO: 2038260 - RNA, 13 nt, Human herpesvirus 6
auaacugcauacg

SEQ ID NO: 2038261 - RNA, 16 nt, Human herpesvirus 6
ucuaaauuggucucuu

SEQ ID NO: 2038262 - RNA, 21 nt, Human herpesvirus 6
acgcaacgcggagugaacuca

SEQ ID NO: 2038263 - RNA, 15 nt, Human herpesvirus 6
aaagaagauuuuccu

SEQ ID NO: 2038264 - RNA, 19 nt, Human herpesvirus 6
gacuauacgaaauaaucga

SEQ ID NO: 2038265 - RNA, 13 nt, Human herpesvirus 6
cuucaggugucuc

SEQ ID NO: 2038266 - RNA, 14 nt, Human herpesvirus 6
cccauccaccuucc

SEQ ID NO: 2038267 - RNA, 23 nt, Human herpesvirus 6
uaagcaaauguaacuuuuuguau

SEQ ID NO: 2038268 - RNA, 18 nt, Human herpesvirus 6
ccaccagaaaaguauagu

SEQ ID NO: 2038269 - RNA, 13 nt, Human herpesvirus 6
gagacgaaagcag

SEQ ID NO: 2038270 - RNA, 17 nt, Human herpesvirus 6
cuaaaagucagugggua

SEQ ID NO: 2038271 - RNA, 20 nt, Human herpesvirus 6
ucuugggacuaggaauacgu

SEQ ID NO: 2038272 - RNA, 12 nt, Human herpesvirus 6
cuaaaagucagu

SEQ ID NO: 2038273 - RNA, 15 nt, Human herpesvirus 6
uccgacacgccccca

SEQ ID NO: 2038274 - RNA, 21 nt, Human herpesvirus 6
auauaacgauauauaaaaaac

SEQ ID NO: 2038275 - RNA, 12 nt, Human herpesvirus 6
aaaaaucaacau

SEQ ID NO: 2038276 - RNA, 20 nt, Human herpesvirus 6
guacuaugauuuauagaauu

SEQ ID NO: 2038277 - RNA, 17 nt, Human herpesvirus 6
aaccuuuaacuuuuugc

SEQ ID NO: 2038278 - RNA, 17 nt, Human herpesvirus 6
auguuaacucagguggu

SEQ ID NO: 2038279 - RNA, 21 nt, Human herpesvirus 6
agauccgucucucagcuggcu

SEQ ID NO: 2038280 - RNA, 13 nt, Human herpesvirus 6
gacacacaaaaaa

SEQ ID NO: 2038281 - RNA, 14 nt, Human herpesvirus 6
uuugcgugugugua

SEQ ID NO: 2038282 - RNA, 21 nt, Human herpesvirus 6
cgacuucaaacaccucacaau

SEQ ID NO: 2038283 - RNA, 15 nt, Human herpesvirus 6
aucaaaaaaaugaua

SEQ ID NO: 2038284 - RNA, 20 nt, Human herpesvirus 6
cacuugaaccaagucaacaa

SEQ ID NO: 2038285 - RNA, 16 nt, Human herpesvirus 6
aacugugucuguucaa

SEQ ID NO: 2038286 - RNA, 17 nt, Human herpesvirus 6
uucgacuucaaacaccu

SEQ ID NO: 2038287 - RNA, 20 nt, Human herpesvirus 6
ugagaucgcauuagucacag

SEQ ID NO: 2038288 - RNA, 17 nt, Human herpesvirus 6
cccugccuauacaggca

SEQ ID NO: 2038289 - RNA, 14 nt, Human herpesvirus 6
ucucucgaugaaag

SEQ ID NO: 2038290 - RNA, 20 nt, Human herpesvirus 6
uugguuaaaaggaauagcag

SEQ ID NO: 2038291 - RNA, 16 nt, Human herpesvirus 6
uaucacggaugguuug

SEQ ID NO: 2038292 - RNA, 15 nt, Human herpesvirus 6
ugacaauaaacauga

SEQ ID NO: 2038293 - RNA, 13 nt, Human herpesvirus 6
auaaaaaaaagac

SEQ ID NO: 2038294 - RNA, 14 nt, Human herpesvirus 6
caaaaccgaggcag

SEQ ID NO: 2038295 - RNA, 13 nt, Human herpesvirus 6
gugcaaaagcuga

SEQ ID NO: 2038296 - RNA, 21 nt, Human herpesvirus 6
gauaaccguugcgauuuccuu

SEQ ID NO: 2038297 - RNA, 16 nt, Human herpesvirus 6
aaaacgacaucgcgcg

SEQ ID NO: 2038298 - RNA, 18 nt, Human herpesvirus 6
cuauuuguuuaaugcauu

SEQ ID NO: 2038299 - RNA, 16 nt, Human herpesvirus 6
gcgaggugacggaggc

SEQ ID NO: 2038300 - RNA, 12 nt, Human herpesvirus 6
gugccuuuguau

SEQ ID NO: 2038301 - RNA, 14 nt, Human herpesvirus 6
cauggugaaagacu

SEQ ID NO: 2038302 - RNA, 15 nt, Human herpesvirus 6
uaaagauagaauaau

SEQ ID NO: 2038303 - RNA, 20 nt, Human herpesvirus 6
cggaaucaccggaugucgac

SEQ ID NO: 2038304 - RNA, 18 nt, Human herpesvirus 6
cauauuauauuuaaauga

SEQ ID NO: 2038305 - RNA, 12 nt, Human herpesvirus 6
aacauuguaaau

SEQ ID NO: 2038306 - RNA, 13 nt, Human herpesvirus 6
uagagauuuugga

SEQ ID NO: 2038307 - RNA, 22 nt, Human herpesvirus 6
gucuuuccccagcacaccccau

SEQ ID NO: 2038308 - RNA, 18 nt, Human herpesvirus 6
accucaaaaaugcacaau

SEQ ID NO: 2038309 - RNA, 14 nt, Human herpesvirus 6
agaaaaguuuauuu

SEQ ID NO: 2038310 - RNA, 17 nt, Human herpesvirus 6
uacaagaaaagaaacaa

SEQ ID NO: 2038311 - RNA, 20 nt, Human herpesvirus 6
gcaauuucuuuugagggaau

SEQ ID NO: 2038312 - RNA, 14 nt, Human herpesvirus 6
cuuacguugaugau

SEQ ID NO: 2038313 - RNA, 15 nt, Human herpesvirus 6
ucuccauucuucgaa

SEQ ID NO: 2038314 - RNA, 14 nt, Human herpesvirus 6
gggacgggcggagc

SEQ ID NO: 2038315 - RNA, 13 nt, Human herpesvirus 6
uguuuuuucaaaa

SEQ ID NO: 2038316 - RNA, 18 nt, Human herpesvirus 6
guauuggugcaucaguga

SEQ ID NO: 2038317 - RNA, 10 nt, Human herpesvirus 6
aaugcugcug

SEQ ID NO: 2038318 - RNA, 19 nt, Human herpesvirus 6
cagcaaguugcuaccgcug

SEQ ID NO: 2038319 - RNA, 17 nt, Human herpesvirus 6
aaagaucaguggguacc

SEQ ID NO: 2038320 - RNA, 16 nt, Human herpesvirus 6
gugauugugacaagga

SEQ ID NO: 2038321 - RNA, 16 nt, Human herpesvirus 6
ucugaagcaaaagucu

SEQ ID NO: 2038322 - RNA, 23 nt, Human herpesvirus 6
ccgcgguuggggucuuuccugca

SEQ ID NO: 2038323 - RNA, 13 nt, Human herpesvirus 6
aaagcugcuaacg

SEQ ID NO: 2038324 - RNA, 16 nt, Human herpesvirus 6
caaccccgcacgcaua

SEQ ID NO: 2038325 - RNA, 17 nt, Human herpesvirus 6
uuaauguugaguaauug

SEQ ID NO: 2038326 - RNA, 18 nt, Human herpesvirus 6
aucaugcugugagagaau

SEQ ID NO: 2038327 - RNA, 20 nt, Human herpesvirus 6
augcuuuuagauggaaaauu

SEQ ID NO: 2038328 - RNA, 12 nt, Human herpesvirus 6
guguuuguaaau

SEQ ID NO: 2038329 - RNA, 20 nt, Human herpesvirus 6
ggcgucaucgguggcagagg

SEQ ID NO: 2038330 - RNA, 15 nt, Human herpesvirus 6
aaacuaugcaaacga

SEQ ID NO: 2038331 - RNA, 22 nt, Human herpesvirus 6
ugagauucacuccgcguaaaga

SEQ ID NO: 2038332 - RNA, 23 nt, Human herpesvirus 6
agggcagggggggucucuguucu

SEQ ID NO: 2038333 - RNA, 14 nt, Human herpesvirus 6
gugucaaguuucac

SEQ ID NO: 2038334 - RNA, 23 nt, Human herpesvirus 6
uuuccugcccaggcgaacgagaa

SEQ ID NO: 2038335 - RNA, 19 nt, Human herpesvirus 6
ggcgucaucgguggcagag

SEQ ID NO: 2038336 - RNA, 17 nt, Human herpesvirus 6
acacaaaccaucaauuu

SEQ ID NO: 2038337 - RNA, 22 nt, Human herpesvirus 6
agugccguugagugccucagag

SEQ ID NO: 2038338 - RNA, 15 nt, Human herpesvirus 6
aaaauuugcuaacgg

SEQ ID NO: 2038339 - RNA, 22 nt, Human herpesvirus 6
gacuguuuauuuucucgacauc

SEQ ID NO: 2038340 - RNA, 21 nt, Human herpesvirus 6
gcagggggggucucuguucug

SEQ ID NO: 2038341 - RNA, 16 nt, Human herpesvirus 6
cccagcugaaauagac

SEQ ID NO: 2038342 - RNA, 14 nt, Human herpesvirus 6
uacggaaaaaguau

SEQ ID NO: 2038343 - RNA, 18 nt, Human herpesvirus 6
augauuauucugucuuga

SEQ ID NO: 2038344 - RNA, 23 nt, Human herpesvirus 6
uggaaaacgacacagaacacauc

SEQ ID NO: 2038345 - RNA, 12 nt, Human herpesvirus 6
gcagguauaaga

SEQ ID NO: 2038346 - RNA, 13 nt, Human herpesvirus 6
aauucuaaauacg

SEQ ID NO: 2038347 - RNA, 15 nt, Human herpesvirus 6
uguuuuugcauguga

SEQ ID NO: 2038348 - RNA, 16 nt, Human herpesvirus 6
agcugcgcugauccug

SEQ ID NO: 2038349 - RNA, 22 nt, Human herpesvirus 6
uaaauguuuauuauccaaacau

SEQ ID NO: 2038350 - RNA, 16 nt, Human herpesvirus 6
gucuuuagaacagcuu

SEQ ID NO: 2038351 - RNA, 20 nt, Human herpesvirus 6
cagggucaaaaaacucagcc

SEQ ID NO: 2038352 - RNA, 20 nt, Human herpesvirus 6
cguuacccggaagcuucaag

SEQ ID NO: 2038353 - RNA, 21 nt, Human herpesvirus 6
uuucguuuacgaauucaaugu

SEQ ID NO: 2038354 - RNA, 23 nt, Human herpesvirus 6
aaguauguacaauauaauuucuu

SEQ ID NO: 2038355 - RNA, 13 nt, Human herpesvirus 6
aucaugcugugag

SEQ ID NO: 2038356 - RNA, 22 nt, Human herpesvirus 6
agagacgugauacuauaaacaa

SEQ ID NO: 2038357 - RNA, 11 nt, Human herpesvirus 6
uaccgcugggc

SEQ ID NO: 2038358 - RNA, 16 nt, Human herpesvirus 6
aaaguuucggaaaaug

SEQ ID NO: 2038359 - RNA, 16 nt, Human herpesvirus 6
caaacauguauccucg

SEQ ID NO: 2038360 - RNA, 14 nt, Human herpesvirus 6
acucuaaaagcugc

SEQ ID NO: 2038361 - RNA, 15 nt, Human herpesvirus 6
agguguuuccugccc

SEQ ID NO: 2038362 - RNA, 17 nt, Human herpesvirus 6
uucuucaaaaaaagaag

SEQ ID NO: 2038363 - RNA, 17 nt, Human herpesvirus 6
gguagagaguggggaca

SEQ ID NO: 2038364 - RNA, 15 nt, Human herpesvirus 6
uggucauuucauuug

SEQ ID NO: 2038365 - RNA, 15 nt, Human herpesvirus 6
aauaugauggacaaa

SEQ ID NO: 2038366 - RNA, 21 nt, Human herpesvirus 6
aauaucaccuuacaaauaaua

SEQ ID NO: 2038367 - RNA, 11 nt, Human herpesvirus 6
gcggacggacg

SEQ ID NO: 2038368 - RNA, 17 nt, Human herpesvirus 6
uugucagucaacgcaau

SEQ ID NO: 2038369 - RNA, 19 nt, Human herpesvirus 6
aaagaguugacguuccaaa

SEQ ID NO: 2038370 - RNA, 15 nt, Human herpesvirus 6
uguauauguaaauaa

SEQ ID NO: 2038371 - RNA, 16 nt, Human herpesvirus 6
aggccuacggcgccac

SEQ ID NO: 2038372 - RNA, 20 nt, Human herpesvirus 6
cuccugggagcucucccucg

SEQ ID NO: 2038373 - RNA, 18 nt, Human herpesvirus 6
auuuaaacucgacuucuu

SEQ ID NO: 2038374 - RNA, 19 nt, Human herpesvirus 6
acggguaagcagcagaaca

SEQ ID NO: 2038375 - RNA, 15 nt, Human herpesvirus 6
ugaucuuuacaaaag

SEQ ID NO: 2038376 - RNA, 23 nt, Human herpesvirus 6
aaacaccucuaaaacaagacaga

SEQ ID NO: 2038377 - RNA, 13 nt, Human herpesvirus 6
uccugcacaggcg

SEQ ID NO: 2038378 - RNA, 16 nt, Human herpesvirus 6
ugauacuauaaacaau

SEQ ID NO: 2038379 - RNA, 15 nt, Human herpesvirus 6
uugguucggagaggu

SEQ ID NO: 2038380 - RNA, 12 nt, Human herpesvirus 6
uaccuauaguca

SEQ ID NO: 2038381 - RNA, 20 nt, Human herpesvirus 6
aagugggccucguuguuuca

SEQ ID NO: 2038382 - RNA, 22 nt, Human herpesvirus 6
ggcgucaucgguggcagagggg

SEQ ID NO: 2038383 - RNA, 15 nt, Human herpesvirus 6
gaaugagauguucua

SEQ ID NO: 2038384 - RNA, 13 nt, Human herpesvirus 6
gcuaagcucguuc

SEQ ID NO: 2038385 - RNA, 14 nt, Human herpesvirus 6
aaacauguuguucu

SEQ ID NO: 2038386 - RNA, 20 nt, Human herpesvirus 6
gggcgcgagacagcggacag

SEQ ID NO: 2038387 - RNA, 20 nt, Human herpesvirus 6
ccucuaaaacaagacagacc

SEQ ID NO: 2038388 - RNA, 16 nt, Human herpesvirus 6
cuguauuaaugucacu

SEQ ID NO: 2038389 - RNA, 11 nt, Human herpesvirus 6
acugauggcag

SEQ ID NO: 2038390 - RNA, 13 nt, Human herpesvirus 6
uacacacccagca

SEQ ID NO: 2038391 - RNA, 17 nt, Human herpesvirus 6
gacgcagauuuacggca

SEQ ID NO: 2038392 - RNA, 17 nt, Human herpesvirus 6
gauuaauguguuuuucu

SEQ ID NO: 2038393 - RNA, 13 nt, Human herpesvirus 6
ccacaugaaauca

SEQ ID NO: 2038394 - RNA, 18 nt, Human herpesvirus 6
auaauuuauggaaauucg

SEQ ID NO: 2038395 - RNA, 20 nt, Human herpesvirus 6
gcagacuaauccauaugaaa

SEQ ID NO: 2038396 - RNA, 14 nt, Human herpesvirus 6
uucuuaucaaaucg

SEQ ID NO: 2038397 - RNA, 18 nt, Human herpesvirus 6
gaagaguuuuuuaagagu

SEQ ID NO: 2038398 - RNA, 16 nt, Human herpesvirus 6
cuaauaauuacaauac

SEQ ID NO: 2038399 - RNA, 13 nt, Human herpesvirus 6
uggcugugcuauc

SEQ ID NO: 2038400 - RNA, 18 nt, Human herpesvirus 6
cuauaaacaauuguauuc

SEQ ID NO: 2038401 - RNA, 22 nt, Human herpesvirus 6
aaacacacaauuaguccauuac

SEQ ID NO: 2038402 - RNA, 18 nt, Human herpesvirus 6
agaggaagauagcagaau

SEQ ID NO: 2038403 - RNA, 21 nt, Human herpesvirus 6
acuggcgcgcauguugcaguu

SEQ ID NO: 2038404 - RNA, 17 nt, Human herpesvirus 6
gcucgcucugaaauuug

SEQ ID NO: 2038405 - RNA, 23 nt, Human herpesvirus 6
ucacuccaauccaacgaauacuu

SEQ ID NO: 2038406 - RNA, 22 nt, Human herpesvirus 6
auuuuuauguugugaucaagug

SEQ ID NO: 2038407 - RNA, 12 nt, Human herpesvirus 6
uugauagacggc

SEQ ID NO: 2038408 - RNA, 22 nt, Human herpesvirus 6
ggcaaccugaaacuccccagag

SEQ ID NO: 2038409 - RNA, 23 nt, Human herpesvirus 6
cugacugguauccaauuaacaca

SEQ ID NO: 2038410 - RNA, 18 nt, Human herpesvirus 6
uccauaaguuaauuccag

SEQ ID NO: 2038411 - RNA, 19 nt, Human herpesvirus 6
uuugacugauacuugaaac

SEQ ID NO: 2038412 - RNA, 16 nt, Human herpesvirus 6
cugacaaauacgagag

SEQ ID NO: 2038413 - RNA, 23 nt, Human herpesvirus 6
agucaguaaugauauaaaagaaa

SEQ ID NO: 2038414 - RNA, 23 nt, Human herpesvirus 6
cauguguauauugaauuguauau

SEQ ID NO: 2038415 - RNA, 20 nt, Human herpesvirus 6
ucuccaaaagcgccugccua

SEQ ID NO: 2038416 - RNA, 20 nt, Human herpesvirus 6
acgcacgacaacacgccaga

SEQ ID NO: 2038417 - RNA, 21 nt, Human herpesvirus 6
agaauucuucugugacuauau

SEQ ID NO: 2038418 - RNA, 18 nt, Human herpesvirus 6
aauucaaaauaaauacua

SEQ ID NO: 2038419 - RNA, 20 nt, Human herpesvirus 6
uguaaauaugcuuauacugu

SEQ ID NO: 2038420 - RNA, 18 nt, Human herpesvirus 6
acuacugaaaccaaagca

SEQ ID NO: 2038421 - RNA, 22 nt, Human herpesvirus 6
cuccuacuauccgcccuccccg

SEQ ID NO: 2038422 - RNA, 14 nt, Human herpesvirus 6
acagucuuuaaaug

SEQ ID NO: 2038423 - RNA, 13 nt, Human herpesvirus 6
cguaaugugcaaa

SEQ ID NO: 2038424 - RNA, 14 nt, Human herpesvirus 6
guagaguggaguug

SEQ ID NO: 2038425 - RNA, 23 nt, Human herpesvirus 6
gguccaacacagcaugcauuugg

SEQ ID NO: 2038426 - RNA, 13 nt, Human herpesvirus 6
cuacuauccgccc

SEQ ID NO: 2038427 - RNA, 17 nt, Human herpesvirus 6
aucuuccuuauaacaca

SEQ ID NO: 2038428 - RNA, 20 nt, Human herpesvirus 6
cuugucgggcuuugugaaau

SEQ ID NO: 2038429 - RNA, 18 nt, Human herpesvirus 6
uccuuaauucuaaauacg

SEQ ID NO: 2038430 - RNA, 21 nt, Human herpesvirus 6
acauuauaaauuauuuuguga

SEQ ID NO: 2038431 - RNA, 14 nt, Human herpesvirus 6
ccggaguugcagug

SEQ ID NO: 2038432 - RNA, 17 nt, Human herpesvirus 6
cuggugaauguuucuga

SEQ ID NO: 2038433 - RNA, 13 nt, Human herpesvirus 6
gguuaaauuuauc

SEQ ID NO: 2038434 - RNA, 21 nt, Human herpesvirus 6
ucuggaugguugugugaguuu

SEQ ID NO: 2038435 - RNA, 20 nt, Human herpesvirus 6
aaacauguauauaaauuggu

SEQ ID NO: 2038436 - RNA, 20 nt, Human herpesvirus 6
cugagaugacaucugcaaaa

SEQ ID NO: 2038437 - RNA, 16 nt, Human herpesvirus 6
caaaaaaaugauagac

SEQ ID NO: 2038438 - RNA, 15 nt, Human herpesvirus 6
cuaggccuucaccug

SEQ ID NO: 2038439 - RNA, 16 nt, Human herpesvirus 6
aaauaucgaaauaacg

SEQ ID NO: 2038440 - RNA, 22 nt, Human herpesvirus 6
agcucaagaggguuuuuuacaa

SEQ ID NO: 2038441 - RNA, 17 nt, Human herpesvirus 6
aggggagagacauccau

SEQ ID NO: 2038442 - RNA, 14 nt, Human herpesvirus 6
cucgaaaaaacaac

SEQ ID NO: 2038443 - RNA, 14 nt, Human herpesvirus 6
aauauuuccugccc

SEQ ID NO: 2038444 - RNA, 20 nt, Human herpesvirus 6
uuaauuccaagacauguaca

SEQ ID NO: 2038445 - RNA, 18 nt, Human herpesvirus 6
ucaaacaccucacaaucu

SEQ ID NO: 2038446 - RNA, 16 nt, Human herpesvirus 6
aaaacagcuccgcauc

SEQ ID NO: 2038447 - RNA, 20 nt, Human herpesvirus 6
uuuguguuaaaauaaaguuc

SEQ ID NO: 2038448 - RNA, 20 nt, Human herpesvirus 6
uaacaucugcuaacgcggca

SEQ ID NO: 2038449 - RNA, 22 nt, Human herpesvirus 6
uacaagaaaagaaacaaugcuu

SEQ ID NO: 2038450 - RNA, 23 nt, Human herpesvirus 6
uggaagcgagcgggcuaauguau

SEQ ID NO: 2038451 - RNA, 22 nt, Human herpesvirus 6
cagaugguuuuaagagcagaca

SEQ ID NO: 2038452 - RNA, 12 nt, Human herpesvirus 6
cuauccaugaaa

SEQ ID NO: 2038453 - RNA, 20 nt, Human herpesvirus 6
cgaucucucucagaucgaga

SEQ ID NO: 2038454 - RNA, 20 nt, Human herpesvirus 6
cgcaagucacgggcagcugc

SEQ ID NO: 2038455 - RNA, 12 nt, Human herpesvirus 6
aaaggauguuug

SEQ ID NO: 2038456 - RNA, 19 nt, Human herpesvirus 6
auccgcccuccccgagcac

SEQ ID NO: 2038457 - RNA, 20 nt, Human herpesvirus 6
aucaaaugauuuuacaaaga

SEQ ID NO: 2038458 - RNA, 19 nt, Human herpesvirus 6
gcccccauacacacccagc

SEQ ID NO: 2038459 - RNA, 23 nt, Human herpesvirus 6
gggugucggacgacgggcggggc

SEQ ID NO: 2038460 - RNA, 16 nt, Human herpesvirus 6
gaucacaacauaaaaa

SEQ ID NO: 2038461 - RNA, 13 nt, Human herpesvirus 6
agguaaagaucug

SEQ ID NO: 2038462 - RNA, 22 nt, Human herpesvirus 6
agacaucacauuauaagacacu

SEQ ID NO: 2038463 - RNA, 15 nt, Human herpesvirus 6
acgagaaccugcagg

SEQ ID NO: 2038464 - RNA, 15 nt, Human herpesvirus 6
auaaaguaagcaccu

SEQ ID NO: 2038465 - RNA, 17 nt, Human herpesvirus 6
accauuguauauguguu

SEQ ID NO: 2038466 - RNA, 16 nt, Human herpesvirus 6
gaagauacgagaacaa

SEQ ID NO: 2038467 - RNA, 14 nt, Human herpesvirus 6
cuuuccugcccaag

SEQ ID NO: 2038468 - RNA, 17 nt, Human herpesvirus 6
auuauguaauacaucaa

SEQ ID NO: 2038469 - RNA, 20 nt, Human herpesvirus 6
guucagucuaugcagcgcca

SEQ ID NO: 2038470 - RNA, 13 nt, Human herpesvirus 6
agaagaucuaaau

SEQ ID NO: 2038471 - RNA, 17 nt, Human herpesvirus 6
ccucgcgcaccgccucc

SEQ ID NO: 2038472 - RNA, 13 nt, Human herpesvirus 6
aacuuuuaaaaca

SEQ ID NO: 2038473 - RNA, 14 nt, Human herpesvirus 6
uaucacucauacac

SEQ ID NO: 2038474 - RNA, 17 nt, Human herpesvirus 6
agcaauaggcaccuauc

SEQ ID NO: 2038475 - RNA, 17 nt, Human herpesvirus 6
gaccaauuuaugucauu

SEQ ID NO: 2038476 - RNA, 12 nt, Human herpesvirus 6
cuaauaaauguc

SEQ ID NO: 2038477 - RNA, 20 nt, Human herpesvirus 6
uugaucaaauaucugaaaca

SEQ ID NO: 2038478 - RNA, 22 nt, Human herpesvirus 6
agacaaaacuguccucuuugaa

SEQ ID NO: 2038479 - RNA, 20 nt, Human herpesvirus 6
aguuucaccauguccaggaa

SEQ ID NO: 2038480 - RNA, 16 nt, Human herpesvirus 6
uagaaauuacaaggua

SEQ ID NO: 2038481 - RNA, 20 nt, Human herpesvirus 6
cugaaauuugagaaaguugu

SEQ ID NO: 2038482 - RNA, 21 nt, Human herpesvirus 6
gugacuacguuuuguguuaaa

SEQ ID NO: 2038483 - RNA, 18 nt, Human herpesvirus 6
guccgugacacacagaau

SEQ ID NO: 2038484 - RNA, 13 nt, Human herpesvirus 6
uguggaaaaacug

SEQ ID NO: 2038485 - RNA, 23 nt, Human herpesvirus 6
ucuugaaaaaccuuauacagaug

SEQ ID NO: 2038486 - RNA, 19 nt, Human herpesvirus 6
ggcucgugauccuacaagg

SEQ ID NO: 2038487 - RNA, 14 nt, Human herpesvirus 6
accgucucugaagc

SEQ ID NO: 2038488 - RNA, 20 nt, Human herpesvirus 6
gugauccuacaagggcaggg

SEQ ID NO: 2038489 - RNA, 24 nt, Human herpesvirus 6
cugaguucuguggccgaagaagag

SEQ ID NO: 2038490 - RNA, 23 nt, Human herpesvirus 6
guaaaugaauguguucacagagc

SEQ ID NO: 2038491 - RNA, 17 nt, Human herpesvirus 6
gcagaguccggcgcacg

SEQ ID NO: 2038492 - RNA, 15 nt, Human herpesvirus 6
uaucauagacaaacc

SEQ ID NO: 2038493 - RNA, 17 nt, Human herpesvirus 6
agccaaagaaacagaua

SEQ ID NO: 2038494 - RNA, 12 nt, Human herpesvirus 6
aucuauaugcau

SEQ ID NO: 2038495 - RNA, 20 nt, Human herpesvirus 6
auguaaacacgaaauugcuu

SEQ ID NO: 2038496 - RNA, 18 nt, Human herpesvirus 6
ggcaccuaucuagaucaa

SEQ ID NO: 2038497 - RNA, 18 nt, Human herpesvirus 6
cacguggcagucugcucg

SEQ ID NO: 2038498 - RNA, 17 nt, Human herpesvirus 6
ggauaauuuauggaaau

SEQ ID NO: 2038499 - RNA, 17 nt, Human herpesvirus 6
aguuuaccuauuuacaa

SEQ ID NO: 2038500 - RNA, 18 nt, Human herpesvirus 6
caaagacaucgauuugcu

SEQ ID NO: 2038501 - RNA, 18 nt, Human herpesvirus 6
cucguucuaccaugugcg

SEQ ID NO: 2038502 - RNA, 17 nt, Human herpesvirus 6
auguuugggagaacuga

SEQ ID NO: 2038503 - RNA, 12 nt, Human herpesvirus 6
uauaaaaacuaa

SEQ ID NO: 2038504 - RNA, 22 nt, Human herpesvirus 6
cugcacaggcgaacgaaaacuc

SEQ ID NO: 2038505 - RNA, 18 nt, Human herpesvirus 6
caauuuaggucuuuaucc

SEQ ID NO: 2038506 - RNA, 16 nt, Human herpesvirus 6
acugaccguuguaaga

SEQ ID NO: 2038507 - RNA, 16 nt, Human herpesvirus 6
cagcuuuauucccaug

SEQ ID NO: 2038508 - RNA, 14 nt, Human herpesvirus 6
uuuguguuuguaaa

SEQ ID NO: 2038509 - RNA, 18 nt, Human herpesvirus 6
ugccaccgucugggaccc

SEQ ID NO: 2038510 - RNA, 15 nt, Human herpesvirus 6
ucaaaugauuuuaca

SEQ ID NO: 2038511 - RNA, 13 nt, Human herpesvirus 6
ccugaucacagag

SEQ ID NO: 2038512 - RNA, 15 nt, Human herpesvirus 6
ugcauuuuguauuua

SEQ ID NO: 2038513 - RNA, 17 nt, Human herpesvirus 6
uggucaugaucugcuug

SEQ ID NO: 2038514 - RNA, 21 nt, Human herpesvirus 6
ucaauaucaccuuacaaauaa

SEQ ID NO: 2038515 - RNA, 17 nt, Human herpesvirus 6
ugugacaaaucuguaag

SEQ ID NO: 2038516 - RNA, 14 nt, Human herpesvirus 6
guuuuguggcucuc

SEQ ID NO: 2038517 - RNA, 13 nt, Human herpesvirus 6
gccgacagcaagu

SEQ ID NO: 2038518 - RNA, 16 nt, Human herpesvirus 6
uaucgauucuguaauu

SEQ ID NO: 2038519 - RNA, 23 nt, Human herpesvirus 6
caguuauacuggcaaagcaaaga

SEQ ID NO: 2038520 - RNA, 18 nt, Human herpesvirus 6
ucuaacaucucguaacgc

SEQ ID NO: 2038521 - RNA, 22 nt, Human herpesvirus 6
gacggccuccggccccagagac

SEQ ID NO: 2038522 - RNA, 23 nt, Human herpesvirus 6
cacagcaugaacucucacggcca

SEQ ID NO: 2038523 - RNA, 14 nt, Human herpesvirus 6
caacgcaucacaca

SEQ ID NO: 2038524 - RNA, 16 nt, Human herpesvirus 6
cggccuggaguacaag

SEQ ID NO: 2038525 - RNA, 13 nt, Human herpesvirus 6
agguuagugggga

SEQ ID NO: 2038526 - RNA, 11 nt, Human herpesvirus 6
guguuuccaau

SEQ ID NO: 2038527 - RNA, 20 nt, Human herpesvirus 6
cgggcccggggacggacagg

SEQ ID NO: 2038528 - RNA, 15 nt, Human herpesvirus 6
uuacaagguacacaa

SEQ ID NO: 2038529 - RNA, 18 nt, Human herpesvirus 6
aaaaauuuugaugccaaa

SEQ ID NO: 2038530 - RNA, 16 nt, Human herpesvirus 6
cucaaagaaaagaugu

SEQ ID NO: 2038531 - RNA, 18 nt, Human herpesvirus 6
uauauugggggaaaauac

SEQ ID NO: 2038532 - RNA, 15 nt, Human herpesvirus 6
ugcaugguccacaga

SEQ ID NO: 2038533 - RNA, 16 nt, Human herpesvirus 6
uaaaggucagugggua

SEQ ID NO: 2038534 - RNA, 17 nt, Human herpesvirus 6
ucauuagcauacagaug

SEQ ID NO: 2038535 - RNA, 21 nt, Human herpesvirus 6
caaagaacaaaaucuucuuug

SEQ ID NO: 2038536 - RNA, 15 nt, Human herpesvirus 6
agcuaaaacuugaaa

SEQ ID NO: 2038537 - RNA, 15 nt, Human herpesvirus 6
aguucaacgcugucu

SEQ ID NO: 2038538 - RNA, 15 nt, Human herpesvirus 6
aauguuuuguggcuc

SEQ ID NO: 2038539 - RNA, 23 nt, Human herpesvirus 6
uuauggacaacgguguggagaca

SEQ ID NO: 2038540 - RNA, 15 nt, Human herpesvirus 6
uaucaugagagagca

SEQ ID NO: 2038541 - RNA, 17 nt, Human herpesvirus 6
acggugccaaaggaaac

SEQ ID NO: 2038542 - RNA, 18 nt, Human herpesvirus 6
gucuuuccugcacaggcg

SEQ ID NO: 2038543 - RNA, 23 nt, Human herpesvirus 6
uaucgcaagcaaaacacagacgg

SEQ ID NO: 2038544 - RNA, 22 nt, Human herpesvirus 6
uuucaugauucuuugucuaauu

SEQ ID NO: 2038545 - RNA, 17 nt, Human herpesvirus 6
agucugcuaaaaaucau

SEQ ID NO: 2038546 - RNA, 21 nt, Human herpesvirus 6
ccacgugcuugucucacaagc

SEQ ID NO: 2038547 - RNA, 14 nt, Human herpesvirus 6
agcagucaguaaug

SEQ ID NO: 2038548 - RNA, 16 nt, Human herpesvirus 6
uacauauagucaaugu

SEQ ID NO: 2038549 - RNA, 19 nt, Human herpesvirus 6
aguguucgcauuagaaaau

SEQ ID NO: 2038550 - RNA, 21 nt, Human herpesvirus 6
gucucuucuugcgaccuggcu

SEQ ID NO: 2038551 - RNA, 18 nt, Human herpesvirus 6
acauaagcaaauguaacu

SEQ ID NO: 2038552 - RNA, 15 nt, Human herpesvirus 6
agcagaagaacagcu

SEQ ID NO: 2038553 - RNA, 14 nt, Human herpesvirus 6
cccgcguccuccau

SEQ ID NO: 2038554 - RNA, 22 nt, Human herpesvirus 6
augaaaguccucaaacuuuuag

SEQ ID NO: 2038555 - RNA, 14 nt, Human herpesvirus 6
uccugcguguuaau

SEQ ID NO: 2038556 - RNA, 21 nt, Human herpesvirus 6
aagaaaaagcagcagaugcuu

SEQ ID NO: 2038557 - RNA, 20 nt, Human herpesvirus 6
uuucuaacagaggguuuaga

SEQ ID NO: 2038558 - RNA, 19 nt, Human herpesvirus 6
acagugauuagaauguuug

SEQ ID NO: 2038559 - RNA, 23 nt, Human herpesvirus 6
uauugccgcuucuauauaucaua

SEQ ID NO: 2038560 - RNA, 16 nt, Human herpesvirus 6
gcggagcccaagaaga

SEQ ID NO: 2038561 - RNA, 22 nt, Human herpesvirus 6
gcccgaaugugauuaugccaaa

SEQ ID NO: 2038562 - RNA, 19 nt, Human herpesvirus 6
uggauggauaaaauugaug

SEQ ID NO: 2038563 - RNA, 15 nt, Human herpesvirus 6
acccccgauucagac

SEQ ID NO: 2038564 - RNA, 13 nt, Human herpesvirus 6
ccaauaaaauauc

SEQ ID NO: 2038565 - RNA, 18 nt, Human herpesvirus 6
uguuucugauuuguucua

SEQ ID NO: 2038566 - RNA, 17 nt, Human herpesvirus 6
uccagguagaguugcgu

SEQ ID NO: 2038567 - RNA, 21 nt, Human herpesvirus 6
uggaugaucgccacaugugua

SEQ ID NO: 2038568 - RNA, 19 nt, Human herpesvirus 6
aguuuuuuuucuuuaccga

SEQ ID NO: 2038569 - RNA, 22 nt, Human herpesvirus 6
aacaggauucccuucagacauc

SEQ ID NO: 2038570 - RNA, 21 nt, Human herpesvirus 6
uuccucgcgguauaaugcaug

SEQ ID NO: 2038571 - RNA, 18 nt, Human herpesvirus 6
auguaguuaaugcugcug

SEQ ID NO: 2038572 - RNA, 18 nt, Human herpesvirus 6
caacaucuuaaaagacca

SEQ ID NO: 2038573 - RNA, 17 nt, Human herpesvirus 6
cguuuagaaugacagag

SEQ ID NO: 2038574 - RNA, 15 nt, Human herpesvirus 6
acguagcgaaccagg

SEQ ID NO: 2038575 - RNA, 16 nt, Human herpesvirus 6
uacgaaauaaucgauu

SEQ ID NO: 2038576 - RNA, 13 nt, Human herpesvirus 6
gacuacagcugca

SEQ ID NO: 2038577 - RNA, 13 nt, Human herpesvirus 6
ccgauucagaccu

SEQ ID NO: 2038578 - RNA, 16 nt, Human herpesvirus 6
ggcagaggggaaggga

SEQ ID NO: 2038579 - RNA, 13 nt, Human herpesvirus 6
uuagaauguuugg

SEQ ID NO: 2038580 - RNA, 23 nt, Human herpesvirus 6
aguucagaagagaugaaagacag

SEQ ID NO: 2038581 - RNA, 18 nt, Human herpesvirus 6
gucuccugggagcucucc

SEQ ID NO: 2038582 - RNA, 16 nt, Human herpesvirus 6
gagguuuuuguugguu

SEQ ID NO: 2038583 - RNA, 18 nt, Human herpesvirus 6
caguaaaucuucauuaaa

SEQ ID NO: 2038584 - RNA, 19 nt, Human herpesvirus 6
acccuaccauccuucggcc

SEQ ID NO: 2038585 - RNA, 14 nt, Human herpesvirus 6
uguuuccugcccag

SEQ ID NO: 2038586 - RNA, 21 nt, Human herpesvirus 6
ugaaagagacucuauggugag

SEQ ID NO: 2038587 - RNA, 21 nt, Human herpesvirus 6
acucuccacccaucuccucaa

SEQ ID NO: 2038588 - RNA, 14 nt, Human herpesvirus 6
ugaaauaucagaaa

SEQ ID NO: 2038589 - RNA, 17 nt, Human herpesvirus 6
agugauuagaauguuug

SEQ ID NO: 2038590 - RNA, 23 nt, Human herpesvirus 6
guuugcaaaacuguuaaaagaga

SEQ ID NO: 2038591 - RNA, 16 nt, Human herpesvirus 6
cagcaucaccuggguu

SEQ ID NO: 2038592 - RNA, 17 nt, Human herpesvirus 6
uggauggauaaaauuga

SEQ ID NO: 2038593 - RNA, 15 nt, Human herpesvirus 6
aacuaucggagagac

SEQ ID NO: 2038594 - RNA, 17 nt, Human herpesvirus 6
aaggauuaugaucauau

SEQ ID NO: 2038595 - RNA, 18 nt, Human herpesvirus 6
cggagaaaguugauagac

SEQ ID NO: 2038596 - RNA, 13 nt, Human herpesvirus 6
uacaacaauaaaa

SEQ ID NO: 2038597 - RNA, 17 nt, Human herpesvirus 6
gggcuggaaagagaacg

SEQ ID NO: 2038598 - RNA, 13 nt, Human herpesvirus 6
auuacaaaacaau

SEQ ID NO: 2038599 - RNA, 16 nt, Human herpesvirus 6
uaaaagcuauguauga

SEQ ID NO: 2038600 - RNA, 16 nt, Human herpesvirus 6
accuaaauacauucac

SEQ ID NO: 2038601 - RNA, 15 nt, Human herpesvirus 6
ugcccagauguggaa

SEQ ID NO: 2038602 - RNA, 16 nt, Human herpesvirus 6
gaaaguucaucuuuca

SEQ ID NO: 2038603 - RNA, 16 nt, Human herpesvirus 6
aaaaaauagcagcaau

SEQ ID NO: 2038604 - RNA, 14 nt, Human herpesvirus 6
uagcauacgacaaa

SEQ ID NO: 2038605 - RNA, 12 nt, Human herpesvirus 6
ugguuugcuucg

SEQ ID NO: 2038606 - RNA, 20 nt, Human herpesvirus 6
agaaguuuacauagaaauua

SEQ ID NO: 2038607 - RNA, 14 nt, Human herpesvirus 6
caugagagagcaaa

SEQ ID NO: 2038608 - RNA, 14 nt, Human herpesvirus 6
cgcuccuccccugu

SEQ ID NO: 2038609 - RNA, 19 nt, Human herpesvirus 6
uaacucuuuuuguugcuau

SEQ ID NO: 2038610 - RNA, 20 nt, Human herpesvirus 6
uuuuuauuuuauaauacacu

SEQ ID NO: 2038611 - RNA, 12 nt, Human herpesvirus 6
uccugcccaggc

SEQ ID NO: 2038612 - RNA, 19 nt, Human herpesvirus 6
ccccugccgagccugugga

SEQ ID NO: 2038613 - RNA, 14 nt, Human herpesvirus 6
uaggauuagaacaa

SEQ ID NO: 2038614 - RNA, 15 nt, Human herpesvirus 6
cagaccacaccccug

SEQ ID NO: 2038615 - RNA, 15 nt, Human herpesvirus 6
ugacuauuaaacuaa

SEQ ID NO: 2038616 - RNA, 12 nt, Human herpesvirus 6
guauugaagaaa

SEQ ID NO: 2038617 - RNA, 17 nt, Human herpesvirus 6
caucugcaaaaaacaaa

SEQ ID NO: 2038618 - RNA, 13 nt, Human herpesvirus 6
cugagacagucca

SEQ ID NO: 2038619 - RNA, 22 nt, Human herpesvirus 6
ucgcgcgcgacgugccaccguc

SEQ ID NO: 2038620 - RNA, 17 nt, Human herpesvirus 6
acagauuaaauauaccu

SEQ ID NO: 2038621 - RNA, 16 nt, Human herpesvirus 6
caucccuuaaaaaaac

SEQ ID NO: 2038622 - RNA, 17 nt, Human herpesvirus 6
cgggccuccgccacugc

SEQ ID NO: 2038623 - RNA, 16 nt, Human herpesvirus 6
accgccguucugcuua

SEQ ID NO: 2038624 - RNA, 19 nt, Human herpesvirus 6
aauguugaaguauguacaa

SEQ ID NO: 2038625 - RNA, 18 nt, Human herpesvirus 6
auguugaaguauguacaa

SEQ ID NO: 2038626 - RNA, 14 nt, Human herpesvirus 6
uucccuuuuacaau

SEQ ID NO: 2038627 - RNA, 22 nt, Human herpesvirus 6
uuguaguauaucuagauaaacg

SEQ ID NO: 2038628 - RNA, 16 nt, Human herpesvirus 6
uucuauguaaacuucu

SEQ ID NO: 2038629 - RNA, 16 nt, Human herpesvirus 6
gccaaaggaaaccacc

SEQ ID NO: 2038630 - RNA, 18 nt, Human herpesvirus 6
ccauguguauauugaauu

SEQ ID NO: 2038631 - RNA, 21 nt, Human herpesvirus 6
aauaaauacuagcuaaaacuu

SEQ ID NO: 2038632 - RNA, 12 nt, Human herpesvirus 6
uaucugaagacg

SEQ ID NO: 2038633 - RNA, 15 nt, Human herpesvirus 6
aacaaauggaaacug

SEQ ID NO: 2038634 - RNA, 17 nt, Human herpesvirus 6
gcgcgaggugacggagg

SEQ ID NO: 2038635 - RNA, 15 nt, Human herpesvirus 6
ucuaaaaucucguaa

SEQ ID NO: 2038636 - RNA, 16 nt, Human herpesvirus 6
cgucuauaacaauugu

SEQ ID NO: 2038637 - RNA, 17 nt, Human herpesvirus 6
agaaaauugcagaucua

SEQ ID NO: 2038638 - RNA, 14 nt, Human herpesvirus 6
aacacgcuguugcu

SEQ ID NO: 2038639 - RNA, 17 nt, Human herpesvirus 6
auacggaagcugaaaaa

SEQ ID NO: 2038640 - RNA, 16 nt, Human herpesvirus 6
aacugcuuaacuugca

SEQ ID NO: 2038641 - RNA, 11 nt, Human herpesvirus 6
gcccugcuccg

SEQ ID NO: 2038642 - RNA, 22 nt, Human herpesvirus 6
caugcaacacaacaaacauccu

SEQ ID NO: 2038643 - RNA, 21 nt, Human herpesvirus 6
aucuauuauaagcaaacaugu

SEQ ID NO: 2038644 - RNA, 15 nt, Human herpesvirus 6
augacucuaaauacg

SEQ ID NO: 2038645 - RNA, 13 nt, Human herpesvirus 6
auuuccugcccag

SEQ ID NO: 2038646 - RNA, 16 nt, Human herpesvirus 6
uuaaugagaggacagu

SEQ ID NO: 2038647 - RNA, 17 nt, Human herpesvirus 6
aauauguuuucaaaaau

SEQ ID NO: 2038648 - RNA, 22 nt, Human herpesvirus 6
ccgcgguuugggggucuuuccu

SEQ ID NO: 2038649 - RNA, 13 nt, Human herpesvirus 6
aaaccucuguaga

SEQ ID NO: 2038650 - RNA, 17 nt, Human herpesvirus 6
uaaaaacucacacaacc

SEQ ID NO: 2038651 - RNA, 14 nt, Human herpesvirus 6
uuaccuauagucaa

SEQ ID NO: 2038652 - RNA, 23 nt, Human herpesvirus 6
uguauauugaauuguauauauag

SEQ ID NO: 2038653 - RNA, 14 nt, Human herpesvirus 6
agcucucccuuaaa

SEQ ID NO: 2038654 - RNA, 20 nt, Human herpesvirus 6
ggacgggaagaacaggcgga

SEQ ID NO: 2038655 - RNA, 23 nt, Human herpesvirus 6
uacuauauaugcaagccaugaca

SEQ ID NO: 2038656 - RNA, 12 nt, Human herpesvirus 6
aagucagugggu

SEQ ID NO: 2038657 - RNA, 18 nt, Human herpesvirus 6
caggaacagucugacaug

SEQ ID NO: 2038658 - RNA, 17 nt, Human herpesvirus 6
ggaugcugaugaauuua

SEQ ID NO: 2038659 - RNA, 15 nt, Human herpesvirus 6
ggaccgagcggcgga

SEQ ID NO: 2038660 - RNA, 14 nt, Human herpesvirus 6
gcuccgcgccccuc

SEQ ID NO: 2038661 - RNA, 23 nt, Human herpesvirus 6
ugaauggaguaaauuaaaguuua

SEQ ID NO: 2038662 - RNA, 14 nt, Human herpesvirus 6
ggcaacgcuccucc

SEQ ID NO: 2038663 - RNA, 17 nt, Human herpesvirus 6
cggggcggacggggacg

SEQ ID NO: 2038664 - RNA, 15 nt, Human herpesvirus 6
caaauugauuaugau

SEQ ID NO: 2038665 - RNA, 15 nt, Human herpesvirus 6
uuauacuguuguaaa

SEQ ID NO: 2038666 - RNA, 16 nt, Human herpesvirus 6
ucugacauggaagaca

SEQ ID NO: 2038667 - RNA, 15 nt, Human herpesvirus 6
auccaccuucccucc

SEQ ID NO: 2038668 - RNA, 21 nt, Human herpesvirus 6
cgaggggcggauccgcuccgc

SEQ ID NO: 2038669 - RNA, 20 nt, Human herpesvirus 6
uaauuaccuauagucaaugu

SEQ ID NO: 2038670 - RNA, 19 nt, Human herpesvirus 6
caauuguaguuuguguccu

SEQ ID NO: 2038671 - RNA, 23 nt, Human herpesvirus 6
caaaucuucccuuuuacaauaca

SEQ ID NO: 2038672 - RNA, 18 nt, Human herpesvirus 6
ccgguuuaagaagggcuu

SEQ ID NO: 2038673 - RNA, 15 nt, Human herpesvirus 6
cauacacacccagca

SEQ ID NO: 2038674 - RNA, 22 nt, Human herpesvirus 6
gacagggggaucgacgggcagg

SEQ ID NO: 2038675 - RNA, 15 nt, Human herpesvirus 6
ugaauguuacagaua

SEQ ID NO: 2038676 - RNA, 22 nt, Human herpesvirus 6
ucuagcuauagcuaauguaaua

SEQ ID NO: 2038677 - RNA, 18 nt, Human herpesvirus 6
aucacauuauaagacacu

SEQ ID NO: 2038678 - RNA, 12 nt, Human herpesvirus 6
aaauuacauaag

SEQ ID NO: 2038679 - RNA, 14 nt, Human herpesvirus 6
acugugauaugcaa

SEQ ID NO: 2038680 - RNA, 16 nt, Human herpesvirus 6
gagauaucauaaucug

SEQ ID NO: 2038681 - RNA, 12 nt, Human herpesvirus 6
ccacauguguau

SEQ ID NO: 2038682 - RNA, 13 nt, Human herpesvirus 6
acgcauuugcaau

SEQ ID NO: 2038683 - RNA, 17 nt, Human herpesvirus 6
guaugaaaguccucaaa

SEQ ID NO: 2038684 - RNA, 21 nt, Human herpesvirus 6
aaauauguugaaucuuauuca

SEQ ID NO: 2038685 - RNA, 23 nt, Human herpesvirus 6
gucugggacccacgguggccugg

SEQ ID NO: 2038686 - RNA, 23 nt, Human herpesvirus 6
uuguugucucuuuauaaacuuaa

SEQ ID NO: 2038687 - RNA, 15 nt, Human herpesvirus 6
uucaaugcguuucuu

SEQ ID NO: 2038688 - RNA, 20 nt, Human herpesvirus 6
cagcggaccaauccaugcaa

SEQ ID NO: 2038689 - RNA, 16 nt, Human herpesvirus 6
uauguaauacaucaac

SEQ ID NO: 2038690 - RNA, 14 nt, Human herpesvirus 6
gaaaagggugacac

SEQ ID NO: 2038691 - RNA, 18 nt, Human herpesvirus 6
uucaacauuccaacuuuc

SEQ ID NO: 2038692 - RNA, 14 nt, Human herpesvirus 6
uaaaguuuugugau

SEQ ID NO: 2038693 - RNA, 19 nt, Human herpesvirus 6
acccugccuauacaggcaa

SEQ ID NO: 2038694 - RNA, 18 nt, Human herpesvirus 6
aaucauuguuugaauaac

SEQ ID NO: 2038695 - RNA, 16 nt, Human herpesvirus 6
augccugcauaugcag

SEQ ID NO: 2038696 - RNA, 13 nt, Human herpesvirus 6
ccuucggccgaca

SEQ ID NO: 2038697 - RNA, 15 nt, Human herpesvirus 6
auaucgagccaaaga

SEQ ID NO: 2038698 - RNA, 14 nt, Human herpesvirus 6
augacaucugcaaa

SEQ ID NO: 2038699 - RNA, 14 nt, Human herpesvirus 6
ucuccauccucgaa

SEQ ID NO: 2038700 - RNA, 14 nt, Human herpesvirus 6
gacuauuucaaaag

SEQ ID NO: 2038701 - RNA, 19 nt, Human herpesvirus 6
ggcggagccacuugcaaug

SEQ ID NO: 2038702 - RNA, 23 nt, Human herpesvirus 6
gacaaucgucggaucaacagaug

SEQ ID NO: 2038703 - RNA, 18 nt, Human herpesvirus 6
gugccaccgucugggacc

SEQ ID NO: 2038704 - RNA, 15 nt, Human herpesvirus 6
agcccuuacuugaaa

SEQ ID NO: 2038705 - RNA, 21 nt, Human herpesvirus 6
uaaagacgggccuccgccacu

SEQ ID NO: 2038706 - RNA, 14 nt, Human herpesvirus 6
uaaaguuauauucu

SEQ ID NO: 2038707 - RNA, 12 nt, Human herpesvirus 6
agaaaauugcag

SEQ ID NO: 2038708 - RNA, 16 nt, Human herpesvirus 6
augaaacucuuugaac

SEQ ID NO: 2038709 - RNA, 23 nt, Human herpesvirus 6
ucucggcgccggugguaccuguc

SEQ ID NO: 2038710 - RNA, 23 nt, Human herpesvirus 6
aaucucaagcacaaaaccaggaa

SEQ ID NO: 2038711 - RNA, 20 nt, Human herpesvirus 6
gaucaucgggaacauagaga

SEQ ID NO: 2038712 - RNA, 17 nt, Human herpesvirus 6
ggagguaacggagcccg

SEQ ID NO: 2038713 - RNA, 16 nt, Human herpesvirus 6
cccacaggcggggauc

SEQ ID NO: 2038714 - RNA, 14 nt, Human herpesvirus 6
ucuggcacaggcau

SEQ ID NO: 2038715 - RNA, 15 nt, Human herpesvirus 6
guauuuuuuaagagu

SEQ ID NO: 2038716 - RNA, 18 nt, Human herpesvirus 6
cccugccgagccugugga

SEQ ID NO: 2038717 - RNA, 16 nt, Human herpesvirus 6
aaaacgacacagaaca

SEQ ID NO: 2038718 - RNA, 23 nt, Human herpesvirus 6
uacgacacgcuggagcagcuucc

SEQ ID NO: 2038719 - RNA, 14 nt, Human herpesvirus 6
guucaucagccauu

SEQ ID NO: 2038720 - RNA, 14 nt, Human herpesvirus 6
aaacaaauggaaac

SEQ ID NO: 2038721 - RNA, 17 nt, Human herpesvirus 6
ucccccggaguacacgu

SEQ ID NO: 2038722 - RNA, 21 nt, Human herpesvirus 6
acaguaugucuccaaacagag

SEQ ID NO: 2038723 - RNA, 18 nt, Human herpesvirus 6
cacugugauaugcaaacu

SEQ ID NO: 2038724 - RNA, 22 nt, Human herpesvirus 6
auuaugugacucggaacauaau

SEQ ID NO: 2038725 - RNA, 15 nt, Human herpesvirus 6
gguuggaugccugca

SEQ ID NO: 2038726 - RNA, 22 nt, Human herpesvirus 6
aaaacugcauggugagcaaaau

SEQ ID NO: 2038727 - RNA, 15 nt, Human herpesvirus 6
aggaaaccaccggcu

SEQ ID NO: 2038728 - RNA, 19 nt, Human herpesvirus 6
cgccggaucguaaggcagu

SEQ ID NO: 2038729 - RNA, 22 nt, Human herpesvirus 6
caucccagauacauaaacaccc

SEQ ID NO: 2038730 - RNA, 22 nt, Human herpesvirus 6
acggaaaagaugagcgucagag

SEQ ID NO: 2038731 - RNA, 16 nt, Human herpesvirus 6
aggcaaacgagaacuc

SEQ ID NO: 2038732 - RNA, 13 nt, Human herpesvirus 6
auucuauguacuu

SEQ ID NO: 2038733 - RNA, 15 nt, Human herpesvirus 6
aaccuugacagauau

SEQ ID NO: 2038734 - RNA, 17 nt, Human herpesvirus 6
aacacacaucauauccu

SEQ ID NO: 2038735 - RNA, 21 nt, Human herpesvirus 6
ugaacuggcgcgcauguugca

SEQ ID NO: 2038736 - RNA, 16 nt, Human herpesvirus 6
ucuuguugaguuucag

SEQ ID NO: 2038737 - RNA, 16 nt, Human herpesvirus 6
gaaacuccccagagaa

SEQ ID NO: 2038738 - RNA, 13 nt, Human herpesvirus 6
aaagucagugggu

SEQ ID NO: 2038739 - RNA, 20 nt, Human herpesvirus 6
cuuuuauuuugggauacaua

SEQ ID NO: 2038740 - RNA, 19 nt, Human herpesvirus 6
acggcaacgcuccuccccu

SEQ ID NO: 2038741 - RNA, 23 nt, Human herpesvirus 6
aaucugcguuccucucucggcug

SEQ ID NO: 2038742 - RNA, 13 nt, Human herpesvirus 6
ugaagaugacagc

SEQ ID NO: 2038743 - RNA, 14 nt, Human herpesvirus 6
ggagacuccccgcu

SEQ ID NO: 2038744 - RNA, 16 nt, Human herpesvirus 6
agccaaugauucuuaa

SEQ ID NO: 2038745 - RNA, 20 nt, Human herpesvirus 6
uagguauuagaugaauuugu

SEQ ID NO: 2038746 - RNA, 13 nt, Human herpesvirus 6
agucugcuauuuu

SEQ ID NO: 2038747 - RNA, 15 nt, Human herpesvirus 6
cauuuccaugcauau

SEQ ID NO: 2038748 - RNA, 17 nt, Human herpesvirus 6
gacgggcggggcggacg

SEQ ID NO: 2038749 - RNA, 20 nt, Human herpesvirus 6
aaacaccucuaaaacaagac

SEQ ID NO: 2038750 - RNA, 12 nt, Human herpesvirus 6
aauguugcaugg

SEQ ID NO: 2038751 - RNA, 20 nt, Human herpesvirus 6
guucaccacugugauaugca

SEQ ID NO: 2038752 - RNA, 17 nt, Human herpesvirus 6
agacgggccuccgccac

SEQ ID NO: 2038753 - RNA, 22 nt, Human herpesvirus 6
uuuuaagagugcaacaaaaagc

SEQ ID NO: 2038754 - RNA, 18 nt, Human herpesvirus 6
accgucucugaagcaaaa

SEQ ID NO: 2038755 - RNA, 17 nt, Human herpesvirus 6
cacuuguauuaaaguuc

SEQ ID NO: 2038756 - RNA, 21 nt, Human herpesvirus 6
aucgcuuaaagcguuugcaaa

SEQ ID NO: 2038757 - RNA, 20 nt, Human herpesvirus 6
uucaagguggagguuucuuu

SEQ ID NO: 2038758 - RNA, 19 nt, Human herpesvirus 6
aaagagaauacuacaguga

SEQ ID NO: 2038759 - RNA, 14 nt, Human herpesvirus 6
ucugaaaauaaagu

SEQ ID NO: 2038760 - RNA, 21 nt, Human herpesvirus 6
acauugauuccaccuuuaucg

SEQ ID NO: 2038761 - RNA, 18 nt, Human herpesvirus 6
ugguagcuauuaugugaa

SEQ ID NO: 2038762 - RNA, 12 nt, Human herpesvirus 6
gacgggcaggaa

SEQ ID NO: 2038763 - RNA, 16 nt, Human herpesvirus 6
cugagaccuugucaau

SEQ ID NO: 2038764 - RNA, 19 nt, Human herpesvirus 6
ggcgggcagaucuaucaca

SEQ ID NO: 2038765 - RNA, 17 nt, Human herpesvirus 6
uucgcaaaaacguuuuu

SEQ ID NO: 2038766 - RNA, 22 nt, Human herpesvirus 6
cuuugggaccuucaggaacaaa

SEQ ID NO: 2038767 - RNA, 17 nt, Human herpesvirus 6
cagugucguuagaaugu

SEQ ID NO: 2038768 - RNA, 18 nt, Human herpesvirus 6
gcucuacacccucucucg

SEQ ID NO: 2038769 - RNA, 21 nt, Human herpesvirus 6
uaaagaaacagauuuccgccu

SEQ ID NO: 2038770 - RNA, 13 nt, Human herpesvirus 6
uccaccccucuuc

SEQ ID NO: 2038771 - RNA, 24 nt, Human herpesvirus 6
aauguugaguaauugaacauugua

SEQ ID NO: 2038772 - RNA, 21 nt, Human herpesvirus 6
aauuuuaucuucgccuuguau

SEQ ID NO: 2038773 - RNA, 13 nt, Human herpesvirus 6
cgggcuugcgaug

SEQ ID NO: 2038774 - RNA, 13 nt, Human herpesvirus 6
gcagaucaucaaa

SEQ ID NO: 2038775 - RNA, 20 nt, Human herpesvirus 6
uucuucgaguuuuuuuugaa

SEQ ID NO: 2038776 - RNA, 23 nt, Human herpesvirus 6
aaucagccugcucagagcugcgc

SEQ ID NO: 2038777 - RNA, 18 nt, Human herpesvirus 6
cuacggcaacgcuccucc

SEQ ID NO: 2038778 - RNA, 19 nt, Human herpesvirus 6
cgcgguuuggggucuuucc

SEQ ID NO: 2038779 - RNA, 10 nt, Human herpesvirus 6
aaaugugucu

SEQ ID NO: 2038780 - RNA, 15 nt, Human herpesvirus 6
auacuuuugucucug

SEQ ID NO: 2038781 - RNA, 17 nt, Human herpesvirus 6
uguuaaccaguagacaa

SEQ ID NO: 2038782 - RNA, 16 nt, Human herpesvirus 6
acgaaaacucuaaaag

SEQ ID NO: 2038783 - RNA, 16 nt, Human herpesvirus 6
acuggagcuagagaaa

SEQ ID NO: 2038784 - RNA, 15 nt, Human herpesvirus 6
cagagccgaucagau

SEQ ID NO: 2038785 - RNA, 23 nt, Human herpesvirus 6
cauaaguuaauuccagcuuucuu

SEQ ID NO: 2038786 - RNA, 15 nt, Human herpesvirus 6
caccucgcgcaccgc

SEQ ID NO: 2038787 - RNA, 19 nt, Human herpesvirus 6
gacagcaaguugcuaccgc

SEQ ID NO: 2038788 - RNA, 14 nt, Human herpesvirus 6
gacgugcugcaagg

SEQ ID NO: 2038789 - RNA, 19 nt, Human herpesvirus 6
cucaacacucucaguguaa

SEQ ID NO: 2038790 - RNA, 16 nt, Human herpesvirus 6
agcuuguuaggacacu

SEQ ID NO: 2038791 - RNA, 12 nt, Human herpesvirus 6
aaaauuugaaau

SEQ ID NO: 2038792 - RNA, 16 nt, Human herpesvirus 6
cccagcgggcuccguc

SEQ ID NO: 2038793 - RNA, 15 nt, Human herpesvirus 6
gcgagccgcggggag

SEQ ID NO: 2038794 - RNA, 16 nt, Human herpesvirus 6
auuaaauauaccugaa

SEQ ID NO: 2038795 - RNA, 24 nt, Human herpesvirus 6
aucuuauuaauuuccugaucacag

SEQ ID NO: 2038796 - RNA, 16 nt, Human herpesvirus 6
auuucuauguaaacuu

SEQ ID NO: 2038797 - RNA, 19 nt, Human herpesvirus 6
uguaccuagcagcaaauaa

SEQ ID NO: 2038798 - RNA, 18 nt, Human herpesvirus 6
uaaccagauguguacaac

SEQ ID NO: 2038799 - RNA, 20 nt, Human herpesvirus 6
cucaaacuuuuagagacuuu

SEQ ID NO: 2038800 - RNA, 16 nt, Human herpesvirus 6
gagcauucacauaaga

SEQ ID NO: 2038801 - RNA, 23 nt, Human herpesvirus 6
aauguaacugguucagaauuugu

SEQ ID NO: 2038802 - RNA, 20 nt, Human herpesvirus 6
gacgugccaccgucugggac

SEQ ID NO: 2038803 - RNA, 16 nt, Human herpesvirus 6
uuuuugucagguuuga

SEQ ID NO: 2038804 - RNA, 16 nt, Human herpesvirus 6
cacgaagacgaagagg

SEQ ID NO: 2038805 - RNA, 22 nt, Human herpesvirus 6
ucuacguaugaaaguccucaaa

SEQ ID NO: 2038806 - RNA, 22 nt, Human herpesvirus 6
agacauccagaaaagcaaacau

SEQ ID NO: 2038807 - RNA, 19 nt, Human herpesvirus 6
gaugaagcgguuagagcug

SEQ ID NO: 2038808 - RNA, 15 nt, Human herpesvirus 6
uuaaacuaugcaaac

SEQ ID NO: 2038809 - RNA, 17 nt, Human herpesvirus 6
acguuuuccaugugaau

SEQ ID NO: 2038810 - RNA, 13 nt, Human herpesvirus 6
guuuccugcccag

SEQ ID NO: 2038811 - RNA, 19 nt, Human herpesvirus 6
ggaacaaaacuuucauccu

SEQ ID NO: 2038812 - RNA, 21 nt, Human herpesvirus 6
cauccaccuucccucccaccc

SEQ ID NO: 2038813 - RNA, 14 nt, Human herpesvirus 6
cgcauguugcaguu

SEQ ID NO: 2038814 - RNA, 18 nt, Human herpesvirus 6
auauaaagagaccaauuu

SEQ ID NO: 2038815 - RNA, 16 nt, Human herpesvirus 6
aaccaaguguuuuaug

SEQ ID NO: 2038816 - RNA, 23 nt, Human herpesvirus 6
aaucuuauucaaaaauguugcau

SEQ ID NO: 2038817 - RNA, 23 nt, Human herpesvirus 6
aauaaaauuuacaguguuuccaa

SEQ ID NO: 2038818 - RNA, 17 nt, Human herpesvirus 6
gaacuagaaaaacaacg

SEQ ID NO: 2038819 - RNA, 19 nt, Human herpesvirus 6
uugguaucaguggauagga

SEQ ID NO: 2038820 - RNA, 19 nt, Human herpesvirus 6
cgucuccugggagcucucc

SEQ ID NO: 2038821 - RNA, 18 nt, Human herpesvirus 6
aaaaccuuauacagaugu

SEQ ID NO: 2038822 - RNA, 14 nt, Human herpesvirus 6
agguguuuccugcc

SEQ ID NO: 2038823 - RNA, 23 nt, Human herpesvirus 6
auuaaaguuuucauaaaaacgac

SEQ ID NO: 2038824 - RNA, 22 nt, Human herpesvirus 6
agguuuuauucguucagaaugu

SEQ ID NO: 2038825 - RNA, 20 nt, Human herpesvirus 6
agaaagagauaaaaagagag

SEQ ID NO: 2038826 - RNA, 20 nt, Human herpesvirus 6
uuccaagacauguacaucaa

SEQ ID NO: 2038827 - RNA, 15 nt, Human herpesvirus 6
agaacaucucagauc

SEQ ID NO: 2038828 - RNA, 22 nt, Human herpesvirus 6
acgccuccacaugacaccucaa

SEQ ID NO: 2038829 - RNA, 12 nt, Human herpesvirus 6
cuucccucuucc

SEQ ID NO: 2038830 - RNA, 18 nt, Human herpesvirus 6
aacuaaaagucagugggu

SEQ ID NO: 2038831 - RNA, 14 nt, Human herpesvirus 6
gaagauauggauga

SEQ ID NO: 2038832 - RNA, 15 nt, Human herpesvirus 6
aguaaauauuucuaa

SEQ ID NO: 2038833 - RNA, 16 nt, Human herpesvirus 6
caaaugcaguaaauga

SEQ ID NO: 2038834 - RNA, 15 nt, Human herpesvirus 6
gagacagcggacagc

SEQ ID NO: 2038835 - RNA, 14 nt, Human herpesvirus 6
uggugguaauuuag

SEQ ID NO: 2038836 - RNA, 23 nt, Human herpesvirus 6
gauuucacuuaagccagcuuucg

SEQ ID NO: 2038837 - RNA, 14 nt, Human herpesvirus 6
uaguuuuugcuuac

SEQ ID NO: 2038838 - RNA, 18 nt, Human herpesvirus 6
cgaugucggaaucuacug

SEQ ID NO: 2038839 - RNA, 12 nt, Human herpesvirus 6
uguuucugauuu

SEQ ID NO: 2038840 - RNA, 13 nt, Human herpesvirus 6
gaaaaaaaaucua

SEQ ID NO: 2038841 - RNA, 15 nt, Human herpesvirus 6
uguaucugugaacaa

SEQ ID NO: 2038842 - RNA, 16 nt, Human herpesvirus 6
aaugagauagaaguua

SEQ ID NO: 2038843 - RNA, 15 nt, Human herpesvirus 6
aaaagggaagauuug

SEQ ID NO: 2038844 - RNA, 20 nt, Human herpesvirus 6
auucuaaauacgauauuaac

SEQ ID NO: 2038845 - RNA, 22 nt, Human herpesvirus 6
agaccaauuuaugucauuucau

SEQ ID NO: 2038846 - RNA, 11 nt, Human herpesvirus 6
aaaaacauuuc

SEQ ID NO: 2038847 - RNA, 18 nt, Human herpesvirus 6
aagacucagcgacucccg

SEQ ID NO: 2038848 - RNA, 19 nt, Human herpesvirus 6
acguaauagccaaacaagg

SEQ ID NO: 2038849 - RNA, 23 nt, Human herpesvirus 6
uuacaauguucaauuacucaaca

SEQ ID NO: 2038850 - RNA, 16 nt, Human herpesvirus 6
acaaaacaaucuaucu

SEQ ID NO: 2038851 - RNA, 17 nt, Human herpesvirus 6
gguuuggggucuuuccu

SEQ ID NO: 2038852 - RNA, 14 nt, Human herpesvirus 6
guuauauuggauug

SEQ ID NO: 2038853 - RNA, 16 nt, Human herpesvirus 6
cuuagacgaaaauugu

SEQ ID NO: 2038854 - RNA, 20 nt, Human herpesvirus 6
gaaaauugaugauguucuuc

SEQ ID NO: 2038855 - RNA, 13 nt, Human herpesvirus 6
gaagaggaagaag

SEQ ID NO: 2038856 - RNA, 17 nt, Human herpesvirus 6
agaucuggugaauguuu

SEQ ID NO: 2038857 - RNA, 22 nt, Human herpesvirus 6
cagucuucaauaaaaacucaau

SEQ ID NO: 2038858 - RNA, 11 nt, Human herpesvirus 6
guauuguaaaa

SEQ ID NO: 2038859 - RNA, 22 nt, Human herpesvirus 6
gacgaaagcaguuuuacaucau

SEQ ID NO: 2038860 - RNA, 18 nt, Human herpesvirus 6
ugcagacugcuucuuaga

SEQ ID NO: 2038861 - RNA, 13 nt, Human herpesvirus 6
ugcaaccaauaaa

SEQ ID NO: 2038862 - RNA, 19 nt, Human herpesvirus 6
auucugcauuuauaucaaa

SEQ ID NO: 2038863 - RNA, 17 nt, Human herpesvirus 6
ugcagacuucacuuugg

SEQ ID NO: 2038864 - RNA, 14 nt, Human herpesvirus 6
agucgcgaagugcu

SEQ ID NO: 2038865 - RNA, 20 nt, Human herpesvirus 6
caaucauguuuauugucaaa

SEQ ID NO: 2038866 - RNA, 21 nt, Human herpesvirus 6
accuagcagcaaauaaauaca

SEQ ID NO: 2038867 - RNA, 22 nt, Human herpesvirus 6
uccugagaguaaauauuucuaa

SEQ ID NO: 2038868 - RNA, 16 nt, Human herpesvirus 6
agcccccagcugaaau

SEQ ID NO: 2038869 - RNA, 14 nt, Human herpesvirus 6
uugggacauguaua

SEQ ID NO: 2038870 - RNA, 16 nt, Human herpesvirus 6
gacucgccgaugaaac

SEQ ID NO: 2038871 - RNA, 17 nt, Human herpesvirus 6
auguguauuauguaaau

SEQ ID NO: 2038872 - RNA, 13 nt, Human herpesvirus 6
guuucguacugga

SEQ ID NO: 2038873 - RNA, 22 nt, Human herpesvirus 6
gcgcgaggugacggaggcgacg

SEQ ID NO: 2038874 - RNA, 19 nt, Human herpesvirus 6
aaauuacaagguacacaau

SEQ ID NO: 2038875 - RNA, 16 nt, Human herpesvirus 6
auguuuuccuuuauga

SEQ ID NO: 2038876 - RNA, 15 nt, Human herpesvirus 6
auauauuugcauaca

SEQ ID NO: 2038877 - RNA, 23 nt, Human herpesvirus 6
gagcacgcacgacaacacgccag

SEQ ID NO: 2038878 - RNA, 23 nt, Human herpesvirus 6
cauuuccggagauuaaaacauca

SEQ ID NO: 2038879 - RNA, 17 nt, Human herpesvirus 6
ccaccgucugggaccca

SEQ ID NO: 2038880 - RNA, 17 nt, Human herpesvirus 6
aauaaucgauuacaaaa

SEQ ID NO: 2038881 - RNA, 15 nt, Human herpesvirus 6
ccgaucucucucaga

SEQ ID NO: 2038882 - RNA, 20 nt, Human herpesvirus 6
gacaguccauuucuaaagau

SEQ ID NO: 2038883 - RNA, 15 nt, Human herpesvirus 6
caacaucuuaaaaga

SEQ ID NO: 2038884 - RNA, 14 nt, Human herpesvirus 6
ggugaguuugauuu

SEQ ID NO: 2038885 - RNA, 19 nt, Human herpesvirus 6
acuaaaaaaaaaaacacaa

SEQ ID NO: 2038886 - RNA, 13 nt, Human herpesvirus 6
cggauggagcccg

SEQ ID NO: 2038887 - RNA, 16 nt, Human herpesvirus 6
auucaaaacgacaucg

SEQ ID NO: 2038888 - RNA, 16 nt, Human herpesvirus 6
ucaaaccgcagagcaa

SEQ ID NO: 2038889 - RNA, 11 nt, Human herpesvirus 6
ggucagugggu

SEQ ID NO: 2038890 - RNA, 15 nt, Human herpesvirus 6
auaucuugaaaucua

SEQ ID NO: 2038891 - RNA, 19 nt, Human herpesvirus 6
caauuuguguuuauuugcc

SEQ ID NO: 2038892 - RNA, 13 nt, Human herpesvirus 6
gucgcccccccgc

SEQ ID NO: 2038893 - RNA, 17 nt, Human herpesvirus 6
ggaggaggaggaagaga

SEQ ID NO: 2038894 - RNA, 20 nt, Human herpesvirus 6
ucacugucgaaauucaccag

SEQ ID NO: 2038895 - RNA, 19 nt, Human herpesvirus 6
ugcuucucucgaugaaagu

SEQ ID NO: 2038896 - RNA, 19 nt, Human herpesvirus 6
uuguaaauagguaaacugu

SEQ ID NO: 2038897 - RNA, 20 nt, Human herpesvirus 6
aucuccucaacacucucagu

SEQ ID NO: 2038898 - RNA, 21 nt, Human herpesvirus 6
uuagucuauccaugaaacucu

SEQ ID NO: 2038899 - RNA, 11 nt, Human herpesvirus 6
aaauaaaguuu

SEQ ID NO: 2038900 - RNA, 22 nt, Human herpesvirus 6
aaauaauuuuauuaacuguaaa

SEQ ID NO: 2038901 - RNA, 18 nt, Human herpesvirus 6
ggcaaccgcaguuccugu

SEQ ID NO: 2038902 - RNA, 22 nt, Human herpesvirus 6
uuucaguauuaacuaguugcuu

SEQ ID NO: 2038903 - RNA, 21 nt, Human herpesvirus 6
agcuuuucauaugaaaagcug

SEQ ID NO: 2038904 - RNA, 23 nt, Human herpesvirus 6
auuguaauuauuagguaaacuga

SEQ ID NO: 2038905 - RNA, 15 nt, Human herpesvirus 6
ccgcugacaaccucc

SEQ ID NO: 2038906 - RNA, 16 nt, Human herpesvirus 6
uacugagcaaagaaau

SEQ ID NO: 2038907 - RNA, 19 nt, Human herpesvirus 6
aaucauuagcauacagaug

SEQ ID NO: 2038908 - RNA, 14 nt, Human herpesvirus 6
gauucuaauaaaag

SEQ ID NO: 2038909 - RNA, 19 nt, Human herpesvirus 6
acuuucuaagacgagaugu

SEQ ID NO: 2038910 - RNA, 22 nt, Human herpesvirus 6
aucgauucuguaauuuugaaau

SEQ ID NO: 2038911 - RNA, 22 nt, Human herpesvirus 6
ugcauaugcagacugcuucuua

SEQ ID NO: 2038912 - RNA, 16 nt, Human herpesvirus 6
auagauuagaaauuac

SEQ ID NO: 2038913 - RNA, 16 nt, Human herpesvirus 6
cacgcuaaaaacagac

SEQ ID NO: 2038914 - RNA, 22 nt, Human herpesvirus 6
ggaaucaugucggccucugccg

SEQ ID NO: 2038915 - RNA, 16 nt, Human herpesvirus 6
ucuugguuguguauau

SEQ ID NO: 2038916 - RNA, 18 nt, Human herpesvirus 6
augaaccacguuuuucca

SEQ ID NO: 2038917 - RNA, 18 nt, Human herpesvirus 6
aaggaaagacaugcauuu

SEQ ID NO: 2038918 - RNA, 16 nt, Human herpesvirus 6
uuucuuaaggugcuuu

SEQ ID NO: 2038919 - RNA, 16 nt, Human herpesvirus 6
guauaagucuaaugca

SEQ ID NO: 2038920 - RNA, 16 nt, Human herpesvirus 6
uccaauccaauauaac

SEQ ID NO: 2038921 - RNA, 12 nt, Human herpesvirus 6
ggaguugcagug

SEQ ID NO: 2038922 - RNA, 14 nt, Human herpesvirus 6
acgaagaauuauuu

SEQ ID NO: 2038923 - RNA, 22 nt, Human herpesvirus 6
ggccacguccucgugcucugcc

SEQ ID NO: 2038924 - RNA, 17 nt, Human herpesvirus 6
guuaugaaugagauguu

SEQ ID NO: 2038925 - RNA, 20 nt, Human herpesvirus 6
caacacuuuuaccaugcgcc

SEQ ID NO: 2038926 - RNA, 18 nt, Human herpesvirus 6
ggcgucaucgguggcaga

SEQ ID NO: 2038927 - RNA, 22 nt, Human herpesvirus 6
uaacgcaacucuaccuggaaac

SEQ ID NO: 2038928 - RNA, 15 nt, Human herpesvirus 6
gaaaaauucaaucag

SEQ ID NO: 2038929 - RNA, 18 nt, Human herpesvirus 6
cuggcaucugcggcucug

SEQ ID NO: 2038930 - RNA, 16 nt, Human herpesvirus 6
caauuacucaacauua

SEQ ID NO: 2038931 - RNA, 14 nt, Human herpesvirus 6
gauguuuccugaau

SEQ ID NO: 2038932 - RNA, 16 nt, Human herpesvirus 6
gaagaaccugaaaucu

SEQ ID NO: 2038933 - RNA, 19 nt, Human herpesvirus 6
ugaaagacagaggaaauaa

SEQ ID NO: 2038934 - RNA, 17 nt, Human herpesvirus 6
uccaguauugaagaaaa

SEQ ID NO: 2038935 - RNA, 14 nt, Human herpesvirus 6
uccaucuucagaca

SEQ ID NO: 2038936 - RNA, 14 nt, Human herpesvirus 6
ugaaguaaaacuau

SEQ ID NO: 2038937 - RNA, 15 nt, Human herpesvirus 6
agcaucugcugcuuu

SEQ ID NO: 2038938 - RNA, 22 nt, Human herpesvirus 6
uuuaauuacggaacaaggccaa

SEQ ID NO: 2038939 - RNA, 14 nt, Human herpesvirus 6
gaagugaaagcagu

SEQ ID NO: 2038940 - RNA, 12 nt, Human herpesvirus 6
aaagaacaugug

SEQ ID NO: 2038941 - RNA, 17 nt, Human herpesvirus 6
gaaaagguguuguguuu

SEQ ID NO: 2038942 - RNA, 18 nt, Human herpesvirus 6
uuuagaaacauuugcuga

SEQ ID NO: 2038943 - RNA, 20 nt, Human herpesvirus 6
cggggaggaggaggaggaag

SEQ ID NO: 2038944 - RNA, 22 nt, Human herpesvirus 6
cuuucuguuuuaauuaaaaaaa

SEQ ID NO: 2038945 - RNA, 16 nt, Human herpesvirus 6
auuuaaccuuuucacu

SEQ ID NO: 2038946 - RNA, 21 nt, Human herpesvirus 6
cgauguggagcggaaacauga

SEQ ID NO: 2038947 - RNA, 21 nt, Human herpesvirus 6
cgcugggaauugcauccaaag

SEQ ID NO: 2038948 - RNA, 15 nt, Human herpesvirus 6
aggaggaggaagaga

SEQ ID NO: 2038949 - RNA, 23 nt, Human herpesvirus 6
gcgucgcccccccgcagcuccuu

SEQ ID NO: 2038950 - RNA, 12 nt, Human herpesvirus 6
agaucagugggu

SEQ ID NO: 2038951 - RNA, 17 nt, Human herpesvirus 6
cugaaacuccccagaga

SEQ ID NO: 2038952 - RNA, 21 nt, Human herpesvirus 6
cgucauaccgaucccagcuca

SEQ ID NO: 2038953 - RNA, 18 nt, Human herpesvirus 6
ugcaguuuaaggauaaga

SEQ ID NO: 2038954 - RNA, 19 nt, Human herpesvirus 6
uauauuggauuggauggau

SEQ ID NO: 2038955 - RNA, 22 nt, Human herpesvirus 6
uaaauauguugaaucuuauuca

SEQ ID NO: 2038956 - RNA, 19 nt, Human herpesvirus 6
ggaugcaaucgaugugaca

SEQ ID NO: 2038957 - RNA, 13 nt, Human herpesvirus 6
uuuguugguuaaa

SEQ ID NO: 2038958 - RNA, 21 nt, Human herpesvirus 6
acucgugugucuuugugaaga

SEQ ID NO: 2038959 - RNA, 15 nt, Human herpesvirus 6
gccuguuuuagucua

SEQ ID NO: 2038960 - RNA, 14 nt, Human herpesvirus 6
aaaauuugcuaacg

SEQ ID NO: 2038961 - RNA, 16 nt, Human herpesvirus 6
accaacacaccugccu

SEQ ID NO: 2038962 - RNA, 15 nt, Human herpesvirus 6
auguagauaaauaua

SEQ ID NO: 2038963 - RNA, 22 nt, Human herpesvirus 6
caccgucugggacccacggugg

SEQ ID NO: 2038964 - RNA, 22 nt, Human herpesvirus 6
aacaauauagaagacgcaaaga

SEQ ID NO: 2038965 - RNA, 15 nt, Human herpesvirus 6
cgacaaccgccgccg

SEQ ID NO: 2038966 - RNA, 13 nt, Human herpesvirus 6
ucaugucggccuc

SEQ ID NO: 2038967 - RNA, 21 nt, Human herpesvirus 6
uauaugaggcgcuugaaacca

SEQ ID NO: 2038968 - RNA, 22 nt, Human herpesvirus 6
guuauugccgcuucuauauauc

SEQ ID NO: 2038969 - RNA, 23 nt, Human herpesvirus 6
acauccagaaaagcaaacaugca

SEQ ID NO: 2038970 - RNA, 14 nt, Human herpesvirus 6
caacaaccacagca

SEQ ID NO: 2038971 - RNA, 15 nt, Human herpesvirus 6
uucaugauauuccag

SEQ ID NO: 2038972 - RNA, 20 nt, Human herpesvirus 6
agaaaguucuaugucuagau

SEQ ID NO: 2038973 - RNA, 15 nt, Human herpesvirus 6
uaaaugguagcuauu

SEQ ID NO: 2038974 - RNA, 20 nt, Human herpesvirus 6
ccaauuuguguuuauuugcc

SEQ ID NO: 2038975 - RNA, 16 nt, Human herpesvirus 6
cgauuaguuuguguag

SEQ ID NO: 2038976 - RNA, 17 nt, Human herpesvirus 6
cuugacguauccucaga

SEQ ID NO: 2038977 - RNA, 22 nt, Human herpesvirus 6
uaaccauuuugaaaaaacaguu

SEQ ID NO: 2038978 - RNA, 12 nt, Human herpesvirus 6
cucugaaacacu

SEQ ID NO: 2038979 - RNA, 13 nt, Human herpesvirus 6
augugauugucuu

SEQ ID NO: 2038980 - RNA, 16 nt, Human herpesvirus 6
ccucaugaguguuuaa

SEQ ID NO: 2038981 - RNA, 14 nt, Human herpesvirus 6
uacuuucaugauuc

SEQ ID NO: 2038982 - RNA, 20 nt, Human herpesvirus 6
ugaauacgaggaggggagac

SEQ ID NO: 2038983 - RNA, 22 nt, Human herpesvirus 6
acccauuuccggaguugcagug

SEQ ID NO: 2038984 - RNA, 22 nt, Human herpesvirus 6
auggcuaacguacucaaagaaa

SEQ ID NO: 2038985 - RNA, 13 nt, Human herpesvirus 6
uguuuccugccca

SEQ ID NO: 2038986 - RNA, 12 nt, Human herpesvirus 6
gucuuuccugcc

SEQ ID NO: 2038987 - RNA, 15 nt, Human herpesvirus 6
uuaacauccaaaaua

SEQ ID NO: 2038988 - RNA, 22 nt, Human herpesvirus 6
ugggacccacgguggccuggca

SEQ ID NO: 2038989 - RNA, 17 nt, Human herpesvirus 6
cgugccgggaccccgac

SEQ ID NO: 2038990 - RNA, 15 nt, Human herpesvirus 6
uguaaauacccuggg

SEQ ID NO: 2038991 - RNA, 20 nt, Human herpesvirus 6
uuccaggcggcaugaauucc

SEQ ID NO: 2038992 - RNA, 22 nt, Human herpesvirus 6
uaauaaaggauguuugugacuc

SEQ ID NO: 2038993 - RNA, 22 nt, Human herpesvirus 6
uucuaccguagaccguuucuua

SEQ ID NO: 2038994 - RNA, 12 nt, Human herpesvirus 6
auauaaauagug

SEQ ID NO: 2038995 - RNA, 14 nt, Human herpesvirus 6
gcgacuauuugaaa

SEQ ID NO: 2038996 - RNA, 15 nt, Human herpesvirus 6
gucuccauccucgaa

SEQ ID NO: 2038997 - RNA, 16 nt, Human herpesvirus 6
aaguauccuaaauacc

SEQ ID NO: 2038998 - RNA, 16 nt, Human herpesvirus 6
aggucaucaugcugug

SEQ ID NO: 2038999 - RNA, 17 nt, Human herpesvirus 6
ccgguuacggaaaagau

SEQ ID NO: 2039000 - RNA, 16 nt, Human herpesvirus 6
ggguuggaaaucaguu

SEQ ID NO: 2039001 - RNA, 11 nt, Human herpesvirus 6
uccaauccuau

SEQ ID NO: 2039002 - RNA, 12 nt, Human herpesvirus 6
cuuuaaagcagc

SEQ ID NO: 2039003 - RNA, 17 nt, Human herpesvirus 6
acgacuucgacuucaaa

SEQ ID NO: 2039004 - RNA, 22 nt, Human herpesvirus 6
cauccaaauacacuuucauagg

SEQ ID NO: 2039005 - RNA, 18 nt, Human herpesvirus 6
uaaacauuuauaaaagga

SEQ ID NO: 2039006 - RNA, 15 nt, Human herpesvirus 6
auaauuuauggaaau

SEQ ID NO: 2039007 - RNA, 13 nt, Human herpesvirus 6
uucaguaucuguu

SEQ ID NO: 2039008 - RNA, 12 nt, Human herpesvirus 6
aauauagacuuu

SEQ ID NO: 2039009 - RNA, 14 nt, Human herpesvirus 6
cucugcaaaacaaa

SEQ ID NO: 2039010 - RNA, 16 nt, Human herpesvirus 6
agaaaauaaaaaaaag

SEQ ID NO: 2039011 - RNA, 17 nt, Human herpesvirus 6
uggggucuuuccugccc

SEQ ID NO: 2039012 - RNA, 20 nt, Human herpesvirus 6
cccgcucggucucgcacuuc

SEQ ID NO: 2039013 - RNA, 19 nt, Human herpesvirus 6
uaccgugucuuuaaugggu

SEQ ID NO: 2039014 - RNA, 20 nt, Human herpesvirus 6
cuuacaauguuuuugacaaa

SEQ ID NO: 2039015 - RNA, 19 nt, Human herpesvirus 6
ccuuuaacuuuuugcauuc

SEQ ID NO: 2039016 - RNA, 22 nt, Human herpesvirus 6
uuaacuagguagcguacaaguc

SEQ ID NO: 2039017 - RNA, 11 nt, Human herpesvirus 6
cuagaggugcc

SEQ ID NO: 2039018 - RNA, 17 nt, Human herpesvirus 6
aaaauuuuauaaugagu

SEQ ID NO: 2039019 - RNA, 12 nt, Human herpesvirus 6
uucagagugaau

SEQ ID NO: 2039020 - RNA, 16 nt, Human herpesvirus 6
gaccucauauaagaac

SEQ ID NO: 2039021 - RNA, 16 nt, Human herpesvirus 6
uauucucggucuugcu

SEQ ID NO: 2039022 - RNA, 22 nt, Human herpesvirus 6
cauacauuccuuaagaaugaaa

SEQ ID NO: 2039023 - RNA, 21 nt, Human herpesvirus 6
uagccauuuuuuucuuacacg

SEQ ID NO: 2039024 - RNA, 22 nt, Human herpesvirus 6
cugugucuguucaacgucuuca

SEQ ID NO: 2039025 - RNA, 23 nt, Human herpesvirus 6
guagccuaggccuucaccugucu

SEQ ID NO: 2039026 - RNA, 15 nt, Human herpesvirus 6
auguggcaucggcuu

SEQ ID NO: 2039027 - RNA, 16 nt, Human herpesvirus 6
uuuugaagguaucaaa

SEQ ID NO: 2039028 - RNA, 23 nt, Human herpesvirus 6
gcuuauacuguuguaaaauauag

SEQ ID NO: 2039029 - RNA, 20 nt, Human herpesvirus 6
agauuuggcauuaaaggacu

SEQ ID NO: 2039030 - RNA, 15 nt, Human herpesvirus 6
ucucuucgaaauuuu

SEQ ID NO: 2039031 - RNA, 22 nt, Human herpesvirus 6
auuauaaauguagcauacgaca

SEQ ID NO: 2039032 - RNA, 20 nt, Human herpesvirus 6
cuuauuaacgcagcaacaau

SEQ ID NO: 2039033 - RNA, 19 nt, Human herpesvirus 6
gcacgcacgacaacacgcc

SEQ ID NO: 2039034 - RNA, 20 nt, Human herpesvirus 6
caacaggcuugugaaagacc

SEQ ID NO: 2039035 - RNA, 16 nt, Human herpesvirus 6
acgacacgcuggagca

SEQ ID NO: 2039036 - RNA, 22 nt, Human herpesvirus 6
uguaaagaaguaucgagauuuu

SEQ ID NO: 2039037 - RNA, 14 nt, Human herpesvirus 6
ccugccuacacugc

SEQ ID NO: 2039038 - RNA, 17 nt, Human herpesvirus 6
cacgugaaauaaaguuu

SEQ ID NO: 2039039 - RNA, 20 nt, Human herpesvirus 6
ugauuaacaaauuacaauca

SEQ ID NO: 2039040 - RNA, 10 nt, Human herpesvirus 6
ucuacaaaaa

SEQ ID NO: 2039041 - RNA, 22 nt, Human herpesvirus 6
uucaaaagaguuacuagcaguu

SEQ ID NO: 2039042 - RNA, 11 nt, Human herpesvirus 6
cgauguuuuca

SEQ ID NO: 2039043 - RNA, 20 nt, Human herpesvirus 6
gucuucaauaaaaacucaau

SEQ ID NO: 2039044 - RNA, 18 nt, Human herpesvirus 6
uggccuucgguacaguga

SEQ ID NO: 2039045 - RNA, 15 nt, Human herpesvirus 6
acacaaaaaauugac

SEQ ID NO: 2039046 - RNA, 13 nt, Human herpesvirus 6
ucuauggaucuga

SEQ ID NO: 2039047 - RNA, 12 nt, Human herpesvirus 6
aaguauguacaa

SEQ ID NO: 2039048 - RNA, 14 nt, Human herpesvirus 6
gcaguggacggcgg

SEQ ID NO: 2039049 - RNA, 18 nt, Human herpesvirus 6
ucuucguacguacuacag

SEQ ID NO: 2039050 - RNA, 20 nt, Human herpesvirus 6
caaguguuuggugugacauu

SEQ ID NO: 2039051 - RNA, 22 nt, Human herpesvirus 6
cagauggugcgaucgagcaaca

SEQ ID NO: 2039052 - RNA, 16 nt, Human herpesvirus 6
uacuauaaacaauugu

SEQ ID NO: 2039053 - RNA, 20 nt, Human herpesvirus 6
uaaaugaauguguucacaga

SEQ ID NO: 2039054 - RNA, 17 nt, Human herpesvirus 6
gcuagauaauuaugcau

SEQ ID NO: 2039055 - RNA, 11 nt, Human herpesvirus 6
ccaaaggaaac

SEQ ID NO: 2039056 - RNA, 15 nt, Human herpesvirus 6
aacauagaaaaauga

SEQ ID NO: 2039057 - RNA, 10 nt, Human herpesvirus 6
cuuuccugca

SEQ ID NO: 2039058 - RNA, 22 nt, Human herpesvirus 6
uauuccccauuccuagaggugc

SEQ ID NO: 2039059 - RNA, 22 nt, Human herpesvirus 6
gguuucuugauuagagacgcac

SEQ ID NO: 2039060 - RNA, 22 nt, Human herpesvirus 6
uuaacaucgugauaacaaugca

SEQ ID NO: 2039061 - RNA, 13 nt, Human herpesvirus 6
augugucggccgu

SEQ ID NO: 2039062 - RNA, 18 nt, Human herpesvirus 6
ugcgucgcccccccgcag

SEQ ID NO: 2039063 - RNA, 15 nt, Human herpesvirus 6
uuagaacaauuauca

SEQ ID NO: 2039064 - RNA, 19 nt, Human herpesvirus 6
uacuuacaucgauccaaaa

SEQ ID NO: 2039065 - RNA, 13 nt, Human herpesvirus 6
aauaauugcauuc

SEQ ID NO: 2039066 - RNA, 18 nt, Human herpesvirus 6
aguugggacuuggaaacg

SEQ ID NO: 2039067 - RNA, 17 nt, Human herpesvirus 6
gcgaaugcucaaccuaa

SEQ ID NO: 2039068 - RNA, 23 nt, Human herpesvirus 6
cacccauuuccggaguugcagug

SEQ ID NO: 2039069 - RNA, 16 nt, Human herpesvirus 6
gucucuguucugccac

SEQ ID NO: 2039070 - RNA, 16 nt, Human herpesvirus 6
uguuagaucacguuca

SEQ ID NO: 2039071 - RNA, 17 nt, Human herpesvirus 6
gacgccuugauguuucc

SEQ ID NO: 2039072 - RNA, 18 nt, Human herpesvirus 6
ggacccacgguggccugg

SEQ ID NO: 2039073 - RNA, 20 nt, Human herpesvirus 6
cuauuaaacuaacauagcga

SEQ ID NO: 2039074 - RNA, 18 nt, Human herpesvirus 6
aaaguuucggaaaaugua

SEQ ID NO: 2039075 - RNA, 16 nt, Human herpesvirus 6
uaaaggucagugggug

SEQ ID NO: 2039076 - RNA, 16 nt, Human herpesvirus 6
agcauauuuuggcaaa

SEQ ID NO: 2039077 - RNA, 16 nt, Human herpesvirus 6
guguuuacauauacau

SEQ ID NO: 2039078 - RNA, 23 nt, Human herpesvirus 6
ugauaccgaaaucuccugagaag

SEQ ID NO: 2039079 - RNA, 20 nt, Human herpesvirus 6
uauuguguaacucuuuuugu

SEQ ID NO: 2039080 - RNA, 14 nt, Human herpesvirus 6
cgagcggugugcag

SEQ ID NO: 2039081 - RNA, 16 nt, Human herpesvirus 6
uuuccugcacaggcga

SEQ ID NO: 2039082 - RNA, 18 nt, Human herpesvirus 6
ugggggucuuuccugcac

SEQ ID NO: 2039083 - RNA, 17 nt, Human herpesvirus 6
auaucguggaauggcug

SEQ ID NO: 2039084 - RNA, 13 nt, Human herpesvirus 6
auuccuucaaugu

SEQ ID NO: 2039085 - RNA, 21 nt, Human herpesvirus 6
ccuggcggacaccgagggcgg

SEQ ID NO: 2039086 - RNA, 17 nt, Human herpesvirus 6
uauuuaugaaaauugcu

SEQ ID NO: 2039087 - RNA, 23 nt, Human herpesvirus 6
uagcgaaugaauuuacuguuuua

SEQ ID NO: 2039088 - RNA, 23 nt, Human herpesvirus 6
agaucuauuucucguucuccguu

SEQ ID NO: 2039089 - RNA, 19 nt, Human herpesvirus 6
agcagaaguuuacauagaa

SEQ ID NO: 2039090 - RNA, 17 nt, Human herpesvirus 6
aucgagaaucuuccuuu

SEQ ID NO: 2039091 - RNA, 12 nt, Human herpesvirus 6
gcuggaaagaga

SEQ ID NO: 2039092 - RNA, 21 nt, Human herpesvirus 6
aaaacauaucgagccaaagaa

SEQ ID NO: 2039093 - RNA, 13 nt, Human herpesvirus 6
cuugcgauacaug

SEQ ID NO: 2039094 - RNA, 12 nt, Human herpesvirus 6
guugaguuucag

SEQ ID NO: 2039095 - RNA, 20 nt, Human herpesvirus 6
agaaugcaacauccugcgug

SEQ ID NO: 2039096 - RNA, 12 nt, Human herpesvirus 6
aauuuuaaaugc

SEQ ID NO: 2039097 - RNA, 13 nt, Human herpesvirus 6
auaagacacugau

SEQ ID NO: 2039098 - RNA, 21 nt, Human herpesvirus 6
agauuuauugcgauucuaaua

SEQ ID NO: 2039099 - RNA, 17 nt, Human herpesvirus 6
guugagguguuuccugc

SEQ ID NO: 2039100 - RNA, 11 nt, Human herpesvirus 6
acgucuucaaa

SEQ ID NO: 2039101 - RNA, 14 nt, Human herpesvirus 6
augacaagaaaggu

SEQ ID NO: 2039102 - RNA, 13 nt, Human herpesvirus 6
uguguauuguaaa

SEQ ID NO: 2039103 - RNA, 20 nt, Human herpesvirus 6
cacguuuuuccaugucuucu

SEQ ID NO: 2039104 - RNA, 13 nt, Human herpesvirus 6
aaaaaaucuaucc

SEQ ID NO: 2039105 - RNA, 14 nt, Human herpesvirus 6
uuuccugcccaggc

SEQ ID NO: 2039106 - RNA, 14 nt, Human herpesvirus 6
acaaguuucaauau

SEQ ID NO: 2039107 - RNA, 17 nt, Human herpesvirus 6
cguccauacaguugugu

SEQ ID NO: 2039108 - RNA, 16 nt, Human herpesvirus 6
aagauuacggcaacau

SEQ ID NO: 2039109 - RNA, 22 nt, Human herpesvirus 6
guuugaguugggacuuggaaac

SEQ ID NO: 2039110 - RNA, 13 nt, Human herpesvirus 6
caugcaaaacaga

SEQ ID NO: 2039111 - RNA, 23 nt, Human herpesvirus 6
ggauaagcagaagaguuuuuuaa

SEQ ID NO: 2039112 - RNA, 21 nt, Human herpesvirus 6
cuuaaagcguuugcaaaacug

SEQ ID NO: 2039113 - RNA, 18 nt, Human herpesvirus 6
ggaagaggaagggauggc

SEQ ID NO: 2039114 - RNA, 20 nt, Human herpesvirus 6
aaaaagagaggaaagaauua

SEQ ID NO: 2039115 - RNA, 12 nt, Human herpesvirus 6
ucaaauccucua

SEQ ID NO: 2039116 - RNA, 19 nt, Human herpesvirus 6
caucagcccccagcugaaa

SEQ ID NO: 2039117 - RNA, 18 nt, Human herpesvirus 6
cuucgauccaauaagaaa

SEQ ID NO: 2039118 - RNA, 14 nt, Human herpesvirus 6
agauaagagaguuu

SEQ ID NO: 2039119 - RNA, 17 nt, Human herpesvirus 6
uugcaauaaaaaaugga

SEQ ID NO: 2039120 - RNA, 16 nt, Human herpesvirus 6
uaaucaucccaauaaa

SEQ ID NO: 2039121 - RNA, 16 nt, Human herpesvirus 6
aaagucaguggguacc

SEQ ID NO: 2039122 - RNA, 23 nt, Human herpesvirus 6
accgcaguuccuguuuuucucgg

SEQ ID NO: 2039123 - RNA, 19 nt, Human herpesvirus 6
cugaccguuguaagaagaa

SEQ ID NO: 2039124 - RNA, 13 nt, Human herpesvirus 6
aaaugcacuguuu

SEQ ID NO: 2039125 - RNA, 13 nt, Human herpesvirus 6
ucuauauccuguc

SEQ ID NO: 2039126 - RNA, 13 nt, Human herpesvirus 6
agagacugguuga

SEQ ID NO: 2039127 - RNA, 16 nt, Human herpesvirus 6
auggcgucgaaguauu

SEQ ID NO: 2039128 - RNA, 20 nt, Human herpesvirus 6
aaagcaucucaaaaaacaua

SEQ ID NO: 2039129 - RNA, 13 nt, Human herpesvirus 6
guguuuguucuuu

SEQ ID NO: 2039130 - RNA, 16 nt, Human herpesvirus 6
cuguucuucucagaaa

SEQ ID NO: 2039131 - RNA, 21 nt, Human herpesvirus 6
gaaaaaaacacaaaucuggau

SEQ ID NO: 2039132 - RNA, 14 nt, Human herpesvirus 6
ucuuacaauguuuu

SEQ ID NO: 2039133 - RNA, 23 nt, Human herpesvirus 6
ccccauacgauauaaaauuuaau

SEQ ID NO: 2039134 - RNA, 16 nt, Human herpesvirus 6
caaguuugugugccuu

SEQ ID NO: 2039135 - RNA, 23 nt, Human herpesvirus 6
gaauuuguggaacaauagacgaa

SEQ ID NO: 2039136 - RNA, 15 nt, Human herpesvirus 6
agucgacaaauuaua

SEQ ID NO: 2039137 - RNA, 16 nt, Human herpesvirus 6
auacaaaauuugaaau

SEQ ID NO: 2039138 - RNA, 15 nt, Human herpesvirus 6
gaaaucguauacguu

SEQ ID NO: 2039139 - RNA, 13 nt, Human herpesvirus 6
uccccacaauaag

SEQ ID NO: 2039140 - RNA, 20 nt, Human herpesvirus 6
gcccgccggcccauccaccu

SEQ ID NO: 2039141 - RNA, 21 nt, Human herpesvirus 6
caagaaugccgugaauugugu

SEQ ID NO: 2039142 - RNA, 20 nt, Human herpesvirus 6
cuuauugaggaaaugcagca

SEQ ID NO: 2039143 - RNA, 14 nt, Human herpesvirus 6
cccuacuacagugg

SEQ ID NO: 2039144 - RNA, 19 nt, Human herpesvirus 6
caucugcaaaaaacaaaug

SEQ ID NO: 2039145 - RNA, 14 nt, Human herpesvirus 6
guucgauugccaaa

SEQ ID NO: 2039146 - RNA, 23 nt, Human herpesvirus 6
ggacagggggaucgacgggcagg

SEQ ID NO: 2039147 - RNA, 20 nt, Human herpesvirus 6
uguaguuuaguaugggugag

SEQ ID NO: 2039148 - RNA, 14 nt, Human herpesvirus 6
cucugcggacggag

SEQ ID NO: 2039149 - RNA, 21 nt, Human herpesvirus 6
acugaccguuguaagaagaaa

SEQ ID NO: 2039150 - RNA, 19 nt, Human herpesvirus 6
gccaugaaacaggaacagu

SEQ ID NO: 2039151 - RNA, 17 nt, Human herpesvirus 6
caucucgugcaaaagcu

SEQ ID NO: 2039152 - RNA, 21 nt, Human herpesvirus 6
cggaaaaauuuuauaaugagu

SEQ ID NO: 2039153 - RNA, 19 nt, Human herpesvirus 6
cccucguccaaaucagacg

SEQ ID NO: 2039154 - RNA, 17 nt, Human herpesvirus 6
gaacaaaguaauaugau

SEQ ID NO: 2039155 - RNA, 19 nt, Human herpesvirus 6
ucaagacuacucuggcuga

SEQ ID NO: 2039156 - RNA, 11 nt, Human herpesvirus 6
uuaaggcauug

SEQ ID NO: 2039157 - RNA, 18 nt, Human herpesvirus 6
caaccugaaacuccccag

SEQ ID NO: 2039158 - RNA, 22 nt, Human herpesvirus 6
caggcgaacgaaaacucuaaaa

SEQ ID NO: 2039159 - RNA, 21 nt, Human herpesvirus 6
ccucgcgcaccgccuccgcca

SEQ ID NO: 2039160 - RNA, 13 nt, Human herpesvirus 6
caccaacacaccu

SEQ ID NO: 2039161 - RNA, 19 nt, Human herpesvirus 6
gucgcccccccgcagcucc

SEQ ID NO: 2039162 - RNA, 21 nt, Human herpesvirus 6
cccacgguggccuggcacggu

SEQ ID NO: 2039163 - RNA, 18 nt, Human herpesvirus 6
ugauuuuguuuucuacgu

SEQ ID NO: 2039164 - RNA, 14 nt, Human herpesvirus 6
cuauguaaacuucu

SEQ ID NO: 2039165 - RNA, 16 nt, Human herpesvirus 6
cgcgcauguugcaguu

SEQ ID NO: 2039166 - RNA, 20 nt, Human herpesvirus 6
uagacgaaaauuguaacuuc

SEQ ID NO: 2039167 - RNA, 14 nt, Human herpesvirus 6
uuucuuacacaaau

SEQ ID NO: 2039168 - RNA, 15 nt, Human herpesvirus 6
auuaucauagacaaa

SEQ ID NO: 2039169 - RNA, 11 nt, Human herpesvirus 6
uaaaaagagag

SEQ ID NO: 2039170 - RNA, 14 nt, Human herpesvirus 6
aggaacgauaugcu

SEQ ID NO: 2039171 - RNA, 23 nt, Human herpesvirus 6
uacccuaagugaaauucaaaaua

SEQ ID NO: 2039172 - RNA, 22 nt, Human herpesvirus 6
ucgaaauucaccagauucacug

SEQ ID NO: 2039173 - RNA, 19 nt, Human herpesvirus 6
cgaguucgccuugucauca

SEQ ID NO: 2039174 - RNA, 18 nt, Human herpesvirus 6
uccgccuguuccacgcgc

SEQ ID NO: 2039175 - RNA, 16 nt, Human herpesvirus 6
auaauggcaugcauua

SEQ ID NO: 2039176 - RNA, 21 nt, Human herpesvirus 6
aacuacugagugcgaccuguc

SEQ ID NO: 2039177 - RNA, 12 nt, Human herpesvirus 6
acuuucauccug

SEQ ID NO: 2039178 - RNA, 14 nt, Human herpesvirus 6
gcccagauguggaa

SEQ ID NO: 2039179 - RNA, 19 nt, Human herpesvirus 6
guaacggcaggcuuuuuaa

SEQ ID NO: 2039180 - RNA, 14 nt, Human herpesvirus 6
cauccaccuucccu

SEQ ID NO: 2039181 - RNA, 23 nt, Human herpesvirus 6
uagcagaauagagagaaagagau

SEQ ID NO: 2039182 - RNA, 15 nt, Human herpesvirus 6
ggugagucacauaga

SEQ ID NO: 2039183 - RNA, 15 nt, Human herpesvirus 6
auaugaugcuguaga

SEQ ID NO: 2039184 - RNA, 22 nt, Human herpesvirus 6
caggcaaccgccgugcuucugg

SEQ ID NO: 2039185 - RNA, 19 nt, Human herpesvirus 6
auguuuuucauaaauggua

SEQ ID NO: 2039186 - RNA, 21 nt, Human herpesvirus 6
gcagaguccggcgcacgcaca

SEQ ID NO: 2039187 - RNA, 14 nt, Human herpesvirus 6
augcaaaucucacu

SEQ ID NO: 2039188 - RNA, 13 nt, Human herpesvirus 6
auaaaguuaauuc

SEQ ID NO: 2039189 - RNA, 18 nt, Human herpesvirus 6
acgcccccaccucgcgca

SEQ ID NO: 2039190 - RNA, 17 nt, Human herpesvirus 6
gacaaguaagauugcag

SEQ ID NO: 2039191 - RNA, 13 nt, Human herpesvirus 6
cagguuugaaaca

SEQ ID NO: 2039192 - RNA, 20 nt, Human herpesvirus 6
cagcggaagugaaagcaguc

SEQ ID NO: 2039193 - RNA, 22 nt, Human herpesvirus 6
ggcggcgaguaacggaaaacga

SEQ ID NO: 2039194 - RNA, 13 nt, Human herpesvirus 6
acgcacuggacau

SEQ ID NO: 2039195 - RNA, 12 nt, Human herpesvirus 6
guuuuuuaagag

SEQ ID NO: 2039196 - RNA, 16 nt, Human herpesvirus 6
cucuuuuuaauuccaa

SEQ ID NO: 2039197 - RNA, 21 nt, Human herpesvirus 6
aaaaucauuaccaguagcaca

SEQ ID NO: 2039198 - RNA, 17 nt, Human herpesvirus 6
aaaccaccggcuaaccc

SEQ ID NO: 2039199 - RNA, 15 nt, Human herpesvirus 6
aaaaucuauugaaga

SEQ ID NO: 2039200 - RNA, 15 nt, Human herpesvirus 6
cauccguuaguaaau

SEQ ID NO: 2039201 - RNA, 12 nt, Human herpesvirus 6
ggagauuucagg

SEQ ID NO: 2039202 - RNA, 18 nt, Human herpesvirus 6
aggcaguaaagccgauga

SEQ ID NO: 2039203 - RNA, 17 nt, Human herpesvirus 6
cgccguccuauucagag

SEQ ID NO: 2039204 - RNA, 22 nt, Human herpesvirus 6
aguccauuucuaccgauaguuu

SEQ ID NO: 2039205 - RNA, 19 nt, Human herpesvirus 6
gauuaugccgucuuauucc

SEQ ID NO: 2039206 - RNA, 19 nt, Human herpesvirus 6
caccgucugggacccacgg

SEQ ID NO: 2039207 - RNA, 17 nt, Human herpesvirus 6
cuaaauuucuacaaaaa

SEQ ID NO: 2039208 - RNA, 21 nt, Human herpesvirus 6
guugcuauagauuagaaauua

SEQ ID NO: 2039209 - RNA, 18 nt, Human herpesvirus 6
gcugaugcgauguggagc

SEQ ID NO: 2039210 - RNA, 15 nt, Human herpesvirus 6
caccgaaguacccau

SEQ ID NO: 2039211 - RNA, 15 nt, Human herpesvirus 6
aacuagaaaaacaac

SEQ ID NO: 2039212 - RNA, 16 nt, Human herpesvirus 6
augauauuccagacaa

SEQ ID NO: 2039213 - RNA, 22 nt, Human herpesvirus 6
auagaucuucggcgcugauucc

SEQ ID NO: 2039214 - RNA, 14 nt, Human herpesvirus 6
aggcugccaugaaa

SEQ ID NO: 2039215 - RNA, 16 nt, Human herpesvirus 6
uccucgugcucugccu

SEQ ID NO: 2039216 - RNA, 15 nt, Human herpesvirus 6
cggcggauggagccc

SEQ ID NO: 2039217 - RNA, 21 nt, Human herpesvirus 6
cuggcggacaccgagggcgga

SEQ ID NO: 2039218 - RNA, 22 nt, Human herpesvirus 6
ugcuaggacuucguucuugaca

SEQ ID NO: 2039219 - RNA, 19 nt, Human herpesvirus 6
ugccauaauuucuguuuug

SEQ ID NO: 2039220 - RNA, 13 nt, Human herpesvirus 6
auuaauuaagugc

SEQ ID NO: 2039221 - RNA, 13 nt, Human herpesvirus 6
aacgcuccucccc

SEQ ID NO: 2039222 - RNA, 19 nt, Human herpesvirus 6
ggauagagagauagauaug

SEQ ID NO: 2039223 - RNA, 15 nt, Human herpesvirus 6
uauguaugaacaggu

SEQ ID NO: 2039224 - RNA, 18 nt, Human herpesvirus 6
aaccucauuaugaauaac

SEQ ID NO: 2039225 - RNA, 17 nt, Human herpesvirus 6
agagacguuguuugacc

SEQ ID NO: 2039226 - RNA, 16 nt, Human herpesvirus 6
caucugccauaucaca

SEQ ID NO: 2039227 - RNA, 21 nt, Human herpesvirus 6
aagagugggaugcauuauacu

SEQ ID NO: 2039228 - RNA, 19 nt, Human herpesvirus 6
cugucuauuaucuggccuc

SEQ ID NO: 2039229 - RNA, 18 nt, Human herpesvirus 6
gacacgcuaaaaacagac

SEQ ID NO: 2039230 - RNA, 23 nt, Human herpesvirus 6
acgaugugugggaaugcugagcu

SEQ ID NO: 2039231 - RNA, 16 nt, Human herpesvirus 6
aaagcagcagaugcuu

SEQ ID NO: 2039232 - RNA, 18 nt, Human herpesvirus 6
aaaguucaguaacauuua

SEQ ID NO: 2039233 - RNA, 21 nt, Human herpesvirus 6
cuguuauaacacaacaaguaa

SEQ ID NO: 2039234 - RNA, 21 nt, Human herpesvirus 6
acagacuccccaccgagaucc

SEQ ID NO: 2039235 - RNA, 16 nt, Human herpesvirus 6
acagaccgucaaaucu

SEQ ID NO: 2039236 - RNA, 16 nt, Human herpesvirus 6
auaaaggucagugggu

SEQ ID NO: 2039237 - RNA, 16 nt, Human herpesvirus 6
agcuaaacaccacuug

SEQ ID NO: 2039238 - RNA, 15 nt, Human herpesvirus 6
uucuauguuauguaa

SEQ ID NO: 2039239 - RNA, 17 nt, Human herpesvirus 6
ccucgcccgauccgccc

SEQ ID NO: 2039240 - RNA, 17 nt, Human herpesvirus 6
acggcgcggagcccaag

SEQ ID NO: 2039241 - RNA, 18 nt, Human herpesvirus 6
cgugccaccgucugggac

SEQ ID NO: 2039242 - RNA, 13 nt, Human herpesvirus 6
guguuauucggag

SEQ ID NO: 2039243 - RNA, 19 nt, Human herpesvirus 6
ugugacuacguuuuguguu

SEQ ID NO: 2039244 - RNA, 13 nt, Human herpesvirus 6
uaucaccuuacaa

SEQ ID NO: 2039245 - RNA, 21 nt, Human herpesvirus 6
accccucccaucccccucccc

SEQ ID NO: 2039246 - RNA, 15 nt, Human herpesvirus 6
auaugcaaacugacu

SEQ ID NO: 2039247 - RNA, 22 nt, Human herpesvirus 6
guuuuucauaaaugguagcuau

SEQ ID NO: 2039248 - RNA, 15 nt, Human herpesvirus 6
ggaauuuugagauuu

SEQ ID NO: 2039249 - RNA, 14 nt, Human herpesvirus 6
caucaaauccucua

SEQ ID NO: 2039250 - RNA, 21 nt, Human herpesvirus 6
gccaucuaucgcgcaccgcug

SEQ ID NO: 2039251 - RNA, 21 nt, Human herpesvirus 6
aauguaacuuuuuguauuaug

SEQ ID NO: 2039252 - RNA, 12 nt, Human herpesvirus 6
cuugacagagau

SEQ ID NO: 2039253 - RNA, 13 nt, Human herpesvirus 6
guaccuguacaag

SEQ ID NO: 2039254 - RNA, 12 nt, Human herpesvirus 6
uggauguuuucg

SEQ ID NO: 2039255 - RNA, 20 nt, Human herpesvirus 6
uguuucuaacagaggguuua

SEQ ID NO: 2039256 - RNA, 17 nt, Human herpesvirus 6
ccuaaauacauucacau

SEQ ID NO: 2039257 - RNA, 18 nt, Human herpesvirus 6
uaaugagaggacagucaa

SEQ ID NO: 2039258 - RNA, 23 nt, Human herpesvirus 6
ccucacuacugaaaccaaagcau

SEQ ID NO: 2039259 - RNA, 20 nt, Human herpesvirus 6
uaccgcgguuuggggucuuu

SEQ ID NO: 2039260 - RNA, 15 nt, Human herpesvirus 6
gauagaggaauugcu

SEQ ID NO: 2039261 - RNA, 12 nt, Human herpesvirus 6
caugaacucuca

SEQ ID NO: 2039262 - RNA, 18 nt, Human herpesvirus 6
uuaaaacaauggaaaagg

SEQ ID NO: 2039263 - RNA, 19 nt, Human herpesvirus 6
uaacaggauucccuucaga

SEQ ID NO: 2039264 - RNA, 20 nt, Human herpesvirus 6
agguccccccucggacagau

SEQ ID NO: 2039265 - RNA, 15 nt, Human herpesvirus 6
uuuacgguuucaggc

SEQ ID NO: 2039266 - RNA, 13 nt, Human herpesvirus 6
acaacaacaauaa

SEQ ID NO: 2039267 - RNA, 16 nt, Human herpesvirus 6
gggucuuuccugcaca

SEQ ID NO: 2039268 - RNA, 16 nt, Human herpesvirus 6
auccaccaaugacacc

SEQ ID NO: 2039269 - RNA, 16 nt, Human herpesvirus 6
ggggagggacccacag

SEQ ID NO: 2039270 - RNA, 21 nt, Human herpesvirus 6
aaauauuaaucguuacaaaau

SEQ ID NO: 2039271 - RNA, 16 nt, Human herpesvirus 6
cggacaccgagggcgg

SEQ ID NO: 2039272 - RNA, 18 nt, Human herpesvirus 6
agugguuuaauggaaacc

SEQ ID NO: 2039273 - RNA, 12 nt, Human herpesvirus 6
cuguuuuaaccg

SEQ ID NO: 2039274 - RNA, 16 nt, Human herpesvirus 6
guauuauguaauacau

SEQ ID NO: 2039275 - RNA, 23 nt, Human herpesvirus 6
auguguauuauguaaauaugcuu

SEQ ID NO: 2039276 - RNA, 20 nt, Human herpesvirus 6
uauuucugguuguguuaauc

SEQ ID NO: 2039277 - RNA, 15 nt, Human herpesvirus 6
acaaugacugggaga

SEQ ID NO: 2039278 - RNA, 19 nt, Human herpesvirus 6
guggauuaugaguaugaaa

SEQ ID NO: 2039279 - RNA, 18 nt, Human herpesvirus 6
ggauucccuucagacauc

SEQ ID NO: 2039280 - RNA, 16 nt, Human herpesvirus 6
cucguaacgcggcaac

SEQ ID NO: 2039281 - RNA, 14 nt, Human herpesvirus 6
aaccaccggcuaac

SEQ ID NO: 2039282 - RNA, 17 nt, Human herpesvirus 6
uagauuuuaauuuugaa

SEQ ID NO: 2039283 - RNA, 18 nt, Human herpesvirus 6
uucgauccaauaagaaac

SEQ ID NO: 2039284 - RNA, 12 nt, Human herpesvirus 6
ggugaaaugaau

SEQ ID NO: 2039285 - RNA, 23 nt, Human herpesvirus 6
cgucugggacccacgguggccug

SEQ ID NO: 2039286 - RNA, 22 nt, Human herpesvirus 6
guuuuagagaaaagugcaaggg

SEQ ID NO: 2039287 - RNA, 13 nt, Human herpesvirus 6
agguugagaauga

SEQ ID NO: 2039288 - RNA, 16 nt, Human herpesvirus 6
aaaaacguuuuuguua

SEQ ID NO: 2039289 - RNA, 20 nt, Human herpesvirus 6
auaacuuuacauuaaacacu

SEQ ID NO: 2039290 - RNA, 22 nt, Human herpesvirus 6
uggggucuuuccugcacaggcg

SEQ ID NO: 2039291 - RNA, 16 nt, Human herpesvirus 6
uuauauucuucuguaa

SEQ ID NO: 2039292 - RNA, 18 nt, Human herpesvirus 6
auccaacgaauacuucuc

SEQ ID NO: 2039293 - RNA, 19 nt, Human herpesvirus 6
cgcuccgcgccccucgccc

SEQ ID NO: 2039294 - RNA, 17 nt, Human herpesvirus 6
guaauauagacauugcu

SEQ ID NO: 2039295 - RNA, 20 nt, Human herpesvirus 6
aaaccaaagcauacucaacc

SEQ ID NO: 2039296 - RNA, 21 nt, Human herpesvirus 6
cgggcccggggacggacaggg

SEQ ID NO: 2039297 - RNA, 15 nt, Human herpesvirus 6
acaaauuuuuaacua

SEQ ID NO: 2039298 - RNA, 12 nt, Human herpesvirus 6
uuaaauauuaau

SEQ ID NO: 2039299 - RNA, 22 nt, Human herpesvirus 6
aauaacucagauucgcaagacu

SEQ ID NO: 2039300 - RNA, 18 nt, Human herpesvirus 6
ggcgcgcauguugcaguu

SEQ ID NO: 2039301 - RNA, 15 nt, Human herpesvirus 6
cgcaguggacggcgg

SEQ ID NO: 2039302 - RNA, 15 nt, Human herpesvirus 6
cccaucgucuccucc

SEQ ID NO: 2039303 - RNA, 17 nt, Human herpesvirus 6
ucaaagaaacaguaaau

SEQ ID NO: 2039304 - RNA, 12 nt, Human herpesvirus 6
cgcccccaccuc

SEQ ID NO: 2039305 - RNA, 21 nt, Human herpesvirus 6
ccaaauguauugaacuuugua

SEQ ID NO: 2039306 - RNA, 17 nt, Human herpesvirus 6
auugucugauauggcaa

SEQ ID NO: 2039307 - RNA, 16 nt, Human herpesvirus 6
cugcuggaugcugaug

SEQ ID NO: 2039308 - RNA, 23 nt, Human herpesvirus 6
uucucggaaaauuaaaagucagu

SEQ ID NO: 2039309 - RNA, 18 nt, Human herpesvirus 6
uugaauguuuaaaguuuu

SEQ ID NO: 2039310 - RNA, 14 nt, Human herpesvirus 6
uccggaguugcagu

SEQ ID NO: 2039311 - RNA, 14 nt, Human herpesvirus 6
gcacauaacugcau

SEQ ID NO: 2039312 - RNA, 14 nt, Human herpesvirus 6
guucaauuacucaa

SEQ ID NO: 2039313 - RNA, 21 nt, Human herpesvirus 6
cauacauucucguaguugcau

SEQ ID NO: 2039314 - RNA, 14 nt, Human herpesvirus 6
accuucccucccac

SEQ ID NO: 2039315 - RNA, 15 nt, Human herpesvirus 6
uucauuuguuuuuua

SEQ ID NO: 2039316 - RNA, 14 nt, Human herpesvirus 6
ucucagcuggcuga

SEQ ID NO: 2039317 - RNA, 13 nt, Human herpesvirus 6
auggaaauucgcu

SEQ ID NO: 2039318 - RNA, 13 nt, Human herpesvirus 6
ugcuguuuucacc

SEQ ID NO: 2039319 - RNA, 22 nt, Human herpesvirus 6
auauuaaucguuacaaaauuga

SEQ ID NO: 2039320 - RNA, 17 nt, Human herpesvirus 6
cguagacaguaaaaugu

SEQ ID NO: 2039321 - RNA, 19 nt, Human herpesvirus 6
ggaaaauauuuccugccca

SEQ ID NO: 2039322 - RNA, 15 nt, Human herpesvirus 6
uaacgaacaaaucuc

SEQ ID NO: 2039323 - RNA, 22 nt, Human herpesvirus 6
ucgcgcgcgcgggcccuccucg

SEQ ID NO: 2039324 - RNA, 21 nt, Human herpesvirus 6
cuaauaaaugucaaagaaaca

SEQ ID NO: 2039325 - RNA, 21 nt, Human herpesvirus 6
gcaaaucucacugucgaaauu

SEQ ID NO: 2039326 - RNA, 19 nt, Human herpesvirus 6
gauagcagaauagagagaa

SEQ ID NO: 2039327 - RNA, 14 nt, Human herpesvirus 6
ugacauucaaaguc

SEQ ID NO: 2039328 - RNA, 16 nt, Human herpesvirus 6
uaagcgugacuuauau

SEQ ID NO: 2039329 - RNA, 19 nt, Human herpesvirus 6
cgaaucucaagcacaaaac

SEQ ID NO: 2039330 - RNA, 20 nt, Human herpesvirus 6
cuaccaugugcggagaaagu

SEQ ID NO: 2039331 - RNA, 23 nt, Human herpesvirus 6
aaggacuaucugagacaguccau

SEQ ID NO: 2039332 - RNA, 20 nt, Human herpesvirus 6
uuuguuucagcguauucaga

SEQ ID NO: 2039333 - RNA, 23 nt, Human herpesvirus 6
cauuugcugaugcgauguggagc

SEQ ID NO: 2039334 - RNA, 14 nt, Human herpesvirus 6
aguguaacgagaau

SEQ ID NO: 2039335 - RNA, 16 nt, Human herpesvirus 6
ggccucccauguaugc

SEQ ID NO: 2039336 - RNA, 15 nt, Human herpesvirus 6
aucgcuuaaagaaaa

SEQ ID NO: 2039337 - RNA, 15 nt, Human herpesvirus 6
auuuugggacaagau

SEQ ID NO: 2039338 - RNA, 19 nt, Human herpesvirus 6
uacauuuuguacaaacuuu

SEQ ID NO: 2039339 - RNA, 23 nt, Human herpesvirus 6
gugggggguuccuccgcgggacc

SEQ ID NO: 2039340 - RNA, 20 nt, Human herpesvirus 6
ccacgcgacagauccgucuc

SEQ ID NO: 2039341 - RNA, 18 nt, Human herpesvirus 6
ucagccugagaacgggca

SEQ ID NO: 2039342 - RNA, 16 nt, Human herpesvirus 6
gccaauagauggugcu

SEQ ID NO: 2039343 - RNA, 17 nt, Human herpesvirus 6
gcagaauagagagaaag

SEQ ID NO: 2039344 - RNA, 20 nt, Human herpesvirus 6
uaaauuauuuugugauuaac

SEQ ID NO: 2039345 - RNA, 23 nt, Human herpesvirus 6
cuacauuaacagacgaggacgga

SEQ ID NO: 2039346 - RNA, 20 nt, Human herpesvirus 6
aaaacuccccucauuuucaa

SEQ ID NO: 2039347 - RNA, 20 nt, Human herpesvirus 6
gccuccccgggugcuccgcc

SEQ ID NO: 2039348 - RNA, 16 nt, Human herpesvirus 6
aaaauagauggcuuug

SEQ ID NO: 2039349 - RNA, 13 nt, Human herpesvirus 6
auugaagaaaauu

SEQ ID NO: 2039350 - RNA, 19 nt, Human herpesvirus 6
gcgaucauaaaacugccaa

SEQ ID NO: 2039351 - RNA, 18 nt, Human herpesvirus 6
acaacgguguggagacac

SEQ ID NO: 2039352 - RNA, 17 nt, Human herpesvirus 6
ccuuguguaucugugaa

SEQ ID NO: 2039353 - RNA, 23 nt, Human herpesvirus 6
cuuggacaccgguaaccucgcuc

SEQ ID NO: 2039354 - RNA, 14 nt, Human herpesvirus 6
cgggaccuggcgga

SEQ ID NO: 2039355 - RNA, 11 nt, Human herpesvirus 6
uuagucaguuu

SEQ ID NO: 2039356 - RNA, 18 nt, Human herpesvirus 6
ugacgccuugauguuucc

SEQ ID NO: 2039357 - RNA, 18 nt, Human herpesvirus 6
uugccgggaugagcuuua

SEQ ID NO: 2039358 - RNA, 20 nt, Human herpesvirus 6
aaucuguaagauuaaaugug

SEQ ID NO: 2039359 - RNA, 21 nt, Human herpesvirus 6
uuauucggaguuuucaagaug

SEQ ID NO: 2039360 - RNA, 17 nt, Human herpesvirus 6
gauaaagaucagugggu

SEQ ID NO: 2039361 - RNA, 15 nt, Human herpesvirus 6
cuucaauaaaaacuc

SEQ ID NO: 2039362 - RNA, 17 nt, Human herpesvirus 6
cauauagucaauguugu

SEQ ID NO: 2039363 - RNA, 21 nt, Human herpesvirus 6
uucuaccguagaccguuucuu

SEQ ID NO: 2039364 - RNA, 15 nt, Human herpesvirus 6
uacaaucaugugcau

SEQ ID NO: 2039365 - RNA, 22 nt, Human herpesvirus 6
acuuuuugccgaagauagcucu

SEQ ID NO: 2039366 - RNA, 18 nt, Human herpesvirus 6
acaaaaucuucuuugugc

SEQ ID NO: 2039367 - RNA, 14 nt, Human herpesvirus 6
ccgcgggaccuggc

SEQ ID NO: 2039368 - RNA, 22 nt, Human herpesvirus 6
aauucaaaaaccgccaagagau

SEQ ID NO: 2039369 - RNA, 20 nt, Human herpesvirus 6
uaacuuuuuguauuauguaa

SEQ ID NO: 2039370 - RNA, 14 nt, Human herpesvirus 6
cuucgguacaguga

SEQ ID NO: 2039371 - RNA, 13 nt, Human herpesvirus 6
uaauaugaacaau

SEQ ID NO: 2039372 - RNA, 13 nt, Human herpesvirus 6
augucgguaaacu

SEQ ID NO: 2039373 - RNA, 14 nt, Human herpesvirus 6
ccgaacuagaaaaa

SEQ ID NO: 2039374 - RNA, 13 nt, Human herpesvirus 6
aaagcgccugccu

SEQ ID NO: 2039375 - RNA, 14 nt, Human herpesvirus 6
acgguuuauaugca

SEQ ID NO: 2039376 - RNA, 11 nt, Human herpesvirus 6
acacacccagc

SEQ ID NO: 2039377 - RNA, 18 nt, Human herpesvirus 6
uuaacgcagcaacaaucc

SEQ ID NO: 2039378 - RNA, 14 nt, Human herpesvirus 6
aucuccaaaagcgc

SEQ ID NO: 2039379 - RNA, 16 nt, Human herpesvirus 6
gauucccuucagacau

SEQ ID NO: 2039380 - RNA, 19 nt, Human herpesvirus 6
ccgaggggacaggggagga

SEQ ID NO: 2039381 - RNA, 22 nt, Human herpesvirus 6
acacgacaaaacaaucagccug

SEQ ID NO: 2039382 - RNA, 20 nt, Human herpesvirus 6
ucgagccaaagaaacagaua

SEQ ID NO: 2039383 - RNA, 15 nt, Human herpesvirus 6
caacacaccugccua

SEQ ID NO: 2039384 - RNA, 18 nt, Human herpesvirus 6
auuagauaagagaguuuc

SEQ ID NO: 2039385 - RNA, 19 nt, Human herpesvirus 6
gugcgaucgagcaacagcg

SEQ ID NO: 2039386 - RNA, 12 nt, Human herpesvirus 6
uucgacagacga

SEQ ID NO: 2039387 - RNA, 17 nt, Human herpesvirus 6
aaucgauuacaaaacaa

SEQ ID NO: 2039388 - RNA, 15 nt, Human herpesvirus 6
ccaacacaccugccu

SEQ ID NO: 2039389 - RNA, 14 nt, Human herpesvirus 6
gaauaacagaugag

SEQ ID NO: 2039390 - RNA, 22 nt, Human herpesvirus 6
uauuuuaagcgugacuuauaua

SEQ ID NO: 2039391 - RNA, 15 nt, Human herpesvirus 6
caacauuuauguuuc

SEQ ID NO: 2039392 - RNA, 13 nt, Human herpesvirus 6
uggggucuuuccu

SEQ ID NO: 2039393 - RNA, 14 nt, Human herpesvirus 6
cuaaugauaaauug

SEQ ID NO: 2039394 - RNA, 19 nt, Human herpesvirus 6
aucacaccaauggucacac

SEQ ID NO: 2039395 - RNA, 12 nt, Human herpesvirus 6
uacacgaacuaa

SEQ ID NO: 2039396 - RNA, 23 nt, Human herpesvirus 6
acaagcacugaauuagaauaauu

SEQ ID NO: 2039397 - RNA, 15 nt, Human herpesvirus 6
acuuccgauaaagau

SEQ ID NO: 2039398 - RNA, 17 nt, Human herpesvirus 6
agaugacaucugcaaaa

SEQ ID NO: 2039399 - RNA, 17 nt, Human herpesvirus 6
gaccccugccgagccug

SEQ ID NO: 2039400 - RNA, 18 nt, Human herpesvirus 6
guuucgccaagaaaaaga

SEQ ID NO: 2039401 - RNA, 15 nt, Human herpesvirus 6
cccaugucuugccuc

SEQ ID NO: 2039402 - RNA, 14 nt, Human herpesvirus 6
cuaaaagcugcuaa

SEQ ID NO: 2039403 - RNA, 21 nt, Human herpesvirus 6
acagagaaggguaugaaacuu

SEQ ID NO: 2039404 - RNA, 22 nt, Human herpesvirus 6
auaacccuucaccgucucugaa

SEQ ID NO: 2039405 - RNA, 21 nt, Human herpesvirus 6
gcaacuacuuuuucaaguaag

SEQ ID NO: 2039406 - RNA, 18 nt, Human herpesvirus 6
cagucuucaauaaaaacu

SEQ ID NO: 2039407 - RNA, 20 nt, Human herpesvirus 6
caccccggggggugggagga

SEQ ID NO: 2039408 - RNA, 12 nt, Human herpesvirus 6
aaucacaaauau

SEQ ID NO: 2039409 - RNA, 16 nt, Human herpesvirus 6
gaggaaaugcagcagu

SEQ ID NO: 2039410 - RNA, 12 nt, Human herpesvirus 6
aucacaaaauuu

SEQ ID NO: 2039411 - RNA, 18 nt, Human herpesvirus 6
cgguccacacgccagucc

SEQ ID NO: 2039412 - RNA, 16 nt, Human herpesvirus 6
augccauaaagaacac

SEQ ID NO: 2039413 - RNA, 22 nt, Human herpesvirus 6
acugcauacguuugccaaagcu

SEQ ID NO: 2039414 - RNA, 15 nt, Human herpesvirus 6
uuauuaacaaugaaa

SEQ ID NO: 2039415 - RNA, 14 nt, Human herpesvirus 6
cccaccuaauaaac

SEQ ID NO: 2039416 - RNA, 20 nt, Human herpesvirus 6
caugagggacucggaaaagg

SEQ ID NO: 2039417 - RNA, 12 nt, Human herpesvirus 6
agagaaggaaaa

SEQ ID NO: 2039418 - RNA, 14 nt, Human herpesvirus 6
auauuccagacaau

SEQ ID NO: 2039419 - RNA, 23 nt, Human herpesvirus 6
cgacuaucaaaauaaaaauuuua

SEQ ID NO: 2039420 - RNA, 16 nt, Human herpesvirus 6
ugaacuacugagugcg

SEQ ID NO: 2039421 - RNA, 19 nt, Human herpesvirus 6
cuggaucggacggugaugg

SEQ ID NO: 2039422 - RNA, 15 nt, Human herpesvirus 6
ccuaaauaccauuuu

SEQ ID NO: 2039423 - RNA, 21 nt, Human herpesvirus 6
acacgcuggagcagcuuccac

SEQ ID NO: 2039424 - RNA, 16 nt, Human herpesvirus 6
uuaauacaaaauuuga

SEQ ID NO: 2039425 - RNA, 21 nt, Human herpesvirus 6
auuccuuaauucuaaauacga

SEQ ID NO: 2039426 - RNA, 19 nt, Human herpesvirus 6
acuauuuuagucacacauu

SEQ ID NO: 2039427 - RNA, 16 nt, Human herpesvirus 6
ccccugccgagccugu

SEQ ID NO: 2039428 - RNA, 20 nt, Human herpesvirus 6
ucacacccauggcgagaaac

SEQ ID NO: 2039429 - RNA, 15 nt, Human herpesvirus 6
cucacuacugaaacc

SEQ ID NO: 2039430 - RNA, 19 nt, Human herpesvirus 6
aacaugcguuguguuacac

SEQ ID NO: 2039431 - RNA, 22 nt, Human herpesvirus 6
agauuuauuagccgugauguuu

SEQ ID NO: 2039432 - RNA, 14 nt, Human herpesvirus 6
ggaggugagacauc

SEQ ID NO: 2039433 - RNA, 15 nt, Human herpesvirus 6
uuaaacaacacagca

SEQ ID NO: 2039434 - RNA, 17 nt, Human herpesvirus 6
uaguuuucacacguuau

SEQ ID NO: 2039435 - RNA, 13 nt, Human herpesvirus 6
gaaaacccagcgg

SEQ ID NO: 2039436 - RNA, 22 nt, Human herpesvirus 6
cauguuuucuccucaacuaaac

SEQ ID NO: 2039437 - RNA, 15 nt, Human herpesvirus 6
auucacauaagacuu

SEQ ID NO: 2039438 - RNA, 17 nt, Human herpesvirus 6
auuuacaaaacaaauau

SEQ ID NO: 2039439 - RNA, 15 nt, Human herpesvirus 6
aaauagcagcaauca

SEQ ID NO: 2039440 - RNA, 16 nt, Human herpesvirus 6
acaguuuccgcugccg

SEQ ID NO: 2039441 - RNA, 23 nt, Human herpesvirus 6
gccgcugcagaaaaacggcagcu

SEQ ID NO: 2039442 - RNA, 22 nt, Human herpesvirus 6
cuucauacccgaaguucucuca

SEQ ID NO: 2039443 - RNA, 12 nt, Human herpesvirus 6
cuaugcagcgcc

SEQ ID NO: 2039444 - RNA, 23 nt, Human herpesvirus 6
cggugccaaaggaaaccaccggc

SEQ ID NO: 2039445 - RNA, 14 nt, Human herpesvirus 6
gauuacaaaacaau

SEQ ID NO: 2039446 - RNA, 23 nt, Human herpesvirus 6
aggacuaucugagacaguccauu

SEQ ID NO: 2039447 - RNA, 16 nt, Human herpesvirus 6
agcagcagaguccggc

SEQ ID NO: 2039448 - RNA, 13 nt, Human herpesvirus 6
uucugaccagcaa

SEQ ID NO: 2039449 - RNA, 23 nt, Human herpesvirus 6
uucggcagaugcgcuauuguacc

SEQ ID NO: 2039450 - RNA, 17 nt, Human herpesvirus 6
auggaugugcacuuucu

SEQ ID NO: 2039451 - RNA, 20 nt, Human herpesvirus 6
gcgccugccuacacugcgaa

SEQ ID NO: 2039452 - RNA, 21 nt, Human herpesvirus 6
ugaaccaagucaacaacguca

SEQ ID NO: 2039453 - RNA, 14 nt, Human herpesvirus 6
cguuuuccauguga

SEQ ID NO: 2039454 - RNA, 21 nt, Human herpesvirus 6
aaaaacacuagccuacuauga

SEQ ID NO: 2039455 - RNA, 17 nt, Human herpesvirus 6
aagaugagcagcuuugg

SEQ ID NO: 2039456 - RNA, 18 nt, Human herpesvirus 6
acugcauacguuugccaa

SEQ ID NO: 2039457 - RNA, 19 nt, Human herpesvirus 6
caaggaaugugcagagugc

SEQ ID NO: 2039458 - RNA, 16 nt, Human herpesvirus 6
gagagacgcaccacgg

SEQ ID NO: 2039459 - RNA, 14 nt, Human herpesvirus 6
accucuaaaacaag

SEQ ID NO: 2039460 - RNA, 22 nt, Human herpesvirus 6
uuuaucccccguacaagcuuaa

SEQ ID NO: 2039461 - RNA, 18 nt, Human herpesvirus 6
cgcgguuggggucuuucc

SEQ ID NO: 2039462 - RNA, 16 nt, Human herpesvirus 6
aaguuuacauagaaau

SEQ ID NO: 2039463 - RNA, 21 nt, Human herpesvirus 6
guugagguguuuccugcccag

SEQ ID NO: 2039464 - RNA, 18 nt, Human herpesvirus 6
uauuaacacguacauaau

SEQ ID NO: 2039465 - RNA, 24 nt, Human herpesvirus 6
ugauccugacugguauccaauuaa

SEQ ID NO: 2039466 - RNA, 16 nt, Human herpesvirus 6
aacgaacaaaucucca

SEQ ID NO: 2039467 - RNA, 15 nt, Human herpesvirus 6
uucgcagaggacagu

SEQ ID NO: 2039468 - RNA, 18 nt, Human herpesvirus 6
guuucauuucaucuuguu

SEQ ID NO: 2039469 - RNA, 15 nt, Human herpesvirus 6
ugccaaaggaaacca

SEQ ID NO: 2039470 - RNA, 14 nt, Human herpesvirus 6
uugcaaccaauaaa

SEQ ID NO: 2039471 - RNA, 11 nt, Human herpesvirus 6
ucucugcaaaa

SEQ ID NO: 2039472 - RNA, 17 nt, Human herpesvirus 6
uacauauagucaauguu

SEQ ID NO: 2039473 - RNA, 13 nt, Human herpesvirus 6
uaacucuuuuugu

SEQ ID NO: 2039474 - RNA, 16 nt, Human herpesvirus 6
ucgguuaaaacaguaa

SEQ ID NO: 2039475 - RNA, 21 nt, Human herpesvirus 6
uuucguauguuuggauaauaa

SEQ ID NO: 2039476 - RNA, 14 nt, Human herpesvirus 6
gccgagccugugga

SEQ ID NO: 2039477 - RNA, 14 nt, Human herpesvirus 6
aauaaaaaauucuu

SEQ ID NO: 2039478 - RNA, 17 nt, Human herpesvirus 6
guaaaucaucaacguaa

SEQ ID NO: 2039479 - RNA, 14 nt, Human herpesvirus 6
guuccacgcgcgug

SEQ ID NO: 2039480 - RNA, 17 nt, Human herpesvirus 6
auacguuugccaaagcu

SEQ ID NO: 2039481 - RNA, 15 nt, Human herpesvirus 6
agggggggucucugu

SEQ ID NO: 2039482 - RNA, 20 nt, Human herpesvirus 6
cuuuuacaauacacagaaaa

SEQ ID NO: 2039483 - RNA, 15 nt, Human herpesvirus 6
ggaacgauuugcagu

SEQ ID NO: 2039484 - RNA, 16 nt, Human herpesvirus 6
acaccaucuucagcuc

SEQ ID NO: 2039485 - RNA, 16 nt, Human herpesvirus 6
uuguguuguuguauau

SEQ ID NO: 2039486 - RNA, 16 nt, Human herpesvirus 6
uacaagguacacaaua

SEQ ID NO: 2039487 - RNA, 20 nt, Human herpesvirus 6
uccaggucuuauauuucaga

SEQ ID NO: 2039488 - RNA, 20 nt, Human herpesvirus 6
agaucuggugaauguuucug

SEQ ID NO: 2039489 - RNA, 22 nt, Human herpesvirus 6
gaaacggcgcggagcccaagaa

SEQ ID NO: 2039490 - RNA, 13 nt, Human herpesvirus 6
acgcugaaaucau

SEQ ID NO: 2039491 - RNA, 22 nt, Human herpesvirus 6
acugccgguaacgcugucguua

SEQ ID NO: 2039492 - RNA, 13 nt, Human herpesvirus 6
ccaucuguucaau

SEQ ID NO: 2039493 - RNA, 20 nt, Human herpesvirus 6
acaaacgccuccacaugaca

SEQ ID NO: 2039494 - RNA, 16 nt, Human herpesvirus 6
ucugaauuuaaugcaa

SEQ ID NO: 2039495 - RNA, 17 nt, Human herpesvirus 6
ggucuuuccugcacagg

SEQ ID NO: 2039496 - RNA, 20 nt, Human herpesvirus 6
uggaugcugaugaauuuaug

SEQ ID NO: 2039497 - RNA, 13 nt, Human herpesvirus 6
ggauccgcuccgc

SEQ ID NO: 2039498 - RNA, 19 nt, Human herpesvirus 6
uuuacagucuuuaaaugag

SEQ ID NO: 2039499 - RNA, 23 nt, Human herpesvirus 6
aauggaguaaauuaaaguuuacu

SEQ ID NO: 2039500 - RNA, 21 nt, Human herpesvirus 6
ugcaauuuaaaagaauuuuug

SEQ ID NO: 2039501 - RNA, 20 nt, Human herpesvirus 6
uaauuacauauagucaaugu

SEQ ID NO: 2039502 - RNA, 13 nt, Human herpesvirus 6
gcauguugcaguu

SEQ ID NO: 2039503 - RNA, 20 nt, Human herpesvirus 6
cgccuguuccacgcgcgugu

SEQ ID NO: 2039504 - RNA, 22 nt, Human herpesvirus 6
gucuuuaccauuugacuccaac

SEQ ID NO: 2039505 - RNA, 16 nt, Human herpesvirus 6
uuucaagauggaccuc

SEQ ID NO: 2039506 - RNA, 18 nt, Human herpesvirus 6
gacaaaucaucacuacgu

SEQ ID NO: 2039507 - RNA, 20 nt, Human herpesvirus 6
caaaacaccgguaagcaucu

SEQ ID NO: 2039508 - RNA, 15 nt, Human herpesvirus 6
uaucauuaaauuguu

SEQ ID NO: 2039509 - RNA, 12 nt, Human herpesvirus 6
ugucuuagugua

SEQ ID NO: 2039510 - RNA, 18 nt, Human herpesvirus 6
auguuucauccaaauaca

SEQ ID NO: 2039511 - RNA, 17 nt, Human herpesvirus 6
uuccacguacuauuuuu

SEQ ID NO: 2039512 - RNA, 19 nt, Human herpesvirus 6
uaggauuacacuuucuugu

SEQ ID NO: 2039513 - RNA, 12 nt, Human herpesvirus 6
ucacugucuauu

SEQ ID NO: 2039514 - RNA, 20 nt, Human herpesvirus 6
aagcgucaacggcuucaaga

SEQ ID NO: 2039515 - RNA, 22 nt, Human herpesvirus 6
ggaaaacuaaaagucagugggu

SEQ ID NO: 2039516 - RNA, 13 nt, Human herpesvirus 6
guuaaugcugcug

SEQ ID NO: 2039517 - RNA, 24 nt, Human herpesvirus 6
ugcagacuucacuuugggcgaugg

SEQ ID NO: 2039518 - RNA, 15 nt, Human herpesvirus 6
auugacuacagcugc

SEQ ID NO: 2039519 - RNA, 14 nt, Human herpesvirus 6
cacuguuugaaacu

SEQ ID NO: 2039520 - RNA, 18 nt, Human herpesvirus 6
auaccaacgugagggaaa

SEQ ID NO: 2039521 - RNA, 12 nt, Human herpesvirus 6
uuuugaaaaggu

SEQ ID NO: 2039522 - RNA, 19 nt, Human herpesvirus 6
aauuacauaagcaaaugua

SEQ ID NO: 2039523 - RNA, 22 nt, Human herpesvirus 6
uccccuuggcucgugauccuac

SEQ ID NO: 2039524 - RNA, 21 nt, Human herpesvirus 6
ugaacuuuuuucggauuuuga

SEQ ID NO: 2039525 - RNA, 13 nt, Human herpesvirus 6
uuuuucauaaaug

SEQ ID NO: 2039526 - RNA, 19 nt, Human herpesvirus 6
cuuuuggaugcagcguugg

SEQ ID NO: 2039527 - RNA, 14 nt, Human herpesvirus 6
auuaaaguuuacug

SEQ ID NO: 2039528 - RNA, 16 nt, Human herpesvirus 6
auuuuaauuuugaaau

SEQ ID NO: 2039529 - RNA, 20 nt, Human herpesvirus 6
cccaggcgaacgagaacucu

SEQ ID NO: 2039530 - RNA, 22 nt, Human herpesvirus 6
ugaaugcauaccgccuccgcag

SEQ ID NO: 2039531 - RNA, 16 nt, Human herpesvirus 6
ucacauguucuuuauu

SEQ ID NO: 2039532 - RNA, 16 nt, Human herpesvirus 6
ucucggaaaauuaaag

SEQ ID NO: 2039533 - RNA, 21 nt, Human herpesvirus 6
cuuuauguacccuaagugaaa

SEQ ID NO: 2039534 - RNA, 13 nt, Human herpesvirus 6
ccuccgccacugc

SEQ ID NO: 2039535 - RNA, 23 nt, Human herpesvirus 6
ugacuguguguugaauguuacag

SEQ ID NO: 2039536 - RNA, 19 nt, Human herpesvirus 6
uucuuacaauguuuuugac

SEQ ID NO: 2039537 - RNA, 16 nt, Human herpesvirus 6
ucgggaacauagagaa

SEQ ID NO: 2039538 - RNA, 22 nt, Human herpesvirus 6
ggaaaauuaaaagucagugggu

SEQ ID NO: 2039539 - RNA, 20 nt, Human herpesvirus 6
aaaacuaauucggaacauug

SEQ ID NO: 2039540 - RNA, 15 nt, Human herpesvirus 6
uugauuuacaaggca

SEQ ID NO: 2039541 - RNA, 14 nt, Human herpesvirus 6
aauuucuuuugagg

SEQ ID NO: 2039542 - RNA, 22 nt, Human herpesvirus 6
ugacucuucucuaaaaacuaaa

SEQ ID NO: 2039543 - RNA, 14 nt, Human herpesvirus 6
aagcaucugcugcu

SEQ ID NO: 2039544 - RNA, 19 nt, Human herpesvirus 6
uuuguuuucuacguagaua

SEQ ID NO: 2039545 - RNA, 13 nt, Human herpesvirus 6
agugcuuuaucua

SEQ ID NO: 2039546 - RNA, 18 nt, Human herpesvirus 6
uaucaaacuuuuuuugaa

SEQ ID NO: 2039547 - RNA, 17 nt, Human herpesvirus 6
aaaagcuggaaaacuau

SEQ ID NO: 2039548 - RNA, 22 nt, Human herpesvirus 6
cggaaaaaaaaucuauccgcua

SEQ ID NO: 2039549 - RNA, 17 nt, Human herpesvirus 6
ucgaguaauuguggauu

SEQ ID NO: 2039550 - RNA, 15 nt, Human herpesvirus 6
uucucuaaaaacuaa

SEQ ID NO: 2039551 - RNA, 16 nt, Human herpesvirus 6
uucuuuauuaaauguu

SEQ ID NO: 2039552 - RNA, 23 nt, Human herpesvirus 6
aauauuuccauaaguuaauucca

SEQ ID NO: 2039553 - RNA, 15 nt, Human herpesvirus 6
acaugaacauugaaa

SEQ ID NO: 2039554 - RNA, 17 nt, Human herpesvirus 6
aacccuaacccuaaccc

SEQ ID NO: 2039555 - RNA, 11 nt, Human herpesvirus 6
agauuuacaga

SEQ ID NO: 2039556 - RNA, 21 nt, Human herpesvirus 6
cuaagucuuugggaacaugua

SEQ ID NO: 2039557 - RNA, 17 nt, Human herpesvirus 6
uccccgggugcuccgcc

SEQ ID NO: 2039558 - RNA, 14 nt, Human herpesvirus 6
accuaauaaacugu

SEQ ID NO: 2039559 - RNA, 23 nt, Human herpesvirus 6
cuugauaaucugaucgaaauacu

SEQ ID NO: 2039560 - RNA, 21 nt, Human herpesvirus 6
uccucaaacuuuuagagacuu

SEQ ID NO: 2039561 - RNA, 21 nt, Human herpesvirus 6
ugaguaauugaacauuguaaa

SEQ ID NO: 2039562 - RNA, 15 nt, Human herpesvirus 6
augacgcggaaucua

SEQ ID NO: 2039563 - RNA, 15 nt, Human herpesvirus 6
cacuguaccuuuagu

SEQ ID NO: 2039564 - RNA, 21 nt, Human herpesvirus 6
aacaugagggacucggaaaag

SEQ ID NO: 2039565 - RNA, 15 nt, Human herpesvirus 6
auacaucguuuguug

SEQ ID NO: 2039566 - RNA, 14 nt, Human herpesvirus 6
uauaucuaaaguca

SEQ ID NO: 2039567 - RNA, 23 nt, Human herpesvirus 6
ugggggucuuuccugcacaggcg

SEQ ID NO: 2039568 - RNA, 16 nt, Human herpesvirus 6
ucgccaagaaaaagaa

SEQ ID NO: 2039569 - RNA, 15 nt, Human herpesvirus 6
gaagauaauaaaaca

SEQ ID NO: 2039570 - RNA, 22 nt, Human herpesvirus 6
cuaaaaucaaaaaaauuuugau

SEQ ID NO: 2039571 - RNA, 18 nt, Human herpesvirus 6
uccaugcaacacaacaaa

SEQ ID NO: 2039572 - RNA, 19 nt, Human herpesvirus 6
uuagacuuggugaugauga

SEQ ID NO: 2039573 - RNA, 22 nt, Human herpesvirus 6
cacgauguuaacauaaaacaac

SEQ ID NO: 2039574 - RNA, 19 nt, Human herpesvirus 6
uguucagucuaugcagcgc

SEQ ID NO: 2039575 - RNA, 18 nt, Human herpesvirus 6
guccgacacgcccccacc

SEQ ID NO: 2039576 - RNA, 18 nt, Human herpesvirus 6
gcugcagucucgggagag

SEQ ID NO: 2039577 - RNA, 16 nt, Human herpesvirus 6
cacacaauuaguccau

SEQ ID NO: 2039578 - RNA, 16 nt, Human herpesvirus 6
uuuuuaaucaugauug

SEQ ID NO: 2039579 - RNA, 22 nt, Human herpesvirus 6
auguguuuuucuuuuacaggaa

SEQ ID NO: 2039580 - RNA, 18 nt, Human herpesvirus 6
ucgaauaauuauccucuc

SEQ ID NO: 2039581 - RNA, 17 nt, Human herpesvirus 6
aucacuuagacacggcc

SEQ ID NO: 2039582 - RNA, 23 nt, Human herpesvirus 6
aguaaaucucucgguagauugga

SEQ ID NO: 2039583 - RNA, 20 nt, Human herpesvirus 6
agaagaucugcgugaacgug

SEQ ID NO: 2039584 - RNA, 17 nt, Human herpesvirus 6
ugcuuuacaucgaauuu

SEQ ID NO: 2039585 - RNA, 14 nt, Human herpesvirus 6
ugaaauaaaguuua

SEQ ID NO: 2039586 - RNA, 23 nt, Human herpesvirus 6
aagagugauucaagguggagguu

SEQ ID NO: 2039587 - RNA, 16 nt, Human herpesvirus 6
gaguuuccgggcaugg

SEQ ID NO: 2039588 - RNA, 20 nt, Human herpesvirus 6
auagaaaaaaauauuuugaa

SEQ ID NO: 2039589 - RNA, 22 nt, Human herpesvirus 6
gcgacgugccaccgucugggac

SEQ ID NO: 2039590 - RNA, 16 nt, Human herpesvirus 6
uguucuagugcguauu

SEQ ID NO: 2039591 - RNA, 22 nt, Human herpesvirus 6
ggcuauuuuuccgaaaggugaa

SEQ ID NO: 2039592 - RNA, 14 nt, Human herpesvirus 6
ggaucgggcccggg

SEQ ID NO: 2039593 - RNA, 21 nt, Human herpesvirus 6
uaccgcgguuugggggucuuu

SEQ ID NO: 2039594 - RNA, 15 nt, Human herpesvirus 6
gcucgaaucuaaauu

SEQ ID NO: 2039595 - RNA, 23 nt, Human herpesvirus 6
uucaauccggaguuaaguaaacu

SEQ ID NO: 2039596 - RNA, 23 nt, Human herpesvirus 6
uccuguuuucccaccuaauaaac

SEQ ID NO: 2039597 - RNA, 18 nt, Human herpesvirus 6
acccuacaaucuguccag

SEQ ID NO: 2039598 - RNA, 17 nt, Human herpesvirus 6
aagucacgggcagcugc

SEQ ID NO: 2039599 - RNA, 17 nt, Human herpesvirus 6
gguccaaccccucccau

SEQ ID NO: 2039600 - RNA, 21 nt, Human herpesvirus 6
guuaauucaaaugcaguaaau

SEQ ID NO: 2039601 - RNA, 17 nt, Human herpesvirus 6
uguacgaugaacuacug

SEQ ID NO: 2039602 - RNA, 15 nt, Human herpesvirus 6
uacgaauucaauguc

SEQ ID NO: 2039603 - RNA, 19 nt, Human herpesvirus 6
ggagcagcuuccacgcgac

SEQ ID NO: 2039604 - RNA, 19 nt, Human herpesvirus 6
ggcagaucuaucacaggcg

SEQ ID NO: 2039605 - RNA, 13 nt, Human herpesvirus 6
auuaucauagaca

SEQ ID NO: 2039606 - RNA, 19 nt, Human herpesvirus 6
guaaauauuucuaaacaca

SEQ ID NO: 2039607 - RNA, 16 nt, Human herpesvirus 6
ucgaccauguguauau

SEQ ID NO: 2039608 - RNA, 14 nt, Human herpesvirus 6
aagaauucaaaaac

SEQ ID NO: 2039609 - RNA, 23 nt, Human herpesvirus 6
gagugguuuuuuggauaagcaga

SEQ ID NO: 2039610 - RNA, 19 nt, Human herpesvirus 6
aggcuaucacuuagacacg

SEQ ID NO: 2039611 - RNA, 15 nt, Human herpesvirus 6
guuuaacgcucauga

SEQ ID NO: 2039612 - RNA, 14 nt, Human herpesvirus 6
aaacagagacuggu

SEQ ID NO: 2039613 - RNA, 20 nt, Human herpesvirus 6
aagaaaguuucguacuggag

SEQ ID NO: 2039614 - RNA, 14 nt, Human herpesvirus 6
acggacacgcgcag

SEQ ID NO: 2039615 - RNA, 12 nt, Human herpesvirus 6
caccagccggua

SEQ ID NO: 2039616 - RNA, 14 nt, Human herpesvirus 6
augcgacugcaaga

SEQ ID NO: 2039617 - RNA, 22 nt, Human herpesvirus 6
cgacacgugggggguuccuccg

SEQ ID NO: 2039618 - RNA, 17 nt, Human herpesvirus 6
cuuauaacaagcacuga

SEQ ID NO: 2039619 - RNA, 23 nt, Human herpesvirus 6
cuuacacaaauugaccagccaga

SEQ ID NO: 2039620 - RNA, 23 nt, Human herpesvirus 6
aacaaagguaccacggggauuua

SEQ ID NO: 2039621 - RNA, 13 nt, Human herpesvirus 6
cugcgaggccauc

SEQ ID NO: 2039622 - RNA, 22 nt, Human herpesvirus 6
cuuugaaggacuaucugagaca

SEQ ID NO: 2039623 - RNA, 12 nt, Human herpesvirus 6
uuacuaguuuuc

SEQ ID NO: 2039624 - RNA, 16 nt, Human herpesvirus 6
gaggacgggaagaaca

SEQ ID NO: 2039625 - RNA, 22 nt, Human herpesvirus 6
aacuaauucggaacauuguucu

SEQ ID NO: 2039626 - RNA, 15 nt, Human herpesvirus 6
ccaaagaaacagaua

SEQ ID NO: 2039627 - RNA, 19 nt, Human herpesvirus 6
cuaaauauaucaaagaugu

SEQ ID NO: 2039628 - RNA, 19 nt, Human herpesvirus 6
aaaacauaccgacguaaua

SEQ ID NO: 2039629 - RNA, 16 nt, Human herpesvirus 6
ugacacacagaauaca

SEQ ID NO: 2039630 - RNA, 16 nt, Human herpesvirus 6
auuucuacaaaaauac

SEQ ID NO: 2039631 - RNA, 15 nt, Human herpesvirus 6
ugauuauucugucuu

SEQ ID NO: 2039632 - RNA, 17 nt, Human herpesvirus 6
gacucccggcccagaga

SEQ ID NO: 2039633 - RNA, 13 nt, Human herpesvirus 6
gcuaccgcugggc

SEQ ID NO: 2039634 - RNA, 20 nt, Human herpesvirus 6
cuaggacuucguucuugaca

SEQ ID NO: 2039635 - RNA, 17 nt, Human herpesvirus 6
aaaaugcguuugucauu

SEQ ID NO: 2039636 - RNA, 18 nt, Human herpesvirus 6
caucaccgauaaaaacuc

SEQ ID NO: 2039637 - RNA, 13 nt, Human herpesvirus 6
uuuuuaacuaggu

SEQ ID NO: 2039638 - RNA, 22 nt, Human herpesvirus 6
aacauccuauugagauucuccg

SEQ ID NO: 2039639 - RNA, 19 nt, Human herpesvirus 6
agauaucauaaucugcguu

SEQ ID NO: 2039640 - RNA, 22 nt, Human herpesvirus 6
uugaauaauaagccuaagaaau

SEQ ID NO: 2039641 - RNA, 11 nt, Human herpesvirus 6
acuauacuuuu

SEQ ID NO: 2039642 - RNA, 19 nt, Human herpesvirus 6
gaauucguuacaaucucug

SEQ ID NO: 2039643 - RNA, 14 nt, Human herpesvirus 6
uuucuguuuuaauu

SEQ ID NO: 2039644 - RNA, 14 nt, Human herpesvirus 6
aauguaauaauuga

SEQ ID NO: 2039645 - RNA, 13 nt, Human herpesvirus 6
auuacauuaucca

SEQ ID NO: 2039646 - RNA, 16 nt, Human herpesvirus 6
ucaaacugguguaaau

SEQ ID NO: 2039647 - RNA, 16 nt, Human herpesvirus 6
uaauguaaaguuauau

SEQ ID NO: 2039648 - RNA, 20 nt, Human herpesvirus 6
uccagaggcguggaaagacg

SEQ ID NO: 2039649 - RNA, 19 nt, Human herpesvirus 6
uuuccagguagaguugcgu

SEQ ID NO: 2039650 - RNA, 13 nt, Human herpesvirus 6
uguuagaauguau

SEQ ID NO: 2039651 - RNA, 19 nt, Human herpesvirus 6
cucgggaacgaccgcggcc

SEQ ID NO: 2039652 - RNA, 21 nt, Human herpesvirus 6
auaacgauauauaaaaaacug

SEQ ID NO: 2039653 - RNA, 20 nt, Human herpesvirus 6
uaaaagaauuuuuguagcaa

SEQ ID NO: 2039654 - RNA, 12 nt, Human herpesvirus 6
ccguagaggcgu

SEQ ID NO: 2039655 - RNA, 17 nt, Human herpesvirus 6
uguguguuauaaggaag

SEQ ID NO: 2039656 - RNA, 17 nt, Human herpesvirus 6
ugucguuguaguuuuua

SEQ ID NO: 2039657 - RNA, 13 nt, Human herpesvirus 6
ggagaggccggag

SEQ ID NO: 2039658 - RNA, 19 nt, Human herpesvirus 6
ccggcugagcggaguggag

SEQ ID NO: 2039659 - RNA, 23 nt, Human herpesvirus 6
auuucauuuguuuuuuaaagcac

SEQ ID NO: 2039660 - RNA, 16 nt, Human herpesvirus 6
gccgcugcagaaaaac

SEQ ID NO: 2039661 - RNA, 14 nt, Human herpesvirus 6
guucaucauuccag

SEQ ID NO: 2039662 - RNA, 17 nt, Human herpesvirus 6
agaagaaaagaaaaagc

SEQ ID NO: 2039663 - RNA, 15 nt, Human herpesvirus 6
acuuagcuagaugug

SEQ ID NO: 2039664 - RNA, 17 nt, Human herpesvirus 6
auaaacugugucuguuc

SEQ ID NO: 2039665 - RNA, 18 nt, Human herpesvirus 6
gggcucgcucugaaauuu

SEQ ID NO: 2039666 - RNA, 15 nt, Human herpesvirus 6
ggucuuuccugccca

SEQ ID NO: 2039667 - RNA, 15 nt, Human herpesvirus 6
aauuacauuaaaaca

SEQ ID NO: 2039668 - RNA, 20 nt, Human herpesvirus 6
gaauaacaaacuauauugcu

SEQ ID NO: 2039669 - RNA, 15 nt, Human herpesvirus 6
aaaaacugacugaca

SEQ ID NO: 2039670 - RNA, 14 nt, Human herpesvirus 6
gucggcgugucugu

SEQ ID NO: 2039671 - RNA, 17 nt, Human herpesvirus 6
uuagagaaaagugcaag

SEQ ID NO: 2039672 - RNA, 18 nt, Human herpesvirus 6
ggggaucgacgggcagga

SEQ ID NO: 2039673 - RNA, 15 nt, Human herpesvirus 6
aaaucucucgguaga

SEQ ID NO: 2039674 - RNA, 16 nt, Human herpesvirus 6
aauauuuccugcccag

SEQ ID NO: 2039675 - RNA, 20 nt, Human herpesvirus 6
uagcguucauucccaguguc

SEQ ID NO: 2039676 - RNA, 17 nt, Human herpesvirus 6
auauccuagcauuuccg

SEQ ID NO: 2039677 - RNA, 17 nt, Human herpesvirus 6
gaagaaggcuaucacuu

SEQ ID NO: 2039678 - RNA, 15 nt, Human herpesvirus 6
ugauuccuucaaugu

SEQ ID NO: 2039679 - RNA, 19 nt, Human herpesvirus 6
acuuauauauauaucagaa

SEQ ID NO: 2039680 - RNA, 14 nt, Human herpesvirus 6
uguuguguuuacau

SEQ ID NO: 2039681 - RNA, 18 nt, Human herpesvirus 6
gccggaucguaaggcagu

SEQ ID NO: 2039682 - RNA, 19 nt, Human herpesvirus 6
cggggagagaauugccgau

SEQ ID NO: 2039683 - RNA, 17 nt, Human herpesvirus 6
ucaaaugaauuuauuuu

SEQ ID NO: 2039684 - RNA, 15 nt, Human herpesvirus 6
ugccgagccugugga

SEQ ID NO: 2039685 - RNA, 13 nt, Human herpesvirus 6
gcgauacccagcg

SEQ ID NO: 2039686 - RNA, 20 nt, Human herpesvirus 6
ucugcauaguguagaaaaca

SEQ ID NO: 2039687 - RNA, 20 nt, Human herpesvirus 6
uuacucaccugcgucaaugc

SEQ ID NO: 2039688 - RNA, 14 nt, Human herpesvirus 6
agacacacaaaaaa

SEQ ID NO: 2039689 - RNA, 13 nt, Human herpesvirus 6
acaccucaggguc

SEQ ID NO: 2039690 - RNA, 19 nt, Human herpesvirus 6
aauuuaauaagaaagcagu

SEQ ID NO: 2039691 - RNA, 13 nt, Human herpesvirus 6
acguuuagaauga

SEQ ID NO: 2039692 - RNA, 13 nt, Human herpesvirus 6
ccgagccugugga

SEQ ID NO: 2039693 - RNA, 22 nt, Human herpesvirus 6
auuaauuaccuauagucaaugu

SEQ ID NO: 2039694 - RNA, 19 nt, Human herpesvirus 6
guucagaagagaugaaaga

SEQ ID NO: 2039695 - RNA, 15 nt, Human herpesvirus 6
auguaaaaguuguga

SEQ ID NO: 2039696 - RNA, 22 nt, Human herpesvirus 6
agagcaaaugccgacaagcuuu

SEQ ID NO: 2039697 - RNA, 17 nt, Human herpesvirus 6
cggacgacgggcggggc

SEQ ID NO: 2039698 - RNA, 19 nt, Human herpesvirus 6
uguuaacauaaaacaacaa

SEQ ID NO: 2039699 - RNA, 20 nt, Human herpesvirus 6
cuguccccucgguccaaccc

SEQ ID NO: 2039700 - RNA, 19 nt, Human herpesvirus 6
aaguagccaaugauucuua

SEQ ID NO: 2039701 - RNA, 15 nt, Human herpesvirus 6
agaugacaucugcaa

SEQ ID NO: 2039702 - RNA, 13 nt, Human herpesvirus 6
gaaacucuuauaa

SEQ ID NO: 2039703 - RNA, 13 nt, Human herpesvirus 6
gguaacgcugucg

SEQ ID NO: 2039704 - RNA, 14 nt, Human herpesvirus 6
ugacaucugcaaaa

SEQ ID NO: 2039705 - RNA, 16 nt, Human herpesvirus 6
cauagagaaacgagag

SEQ ID NO: 2039706 - RNA, 19 nt, Human herpesvirus 6
ggagagacgcaccacggcu

SEQ ID NO: 2039707 - RNA, 20 nt, Human herpesvirus 6
aucagaauccaccaaugaca

SEQ ID NO: 2039708 - RNA, 16 nt, Human herpesvirus 6
gcacacacaagaacag

SEQ ID NO: 2039709 - RNA, 17 nt, Human herpesvirus 6
acgucgacgaaauaauu

SEQ ID NO: 2039710 - RNA, 16 nt, Human herpesvirus 6
gcuguccgccuguucc

SEQ ID NO: 2039711 - RNA, 19 nt, Human herpesvirus 6
uaauuccagcuuucuuaga

SEQ ID NO: 2039712 - RNA, 19 nt, Human herpesvirus 6
acuugccucacaaauauug

SEQ ID NO: 2039713 - RNA, 14 nt, Human herpesvirus 6
gugacucuucucua

SEQ ID NO: 2039714 - RNA, 15 nt, Human herpesvirus 6
cgaaugguuaaaagu

SEQ ID NO: 2039715 - RNA, 14 nt, Human herpesvirus 6
cauuauugucugca

SEQ ID NO: 2039716 - RNA, 15 nt, Human herpesvirus 6
uggugcgaucgagca

SEQ ID NO: 2039717 - RNA, 16 nt, Human herpesvirus 6
cgucuccucauggaga

SEQ ID NO: 2039718 - RNA, 19 nt, Human herpesvirus 6
uaaaguuuugugauccugu

SEQ ID NO: 2039719 - RNA, 16 nt, Human herpesvirus 6
acaauauuucacauau

SEQ ID NO: 2039720 - RNA, 14 nt, Human herpesvirus 6
ucaaauauggcaga

SEQ ID NO: 2039721 - RNA, 15 nt, Human herpesvirus 6
guuauacauaaggca

SEQ ID NO: 2039722 - RNA, 13 nt, Human herpesvirus 6
aaggucagugggu

SEQ ID NO: 2039723 - RNA, 14 nt, Human herpesvirus 6
cguaaaucugcguc

SEQ ID NO: 2039724 - RNA, 12 nt, Human herpesvirus 6
aaaaaaacacag

SEQ ID NO: 2039725 - RNA, 17 nt, Human herpesvirus 6
aacgcaagucacgggca

SEQ ID NO: 2039726 - RNA, 19 nt, Human herpesvirus 6
acgugaaauaaaguuuaaa

SEQ ID NO: 2039727 - RNA, 22 nt, Human herpesvirus 6
auaaaugaauagauaauaauca

SEQ ID NO: 2039728 - RNA, 20 nt, Human herpesvirus 6
agaagaaaagaaaaagcagc

SEQ ID NO: 2039729 - RNA, 14 nt, Human herpesvirus 6
aaacaaucaaaugg

SEQ ID NO: 2039730 - RNA, 15 nt, Human herpesvirus 6
uccggaguugcagug

SEQ ID NO: 2039731 - RNA, 15 nt, Human herpesvirus 6
acgguggccuggcac

SEQ ID NO: 2039732 - RNA, 23 nt, Human herpesvirus 6
aaagaaucgguaaacuucagacc

SEQ ID NO: 2039733 - RNA, 13 nt, Human herpesvirus 6
cgcgagacagcgg

SEQ ID NO: 2039734 - RNA, 13 nt, Human herpesvirus 6
cuauccgcccucc

SEQ ID NO: 2039735 - RNA, 23 nt, Human herpesvirus 6
cacugcauuucauuccccgacca

SEQ ID NO: 2039736 - RNA, 15 nt, Human herpesvirus 6
uaaaaacucacacaa

SEQ ID NO: 2039737 - RNA, 18 nt, Human herpesvirus 6
cucuuaacuacuucuuuc

SEQ ID NO: 2039738 - RNA, 22 nt, Human herpesvirus 6
ucucggaaaacuaaaagucagu

SEQ ID NO: 2039739 - RNA, 14 nt, Human herpesvirus 6
accucgcgcaccgc

SEQ ID NO: 2039740 - RNA, 20 nt, Human herpesvirus 6
acaucgucuccuacauucuc

SEQ ID NO: 2039741 - RNA, 18 nt, Human herpesvirus 6
cgguccggcugagcggag

SEQ ID NO: 2039742 - RNA, 17 nt, Human herpesvirus 6
uauuucguauguuugga

SEQ ID NO: 2039743 - RNA, 23 nt, Human herpesvirus 6
guuaauuguguuguuguauaugu

SEQ ID NO: 2039744 - RNA, 13 nt, Human herpesvirus 6
cgagucgaagaga

SEQ ID NO: 2039745 - RNA, 12 nt, Human herpesvirus 6
ugccguaaaucu

SEQ ID NO: 2039746 - RNA, 13 nt, Human herpesvirus 6
auuuucuuaguaa

SEQ ID NO: 2039747 - RNA, 13 nt, Human herpesvirus 6
aaacacagauggu

SEQ ID NO: 2039748 - RNA, 18 nt, Human herpesvirus 6
acgagagaguccauuucu

SEQ ID NO: 2039749 - RNA, 22 nt, Human herpesvirus 6
uuuugugauuaacaaauuacaa

SEQ ID NO: 2039750 - RNA, 18 nt, Human herpesvirus 6
cuaguguuucgcagagga

SEQ ID NO: 2039751 - RNA, 19 nt, Human herpesvirus 6
cccauaccuguaaacuggu

SEQ ID NO: 2039752 - RNA, 17 nt, Human herpesvirus 6
uauacacgaacuaaaua

SEQ ID NO: 2039753 - RNA, 19 nt, Human herpesvirus 6
aauaaacuuuuuuggcucg

SEQ ID NO: 2039754 - RNA, 14 nt, Human herpesvirus 6
cuuuucguacggcg

SEQ ID NO: 2039755 - RNA, 14 nt, Human herpesvirus 6
aacaucccggaaau

SEQ ID NO: 2039756 - RNA, 22 nt, Human herpesvirus 6
cgaaaccaucgucauaaccuca

SEQ ID NO: 2039757 - RNA, 16 nt, Human herpesvirus 6
cagugauauggaaaca

SEQ ID NO: 2039758 - RNA, 19 nt, Human herpesvirus 6
uuuguguucagucuaugca

SEQ ID NO: 2039759 - RNA, 19 nt, Human herpesvirus 6
uugcaauuuccugucaugu

SEQ ID NO: 2039760 - RNA, 12 nt, Human herpesvirus 6
guggacaaugau

SEQ ID NO: 2039761 - RNA, 18 nt, Human herpesvirus 6
gagagacgcaccacggcu

SEQ ID NO: 2039762 - RNA, 17 nt, Human herpesvirus 6
ucauuguuuuugcaugu

SEQ ID NO: 2039763 - RNA, 15 nt, Human herpesvirus 6
acagacgaaucacau

SEQ ID NO: 2039764 - RNA, 13 nt, Human herpesvirus 6
gggagggacccac

SEQ ID NO: 2039765 - RNA, 22 nt, Human herpesvirus 6
cagucuacacacacgccgguua

SEQ ID NO: 2039766 - RNA, 15 nt, Human herpesvirus 6
cuguguguuauaagg

SEQ ID NO: 2039767 - RNA, 17 nt, Human herpesvirus 6
uggacacgguaccuguu

SEQ ID NO: 2039768 - RNA, 23 nt, Human herpesvirus 6
aaagauuagauuaggggagagac

SEQ ID NO: 2039769 - RNA, 23 nt, Human herpesvirus 6
ucacauguucuuuauuaaauguu

SEQ ID NO: 2039770 - RNA, 21 nt, Human herpesvirus 6
ugaagaucacgcccauauguu

SEQ ID NO: 2039771 - RNA, 15 nt, Human herpesvirus 6
auugcucuauugugu

SEQ ID NO: 2039772 - RNA, 19 nt, Human herpesvirus 6
uuaccauauauuggcaugu

SEQ ID NO: 2039773 - RNA, 19 nt, Human herpesvirus 6
gaaaguugauacgccagaa

SEQ ID NO: 2039774 - RNA, 14 nt, Human herpesvirus 6
aggaaguaaauaca

SEQ ID NO: 2039775 - RNA, 18 nt, Human herpesvirus 6
gcucugaaauuugagaaa

SEQ ID NO: 2039776 - RNA, 14 nt, Human herpesvirus 6
auugguuugcauaa

SEQ ID NO: 2039777 - RNA, 19 nt, Human herpesvirus 6
aacgcgucgguaaacaauu

SEQ ID NO: 2039778 - RNA, 21 nt, Human herpesvirus 6
uguacuuccgcauacuuuugu

SEQ ID NO: 2039779 - RNA, 21 nt, Human herpesvirus 6
ccgccgugcuucuggcacagg

SEQ ID NO: 2039780 - RNA, 14 nt, Human herpesvirus 6
uguccaucuucaga

SEQ ID NO: 2039781 - RNA, 19 nt, Human herpesvirus 6
uaauuguguuguuguauau

SEQ ID NO: 2039782 - RNA, 19 nt, Human herpesvirus 6
auuaggggagagacaucca

SEQ ID NO: 2039783 - RNA, 17 nt, Human herpesvirus 6
ccauggaaaacaaagaa

SEQ ID NO: 2039784 - RNA, 15 nt, Human herpesvirus 6
aaccaugucuugcaa

SEQ ID NO: 2039785 - RNA, 21 nt, Human herpesvirus 6
ccaaugacaccgauucagaaa

SEQ ID NO: 2039786 - RNA, 12 nt, Human herpesvirus 6
uaaagcagcuag

SEQ ID NO: 2039787 - RNA, 21 nt, Human herpesvirus 6
gugaucuuuacaaaagacaca

SEQ ID NO: 2039788 - RNA, 13 nt, Human herpesvirus 6
ccuaauaaauguc

SEQ ID NO: 2039789 - RNA, 19 nt, Human herpesvirus 6
uuacacuuucuuguaguau

SEQ ID NO: 2039790 - RNA, 15 nt, Human herpesvirus 6
accgcaguuucuguu

SEQ ID NO: 2039791 - RNA, 17 nt, Human herpesvirus 6
gacuauauuaucuuuca

SEQ ID NO: 2039792 - RNA, 22 nt, Human herpesvirus 6
auuguauauauagcuguaaaua

SEQ ID NO: 2039793 - RNA, 15 nt, Human herpesvirus 6
ugugcuaucugauuu

SEQ ID NO: 2039794 - RNA, 17 nt, Human herpesvirus 6
uuacugacgguuagguu

SEQ ID NO: 2039795 - RNA, 18 nt, Human herpesvirus 6
uaacguggauaaaacggc

SEQ ID NO: 2039796 - RNA, 21 nt, Human herpesvirus 6
aaaucuggaucaucaagcauc

SEQ ID NO: 2039797 - RNA, 22 nt, Human herpesvirus 6
agucugucgcuuauuucguuug

SEQ ID NO: 2039798 - RNA, 15 nt, Human herpesvirus 6
gccgaugaaacuguc

SEQ ID NO: 2039799 - RNA, 15 nt, Human herpesvirus 6
uucuuuuuaacuagg

SEQ ID NO: 2039800 - RNA, 14 nt, Human herpesvirus 6
ucgggagaggacca

SEQ ID NO: 2039801 - RNA, 13 nt, Human herpesvirus 6
cagacagaggaag

SEQ ID NO: 2039802 - RNA, 18 nt, Human herpesvirus 6
auuuuauaauacacuauu

SEQ ID NO: 2039803 - RNA, 15 nt, Human herpesvirus 6
auucuaauaaaagac

SEQ ID NO: 2039804 - RNA, 18 nt, Human herpesvirus 6
ugaucgacauuuguauuu

SEQ ID NO: 2039805 - RNA, 14 nt, Human herpesvirus 6
ugaguaggagaggc

SEQ ID NO: 2039806 - RNA, 15 nt, Human herpesvirus 6
cacuuccucacgcaa

SEQ ID NO: 2039807 - RNA, 23 nt, Human herpesvirus 6
guuugggauguccauuucuucga

SEQ ID NO: 2039808 - RNA, 20 nt, Human herpesvirus 6
uuggaugccugcauaugcag

SEQ ID NO: 2039809 - RNA, 21 nt, Human herpesvirus 6
gcggaaauaaaaaauauuaau

SEQ ID NO: 2039810 - RNA, 19 nt, Human herpesvirus 6
uaauacauauaaaagcuaa

SEQ ID NO: 2039811 - RNA, 17 nt, Human herpesvirus 6
ucggucaccuacauucg

SEQ ID NO: 2039812 - RNA, 21 nt, Human herpesvirus 6
caaucgaugugacaaaucugu

SEQ ID NO: 2039813 - RNA, 12 nt, Human herpesvirus 6
cauaaaauguuu

SEQ ID NO: 2039814 - RNA, 15 nt, Human herpesvirus 6
cagguuucuccgcac

SEQ ID NO: 2039815 - RNA, 14 nt, Human herpesvirus 6
uucaacgucuucaa

SEQ ID NO: 2039816 - RNA, 17 nt, Human herpesvirus 6
cugaucacagagaaaaa

SEQ ID NO: 2039817 - RNA, 22 nt, Human herpesvirus 6
cucgacuccagugcuuuaauca

SEQ ID NO: 2039818 - RNA, 17 nt, Human herpesvirus 6
ugauuauauauuugcau

SEQ ID NO: 2039819 - RNA, 13 nt, Human herpesvirus 6
uucauuucaucuu

SEQ ID NO: 2039820 - RNA, 13 nt, Human herpesvirus 6
guguuuucaucag

SEQ ID NO: 2039821 - RNA, 17 nt, Human herpesvirus 6
caauguuuuugacaaau

SEQ ID NO: 2039822 - RNA, 20 nt, Human herpesvirus 6
ggccuggcacggugccaaag

SEQ ID NO: 2039823 - RNA, 19 nt, Human herpesvirus 6
gacuacucuggcugaaaga

SEQ ID NO: 2039824 - RNA, 20 nt, Human herpesvirus 6
uaaugaguuuuucgcaauuu

SEQ ID NO: 2039825 - RNA, 16 nt, Human herpesvirus 6
cugagugcgaccuguc

SEQ ID NO: 2039826 - RNA, 13 nt, Human herpesvirus 6
aacaacaauaaca

SEQ ID NO: 2039827 - RNA, 16 nt, Human herpesvirus 6
gcagacgcugaaauca

SEQ ID NO: 2039828 - RNA, 21 nt, Human herpesvirus 6
ccucaaacuuuuagagacuuu

SEQ ID NO: 2039829 - RNA, 14 nt, Human herpesvirus 6
gagaugacggaaua

SEQ ID NO: 2039830 - RNA, 17 nt, Human herpesvirus 6
acuaagauugugcaguu

SEQ ID NO: 2039831 - RNA, 17 nt, Human herpesvirus 6
uuuguagcaaucuuaaa

SEQ ID NO: 2039832 - RNA, 11 nt, Human herpesvirus 6
uacuacaguga

SEQ ID NO: 2039833 - RNA, 20 nt, Human herpesvirus 6
ucggaaaauauuuccugccc

SEQ ID NO: 2039834 - RNA, 22 nt, Human herpesvirus 6
aucgggcccggggacggacagg

SEQ ID NO: 2039835 - RNA, 22 nt, Human herpesvirus 6
aguuaccgugaugugggugugg

SEQ ID NO: 2039836 - RNA, 16 nt, Human herpesvirus 6
augaaugugcugaugu

SEQ ID NO: 2039837 - RNA, 13 nt, Human herpesvirus 6
auuucuaaacaca

SEQ ID NO: 2039838 - RNA, 13 nt, Human herpesvirus 6
cauucacauuacc

SEQ ID NO: 2039839 - RNA, 22 nt, Human herpesvirus 6
uagguaucacccccccuucauc

SEQ ID NO: 2039840 - RNA, 20 nt, Human herpesvirus 6
agagaacugucuugcagcug

SEQ ID NO: 2039841 - RNA, 16 nt, Human herpesvirus 6
uuuagccuuuauucug

SEQ ID NO: 2039842 - RNA, 20 nt, Human herpesvirus 6
guuugggggucuuuccugca

SEQ ID NO: 2039843 - RNA, 13 nt, Human herpesvirus 6
ccagaaaaguaua

SEQ ID NO: 2039844 - RNA, 22 nt, Human herpesvirus 6
cucgcucacaauauuucacaua

SEQ ID NO: 2039845 - RNA, 19 nt, Human herpesvirus 6
gguuuuaagagcagacaag

SEQ ID NO: 2039846 - RNA, 20 nt, Human herpesvirus 6
caacugguuuugagaaagcc

SEQ ID NO: 2039847 - RNA, 12 nt, Human herpesvirus 6
ggcacggugcca

SEQ ID NO: 2039848 - RNA, 21 nt, Human herpesvirus 6
gguaccgcgguuuggggucuu

SEQ ID NO: 2039849 - RNA, 22 nt, Human herpesvirus 6
cugccauuauugauagcauuau

SEQ ID NO: 2039850 - RNA, 13 nt, Human herpesvirus 6
uugcgauucuaau

SEQ ID NO: 2039851 - RNA, 15 nt, Human herpesvirus 6
agucugaaugcgagu

SEQ ID NO: 2039852 - RNA, 14 nt, Human herpesvirus 6
accugucucugcuu

SEQ ID NO: 2039853 - RNA, 16 nt, Human herpesvirus 6
ucagguuuagaugcuu

SEQ ID NO: 2039854 - RNA, 22 nt, Human herpesvirus 6
agaaaaauaaaggucagugggu

SEQ ID NO: 2039855 - RNA, 21 nt, Human herpesvirus 6
agcgacucccggcccagagac

SEQ ID NO: 2039856 - RNA, 13 nt, Human herpesvirus 6
auuugcccugagc

SEQ ID NO: 2039857 - RNA, 15 nt, Human herpesvirus 6
ugagguacaaaacau

SEQ ID NO: 2039858 - RNA, 23 nt, Human herpesvirus 6
aauauucaagcgaagugaagaau

SEQ ID NO: 2039859 - RNA, 12 nt, Human herpesvirus 6
uuaaaagucagu

SEQ ID NO: 2039860 - RNA, 14 nt, Human herpesvirus 6
uguguuucugucuu

SEQ ID NO: 2039861 - RNA, 15 nt, Human herpesvirus 6
gcauaauccuuuucu

SEQ ID NO: 2039862 - RNA, 13 nt, Human herpesvirus 6
guuaucacgaugu

SEQ ID NO: 2039863 - RNA, 17 nt, Human herpesvirus 6
acucguuuuccuucccu

SEQ ID NO: 2039864 - RNA, 14 nt, Human herpesvirus 6
ccuucacuuuuuca

SEQ ID NO: 2039865 - RNA, 12 nt, Human herpesvirus 6
cacaaucagaaa

SEQ ID NO: 2039866 - RNA, 18 nt, Human herpesvirus 6
cuggccgaguuuggacau

SEQ ID NO: 2039867 - RNA, 13 nt, Human herpesvirus 6
uguuguguuugag

SEQ ID NO: 2039868 - RNA, 12 nt, Human herpesvirus 6
uuucucugcaaa

SEQ ID NO: 2039869 - RNA, 13 nt, Human herpesvirus 6
acaugcaauuuuu

SEQ ID NO: 2039870 - RNA, 16 nt, Human herpesvirus 6
auuucuaaacacagau

SEQ ID NO: 2039871 - RNA, 24 nt, Human herpesvirus 6
uuucguuacgacgaacaauauaga

SEQ ID NO: 2039872 - RNA, 22 nt, Human herpesvirus 6
auaaucuuauagcucaguguuu

SEQ ID NO: 2039873 - RNA, 19 nt, Human herpesvirus 6
cuuucucuuuuuaauucca

SEQ ID NO: 2039874 - RNA, 14 nt, Human herpesvirus 6
cgagaacucuaaaa

SEQ ID NO: 2039875 - RNA, 19 nt, Human herpesvirus 6
gaaaacccagcaugaugau

SEQ ID NO: 2039876 - RNA, 20 nt, Human herpesvirus 6
uaacucuuuuuguugcuaua

SEQ ID NO: 2039877 - RNA, 20 nt, Human herpesvirus 6
aucaagacuacucuggcuga

SEQ ID NO: 2039878 - RNA, 16 nt, Human herpesvirus 6
gugccaccgucuggga

SEQ ID NO: 2039879 - RNA, 12 nt, Human herpesvirus 6
auguaaagaaau

SEQ ID NO: 2039880 - RNA, 18 nt, Human herpesvirus 6
auaaaaucuauugaagau

SEQ ID NO: 2039881 - RNA, 22 nt, Human herpesvirus 6
agacaucgauuugcugguaaau

SEQ ID NO: 2039882 - RNA, 15 nt, Human herpesvirus 6
guaauuuugaaauug

SEQ ID NO: 2039883 - RNA, 21 nt, Human herpesvirus 6
gacuggaaaacuaugugcauu

SEQ ID NO: 2039884 - RNA, 21 nt, Human herpesvirus 6
guaacaacuaccgccauauua

SEQ ID NO: 2039885 - RNA, 18 nt, Human herpesvirus 6
cugauggcagguaaccaa

SEQ ID NO: 2039886 - RNA, 17 nt, Human herpesvirus 6
caagcuguccaucuuca

SEQ ID NO: 2039887 - RNA, 15 nt, Human herpesvirus 6
ugggggguuccuccg

SEQ ID NO: 2039888 - RNA, 23 nt, Human herpesvirus 6
cauuguucuaaagauuuuuauuc

SEQ ID NO: 2039889 - RNA, 17 nt, Human herpesvirus 6
uuauacgaaaauaaaaa

SEQ ID NO: 2039890 - RNA, 18 nt, Human herpesvirus 6
uucaaccuguuuccagaa

SEQ ID NO: 2039891 - RNA, 18 nt, Human herpesvirus 6
uuuacauagaaauuacaa

SEQ ID NO: 2039892 - RNA, 17 nt, Human herpesvirus 6
cauucgguacucuuuuc

SEQ ID NO: 2039893 - RNA, 12 nt, Human herpesvirus 6
ggaaugugucag

SEQ ID NO: 2039894 - RNA, 19 nt, Human herpesvirus 6
agaaugaaaaaaaaaauau

SEQ ID NO: 2039895 - RNA, 21 nt, Human herpesvirus 6
caaucagccugcucagagcug

SEQ ID NO: 2039896 - RNA, 19 nt, Human herpesvirus 6
auaucaaacuuuuuuugaa

SEQ ID NO: 2039897 - RNA, 14 nt, Human herpesvirus 6
guucguaaugugca

SEQ ID NO: 2039898 - RNA, 17 nt, Human herpesvirus 6
auuaaauguuacugaac

SEQ ID NO: 2039899 - RNA, 16 nt, Human herpesvirus 6
uuuuuuaacagugucu

SEQ ID NO: 2039900 - RNA, 13 nt, Human herpesvirus 6
cugacacaaucag

SEQ ID NO: 2039901 - RNA, 19 nt, Human herpesvirus 6
uggaaaacuaugugcauuc

SEQ ID NO: 2039902 - RNA, 13 nt, Human herpesvirus 6
gcaccgcuguggc

SEQ ID NO: 2039903 - RNA, 16 nt, Human herpesvirus 6
uauucagaggugcuga

SEQ ID NO: 2039904 - RNA, 18 nt, Human herpesvirus 6
cuauuacuauauauugga

SEQ ID NO: 2039905 - RNA, 22 nt, Human herpesvirus 6
guuaggacaauuagauaaacaa

SEQ ID NO: 2039906 - RNA, 18 nt, Human herpesvirus 6
accaucaauaaaaaucua

SEQ ID NO: 2039907 - RNA, 16 nt, Human herpesvirus 6
ccacauguguauugga

SEQ ID NO: 2039908 - RNA, 12 nt, Human herpesvirus 6
ugaaugugcuuu

SEQ ID NO: 2039909 - RNA, 21 nt, Human herpesvirus 6
auuuuauaacgacaaaagaca

SEQ ID NO: 2039910 - RNA, 19 nt, Human herpesvirus 6
ccaaugauucuuaauucuu

SEQ ID NO: 2039911 - RNA, 21 nt, Human herpesvirus 6
acauguucuuuauuaaauguu

SEQ ID NO: 2039912 - RNA, 19 nt, Human herpesvirus 6
auacauuuccaugcauauc

SEQ ID NO: 2039913 - RNA, 20 nt, Human herpesvirus 6
gaaacggcgcggagcccaag

SEQ ID NO: 2039914 - RNA, 17 nt, Human herpesvirus 6
ggagcacacacgccgac

SEQ ID NO: 2039915 - RNA, 17 nt, Human herpesvirus 6
gaaauaaaguuuaaaga

SEQ ID NO: 2039916 - RNA, 16 nt, Human herpesvirus 6
gauguauggagauguu

SEQ ID NO: 2039917 - RNA, 23 nt, Human herpesvirus 6
uuaaagaguuuucucacacccau

SEQ ID NO: 2039918 - RNA, 21 nt, Human herpesvirus 6
cuaacggggcaaccgcaguuc

SEQ ID NO: 2039919 - RNA, 17 nt, Human herpesvirus 6
uuuuugucggauuuaaa

SEQ ID NO: 2039920 - RNA, 19 nt, Human herpesvirus 6
uugauuauauauuugcaua

SEQ ID NO: 2039921 - RNA, 14 nt, Human herpesvirus 6
agcuagagugacau

SEQ ID NO: 2039922 - RNA, 23 nt, Human herpesvirus 6
gccgccguccuauucagaggugc

SEQ ID NO: 2039923 - RNA, 13 nt, Human herpesvirus 6
uuaauccacugca

SEQ ID NO: 2039924 - RNA, 21 nt, Human herpesvirus 6
ugaucugauucgacaaaucau

SEQ ID NO: 2039925 - RNA, 23 nt, Human herpesvirus 6
agccucgacguccaccuggaaaa

SEQ ID NO: 2039926 - RNA, 23 nt, Human herpesvirus 6
ggccauauuaggcugcagcccca

SEQ ID NO: 2039927 - RNA, 16 nt, Human herpesvirus 6
cacgcauagacaaacc

SEQ ID NO: 2039928 - RNA, 13 nt, Human herpesvirus 6
auuucuuguugag

SEQ ID NO: 2039929 - RNA, 16 nt, Human herpesvirus 6
uuccccagcuguguuu

SEQ ID NO: 2039930 - RNA, 22 nt, Human herpesvirus 6
auuggcgucuaguaccuguagc

SEQ ID NO: 2039931 - RNA, 14 nt, Human herpesvirus 6
acggaccgagagcc

SEQ ID NO: 2039932 - RNA, 20 nt, Human herpesvirus 6
cugggacccacgguggccug

SEQ ID NO: 2039933 - RNA, 17 nt, Human herpesvirus 6
gcaggauaauuuaugga

SEQ ID NO: 2039934 - RNA, 23 nt, Human herpesvirus 6
ggcaaccugaaacuccccagaga

SEQ ID NO: 2039935 - RNA, 17 nt, Human herpesvirus 6
gacaaaaccuaaauaca

SEQ ID NO: 2039936 - RNA, 16 nt, Human herpesvirus 6
cgccacugcgaggcca

SEQ ID NO: 2039937 - RNA, 23 nt, Human herpesvirus 6
acacagaugguuuuaagagcaga

SEQ ID NO: 2039938 - RNA, 20 nt, Human herpesvirus 6
uguuugggagaacugaggac

SEQ ID NO: 2039939 - RNA, 11 nt, Human herpesvirus 6
cuccaauaaaa

SEQ ID NO: 2039940 - RNA, 13 nt, Human herpesvirus 6
aaacggccaaccu

SEQ ID NO: 2039941 - RNA, 18 nt, Human herpesvirus 6
cuuuccugcacaggcgaa

SEQ ID NO: 2039942 - RNA, 18 nt, Human herpesvirus 6
acgaaagcaguuuuacau

SEQ ID NO: 2039943 - RNA, 15 nt, Human herpesvirus 6
ggccguucucucucc

SEQ ID NO: 2039944 - RNA, 20 nt, Human herpesvirus 6
ggaucgacgggcaggaauca

SEQ ID NO: 2039945 - RNA, 19 nt, Human herpesvirus 6
uagccuauuaagcagccgc

SEQ ID NO: 2039946 - RNA, 18 nt, Human herpesvirus 6
gaagauuuguaaggacaa

SEQ ID NO: 2039947 - RNA, 22 nt, Human herpesvirus 6
auuuggaagcgaaucgcuuaaa

SEQ ID NO: 2039948 - RNA, 13 nt, Human herpesvirus 6
caaagaaacagua

SEQ ID NO: 2039949 - RNA, 20 nt, Human herpesvirus 6
auuaccaccagaaaaguaua

SEQ ID NO: 2039950 - RNA, 14 nt, Human herpesvirus 6
cuuacagagcuuuu

SEQ ID NO: 2039951 - RNA, 13 nt, Human herpesvirus 6
uuuauaaacuuaa

SEQ ID NO: 2039952 - RNA, 23 nt, Human herpesvirus 6
uaagucuuugggaacauguaacu

SEQ ID NO: 2039953 - RNA, 20 nt, Human herpesvirus 6
agacccugccuauacaggca

SEQ ID NO: 2039954 - RNA, 18 nt, Human herpesvirus 6
uaggugauugggagcuca

SEQ ID NO: 2039955 - RNA, 16 nt, Human herpesvirus 6
uuguugaguuucagca

SEQ ID NO: 2039956 - RNA, 15 nt, Human herpesvirus 6
caaaagcgccugccu

SEQ ID NO: 2039957 - RNA, 19 nt, Human herpesvirus 6
ccgcugcggucgccgccuc

SEQ ID NO: 2039958 - RNA, 19 nt, Human herpesvirus 6
caucccuuaaaaaaacaca

SEQ ID NO: 2039959 - RNA, 17 nt, Human herpesvirus 6
gaaacaaccacaaacau

SEQ ID NO: 2039960 - RNA, 17 nt, Human herpesvirus 6
acucauuuuaacauuuu

SEQ ID NO: 2039961 - RNA, 22 nt, Human herpesvirus 6
aguuauacuggcaaagcaaaga

SEQ ID NO: 2039962 - RNA, 17 nt, Human herpesvirus 6
gaagucuucuugggcuc

SEQ ID NO: 2039963 - RNA, 14 nt, Human herpesvirus 6
uccguuuccuccuc

SEQ ID NO: 2039964 - RNA, 18 nt, Human herpesvirus 6
cuccucaacacucucagu

SEQ ID NO: 2039965 - RNA, 20 nt, Human herpesvirus 6
uuccgauacagcaccaucaa

SEQ ID NO: 2039966 - RNA, 13 nt, Human herpesvirus 6
agguguuaaacga

SEQ ID NO: 2039967 - RNA, 20 nt, Human herpesvirus 6
ucuaaaauuguaauuuugaa

SEQ ID NO: 2039968 - RNA, 19 nt, Human herpesvirus 6
uagauuuuauaacgacaaa

SEQ ID NO: 2039969 - RNA, 22 nt, Human herpesvirus 6
ucauaaucugcguuccucucuc

SEQ ID NO: 2039970 - RNA, 15 nt, Human herpesvirus 6
guuaaaacaguaaau

SEQ ID NO: 2039971 - RNA, 16 nt, Human herpesvirus 6
gggaccuucaggaaca

SEQ ID NO: 2039972 - RNA, 19 nt, Human herpesvirus 6
acucgaccccuuuauaaga

SEQ ID NO: 2039973 - RNA, 20 nt, Human herpesvirus 6
gagacagcggacagcggggu

SEQ ID NO: 2039974 - RNA, 15 nt, Human herpesvirus 6
auaagcagaagaguu

SEQ ID NO: 2039975 - RNA, 18 nt, Human herpesvirus 6
agcaaguugcuaccgcug

SEQ ID NO: 2039976 - RNA, 16 nt, Human herpesvirus 6
accuugucaauaaaca

SEQ ID NO: 2039977 - RNA, 18 nt, Human herpesvirus 6
cuuucuaagacgagaugu

SEQ ID NO: 2039978 - RNA, 14 nt, Human herpesvirus 6
guugugauuggauc

SEQ ID NO: 2039979 - RNA, 22 nt, Human herpesvirus 6
auaaucugaucgaaauacuucu

SEQ ID NO: 2039980 - RNA, 16 nt, Human herpesvirus 6
uggaugugcacuuucu

SEQ ID NO: 2039981 - RNA, 15 nt, Human herpesvirus 6
uuaauccauauuugg

SEQ ID NO: 2039982 - RNA, 12 nt, Human herpesvirus 6
gcgggaccuggc

SEQ ID NO: 2039983 - RNA, 20 nt, Human herpesvirus 6
uugacauaggaauucuuauu

SEQ ID NO: 2039984 - RNA, 19 nt, Human herpesvirus 6
acauccagaaaagcaaaca

SEQ ID NO: 2039985 - RNA, 17 nt, Human herpesvirus 6
auguagcauacgacaaa

SEQ ID NO: 2039986 - RNA, 22 nt, Human herpesvirus 6
auuugagagcuaauaugaacaa

SEQ ID NO: 2039987 - RNA, 22 nt, Human herpesvirus 6
acucuucggcauaaacagagac

SEQ ID NO: 2039988 - RNA, 15 nt, Human herpesvirus 6
uuugauuuuguacag

SEQ ID NO: 2039989 - RNA, 20 nt, Human herpesvirus 6
auguaguuaaugcugcugcu

SEQ ID NO: 2039990 - RNA, 17 nt, Human herpesvirus 6
uaaaaaccgacuuauau

SEQ ID NO: 2039991 - RNA, 16 nt, Human herpesvirus 6
cgcuccuccccugucc

SEQ ID NO: 2039992 - RNA, 17 nt, Human herpesvirus 6
gcggcaaccgcaguucc

SEQ ID NO: 2039993 - RNA, 21 nt, Human herpesvirus 6
gacaucgagauucuuuaaaga

SEQ ID NO: 2039994 - RNA, 20 nt, Human herpesvirus 6
ugauguggacguucugucug

SEQ ID NO: 2039995 - RNA, 20 nt, Human herpesvirus 6
ccggggacggacagggggau

SEQ ID NO: 2039996 - RNA, 18 nt, Human herpesvirus 6
acucaacugcuaguuuuu

SEQ ID NO: 2039997 - RNA, 23 nt, Human herpesvirus 6
uuuaaaauggauuagugaaaaga

SEQ ID NO: 2039998 - RNA, 12 nt, Human herpesvirus 6
caacggagaaaa

SEQ ID NO: 2039999 - RNA, 20 nt, Human herpesvirus 6
uauaaauccgauagccauac

SEQ ID NO: 2040000 - RNA, 23 nt, Human herpesvirus 6
ccuagacccugccuauacaggca

SEQ ID NO: 2040001 - RNA, 18 nt, Human herpesvirus 6
gcgccggugguaccuguc

SEQ ID NO: 2040002 - RNA, 14 nt, Human herpesvirus 6
ugcauaugucuguu

SEQ ID NO: 2040003 - RNA, 12 nt, Human herpesvirus 6
aaaucuggcaac

SEQ ID NO: 2040004 - RNA, 14 nt, Human herpesvirus 6
gcgccauaaaaaua

SEQ ID NO: 2040005 - RNA, 17 nt, Human herpesvirus 6
ugauguauggagauguu

SEQ ID NO: 2040006 - RNA, 20 nt, Human herpesvirus 6
cuugggugugcauugugaca

SEQ ID NO: 2040007 - RNA, 20 nt, Human herpesvirus 6
ucucgugguacaauaaaaac

SEQ ID NO: 2040008 - RNA, 15 nt, Human herpesvirus 6
uacggcagcggacca

SEQ ID NO: 2040009 - RNA, 18 nt, Human herpesvirus 6
acauucguauacuuccuc

SEQ ID NO: 2040010 - RNA, 14 nt, Human herpesvirus 6
cccggaguacacgu

SEQ ID NO: 2040011 - RNA, 16 nt, Human herpesvirus 6
uucgauguuuucaggu

SEQ ID NO: 2040012 - RNA, 20 nt, Human herpesvirus 6
caccggaugucgacuccucc

SEQ ID NO: 2040013 - RNA, 14 nt, Human herpesvirus 6
aucgguggcagagg

SEQ ID NO: 2040014 - RNA, 12 nt, Human herpesvirus 6
uacauauaguca

SEQ ID NO: 2040015 - RNA, 15 nt, Human herpesvirus 6
aagacggaaccauga

SEQ ID NO: 2040016 - RNA, 21 nt, Human herpesvirus 6
cucugaaauuugagaaaguug

SEQ ID NO: 2040017 - RNA, 13 nt, Human herpesvirus 6
aaaaaaauuccca

SEQ ID NO: 2040018 - RNA, 13 nt, Human herpesvirus 6
aucgauuuaaccu

SEQ ID NO: 2040019 - RNA, 19 nt, Human herpesvirus 6
auaaucgauuacaaaacaa

SEQ ID NO: 2040020 - RNA, 22 nt, Human herpesvirus 6
agcgacuuuuuaacaaaauggu

SEQ ID NO: 2040021 - RNA, 17 nt, Human herpesvirus 6
cggauccaacucgacua

SEQ ID NO: 2040022 - RNA, 17 nt, Human herpesvirus 6
uguaaauaaacaccagc

SEQ ID NO: 2040023 - RNA, 11 nt, Human herpesvirus 6
uaaaauuaaag

SEQ ID NO: 2040024 - RNA, 21 nt, Human herpesvirus 6
caaaaagcuuuaaagcagcua

SEQ ID NO: 2040025 - RNA, 16 nt, Human herpesvirus 6
cagaccacaccccugu

SEQ ID NO: 2040026 - RNA, 18 nt, Human herpesvirus 6
acuuuugcuuagucugua

SEQ ID NO: 2040027 - RNA, 20 nt, Human herpesvirus 6
uucgggacaaaaccgaggca

SEQ ID NO: 2040028 - RNA, 23 nt, Human herpesvirus 6
auuucuagcgaucauaaaacugc

SEQ ID NO: 2040029 - RNA, 14 nt, Human herpesvirus 6
cauagcagcaauag

SEQ ID NO: 2040030 - RNA, 14 nt, Human herpesvirus 6
uuuauaugcaggua

SEQ ID NO: 2040031 - RNA, 18 nt, Human herpesvirus 6
gaccugaucacagagaaa

SEQ ID NO: 2040032 - RNA, 17 nt, Human herpesvirus 6
acuuuguccuuacaaau

SEQ ID NO: 2040033 - RNA, 15 nt, Human herpesvirus 6
cauaacggaaaaaug

SEQ ID NO: 2040034 - RNA, 14 nt, Human herpesvirus 6
cagguggagcugug

SEQ ID NO: 2040035 - RNA, 15 nt, Human herpesvirus 6
uaggauuagaacaau

SEQ ID NO: 2040036 - RNA, 10 nt, Human herpesvirus 6
gccaaaauau

SEQ ID NO: 2040037 - RNA, 18 nt, Human herpesvirus 6
cauauauuggcaugugaa

SEQ ID NO: 2040038 - RNA, 11 nt, Human herpesvirus 6
aacaaguaaau

SEQ ID NO: 2040039 - RNA, 11 nt, Human herpesvirus 6
aaaaaaaaugu

SEQ ID NO: 2040040 - RNA, 22 nt, Human herpesvirus 6
ucucuguguguguugugcgcua

SEQ ID NO: 2040041 - RNA, 19 nt, Human herpesvirus 6
acguaagaaaaaaaacgaa

SEQ ID NO: 2040042 - RNA, 12 nt, Human herpesvirus 6
uuugaacuuuuu

SEQ ID NO: 2040043 - RNA, 14 nt, Human herpesvirus 6
gaaccaccagagac

SEQ ID NO: 2040044 - RNA, 12 nt, Human herpesvirus 6
cugauggaaacc

SEQ ID NO: 2040045 - RNA, 14 nt, Human herpesvirus 6
ucuaaacacagaug

SEQ ID NO: 2040046 - RNA, 18 nt, Human herpesvirus 6
ucgcccgauccgccccga

SEQ ID NO: 2040047 - RNA, 20 nt, Human herpesvirus 6
uauuguuaacauguacaaac

SEQ ID NO: 2040048 - RNA, 18 nt, Human herpesvirus 6
gaagaauuuauguucagc

SEQ ID NO: 2040049 - RNA, 17 nt, Human herpesvirus 6
ggcgacaaccgccgccg

SEQ ID NO: 2040050 - RNA, 19 nt, Human herpesvirus 6
uuguguuaaucggaauguc

SEQ ID NO: 2040051 - RNA, 20 nt, Human herpesvirus 6
gaauacgaggaggggagacg

SEQ ID NO: 2040052 - RNA, 15 nt, Human herpesvirus 6
uauccgcccuccccg

SEQ ID NO: 2040053 - RNA, 17 nt, Human herpesvirus 6
ggcagaucuaucacagg

SEQ ID NO: 2040054 - RNA, 19 nt, Human herpesvirus 6
gggcaaccgcaguuccugu

SEQ ID NO: 2040055 - RNA, 19 nt, Human herpesvirus 6
cccucgguccaaccccucc

SEQ ID NO: 2040056 - RNA, 14 nt, Human herpesvirus 6
cuuuaaagcagcua

SEQ ID NO: 2040057 - RNA, 20 nt, Human herpesvirus 6
cucgguccaaccccucccau

SEQ ID NO: 2040058 - RNA, 16 nt, Human herpesvirus 6
aaugagauguucuaaa

SEQ ID NO: 2040059 - RNA, 14 nt, Human herpesvirus 6
uaagcaaaaacaga

SEQ ID NO: 2040060 - RNA, 22 nt, Human herpesvirus 6
aacaccaauaaaauuuuuugca

SEQ ID NO: 2040061 - RNA, 15 nt, Human herpesvirus 6
gaaucauggugucuu

SEQ ID NO: 2040062 - RNA, 15 nt, Human herpesvirus 6
uauacggaaaagaug

SEQ ID NO: 2040063 - RNA, 21 nt, Human herpesvirus 6
cuauaaaaaauuucaaacugg

SEQ ID NO: 2040064 - RNA, 17 nt, Human herpesvirus 6
acauuuauaaaaggagu

SEQ ID NO: 2040065 - RNA, 12 nt, Human herpesvirus 6
uaacggagcccg

SEQ ID NO: 2040066 - RNA, 22 nt, Human herpesvirus 6
aaacaagauccaaucacaacaa

SEQ ID NO: 2040067 - RNA, 16 nt, Human herpesvirus 6
ugcagaacaucucaga

SEQ ID NO: 2040068 - RNA, 19 nt, Human herpesvirus 6
uguacaauauaauuucuua

SEQ ID NO: 2040069 - RNA, 16 nt, Human herpesvirus 6
gccgcugcggucgccg

SEQ ID NO: 2040070 - RNA, 14 nt, Human herpesvirus 6
uauaaaaaacugca

SEQ ID NO: 2040071 - RNA, 22 nt, Human herpesvirus 6
auuaaaugugaacauuauaaau

SEQ ID NO: 2040072 - RNA, 15 nt, Human herpesvirus 6
acaaauuuuaaaugc

SEQ ID NO: 2040073 - RNA, 12 nt, Human herpesvirus 6
cuccucaacacu

SEQ ID NO: 2040074 - RNA, 16 nt, Human herpesvirus 6
uugugauucugcauuu

SEQ ID NO: 2040075 - RNA, 12 nt, Human herpesvirus 6
ugucggccucug

SEQ ID NO: 2040076 - RNA, 17 nt, Human herpesvirus 6
agaaccugaaaucugag

SEQ ID NO: 2040077 - RNA, 17 nt, Human herpesvirus 6
uugaugaaauugugacu

SEQ ID NO: 2040078 - RNA, 17 nt, Human herpesvirus 6
cggaacaaggccaaacc

SEQ ID NO: 2040079 - RNA, 17 nt, Human herpesvirus 6
acauaguggcuaugaag

SEQ ID NO: 2040080 - RNA, 14 nt, Human herpesvirus 6
ucaaaaaaauuccc

SEQ ID NO: 2040081 - RNA, 12 nt, Human herpesvirus 6
uaccuguacaag

SEQ ID NO: 2040082 - RNA, 13 nt, Human herpesvirus 6
ccacgguggccug

SEQ ID NO: 2040083 - RNA, 23 nt, Human herpesvirus 6
uucaucaaucacucccuguuuuu

SEQ ID NO: 2040084 - RNA, 14 nt, Human herpesvirus 6
acucucucaguaau

SEQ ID NO: 2040085 - RNA, 14 nt, Human herpesvirus 6
ccuaccauguugcu

SEQ ID NO: 2040086 - RNA, 23 nt, Human herpesvirus 6
aggggcgcgagacagcggacagc

SEQ ID NO: 2040087 - RNA, 19 nt, Human herpesvirus 6
guggacguucugucugcag

SEQ ID NO: 2040088 - RNA, 19 nt, Human herpesvirus 6
uugggaccuucaggaacaa

SEQ ID NO: 2040089 - RNA, 13 nt, Human herpesvirus 6
acugauggcaggu

SEQ ID NO: 2040090 - RNA, 13 nt, Human herpesvirus 6
auaauauuuccau

SEQ ID NO: 2040091 - RNA, 21 nt, Human herpesvirus 6
uuauuagggauacguauauug

SEQ ID NO: 2040092 - RNA, 17 nt, Human herpesvirus 6
aucuauugucgaagaac

SEQ ID NO: 2040093 - RNA, 22 nt, Human herpesvirus 6
uccacucggauucaaagaaagu

SEQ ID NO: 2040094 - RNA, 12 nt, Human herpesvirus 6
acacaggacacg

SEQ ID NO: 2040095 - RNA, 20 nt, Human herpesvirus 6
gaaucaugagagccuucagu

SEQ ID NO: 2040096 - RNA, 20 nt, Human herpesvirus 6
uuuuaaccggaaaaaugaaa

SEQ ID NO: 2040097 - RNA, 16 nt, Human herpesvirus 6
ugaaaauaucauuaaa

SEQ ID NO: 2040098 - RNA, 16 nt, Human herpesvirus 6
gucuuuccugcacagg

SEQ ID NO: 2040099 - RNA, 20 nt, Human herpesvirus 6
ugauagcgucuuugcauauu

SEQ ID NO: 2040100 - RNA, 13 nt, Human herpesvirus 6
gucugugauuuua

SEQ ID NO: 2040101 - RNA, 15 nt, Human herpesvirus 6
gugauuccaguuaau

SEQ ID NO: 2040102 - RNA, 16 nt, Human herpesvirus 6
gccuggcacggugcca

SEQ ID NO: 2040103 - RNA, 21 nt, Human herpesvirus 6
auaauuuuauuaacuguaaaa

SEQ ID NO: 2040104 - RNA, 19 nt, Human herpesvirus 6
uauuuuuuuuuuauuuaca

SEQ ID NO: 2040105 - RNA, 16 nt, Human herpesvirus 6
cugccuauacaggcaa

SEQ ID NO: 2040106 - RNA, 22 nt, Human herpesvirus 6
uucaggcggaauguuuguuuuu

SEQ ID NO: 2040107 - RNA, 17 nt, Human herpesvirus 6
augcggacucugacgaa

SEQ ID NO: 2040108 - RNA, 15 nt, Human herpesvirus 6
gaacaucucagaucu

SEQ ID NO: 2040109 - RNA, 14 nt, Human herpesvirus 6
auugugacaaggaa

SEQ ID NO: 2040110 - RNA, 13 nt, Human herpesvirus 6
uguuuuguaugaa

SEQ ID NO: 2040111 - RNA, 17 nt, Human herpesvirus 6
uuugccaaaauaugcua

SEQ ID NO: 2040112 - RNA, 17 nt, Human herpesvirus 6
cauauuaggcugcagcc

SEQ ID NO: 2040113 - RNA, 15 nt, Human herpesvirus 6
acaacaaguaaauuc

SEQ ID NO: 2040114 - RNA, 18 nt, Human herpesvirus 6
cuuuucauaugaaaagcu

SEQ ID NO: 2040115 - RNA, 16 nt, Human herpesvirus 6
aauaauggcaugcauu

SEQ ID NO: 2040116 - RNA, 15 nt, Human herpesvirus 6
gcacaaaccaaaaug

SEQ ID NO: 2040117 - RNA, 23 nt, Human herpesvirus 6
caagaaaucauuuugaaaugucg

SEQ ID NO: 2040118 - RNA, 18 nt, Human herpesvirus 6
ggcccagagacgguguuu

SEQ ID NO: 2040119 - RNA, 21 nt, Human herpesvirus 6
ccgcgguuuggggucuuuccu

SEQ ID NO: 2040120 - RNA, 18 nt, Human herpesvirus 6
gugacuuauauauauauc

SEQ ID NO: 2040121 - RNA, 17 nt, Human herpesvirus 6
uaccacacgcuuacaca

SEQ ID NO: 2040122 - RNA, 23 nt, Human herpesvirus 6
gaucuaaauuucuacaaaaauac

SEQ ID NO: 2040123 - RNA, 17 nt, Human herpesvirus 6
cugcaugguccacagau

SEQ ID NO: 2040124 - RNA, 20 nt, Human herpesvirus 6
ugcaauuguuugugaugggu

SEQ ID NO: 2040125 - RNA, 16 nt, Human herpesvirus 6
gggucuuuccugccca

SEQ ID NO: 2040126 - RNA, 15 nt, Human herpesvirus 6
cuuaccauauauugg

SEQ ID NO: 2040127 - RNA, 18 nt, Human herpesvirus 6
agucccaucuauacaccc

SEQ ID NO: 2040128 - RNA, 20 nt, Human herpesvirus 6
ucaaugcguuggagcaagcg

SEQ ID NO: 2040129 - RNA, 19 nt, Human herpesvirus 6
cugggacccacgguggccu

SEQ ID NO: 2040130 - RNA, 22 nt, Human herpesvirus 6
gcaaucgaugugacaaaucugu

SEQ ID NO: 2040131 - RNA, 23 nt, Human herpesvirus 6
aacucauguugccucuggacacg

SEQ ID NO: 2040132 - RNA, 15 nt, Human herpesvirus 6
acuguguguugaaug

SEQ ID NO: 2040133 - RNA, 12 nt, Human herpesvirus 6
uaauguccagug

SEQ ID NO: 2040134 - RNA, 13 nt, Human herpesvirus 6
agaugccuguagg

SEQ ID NO: 2040135 - RNA, 23 nt, Human herpesvirus 6
uaugaauucguuacaaucucugu

SEQ ID NO: 2040136 - RNA, 13 nt, Human herpesvirus 6
uagacuuggugau

SEQ ID NO: 2040137 - RNA, 13 nt, Human herpesvirus 6
cagaccacacccc

SEQ ID NO: 2040138 - RNA, 15 nt, Human herpesvirus 6
gcuaggcagaucauc

SEQ ID NO: 2040139 - RNA, 17 nt, Human herpesvirus 6
aguucuaugucuagaug

SEQ ID NO: 2040140 - RNA, 15 nt, Human herpesvirus 6
cacaagcguacacua

SEQ ID NO: 2040141 - RNA, 14 nt, Human herpesvirus 6
uccagacaauaauc

SEQ ID NO: 2040142 - RNA, 16 nt, Human herpesvirus 6
gaacaggcggaagaac

SEQ ID NO: 2040143 - RNA, 13 nt, Human herpesvirus 6
uuccugcccaggc

SEQ ID NO: 2040144 - RNA, 11 nt, Human herpesvirus 6
ccugcacaggc

SEQ ID NO: 2040145 - RNA, 19 nt, Human herpesvirus 6
gaaaccaccggcuaacccu

SEQ ID NO: 2040146 - RNA, 20 nt, Human herpesvirus 6
gaccuggccgaguuuggaca

SEQ ID NO: 2040147 - RNA, 13 nt, Human herpesvirus 6
uugauaguacuua

SEQ ID NO: 2040148 - RNA, 18 nt, Human herpesvirus 6
acggugucacacagcaug

SEQ ID NO: 2040149 - RNA, 19 nt, Human herpesvirus 6
caccaccgcugacaaccuc

SEQ ID NO: 2040150 - RNA, 21 nt, Human herpesvirus 6
guuauaacacaacaaguaaau

SEQ ID NO: 2040151 - RNA, 21 nt, Human herpesvirus 6
cagcucaaacaaauggaaacu

SEQ ID NO: 2040152 - RNA, 18 nt, Human herpesvirus 6
uguugaguaauugaacau

SEQ ID NO: 2040153 - RNA, 14 nt, Human herpesvirus 6
agagaugaaagaca

SEQ ID NO: 2040154 - RNA, 13 nt, Human herpesvirus 6
aagaucagugggu

SEQ ID NO: 2040155 - RNA, 17 nt, Human herpesvirus 6
uuucgacaauccuaauu

SEQ ID NO: 2040156 - RNA, 19 nt, Human herpesvirus 6
uaaaauuaugccacaccca

SEQ ID NO: 2040157 - RNA, 22 nt, Human herpesvirus 6
gaauuucgucuccugggagcuc

SEQ ID NO: 2040158 - RNA, 15 nt, Human herpesvirus 6
augaacuacugagug

SEQ ID NO: 2040159 - RNA, 18 nt, Human herpesvirus 6
uauuuucgguguguauuu

SEQ ID NO: 2040160 - RNA, 14 nt, Human herpesvirus 6
cuuauauaggcacc

SEQ ID NO: 2040161 - RNA, 15 nt, Human herpesvirus 6
uaacccuaacccuaa

SEQ ID NO: 2040162 - RNA, 21 nt, Human herpesvirus 6
caaacuuuuugccgucacacu

SEQ ID NO: 2040163 - RNA, 20 nt, Human herpesvirus 6
uuauucggaguuuucaagau

SEQ ID NO: 2040164 - RNA, 19 nt, Human herpesvirus 6
aaacagacuuuacuucuac

SEQ ID NO: 2040165 - RNA, 13 nt, Human herpesvirus 6
uauauauuugcau

SEQ ID NO: 2040166 - RNA, 16 nt, Human herpesvirus 6
auuguuaacauguaca

SEQ ID NO: 2040167 - RNA, 15 nt, Human herpesvirus 6
cgauucagaccucau

SEQ ID NO: 2040168 - RNA, 17 nt, Human herpesvirus 6
uagauggaaaauugcaa

SEQ ID NO: 2040169 - RNA, 20 nt, Human herpesvirus 6
gaucugauucgacaaaucau

SEQ ID NO: 2040170 - RNA, 24 nt, Human herpesvirus 6
ccaucuaucgcgcaccgcuguggc

SEQ ID NO: 2040171 - RNA, 14 nt, Human herpesvirus 6
cucgaagccucgac

SEQ ID NO: 2040172 - RNA, 17 nt, Human herpesvirus 6
aggacgggaagaacagg

SEQ ID NO: 2040173 - RNA, 17 nt, Human herpesvirus 6
gcuauuuuuuuuaaugu

SEQ ID NO: 2040174 - RNA, 16 nt, Human herpesvirus 6
uuaaagaaucugcaga

SEQ ID NO: 2040175 - RNA, 11 nt, Human herpesvirus 6
ugcauacauaa

SEQ ID NO: 2040176 - RNA, 23 nt, Human herpesvirus 6
agccuguccgugacacacagaau

SEQ ID NO: 2040177 - RNA, 17 nt, Human herpesvirus 6
auuucuuacuaggaaag

SEQ ID NO: 2040178 - RNA, 12 nt, Human herpesvirus 6
cgauacccagcg

SEQ ID NO: 2040179 - RNA, 17 nt, Human herpesvirus 6
accccucccaucccccu

SEQ ID NO: 2040180 - RNA, 16 nt, Human herpesvirus 6
gaaaugaucaauacau

SEQ ID NO: 2040181 - RNA, 15 nt, Human herpesvirus 6
uaggaaguaaauaca

SEQ ID NO: 2040182 - RNA, 16 nt, Human herpesvirus 6
aguaacggaaaaauuu

SEQ ID NO: 2040183 - RNA, 16 nt, Human herpesvirus 6
caaauuacaaucaugu

SEQ ID NO: 2040184 - RNA, 19 nt, Human herpesvirus 6
aucuacugcaguccagaag

SEQ ID NO: 2040185 - RNA, 12 nt, Human herpesvirus 6
gccaaaggaaac

SEQ ID NO: 2040186 - RNA, 18 nt, Human herpesvirus 6
cgagaacucuaaaagcug

SEQ ID NO: 2040187 - RNA, 18 nt, Human herpesvirus 6
auaaguacauagaauuuc

SEQ ID NO: 2040188 - RNA, 21 nt, Human herpesvirus 6
uucauaaagauaaagaucagu

SEQ ID NO: 2040189 - RNA, 18 nt, Human herpesvirus 6
auuuucaaauuuauuugu

SEQ ID NO: 2040190 - RNA, 13 nt, Human herpesvirus 6
gaaugagauguuc

SEQ ID NO: 2040191 - RNA, 20 nt, Human herpesvirus 6
aucaucucgugcaaaagcug

SEQ ID NO: 2040192 - RNA, 23 nt, Human herpesvirus 6
aacauaaaacaacaacaauaaca

SEQ ID NO: 2040193 - RNA, 14 nt, Human herpesvirus 6
caggcaaacgagaa

SEQ ID NO: 2040194 - RNA, 23 nt, Human herpesvirus 6
gagacaccagccgguagagagug

SEQ ID NO: 2040195 - RNA, 13 nt, Human herpesvirus 6
cgucugggaccca

SEQ ID NO: 2040196 - RNA, 18 nt, Human herpesvirus 6
agcggaagugaaagcagu

SEQ ID NO: 2040197 - RNA, 20 nt, Human herpesvirus 6
ggguuggaccgaggggacag

SEQ ID NO: 2040198 - RNA, 14 nt, Human herpesvirus 6
gugacaucuuuuau

SEQ ID NO: 2040199 - RNA, 17 nt, Human herpesvirus 6
ugcagaucuaauucaca

SEQ ID NO: 2040200 - RNA, 19 nt, Human herpesvirus 6
gucuaucgcaaauucucuc

SEQ ID NO: 2040201 - RNA, 16 nt, Human herpesvirus 6
agggcggacggacggc

SEQ ID NO: 2040202 - RNA, 13 nt, Human herpesvirus 6
agacgagauguuu

SEQ ID NO: 2040203 - RNA, 17 nt, Human herpesvirus 6
acaaagaaucaaugaaa

SEQ ID NO: 2040204 - RNA, 13 nt, Human herpesvirus 6
uuuacugugauuu

SEQ ID NO: 2040205 - RNA, 22 nt, Human herpesvirus 6
cugcacaggcgaacgagaacuc

SEQ ID NO: 2040206 - RNA, 16 nt, Human herpesvirus 6
uucaauaaaaacucaa

SEQ ID NO: 2040207 - RNA, 18 nt, Human herpesvirus 6
cgaccugaucacagagaa

SEQ ID NO: 2040208 - RNA, 16 nt, Human herpesvirus 6
guauucagaguacuuu

SEQ ID NO: 2040209 - RNA, 20 nt, Human herpesvirus 6
aagccucgacguccaccugg

SEQ ID NO: 2040210 - RNA, 15 nt, Human herpesvirus 6
aacggagagcuuguu

SEQ ID NO: 2040211 - RNA, 20 nt, Human herpesvirus 6
auuucagguucuucaaaaaa

SEQ ID NO: 2040212 - RNA, 12 nt, Human herpesvirus 6
agcaucucaaaa

SEQ ID NO: 2040213 - RNA, 16 nt, Human herpesvirus 6
auggaggaauggaaaa

SEQ ID NO: 2040214 - RNA, 12 nt, Human herpesvirus 6
gaaugagauguu

SEQ ID NO: 2040215 - RNA, 13 nt, Human herpesvirus 6
caagaacagagag

SEQ ID NO: 2040216 - RNA, 14 nt, Human herpesvirus 6
acguauccucagaa

SEQ ID NO: 2040217 - RNA, 16 nt, Human herpesvirus 6
auuuuaccuuuggaaa

SEQ ID NO: 2040218 - RNA, 22 nt, Human herpesvirus 6
cgacaucgcgcgcgacgugcca

SEQ ID NO: 2040219 - RNA, 16 nt, Human herpesvirus 6
uuguacaaacuuuuug

SEQ ID NO: 2040220 - RNA, 14 nt, Human herpesvirus 6
acgauagcagcucu

SEQ ID NO: 2040221 - RNA, 15 nt, Human herpesvirus 6
aaguuucagagguuu

SEQ ID NO: 2040222 - RNA, 15 nt, Human herpesvirus 6
augaagauuugacau

SEQ ID NO: 2040223 - RNA, 16 nt, Human herpesvirus 6
ucuggugaauguuucu

SEQ ID NO: 2040224 - RNA, 15 nt, Human herpesvirus 6
gacuuggagagaacu

SEQ ID NO: 2040225 - RNA, 15 nt, Human herpesvirus 6
gacaaccuccgcaua

SEQ ID NO: 2040226 - RNA, 14 nt, Human herpesvirus 6
cguuaaaaaaaaug

SEQ ID NO: 2040227 - RNA, 22 nt, Human herpesvirus 6
gaugacagcgauacaauaacaa

SEQ ID NO: 2040228 - RNA, 20 nt, Human herpesvirus 6
cugucgaguaauuguggauu

SEQ ID NO: 2040229 - RNA, 18 nt, Human herpesvirus 6
cugggacccacgguggcc

SEQ ID NO: 2040230 - RNA, 19 nt, Human herpesvirus 6
aaguuggggucucaugacu

SEQ ID NO: 2040231 - RNA, 17 nt, Human herpesvirus 6
gagaggcucuaugaaga

SEQ ID NO: 2040232 - RNA, 15 nt, Human herpesvirus 6
acaggggaggagcgu

SEQ ID NO: 2040233 - RNA, 19 nt, Human herpesvirus 6
ggaggccuucaugagccag

SEQ ID NO: 2040234 - RNA, 20 nt, Human herpesvirus 6
auuuguaaaaaaacauucua

SEQ ID NO: 2040235 - RNA, 18 nt, Human herpesvirus 6
caguuucucgaaaaaaca

SEQ ID NO: 2040236 - RNA, 23 nt, Human herpesvirus 6
ucaacauuaaaaaaaauagcaga

SEQ ID NO: 2040237 - RNA, 16 nt, Human herpesvirus 6
acccgcguccuccauc

SEQ ID NO: 2040238 - RNA, 17 nt, Human herpesvirus 6
agaccguagcaaaauuc

SEQ ID NO: 2040239 - RNA, 17 nt, Human herpesvirus 6
guccucuuugaauuuua

SEQ ID NO: 2040240 - RNA, 14 nt, Human herpesvirus 6
cacguacuauuuuu

SEQ ID NO: 2040241 - RNA, 22 nt, Human herpesvirus 6
augaaaauaucauuaaauuguu

SEQ ID NO: 2040242 - RNA, 13 nt, Human herpesvirus 6
auugcgauucuaa

SEQ ID NO: 2040243 - RNA, 16 nt, Human herpesvirus 6
cagcacauaacugcau

SEQ ID NO: 2040244 - RNA, 11 nt, Human herpesvirus 6
aaauggcucag

SEQ ID NO: 2040245 - RNA, 19 nt, Human herpesvirus 6
cagcggaagugaaagcagu

SEQ ID NO: 2040246 - RNA, 20 nt, Human herpesvirus 6
ugacggcgacaaccgccgcc

SEQ ID NO: 2040247 - RNA, 11 nt, Human herpesvirus 6
acagauugcau

SEQ ID NO: 2040248 - RNA, 15 nt, Human herpesvirus 6
gugcuuuuaaaauua

SEQ ID NO: 2040249 - RNA, 22 nt, Human herpesvirus 6
ugugauucugcauuuauaucaa

SEQ ID NO: 2040250 - RNA, 15 nt, Human herpesvirus 6
gacccacgguggccu

SEQ ID NO: 2040251 - RNA, 13 nt, Human herpesvirus 6
gcgauuuaaacaa

SEQ ID NO: 2040252 - RNA, 14 nt, Human herpesvirus 6
gccugaaaaugaag

SEQ ID NO: 2040253 - RNA, 19 nt, Human herpesvirus 6
aaagucguuuuggagaaau

SEQ ID NO: 2040254 - RNA, 20 nt, Human herpesvirus 6
cagaagagaugaaagacaga

SEQ ID NO: 2040255 - RNA, 19 nt, Human herpesvirus 6
uugauaaugauauaguuuu

SEQ ID NO: 2040256 - RNA, 21 nt, Human herpesvirus 6
uagcagaaguuuacauagaaa

SEQ ID NO: 2040257 - RNA, 13 nt, Human herpesvirus 6
gugaauauaucaa

SEQ ID NO: 2040258 - RNA, 22 nt, Human herpesvirus 6
acagcacuuugcgcccauaccu

SEQ ID NO: 2040259 - RNA, 13 nt, Human herpesvirus 6
ccacagcagcagc

SEQ ID NO: 2040260 - RNA, 15 nt, Human herpesvirus 6
ucggcugacaacaaa

SEQ ID NO: 2040261 - RNA, 14 nt, Human herpesvirus 6
auaauuaugcauuu

SEQ ID NO: 2040262 - RNA, 22 nt, Human herpesvirus 6
ugucuauuuuuaaaccuguugu

SEQ ID NO: 2040263 - RNA, 22 nt, Human herpesvirus 6
aacaugagggacucggaaaagg

SEQ ID NO: 2040264 - RNA, 20 nt, Human herpesvirus 6
ccgguguuuagccuuuauuc

SEQ ID NO: 2040265 - RNA, 17 nt, Human herpesvirus 6
caguucguagaacggaa

SEQ ID NO: 2040266 - RNA, 21 nt, Human herpesvirus 6
cagagagaggagcauucacau

SEQ ID NO: 2040267 - RNA, 18 nt, Human herpesvirus 6
uuuccgaaaucaaugagu

SEQ ID NO: 2040268 - RNA, 13 nt, Human herpesvirus 6
ugugucaugauua

SEQ ID NO: 2040269 - RNA, 16 nt, Human herpesvirus 6
cgcggccguucucucu

SEQ ID NO: 2040270 - RNA, 18 nt, Human herpesvirus 6
uggcagaggggaagggaa

SEQ ID NO: 2040271 - RNA, 13 nt, Human herpesvirus 6
gaauagagauuuu

SEQ ID NO: 2040272 - RNA, 15 nt, Human herpesvirus 6
cugcggucgccgccu

SEQ ID NO: 2040273 - RNA, 15 nt, Human herpesvirus 6
gccaacgaaaagcau

SEQ ID NO: 2040274 - RNA, 15 nt, Human herpesvirus 6
auuuuuuauuuccac

SEQ ID NO: 2040275 - RNA, 23 nt, Human herpesvirus 6
ggguuggaccgaggggacagggg

SEQ ID NO: 2040276 - RNA, 22 nt, Human herpesvirus 6
ucucggaaaauuaaaagucagu

SEQ ID NO: 2040277 - RNA, 13 nt, Human herpesvirus 6
aaaguucaguaac

SEQ ID NO: 2040278 - RNA, 14 nt, Human herpesvirus 6
uuacauauagucaa

SEQ ID NO: 2040279 - RNA, 17 nt, Human herpesvirus 6
augcaacgcaucacaca

SEQ ID NO: 2040280 - RNA, 22 nt, Human herpesvirus 6
auguucgaugauuauucugucu

SEQ ID NO: 2040281 - RNA, 24 nt, Human herpesvirus 6
uugcauuuuggguugaguaugcuu

SEQ ID NO: 2040282 - RNA, 17 nt, Human herpesvirus 6
cgcuaucgcccugcucc

SEQ ID NO: 2040283 - RNA, 21 nt, Human herpesvirus 6
gagaucuggugaauguuucug

SEQ ID NO: 2040284 - RNA, 15 nt, Human herpesvirus 6
acccacgguggccug

SEQ ID NO: 2040285 - RNA, 16 nt, Human herpesvirus 6
acguggcagucugcuc

SEQ ID NO: 2040286 - RNA, 20 nt, Human herpesvirus 6
aaaguuuguguuuguaaaug

SEQ ID NO: 2040287 - RNA, 21 nt, Human herpesvirus 6
cagguaauauuccgaacgaga

SEQ ID NO: 2040288 - RNA, 13 nt, Human herpesvirus 6
ccgccaccaccgc

SEQ ID NO: 2040289 - RNA, 14 nt, Human herpesvirus 6
agguaacggagccc

SEQ ID NO: 2040290 - RNA, 17 nt, Human herpesvirus 6
ccuauagucaauguugu

SEQ ID NO: 2040291 - RNA, 23 nt, Human herpesvirus 6
ugucgugcgccuuguguaucugu

SEQ ID NO: 2040292 - RNA, 12 nt, Human herpesvirus 6
cgaauauguuuu

SEQ ID NO: 2040293 - RNA, 21 nt, Human herpesvirus 6
guuacaaguuucaauauauga

SEQ ID NO: 2040294 - RNA, 15 nt, Human herpesvirus 6
auuauuaacaaugaa

SEQ ID NO: 2040295 - RNA, 23 nt, Human herpesvirus 6
auauaacgauauauaaaaaacug

SEQ ID NO: 2040296 - RNA, 23 nt, Human herpesvirus 6
auacacugcaagaacugcgacuc

SEQ ID NO: 2040297 - RNA, 20 nt, Human herpesvirus 6
gaaaacucuaaaagcugcua

SEQ ID NO: 2040298 - RNA, 20 nt, Human herpesvirus 6
uguaguuuuuaaauccuguu

SEQ ID NO: 2040299 - RNA, 23 nt, Human herpesvirus 6
augcaagccaugacaagaaaggu

SEQ ID NO: 2040300 - RNA, 23 nt, Human herpesvirus 6
aguuuuuccgauacagcaccauc

SEQ ID NO: 2040301 - RNA, 22 nt, Human herpesvirus 6
caccgagggcggacggacggcu

SEQ ID NO: 2040302 - RNA, 16 nt, Human herpesvirus 6
cuguguuuauguuuca

SEQ ID NO: 2040303 - RNA, 12 nt, Human herpesvirus 6
cauugcuuucuc

SEQ ID NO: 2040304 - RNA, 17 nt, Human herpesvirus 6
uaaaauguguagugguc

SEQ ID NO: 2040305 - RNA, 18 nt, Human herpesvirus 6
cugccucgguuuuguccc

SEQ ID NO: 2040306 - RNA, 14 nt, Human herpesvirus 6
aauuguauucuuga

SEQ ID NO: 2040307 - RNA, 17 nt, Human herpesvirus 6
ggaccgaggggacaggg

SEQ ID NO: 2040308 - RNA, 14 nt, Human herpesvirus 6
cucacaagcugucc

SEQ ID NO: 2040309 - RNA, 19 nt, Human herpesvirus 6
acagaaaaaaaaauaagua

SEQ ID NO: 2040310 - RNA, 17 nt, Human herpesvirus 6
aucuguuggcggaaacg

SEQ ID NO: 2040311 - RNA, 16 nt, Human herpesvirus 6
agagauuuuggaagca

SEQ ID NO: 2040312 - RNA, 13 nt, Human herpesvirus 6
guuuuucauaaau

SEQ ID NO: 2040313 - RNA, 15 nt, Human herpesvirus 6
ugugcgauuuacugg

SEQ ID NO: 2040314 - RNA, 21 nt, Human herpesvirus 6
gugucaguucaacgcugucuu

SEQ ID NO: 2040315 - RNA, 15 nt, Human herpesvirus 6
ugggaaucaugugua

SEQ ID NO: 2040316 - RNA, 13 nt, Human herpesvirus 6
cugcaaaaggugg

SEQ ID NO: 2040317 - RNA, 15 nt, Human herpesvirus 6
aacgauaugucucug

SEQ ID NO: 2040318 - RNA, 14 nt, Human herpesvirus 6
auaaaaaauauuaa

SEQ ID NO: 2040319 - RNA, 22 nt, Human herpesvirus 6
aacaacaucuuaaaagaccacu

SEQ ID NO: 2040320 - RNA, 16 nt, Human herpesvirus 6
acagugauuagaaugu

SEQ ID NO: 2040321 - RNA, 19 nt, Human herpesvirus 6
aguuuuacaucaucgccuu

SEQ ID NO: 2040322 - RNA, 22 nt, Human herpesvirus 6
caaaugauuuuacaaagaccua

SEQ ID NO: 2040323 - RNA, 20 nt, Human herpesvirus 6
auacucaacccaaaaugcaa

SEQ ID NO: 2040324 - RNA, 15 nt, Human herpesvirus 6
cacccauuuccggag

SEQ ID NO: 2040325 - RNA, 15 nt, Human herpesvirus 6
gucauuucaucuauu

SEQ ID NO: 2040326 - RNA, 23 nt, Human herpesvirus 6
uacguuaaauaucuauuuaaaau

SEQ ID NO: 2040327 - RNA, 17 nt, Human herpesvirus 6
cuaagauugugcaguua

SEQ ID NO: 2040328 - RNA, 18 nt, Human herpesvirus 6
gauuauauauuugcauac

SEQ ID NO: 2040329 - RNA, 18 nt, Human herpesvirus 6
auauuggaauugggaagc

SEQ ID NO: 2040330 - RNA, 20 nt, Human herpesvirus 6
auaaugauauaguuuuugcu

SEQ ID NO: 2040331 - RNA, 15 nt, Human herpesvirus 6
uggguacaaugaaaa

SEQ ID NO: 2040332 - RNA, 17 nt, Human herpesvirus 6
gggucuuuccugcacag

SEQ ID NO: 2040333 - RNA, 16 nt, Human herpesvirus 6
aucuuccguacuguaa

SEQ ID NO: 2040334 - RNA, 18 nt, Human herpesvirus 6
aaucugaauuuaaugcaa

SEQ ID NO: 2040335 - RNA, 16 nt, Human herpesvirus 6
uacgaacagaaauuuc

SEQ ID NO: 2040336 - RNA, 20 nt, Human herpesvirus 6
auccuaaauaccaauuccuu

SEQ ID NO: 2040337 - RNA, 24 nt, Human herpesvirus 6
uuuuucucgagcuagagugacauc

SEQ ID NO: 2040338 - RNA, 20 nt, Human herpesvirus 6
agcguuggaaagcuuuaugg

SEQ ID NO: 2040339 - RNA, 22 nt, Human herpesvirus 6
gauccuguaauaguauugucug

SEQ ID NO: 2040340 - RNA, 14 nt, Human herpesvirus 6
auccucucuggaaa

SEQ ID NO: 2040341 - RNA, 15 nt, Human herpesvirus 6
aaacauaaaauguuu

SEQ ID NO: 2040342 - RNA, 22 nt, Human herpesvirus 6
aucuuaccguaaacaaauucuu

SEQ ID NO: 2040343 - RNA, 16 nt, Human herpesvirus 6
cgcaguuucuguuuuu

SEQ ID NO: 2040344 - RNA, 22 nt, Human herpesvirus 6
uccgcaucgggggaacuacaua

SEQ ID NO: 2040345 - RNA, 23 nt, Human herpesvirus 6
cuucccuuuuacaauacacagaa

SEQ ID NO: 2040346 - RNA, 18 nt, Human herpesvirus 6
ucacugucgaaauucacc

SEQ ID NO: 2040347 - RNA, 12 nt, Human herpesvirus 6
guuaauucucau

SEQ ID NO: 2040348 - RNA, 13 nt, Human herpesvirus 6
cuacguucgccuc

SEQ ID NO: 2040349 - RNA, 15 nt, Human herpesvirus 6
cuccugagaagcugg

SEQ ID NO: 2040350 - RNA, 21 nt, Human herpesvirus 6
auuucuuaccuuuuaagagug

SEQ ID NO: 2040351 - RNA, 23 nt, Human herpesvirus 6
ccuucaccugucucugcuuuaug

SEQ ID NO: 2040352 - RNA, 15 nt, Human herpesvirus 6
aaauagcagaaguuu

SEQ ID NO: 2040353 - RNA, 16 nt, Human herpesvirus 6
ccgcauaucgccccca

SEQ ID NO: 2040354 - RNA, 21 nt, Human herpesvirus 6
acgucugcgucgcccccccgc

SEQ ID NO: 2040355 - RNA, 16 nt, Human herpesvirus 6
aauuucuacaaaaaua

SEQ ID NO: 2040356 - RNA, 22 nt, Human herpesvirus 6
acauaguggcuaugaagccuuc

SEQ ID NO: 2040357 - RNA, 13 nt, Human herpesvirus 6
uuuguacacuuua

SEQ ID NO: 2040358 - RNA, 18 nt, Human herpesvirus 6
acgaucgcgaagccuguc

SEQ ID NO: 2040359 - RNA, 18 nt, Human herpesvirus 6
acggcagcggaagugaaa

SEQ ID NO: 2040360 - RNA, 21 nt, Human herpesvirus 6
caugauuaucauagacaaacc

SEQ ID NO: 2040361 - RNA, 15 nt, Human herpesvirus 6
aaugcacuguuugaa

SEQ ID NO: 2040362 - RNA, 14 nt, Human herpesvirus 6
uacaaagugaaaga

SEQ ID NO: 2040363 - RNA, 15 nt, Human herpesvirus 6
aacaauccauguuca

SEQ ID NO: 2040364 - RNA, 15 nt, Human herpesvirus 6
uuuccugcacaggcg

SEQ ID NO: 2040365 - RNA, 13 nt, Human herpesvirus 6
gggcacaaaacag

SEQ ID NO: 2040366 - RNA, 21 nt, Human herpesvirus 6
gggacccacgguggccuggca

SEQ ID NO: 2040367 - RNA, 16 nt, Human herpesvirus 6
aagucgacaaauuaua

SEQ ID NO: 2040368 - RNA, 18 nt, Human herpesvirus 6
ucugauauggcaaauuuu

SEQ ID NO: 2040369 - RNA, 17 nt, Human herpesvirus 6
cuuguguucuaucacau

SEQ ID NO: 2040370 - RNA, 21 nt, Human herpesvirus 6
uguuuuauguuaacaucguga

SEQ ID NO: 2040371 - RNA, 17 nt, Human herpesvirus 6
gaaaagaucaagcaagu

SEQ ID NO: 2040372 - RNA, 17 nt, Human herpesvirus 6
uacaucguuuguugaau

SEQ ID NO: 2040373 - RNA, 14 nt, Human herpesvirus 6
uccguaucacacuu

SEQ ID NO: 2040374 - RNA, 21 nt, Human herpesvirus 6
gccucuacggcaacgcuccuc

SEQ ID NO: 2040375 - RNA, 15 nt, Human herpesvirus 6
auugguuaaaaggaa

SEQ ID NO: 2040376 - RNA, 12 nt, Human herpesvirus 6
aggucagugggu

SEQ ID NO: 2040377 - RNA, 13 nt, Human herpesvirus 6
gcauucgguacuc

SEQ ID NO: 2040378 - RNA, 12 nt, Human herpesvirus 6
uguaauaagaaa

SEQ ID NO: 2040379 - RNA, 13 nt, Human herpesvirus 6
agucacacacagg

SEQ ID NO: 2040380 - RNA, 15 nt, Human herpesvirus 6
uauaucaaacuuuuu

SEQ ID NO: 2040381 - RNA, 23 nt, Human herpesvirus 6
acaagggcagggggggucucugu

SEQ ID NO: 2040382 - RNA, 17 nt, Human herpesvirus 6
uguaagauuaaauguga

SEQ ID NO: 2040383 - RNA, 21 nt, Human herpesvirus 6
ccagugcuuuaaucacaauga

SEQ ID NO: 2040384 - RNA, 16 nt, Human herpesvirus 6
acggauucgaucgaga

SEQ ID NO: 2040385 - RNA, 16 nt, Human herpesvirus 6
ugcucgccguauaagu

SEQ ID NO: 2040386 - RNA, 12 nt, Human herpesvirus 6
uucuaugucuag

SEQ ID NO: 2040387 - RNA, 16 nt, Human herpesvirus 6
aaucaaaaaaaugaua

SEQ ID NO: 2040388 - RNA, 16 nt, Human herpesvirus 6
cauguauuuauucacu

SEQ ID NO: 2040389 - RNA, 20 nt, Human herpesvirus 6
cauuaacagacgaggacgga

SEQ ID NO: 2040390 - RNA, 17 nt, Human herpesvirus 6
ccaaaugccucgugaga

SEQ ID NO: 2040391 - RNA, 23 nt, Human herpesvirus 6
cauuuccggagauuaaaacauca

SEQ ID NO: 2040392 - RNA, 13 nt, Human herpesvirus 6
caaaugauuuuac

SEQ ID NO: 2040393 - RNA, 18 nt, Human herpesvirus 6
caaaagacacaaucuucg

SEQ ID NO: 2040394 - RNA, 20 nt, Human herpesvirus 6
caaauucuuacauuuuguac

SEQ ID NO: 2040395 - RNA, 17 nt, Human herpesvirus 6
caaauccugacuacgau

SEQ ID NO: 2040396 - RNA, 13 nt, Human herpesvirus 6
caaacuacggaaa

SEQ ID NO: 2040397 - RNA, 21 nt, Human herpesvirus 6
auguaauaauugaugggaugc

SEQ ID NO: 2040398 - RNA, 22 nt, Human herpesvirus 6
auggcgaugaccgcuaaauuga

SEQ ID NO: 2040399 - RNA, 15 nt, Human herpesvirus 6
augcgagcaaaaaau

SEQ ID NO: 2040400 - RNA, 14 nt, Human herpesvirus 6
cgcccgauccgccc

SEQ ID NO: 2040401 - RNA, 19 nt, Human herpesvirus 6
aaacuaucggagagacgca

SEQ ID NO: 2040402 - RNA, 15 nt, Human herpesvirus 6
aaaccaucgcaaugc

SEQ ID NO: 2040403 - RNA, 23 nt, Human herpesvirus 6
aaauccuccuagggaauuuaauc

SEQ ID NO: 2040404 - RNA, 13 nt, Human herpesvirus 6
gcgcgcgugugug

SEQ ID NO: 2040405 - RNA, 18 nt, Human herpesvirus 6
ggcuaacccuaacccuaa

SEQ ID NO: 2040406 - RNA, 13 nt, Human herpesvirus 6
ggcucgaaucuaa

SEQ ID NO: 2040407 - RNA, 20 nt, Human herpesvirus 6
ucauuuguuuuuuaaagcac

SEQ ID NO: 2040408 - RNA, 22 nt, Human herpesvirus 6
ucauaaccucaucgcgacuaaa

SEQ ID NO: 2040409 - RNA, 12 nt, Human herpesvirus 6
ucauaugucucg

SEQ ID NO: 2040410 - RNA, 14 nt, Human herpesvirus 6
ucgcgauagucaug

SEQ ID NO: 2040411 - RNA, 22 nt, Human herpesvirus 6
cagaauuuguaaaaaaacauuc

SEQ ID NO: 2040412 - RNA, 14 nt, Human herpesvirus 6
cagaagacuuuaaa

SEQ ID NO: 2040413 - RNA, 20 nt, Human herpesvirus 6
ccgauuaauguguuuuucuu

SEQ ID NO: 2040414 - RNA, 16 nt, Human herpesvirus 6
caccucuaaaacaaga

SEQ ID NO: 2040415 - RNA, 14 nt, Human herpesvirus 6
cacgacaacacgcc

SEQ ID NO: 2040416 - RNA, 13 nt, Human herpesvirus 6
caccuuuaucgac

SEQ ID NO: 2040417 - RNA, 19 nt, Human herpesvirus 6
caccuggguuucgaagaau

SEQ ID NO: 2040418 - RNA, 19 nt, Human herpesvirus 6
agaaaugcacuguuugaaa

SEQ ID NO: 2040419 - RNA, 21 nt, Human herpesvirus 6
acuuuaucgauguagauaaau

SEQ ID NO: 2040420 - RNA, 19 nt, Human herpesvirus 6
acuuuuugccgucacacuc

SEQ ID NO: 2040421 - RNA, 19 nt, Human herpesvirus 6
acgugguuuuuuuuuucuu

SEQ ID NO: 2040422 - RNA, 16 nt, Human herpesvirus 6
agacacgucaacgugu

SEQ ID NO: 2040423 - RNA, 23 nt, Human herpesvirus 6
acguauauuguguaccuuguaau

SEQ ID NO: 2040424 - RNA, 15 nt, Human herpesvirus 6
acgccaguccguaaa

SEQ ID NO: 2040425 - RNA, 14 nt, Human herpesvirus 6
aacgucgaaacgaa

SEQ ID NO: 2040426 - RNA, 14 nt, Human herpesvirus 6
aagaauuauuuauc

SEQ ID NO: 2040427 - RNA, 19 nt, Human herpesvirus 6
aacugccaauuaccgguaa

SEQ ID NO: 2040428 - RNA, 20 nt, Human herpesvirus 6
aacuuuuugccgaagauagc

SEQ ID NO: 2040429 - RNA, 18 nt, Human herpesvirus 6
cuuauguuucuaacagag

SEQ ID NO: 2040430 - RNA, 13 nt, Human herpesvirus 6
cuuauauaggcac

SEQ ID NO: 2040431 - RNA, 17 nt, Human herpesvirus 6
cuguguuacaaacaugc

SEQ ID NO: 2040432 - RNA, 15 nt, Human herpesvirus 6
cuguuugaaacugag

SEQ ID NO: 2040433 - RNA, 14 nt, Human herpesvirus 6
cuguuuuucucgga

SEQ ID NO: 2040434 - RNA, 16 nt, Human herpesvirus 6
gcagauuuuuaaaagu

SEQ ID NO: 2040435 - RNA, 18 nt, Human herpesvirus 6
cugguaaauuuuaucgaa

SEQ ID NO: 2040436 - RNA, 18 nt, Human herpesvirus 6
cucuaccuggaaacaacg

SEQ ID NO: 2040437 - RNA, 14 nt, Human herpesvirus 6
cucugcaaaacaaa

SEQ ID NO: 2040438 - RNA, 17 nt, Human herpesvirus 6
gccaaaggaaaccaccg

SEQ ID NO: 2040439 - RNA, 20 nt, Human herpesvirus 6
gccaaaggaaaccaccggcu

SEQ ID NO: 2040440 - RNA, 23 nt, Human herpesvirus 6
gcgaccgaccccugccgagccug

SEQ ID NO: 2040441 - RNA, 13 nt, Human herpesvirus 6
gcgacaaccgccg

SEQ ID NO: 2040442 - RNA, 15 nt, Human herpesvirus 6
gccuguuccacgcgc

SEQ ID NO: 2040443 - RNA, 18 nt, Human herpesvirus 6
ggagagacgcaccacggc

SEQ ID NO: 2040444 - RNA, 20 nt, Human herpesvirus 6
guaauuucagucaauuuuac

SEQ ID NO: 2040445 - RNA, 20 nt, Human herpesvirus 6
ggagcccgcucggucucgca

SEQ ID NO: 2040446 - RNA, 13 nt, Human herpesvirus 6
gguuugucucgca

SEQ ID NO: 2040447 - RNA, 17 nt, Human herpesvirus 6
ccagauacuacacaaac

SEQ ID NO: 2040448 - RNA, 14 nt, Human herpesvirus 6
ccagauaaccucac

SEQ ID NO: 2040449 - RNA, 18 nt, Human herpesvirus 6
ccagauacauaaacaccc

SEQ ID NO: 2040450 - RNA, 16 nt, Human herpesvirus 6
cgacuauacgaaauaa

SEQ ID NO: 2040451 - RNA, 23 nt, Human herpesvirus 6
cgacccacuccuacuauccgccc

SEQ ID NO: 2040452 - RNA, 11 nt, Human herpesvirus 6
cgccgugugug

SEQ ID NO: 2040453 - RNA, 20 nt, Human herpesvirus 6
cgauacccagcgggcuccgu

SEQ ID NO: 2040454 - RNA, 21 nt, Human herpesvirus 6
cgaguuagcagaagaacagcu

SEQ ID NO: 2040455 - RNA, 12 nt, Human herpesvirus 6
cagugaaacgga

SEQ ID NO: 2040456 - RNA, 21 nt, Human herpesvirus 6
cagugaaggcugccaugaaac

SEQ ID NO: 2040457 - RNA, 20 nt, Human herpesvirus 6
caguaugucuccaaacagag

SEQ ID NO: 2040458 - RNA, 13 nt, Human herpesvirus 6
cagcggaagugaa

SEQ ID NO: 2040459 - RNA, 14 nt, Human herpesvirus 6
aucucuaugagacu

SEQ ID NO: 2040460 - RNA, 21 nt, Human herpesvirus 6
aucucuauugguuaaaaggaa

SEQ ID NO: 2040461 - RNA, 18 nt, Human herpesvirus 6
aucuucugggugggaaga

SEQ ID NO: 2040462 - RNA, 16 nt, Human herpesvirus 6
augaggggaacacgcc

SEQ ID NO: 2040463 - RNA, 17 nt, Human herpesvirus 6
augaucagcauucacuc

SEQ ID NO: 2040464 - RNA, 20 nt, Human herpesvirus 6
augauccgguauaucgagaa

SEQ ID NO: 2040465 - RNA, 14 nt, Human herpesvirus 6
caucucaaaaaaca

SEQ ID NO: 2040466 - RNA, 19 nt, Human herpesvirus 6
caugaucugcuugauauuu

SEQ ID NO: 2040467 - RNA, 15 nt, Human herpesvirus 6
caucugcaaaaaaca

SEQ ID NO: 2040468 - RNA, 21 nt, Human herpesvirus 6
cauacauuccuuaagaaugaa

SEQ ID NO: 2040469 - RNA, 18 nt, Human herpesvirus 6
caguucguagaacggaaa

SEQ ID NO: 2040470 - RNA, 18 nt, Human herpesvirus 6
caugcauuuuguauuuau

SEQ ID NO: 2040471 - RNA, 19 nt, Human herpesvirus 6
aucggagagacgcaccacg

SEQ ID NO: 2040472 - RNA, 19 nt, Human herpesvirus 6
aucguagguaauuuuuauu

SEQ ID NO: 2040473 - RNA, 12 nt, Human herpesvirus 6
agguuaucggaa

SEQ ID NO: 2040474 - RNA, 12 nt, Human herpesvirus 6
aggugaaaugaa

SEQ ID NO: 2040475 - RNA, 15 nt, Human herpesvirus 6
uccccagagaaaauu

SEQ ID NO: 2040476 - RNA, 18 nt, Human herpesvirus 6
ucguauaaauuuaacuaa

SEQ ID NO: 2040477 - RNA, 19 nt, Human herpesvirus 6
uuucaguauuaacuaguug

SEQ ID NO: 2040478 - RNA, 16 nt, Human herpesvirus 6
uuuaauaguuugccau

SEQ ID NO: 2040479 - RNA, 13 nt, Human herpesvirus 6
uuuaauuuugaaa

SEQ ID NO: 2040480 - RNA, 20 nt, Human herpesvirus 6
ucgugccaguucacacggac

SEQ ID NO: 2040481 - RNA, 13 nt, Human herpesvirus 6
uuugaaacggcgc

SEQ ID NO: 2040482 - RNA, 23 nt, Human herpesvirus 6
uuugaauuuauacugugugcgau

SEQ ID NO: 2040483 - RNA, 23 nt, Human herpesvirus 6
uuuuguauuauguaauacaucaa

SEQ ID NO: 2040484 - RNA, 15 nt, Human herpesvirus 6
uuuuagaaacauuug

SEQ ID NO: 2040485 - RNA, 18 nt, Human herpesvirus 6
uuuuaugaucgacauuug

SEQ ID NO: 2040486 - RNA, 22 nt, Human herpesvirus 6
uuuuauuuccacguacuauuuu

SEQ ID NO: 2040487 - RNA, 20 nt, Human herpesvirus 6
uuuuauuuuuuggcuauuug

SEQ ID NO: 2040488 - RNA, 16 nt, Human herpesvirus 6
gcaagacgccacgggc

SEQ ID NO: 2040489 - RNA, 19 nt, Human herpesvirus 6
ccgucuccguuccaaccuc

SEQ ID NO: 2040490 - RNA, 20 nt, Human herpesvirus 6
cgucuccgucuccucgcaau

SEQ ID NO: 2040491 - RNA, 21 nt, Human herpesvirus 6
gaggccaucuaucgcgcaccg

SEQ ID NO: 2040492 - RNA, 19 nt, Human herpesvirus 6
gauguagauaguuuugcgu

SEQ ID NO: 2040493 - RNA, 15 nt, Human herpesvirus 6
gauguagguuucgau

SEQ ID NO: 2040494 - RNA, 15 nt, Human herpesvirus 6
gauuuuuauucugcu

SEQ ID NO: 2040495 - RNA, 16 nt, Human herpesvirus 6
cuauccgcccuccccg

SEQ ID NO: 2040496 - RNA, 14 nt, Human herpesvirus 6
cuauggcuuccgga

SEQ ID NO: 2040497 - RNA, 12 nt, Human herpesvirus 6
cagaggaaauaa

SEQ ID NO: 2040498 - RNA, 23 nt, Human herpesvirus 6
cagagacgugaccggagaaaauc

SEQ ID NO: 2040499 - RNA, 16 nt, Human herpesvirus 6
cagagaaaaaacaaag

SEQ ID NO: 2040500 - RNA, 19 nt, Human herpesvirus 6
acuaacauagcgaauuuga

SEQ ID NO: 2040501 - RNA, 19 nt, Human herpesvirus 6
acuaagcaggaacccagau

SEQ ID NO: 2040502 - RNA, 11 nt, Human herpesvirus 6
acugaauuugc

SEQ ID NO: 2040503 - RNA, 15 nt, Human herpesvirus 6
acugcuaguuuuuuu

SEQ ID NO: 2040504 - RNA, 17 nt, Human herpesvirus 6
acuuauuuuuuuuucug

SEQ ID NO: 2040505 - RNA, 14 nt, Human herpesvirus 6
acuucaaacaccuc

SEQ ID NO: 2040506 - RNA, 20 nt, Human herpesvirus 6
acuucacgaucuacacaccg

SEQ ID NO: 2040507 - RNA, 19 nt, Human herpesvirus 6
acuuccgcgauacccagcg

SEQ ID NO: 2040508 - RNA, 13 nt, Human herpesvirus 6
uuggaauauauaa

SEQ ID NO: 2040509 - RNA, 20 nt, Human herpesvirus 6
uucucugcaaaacaaaggua

SEQ ID NO: 2040510 - RNA, 19 nt, Human herpesvirus 6
uucccaccuaauaaacugu

SEQ ID NO: 2040511 - RNA, 23 nt, Human herpesvirus 6
uuccaguuaauaagauguugcaa

SEQ ID NO: 2040512 - RNA, 20 nt, Human herpesvirus 6
uuccaagacauguacaucaa

SEQ ID NO: 2040513 - RNA, 21 nt, Human herpesvirus 6
uucaaaaaucgaaaucguaua

SEQ ID NO: 2040514 - RNA, 15 nt, Human herpesvirus 6
uuacuuaaacggaau

SEQ ID NO: 2040515 - RNA, 16 nt, Human herpesvirus 6
uuagaaauuacauaag

SEQ ID NO: 2040516 - RNA, 12 nt, Human herpesvirus 6
uuacauaacaua

SEQ ID NO: 2040517 - RNA, 15 nt, Human herpesvirus 6
uuacauauacauuug

SEQ ID NO: 2040518 - RNA, 19 nt, Human herpesvirus 6
uuaaugucacugucgaaua

SEQ ID NO: 2040519 - RNA, 17 nt, Human herpesvirus 6
uuaaguccguuuggaga

SEQ ID NO: 2040520 - RNA, 16 nt, Human herpesvirus 6
uuaaagauguguuaaa

SEQ ID NO: 2040521 - RNA, 20 nt, Human herpesvirus 6
uugaauaacaaacuauauug

SEQ ID NO: 2040522 - RNA, 16 nt, Human herpesvirus 6
uucuguaauuuugaaa

SEQ ID NO: 2040523 - RNA, 22 nt, Human herpesvirus 6
uucuuacaacaggcuugugaaa

SEQ ID NO: 2040524 - RNA, 16 nt, Human herpesvirus 6
uugcaagcagcggcga

SEQ ID NO: 2040525 - RNA, 14 nt, Human herpesvirus 6
uugcaguucucgga

SEQ ID NO: 2040526 - RNA, 20 nt, Human herpesvirus 6
uuccuuauaacacacagcua

SEQ ID NO: 2040527 - RNA, 15 nt, Human herpesvirus 6
uguaucguuugagau

SEQ ID NO: 2040528 - RNA, 19 nt, Human herpesvirus 6
ugugccguuuaugcgaauc

SEQ ID NO: 2040529 - RNA, 19 nt, Human herpesvirus 6
uuaaaagaauuuuuguagc

SEQ ID NO: 2040530 - RNA, 17 nt, Human herpesvirus 6
uguguuagcuuugcgau

SEQ ID NO: 2040531 - RNA, 20 nt, Human herpesvirus 6
uggccguuacaguuuccgcu

SEQ ID NO: 2040532 - RNA, 20 nt, Human herpesvirus 6
uaguacaguaugucuccaaa

SEQ ID NO: 2040533 - RNA, 16 nt, Human herpesvirus 6
uagcuauuaugugaau

SEQ ID NO: 2040534 - RNA, 19 nt, Human herpesvirus 6
uauaucucggacucauaga

SEQ ID NO: 2040535 - RNA, 16 nt, Human herpesvirus 6
uauauuggaauuggga

SEQ ID NO: 2040536 - RNA, 19 nt, Human herpesvirus 6
uauauuuuuaccgaaccau

SEQ ID NO: 2040537 - RNA, 14 nt, Human herpesvirus 6
ucuaaugguugaaa

SEQ ID NO: 2040538 - RNA, 20 nt, Human herpesvirus 6
ucuaacucgcgagacaaauc

SEQ ID NO: 2040539 - RNA, 20 nt, Human herpesvirus 6
ucguuauauuuuuuauuuuu

SEQ ID NO: 2040540 - RNA, 16 nt, Human herpesvirus 6
ucucgaaaaaacaacg

SEQ ID NO: 2040541 - RNA, 19 nt, Human herpesvirus 6
ucuagaauaucugcuaagu

SEQ ID NO: 2040542 - RNA, 16 nt, Human herpesvirus 6
ucuccucauggagaau

SEQ ID NO: 2040543 - RNA, 23 nt, Human herpesvirus 6
ugaaccgcguauguuuuaucgag

SEQ ID NO: 2040544 - RNA, 16 nt, Human herpesvirus 6
uagauggaaaauugca

SEQ ID NO: 2040545 - RNA, 13 nt, Human herpesvirus 6
uaccuauagucaa

SEQ ID NO: 2040546 - RNA, 16 nt, Human herpesvirus 6
uacuauuuuagucaca

SEQ ID NO: 2040547 - RNA, 17 nt, Human herpesvirus 6
gugucggcuacgacacg

SEQ ID NO: 2040548 - RNA, 18 nt, Human herpesvirus 6
gugguuguuguuauuguu

SEQ ID NO: 2040549 - RNA, 10 nt, Human herpesvirus 6
guuaguaaau

SEQ ID NO: 2040550 - RNA, 14 nt, Human herpesvirus 6
guuagcuuugcgau

SEQ ID NO: 2040551 - RNA, 13 nt, Human herpesvirus 6
guuaaauaauauu

SEQ ID NO: 2040552 - RNA, 15 nt, Human herpesvirus 6
guguguguaauuuuu

SEQ ID NO: 2040553 - RNA, 16 nt, Human herpesvirus 6
guguuagcuuugcgau

SEQ ID NO: 2040554 - RNA, 23 nt, Human herpesvirus 6
gacuacagacuccccaccgagau

SEQ ID NO: 2040555 - RNA, 16 nt, Human herpesvirus 6
gacgucgacgaaauaa

SEQ ID NO: 2040556 - RNA, 19 nt, Human herpesvirus 6
gacaucgcgcgcgacgugc

SEQ ID NO: 2040557 - RNA, 14 nt, Human herpesvirus 6
gaagacuuuaaagu

SEQ ID NO: 2040558 - RNA, 20 nt, Human herpesvirus 6
cuggcccgaggauuaucgau

SEQ ID NO: 2040559 - RNA, 16 nt, Human herpesvirus 6
cugcuggcugagauuc

SEQ ID NO: 2040560 - RNA, 13 nt, Human herpesvirus 6
cugcacuuucgau

SEQ ID NO: 2040561 - RNA, 15 nt, Human herpesvirus 6
cuuucaguauuaacu

SEQ ID NO: 2040562 - RNA, 18 nt, Human herpesvirus 6
cugagaguaaauauuucu

SEQ ID NO: 2040563 - RNA, 19 nt, Human herpesvirus 6
cugauuuuguuuucuacgu

SEQ ID NO: 2040564 - RNA, 13 nt, Human herpesvirus 6
cgucgccgcuucg

SEQ ID NO: 2040565 - RNA, 18 nt, Human herpesvirus 6
cgguccaaggauuaugau

SEQ ID NO: 2040566 - RNA, 17 nt, Human herpesvirus 6
cgucaugcaaaacagac

SEQ ID NO: 2040567 - RNA, 23 nt, Human herpesvirus 6
gcuuucaaaaccgucaaccgcca

SEQ ID NO: 2040568 - RNA, 18 nt, Human herpesvirus 6
gcuccgcgccccucgccc

SEQ ID NO: 2040569 - RNA, 19 nt, Human herpesvirus 6
gcguuccgacucgauuuga

SEQ ID NO: 2040570 - RNA, 20 nt, Human herpesvirus 6
gccuauacaggcaaccgccg

SEQ ID NO: 2040571 - RNA, 20 nt, Human herpesvirus 6
guauauuuuuuuuuauuuuu

SEQ ID NO: 2040572 - RNA, 18 nt, Human herpesvirus 6
guauacagcuaaacgccg

SEQ ID NO: 2040573 - RNA, 16 nt, Human herpesvirus 6
guacguugguaucagu

SEQ ID NO: 2040574 - RNA, 21 nt, Human herpesvirus 6
gucuaauuucgacaauccuaa

SEQ ID NO: 2040575 - RNA, 22 nt, Human herpesvirus 6
gccuaauuacgcuguccgccug

SEQ ID NO: 2040576 - RNA, 14 nt, Human herpesvirus 6
ccaucuauacaccc

SEQ ID NO: 2040577 - RNA, 15 nt, Human herpesvirus 6
ccccucccauccccc

SEQ ID NO: 2040578 - RNA, 18 nt, Human herpesvirus 6
ccccucgcccgauccgcc

SEQ ID NO: 2040579 - RNA, 19 nt, Human herpesvirus 6
cccacuccuacuauccgcc

SEQ ID NO: 2040580 - RNA, 14 nt, Human herpesvirus 6
cgaaaaucgccagg

SEQ ID NO: 2040581 - RNA, 13 nt, Human herpesvirus 6
ccuucaccgucuc

SEQ ID NO: 2040582 - RNA, 20 nt, Human herpesvirus 6
cgccgccguuacugucgcug

SEQ ID NO: 2040583 - RNA, 14 nt, Human herpesvirus 6
cgcguacacgaaaa

SEQ ID NO: 2040584 - RNA, 19 nt, Human herpesvirus 6
cggaauuuugagauuuaca

SEQ ID NO: 2040585 - RNA, 20 nt, Human herpesvirus 6
accgcaguuccuguuuuucu

SEQ ID NO: 2040586 - RNA, 20 nt, Human herpesvirus 6
accgcaguuucuguuuuucu

SEQ ID NO: 2040587 - RNA, 22 nt, Human herpesvirus 6
accgagagauuuacuguuucuu

SEQ ID NO: 2040588 - RNA, 16 nt, Human herpesvirus 6
accaccaacacaccug

SEQ ID NO: 2040589 - RNA, 19 nt, Human herpesvirus 6
accaauuccuuaauucuaa

SEQ ID NO: 2040590 - RNA, 21 nt, Human herpesvirus 6
acauuuauguuucuuauuagc

SEQ ID NO: 2040591 - RNA, 20 nt, Human herpesvirus 6
acagucguaguauccuuaac

SEQ ID NO: 2040592 - RNA, 20 nt, Human herpesvirus 6
acaguuauacuggcaaagca

SEQ ID NO: 2040593 - RNA, 18 nt, Human herpesvirus 6
acaguuuaccuauuuaca

SEQ ID NO: 2040594 - RNA, 22 nt, Human herpesvirus 6
acagucacacacagggugcuua

SEQ ID NO: 2040595 - RNA, 16 nt, Human herpesvirus 6
aaucuauugaagauaa

SEQ ID NO: 2040596 - RNA, 14 nt, Human herpesvirus 6
aaucaucaacguaa

SEQ ID NO: 2040597 - RNA, 15 nt, Human herpesvirus 6
aauauuuugaaaagg

SEQ ID NO: 2040598 - RNA, 21 nt, Human herpesvirus 6
acacugcaagguuucgaaugg

SEQ ID NO: 2040599 - RNA, 17 nt, Human herpesvirus 6
acacuugccaugcuagc

SEQ ID NO: 2040600 - RNA, 17 nt, Human herpesvirus 6
aagucuaaggugacucu

SEQ ID NO: 2040601 - RNA, 14 nt, Human herpesvirus 6
aagcucauuuucuc

SEQ ID NO: 2040602 - RNA, 17 nt, Human herpesvirus 6
caaguuugaauuuauac

SEQ ID NO: 2040603 - RNA, 23 nt, Human herpesvirus 6
caacgcugucuuuuuucccuaac

SEQ ID NO: 2040604 - RNA, 18 nt, Human herpesvirus 6
aucaccaccaacacaccu

SEQ ID NO: 2040605 - RNA, 18 nt, Human herpesvirus 6
aucagauuuggagaaaau

SEQ ID NO: 2040606 - RNA, 22 nt, Human herpesvirus 6
auauuaauuacauauagucaau

SEQ ID NO: 2040607 - RNA, 22 nt, Human herpesvirus 6
auauuaauuaccuauagucaau

SEQ ID NO: 2040608 - RNA, 15 nt, Human herpesvirus 6
aucgagaaaaggaca

SEQ ID NO: 2040609 - RNA, 15 nt, Human herpesvirus 6
auccgccccgauaaa

SEQ ID NO: 2040610 - RNA, 17 nt, Human herpesvirus 6
acgaucuacacaccguc

SEQ ID NO: 2040611 - RNA, 24 nt, Human herpesvirus 6
acgauuucugacucucucaguaau

SEQ ID NO: 2040612 - RNA, 15 nt, Human herpesvirus 6
auauauauaucagaa

SEQ ID NO: 2040613 - RNA, 22 nt, Human herpesvirus 6
cacacccauggcgagaaacgcc

SEQ ID NO: 2040614 - RNA, 19 nt, Human herpesvirus 6
caggacagcuucuauuacu

SEQ ID NO: 2040615 - RNA, 20 nt, Human herpesvirus 6
cacaauaagaaaacgagaga

SEQ ID NO: 2040616 - RNA, 23 nt, Human herpesvirus 6
aaaaauaaguacauagaauuucu

SEQ ID NO: 2040617 - RNA, 23 nt, Human herpesvirus 6
ccgccuuuucuuauauuuuucug

SEQ ID NO: 2040618 - RNA, 17 nt, Human herpesvirus 6
cuauugagauucuccgu

SEQ ID NO: 2040619 - RNA, 18 nt, Human herpesvirus 6
cucccaucccccuccccg

SEQ ID NO: 2040620 - RNA, 23 nt, Human herpesvirus 6
gauggccgguuacaauagucauu

SEQ ID NO: 2040621 - RNA, 19 nt, Human herpesvirus 6
gaucaguggguaccgcggu

SEQ ID NO: 2040622 - RNA, 20 nt, Human herpesvirus 6
gaugaauuaccuguuuuaga

SEQ ID NO: 2040623 - RNA, 21 nt, Human herpesvirus 6
uccgccccgauaaaaacaagu

SEQ ID NO: 2040624 - RNA, 15 nt, Human herpesvirus 6
uggauaaaacggcgu

SEQ ID NO: 2040625 - RNA, 23 nt, Human herpesvirus 6
guuccccaugucuugccucuccg

SEQ ID NO: 2040626 - RNA, 17 nt, Human herpesvirus 6
guuuaauaguuugccau

SEQ ID NO: 2040627 - RNA, 19 nt, Human herpesvirus 6
ucaaugcggguacuauaga

SEQ ID NO: 2040628 - RNA, 14 nt, Human herpesvirus 6
ucaauugucacuuu

SEQ ID NO: 2040629 - RNA, 21 nt, Human herpesvirus 6
uaugacgggcagguuaucgga

SEQ ID NO: 2040630 - RNA, 18 nt, Human herpesvirus 6
uaugacuguguguugaau

SEQ ID NO: 2040631 - RNA, 20 nt, Human herpesvirus 6
uaugcuaagcagaacggcgg

SEQ ID NO: 2040632 - RNA, 15 nt, Human herpesvirus 6
uaugauuuauagaau

SEQ ID NO: 2040633 - RNA, 19 nt, Human herpesvirus 6
uacaauagucauuaacgag

SEQ ID NO: 2040634 - RNA, 18 nt, Human herpesvirus 6
uacaaugaaaaaaaaauc

SEQ ID NO: 2040635 - RNA, 13 nt, Human herpesvirus 6
uacauauagucaa

SEQ ID NO: 2040636 - RNA, 20 nt, Human herpesvirus 6
uaauaaaucgcuuaaagcgu

SEQ ID NO: 2040637 - RNA, 14 nt, Human herpesvirus 6
uacacuuuaucgau

SEQ ID NO: 2040638 - RNA, 21 nt, Human herpesvirus 6
uaaaauaccgacaagaaaaua

SEQ ID NO: 2040639 - RNA, 17 nt, Human herpesvirus 6
uaaacaauuauguguca

SEQ ID NO: 2040640 - RNA, 22 nt, Human herpesvirus 6
uaaacuaugcaaacgaaaccau

SEQ ID NO: 2040641 - RNA, 12 nt, Human herpesvirus 6
guuuuuauuuua

SEQ ID NO: 2040642 - RNA, 20 nt, Human herpesvirus 6
guuuuuuggaauauauaaau

SEQ ID NO: 2040643 - RNA, 17 nt, Human herpesvirus 6
guuuuuuucguauaaau

SEQ ID NO: 2040644 - RNA, 23 nt, Human herpesvirus 6
uaaauauaucaaagauguacuca

SEQ ID NO: 2040645 - RNA, 15 nt, Human herpesvirus 6
uaaauuauuuuguga

SEQ ID NO: 2040646 - RNA, 18 nt, Human herpesvirus 6
uaacgacuucgacuucaa

SEQ ID NO: 2040647 - RNA, 13 nt, Human herpesvirus 6
uaagcgugacuua

SEQ ID NO: 2040648 - RNA, 19 nt, Human herpesvirus 6
uaacuguaaaaagugcuuu

SEQ ID NO: 2040649 - RNA, 20 nt, Human herpesvirus 6
ugacuguccgcaugagcgac

SEQ ID NO: 2040650 - RNA, 20 nt, Human herpesvirus 6
ugcauacauaaauuauuuuu

SEQ ID NO: 2040651 - RNA, 18 nt, Human herpesvirus 6
ugccaaaggaaaccaccg

SEQ ID NO: 2040652 - RNA, 13 nt, Human herpesvirus 6
ucagagaaacgga

SEQ ID NO: 2040653 - RNA, 22 nt, Human herpesvirus 6
ucagauugcggacauggugaaa

SEQ ID NO: 2040654 - RNA, 12 nt, Human herpesvirus 6
ugcguuaucgac

SEQ ID NO: 2040655 - RNA, 16 nt, Human herpesvirus 6
ggagucggcgugugug

SEQ ID NO: 2040656 - RNA, 18 nt, Human herpesvirus 6
gcuuccggaauaguucuu

SEQ ID NO: 2040657 - RNA, 20 nt, Human herpesvirus 6
gcuuaccguucaucauucca

SEQ ID NO: 2040658 - RNA, 19 nt, Human herpesvirus 6
gucaguggguaccgcgguu

SEQ ID NO: 2040659 - RNA, 13 nt, Human herpesvirus 6
gucagguuugaaa

SEQ ID NO: 2040660 - RNA, 22 nt, Human herpesvirus 6
gucccaucuauacacccugccg

SEQ ID NO: 2040661 - RNA, 17 nt, Human herpesvirus 6
gcggacgguuuauuuuu

SEQ ID NO: 2040662 - RNA, 20 nt, Human herpesvirus 6
cggcggauggagcccgcucg

SEQ ID NO: 2040663 - RNA, 17 nt, Human herpesvirus 6
cggccauuuaacggaac

SEQ ID NO: 2040664 - RNA, 14 nt, Human herpesvirus 6
gaauauugaaacgg

SEQ ID NO: 2040665 - RNA, 17 nt, Human herpesvirus 6
gaaguuagaaauuuuac

SEQ ID NO: 2040666 - RNA, 23 nt, Human herpesvirus 6
gaaguugguuuaaaauaucuguu

SEQ ID NO: 2040667 - RNA, 22 nt, Human herpesvirus 6
gaaucagaucacucagauuuca

SEQ ID NO: 2040668 - RNA, 15 nt, Human herpesvirus 6
gaauuguauauauag

SEQ ID NO: 2040669 - RNA, 22 nt, Human herpesvirus 6
gacaaaccucucgccgaccugu

SEQ ID NO: 2040670 - RNA, 18 nt, Human herpesvirus 6
gacaaagaaccggcgugu

SEQ ID NO: 2040671 - RNA, 22 nt, Human herpesvirus 6
gacucuaaauacggaccgagag

SEQ ID NO: 2040672 - RNA, 15 nt, Human herpesvirus 6
gacuguguguugaau

SEQ ID NO: 2040673 - RNA, 21 nt, Human herpesvirus 6
gaacauacaaaggaggugcgu

SEQ ID NO: 2040674 - RNA, 20 nt, Human herpesvirus 6
gaaauuugagaaaguuguac

SEQ ID NO: 2040675 - RNA, 16 nt, Human herpesvirus 6
gaaauuuuugacugau

SEQ ID NO: 2040676 - RNA, 20 nt, Human herpesvirus 6
gaaaaucucaaacgccgugu

SEQ ID NO: 2040677 - RNA, 19 nt, Human herpesvirus 6
cgguggccuggcacggugc

SEQ ID NO: 2040678 - RNA, 22 nt, Human herpesvirus 6
cgguuugucucgcaaacagcuu

SEQ ID NO: 2040679 - RNA, 23 nt, Human herpesvirus 6
gagagagcgugcacacaaacagu

SEQ ID NO: 2040680 - RNA, 17 nt, Human herpesvirus 6
gagaccuacacuuuucc

SEQ ID NO: 2040681 - RNA, 23 nt, Human herpesvirus 6
gagacgcacccuacaaucugucc

SEQ ID NO: 2040682 - RNA, 15 nt, Human herpesvirus 6
gcagcuuccacgcga

SEQ ID NO: 2040683 - RNA, 13 nt, Human herpesvirus 6
cauaggugauuuc

SEQ ID NO: 2040684 - RNA, 14 nt, Human herpesvirus 6
cauauaaacagauu

SEQ ID NO: 2040685 - RNA, 15 nt, Human herpesvirus 6
auuuuuuuaauaaau

SEQ ID NO: 2040686 - RNA, 20 nt, Human herpesvirus 6
cauaggaauucuuauuuacc

SEQ ID NO: 2040687 - RNA, 18 nt, Human herpesvirus 6
auuugacaauaaacauga

SEQ ID NO: 2040688 - RNA, 19 nt, Human herpesvirus 6
auuucaaacugguguaaau

SEQ ID NO: 2040689 - RNA, 20 nt, Human herpesvirus 6
auuucuuccuuucucugcgc

SEQ ID NO: 2040690 - RNA, 20 nt, Human herpesvirus 6
caucgcgcgcgacgugccac

SEQ ID NO: 2040691 - RNA, 17 nt, Human herpesvirus 6
caucagaauccagaaac

SEQ ID NO: 2040692 - RNA, 17 nt, Human herpesvirus 6
caucccuuaaaaaaaca

SEQ ID NO: 2040693 - RNA, 14 nt, Human herpesvirus 6
caucaaaucggaca

SEQ ID NO: 2040694 - RNA, 19 nt, Human herpesvirus 6
caucaugcugugagagaau

SEQ ID NO: 2040695 - RNA, 20 nt, Human herpesvirus 6
auucugcauuuauaucaaac

SEQ ID NO: 2040696 - RNA, 14 nt, Human herpesvirus 6
auugcauucugggc

SEQ ID NO: 2040697 - RNA, 13 nt, Human herpesvirus 6
auucguuacaauc

SEQ ID NO: 2040698 - RNA, 16 nt, Human herpesvirus 6
auucguuuuuuuucuu

SEQ ID NO: 2040699 - RNA, 14 nt, Human herpesvirus 6
auuguaaacgauau

SEQ ID NO: 2040700 - RNA, 21 nt, Human herpesvirus 6
auuguauauauagcuguaaau

SEQ ID NO: 2040701 - RNA, 19 nt, Human herpesvirus 6
auuucgguuucgucgcaaa

SEQ ID NO: 2040702 - RNA, 22 nt, Human herpesvirus 6
auuuaccuuccugagaguaaau

SEQ ID NO: 2040703 - RNA, 12 nt, Human herpesvirus 6
auuuaaacaaca

SEQ ID NO: 2040704 - RNA, 15 nt, Human herpesvirus 6
auuuaacaacaucuu

SEQ ID NO: 2040705 - RNA, 10 nt, Human herpesvirus 6
augucucgcg

SEQ ID NO: 2040706 - RNA, 14 nt, Human herpesvirus 6
auguucaauuacuc

SEQ ID NO: 2040707 - RNA, 13 nt, Human herpesvirus 6
auaauuuauggaa

SEQ ID NO: 2040708 - RNA, 14 nt, Human herpesvirus 6
auacacacccagca

SEQ ID NO: 2040709 - RNA, 19 nt, Human herpesvirus 6
auucaaaugcaguaaauga

SEQ ID NO: 2040710 - RNA, 19 nt, Human herpesvirus 6
auuagaauaauuauggaca

SEQ ID NO: 2040711 - RNA, 22 nt, Human herpesvirus 6
auuaaauguuacugaacuuugu

SEQ ID NO: 2040712 - RNA, 11 nt, Human herpesvirus 6
agauuaaaugu

SEQ ID NO: 2040713 - RNA, 13 nt, Human herpesvirus 6
agaggaauuggcg

SEQ ID NO: 2040714 - RNA, 14 nt, Human herpesvirus 6
agaggagaaaugau

SEQ ID NO: 2040715 - RNA, 20 nt, Human herpesvirus 6
agcgcgucguucgcuucuua

SEQ ID NO: 2040716 - RNA, 19 nt, Human herpesvirus 6
aguguucgcauuagaaaau

SEQ ID NO: 2040717 - RNA, 20 nt, Human herpesvirus 6
aguuauauucuucuguaaau

SEQ ID NO: 2040718 - RNA, 15 nt, Human herpesvirus 6
aguuuacauagaaau

SEQ ID NO: 2040719 - RNA, 19 nt, Human herpesvirus 6
aguuucaccauguccagga

SEQ ID NO: 2040720 - RNA, 22 nt, Human herpesvirus 6
aguuucggcaacugaauuugca

SEQ ID NO: 2040721 - RNA, 17 nt, Human herpesvirus 6
aguuuguguuuguaaau

SEQ ID NO: 2040722 - RNA, 18 nt, Human herpesvirus 6
auaaauugaugaaauugu

SEQ ID NO: 2040723 - RNA, 14 nt, Human herpesvirus 6
aguuuuugugcggc

SEQ ID NO: 2040724 - RNA, 22 nt, Human herpesvirus 6
auaaaaaguuugugcgaauugu

SEQ ID NO: 2040725 - RNA, 14 nt, Human herpesvirus 6
aauucuuauuuacc

SEQ ID NO: 2040726 - RNA, 14 nt, Human herpesvirus 6
aauuauagcgauaa

SEQ ID NO: 2040727 - RNA, 13 nt, Human herpesvirus 6
aauuuuaaaaaga

SEQ ID NO: 2040728 - RNA, 12 nt, Human herpesvirus 6
aauuuuaaaugc

SEQ ID NO: 2040729 - RNA, 15 nt, Human herpesvirus 6
acaacgcuccauaac

SEQ ID NO: 2040730 - RNA, 22 nt, Human herpesvirus 6
accccguugauuggaugaucgc

SEQ ID NO: 2040731 - RNA, 17 nt, Human herpesvirus 6
aauucauuguacgauaa

SEQ ID NO: 2040732 - RNA, 21 nt, Human herpesvirus 6
aacagggagugauugaugaaa

SEQ ID NO: 2040733 - RNA, 15 nt, Human herpesvirus 6
aacaguauaacggaa

SEQ ID NO: 2040734 - RNA, 23 nt, Human herpesvirus 6
aacgacuaccacaucaccgauaa

SEQ ID NO: 2040735 - RNA, 14 nt, Human herpesvirus 6
aacgauaugucucu

SEQ ID NO: 2040736 - RNA, 21 nt, Human herpesvirus 6
cucgauuuugugaaugagaca

SEQ ID NO: 2040737 - RNA, 20 nt, Human herpesvirus 6
cucgccgaacuagaaaaaca

SEQ ID NO: 2040738 - RNA, 17 nt, Human herpesvirus 6
gauacaucguuuguuga

SEQ ID NO: 2040739 - RNA, 21 nt, Human herpesvirus 6
gaguugggacuuggaaacgug

SEQ ID NO: 2040740 - RNA, 20 nt, Human herpesvirus 6
gaguccggcgcacgcacacg

SEQ ID NO: 2040741 - RNA, 20 nt, Human herpesvirus 6
ggcauagcagcaauaggcac

SEQ ID NO: 2040742 - RNA, 20 nt, Human
agggacucaucauuuccauu

SEQ ID NO: 2040743 - RNA, 23 nt, Human
agcccaaagugguauagaaaugc

SEQ ID NO: 2040744 - RNA, 20 nt, Human
agcccaaagugguauagaaa

SEQ ID NO: 2040745 - RNA, 19 nt, Human
agccuccugaguagcugga

SEQ ID NO: 2040746 - RNA, 11 nt, Human
agccuccugag

SEQ ID NO: 2040747 - RNA, 15 nt, Human
aucucucuucuuuuc

SEQ ID NO: 2040748 - RNA, 16 nt, Human
aguccacaguggaacc

SEQ ID NO: 2040749 - RNA, 23 nt, Human
aguuguuaauaaaaguacauguu

SEQ ID NO: 2040750 - RNA, 17 nt, Human
auaugcaguuuuccuua

SEQ ID NO: 2040751 - RNA, 24 nt, Human
acaacuugcacguauuuuaauagc

SEQ ID NO: 2040752 - RNA, 17 nt, Human
acauguuaaacuuacuu

SEQ ID NO: 2040753 - RNA, 20 nt, Human
agaaaagggaacugaacauu

SEQ ID NO: 2040754 - RNA, 15 nt, Human
acuuauuuauauaaa

SEQ ID NO: 2040755 - RNA, 19 nt, Human
acgugauuuugcuguagaa

SEQ ID NO: 2040756 - RNA, 14 nt, Human
aacuuuuuuuuaag

SEQ ID NO: 2040757 - RNA, 20 nt, Human
aacuuuuuuuuaaguuacac

SEQ ID NO: 2040758 - RNA, 14 nt, Human
aacugaauuuuguc

SEQ ID NO: 2040759 - RNA, 15 nt, Human
aacugaauuuugucu

SEQ ID NO: 2040760 - RNA, 23 nt, Human
aaagugagacuuugaggguguau

SEQ ID NO: 2040761 - RNA, 12 nt, Human
aaagugcuggga

SEQ ID NO: 2040762 - RNA, 21 nt, Human
aaagggaacugaacauuccag

SEQ ID NO: 2040763 - RNA, 16 nt, Human
aaagggaacugaacau

SEQ ID NO: 2040764 - RNA, 21 nt, Human
aagaaauuuccacucaggucu

SEQ ID NO: 2040765 - RNA, 15 nt, Human
aaguuguuaauaaaa

SEQ ID NO: 2040766 - RNA, 17 nt, Human
aagugguauagaaaugc

SEQ ID NO: 2040767 - RNA, 13 nt, Human
aagugguauagaa

SEQ ID NO: 2040768 - RNA, 21 nt, Human
cucgugguaggacuguagaaa

SEQ ID NO: 2040769 - RNA, 20 nt, Human
cugaguagcuggauuacagg

SEQ ID NO: 2040770 - RNA, 19 nt, Human
cugaguagcuggauuacag

SEQ ID NO: 2040771 - RNA, 13 nt, Human
cucaaacuccuga

SEQ ID NO: 2040772 - RNA, 14 nt, Human
cucaaacuccugac

SEQ ID NO: 2040773 - RNA, 14 nt, Human
cuacaguguacagu

SEQ ID NO: 2040774 - RNA, 13 nt, Human
cuacaguguacag

SEQ ID NO: 2040775 - RNA, 17 nt, Human
cgacugccaucuuggac

SEQ ID NO: 2040776 - RNA, 18 nt, Human
cgugauuuugcuguagaa

SEQ ID NO: 2040777 - RNA, 11 nt, Human
cccagcuguuu

SEQ ID NO: 2040778 - RNA, 23 nt, Human
ccgcaggauuugggcucuuggaa

SEQ ID NO: 2040779 - RNA, 16 nt, Human
cauguuggccaggcug

SEQ ID NO: 2040780 - RNA, 21 nt, Human
cagcuguuuaugcauagauaa

SEQ ID NO: 2040781 - RNA, 23 nt, Human
caccuacaguguacagucuugua

SEQ ID NO: 2040782 - RNA, 18 nt, Human
cacauuuuucagauauaa

SEQ ID NO: 2040783 - RNA, 14 nt, Human
cacauuuuucagau

SEQ ID NO: 2040784 - RNA, 22 nt, Human
caaguaauccaccugccucggc

SEQ ID NO: 2040785 - RNA, 13 nt, Human
auuuuuaaagaaa

SEQ ID NO: 2040786 - RNA, 20 nt, Human
auuuuuaaagaaaaguuuug

SEQ ID NO: 2040787 - RNA, 13 nt, Human
auuguacaguuuu

SEQ ID NO: 2040788 - RNA, 15 nt, Human
auuucagauuuguga

SEQ ID NO: 2040789 - RNA, 16 nt, Human
cugguuuuucaguuuu

SEQ ID NO: 2040790 - RNA, 15 nt, Human
cugguuuuucaguuu

SEQ ID NO: 2040791 - RNA, 14 nt, Human
cugguuuuucaguu

SEQ ID NO: 2040792 - RNA, 14 nt, Human
cuuuuuuuuaaguu

SEQ ID NO: 2040793 - RNA, 22 nt, Human
gauggaaaaaccacccccaaau

SEQ ID NO: 2040794 - RNA, 16 nt, Human
ggauuuuugucuugug

SEQ ID NO: 2040795 - RNA, 14 nt, Human
ggauuuuugucuug

SEQ ID NO: 2040796 - RNA, 21 nt, Human
aaaguauccugcuucugauau

SEQ ID NO: 2040797 - RNA, 20 nt, Human
aaagugguauagaaaugcug

SEQ ID NO: 2040798 - RNA, 17 nt, Human
aaagugguauagaaaug

SEQ ID NO: 2040799 - RNA, 16 nt, Human
aaagugguauagaaau

SEQ ID NO: 2040800 - RNA, 14 nt, Human
aaagcuagaaauga

SEQ ID NO: 2040801 - RNA, 15 nt, Human
guaaagcuagaaaug

SEQ ID NO: 2040802 - RNA, 16 nt, Human
guaaagcuagaaauga

SEQ ID NO: 2040803 - RNA, 13 nt, Human
gguauagaaaugc

SEQ ID NO: 2040804 - RNA, 15 nt, Human
aaaaucugcuaggga

SEQ ID NO: 2040805 - RNA, 14 nt, Human
uuuugcuguagaag

SEQ ID NO: 2040806 - RNA, 13 nt, Human
uuuugcuguagaa

SEQ ID NO: 2040807 - RNA, 19 nt, Human
uuuuguuucauauugaugu

SEQ ID NO: 2040808 - RNA, 12 nt, Human
uuuuguuucaua

SEQ ID NO: 2040809 - RNA, 20 nt, Human
auuaaguuguuaauaaaagu

SEQ ID NO: 2040810 - RNA, 19 nt, Human
auuaaguuguuaauaaaag

SEQ ID NO: 2040811 - RNA, 14 nt, Human
auuaaguuguuaau

SEQ ID NO: 2040812 - RNA, 21 nt, Human
auguuaaacuuacuuaguguu

SEQ ID NO: 2040813 - RNA, 20 nt, Human
uuuuaggccaaaaaaaugua

SEQ ID NO: 2040814 - RNA, 12 nt, Human
uuuucaguuuuc

SEQ ID NO: 2040815 - RNA, 14 nt, Human
uuuucaguuuucag

SEQ ID NO: 2040816 - RNA, 18 nt, Human
auucuccugccucagccu

SEQ ID NO: 2040817 - RNA, 22 nt, Human
auuuccacucaggucuguuuuc

SEQ ID NO: 2040818 - RNA, 16 nt, Human
auuuuacuuuuuccug

SEQ ID NO: 2040819 - RNA, 17 nt, Human
auuuuacuuuuuccugg

SEQ ID NO: 2040820 - RNA, 21 nt, Human
augagccaccgcgcccagccu

SEQ ID NO: 2040821 - RNA, 18 nt, Human
augagccaccgcgcccag

SEQ ID NO: 2040822 - RNA, 16 nt, Human
uuucucaaagaaauuu

SEQ ID NO: 2040823 - RNA, 15 nt, Human
uuucucaaagaaauu

SEQ ID NO: 2040824 - RNA, 14 nt, Human
uuucucaaagaaau

SEQ ID NO: 2040825 - RNA, 21 nt, Human
uuucuuuaguuuuugugaagu

SEQ ID NO: 2040826 - RNA, 19 nt, Human
uuuccuuaaauuaucuaaa

SEQ ID NO: 2040827 - RNA, 21 nt, Human
uuuaaagaaaaguuuuguaaa

SEQ ID NO: 2040828 - RNA, 17 nt, Human
uuuaaagaaaaguuuug

SEQ ID NO: 2040829 - RNA, 15 nt, Human
uuuaaagaaaaguuu

SEQ ID NO: 2040830 - RNA, 13 nt, Human
uuuaaagaaaagu

SEQ ID NO: 2040831 - RNA, 19 nt, Human
uuuauuaaauguagaaagu

SEQ ID NO: 2040832 - RNA, 15 nt, Human
uuucaguuuucagga

SEQ ID NO: 2040833 - RNA, 22 nt, Human
uucagauauaaaagacugacca

SEQ ID NO: 2040834 - RNA, 20 nt, Human
uucauaucuauuuauuaaau

SEQ ID NO: 2040835 - RNA, 16 nt, Human
aucaauucauaucuau

SEQ ID NO: 2040836 - RNA, 12 nt, Human
auauuguacagu

SEQ ID NO: 2040837 - RNA, 14 nt, Human
auauuguacaguuu

SEQ ID NO: 2040838 - RNA, 13 nt, Human
auauuguacaguu

SEQ ID NO: 2040839 - RNA, 21 nt, Human
auccugcuucugauaugcagu

SEQ ID NO: 2040840 - RNA, 19 nt, Human
auccugcuucugauaugca

SEQ ID NO: 2040841 - RNA, 13 nt, Human
auccaauuggaua

SEQ ID NO: 2040842 - RNA, 22 nt, Human
aggccaacccaaaauaagcagg

SEQ ID NO: 2040843 - RNA, 13 nt, Human
aggccaaaaaaau

SEQ ID NO: 2040844 - RNA, 16 nt, Human
uggccaaguucuuagu

SEQ ID NO: 2040845 - RNA, 17 nt, Human
ugccucagccuccugag

SEQ ID NO: 2040846 - RNA, 13 nt, Human
ugauucuccugcc

SEQ ID NO: 2040847 - RNA, 20 nt, Human
ugauuucagcaccuacagug

SEQ ID NO: 2040848 - RNA, 21 nt, Human
ugauuucagcaccuacagugu

SEQ ID NO: 2040849 - RNA, 16 nt, Human
aguguacagucuugua

SEQ ID NO: 2040850 - RNA, 15 nt, Human
aguguacagucuugu

SEQ ID NO: 2040851 - RNA, 13 nt, Human
aguguacagucuu

SEQ ID NO: 2040852 - RNA, 16 nt, Human
uguucuuaagacguga

SEQ ID NO: 2040853 - RNA, 17 nt, Human
aguguacagucuuguau

SEQ ID NO: 2040854 - RNA, 20 nt, Human
auaaccaaagcccaaagugg

SEQ ID NO: 2040855 - RNA, 20 nt, Human
uggugaacauugcaauagaa

SEQ ID NO: 2040856 - RNA, 15 nt, Human
uggugaacauugcaa

SEQ ID NO: 2040857 - RNA, 13 nt, Human
agucuuuuccaug

SEQ ID NO: 2040858 - RNA, 15 nt, Human
agucuuuuccaugaa

SEQ ID NO: 2040859 - RNA, 20 nt, Human
ugucucgugguaggacugua

SEQ ID NO: 2040860 - RNA, 19 nt, Human
ugucucgugguaggacugu

SEQ ID NO: 2040861 - RNA, 18 nt, Human
ugucucgugguaggacug

SEQ ID NO: 2040862 - RNA, 21 nt, Human
ugucucgugguaggacuguag

SEQ ID NO: 2040863 - RNA, 18 nt, Human
ugucuuguguuucuuuag

SEQ ID NO: 2040864 - RNA, 21 nt, Human
uguauuaaguuguuaauaaaa

SEQ ID NO: 2040865 - RNA, 17 nt, Human
aguagcuggauuacagg

SEQ ID NO: 2040866 - RNA, 23 nt, Human
ucuuuuuuuuuuuuuaaagacag

SEQ ID NO: 2040867 - RNA, 21 nt, Human
agcaccuacaguguacagucu

SEQ ID NO: 2040868 - RNA, 19 nt, Human
agcaccuacaguguacagu

SEQ ID NO: 2040869 - RNA, 15 nt, Human
agcaccuacagugua

SEQ ID NO: 2040870 - RNA, 14 nt, Human
agcaccuacagugu

SEQ ID NO: 2040871 - RNA, 22 nt, Human
agcaccuacaguguacagucuu

SEQ ID NO: 2040872 - RNA, 16 nt, Human
agaucguucucugccu

SEQ ID NO: 2040873 - RNA, 16 nt, Human
ugaccugccaggcaca

SEQ ID NO: 2040874 - RNA, 19 nt, Human
ugaccugccaggcacacug

SEQ ID NO: 2040875 - RNA, 19 nt, Human
ugacuauuuuucagaaucu

SEQ ID NO: 2040876 - RNA, 16 nt, Human
ucuguugcccaggcug

SEQ ID NO: 2040877 - RNA, 20 nt, Human
agaaagcccuuaggaagaau

SEQ ID NO: 2040878 - RNA, 22 nt, Human
agaaagcccuuaggaagaauuu

SEQ ID NO: 2040879 - RNA, 16 nt, Human
acugaacauuccagag

SEQ ID NO: 2040880 - RNA, 13 nt, Human
acugaacauucca

SEQ ID NO: 2040881 - RNA, 14 nt, Human
acugcaacuucugc

SEQ ID NO: 2040882 - RNA, 16 nt, Human
acugcaacuucugccu

SEQ ID NO: 2040883 - RNA, 18 nt, Human
acguaaagcuagaaauga

SEQ ID NO: 2040884 - RNA, 17 nt, Human
acguaaagcuagaaaug

SEQ ID NO: 2040885 - RNA, 20 nt, Human
acucaagacuuccagagccu

SEQ ID NO: 2040886 - RNA, 16 nt, Human
ucaguuuucaggagug

SEQ ID NO: 2040887 - RNA, 12 nt, Human
acccuucuuuuc

SEQ ID NO: 2040888 - RNA, 14 nt, Human
acauugcaauagaa

SEQ ID NO: 2040889 - RNA, 16 nt, Human
acauugcaauagaaau

SEQ ID NO: 2040890 - RNA, 15 nt, Human
acauugcaauagaaa

SEQ ID NO: 2040891 - RNA, 11 nt, Human
acauuuuguau

SEQ ID NO: 2040892 - RNA, 18 nt, Human
ucacguaaagcuagaaau

SEQ ID NO: 2040893 - RNA, 20 nt, Human
ucacguaaagcuagaaauga

SEQ ID NO: 2040894 - RNA, 19 nt, Human
ucacguaaagcuagaaaug

SEQ ID NO: 2040895 - RNA, 15 nt, Human
ucaccauguuggcca

SEQ ID NO: 2040896 - RNA, 21 nt, Human
ucaccauguuggccaggcugg

SEQ ID NO: 2040897 - RNA, 23 nt, Human
aauauuguacaguuuuuauugcu

SEQ ID NO: 2040898 - RNA, 17 nt, Human
aauauuguacaguuuuu

SEQ ID NO: 2040899 - RNA, 15 nt, Human
aauauuguacaguuu

SEQ ID NO: 2040900 - RNA, 14 nt, Human
aauauuguacaguu

SEQ ID NO: 2040901 - RNA, 12 nt, Human
aauauuccagag

SEQ ID NO: 2040902 - RNA, 20 nt, Human
uaacuagaacugaauuuugu

SEQ ID NO: 2040903 - RNA, 17 nt, Human
uaacuagaacugaauuu

SEQ ID NO: 2040904 - RNA, 14 nt, Human
uaacuagaacugaa

SEQ ID NO: 2040905 - RNA, 12 nt, Human
uaacuagaacug

SEQ ID NO: 2040906 - RNA, 18 nt, Human
uaacauggugugcuucuu

SEQ ID NO: 2040907 - RNA, 14 nt, Human
aauccuggggaaca

SEQ ID NO: 2040908 - RNA, 21 nt, Human
aauccuggggaacauagaacu

SEQ ID NO: 2040909 - RNA, 13 nt, Human
aaucuuucugcag

SEQ ID NO: 2040910 - RNA, 13 nt, Human
aaugacacagucu

SEQ ID NO: 2040911 - RNA, 19 nt, Human
uaauagcgucauaacuaga

SEQ ID NO: 2040912 - RNA, 14 nt, Human
aauugacuuauuua

SEQ ID NO: 2040913 - RNA, 21 nt, Human
uagugaaucacguaaagcuag

SEQ ID NO: 2040914 - RNA, 21 nt, Human
uagcuuacaagccagcuggag

SEQ ID NO: 2040915 - RNA, 14 nt, Human
uaggacuguagaaa

SEQ ID NO: 2040916 - RNA, 13 nt, Human
uaggacuguagaa

SEQ ID NO: 2040917 - RNA, 19 nt, Human
aagaaagcccuuaggaaga

SEQ ID NO: 2040918 - RNA, 19 nt, Human
gugaaguuuaauugacuua

SEQ ID NO: 2040919 - RNA, 17 nt, Human
aacguuuuuccuguucu

SEQ ID NO: 2040920 - RNA, 20 nt, Human
gucuuguguuucuuuaguuu

SEQ ID NO: 2040921 - RNA, 17 nt, Human
aaauuucucuacugucu

SEQ ID NO: 2040922 - RNA, 23 nt, Human
gucuaggcaggaccuguggccaa

SEQ ID NO: 2040923 - RNA, 20 nt, Human
uaaaaguacauguuaaacuu

SEQ ID NO: 2040924 - RNA, 21 nt, Human
aagugauucuccugccucagc

SEQ ID NO: 2040925 - RNA, 14 nt, Human
aaguuacacauuuu

SEQ ID NO: 2040926 - RNA, 16 nt, Human
guucuuaagacgugau

SEQ ID NO: 2040927 - RNA, 12 nt, Human
guuaauaaaagu

SEQ ID NO: 2040928 - RNA, 16 nt, Human
guguuucuuuaguuuu

SEQ ID NO: 2040929 - RNA, 13 nt, Human
guguuucuuuagu

SEQ ID NO: 2040930 - RNA, 23 nt, Human
aagauggcacuuauaaccaaagc

SEQ ID NO: 2040931 - RNA, 20 nt, Human
caaagugcugggauuacagg

SEQ ID NO: 2040932 - RNA, 19 nt, Human
caaagugcugggauuacag

SEQ ID NO: 2040933 - RNA, 14 nt, Human
caauauuguacagu

SEQ ID NO: 2040934 - RNA, 19 nt, Human
uuaugauuuuuaaagaaaa

SEQ ID NO: 2040935 - RNA, 16 nt, Human
uuaugauuuuuaaaga

SEQ ID NO: 2040936 - RNA, 13 nt, Human
uuccagagccuca

SEQ ID NO: 2040937 - RNA, 12 nt, Human
uucagauauaaa

SEQ ID NO: 2040938 - RNA, 15 nt, Human
uucagauauaaaaga

SEQ ID NO: 2040939 - RNA, 14 nt, Human
uucagauauaaaag

SEQ ID NO: 2040940 - RNA, 19 nt, Human
uucagauauaaaagacuga

SEQ ID NO: 2040941 - RNA, 23 nt, Human
uucuuaguugcuguaugucucgu

SEQ ID NO: 2040942 - RNA, 15 nt, Human
uucuuaguugcugua

SEQ ID NO: 2040943 - RNA, 14 nt, Human
uucuuaguugcugu

SEQ ID NO: 2040944 - RNA, 22 nt, Human
uucugauaugcaguuuuccuua

SEQ ID NO: 2040945 - RNA, 23 nt, Human
uuucagcaccuacaguguacagu

SEQ ID NO: 2040946 - RNA, 18 nt, Human
uuucagauauaaaagacu

SEQ ID NO: 2040947 - RNA, 16 nt, Human
uuucagauauaaaaga

SEQ ID NO: 2040948 - RNA, 14 nt, Human
uuucagauauaaaa

SEQ ID NO: 2040949 - RNA, 21 nt, Human
uuuaauagcgucauaacuaga

SEQ ID NO: 2040950 - RNA, 22 nt, Human
uuuaauagcgucauaacuagaa

SEQ ID NO: 2040951 - RNA, 18 nt, Human
uuuaaguuacacauuuuu

SEQ ID NO: 2040952 - RNA, 19 nt, Human
uuguuaauaaaaguacaug

SEQ ID NO: 2040953 - RNA, 14 nt, Human
uuguuaauaaaagu

SEQ ID NO: 2040954 - RNA, 21 nt, Human
uuguuaauaaaaguacauguu

SEQ ID NO: 2040955 - RNA, 19 nt, Human
uuguguuucuuuaguuuuu

SEQ ID NO: 2040956 - RNA, 21 nt, Human
uuggugaacauugcaauagaa

SEQ ID NO: 2040957 - RNA, 19 nt, Human
uugcacguauuuuaauagc

SEQ ID NO: 2040958 - RNA, 20 nt, Human
uuuuuaauaaagacaggguu

SEQ ID NO: 2040959 - RNA, 17 nt, Human
uuuuuaauaaagacagg

SEQ ID NO: 2040960 - RNA, 18 nt, Human
uuuuuaaguuacacauuu

SEQ ID NO: 2040961 - RNA, 15 nt, Human
uuuuucaguuuucag

SEQ ID NO: 2040962 - RNA, 12 nt, Human
uuuuucaguuuu

SEQ ID NO: 2040963 - RNA, 15 nt, Human
uuuucagauauaaaa

SEQ ID NO: 2040964 - RNA, 14 nt, Human
ugcaacuucugccu

SEQ ID NO: 2040965 - RNA, 13 nt, Human
ugcaacuucugcc

SEQ ID NO: 2040966 - RNA, 16 nt, Human
ugauuuugcuguagaa

SEQ ID NO: 2040967 - RNA, 14 nt, Human
ugauuuugcuguag

SEQ ID NO: 2040968 - RNA, 19 nt, Human
ugauuuugcuguagaagau

SEQ ID NO: 2040969 - RNA, 17 nt, Human
ugauuuugcuguagaag

SEQ ID NO: 2040970 - RNA, 19 nt, Human
ugauuuuuaaagaaaaguu

SEQ ID NO: 2040971 - RNA, 21 nt, Human
ugcaaugacacagucuuggcu

SEQ ID NO: 2040972 - RNA, 19 nt, Human
ugauaugcaguuuuccuua

SEQ ID NO: 2040973 - RNA, 23 nt, Human
uggccuccaaguccacaguggaa

SEQ ID NO: 2040974 - RNA, 13 nt, Human
uggccuccaaguc

SEQ ID NO: 2040975 - RNA, 19 nt, Human
ugucuaggcaggaccugug

SEQ ID NO: 2040976 - RNA, 17 nt, Human
ugucuaggcaggaccug

SEQ ID NO: 2040977 - RNA, 20 nt, Human
ugguggggcugccaggggag

SEQ ID NO: 2040978 - RNA, 16 nt, Human
ugguuuuucaguuuuc

SEQ ID NO: 2040979 - RNA, 13 nt, Human
uccccuucacucc

SEQ ID NO: 2040980 - RNA, 23 nt, Human
ucccguggaacguuuuuccuguu

SEQ ID NO: 2040981 - RNA, 22 nt, Human
ucccguggaacguuuuuccugu

SEQ ID NO: 2040982 - RNA, 16 nt, Human
ucccguggaacguuuu

SEQ ID NO: 2040983 - RNA, 14 nt, Human
uccugccucagccu

SEQ ID NO: 2040984 - RNA, 22 nt, Human
ucucaaagaaauuuccacucag

SEQ ID NO: 2040985 - RNA, 21 nt, Human
ucucaaagaaauuuccacuca

SEQ ID NO: 2040986 - RNA, 19 nt, Human
ucucaaagaaauuuccacu

SEQ ID NO: 2040987 - RNA, 22 nt, Human
ucgagguuucucaaagaaauuu

SEQ ID NO: 2040988 - RNA, 16 nt, Human
ucgagguuucucaaag

SEQ ID NO: 2040989 - RNA, 19 nt, Human
ucucgugguaggacuguag

SEQ ID NO: 2040990 - RNA, 21 nt, Human
ucucgugguaggacuguagaa

SEQ ID NO: 2040991 - RNA, 19 nt, Human
ucuucuuuuugcuucaaaa

SEQ ID NO: 2040992 - RNA, 20 nt, Human
ucaaagaaauuuccacucag

SEQ ID NO: 2040993 - RNA, 19 nt, Human
ucaaagaaauuuccacuca

SEQ ID NO: 2040994 - RNA, 13 nt, Human
ucaaagaaauuuc

SEQ ID NO: 2040995 - RNA, 12 nt, Human
ucaaagaaauuu

SEQ ID NO: 2040996 - RNA, 15 nt, Human
ucaaaugagaaaaug

SEQ ID NO: 2040997 - RNA, 13 nt, Human
uauuuauauaaau

SEQ ID NO: 2040998 - RNA, 18 nt, Human
ucaagugauucuccugcc

SEQ ID NO: 2040999 - RNA, 19 nt, Human
ucaagugauucuccugccu

SEQ ID NO: 2041000 - RNA, 21 nt, Human
uauugcuugcacaaaccaauu

SEQ ID NO: 2041001 - RNA, 19 nt, Human
uauugcuuguuggauuuuu

SEQ ID NO: 2041002 - RNA, 17 nt, Human
ucagauauaaaagacug

SEQ ID NO: 2041003 - RNA, 14 nt, Human
ucagauauaaaaga

SEQ ID NO: 2041004 - RNA, 20 nt, Human
ucagauauaaaagacugacc

SEQ ID NO: 2041005 - RNA, 18 nt, Human
ucagauauaaaagacuga

SEQ ID NO: 2041006 - RNA, 21 nt, Human
ucagccuccugaguagcugga

SEQ ID NO: 2041007 - RNA, 13 nt, Human
ucagccuccugag

SEQ ID NO: 2041008 - RNA, 20 nt, Human
ucagccuccugaguagcugg

SEQ ID NO: 2041009 - RNA, 21 nt, Human
ucagggagugggcuaagcacg

SEQ ID NO: 2041010 - RNA, 19 nt, Human
gcuggucucaaacuccuga

SEQ ID NO: 2041011 - RNA, 20 nt, Human
gcuggucucaaacuccugac

SEQ ID NO: 2041012 - RNA, 14 nt, Human
gcuuguuggauuuu

SEQ ID NO: 2041013 - RNA, 12 nt, Human
gccaaguucuua

SEQ ID NO: 2041014 - RNA, 17 nt, Human
gccaccgcgcccagccu

SEQ ID NO: 2041015 - RNA, 21 nt, Human
gauggcacuuauaaccaaagc

SEQ ID NO: 2041016 - RNA, 12 nt, Human
gaguagcuggau

SEQ ID NO: 2041017 - RNA, 18 nt, Human
gagccaccgcgcccagcc

SEQ ID NO: 2041018 - RNA, 20 nt, Human
gaggcggccccggccggggu

SEQ ID NO: 2041019 - RNA, 16 nt, Human
cucaagacuuccagag

SEQ ID NO: 2041020 - RNA, 14 nt, Human
cucaagacuuccag

SEQ ID NO: 2041021 - RNA, 23 nt, Human
cuccaaguccacaguggaaccag

SEQ ID NO: 2041022 - RNA, 13 nt, Human
cucauuaaaaaaa

SEQ ID NO: 2041023 - RNA, 20 nt, Human
cuccuuagaaguggaaguag

SEQ ID NO: 2041024 - RNA, 17 nt, Human
cuccuuagaaguggaag

SEQ ID NO: 2041025 - RNA, 13 nt, Human
cuccuuagaagug

SEQ ID NO: 2041026 - RNA, 21 nt, Human
cuccugccucagccuccugag

SEQ ID NO: 2041027 - RNA, 15 nt, Human
cugaacauuccagag

SEQ ID NO: 2041028 - RNA, 20 nt, Human
cucuuuguucuaaagaugga

SEQ ID NO: 2041029 - RNA, 22 nt, Human
cucuguugcccaggcuggagug

SEQ ID NO: 2041030 - RNA, 20 nt, Human
cucuguugcccaggcuggag

SEQ ID NO: 2041031 - RNA, 23 nt, Human
gaaaugcugguuuuucaguuuuc

SEQ ID NO: 2041032 - RNA, 18 nt, Human
gaaguuuaauugacuuau

SEQ ID NO: 2041033 - RNA, 18 nt, Human
cuuuguucuaaagaugga

SEQ ID NO: 2041034 - RNA, 21 nt, Human
cuuguuggauuuuugucuugu

SEQ ID NO: 2041035 - RNA, 21 nt, Human
cuuguguuucuuuaguuuuug

SEQ ID NO: 2041036 - RNA, 23 nt, Human
cuuguuggauuuuugucuugugu

SEQ ID NO: 2041037 - RNA, 15 nt, Human
cuuuaguuuuuguga

SEQ ID NO: 2041038 - RNA, 13 nt, Human
cuuuaguuuuugu

SEQ ID NO: 2041039 - RNA, 17 nt, Human
cuuuauuaaauguagaa

SEQ ID NO: 2041040 - RNA, 18 nt, Human
cuguucuuaagacgugau

SEQ ID NO: 2041041 - RNA, 16 nt, Human
cuuagaaguggaagua

SEQ ID NO: 2041042 - RNA, 17 nt, Human
cccgucgacguagaacc

SEQ ID NO: 2041043 - RNA, 14 nt, Human
ccuuagaaguggaa

SEQ ID NO: 2041044 - RNA, 19 nt, Human
ccagccucaucucuuuguu

SEQ ID NO: 2041045 - RNA, 21 nt, Human
cccaaagugguauagaaaugc

SEQ ID NO: 2041046 - RNA, 20 nt, Human
cccaaagugguauagaaaug

SEQ ID NO: 2041047 - RNA, 22 nt, Human
cauuuuacuuuuuccuggcuca

SEQ ID NO: 2041048 - RNA, 20 nt, Human
cauuuuacuuuuuccuggcu

SEQ ID NO: 2041049 - RNA, 17 nt, Human
cauuuuacuuuuuccug

SEQ ID NO: 2041050 - RNA, 22 nt, Human
cauuuacccuucuuuucugacu

SEQ ID NO: 2041051 - RNA, 22 nt, Human
cauuaaaaaaaaaaaaaaaagu

SEQ ID NO: 2041052 - RNA, 14 nt, Human
cauguguuccaagg

SEQ ID NO: 2041053 - RNA, 23 nt, Human
caggcuggucucaaacuccugac

SEQ ID NO: 2041054 - RNA, 17 nt, Human
caggaguggguugauuu

SEQ ID NO: 2041055 - RNA, 17 nt, Human
cagucuuguauuaaguu

SEQ ID NO: 2041056 - RNA, 16 nt, Human
cagucuuggcucacug

SEQ ID NO: 2041057 - RNA, 17 nt, Human
caggaccuguggccaag

SEQ ID NO: 2041058 - RNA, 18 nt, Human
cagcuggagaaauauggu

SEQ ID NO: 2041059 - RNA, 20 nt, Human
cagccuccugaguagcugga

SEQ ID NO: 2041060 - RNA, 23 nt, Human
cagagucucgcucuguugcccag

SEQ ID NO: 2041061 - RNA, 16 nt, Human
cacucaggucuguuuu

SEQ ID NO: 2041062 - RNA, 17 nt, Human
cacugcaacuucugccu

SEQ ID NO: 2041063 - RNA, 16 nt, Human
cacugcaacuucugcc

SEQ ID NO: 2041064 - RNA, 16 nt, Human
aguuguuaauaaaagu

SEQ ID NO: 2041065 - RNA, 11 nt, Human
auaaagacagg

SEQ ID NO: 2041066 - RNA, 22 nt, Human
auaaauuuuuuuuguuucauau

SEQ ID NO: 2041067 - RNA, 19 nt, Human
auaaauuuuuuuuguuuca

SEQ ID NO: 2041068 - RNA, 18 nt, Human
aggaguggguugauuuca

SEQ ID NO: 2041069 - RNA, 17 nt, Human
agacgugauuuugcugu

SEQ ID NO: 2041070 - RNA, 16 nt, Human
aaucucuccauucccg

SEQ ID NO: 2041071 - RNA, 20 nt, Human
aaugauccccagcuguuuau

SEQ ID NO: 2041072 - RNA, 19 nt, Human
aaugauccccagcuguuua

SEQ ID NO: 2041073 - RNA, 22 nt, Human
aaugauccccagcuguuuaugc

SEQ ID NO: 2041074 - RNA, 16 nt, Human
aaugauccccagcugu

SEQ ID NO: 2041075 - RNA, 12 nt, Human
aauguuuccuuu

SEQ ID NO: 2041076 - RNA, 13 nt, Human
aauguuuccuuua

SEQ ID NO: 2041077 - RNA, 15 nt, Human
aaguaguggagcccc

SEQ ID NO: 2041078 - RNA, 18 nt, Human
aaguauccugcuucugau

SEQ ID NO: 2041079 - RNA, 19 nt, Human
aaguccacaguggaaccag

SEQ ID NO: 2041080 - RNA, 14 nt, Human
aaguccacagugga

SEQ ID NO: 2041081 - RNA, 19 nt, Human
aaagcccuuaggaagaauu

SEQ ID NO: 2041082 - RNA, 18 nt, Human
aaauuuuuuuuguuucau

SEQ ID NO: 2041083 - RNA, 17 nt, Human
aaauuuuuuuuguuuca

SEQ ID NO: 2041084 - RNA, 15 nt, Human
accagcccagacccu

SEQ ID NO: 2041085 - RNA, 14 nt, Human
acacauuuuucaga

SEQ ID NO: 2041086 - RNA, 18 nt, Human
acuauuuuucagaaucuc

SEQ ID NO: 2041087 - RNA, 14 nt, Human
acuauuuuucagaa

SEQ ID NO: 2041088 - RNA, 17 nt, Human
cucgugguaggacugua

SEQ ID NO: 2041089 - RNA, 16 nt, Human
cucgugguaggacugu

SEQ ID NO: 2041090 - RNA, 15 nt, Human
cucgugguaggacug

SEQ ID NO: 2041091 - RNA, 21 nt, Human
cgagguuucucaaagaaauuu

SEQ ID NO: 2041092 - RNA, 22 nt, Human
cucaaagaaauuuccacucagg

SEQ ID NO: 2041093 - RNA, 14 nt, Human
cuauuuuucagaau

SEQ ID NO: 2041094 - RNA, 14 nt, Human
ccucaaaugagaaa

SEQ ID NO: 2041095 - RNA, 21 nt, Human
ccucgagguuucucaaagaaa

SEQ ID NO: 2041096 - RNA, 20 nt, Human
cccaggcuggagugcaauga

SEQ ID NO: 2041097 - RNA, 12 nt, Human
caagauuucaga

SEQ ID NO: 2041098 - RNA, 20 nt, Human
cagaaagguuuucuucuuuu

SEQ ID NO: 2041099 - RNA, 22 nt, Human
caaaugagaaaaugucuuuauu

SEQ ID NO: 2041100 - RNA, 16 nt, Human
auugcuuguuggauuu

SEQ ID NO: 2041101 - RNA, 14 nt, Human
auugcuugcacaaa

SEQ ID NO: 2041102 - RNA, 15 nt, Human
cagcaccuacagugu

SEQ ID NO: 2041103 - RNA, 20 nt, Human
cagcaccuacaguguacagu

SEQ ID NO: 2041104 - RNA, 22 nt, Human
cauagcuuacaagccagcugga

SEQ ID NO: 2041105 - RNA, 15 nt, Human
gccccugcucuggug

SEQ ID NO: 2041106 - RNA, 12 nt, Human
guagaagauggc

SEQ ID NO: 2041107 - RNA, 14 nt, Human
guacucauuaaaaa

SEQ ID NO: 2041108 - RNA, 16 nt, Human
aaaguacauguuaaac

SEQ ID NO: 2041109 - RNA, 15 nt, Human
guaauccaccugccu

SEQ ID NO: 2041110 - RNA, 19 nt, Human
aaagacugaccaauauugu

SEQ ID NO: 2041111 - RNA, 9 nt, Human
aaagacaga

SEQ ID NO: 2041112 - RNA, 17 nt, Human
gacaggguuucaccaug

SEQ ID NO: 2041113 - RNA, 21 nt, Human
gcaccuacaguguacagucuu

SEQ ID NO: 2041114 - RNA, 19 nt, Human
gcaccuacaguguacaguc

SEQ ID NO: 2041115 - RNA, 18 nt, Human
gcaccuacaguguacagu

SEQ ID NO: 2041116 - RNA, 23 nt, Human
cuuggguucaagugauucuccug

SEQ ID NO: 2041117 - RNA, 15 nt, Human
cuuaggaagaauuuu

SEQ ID NO: 2041118 - RNA, 20 nt, Human
cuuacauuuuacuuuuuccu

SEQ ID NO: 2041119 - RNA, 17 nt, Human
cuuacaagccagcugga

SEQ ID NO: 2041120 - RNA, 16 nt, Human
cuuacaagccagcugg

SEQ ID NO: 2041121 - RNA, 19 nt, Human
cuguagaaaagggaacuga

SEQ ID NO: 2041122 - RNA, 13 nt, Human
auuugucaacaaa

SEQ ID NO: 2041123 - RNA, 15 nt, Human
auuugucaacaaagu

SEQ ID NO: 2041124 - RNA, 16 nt, Human
auuuccacucaggucu

SEQ ID NO: 2041125 - RNA, 16 nt, Human
auuggauuugucuuug

SEQ ID NO: 2041126 - RNA, 21 nt, Human
auuguacaguuuuuauugcuu

SEQ ID NO: 2041127 - RNA, 15 nt, Human
auuguacaguuuuua

SEQ ID NO: 2041128 - RNA, 14 nt, Human
auuguacaguuuuu

SEQ ID NO: 2041129 - RNA, 20 nt, Human
auuuugcuguagaagauggc

SEQ ID NO: 2041130 - RNA, 18 nt, Human
auuuuguauauuuguauu

SEQ ID NO: 2041131 - RNA, 12 nt, Human
auuuugucuuua

SEQ ID NO: 2041132 - RNA, 16 nt, Human
auuuuucagauauaaa

SEQ ID NO: 2041133 - RNA, 14 nt, Human
auuuuugucuugug

SEQ ID NO: 2041134 - RNA, 19 nt, Human
auuccagagcguguaguga

SEQ ID NO: 2041135 - RNA, 19 nt, Human
auuaucuaaaaucugcuag

SEQ ID NO: 2041136 - RNA, 14 nt, Human
uuucugcagaaaca

SEQ ID NO: 2041137 - RNA, 17 nt, Human
auguaaaagacuuuuuu

SEQ ID NO: 2041138 - RNA, 19 nt, Human
uuugucuuuggugaacauu

SEQ ID NO: 2041139 - RNA, 21 nt, Human
uuugucuuguguuucuuuagu

SEQ ID NO: 2041140 - RNA, 16 nt, Human
augucucgugguagga

SEQ ID NO: 2041141 - RNA, 15 nt, Human
augucucgugguagg

SEQ ID NO: 2041142 - RNA, 19 nt, Human
augucucgugguaggacug

SEQ ID NO: 2041143 - RNA, 19 nt, Human
auguaugaggaauuucugu

SEQ ID NO: 2041144 - RNA, 18 nt, Human
aucaguagccagcaucug

SEQ ID NO: 2041145 - RNA, 21 nt, Human
uucuucuuuuugcuucaaaaa

SEQ ID NO: 2041146 - RNA, 17 nt, Human
uucuucuuuuugcuuca

SEQ ID NO: 2041147 - RNA, 23 nt, Human
uucuuaagacgugauuuugcugu

SEQ ID NO: 2041148 - RNA, 21 nt, Human
uucuuaagacgugauuuugcu

SEQ ID NO: 2041149 - RNA, 23 nt, Human
uucccguggaacguuuuuccugu

SEQ ID NO: 2041150 - RNA, 14 nt, Human
aucguucucugccu

SEQ ID NO: 2041151 - RNA, 20 nt, Human
aucugcuagggaauaucaau

SEQ ID NO: 2041152 - RNA, 13 nt, Human
aucuuucugcaga

SEQ ID NO: 2041153 - RNA, 21 nt, Human
uuaguuuuugugaaguuuaau

SEQ ID NO: 2041154 - RNA, 18 nt, Human
uuaguuuuugugaaguuu

SEQ ID NO: 2041155 - RNA, 18 nt, Human
auaacuuuuuuuuaaguu

SEQ ID NO: 2041156 - RNA, 20 nt, Human
uuacagggaugagccaccgc

SEQ ID NO: 2041157 - RNA, 16 nt, Human
uuaauaaaaguacaug

SEQ ID NO: 2041158 - RNA, 20 nt, Human
aguuuuuauugcuuguugga

SEQ ID NO: 2041159 - RNA, 13 nt, Human
auacgauaaauaa

SEQ ID NO: 2041160 - RNA, 22 nt, Human
auagaaaugcugguuuuucagu

SEQ ID NO: 2041161 - RNA, 19 nt, Human
auagaaaugcugguuuuuc

SEQ ID NO: 2041162 - RNA, 13 nt, Human
auagaaaugcugg

SEQ ID NO: 2041163 - RNA, 19 nt, Human
agucucgcucuguugccca

SEQ ID NO: 2041164 - RNA, 18 nt, Human
agugguauagaaaugcug

SEQ ID NO: 2041165 - RNA, 16 nt, Human
agugguauagaaaugc

SEQ ID NO: 2041166 - RNA, 15 nt, Human
agugguauagaaaug

SEQ ID NO: 2041167 - RNA, 14 nt, Human
agugguauagaaau

SEQ ID NO: 2041168 - RNA, 19 nt, Human
uguuaauaaaaguacaugu

SEQ ID NO: 2041169 - RNA, 18 nt, Human
uguuaauaaaaguacaug

SEQ ID NO: 2041170 - RNA, 13 nt, Human
uguuaauaaaagu

SEQ ID NO: 2041171 - RNA, 22 nt, Human
uguagugaaucacguaaagcua

SEQ ID NO: 2041172 - RNA, 12 nt, Human
uguacaguuuuu

SEQ ID NO: 2041173 - RNA, 16 nt, Human
agguuucucaaagaaa

SEQ ID NO: 2041174 - RNA, 19 nt, Human
agguuucucaaagaaauuu

SEQ ID NO: 2041175 - RNA, 21 nt, Human
uggcucacugcaacuucugcc

SEQ ID NO: 2041176 - RNA, 14 nt, Human
uggaaguaguggag

SEQ ID NO: 2041177 - RNA, 17 nt, Human
uggaaguaguggagccc

SEQ ID NO: 2041178 - RNA, 17 nt, Human
agcuggagaaauauggu

SEQ ID NO: 2041179 - RNA, 17 nt, Human
ugcacguauuuuaauag

SEQ ID NO: 2041180 - RNA, 12 nt, Human
ugcaguuuuccu

SEQ ID NO: 2041181 - RNA, 19 nt, Human
acuuugaggguguauauuu

SEQ ID NO: 2041182 - RNA, 15 nt, Human
acuuuuuuuuaaguu

SEQ ID NO: 2041183 - RNA, 15 nt, Human
agaaagaagaugaau

SEQ ID NO: 2041184 - RNA, 15 nt, Human
ucugcagaaacagaa

SEQ ID NO: 2041185 - RNA, 21 nt, Human
agaacucaugacggaagaguu

SEQ ID NO: 2041186 - RNA, 19 nt, Human
agacaggguuucaccaugu

SEQ ID NO: 2041187 - RNA, 19 nt, Human
agaccuaacgagaaauaga

SEQ ID NO: 2041188 - RNA, 21 nt, Human
agcaaaaccaaauauuccaga

SEQ ID NO: 2041189 - RNA, 21 nt, Human
ugacuuauuuauauaaauuuu

SEQ ID NO: 2041190 - RNA, 17 nt, Human
ugacuuauuuauauaaa

SEQ ID NO: 2041191 - RNA, 20 nt, Human
ugacuuauuuauauaaauuu

SEQ ID NO: 2041192 - RNA, 14 nt, Human
uccacagugacucc

SEQ ID NO: 2041193 - RNA, 20 nt, Human
uccacaguggaaccagccca

SEQ ID NO: 2041194 - RNA, 16 nt, Human
uccacaguggaaccag

SEQ ID NO: 2041195 - RNA, 19 nt, Human
uccugaguagcuggauuac

SEQ ID NO: 2041196 - RNA, 19 nt, Human
uccuguucuuaagacguga

SEQ ID NO: 2041197 - RNA, 23 nt, Human
acuguagaaaagggaacugaaca

SEQ ID NO: 2041198 - RNA, 17 nt, Human
acucaagacuuccagag

SEQ ID NO: 2041199 - RNA, 15 nt, Human
acuccugaccucaag

SEQ ID NO: 2041200 - RNA, 17 nt, Human
uauuguacaguuuuuau

SEQ ID NO: 2041201 - RNA, 15 nt, Human
uauuguacaguuuuu

SEQ ID NO: 2041202 - RNA, 14 nt, Human
uauuguacaguuuu

SEQ ID NO: 2041203 - RNA, 13 nt, Human
uauuguacaguuu

SEQ ID NO: 2041204 - RNA, 12 nt, Human
uauuguacaguu

SEQ ID NO: 2041205 - RNA, 11 nt, Human
uauuguacagu

SEQ ID NO: 2041206 - RNA, 14 nt, Human
acagucuuguauua

SEQ ID NO: 2041207 - RNA, 22 nt, Human
acagucuuguauuaaguuguua

SEQ ID NO: 2041208 - RNA, 18 nt, Human
acagucuuguauuaaguu

SEQ ID NO: 2041209 - RNA, 15 nt, Human
acagucuuguauuaa

SEQ ID NO: 2041210 - RNA, 16 nt, Human
aauuucucuacugucu

SEQ ID NO: 2041211 - RNA, 21 nt, Human
uagaaccucgagguuucucaa

SEQ ID NO: 2041212 - RNA, 22 nt, Human
uagaacugaauuuugucuuuau

SEQ ID NO: 2041213 - RNA, 17 nt, Human
uagaacugaauuuuguc

SEQ ID NO: 2041214 - RNA, 13 nt, Human
uagaacugaauuu

SEQ ID NO: 2041215 - RNA, 18 nt, Human
uagaagauggcacuuaua

SEQ ID NO: 2041216 - RNA, 15 nt, Human
acaagccagcuggag

SEQ ID NO: 2041217 - RNA, 13 nt, Human
acaagccagcugg

SEQ ID NO: 2041218 - RNA, 13 nt, Human
uaauuuuuuacua

SEQ ID NO: 2041219 - RNA, 22 nt, Human
uaauuuuuguguuuuuaauaaa

SEQ ID NO: 2041220 - RNA, 18 nt, Human
uacaagccagcuggagaa

SEQ ID NO: 2041221 - RNA, 12 nt, Human
uacagucuugua

SEQ ID NO: 2041222 - RNA, 13 nt, Human
uacagucuuguau

SEQ ID NO: 2041223 - RNA, 14 nt, Human
aaguuuaauugacu

SEQ ID NO: 2041224 - RNA, 17 nt, Human
aaguuacacauuuuuca

SEQ ID NO: 2041225 - RNA, 13 nt, Human
uaaagauggaaaa

SEQ ID NO: 2041226 - RNA, 9 nt, Human
uaaagacag

SEQ ID NO: 2041227 - RNA, 10 nt, Human
uaaagacaga

SEQ ID NO: 2041228 - RNA, 19 nt, Human
uaaacccaguaguggugac

SEQ ID NO: 2041229 - RNA, 13 nt, Human
uaaauaacuuuuu

SEQ ID NO: 2041230 - RNA, 19 nt, Human
uaaauuuuuuuuguuucau

SEQ ID NO: 2041231 - RNA, 22 nt, Human
aagaaaaguuuuguaaauuucu

SEQ ID NO: 2041232 - RNA, 21 nt, Human
aagaaaaguuuuguaaauuuc

SEQ ID NO: 2041233 - RNA, 16 nt, Human
aagaaaaguuuuguaa

SEQ ID NO: 2041234 - RNA, 15 nt, Human
aagaaaaguuuugua

SEQ ID NO: 2041235 - RNA, 14 nt, Human
aacuuggaaauagu

SEQ ID NO: 2041236 - RNA, 16 nt, Human
aagcaagauuucagau

SEQ ID NO: 2041237 - RNA, 16 nt, Human
aaccaaauauuccaga

SEQ ID NO: 2041238 - RNA, 16 nt, Human
gucucaaacuccugac

SEQ ID NO: 2041239 - RNA, 17 nt, Human
aacuagaacugaauuuu

SEQ ID NO: 2041240 - RNA, 15 nt, Human
aacugaacauuccag

SEQ ID NO: 2041241 - RNA, 14 nt, Human
caagugauucuccu

SEQ ID NO: 2041242 - RNA, 21 nt, Human
caagugauucuccugccucag

SEQ ID NO: 2041243 - RNA, 22 nt, Human
caagugauucuccugccucagc

SEQ ID NO: 2041244 - RNA, 16 nt, Human
caagugauucuccugc

SEQ ID NO: 2041245 - RNA, 21 nt, Human
caaugacacagucuuggcuca

SEQ ID NO: 2041246 - RNA, 19 nt, Human
caaugacacagucuuggcu

SEQ ID NO: 2041247 - RNA, 14 nt, Human
caaugacacagucu

SEQ ID NO: 2041248 - RNA, 13 nt, Human
uucugugcagcca

SEQ ID NO: 2041249 - RNA, 18 nt, Human
uugcagcgauuaauaaca

SEQ ID NO: 2041250 - RNA, 19 nt, Human
uugcagcgauuaauaacag

SEQ ID NO: 2041251 - RNA, 19 nt, Human
uugucuuuggugaacauug

SEQ ID NO: 2041252 - RNA, 17 nt, Human
uuuccacucaggucugu

SEQ ID NO: 2041253 - RNA, 21 nt, Human
uuugaggguguauauuuucug

SEQ ID NO: 2041254 - RNA, 15 nt, Human
uuaguugcuguaugu

SEQ ID NO: 2041255 - RNA, 13 nt, Human
uuaguugcuguau

SEQ ID NO: 2041256 - RNA, 14 nt, Human
uuaugcauagauaa

SEQ ID NO: 2041257 - RNA, 19 nt, Human
uuauugcagcgauuaauaa

SEQ ID NO: 2041258 - RNA, 18 nt, Human
uuccacucaggucuguuu

SEQ ID NO: 2041259 - RNA, 15 nt, Human
uucuaaagauggaaa

SEQ ID NO: 2041260 - RNA, 22 nt, Human
uuaggccaaaaaaauguaagau

SEQ ID NO: 2041261 - RNA, 20 nt, Human
uguuucauauugaugugugu

SEQ ID NO: 2041262 - RNA, 12 nt, Human
uuaaagacagag

SEQ ID NO: 2041263 - RNA, 11 nt, Human
uuaaagacaga

SEQ ID NO: 2041264 - RNA, 17 nt, Human
uggauuuuugucuugug

SEQ ID NO: 2041265 - RNA, 13 nt, Human
uggccaggcuggu

SEQ ID NO: 2041266 - RNA, 15 nt, Human
ugcugguuuuucagu

SEQ ID NO: 2041267 - RNA, 12 nt, Human
ugcugguuuuuc

SEQ ID NO: 2041268 - RNA, 18 nt, Human
ugcugguuuuucaguuuu

SEQ ID NO: 2041269 - RNA, 16 nt, Human
ugcugguuuuucaguu

SEQ ID NO: 2041270 - RNA, 18 nt, Human
ugaacauugcaauagaaa

SEQ ID NO: 2041271 - RNA, 12 nt, Human
ucuuguguuucu

SEQ ID NO: 2041272 - RNA, 20 nt, Human
ucgugguaggacuguagaaa

SEQ ID NO: 2041273 - RNA, 15 nt, Human
ucgugguaggacugu

SEQ ID NO: 2041274 - RNA, 14 nt, Human
ucgugguaggacug

SEQ ID NO: 2041275 - RNA, 14 nt, Human
uccuuagaagugga

SEQ ID NO: 2041276 - RNA, 15 nt, Human
uauugcuugcacaaa

SEQ ID NO: 2041277 - RNA, 22 nt, Human
uauugcagcgauuaauaacagg

SEQ ID NO: 2041278 - RNA, 15 nt, Human
uauuaaguuguuaau

SEQ ID NO: 2041279 - RNA, 18 nt, Human
uauguugguagauucuaa

SEQ ID NO: 2041280 - RNA, 18 nt, Human
uauacgauaaauaacuuu

SEQ ID NO: 2041281 - RNA, 23 nt, Human
uauauaaauuuuuuuuguuucau

SEQ ID NO: 2041282 - RNA, 23 nt, Human
uaugauuuuuaaagaaaaguuuu

SEQ ID NO: 2041283 - RNA, 12 nt, Human
uaugauuuuuaa

SEQ ID NO: 2041284 - RNA, 12 nt, Human
uaugaauaacau

SEQ ID NO: 2041285 - RNA, 14 nt, Human
guggccaaguucuu

SEQ ID NO: 2041286 - RNA, 22 nt, Human
guggaacguuuuuccuguucuu

SEQ ID NO: 2041287 - RNA, 16 nt, Human
gugagcuccuaagcca

SEQ ID NO: 2041288 - RNA, 18 nt, Human
gugaaucacguaaagcua

SEQ ID NO: 2041289 - RNA, 16 nt, Human
gugaaucacguaaagc

SEQ ID NO: 2041290 - RNA, 16 nt, Human
gugauuuugcuguaga

SEQ ID NO: 2041291 - RNA, 13 nt, Human
gugauucuccugc

SEQ ID NO: 2041292 - RNA, 13 nt, Human
gucucgugguagg

SEQ ID NO: 2041293 - RNA, 17 nt, Human
gucauaacuagaacuga

SEQ ID NO: 2041294 - RNA, 22 nt, Human
gucauaacuagaacugaauuuu

SEQ ID NO: 2041295 - RNA, 14 nt, Human
ggggcugccagggg

SEQ ID NO: 2041296 - RNA, 20 nt, Human
ggguuucaccauguuggcca

SEQ ID NO: 2041297 - RNA, 14 nt, Human
ggugaacauugcaa

SEQ ID NO: 2041298 - RNA, 19 nt, Human
guaagaucguucucugccu

SEQ ID NO: 2041299 - RNA, 15 nt, Human
guaaaagacuuuuuu

SEQ ID NO: 2041300 - RNA, 14 nt, Human
guacagucuuguau

SEQ ID NO: 2041301 - RNA, 13 nt, Human
guacagucuugua

SEQ ID NO: 2041302 - RNA, 16 nt, Human
guacagucuuguauua

SEQ ID NO: 2041303 - RNA, 13 nt, Human
guacaguuuuuau

SEQ ID NO: 2041304 - RNA, 12 nt, Human
guacaguuuuua

SEQ ID NO: 2041305 - RNA, 20 nt, Human
guagaaaagggaacugaaca

SEQ ID NO: 2041306 - RNA, 18 nt, Human
gccucagccuccugagua

SEQ ID NO: 2041307 - RNA, 16 nt, Human
gccucagccuccugag

SEQ ID NO: 2041308 - RNA, 20 nt, Human
ggagugcaaugacacagucu

SEQ ID NO: 2041309 - RNA, 15 nt, Human
gaguggguugauuuc

SEQ ID NO: 2041310 - RNA, 20 nt, Human
gagguuucucaaagaaauuu

SEQ ID NO: 2041311 - RNA, 18 nt, Human
gauuacaggcaugugcca

SEQ ID NO: 2041312 - RNA, 16 nt, Human
gauuuugcuguagaag

SEQ ID NO: 2041313 - RNA, 20 nt, Human
gauuacagggaugagccacc

SEQ ID NO: 2041314 - RNA, 18 nt, Human
gauuacagggaugagcca

SEQ ID NO: 2041315 - RNA, 21 nt, Human
gagccagcagccuggcucucc

SEQ ID NO: 2041316 - RNA, 19 nt, Human
cuggcaguggaacuaagaa

SEQ ID NO: 2041317 - RNA, 18 nt, Human
cuguggccaaguucuuag

SEQ ID NO: 2041318 - RNA, 16 nt, Human
cuguggccaaguucuu

SEQ ID NO: 2041319 - RNA, 20 nt, Human
cuucuccuuagaaguggaag

SEQ ID NO: 2041320 - RNA, 19 nt, Human
gaaaaguuuuguaaauuuc

SEQ ID NO: 2041321 - RNA, 13 nt, Human
ccugccucagccu

SEQ ID NO: 2041322 - RNA, 22 nt, Human
cuccaaguccacaguggaacca

SEQ ID NO: 2041323 - RNA, 15 nt, Human
ccuacaguguacagu

SEQ ID NO: 2041324 - RNA, 20 nt, Human
ccuacaguguacagucuugu

SEQ ID NO: 2041325 - RNA, 16 nt, Human
ccuacaguguacaguc

SEQ ID NO: 2041326 - RNA, 23 nt, Human
ccagagccucaaaugagaaaaug

SEQ ID NO: 2041327 - RNA, 20 nt, Human
ccagagccucaaaugagaaa

SEQ ID NO: 2041328 - RNA, 14 nt, Human
ccaggcuggucuca

SEQ ID NO: 2041329 - RNA, 19 nt, Human
accuguggccaaguucuua

SEQ ID NO: 2041330 - RNA, 18 nt, Human
accuguggccaaguucuu

SEQ ID NO: 2041331 - RNA, 14 nt, Human
acuaaucuuucugc

SEQ ID NO: 2041332 - RNA, 17 nt, Human
acuauugcuugcacaaa

SEQ ID NO: 2041333 - RNA, 13 nt, Human
acuucugccucuu

SEQ ID NO: 2041334 - RNA, 21 nt, Human
acugaccaauauuguacaguu

SEQ ID NO: 2041335 - RNA, 20 nt, Human
acugaccaauauuguacagu

SEQ ID NO: 2041336 - RNA, 22 nt, Human
acugaccaauauuguacaguuu

SEQ ID NO: 2041337 - RNA, 17 nt, Human
acaguguacagucuugu

SEQ ID NO: 2041338 - RNA, 15 nt, Human
acaguguacagucuu

SEQ ID NO: 2041339 - RNA, 18 nt, Human
acaguguacagucuugua

SEQ ID NO: 2041340 - RNA, 13 nt, Human
acaguguacaguc

SEQ ID NO: 2041341 - RNA, 12 nt, Human
acaguguacagu

SEQ ID NO: 2041342 - RNA, 14 nt, Human
aacuuacuuagugu

SEQ ID NO: 2041343 - RNA, 19 nt, Human
aauccaccugccucggccu

SEQ ID NO: 2041344 - RNA, 18 nt, Human
aauccaccugccucggcc

SEQ ID NO: 2041345 - RNA, 16 nt, Human
aauagaaauccaauug

SEQ ID NO: 2041346 - RNA, 17 nt, Human
aauagaaauggggaacu

SEQ ID NO: 2041347 - RNA, 22 nt, Human
aaguucuuaguugcuguauguc

SEQ ID NO: 2041348 - RNA, 15 nt, Human
aaguucuuaguugcu

SEQ ID NO: 2041349 - RNA, 18 nt, Human
aaagcccaaagugguaua

SEQ ID NO: 2041350 - RNA, 16 nt, Human
aggaccuguggccaag

SEQ ID NO: 2041351 - RNA, 22 nt, Human
aggcuggucucaaacuccugac

SEQ ID NO: 2041352 - RNA, 11 nt, Human
agacagagucu

SEQ ID NO: 2041353 - RNA, 17 nt, Human
agagccucaaaugagaa

SEQ ID NO: 2041354 - RNA, 14 nt, Human
agagccucaaauga

SEQ ID NO: 2041355 - RNA, 22 nt, Human
agacugaccaauauuguacagu

SEQ ID NO: 2041356 - RNA, 16 nt, Human
auaugcaguuuuccuu

SEQ ID NO: 2041357 - RNA, 22 nt, Human
cucagccuccugaguagcugga

SEQ ID NO: 2041358 - RNA, 14 nt, Human
cucagccuccugag

SEQ ID NO: 2041359 - RNA, 17 nt, Human
cggcucuggccuccaag

SEQ ID NO: 2041360 - RNA, 17 nt, Human
cuacaguguacagucuu

SEQ ID NO: 2041361 - RNA, 16 nt, Human
cuacaguguacagucu

SEQ ID NO: 2041362 - RNA, 15 nt, Human
cuacaguguacaguc

SEQ ID NO: 2041363 - RNA, 20 nt, Human
cuacaguguacagucuugua

SEQ ID NO: 2041364 - RNA, 15 nt, Human
cuagaacugaauuuu

SEQ ID NO: 2041365 - RNA, 23 nt, Human
cuagaaaugauccccagcuguuu

SEQ ID NO: 2041366 - RNA, 20 nt, Human
ccuucugaaaaaguauccug

SEQ ID NO: 2041367 - RNA, 21 nt, Human
ccuccaaguccacaguggaac

SEQ ID NO: 2041368 - RNA, 18 nt, Human
ccuccaaguccacagugg

SEQ ID NO: 2041369 - RNA, 14 nt, Human
ccucagccuccuga

SEQ ID NO: 2041370 - RNA, 19 nt, Human
ccugaguagcuggauuaca

SEQ ID NO: 2041371 - RNA, 15 nt, Human
ccugaguagcuggau

SEQ ID NO: 2041372 - RNA, 20 nt, Human
ccugaguagcuggauuacag

SEQ ID NO: 2041373 - RNA, 22 nt, Human
ccaaagugcugggauuacaggg

SEQ ID NO: 2041374 - RNA, 22 nt, Human
ccaaagugguauagaaaugcug

SEQ ID NO: 2041375 - RNA, 19 nt, Human
ccaaagugguauagaaaug

SEQ ID NO: 2041376 - RNA, 17 nt, Human
caaguccacaguggaac

SEQ ID NO: 2041377 - RNA, 23 nt, Human
caccugccucggccucccaaagu

SEQ ID NO: 2041378 - RNA, 17 nt, Human
caccuacaguguacagu

SEQ ID NO: 2041379 - RNA, 16 nt, Human
caccuacaguguacag

SEQ ID NO: 2041380 - RNA, 13 nt, Human
caccuacagugua

SEQ ID NO: 2041381 - RNA, 20 nt, Human
caccuacaguguacagucuu

SEQ ID NO: 2041382 - RNA, 19 nt, Human
auuagcauuugucaacaaa

SEQ ID NO: 2041383 - RNA, 11 nt, Human
gcuagaaauga

SEQ ID NO: 2041384 - RNA, 15 nt, Human
gccauguguuccaag

SEQ ID NO: 2041385 - RNA, 16 nt, Human
gccauguguuccaagg

SEQ ID NO: 2041386 - RNA, 17 nt, Human
ggaacugaacauuccag

SEQ ID NO: 2041387 - RNA, 22 nt, Human
gcuuacaagccagcuggagaaa

SEQ ID NO: 2041388 - RNA, 19 nt, Human
gcuuacaagccagcuggag

SEQ ID NO: 2041389 - RNA, 13 nt, Human
gcuuacaagccag

SEQ ID NO: 2041390 - RNA, 23 nt, Human
ggccuccaaguccacaguggaac

SEQ ID NO: 2041391 - RNA, 19 nt, Human
gguuucaccauguuggcca

SEQ ID NO: 2041392 - RNA, 13 nt, Human
aaaaugucuuuau

SEQ ID NO: 2041393 - RNA, 17 nt, Human
gauacgacaacuugcac

SEQ ID NO: 2041394 - RNA, 18 nt, Human
gauaugcaguuuuccuua

SEQ ID NO: 2041395 - RNA, 23 nt, Human
cuuuuuuuuuuuuuaaagacaga

SEQ ID NO: 2041396 - RNA, 22 nt, Human
cuuuuuuuuuuuuuaaagacag

SEQ ID NO: 2041397 - RNA, 13 nt, Human
cuggcucaucucu

SEQ ID NO: 2041398 - RNA, 16 nt, Human
uugaugugugucuagg

SEQ ID NO: 2041399 - RNA, 19 nt, Human
uugcacaaaccaauuaaac

SEQ ID NO: 2041400 - RNA, 17 nt, Human
augagaaaaugucuuua

SEQ ID NO: 2041401 - RNA, 13 nt, Human
augcugguuuuuc

SEQ ID NO: 2041402 - RNA, 22 nt, Human
uuuaugggucagaguuccgacu

SEQ ID NO: 2041403 - RNA, 15 nt, Human
augcaguuuuccuua

SEQ ID NO: 2041404 - RNA, 16 nt, Human
augauuuuuaaagaaa

SEQ ID NO: 2041405 - RNA, 14 nt, Human
augauuuuuaaaga

SEQ ID NO: 2041406 - RNA, 16 nt, Human
auauaaaagacugacc

SEQ ID NO: 2041407 - RNA, 12 nt, Human
auugcaauagaa

SEQ ID NO: 2041408 - RNA, 19 nt, Human
auuuacccuucuuuucuga

SEQ ID NO: 2041409 - RNA, 17 nt, Human
uuuucagauauaaaaga

SEQ ID NO: 2041410 - RNA, 21 nt, Human
uuuucagauauaaaagacuga

SEQ ID NO: 2041411 - RNA, 19 nt, Human
uuuucagauauaaaagacu

SEQ ID NO: 2041412 - RNA, 22 nt, Human
uuuucagauauaaaagacugac

SEQ ID NO: 2041413 - RNA, 22 nt, Human
uuuuaaguuacacauuuuucag

SEQ ID NO: 2041414 - RNA, 21 nt, Human
uuuuaaguuacacauuuuuca

SEQ ID NO: 2041415 - RNA, 16 nt, Human
auguuggccaggcugg

SEQ ID NO: 2041416 - RNA, 21 nt, Human
uuugcuguagaagauggcacu

SEQ ID NO: 2041417 - RNA, 13 nt, Human
uuugcuguagaag

SEQ ID NO: 2041418 - RNA, 15 nt, Human
uuugcuucaaaaaca

SEQ ID NO: 2041419 - RNA, 18 nt, Human
auaaucucuccauucccg

SEQ ID NO: 2041420 - RNA, 15 nt, Human
aguuuaauugacuua

SEQ ID NO: 2041421 - RNA, 14 nt, Human
aguuuaauugacuu

SEQ ID NO: 2041422 - RNA, 18 nt, Human
aguuuaauugacuuauuu

SEQ ID NO: 2041423 - RNA, 21 nt, Human
uuaauugacuuauuuauauaa

SEQ ID NO: 2041424 - RNA, 15 nt, Human
aguuuuguaaauuuc

SEQ ID NO: 2041425 - RNA, 12 nt, Human
aguuuuguaaau

SEQ ID NO: 2041426 - RNA, 15 nt, Human
aguuuuuauugcuug

SEQ ID NO: 2041427 - RNA, 16 nt, Human
aguggaaccagcccag

SEQ ID NO: 2041428 - RNA, 21 nt, Human
uguugcccaggcuggagugca

SEQ ID NO: 2041429 - RNA, 14 nt, Human
uguugcccaggcug

SEQ ID NO: 2041430 - RNA, 15 nt, Human
uguugcccaggcugg

SEQ ID NO: 2041431 - RNA, 22 nt, Human
agugauucuccugccucagccu

SEQ ID NO: 2041432 - RNA, 16 nt, Human
agugcaaugacacagu

SEQ ID NO: 2041433 - RNA, 18 nt, Human
agugcaaugacacagucu

SEQ ID NO: 2041434 - RNA, 20 nt, Human
ugugucuaggcaggaccugu

SEQ ID NO: 2041435 - RNA, 19 nt, Human
ugugucuaggcaggaccug

SEQ ID NO: 2041436 - RNA, 17 nt, Human
agugcugggauuacagg

SEQ ID NO: 2041437 - RNA, 20 nt, Human
uguaagaucguucucugccu

SEQ ID NO: 2041438 - RNA, 19 nt, Human
uguaagaucguucucugcc

SEQ ID NO: 2041439 - RNA, 14 nt, Human
aguaauccaccugc

SEQ ID NO: 2041440 - RNA, 17 nt, Human
ugguacucauuaaaaaa

SEQ ID NO: 2041441 - RNA, 18 nt, Human
uggucucaaacuccugac

SEQ ID NO: 2041442 - RNA, 21 nt, Human
ugcuucaaaaacauucuuaca

SEQ ID NO: 2041443 - RNA, 13 nt, Human
ugcuucaaaaaca

SEQ ID NO: 2041444 - RNA, 13 nt, Human
uggauuggauuug

SEQ ID NO: 2041445 - RNA, 12 nt, Human
agccucaucucu

SEQ ID NO: 2041446 - RNA, 19 nt, Human
ugauucuccugccucagcc

SEQ ID NO: 2041447 - RNA, 11 nt, Human
agcuagaaaug

SEQ ID NO: 2041448 - RNA, 12 nt, Human
agcuagaaauga

SEQ ID NO: 2041449 - RNA, 13 nt, Human
ugaguagcuggau

SEQ ID NO: 2041450 - RNA, 19 nt, Human
ugauauguugguagauucu

SEQ ID NO: 2041451 - RNA, 14 nt, Human
agcaagauuucaga

SEQ ID NO: 2041452 - RNA, 23 nt, Human
ugacacagucuuggcucacugca

SEQ ID NO: 2041453 - RNA, 22 nt, Human
ugacacagucuuggcucacugc

SEQ ID NO: 2041454 - RNA, 21 nt, Human
ucuuuauuaaauguagaaagu

SEQ ID NO: 2041455 - RNA, 17 nt, Human
ucuuuauuaaauguaga

SEQ ID NO: 2041456 - RNA, 16 nt, Human
ucuuuaugauuuuuaa

SEQ ID NO: 2041457 - RNA, 22 nt, Human
ucuuuggugaacauugcaauag

SEQ ID NO: 2041458 - RNA, 16 nt, Human
ucuuuggugaacauug

SEQ ID NO: 2041459 - RNA, 21 nt, Human
ucuuucugcagaaacagaaag

SEQ ID NO: 2041460 - RNA, 22 nt, Human
ugaaaaaguauccugcuucuga

SEQ ID NO: 2041461 - RNA, 21 nt, Human
agaacugaauuuugucuuuau

SEQ ID NO: 2041462 - RNA, 21 nt, Human
agaaaugcugguuuuucaguu

SEQ ID NO: 2041463 - RNA, 20 nt, Human
agaaaugcugguuuuucagu

SEQ ID NO: 2041464 - RNA, 14 nt, Human
ucucuccauucccg

SEQ ID NO: 2041465 - RNA, 17 nt, Human
ucucgcucuguugccca

SEQ ID NO: 2041466 - RNA, 21 nt, Human
ucuccuuagaaguggaaguag

SEQ ID NO: 2041467 - RNA, 15 nt, Human
ucuccuuagaagugg

SEQ ID NO: 2041468 - RNA, 23 nt, Human
acuuugaggguguauauuuucug

SEQ ID NO: 2041469 - RNA, 21 nt, Human
ucgcucuguugcccaggcugg

SEQ ID NO: 2041470 - RNA, 13 nt, Human
ucguucucugccu

SEQ ID NO: 2041471 - RNA, 18 nt, Human
ucacugcaacuucugccu

SEQ ID NO: 2041472 - RNA, 17 nt, Human
ucacugcaacuucugcc

SEQ ID NO: 2041473 - RNA, 13 nt, Human
ucauaacuagaac

SEQ ID NO: 2041474 - RNA, 15 nt, Human
ucauaacuagaacug

SEQ ID NO: 2041475 - RNA, 18 nt, Human
acauuuuacuuuuuccug

SEQ ID NO: 2041476 - RNA, 21 nt, Human
acauuuuucagauauaaaaga

SEQ ID NO: 2041477 - RNA, 19 nt, Human
ucaaguaauccaccugccu

SEQ ID NO: 2041478 - RNA, 17 nt, Human
ucaagcaagauuucaga

SEQ ID NO: 2041479 - RNA, 16 nt, Human
ucacagccacuuggga

SEQ ID NO: 2041480 - RNA, 20 nt, Human
ucccaaagugcugggauuac

SEQ ID NO: 2041481 - RNA, 23 nt, Human
acuagaacugaauuuugucuuua

SEQ ID NO: 2041482 - RNA, 19 nt, Human
acuagaacugaauuuuguc

SEQ ID NO: 2041483 - RNA, 18 nt, Human
acuagaacugaauuuugu

SEQ ID NO: 2041484 - RNA, 17 nt, Human
acuagaacugaauuuug

SEQ ID NO: 2041485 - RNA, 16 nt, Human
acuagaacugaauuuu

SEQ ID NO: 2041486 - RNA, 15 nt, Human
uaggcaggaccugug

SEQ ID NO: 2041487 - RNA, 14 nt, Human
uaggcaggaccugu

SEQ ID NO: 2041488 - RNA, 16 nt, Human
acagaaagguuuucuu

SEQ ID NO: 2041489 - RNA, 21 nt, Human
uaugucucgugguaggacugu

SEQ ID NO: 2041490 - RNA, 20 nt, Human
aaugagaaaaugucuuuauu

SEQ ID NO: 2041491 - RNA, 18 nt, Human
aaugcugguuuuucaguu

SEQ ID NO: 2041492 - RNA, 21 nt, Human
uaaguuacacauuuuucagau

SEQ ID NO: 2041493 - RNA, 20 nt, Human
aaucacguaaagcuagaaau

SEQ ID NO: 2041494 - RNA, 21 nt, Human
aaucacguaaagcuagaaaug

SEQ ID NO: 2041495 - RNA, 15 nt, Human
aaucacguaaagcua

SEQ ID NO: 2041496 - RNA, 18 nt, Human
aauagcgucauaacuaga

SEQ ID NO: 2041497 - RNA, 18 nt, Human
aagacuuccagagccuca

SEQ ID NO: 2041498 - RNA, 16 nt, Human
aagacuuccagagccu

SEQ ID NO: 2041499 - RNA, 22 nt, Human
aagacgugauuuugcuguagaa

SEQ ID NO: 2041500 - RNA, 16 nt, Human
aagacgugauuuugcu

SEQ ID NO: 2041501 - RNA, 23 nt, Human
aagacgugauuuugcuguagaag

SEQ ID NO: 2041502 - RNA, 17 nt, Human
aagaucguucucugccu

SEQ ID NO: 2041503 - RNA, 16 nt, Human
aagaucguucucugcc

SEQ ID NO: 2041504 - RNA, 13 nt, Human
uaaaagacuuuuu

SEQ ID NO: 2041505 - RNA, 21 nt, Human
aaguaauccaccugccucggc

SEQ ID NO: 2041506 - RNA, 18 nt, Human
aagugagacuuugagggu

SEQ ID NO: 2041507 - RNA, 14 nt, Human
guuuuucaguuuuc

SEQ ID NO: 2041508 - RNA, 19 nt, Human
guuuuuccuguucuuaaga

SEQ ID NO: 2041509 - RNA, 18 nt, Human
guuucucaaagaaauuuc

SEQ ID NO: 2041510 - RNA, 17 nt, Human
guuucucaaagaaauuu

SEQ ID NO: 2041511 - RNA, 14 nt, Human
guuucucaaagaaa

SEQ ID NO: 2041512 - RNA, 13 nt, Human
gucauaacuagaa

SEQ ID NO: 2041513 - RNA, 22 nt, Human
aaauguaagaucguucucugcc

SEQ ID NO: 2041514 - RNA, 14 nt, Human
aaauguaagaucgu

SEQ ID NO: 2041515 - RNA, 22 nt, Human
guauauuuguauuuaaaugaaa

SEQ ID NO: 2041516 - RNA, 16 nt, Human
gucuuuggugaacauu

SEQ ID NO: 2041517 - RNA, 22 nt, Human
aaccucgagguuucucaaagaa

SEQ ID NO: 2041518 - RNA, 21 nt, Human
aaccucgagguuucucaaaga

SEQ ID NO: 2041519 - RNA, 22 nt, Human
aacuucuccccugguagaaaga

SEQ ID NO: 2041520 - RNA, 19 nt, Human
cacaguggaaccagcccag

SEQ ID NO: 2041521 - RNA, 13 nt, Human
cacaguggaacca

SEQ ID NO: 2041522 - RNA, 19 nt, Human
caauagauauuuaccuuuu

SEQ ID NO: 2041523 - RNA, 19 nt, Human
caaagaaauuuccacucag

SEQ ID NO: 2041524 - RNA, 18 nt, Human
caaagaaauuuccacuca

SEQ ID NO: 2041525 - RNA, 12 nt, Human
caaagaaauuuc

SEQ ID NO: 2041526 - RNA, 20 nt, Human
uguguuuuuaauaaagacag

SEQ ID NO: 2041527 - RNA, 15 nt, Human
uguguuuuuaauaaa

SEQ ID NO: 2041528 - RNA, 22 nt, Human
ugugugucuaggcaggaccugu

SEQ ID NO: 2041529 - RNA, 18 nt, Human
uuaaagaaaaguuuugua

SEQ ID NO: 2041530 - RNA, 15 nt, Human
uuacacauuuuucag

SEQ ID NO: 2041531 - RNA, 23 nt, Human
uuacacauuuuucagauauaaaa

SEQ ID NO: 2041532 - RNA, 17 nt, Human
uuacacauuuuucagau

SEQ ID NO: 2041533 - RNA, 15 nt, Human
uuaaauguagaaagu

SEQ ID NO: 2041534 - RNA, 21 nt, Human
uguacagucuuguauuaaguu

SEQ ID NO: 2041535 - RNA, 13 nt, Human
ugcccaggcugga

SEQ ID NO: 2041536 - RNA, 20 nt, Human
ugcccaggcuggagugcaau

SEQ ID NO: 2041537 - RNA, 18 nt, Human
ugcccaggcuggagugca

SEQ ID NO: 2041538 - RNA, 21 nt, Human
ugggauuacagggaugagcca

SEQ ID NO: 2041539 - RNA, 16 nt, Human
ugguauagaaaugcug

SEQ ID NO: 2041540 - RNA, 14 nt, Human
ugguauagaaaugc

SEQ ID NO: 2041541 - RNA, 22 nt, Human
ugguauagaaaugcugguuuuu

SEQ ID NO: 2041542 - RNA, 13 nt, Human
ugguauagaaaug

SEQ ID NO: 2041543 - RNA, 21 nt, Human
uggaacguuuuuccuguucuu

SEQ ID NO: 2041544 - RNA, 22 nt, Human
ucagcaccuacaguguacaguc

SEQ ID NO: 2041545 - RNA, 21 nt, Human
ucagcaccuacaguguacagu

SEQ ID NO: 2041546 - RNA, 20 nt, Human
ucagcaccuacaguguacag

SEQ ID NO: 2041547 - RNA, 20 nt, Human
ucugccucacauagcuuaca

SEQ ID NO: 2041548 - RNA, 14 nt, Human
ugacucuuggcaca

SEQ ID NO: 2041549 - RNA, 19 nt, Human
ugacucuuggcacagcaug

SEQ ID NO: 2041550 - RNA, 17 nt, Human
ugaaucacguaaagcua

SEQ ID NO: 2041551 - RNA, 23 nt, Human
ugaaucacguaaagcuagaaaug

SEQ ID NO: 2041552 - RNA, 11 nt, Human
uauagaaaugc

SEQ ID NO: 2041553 - RNA, 15 nt, Human
uaagccaugggagac

SEQ ID NO: 2041554 - RNA, 11 nt, Human
uaauguuuccu

SEQ ID NO: 2041555 - RNA, 15 nt, Human
uaaauguagaaagug

SEQ ID NO: 2041556 - RNA, 22 nt, Human
uaaagaaaaguuuuguaaauuu

SEQ ID NO: 2041557 - RNA, 16 nt, Human
uaaagaaaaguuuugu

SEQ ID NO: 2041558 - RNA, 17 nt, Human
guuuuuaauaaagacag

SEQ ID NO: 2041559 - RNA, 15 nt, Human
guuguuaauaaaagu

SEQ ID NO: 2041560 - RNA, 14 nt, Human
guuuuguaaauuuc

SEQ ID NO: 2041561 - RNA, 12 nt, Human
guuuuguaaauu

SEQ ID NO: 2041562 - RNA, 24 nt, Human
guuuucaggaguggguugauuuca

SEQ ID NO: 2041563 - RNA, 16 nt, Human
guuucuuuaguuuuug

SEQ ID NO: 2041564 - RNA, 20 nt, Human
guuggauuuuugucuugugu

SEQ ID NO: 2041565 - RNA, 14 nt, Human
guuggauuuuuguc

SEQ ID NO: 2041566 - RNA, 23 nt, Human
guugauuucagcaccuacagugu

SEQ ID NO: 2041567 - RNA, 14 nt, Human
guucuaaagaugga

SEQ ID NO: 2041568 - RNA, 20 nt, Human
guucuaaagauggaaaaacc

SEQ ID NO: 2041569 - RNA, 17 nt, Human
guucuaaagauggaaaa

SEQ ID NO: 2041570 - RNA, 23 nt, Human
guucuaaagauggaaaaaccacc

SEQ ID NO: 2041571 - RNA, 12 nt, Human
gugggcuaagca

SEQ ID NO: 2041572 - RNA, 14 nt, Human
gugguauagaaaug

SEQ ID NO: 2041573 - RNA, 22 nt, Human
guguacagucuuguauuaaguu

SEQ ID NO: 2041574 - RNA, 16 nt, Human
guguacagucuuguau

SEQ ID NO: 2041575 - RNA, 13 nt, Human
guguacagucuug

SEQ ID NO: 2041576 - RNA, 17 nt, Human
guuacacauuuuucaga

SEQ ID NO: 2041577 - RNA, 16 nt, Human
guuacacauuuuucag

SEQ ID NO: 2041578 - RNA, 19 nt, Human
guuaaacuuacuuaguguu

SEQ ID NO: 2041579 - RNA, 19 nt, Human
gugucuaggcaggaccugu

SEQ ID NO: 2041580 - RNA, 19 nt, Human
gucucgugguaggacugua

SEQ ID NO: 2041581 - RNA, 22 nt, Human
guauuaaguuguuaauaaaagu

SEQ ID NO: 2041582 - RNA, 21 nt, Human
guccacaguggaaccagccca

SEQ ID NO: 2041583 - RNA, 19 nt, Human
guccacaguggaaccagcc

SEQ ID NO: 2041584 - RNA, 16 nt, Human
guccacaguggaacca

SEQ ID NO: 2041585 - RNA, 14 nt, Human
guauagaaaugcug

SEQ ID NO: 2041586 - RNA, 22 nt, Human
guauagaaaugcugguuuuuca

SEQ ID NO: 2041587 - RNA, 15 nt, Human
guauagaaaugcugg

SEQ ID NO: 2041588 - RNA, 23 nt, Human
guauagaaaugcugguuuuucag

SEQ ID NO: 2041589 - RNA, 14 nt, Human
uuuuaaagaaaagu

SEQ ID NO: 2041590 - RNA, 15 nt, Human
uuuuaaagaaaaguu

SEQ ID NO: 2041591 - RNA, 22 nt, Human
uuuggugaacauugcaauagaa

SEQ ID NO: 2041592 - RNA, 23 nt, Human
uuuggugaacauugcaauagaaa

SEQ ID NO: 2041593 - RNA, 13 nt, Human
uuuuuuguuucau

SEQ ID NO: 2041594 - RNA, 12 nt, Human
uuuuuuguuuca

SEQ ID NO: 2041595 - RNA, 17 nt, Human
uuuuuaaagacagaguc

SEQ ID NO: 2041596 - RNA, 20 nt, Human
uuuuuaaagaaaaguuuugu

SEQ ID NO: 2041597 - RNA, 12 nt, Human
uuuuuaaagaaa

SEQ ID NO: 2041598 - RNA, 13 nt, Human
uuuugucuugugu

SEQ ID NO: 2041599 - RNA, 13 nt, Human
gccagcuggagaa

SEQ ID NO: 2041600 - RNA, 15 nt, Human
gcccaggcuggagug

SEQ ID NO: 2041601 - RNA, 15 nt, Human
gauuuuugucuugug

SEQ ID NO: 2041602 - RNA, 22 nt, Human
gauuugucuuuggugaacauug

SEQ ID NO: 2041603 - RNA, 20 nt, Human
gauuugucuuuggugaacau

SEQ ID NO: 2041604 - RNA, 14 nt, Human
gauccccagcuguu

SEQ ID NO: 2041605 - RNA, 21 nt, Human
gauaaauaacuuuuuuuuaag

SEQ ID NO: 2041606 - RNA, 16 nt, Human
gauaaauaacuuuuuu

SEQ ID NO: 2041607 - RNA, 15 nt, Human
gcacguauuuuaaua

SEQ ID NO: 2041608 - RNA, 14 nt, Human
gcacguauuuuaau

SEQ ID NO: 2041609 - RNA, 19 nt, Human
gaaauuuccacucaggucu

SEQ ID NO: 2041610 - RNA, 20 nt, Human
gaaauuuccacucaggucug

SEQ ID NO: 2041611 - RNA, 24 nt, Human
cuuggcucacugcaacuucugccu

SEQ ID NO: 2041612 - RNA, 17 nt, Human
cuuguauuaaguuguua

SEQ ID NO: 2041613 - RNA, 13 nt, Human
cuuguauuaaguu

SEQ ID NO: 2041614 - RNA, 23 nt, Human
cuuguauuaaguuguuaauaaaa

SEQ ID NO: 2041615 - RNA, 22 nt, Human
cuuguauuaaguuguuaauaaa

SEQ ID NO: 2041616 - RNA, 19 nt, Human
cuugcacguauuuuaauag

SEQ ID NO: 2041617 - RNA, 20 nt, Human
cuguaugucucgugguagga

SEQ ID NO: 2041618 - RNA, 19 nt, Human
cucuuggguucaagugauu

SEQ ID NO: 2041619 - RNA, 21 nt, Human
cugaccaauauuguacaguuu

SEQ ID NO: 2041620 - RNA, 20 nt, Human
cugaccaauauuguacaguu

SEQ ID NO: 2041621 - RNA, 19 nt, Human
cugaccaauauuguacagu

SEQ ID NO: 2041622 - RNA, 18 nt, Human
cugaccaauauuguacag

SEQ ID NO: 2041623 - RNA, 15 nt, Human
cugaccaauauugua

SEQ ID NO: 2041624 - RNA, 22 nt, Human
cucccaaagugcugggauuaca

SEQ ID NO: 2041625 - RNA, 16 nt, Human
cgggguggauuggauu

SEQ ID NO: 2041626 - RNA, 15 nt, Human
cguggaacguuuuuc

SEQ ID NO: 2041627 - RNA, 20 nt, Human
cguggaacguuuuuccuguu

SEQ ID NO: 2041628 - RNA, 20 nt, Human
cucacauagcuuacaagcca

SEQ ID NO: 2041629 - RNA, 16 nt, Human
cuaggcaggaccugug

SEQ ID NO: 2041630 - RNA, 15 nt, Human
cuaggcaggaccugu

SEQ ID NO: 2041631 - RNA, 23 nt, Human
cuaagcacgggccauaugaauaa

SEQ ID NO: 2041632 - RNA, 20 nt, Human
cuaagcacgggccauaugaa

SEQ ID NO: 2041633 - RNA, 11 nt, Human
cccuucuuuuu

SEQ ID NO: 2041634 - RNA, 23 nt, Human
ccucccaaagugcugggauuaca

SEQ ID NO: 2041635 - RNA, 23 nt, Human
ccauguuggccaggcuggucuca

SEQ ID NO: 2041636 - RNA, 18 nt, Human
ccaauauuguacaguuuu

SEQ ID NO: 2041637 - RNA, 16 nt, Human
ccaauauuguacaguu

SEQ ID NO: 2041638 - RNA, 15 nt, Human
ccaauauuguacagu

SEQ ID NO: 2041639 - RNA, 14 nt, Human
ccaauauuguacag

SEQ ID NO: 2041640 - RNA, 14 nt, Human
cauugcaauagaaa

SEQ ID NO: 2041641 - RNA, 15 nt, Human
cauugcaauagaaau

SEQ ID NO: 2041642 - RNA, 13 nt, Human
cauugcaauagaa

SEQ ID NO: 2041643 - RNA, 16 nt, Human
caguggaaccagccca

SEQ ID NO: 2041644 - RNA, 15 nt, Human
caguguacagucuug

SEQ ID NO: 2041645 - RNA, 12 nt, Human
caguguacaguc

SEQ ID NO: 2041646 - RNA, 18 nt, Human
caguguacagucuuguau

SEQ ID NO: 2041647 - RNA, 17 nt, Human
caguguacagucuugua

SEQ ID NO: 2041648 - RNA, 15 nt, Human
caguuuuuauugcuu

SEQ ID NO: 2041649 - RNA, 13 nt, Human
cauaacuagaacu

SEQ ID NO: 2041650 - RNA, 15 nt, Human
aaagcccaaaguggu

SEQ ID NO: 2041651 - RNA, 22 nt, Human
aaaugcugguuuuucaguuuuc

SEQ ID NO: 2041652 - RNA, 12 nt, Human
aagacagagucu

SEQ ID NO: 2041653 - RNA, 13 nt, Human
aagcuagaaauga

SEQ ID NO: 2041654 - RNA, 12 nt, Human
aauaaagacagg

SEQ ID NO: 2041655 - RNA, 11 nt, Human
aauaaagacag

SEQ ID NO: 2041656 - RNA, 21 nt, Human
aauuuccacucaggucuguuu

SEQ ID NO: 2041657 - RNA, 22 nt, Human
aauuggauacgacaacuugcac

SEQ ID NO: 2041658 - RNA, 18 nt, Human
acaguggaaccagcccag

SEQ ID NO: 2041659 - RNA, 17 nt, Human
accuguggccaaguucu

SEQ ID NO: 2041660 - RNA, 20 nt, Human
acugauguaugaggaauuuc

SEQ ID NO: 2041661 - RNA, 22 nt, Human
aggcaugugccacccacccaac

SEQ ID NO: 2041662 - RNA, 12 nt, Human
agacugaccaau

SEQ ID NO: 2041663 - RNA, 21 nt, Human
agacugaccaauauuguacag

SEQ ID NO: 2041664 - RNA, 19 nt, Human
agaagauggcacuuauaac

SEQ ID NO: 2041665 - RNA, 18 nt, Human
agaagaugaaugagcaaa

SEQ ID NO: 2041666 - RNA, 15 nt, Human
agauauaaaagacug

SEQ ID NO: 2041667 - RNA, 19 nt, Human
aguuacacauuuuucagau

SEQ ID NO: 2041668 - RNA, 16 nt, Human
aguuacacauuuuuca

SEQ ID NO: 2041669 - RNA, 13 nt, Human
aguuacacauuuu

SEQ ID NO: 2041670 - RNA, 19 nt, Human
agugauucuccugccucag

SEQ ID NO: 2041671 - RNA, 22 nt, Human
cuaagaaagcccuuaggaagaa

SEQ ID NO: 2041672 - RNA, 22 nt, Human
cgcucuguugcccaggcuggag

SEQ ID NO: 2041673 - RNA, 19 nt, Human
cgcucuguugcccaggcug

SEQ ID NO: 2041674 - RNA, 16 nt, Human
cguaaagcuagaaaug

SEQ ID NO: 2041675 - RNA, 17 nt, Human
cguaaagcuagaaauga

SEQ ID NO: 2041676 - RNA, 15 nt, Human
ccucagccuccugag

SEQ ID NO: 2041677 - RNA, 16 nt, Human
ccucgagguuucucaa

SEQ ID NO: 2041678 - RNA, 11 nt, Human
caguuuuccuu

SEQ ID NO: 2041679 - RNA, 22 nt, Human
cagauauaaaagacugaccaau

SEQ ID NO: 2041680 - RNA, 15 nt, Human
auuuuuuuuguuuca

SEQ ID NO: 2041681 - RNA, 15 nt, Human
auuuauauaaauuuu

SEQ ID NO: 2041682 - RNA, 16 nt, Human
caauauuguacaguuu

SEQ ID NO: 2041683 - RNA, 15 nt, Human
caauauuguacaguu

SEQ ID NO: 2041684 - RNA, 18 nt, Human
caauauuguacaguuuuu

SEQ ID NO: 2041685 - RNA, 17 nt, Human
caauauuguacaguuuu

SEQ ID NO: 2041686 - RNA, 20 nt, Human
caauuggauacgacaacuug

SEQ ID NO: 2041687 - RNA, 17 nt, Human
gcucuggccuccaaguc

SEQ ID NO: 2041688 - RNA, 15 nt, Human
gcucuggccuccaag

SEQ ID NO: 2041689 - RNA, 14 nt, Human
gcugguuuuucagu

SEQ ID NO: 2041690 - RNA, 15 nt, Human
gcugguuuuucaguu

SEQ ID NO: 2041691 - RNA, 17 nt, Human
gcugggauuacagggau

SEQ ID NO: 2041692 - RNA, 13 nt, Human
ggccucccaaagu

SEQ ID NO: 2041693 - RNA, 18 nt, Human
aaaagggaacugaacauu

SEQ ID NO: 2041694 - RNA, 13 nt, Human
aaagcuagaaaug

SEQ ID NO: 2041695 - RNA, 11 nt, Human
aaacuccugac

SEQ ID NO: 2041696 - RNA, 11 nt, Human
gacuguagaaa

SEQ ID NO: 2041697 - RNA, 21 nt, Human
gaagggcuuggacucaagcaa

SEQ ID NO: 2041698 - RNA, 19 nt, Human
gagugcaaugacacagucu

SEQ ID NO: 2041699 - RNA, 18 nt, Human
gauucuccugccucagcc

SEQ ID NO: 2041700 - RNA, 18 nt, Human
gauguaaaagacuuuuuu

SEQ ID NO: 2041701 - RNA, 16 nt, Human
cuuuuaggccaaaaaa

SEQ ID NO: 2041702 - RNA, 18 nt, Human
cuuuuaggccaaaaaaau

SEQ ID NO: 2041703 - RNA, 15 nt, Human
cuuuggugaacauug

SEQ ID NO: 2041704 - RNA, 14 nt, Human
cugcaacuucugcc

SEQ ID NO: 2041705 - RNA, 15 nt, Human
cugcaacuucugccu

SEQ ID NO: 2041706 - RNA, 13 nt, Human
uuuguuucauauu

SEQ ID NO: 2041707 - RNA, 21 nt, Human
uuuugugaaguuuaauugacu

SEQ ID NO: 2041708 - RNA, 13 nt, Human
auuaaguuguuaa

SEQ ID NO: 2041709 - RNA, 21 nt, Human
uuuaaaugaaagugagacuuu

SEQ ID NO: 2041710 - RNA, 13 nt, Human
uuuaaaugaaagu

SEQ ID NO: 2041711 - RNA, 20 nt, Human
uuuacccuucuuuucugacu

SEQ ID NO: 2041712 - RNA, 15 nt, Human
uugcaauagaaaucc

SEQ ID NO: 2041713 - RNA, 22 nt, Human
uugcaauagaaauccaauugga

SEQ ID NO: 2041714 - RNA, 22 nt, Human
aucucuuuguucuaaagaugga

SEQ ID NO: 2041715 - RNA, 16 nt, Human
augaaagugagacuuu

SEQ ID NO: 2041716 - RNA, 14 nt, Human
uuguaaauuucucu

SEQ ID NO: 2041717 - RNA, 22 nt, Human
auauaaauuuuuuuuguuucau

SEQ ID NO: 2041718 - RNA, 17 nt, Human
auauaaauuuuuuuugu

SEQ ID NO: 2041719 - RNA, 22 nt, Human
uucagcaccuacaguguacagu

SEQ ID NO: 2041720 - RNA, 23 nt, Human
uucagcaccuacaguguacaguc

SEQ ID NO: 2041721 - RNA, 22 nt, Human
auagcuuacaagccagcuggag

SEQ ID NO: 2041722 - RNA, 20 nt, Human
uucaagugauucuccugccu

SEQ ID NO: 2041723 - RNA, 18 nt, Human
auagcgucauaacuagaa

SEQ ID NO: 2041724 - RNA, 20 nt, Human
auagcgucauaacuagaacu

SEQ ID NO: 2041725 - RNA, 20 nt, Human
uuccuguucuuaagacguga

SEQ ID NO: 2041726 - RNA, 21 nt, Human
aucacguaaagcuagaaauga

SEQ ID NO: 2041727 - RNA, 14 nt, Human
aucacguaaagcua

SEQ ID NO: 2041728 - RNA, 13 nt, Human
auauugaugugug

SEQ ID NO: 2041729 - RNA, 20 nt, Human
auauuuguauuuaaaugaaa

SEQ ID NO: 2041730 - RNA, 18 nt, Human
uguggccaaguucuuagu

SEQ ID NO: 2041731 - RNA, 18 nt, Human
agucuuguauuaaguugu

SEQ ID NO: 2041732 - RNA, 16 nt, Human
agucuuguauuaaguu

SEQ ID NO: 2041733 - RNA, 15 nt, Human
agucuuggcucacug

SEQ ID NO: 2041734 - RNA, 22 nt, Human
agucuuguauuaaguuguuaau

SEQ ID NO: 2041735 - RNA, 15 nt, Human
ugucuuguguuucuu

SEQ ID NO: 2041736 - RNA, 17 nt, Human
aguggaaguaguggagc

SEQ ID NO: 2041737 - RNA, 16 nt, Human
aguucuuaguugcugu

SEQ ID NO: 2041738 - RNA, 15 nt, Human
uuaaauuucuaccgc

SEQ ID NO: 2041739 - RNA, 21 nt, Human
aguucuuaguugcuguauguc

SEQ ID NO: 2041740 - RNA, 20 nt, Human
aguucuuaguugcuguaugu

SEQ ID NO: 2041741 - RNA, 14 nt, Human
auaaauaacuuuuu

SEQ ID NO: 2041742 - RNA, 12 nt, Human
auaaauaacuuu

SEQ ID NO: 2041743 - RNA, 19 nt, Human
auaacuagaacugaauuuu

SEQ ID NO: 2041744 - RNA, 21 nt, Human
auaaaaguacauguuaaacuu

SEQ ID NO: 2041745 - RNA, 15 nt, Human
auaaaaguacauguu

SEQ ID NO: 2041746 - RNA, 22 nt, Human
uuaaguuacacauuuuucagau

SEQ ID NO: 2041747 - RNA, 14 nt, Human
uuaauaaagacagg

SEQ ID NO: 2041748 - RNA, 13 nt, Human
uuaauaaagacag

SEQ ID NO: 2041749 - RNA, 14 nt, Human
aguacauguuaaac

SEQ ID NO: 2041750 - RNA, 21 nt, Human
uguagaaaagggaacugaaca

SEQ ID NO: 2041751 - RNA, 20 nt, Human
uguagaaaagggaacugaac

SEQ ID NO: 2041752 - RNA, 19 nt, Human
uguagaaaagggaacugaa

SEQ ID NO: 2041753 - RNA, 18 nt, Human
uguagaaaagggaacuga

SEQ ID NO: 2041754 - RNA, 23 nt, Human
uguagaaaagggaacugaacauu

SEQ ID NO: 2041755 - RNA, 18 nt, Human
uguaugucucgugguagg

SEQ ID NO: 2041756 - RNA, 19 nt, Human
agcuuacaagccagcugga

SEQ ID NO: 2041757 - RNA, 17 nt, Human
agcuuacaagccagcug

SEQ ID NO: 2041758 - RNA, 15 nt, Human
agcuuacaagccagc

SEQ ID NO: 2041759 - RNA, 13 nt, Human
agcuguuuaugca

SEQ ID NO: 2041760 - RNA, 17 nt, Human
uggagugcaaugacaca

SEQ ID NO: 2041761 - RNA, 21 nt, Human
aggaccuguggccaaguucuu

SEQ ID NO: 2041762 - RNA, 16 nt, Human
agcauuugucaacaaa

SEQ ID NO: 2041763 - RNA, 21 nt, Human
ugaccaauauuguacaguuuu

SEQ ID NO: 2041764 - RNA, 19 nt, Human
ugaccaauauuguacaguu

SEQ ID NO: 2041765 - RNA, 18 nt, Human
ugaccaauauuguacagu

SEQ ID NO: 2041766 - RNA, 17 nt, Human
ugaccaauauuguacag

SEQ ID NO: 2041767 - RNA, 15 nt, Human
ucuuuaguuuuugug

SEQ ID NO: 2041768 - RNA, 22 nt, Human
ucuuucugcagaaacagaaagg

SEQ ID NO: 2041769 - RNA, 15 nt, Human
agacuuccagagccu

SEQ ID NO: 2041770 - RNA, 22 nt, Human
agaaauuuccacucaggucugu

SEQ ID NO: 2041771 - RNA, 16 nt, Human
agaaauuuccacucag

SEQ ID NO: 2041772 - RNA, 21 nt, Human
uccuuuaauuuuuuacuauuu

SEQ ID NO: 2041773 - RNA, 20 nt, Human
accuacaguguacagucuug

SEQ ID NO: 2041774 - RNA, 18 nt, Human
accuacaguguacagucu

SEQ ID NO: 2041775 - RNA, 17 nt, Human
accuacaguguacaguc

SEQ ID NO: 2041776 - RNA, 16 nt, Human
accuacaguguacagu

SEQ ID NO: 2041777 - RNA, 15 nt, Human
accuacaguguacag

SEQ ID NO: 2041778 - RNA, 14 nt, Human
uccagagacuggga

SEQ ID NO: 2041779 - RNA, 17 nt, Human
uccacucaggucuguuu

SEQ ID NO: 2041780 - RNA, 19 nt, Human
uccaaguccacaguggaac

SEQ ID NO: 2041781 - RNA, 15 nt, Human
acaguuuuuauugcu

SEQ ID NO: 2041782 - RNA, 21 nt, Human
acauagcuuacaagccagcug

SEQ ID NO: 2041783 - RNA, 15 nt, Human
ucaagacuuccagag

SEQ ID NO: 2041784 - RNA, 16 nt, Human
acccccaaauuuucuu

SEQ ID NO: 2041785 - RNA, 17 nt, Human
ucagaaucucucuucuu

SEQ ID NO: 2041786 - RNA, 17 nt, Human
accaauauuguacaguu

SEQ ID NO: 2041787 - RNA, 16 nt, Human
accaauauuguacagu

SEQ ID NO: 2041788 - RNA, 14 nt, Human
accaauauuguaca

SEQ ID NO: 2041789 - RNA, 15 nt, Human
accaauauuguacag

SEQ ID NO: 2041790 - RNA, 19 nt, Human
accaauauuguacaguuuu

SEQ ID NO: 2041791 - RNA, 18 nt, Human
accaauauuguacaguuu

SEQ ID NO: 2041792 - RNA, 19 nt, Human
acacagucuuggcucacug

SEQ ID NO: 2041793 - RNA, 14 nt, Human
uauaaaagacugac

SEQ ID NO: 2041794 - RNA, 10 nt, Human
uaguuuuugu

SEQ ID NO: 2041795 - RNA, 20 nt, Human
acagauguaaaagacuuuuu

SEQ ID NO: 2041796 - RNA, 21 nt, Human
aauugacuuauuuauauaaau

SEQ ID NO: 2041797 - RNA, 13 nt, Human
uacuuuuuccugg

SEQ ID NO: 2041798 - RNA, 15 nt, Human
aaguuuuguaaauuu

SEQ ID NO: 2041799 - RNA, 12 nt, Human
aauaacuuuuuu

SEQ ID NO: 2041800 - RNA, 13 nt, Human
aauauuguacagu

SEQ ID NO: 2041801 - RNA, 17 nt, Human
uaauaaaaguacauguu

SEQ ID NO: 2041802 - RNA, 21 nt, Human
uaauagcgucauaacuagaac

SEQ ID NO: 2041803 - RNA, 14 nt, Human
aaugugacucaaga

SEQ ID NO: 2041804 - RNA, 19 nt, Human
uacacauuuuucagauaua

SEQ ID NO: 2041805 - RNA, 21 nt, Human
uacacauuuuucagauauaaa

SEQ ID NO: 2041806 - RNA, 17 nt, Human
uacacauuuuucagaua

SEQ ID NO: 2041807 - RNA, 15 nt, Human
uacacauuuuucaga

SEQ ID NO: 2041808 - RNA, 19 nt, Human
guggaaguaguggagcccc

SEQ ID NO: 2041809 - RNA, 15 nt, Human
aagcaagauuucaga

SEQ ID NO: 2041810 - RNA, 14 nt, Human
guucuucaucuaag

SEQ ID NO: 2041811 - RNA, 19 nt, Human
guucuuaguugcuguaugu

SEQ ID NO: 2041812 - RNA, 16 nt, Human
aacauugcaauagaaa

SEQ ID NO: 2041813 - RNA, 15 nt, Human
aacauugcaauagaa

SEQ ID NO: 2041814 - RNA, 14 nt, Human
aacauugcaauaga

SEQ ID NO: 2041815 - RNA, 17 nt, Human
aacauugcaauagaaau

SEQ ID NO: 2041816 - RNA, 23 nt, Human
aaaugauccccagcuguuuaugc

SEQ ID NO: 2041817 - RNA, 14 nt, Human
aaaugaaagugaga

SEQ ID NO: 2041818 - RNA, 17 nt, Human
guagcuggauuacaggc

SEQ ID NO: 2041819 - RNA, 15 nt, Human
guaggacuguagaaa

SEQ ID NO: 2041820 - RNA, 14 nt, Human
aaauuuccacucag

SEQ ID NO: 2041821 - RNA, 22 nt, Human
aaauuuccacucaggucuguuu

SEQ ID NO: 2041822 - RNA, 20 nt, Human
caagugauucuccugccuca

SEQ ID NO: 2041823 - RNA, 14 nt, Human
caagccagcuggag

SEQ ID NO: 2041824 - RNA, 17 nt, Human
caaagcccaaaguggua

SEQ ID NO: 2041825 - RNA, 19 nt, Human
caaagcccaaagugguaua

SEQ ID NO: 2041826 - RNA, 13 nt, Human
caaauauuccaga

SEQ ID NO: 2041827 - RNA, 17 nt, Human
caaauauuccagagacu

SEQ ID NO: 2041828 - RNA, 19 nt, Human
caaagugguauagaaaugc

SEQ ID NO: 2041829 - RNA, 18 nt, Human
caaagugguauagaaaug

SEQ ID NO: 2041830 - RNA, 19 nt, Human
caccauguuggccaggcug

SEQ ID NO: 2041831 - RNA, 23 nt, Human
uuguauuuaaaugaaagugagac

SEQ ID NO: 2041832 - RNA, 13 nt, Human
uuuauugcuuguu

SEQ ID NO: 2041833 - RNA, 12 nt, Human
uucaguuuucag

SEQ ID NO: 2041834 - RNA, 13 nt, Human
uucuaaagaugga

SEQ ID NO: 2041835 - RNA, 20 nt, Human
uucucaaagaaauuuccacu

SEQ ID NO: 2041836 - RNA, 19 nt, Human
uucucaaagaaauuuccac

SEQ ID NO: 2041837 - RNA, 15 nt, Human
uucucaaagaaauuu

SEQ ID NO: 2041838 - RNA, 13 nt, Human
uucucaaagaaau

SEQ ID NO: 2041839 - RNA, 20 nt, Human
uugcuguagaagauggcacu

SEQ ID NO: 2041840 - RNA, 18 nt, Human
uuggauuuuugucuugug

SEQ ID NO: 2041841 - RNA, 13 nt, Human
uuguacaguuuuu

SEQ ID NO: 2041842 - RNA, 12 nt, Human
uuguacaguuuu

SEQ ID NO: 2041843 - RNA, 16 nt, Human
uuguacaguuuuuauu

SEQ ID NO: 2041844 - RNA, 18 nt, Human
ugguaggacuguagaaaa

SEQ ID NO: 2041845 - RNA, 17 nt, Human
ugguaggacuguagaaa

SEQ ID NO: 2041846 - RNA, 12 nt, Human
uguacagucuug

SEQ ID NO: 2041847 - RNA, 15 nt, Human
uguacagucuuguau

SEQ ID NO: 2041848 - RNA, 14 nt, Human
uguacagucuugua

SEQ ID NO: 2041849 - RNA, 17 nt, Human
uguacagucuuguauua

SEQ ID NO: 2041850 - RNA, 15 nt, Human
uguauuuaaaugaaa

SEQ ID NO: 2041851 - RNA, 17 nt, Human
uguuggauuuuugucuu

SEQ ID NO: 2041852 - RNA, 20 nt, Human
uguuggauuuuugucuugug

SEQ ID NO: 2041853 - RNA, 14 nt, Human
uguuggccaggcug

SEQ ID NO: 2041854 - RNA, 20 nt, Human
uuaauagcgucauaacuaga

SEQ ID NO: 2041855 - RNA, 19 nt, Human
uggauacgacaacuugcac

SEQ ID NO: 2041856 - RNA, 14 nt, Human
ugcuuguuggauuu

SEQ ID NO: 2041857 - RNA, 20 nt, Human
uggaaaaaccacccccaaau

SEQ ID NO: 2041858 - RNA, 22 nt, Human
ucuuguauuaaguuguuaauaa

SEQ ID NO: 2041859 - RNA, 18 nt, Human
ucuuguauuaaguuguua

SEQ ID NO: 2041860 - RNA, 16 nt, Human
ucuuguauuaaguugu

SEQ ID NO: 2041861 - RNA, 16 nt, Human
ucuuuuuauacuauua

SEQ ID NO: 2041862 - RNA, 17 nt, Human
ugaacauugcaauagaa

SEQ ID NO: 2041863 - RNA, 15 nt, Human
ugaacauugcaauag

SEQ ID NO: 2041864 - RNA, 14 nt, Human
ugaacauuccagag

SEQ ID NO: 2041865 - RNA, 13 nt, Human
ugaacauuccaga

SEQ ID NO: 2041866 - RNA, 17 nt, Human
ucucaaagaaauuucca

SEQ ID NO: 2041867 - RNA, 14 nt, Human
ucucaaacuccuga

SEQ ID NO: 2041868 - RNA, 21 nt, Human
ucucuacugucucaguuuaca

SEQ ID NO: 2041869 - RNA, 17 nt, Human
ucucuuuguucuaaaga

SEQ ID NO: 2041870 - RNA, 21 nt, Human
ucccaaagugcugggauuaca

SEQ ID NO: 2041871 - RNA, 14 nt, Human
uccccagcuguuua

SEQ ID NO: 2041872 - RNA, 15 nt, Human
uccccagcuguuuau

SEQ ID NO: 2041873 - RNA, 15 nt, Human
ucaaaaacauucuua

SEQ ID NO: 2041874 - RNA, 12 nt, Human
guuuuucaguuu

SEQ ID NO: 2041875 - RNA, 15 nt, Human
uaaagcuagaaauga

SEQ ID NO: 2041876 - RNA, 14 nt, Human
uaaagcuagaaaug

SEQ ID NO: 2041877 - RNA, 18 nt, Human
uaagaucguucucugccu

SEQ ID NO: 2041878 - RNA, 13 nt, Human
uaauaaagacagg

SEQ ID NO: 2041879 - RNA, 15 nt, Human
uagaaagaagaugaa

SEQ ID NO: 2041880 - RNA, 15 nt, Human
uacgacaacuugcac

SEQ ID NO: 2041881 - RNA, 14 nt, Human
uacgacaacuugca

SEQ ID NO: 2041882 - RNA, 21 nt, Human
uacauuuuguauauuuguauu

SEQ ID NO: 2041883 - RNA, 16 nt, Human
uacaguguacagucuu

SEQ ID NO: 2041884 - RNA, 15 nt, Human
uacaguguacagucu

SEQ ID NO: 2041885 - RNA, 22 nt, Human
uacaguguacagucuuguauua

SEQ ID NO: 2041886 - RNA, 13 nt, Human
uacaguguacagu

SEQ ID NO: 2041887 - RNA, 22 nt, Human
uauccugcuucugauaugcagu

SEQ ID NO: 2041888 - RNA, 21 nt, Human
uauaaauuuuuuuuguuucau

SEQ ID NO: 2041889 - RNA, 17 nt, Human
uauaaauuuuuuuuguu

SEQ ID NO: 2041890 - RNA, 12 nt, Human
ggccaaguucuu

SEQ ID NO: 2041891 - RNA, 16 nt, Human
gcuggauuacaggcau

SEQ ID NO: 2041892 - RNA, 19 nt, Human
ggaaaaaccacccccaaau

SEQ ID NO: 2041893 - RNA, 17 nt, Human
ggucucaaacuccugac

SEQ ID NO: 2041894 - RNA, 12 nt, Human
gccgggguggau

SEQ ID NO: 2041895 - RNA, 19 nt, Human
gcccaaagugguauagaaa

SEQ ID NO: 2041896 - RNA, 18 nt, Human
gauauaaaagacugacca

SEQ ID NO: 2041897 - RNA, 23 nt, Human
gaaguaguggagccccugcucug

SEQ ID NO: 2041898 - RNA, 17 nt, Human
gaacauugcaauagaaa

SEQ ID NO: 2041899 - RNA, 15 nt, Human
gaacauugcaauaga

SEQ ID NO: 2041900 - RNA, 13 nt, Human
gaacauugcaaua

SEQ ID NO: 2041901 - RNA, 15 nt, Human
gaacguuuuuccugu

SEQ ID NO: 2041902 - RNA, 12 nt, Human
gaacguuuuucc

SEQ ID NO: 2041903 - RNA, 16 nt, Human
gacgugauuuugcugu

SEQ ID NO: 2041904 - RNA, 17 nt, Human
gacgugauuuugcugua

SEQ ID NO: 2041905 - RNA, 19 nt, Human
gaccuguggccaaguucuu

SEQ ID NO: 2041906 - RNA, 16 nt, Human
gacuuauuuauauaaa

SEQ ID NO: 2041907 - RNA, 22 nt, Human
gacugaccaauauuguacaguu

SEQ ID NO: 2041908 - RNA, 21 nt, Human
gacugaccaauauuguacagu

SEQ ID NO: 2041909 - RNA, 21 nt, Human
gaccaauauuguacaguuuuu

SEQ ID NO: 2041910 - RNA, 19 nt, Human
gaccaauauuguacaguuu

SEQ ID NO: 2041911 - RNA, 18 nt, Human
gaccaauauuguacaguu

SEQ ID NO: 2041912 - RNA, 17 nt, Human
gaccaauauuguacagu

SEQ ID NO: 2041913 - RNA, 18 nt, Human
gaaaagggaacugaacau

SEQ ID NO: 2041914 - RNA, 15 nt, Human
cuuucugcagaaaca

SEQ ID NO: 2041915 - RNA, 14 nt, Human
cuuacuuaguguua

SEQ ID NO: 2041916 - RNA, 21 nt, Human
cucuccauucccguggaacgu

SEQ ID NO: 2041917 - RNA, 24 nt, Human
cuccauucccguggaacguuuuuc

SEQ ID NO: 2041918 - RNA, 15 nt, Human
cucaggucuguuuuc

SEQ ID NO: 2041919 - RNA, 17 nt, Human
cucgagguuucucaaag

SEQ ID NO: 2041920 - RNA, 21 nt, Human
cuccugaguagcuggauuaca

SEQ ID NO: 2041921 - RNA, 18 nt, Human
cuggucucaaacuccuga

SEQ ID NO: 2041922 - RNA, 20 nt, Human
ccuguggccaaguucuuagu

SEQ ID NO: 2041923 - RNA, 12 nt, Human
cguucucugccu

SEQ ID NO: 2041924 - RNA, 17 nt, Human
cgucauaacuagaacug

SEQ ID NO: 2041925 - RNA, 16 nt, Human
cgucauaacuagaacu

SEQ ID NO: 2041926 - RNA, 14 nt, Human
cgucauaacuagaa

SEQ ID NO: 2041927 - RNA, 16 nt, Human
cgucgacguagaaccu

SEQ ID NO: 2041928 - RNA, 14 nt, Human
cggccucccaaagu

SEQ ID NO: 2041929 - RNA, 24 nt, Human
ccagcuggagaaauaugguacuca

SEQ ID NO: 2041930 - RNA, 16 nt, Human
ccacucaggucuguuu

SEQ ID NO: 2041931 - RNA, 11 nt, Human
ccacucagguc

SEQ ID NO: 2041932 - RNA, 20 nt, Human
ccacaguggaaccagcccag

SEQ ID NO: 2041933 - RNA, 17 nt, Human
ccaaauuuucuuuuuau

SEQ ID NO: 2041934 - RNA, 20 nt, Human
cauuuuucagauauaaaaga

SEQ ID NO: 2041935 - RNA, 18 nt, Human
cauuuuucagauauaaaa

SEQ ID NO: 2041936 - RNA, 23 nt, Human
gaaucacguaaagcuagaaauga

SEQ ID NO: 2041937 - RNA, 13 nt, Human
gguauagaaaugc

SEQ ID NO: 2041938 - RNA, 21 nt, Human
ggauuacagggaugagccacc

SEQ ID NO: 2041939 - RNA, 14 nt, Human
guccacaguggaac

SEQ ID NO: 2041940 - RNA, 22 nt, Human
guuaucaaaaaaaaaaaaaugu

SEQ ID NO: 2041941 - RNA, 19 nt, Human
aaaauuuaagcugcaaaaa

SEQ ID NO: 2041942 - RNA, 16 nt, Human
agcuguuuaugcauag

SEQ ID NO: 2041943 - RNA, 14 nt, Human
aaucuucaauaguu

SEQ ID NO: 2041944 - RNA, 16 nt, Human
uguuucuuuaguuuuu

SEQ ID NO: 2041945 - RNA, 18 nt, Human
ugcagcgauuaauaacag

SEQ ID NO: 2041946 - RNA, 21 nt, Human
ggauuacaggcaugugccacc

SEQ ID NO: 2041947 - RNA, 21 nt, Human
gagccucaaaugagaaaaugu

SEQ ID NO: 2041948 - RNA, 12 nt, Human
gccaaguucuua

SEQ ID NO: 2041949 - RNA, 16 nt, Human
uggcaguggaacuaag

SEQ ID NO: 2041950 - RNA, 23 nt, Human
gaccucaaguaauccaccugccu

SEQ ID NO: 2041951 - RNA, 13 nt, Human
aaagauggaaaaa

SEQ ID NO: 2041952 - RNA, 22 nt, Human
ugaaaucuuuuuuguucaaaga

SEQ ID NO: 2041953 - RNA, 21 nt, Human
agagaucuauauauguauaaa

SEQ ID NO: 2041954 - RNA, 20 nt, Human
caaauacuuuaauguauaaa

SEQ ID NO: 2041955 - RNA, 23 nt, Human
auaaccucaagucacaugagaau

SEQ ID NO: 2041956 - RNA, 16 nt, Human
caguuucuuucaaaga

SEQ ID NO: 2041957 - RNA, 11 nt, Human
cugaauagauu

SEQ ID NO: 2041958 - RNA, 15 nt, Human
ccauaugaauaacau

SEQ ID NO: 2041959 - RNA, 20 nt, Human
aauuuggguaugaacagauu

SEQ ID NO: 2041960 - RNA, 22 nt, Human
ucagaugcauccuuucauaaga

SEQ ID NO: 2041961 - RNA, 19 nt, Human
uagaaauggggaacuacug

SEQ ID NO: 2041962 - RNA, 11 nt, Human
aacguuuuucc

SEQ ID NO: 2041963 - RNA, 21 nt, Human
auauaucguucauuguaaaaa

SEQ ID NO: 2041964 - RNA, 20 nt, Human
agugaaucacguaaagcuag

SEQ ID NO: 2041965 - RNA, 20 nt, Human
aucuuuuuuguucaaagauu

SEQ ID NO: 2041966 - RNA, 21 nt, Human
aaauaugguacucauuaaaaa

SEQ ID NO: 2041967 - RNA, 15 nt, Human
aaugcugguuuuuca

SEQ ID NO: 2041968 - RNA, 15 nt, Human
gaucguucucugccu

SEQ ID NO: 2041969 - RNA, 15 nt, Human
cgucgacguagaacc

SEQ ID NO: 2041970 - RNA, 11 nt, Human herpesvirus 6B
uacguuuucaa

SEQ ID NO: 2041971 - RNA, 14 nt, Human herpesvirus 6B
uuauuuucuguauu

SEQ ID NO: 2041972 - RNA, 17 nt, Human herpesvirus 6B
gaaguguuaugaagaau

SEQ ID NO: 2041973 - RNA, 19 nt, Human herpesvirus 6B
aagugaaggcggagaugca

SEQ ID NO: 2041974 - RNA, 21 nt, Human herpesvirus 6B
cugaucucacgucacaguuuu

SEQ ID NO: 2041975 - RNA, 17 nt, Human herpesvirus 6B
ggaagauucugcagaau

SEQ ID NO: 2041976 - RNA, 16 nt, Human herpesvirus 6B
gccguuguuaaugaau

SEQ ID NO: 2041977 - RNA, 23 nt, Human herpesvirus 6B
ccgcaucgcguucgacaaagaac

SEQ ID NO: 2041978 - RNA, 18 nt, Human herpesvirus 6B
gucuccgauccgucagga

SEQ ID NO: 2041979 - RNA, 22 nt, Human herpesvirus 6B
auugaaggguguuuccacacag

SEQ ID NO: 2041980 - RNA, 22 nt, Human herpesvirus 6B
uuuauggagggaauugugucuu

SEQ ID NO: 2041981 - RNA, 12 nt, Human herpesvirus 6B
caauaaacauga

SEQ ID NO: 2041982 - RNA, 21 nt, Human herpesvirus 6B
cugccgaccugauccaugagc

SEQ ID NO: 2041983 - RNA, 21 nt, Human herpesvirus 6B
gcugucgcccgccucucuccg

SEQ ID NO: 2041984 - RNA, 17 nt, Human herpesvirus 6B
cucgucuguugcuguag

SEQ ID NO: 2041985 - RNA, 17 nt, Human herpesvirus 6B
ggacaaaaauucaucag

SEQ ID NO: 2041986 - RNA, 17 nt, Human herpesvirus 6B
acgccauacgggaaaag

SEQ ID NO: 2041987 - RNA, 13 nt, Human herpesvirus 6B
aaaagccccugcu

SEQ ID NO: 2041988 - RNA, 22 nt, Human herpesvirus 6B
aaaauguuuccaugacugugag

SEQ ID NO: 2041989 - RNA, 17 nt, Human herpesvirus 6B
caaggaagagaaugaau

SEQ ID NO: 2041990 - RNA, 23 nt, Human herpesvirus 6B
agguaucugccccccuucaucca

SEQ ID NO: 2041991 - RNA, 19 nt, Human herpesvirus 6B
uaaggaagaucgcuuuucu

SEQ ID NO: 2041992 - RNA, 14 nt, Human herpesvirus 6B
gaaagaaccaguga

SEQ ID NO: 2041993 - RNA, 12 nt, Human herpesvirus 6B
cugcaaaacaaa

SEQ ID NO: 2041994 - RNA, 19 nt, Human herpesvirus 6B
gucaagacgccuaguguua

SEQ ID NO: 2041995 - RNA, 13 nt, Human herpesvirus 6B
aauacgucagcuc

SEQ ID NO: 2041996 - RNA, 17 nt, Human herpesvirus 6B
gaggacgcaaagagaga

SEQ ID NO: 2041997 - RNA, 20 nt, Human herpesvirus 6B
uuucuaaaucugaaauguag

SEQ ID NO: 2041998 - RNA, 22 nt, Human herpesvirus 6B
aacacuuucuucgccuguaaag

SEQ ID NO: 2041999 - RNA, 13 nt, Human herpesvirus 6B
cgaugaaacuguc

SEQ ID NO: 2042000 - RNA, 15 nt, Human herpesvirus 6B
acacaaaaagacucu

SEQ ID NO: 2042001 - RNA, 18 nt, Human herpesvirus 6B
cuggcaugcguuacggag

SEQ ID NO: 2042002 - RNA, 14 nt, Human herpesvirus 6B
aacagaggaagaaa

SEQ ID NO: 2042003 - RNA, 17 nt, Human herpesvirus 6B
uggaugucaagucuaga

SEQ ID NO: 2042004 - RNA, 20 nt, Human herpesvirus 6B
cgcagaaucaagaaacacuu

SEQ ID NO: 2042005 - RNA, 20 nt, Human herpesvirus 6B
cucgggggacggagaggaag

SEQ ID NO: 2042006 - RNA, 19 nt, Human herpesvirus 6B
ccuuuggccuugauuguga

SEQ ID NO: 2042007 - RNA, 21 nt, Human herpesvirus 6B
gggucacuaucuucgcagaag

SEQ ID NO: 2042008 - RNA, 21 nt, Human herpesvirus 6B
augauagaagaucuaaugaau

SEQ ID NO: 2042009 - RNA, 15 nt, Human herpesvirus 6B
uccaaugaugaaacu

SEQ ID NO: 2042010 - RNA, 13 nt, Human herpesvirus 6B
cagaugaggagga

SEQ ID NO: 2042011 - RNA, 16 nt, Human herpesvirus 6B
gacaauuuaucgugcu

SEQ ID NO: 2042012 - RNA, 17 nt, Human herpesvirus 6B
aucuggauauguaucca

SEQ ID NO: 2042013 - RNA, 20 nt, Human herpesvirus 6B
aggcgcagcagcagcuccaa

SEQ ID NO: 2042014 - RNA, 20 nt, Human herpesvirus 6B
cgguuagaucuggggagaug

SEQ ID NO: 2042015 - RNA, 15 nt, Human herpesvirus 6B
auuugaacagagauu

SEQ ID NO: 2042016 - RNA, 14 nt, Human herpesvirus 6B
uauuuuaaaugaca

SEQ ID NO: 2042017 - RNA, 23 nt, Human herpesvirus 6B
gcacgaagaagggcagagagccg

SEQ ID NO: 2042018 - RNA, 15 nt, Human herpesvirus 6B
uuacaacugaaacuc

SEQ ID NO: 2042019 - RNA, 15 nt, Human herpesvirus 6B
uccgcggcgcugggc

SEQ ID NO: 2042020 - RNA, 12 nt, Human herpesvirus 6B
agccaaggggac

SEQ ID NO: 2042021 - RNA, 16 nt, Human herpesvirus 6B
auucuaauuauaaaug

SEQ ID NO: 2042022 - RNA, 22 nt, Human herpesvirus 6B
ucacaauaauuacucccauaga

SEQ ID NO: 2042023 - RNA, 22 nt, Human herpesvirus 6B
uugacggcgugcauauauauga

SEQ ID NO: 2042024 - RNA, 13 nt, Human herpesvirus 6B
cuuuaugugcaau

SEQ ID NO: 2042025 - RNA, 22 nt, Human herpesvirus 6B
caggcaccauguucgccucucc

SEQ ID NO: 2042026 - RNA, 22 nt, Human herpesvirus 6B
cccgggcgcggggcgcaccggc

SEQ ID NO: 2042027 - RNA, 14 nt, Human herpesvirus 6B
gcgagucugugcuu

SEQ ID NO: 2042028 - RNA, 23 nt, Human herpesvirus 6B
auuaauuuuuuguuucugaaaau

SEQ ID NO: 2042029 - RNA, 15 nt, Human herpesvirus 6B
uccuaaauaccauuu

SEQ ID NO: 2042030 - RNA, 23 nt, Human herpesvirus 6B
guccgcucauuuugauuuguaaa

SEQ ID NO: 2042031 - RNA, 13 nt, Human herpesvirus 6B
auucuuaaauuca

SEQ ID NO: 2042032 - RNA, 21 nt, Human herpesvirus 6B
ccucaaacuuuuagagacuuu

SEQ ID NO: 2042033 - RNA, 19 nt, Human herpesvirus 6B
agaagggcagagagccgca

SEQ ID NO: 2042034 - RNA, 15 nt, Human herpesvirus 6B
gaacgcguccuccgc

SEQ ID NO: 2042035 - RNA, 17 nt, Human herpesvirus 6B
acaauuuacacaggaug

SEQ ID NO: 2042036 - RNA, 16 nt, Human herpesvirus 6B
uccgugacacacagaa

SEQ ID NO: 2042037 - RNA, 23 nt, Human herpesvirus 6B
aaugucuucgagauuuuagaaua

SEQ ID NO: 2042038 - RNA, 13 nt, Human herpesvirus 6B
aacaguuucagau

SEQ ID NO: 2042039 - RNA, 13 nt, Human herpesvirus 6B
cuucaucuggagu

SEQ ID NO: 2042040 - RNA, 15 nt, Human herpesvirus 6B
gucauggaaaaauga

SEQ ID NO: 2042041 - RNA, 13 nt, Human herpesvirus 6B
cuguaaacaaauu

SEQ ID NO: 2042042 - RNA, 14 nt, Human herpesvirus 6B
uccgaguauggaga

SEQ ID NO: 2042043 - RNA, 13 nt, Human herpesvirus 6B
gagaucugaggac

SEQ ID NO: 2042044 - RNA, 16 nt, Human herpesvirus 6B
auaaaaaaaaauacua

SEQ ID NO: 2042045 - RNA, 21 nt, Human herpesvirus 6B
ucucgccgccucgccgcuccc

SEQ ID NO: 2042046 - RNA, 17 nt, Human herpesvirus 6B
cagagagccgcagaggc

SEQ ID NO: 2042047 - RNA, 14 nt, Human herpesvirus 6B
agcaagaaaaagag

SEQ ID NO: 2042048 - RNA, 18 nt, Human herpesvirus 6B
uccguuuuuucugcaaaa

SEQ ID NO: 2042049 - RNA, 22 nt, Human herpesvirus 6B
gacugcccuggggucuaagaua

SEQ ID NO: 2042050 - RNA, 19 nt, Human herpesvirus 6B
aauguugucaaucguguau

SEQ ID NO: 2042051 - RNA, 12 nt, Human herpesvirus 6B
aacuauguguua

SEQ ID NO: 2042052 - RNA, 16 nt, Human herpesvirus 6B
gcggggaucgggccug

SEQ ID NO: 2042053 - RNA, 15 nt, Human herpesvirus 6B
auguuauuguuccuu

SEQ ID NO: 2042054 - RNA, 13 nt, Human herpesvirus 6B
gacugacaaggua

SEQ ID NO: 2042055 - RNA, 15 nt, Human herpesvirus 6B
uucaaagugaauucc

SEQ ID NO: 2042056 - RNA, 19 nt, Human herpesvirus 6B
cugauaaacuccaaaaucu

SEQ ID NO: 2042057 - RNA, 15 nt, Human herpesvirus 6B
caugaaaacauucag

SEQ ID NO: 2042058 - RNA, 21 nt, Human herpesvirus 6B
ggagugcguaaucgcaagaaa

SEQ ID NO: 2042059 - RNA, 20 nt, Human herpesvirus 6B
agaugcagucuccacagggc

SEQ ID NO: 2042060 - RNA, 21 nt, Human herpesvirus 6B
auccaaugaugaaacuccuuc

SEQ ID NO: 2042061 - RNA, 15 nt, Human herpesvirus 6B
guaauuauugugaca

SEQ ID NO: 2042062 - RNA, 15 nt, Human herpesvirus 6B
uccccguccucgugc

SEQ ID NO: 2042063 - RNA, 14 nt, Human herpesvirus 6B
agacuaaauguucu

SEQ ID NO: 2042064 - RNA, 18 nt, Human herpesvirus 6B
uuacuuuguggaaaucua

SEQ ID NO: 2042065 - RNA, 18 nt, Human herpesvirus 6B
cacacagaauacaaaaac

SEQ ID NO: 2042066 - RNA, 21 nt, Human herpesvirus 6B
cauucagucucagcaaucacc

SEQ ID NO: 2042067 - RNA, 14 nt, Human herpesvirus 6B
aauuuuauugacug

SEQ ID NO: 2042068 - RNA, 14 nt, Human herpesvirus 6B
gacgucugggauca

SEQ ID NO: 2042069 - RNA, 21 nt, Human herpesvirus 6B
auuuuagaauaaaaaauagac

SEQ ID NO: 2042070 - RNA, 14 nt, Human herpesvirus 6B
ccucuugcaguggc

SEQ ID NO: 2042071 - RNA, 13 nt, Human herpesvirus 6B
ucuuagaaauuuu

SEQ ID NO: 2042072 - RNA, 21 nt, Human herpesvirus 6B
agcagaacggcgguaacgugg

SEQ ID NO: 2042073 - RNA, 11 nt, Human herpesvirus 6B
ggcccuuggug

SEQ ID NO: 2042074 - RNA, 15 nt, Human herpesvirus 6B
caaugcggaacacca

SEQ ID NO: 2042075 - RNA, 16 nt, Human herpesvirus 6B
ccaaagcuuucuguac

SEQ ID NO: 2042076 - RNA, 16 nt, Human herpesvirus 6B
auuauaaaaacacacc

SEQ ID NO: 2042077 - RNA, 21 nt, Human herpesvirus 6B
cacgacauggaacuucauagc

SEQ ID NO: 2042078 - RNA, 17 nt, Human herpesvirus 6B
agggaagucaaggaaac

SEQ ID NO: 2042079 - RNA, 23 nt, Human herpesvirus 6B
cauaauugugauaguuauuuugu

SEQ ID NO: 2042080 - RNA, 17 nt, Human herpesvirus 6B
ucugccgaaaagaaaga

SEQ ID NO: 2042081 - RNA, 18 nt, Human herpesvirus 6B
uuuacguuaaaagggaag

SEQ ID NO: 2042082 - RNA, 14 nt, Human herpesvirus 6B
ccaugacugugagg

SEQ ID NO: 2042083 - RNA, 19 nt, Human herpesvirus 6B
uuggaugccuacauaugcc

SEQ ID NO: 2042084 - RNA, 14 nt, Human herpesvirus 6B
ggagggcggagaag

SEQ ID NO: 2042085 - RNA, 13 nt, Human herpesvirus 6B
ugaacuguuucca

SEQ ID NO: 2042086 - RNA, 13 nt, Human herpesvirus 6B
cugaccccccaca

SEQ ID NO: 2042087 - RNA, 23 nt, Human herpesvirus 6B
caagaaaucacguugaaaugucg

SEQ ID NO: 2042088 - RNA, 15 nt, Human herpesvirus 6B
guuuuucacagaaug

SEQ ID NO: 2042089 - RNA, 19 nt, Human herpesvirus 6B
uugcuacaaaguucucaga

SEQ ID NO: 2042090 - RNA, 17 nt, Human herpesvirus 6B
gcauacacccugccgac

SEQ ID NO: 2042091 - RNA, 13 nt, Human herpesvirus 6B
agaaaggcggaga

SEQ ID NO: 2042092 - RNA, 13 nt, Human herpesvirus 6B
caagguucucagc

SEQ ID NO: 2042093 - RNA, 13 nt, Human herpesvirus 6B
gaaacugaagaaa

SEQ ID NO: 2042094 - RNA, 19 nt, Human herpesvirus 6B
aacuacgaagcugaaaauc

SEQ ID NO: 2042095 - RNA, 14 nt, Human herpesvirus 6B
ccugagagcaggag

SEQ ID NO: 2042096 - RNA, 18 nt, Human herpesvirus 6B
ggcgaccgugaugagaga

SEQ ID NO: 2042097 - RNA, 12 nt, Human herpesvirus 6B
aaacauucuuaa

SEQ ID NO: 2042098 - RNA, 12 nt, Human herpesvirus 6B
aaagaacauuug

SEQ ID NO: 2042099 - RNA, 17 nt, Human herpesvirus 6B
gaguugcacauguuucu

SEQ ID NO: 2042100 - RNA, 19 nt, Human herpesvirus 6B
auguauuggaauugggaag

SEQ ID NO: 2042101 - RNA, 15 nt, Human herpesvirus 6B
acugugaaaagugcu

SEQ ID NO: 2042102 - RNA, 24 nt, Human herpesvirus 6B
agcaacuugcugucggccgaagga

SEQ ID NO: 2042103 - RNA, 21 nt, Human herpesvirus 6B
acaccucguagcgaucuuuua

SEQ ID NO: 2042104 - RNA, 18 nt, Human herpesvirus 6B
accccccucuugcagugg

SEQ ID NO: 2042105 - RNA, 20 nt, Human herpesvirus 6B
cugucgcccgccucucuccg

SEQ ID NO: 2042106 - RNA, 23 nt, Human herpesvirus 6B
cgacgcagauuuacgacacgcuc

SEQ ID NO: 2042107 - RNA, 13 nt, Human herpesvirus 6B
cucacccccacuc

SEQ ID NO: 2042108 - RNA, 14 nt, Human herpesvirus 6B
gcgguucgacagag

SEQ ID NO: 2042109 - RNA, 15 nt, Human herpesvirus 6B
ggcggccccgcguca

SEQ ID NO: 2042110 - RNA, 23 nt, Human herpesvirus 6B
uucuucaagggccguaccuuucu

SEQ ID NO: 2042111 - RNA, 17 nt, Human herpesvirus 6B
agugggagagcggaaga

SEQ ID NO: 2042112 - RNA, 22 nt, Human herpesvirus 6B
gcugacgggggcacaucuguug

SEQ ID NO: 2042113 - RNA, 22 nt, Human herpesvirus 6B
gacggcgugcauauauaugaau

SEQ ID NO: 2042114 - RNA, 19 nt, Human herpesvirus 6B
acguggccgucuccugcaa

SEQ ID NO: 2042115 - RNA, 16 nt, Human herpesvirus 6B
gacucgccgaugaaac

SEQ ID NO: 2042116 - RNA, 23 nt, Human herpesvirus 6B
acuggagcuagagaaaauuauag

SEQ ID NO: 2042117 - RNA, 19 nt, Human herpesvirus 6B
cugauauggcaaauuucaa

SEQ ID NO: 2042118 - RNA, 20 nt, Human herpesvirus 6B
gaaagguguggugaaagaca

SEQ ID NO: 2042119 - RNA, 12 nt, Human herpesvirus 6B
caaaaaauguua

SEQ ID NO: 2042120 - RNA, 16 nt, Human herpesvirus 6B
gauccgucaggaccag

SEQ ID NO: 2042121 - RNA, 20 nt, Human herpesvirus 6B
ccuauucuaauuauaaaugu

SEQ ID NO: 2042122 - RNA, 17 nt, Human herpesvirus 6B
cgucauaauuuuccagc

SEQ ID NO: 2042123 - RNA, 17 nt, Human herpesvirus 6B
gaaaagaucaagcaagu

SEQ ID NO: 2042124 - RNA, 19 nt, Human herpesvirus 6B
gcugcguuccaugugucuc

SEQ ID NO: 2042125 - RNA, 16 nt, Human herpesvirus 6B
aguuguugcuuccgau

SEQ ID NO: 2042126 - RNA, 18 nt, Human herpesvirus 6B
cauuagcugcuaaaugug

SEQ ID NO: 2042127 - RNA, 23 nt, Human herpesvirus 6B
augaaugugagagauuuuucaau

SEQ ID NO: 2042128 - RNA, 13 nt, Human herpesvirus 6B
auccccagaagga

SEQ ID NO: 2042129 - RNA, 19 nt, Human herpesvirus 6B
ggaagaucaugacaaggau

SEQ ID NO: 2042130 - RNA, 15 nt, Human herpesvirus 6B
cagaggaagaaagga

SEQ ID NO: 2042131 - RNA, 16 nt, Human herpesvirus 6B
uggagauugauuccag

SEQ ID NO: 2042132 - RNA, 17 nt, Human herpesvirus 6B
uuaugaucggcauuugu

SEQ ID NO: 2042133 - RNA, 14 nt, Human herpesvirus 6B
gaaauuaauaagau

SEQ ID NO: 2042134 - RNA, 16 nt, Human herpesvirus 6B
augacucaagaauuac

SEQ ID NO: 2042135 - RNA, 18 nt, Human herpesvirus 6B
agcaggcuccccaggcgc

SEQ ID NO: 2042136 - RNA, 17 nt, Human herpesvirus 6B
ggaucgacgaccaggca

SEQ ID NO: 2042137 - RNA, 16 nt, Human herpesvirus 6B
aaauaucgucucuaac

SEQ ID NO: 2042138 - RNA, 21 nt, Human herpesvirus 6B
agcauccuguuuucccaccua

SEQ ID NO: 2042139 - RNA, 21 nt, Human herpesvirus 6B
gagcauaauaaucuaguaccu

SEQ ID NO: 2042140 - RNA, 17 nt, Human herpesvirus 6B
uagaucuggaagacugu

SEQ ID NO: 2042141 - RNA, 19 nt, Human herpesvirus 6B
guaagccuauugacaugau

SEQ ID NO: 2042142 - RNA, 20 nt, Human herpesvirus 6B
aagaacaugcagaagaacau

SEQ ID NO: 2042143 - RNA, 17 nt, Human herpesvirus 6B
gcuccgagcgggauccc

SEQ ID NO: 2042144 - RNA, 19 nt, Human herpesvirus 6B
gaucgaguuacauucguau

SEQ ID NO: 2042145 - RNA, 16 nt, Human herpesvirus 6B
agguguuaaacgaaaa

SEQ ID NO: 2042146 - RNA, 13 nt, Human herpesvirus 6B
aaagcgccugccu

SEQ ID NO: 2042147 - RNA, 18 nt, Human herpesvirus 6B
guguuuguuuuuagaagc

SEQ ID NO: 2042148 - RNA, 20 nt, Human herpesvirus 6B
cguucaggucaagcgccagg

SEQ ID NO: 2042149 - RNA, 14 nt, Human herpesvirus 6B
agauaauuacagau

SEQ ID NO: 2042150 - RNA, 13 nt, Human herpesvirus 6B
gacccaacagaag

SEQ ID NO: 2042151 - RNA, 14 nt, Human herpesvirus 6B
gcaggguguggccg

SEQ ID NO: 2042152 - RNA, 17 nt, Human herpesvirus 6B
uacaauacuuucacaca

SEQ ID NO: 2042153 - RNA, 15 nt, Human herpesvirus 6B
cagaaaagcaaacau

SEQ ID NO: 2042154 - RNA, 14 nt, Human herpesvirus 6B
gaugugcggagaaa

SEQ ID NO: 2042155 - RNA, 18 nt, Human herpesvirus 6B
gugggcgguagguucacu

SEQ ID NO: 2042156 - RNA, 16 nt, Human herpesvirus 6B
cucgccuaucuguauu

SEQ ID NO: 2042157 - RNA, 21 nt, Human herpesvirus 6B
cgguuaaagaaucugcagauu

SEQ ID NO: 2042158 - RNA, 14 nt, Human herpesvirus 6B
cugguaguucuuga

SEQ ID NO: 2042159 - RNA, 14 nt, Human herpesvirus 6B
auaaagaagaucac

SEQ ID NO: 2042160 - RNA, 15 nt, Human herpesvirus 6B
cggggccucccuccg

SEQ ID NO: 2042161 - RNA, 12 nt, Human herpesvirus 6B
ggaguauucgug

SEQ ID NO: 2042162 - RNA, 19 nt, Human herpesvirus 6B
gacacagacgucuacggua

SEQ ID NO: 2042163 - RNA, 14 nt, Human herpesvirus 6B
gcagggcgggcacg

SEQ ID NO: 2042164 - RNA, 15 nt, Human herpesvirus 6B
aguguuaugaagaau

SEQ ID NO: 2042165 - RNA, 15 nt, Human herpesvirus 6B
uccaaugaauacuuc

SEQ ID NO: 2042166 - RNA, 15 nt, Human herpesvirus 6B
cucuuuuccccccgc

SEQ ID NO: 2042167 - RNA, 23 nt, Human herpesvirus 6B
ggcgaagggacacgagaagaaca

SEQ ID NO: 2042168 - RNA, 18 nt, Human herpesvirus 6B
caacguuacgauuuucua

SEQ ID NO: 2042169 - RNA, 18 nt, Human herpesvirus 6B
agucguggcggagcaccc

SEQ ID NO: 2042170 - RNA, 23 nt, Human herpesvirus 6B
cgguccccccucccuccaucccc

SEQ ID NO: 2042171 - RNA, 17 nt, Human herpesvirus 6B
uagucguggcggagcac

SEQ ID NO: 2042172 - RNA, 17 nt, Human herpesvirus 6B
gcgucauuagaagguug

SEQ ID NO: 2042173 - RNA, 12 nt, Human herpesvirus 6B
aguauuuacuga

SEQ ID NO: 2042174 - RNA, 17 nt, Human herpesvirus 6B
agauuaauuaucauuau

SEQ ID NO: 2042175 - RNA, 21 nt, Human herpesvirus 6B
ucgcaagaaaagaaaaaacag

SEQ ID NO: 2042176 - RNA, 16 nt, Human herpesvirus 6B
auuucccaguuaauuu

SEQ ID NO: 2042177 - RNA, 21 nt, Human herpesvirus 6B
ccagcucuguucucucccacu

SEQ ID NO: 2042178 - RNA, 14 nt, Human herpesvirus 6B
cagaaaagcaaaca

SEQ ID NO: 2042179 - RNA, 23 nt, Human herpesvirus 6B
agauaucugaaacacuaagugcc

SEQ ID NO: 2042180 - RNA, 15 nt, Human herpesvirus 6B
uguaaaauguuucca

SEQ ID NO: 2042181 - RNA, 19 nt, Human herpesvirus 6B
ggauuuaguuucuuuggaa

SEQ ID NO: 2042182 - RNA, 12 nt, Human herpesvirus 6B
uaaugccacagg

SEQ ID NO: 2042183 - RNA, 17 nt, Human herpesvirus 6B
uuccuguuuuucucaua

SEQ ID NO: 2042184 - RNA, 14 nt, Human herpesvirus 6B
augacuuuucugaa

SEQ ID NO: 2042185 - RNA, 15 nt, Human herpesvirus 6B
aacagaguuuucaua

SEQ ID NO: 2042186 - RNA, 21 nt, Human herpesvirus 6B
acaagcagccuaaauuuucuu

SEQ ID NO: 2042187 - RNA, 18 nt, Human herpesvirus 6B
uaagauagauauuaugua

SEQ ID NO: 2042188 - RNA, 20 nt, Human herpesvirus 6B
uuggugacguuuagcuuugu

SEQ ID NO: 2042189 - RNA, 15 nt, Human herpesvirus 6B
uaacgaacaaaucuc

SEQ ID NO: 2042190 - RNA, 12 nt, Human herpesvirus 6B
ucagaugugaua

SEQ ID NO: 2042191 - RNA, 15 nt, Human herpesvirus 6B
gacuuuucugaaauu

SEQ ID NO: 2042192 - RNA, 19 nt, Human herpesvirus 6B
gauggauaagauuuaccac

SEQ ID NO: 2042193 - RNA, 14 nt, Human herpesvirus 6B
uuaagaugucgugu

SEQ ID NO: 2042194 - RNA, 15 nt, Human herpesvirus 6B
uaugauuuucaauau

SEQ ID NO: 2042195 - RNA, 14 nt, Human herpesvirus 6B
ugccguguaugaga

SEQ ID NO: 2042196 - RNA, 15 nt, Human herpesvirus 6B
gagagccgcagaggc

SEQ ID NO: 2042197 - RNA, 15 nt, Human herpesvirus 6B
uucgacauagagugu

SEQ ID NO: 2042198 - RNA, 23 nt, Human herpesvirus 6B
cuuugauaaaaccaucuauuugc

SEQ ID NO: 2042199 - RNA, 19 nt, Human herpesvirus 6B
aaagggaagucaaggaaac

SEQ ID NO: 2042200 - RNA, 17 nt, Human herpesvirus 6B
ucugaaaaguuagaguu

SEQ ID NO: 2042201 - RNA, 22 nt, Human herpesvirus 6B
uaauauuugcaagcagaccagu

SEQ ID NO: 2042202 - RNA, 16 nt, Human herpesvirus 6B
ucauguaaaauuaccu

SEQ ID NO: 2042203 - RNA, 22 nt, Human herpesvirus 6B
ggcaugcguuacggagauauac

SEQ ID NO: 2042204 - RNA, 13 nt, Human herpesvirus 6B
uccguccccgccg

SEQ ID NO: 2042205 - RNA, 19 nt, Human herpesvirus 6B
caggguguggccggcacgc

SEQ ID NO: 2042206 - RNA, 13 nt, Human herpesvirus 6B
cucaagaggguuu

SEQ ID NO: 2042207 - RNA, 16 nt, Human herpesvirus 6B
gccccgcgucaggugc

SEQ ID NO: 2042208 - RNA, 23 nt, Human herpesvirus 6B
auaucgagaguacggaagugccu

SEQ ID NO: 2042209 - RNA, 16 nt, Human herpesvirus 6B
aacgaugccuugggga

SEQ ID NO: 2042210 - RNA, 15 nt, Human herpesvirus 6B
caucuauuaucauuu

SEQ ID NO: 2042211 - RNA, 24 nt, Human herpesvirus 6B
agagaggaugcuuuuaguuucaaa

SEQ ID NO: 2042212 - RNA, 21 nt, Human herpesvirus 6B
uccuuauaaugugaacuaaau

SEQ ID NO: 2042213 - RNA, 13 nt, Human herpesvirus 6B
guguggcagcaau

SEQ ID NO: 2042214 - RNA, 18 nt, Human herpesvirus 6B
uaaaagcugcuaacggag

SEQ ID NO: 2042215 - RNA, 17 nt, Human herpesvirus 6B
gaaaggcggagacacau

SEQ ID NO: 2042216 - RNA, 17 nt, Human herpesvirus 6B
aguguuaaagaugcuga

SEQ ID NO: 2042217 - RNA, 14 nt, Human herpesvirus 6B
gaugccuguaggga

SEQ ID NO: 2042218 - RNA, 21 nt, Human herpesvirus 6B
augcuguugcuguuguuguag

SEQ ID NO: 2042219 - RNA, 13 nt, Human herpesvirus 6B
uucgagaaagagg

SEQ ID NO: 2042220 - RNA, 21 nt, Human herpesvirus 6B
caaacaacuguuguguuugaa

SEQ ID NO: 2042221 - RNA, 16 nt, Human herpesvirus 6B
uacuaugauagaagau

SEQ ID NO: 2042222 - RNA, 14 nt, Human herpesvirus 6B
gggcacggagaaca

SEQ ID NO: 2042223 - RNA, 21 nt, Human herpesvirus 6B
aguggcgcgcguuuuugguga

SEQ ID NO: 2042224 - RNA, 18 nt, Human herpesvirus 6B
auggaaaaggcggacagc

SEQ ID NO: 2042225 - RNA, 21 nt, Human herpesvirus 6B
ucgggccuggggacagacagg

SEQ ID NO: 2042226 - RNA, 16 nt, Human herpesvirus 6B
aggaaauaccaaagaa

SEQ ID NO: 2042227 - RNA, 22 nt, Human herpesvirus 6B
ugugggaaaauaauauuugcaa

SEQ ID NO: 2042228 - RNA, 18 nt, Human herpesvirus 6B
uauuaaugcuuauuucga

SEQ ID NO: 2042229 - RNA, 17 nt, Human herpesvirus 6B
uaguguuaaagaugcug

SEQ ID NO: 2042230 - RNA, 19 nt, Human herpesvirus 6B
caaguggaaguguaaaugu

SEQ ID NO: 2042231 - RNA, 13 nt, Human herpesvirus 6B
acccauuuaucug

SEQ ID NO: 2042232 - RNA, 18 nt, Human herpesvirus 6B
gaagaacagaggaagaaa

SEQ ID NO: 2042233 - RNA, 22 nt, Human herpesvirus 6B
uaaacauucuuaaauucaauuu

SEQ ID NO: 2042234 - RNA, 21 nt, Human herpesvirus 6B
cgucagcucuucacuuucuaa

SEQ ID NO: 2042235 - RNA, 11 nt, Human herpesvirus 6B
ggggggggccc

SEQ ID NO: 2042236 - RNA, 13 nt, Human herpesvirus 6B
ccaugcgaguaga

SEQ ID NO: 2042237 - RNA, 21 nt, Human herpesvirus 6B
ccuauucuaauuauaaaugua

SEQ ID NO: 2042238 - RNA, 20 nt, Human herpesvirus 6B
agaauuuucgaaaagaucag

SEQ ID NO: 2042239 - RNA, 18 nt, Human herpesvirus 6B
auuaauuuuuuguuucug

SEQ ID NO: 2042240 - RNA, 17 nt, Human herpesvirus 6B
gcucuccgcgcugcugg

SEQ ID NO: 2042241 - RNA, 13 nt, Human herpesvirus 6B
ugaaggcuacuau

SEQ ID NO: 2042242 - RNA, 22 nt, Human herpesvirus 6B
uaagugugcguuauuuucugua

SEQ ID NO: 2042243 - RNA, 22 nt, Human herpesvirus 6B
ccgguugucacacgucccuucu

SEQ ID NO: 2042244 - RNA, 24 nt, Human herpesvirus 6B
aauucugugaugggaaauguuguc

SEQ ID NO: 2042245 - RNA, 15 nt, Human herpesvirus 6B
gucucaguucaaaau

SEQ ID NO: 2042246 - RNA, 22 nt, Human herpesvirus 6B
uauaguuauucagauuucugua

SEQ ID NO: 2042247 - RNA, 23 nt, Human herpesvirus 6B
cacggcaacgcuccucccacgcc

SEQ ID NO: 2042248 - RNA, 17 nt, Human herpesvirus 6B
uuguagcucaguguuug

SEQ ID NO: 2042249 - RNA, 15 nt, Human herpesvirus 6B
gugaucaggaaauua

SEQ ID NO: 2042250 - RNA, 16 nt, Human herpesvirus 6B
gaugccaaagcuuucu

SEQ ID NO: 2042251 - RNA, 21 nt, Human herpesvirus 6B
aauugauugggucuuucccgu

SEQ ID NO: 2042252 - RNA, 16 nt, Human herpesvirus 6B
uuuacgcggcugauau

SEQ ID NO: 2042253 - RNA, 22 nt, Human herpesvirus 6B
aacuguucggauccaaugauga

SEQ ID NO: 2042254 - RNA, 16 nt, Human herpesvirus 6B
gaugaauugugcgugu

SEQ ID NO: 2042255 - RNA, 13 nt, Human herpesvirus 6B
ccucuugcagugg

SEQ ID NO: 2042256 - RNA, 13 nt, Human herpesvirus 6B
uugcauggcaugu

SEQ ID NO: 2042257 - RNA, 22 nt, Human herpesvirus 6B
aaaacagagccgcgguggaaau

SEQ ID NO: 2042258 - RNA, 18 nt, Human herpesvirus 6B
acaccagagaucagcaug

SEQ ID NO: 2042259 - RNA, 13 nt, Human herpesvirus 6B
aauaauuuacugu

SEQ ID NO: 2042260 - RNA, 18 nt, Human herpesvirus 6B
gucacacgucccuucucc

SEQ ID NO: 2042261 - RNA, 17 nt, Human herpesvirus 6B
acaauauaugaaauacu

SEQ ID NO: 2042262 - RNA, 16 nt, Human herpesvirus 6B
uguuuucauucugcua

SEQ ID NO: 2042263 - RNA, 19 nt, Human herpesvirus 6B
auucaguuuuuuguuucug

SEQ ID NO: 2042264 - RNA, 21 nt, Human herpesvirus 6B
aauaauucguuugauauagaa

SEQ ID NO: 2042265 - RNA, 18 nt, Human herpesvirus 6B
ugccgccgaagaaagagg

SEQ ID NO: 2042266 - RNA, 20 nt, Human herpesvirus 6B
uuuaaaaaugauaacuguuu

SEQ ID NO: 2042267 - RNA, 15 nt, Human herpesvirus 6B
cgggaucacgcaggc

SEQ ID NO: 2042268 - RNA, 13 nt, Human herpesvirus 6B
cagauuucccaaa

SEQ ID NO: 2042269 - RNA, 13 nt, Human herpesvirus 6B
ucaugaauuuaug

SEQ ID NO: 2042270 - RNA, 14 nt, Human herpesvirus 6B
uagaaguuaaucaa

SEQ ID NO: 2042271 - RNA, 14 nt, Human herpesvirus 6B
acaaagccacagcu

SEQ ID NO: 2042272 - RNA, 22 nt, Human herpesvirus 6B
aguggcgcgcguuuuuggugaa

SEQ ID NO: 2042273 - RNA, 15 nt, Human herpesvirus 6B
agacagauugaucau

SEQ ID NO: 2042274 - RNA, 21 nt, Human herpesvirus 6B
gagaucuggugaauguuucug

SEQ ID NO: 2042275 - RNA, 19 nt, Human herpesvirus 6B
gcaggggccguacgcgcca

SEQ ID NO: 2042276 - RNA, 18 nt, Human herpesvirus 6B
caaauaauuuuauugacu

SEQ ID NO: 2042277 - RNA, 15 nt, Human herpesvirus 6B
agccgacuauggaug

SEQ ID NO: 2042278 - RNA, 16 nt, Human herpesvirus 6B
ggaagaaaggaguuug

SEQ ID NO: 2042279 - RNA, 18 nt, Human herpesvirus 6B
uacgggaagguguuugau

SEQ ID NO: 2042280 - RNA, 20 nt, Human herpesvirus 6B
auuuagccuauuaagcagcc

SEQ ID NO: 2042281 - RNA, 21 nt, Human herpesvirus 6B
uagaacauaagggacagcagu

SEQ ID NO: 2042282 - RNA, 17 nt, Human herpesvirus 6B
ccucugcggcucucugc

SEQ ID NO: 2042283 - RNA, 15 nt, Human herpesvirus 6B
cuuaaaggcagcugg

SEQ ID NO: 2042284 - RNA, 15 nt, Human herpesvirus 6B
ccuuccgcuaccgcc

SEQ ID NO: 2042285 - RNA, 21 nt, Human herpesvirus 6B
aaaauugucuacaaucauuua

SEQ ID NO: 2042286 - RNA, 16 nt, Human herpesvirus 6B
aauuaaaguuuacugu

SEQ ID NO: 2042287 - RNA, 23 nt, Human herpesvirus 6B
gcagucaguaauaauauaaaaga

SEQ ID NO: 2042288 - RNA, 19 nt, Human herpesvirus 6B
guggaguauggugucugaa

SEQ ID NO: 2042289 - RNA, 23 nt, Human herpesvirus 6B
cauaagggacagcaguuuuuugg

SEQ ID NO: 2042290 - RNA, 16 nt, Human herpesvirus 6B
uuaugugaauucugug

SEQ ID NO: 2042291 - RNA, 14 nt, Human herpesvirus 6B
gcugucacacucug

SEQ ID NO: 2042292 - RNA, 15 nt, Human herpesvirus 6B
uaucaaacaacuguu

SEQ ID NO: 2042293 - RNA, 14 nt, Human herpesvirus 6B
cagaucuuucuaga

SEQ ID NO: 2042294 - RNA, 20 nt, Human herpesvirus 6B
acauccagaaaagcaaacau

SEQ ID NO: 2042295 - RNA, 12 nt, Human herpesvirus 6B
gggccagcccug

SEQ ID NO: 2042296 - RNA, 13 nt, Human herpesvirus 6B
ugaaaaaaaacug

SEQ ID NO: 2042297 - RNA, 14 nt, Human herpesvirus 6B
uagcacacgacaaa

SEQ ID NO: 2042298 - RNA, 19 nt, Human herpesvirus 6B
aggcuuuauggagauuuga

SEQ ID NO: 2042299 - RNA, 22 nt, Human herpesvirus 6B
uccacggcaacgcuccucccac

SEQ ID NO: 2042300 - RNA, 21 nt, Human herpesvirus 6B
uuauguuaauuccaagaugca

SEQ ID NO: 2042301 - RNA, 21 nt, Human herpesvirus 6B
cgggaccuggcgggcaccgag

SEQ ID NO: 2042302 - RNA, 15 nt, Human herpesvirus 6B
uucauuguaauucca

SEQ ID NO: 2042303 - RNA, 20 nt, Human herpesvirus 6B
caugaugaucugcuuuguuu

SEQ ID NO: 2042304 - RNA, 13 nt, Human herpesvirus 6B
ugcgucuuuugua

SEQ ID NO: 2042305 - RNA, 15 nt, Human herpesvirus 6B
cgagacggugauguu

SEQ ID NO: 2042306 - RNA, 9 nt, Human herpesvirus 6B
gaggaggag

SEQ ID NO: 2042307 - RNA, 23 nt, Human herpesvirus 6B
ucccuccguuaggaucagacaga

SEQ ID NO: 2042308 - RNA, 14 nt, Human herpesvirus 6B
gacauuagagaaau

SEQ ID NO: 2042309 - RNA, 14 nt, Human herpesvirus 6B
uaagcgugugguaa

SEQ ID NO: 2042310 - RNA, 16 nt, Human herpesvirus 6B
guauauggugaugaau

SEQ ID NO: 2042311 - RNA, 20 nt, Human herpesvirus 6B
gcaagcccggagaacugauc

SEQ ID NO: 2042312 - RNA, 17 nt, Human herpesvirus 6B
cguccauccaguugugu

SEQ ID NO: 2042313 - RNA, 22 nt, Human herpesvirus 6B
guccuauguuaacauugugaga

SEQ ID NO: 2042314 - RNA, 17 nt, Human herpesvirus 6B
aagaaugggauugucau

SEQ ID NO: 2042315 - RNA, 14 nt, Human herpesvirus 6B
cccucccgcagcuc

SEQ ID NO: 2042316 - RNA, 17 nt, Human herpesvirus 6B
ggaucccagaugcaguc

SEQ ID NO: 2042317 - RNA, 13 nt, Human herpesvirus 6B
gccauggguguca

SEQ ID NO: 2042318 - RNA, 12 nt, Human herpesvirus 6B
agauuucuguag

SEQ ID NO: 2042319 - RNA, 15 nt, Human herpesvirus 6B
uucuccacacuguuu

SEQ ID NO: 2042320 - RNA, 19 nt, Human herpesvirus 6B
uacuuacaucgauccaaaa

SEQ ID NO: 2042321 - RNA, 20 nt, Human herpesvirus 6B
ucuguuacaacaauauguaa

SEQ ID NO: 2042322 - RNA, 18 nt, Human herpesvirus 6B
uuucguuuacgaauucaa

SEQ ID NO: 2042323 - RNA, 15 nt, Human herpesvirus 6B
ugugaaaagugcuuu

SEQ ID NO: 2042324 - RNA, 22 nt, Human herpesvirus 6B
uuuguacucgcuuacgaucuuu

SEQ ID NO: 2042325 - RNA, 11 nt, Human herpesvirus 6B
ugaccuuuucc

SEQ ID NO: 2042326 - RNA, 18 nt, Human herpesvirus 6B
agaauagagauaaaugua

SEQ ID NO: 2042327 - RNA, 23 nt, Human herpesvirus 6B
gcuucacguccagcgcauccuua

SEQ ID NO: 2042328 - RNA, 18 nt, Human herpesvirus 6B
aauccuucauagccggga

SEQ ID NO: 2042329 - RNA, 18 nt, Human herpesvirus 6B
uacucugcaacuuuauuu

SEQ ID NO: 2042330 - RNA, 16 nt, Human herpesvirus 6B
augcuuuaaaaaugcu

SEQ ID NO: 2042331 - RNA, 14 nt, Human herpesvirus 6B
gagcauugaguaga

SEQ ID NO: 2042332 - RNA, 16 nt, Human herpesvirus 6B
gaggaaaugcagcagu

SEQ ID NO: 2042333 - RNA, 22 nt, Human herpesvirus 6B
aauuuccagggugaagacagaa

SEQ ID NO: 2042334 - RNA, 23 nt, Human herpesvirus 6B
agcaucgguuguguuagcuucgc

SEQ ID NO: 2042335 - RNA, 16 nt, Human herpesvirus 6B
aaacaaaauuaauuca

SEQ ID NO: 2042336 - RNA, 18 nt, Human herpesvirus 6B
gcauagacugaacacaaa

SEQ ID NO: 2042337 - RNA, 18 nt, Human herpesvirus 6B
cugcguuacaagcaugca

SEQ ID NO: 2042338 - RNA, 15 nt, Human herpesvirus 6B
uuugcgucagaguuu

SEQ ID NO: 2042339 - RNA, 20 nt, Human herpesvirus 6B
gaaccacaucuuuuccugcu

SEQ ID NO: 2042340 - RNA, 21 nt, Human herpesvirus 6B
uuuaacgcagauauauggauc

SEQ ID NO: 2042341 - RNA, 22 nt, Human herpesvirus 6B
auuccauguggccuuuuuguaa

SEQ ID NO: 2042342 - RNA, 18 nt, Human herpesvirus 6B
gugcccacugugguguuu

SEQ ID NO: 2042343 - RNA, 19 nt, Human herpesvirus 6B
aacuaaugcggaacauugu

SEQ ID NO: 2042344 - RNA, 16 nt, Human herpesvirus 6B
ugaaaucacuccgcau

SEQ ID NO: 2042345 - RNA, 22 nt, Human herpesvirus 6B
aucuugaaaagccccugcuuga

SEQ ID NO: 2042346 - RNA, 18 nt, Human herpesvirus 6B
augggaaauguugucaau

SEQ ID NO: 2042347 - RNA, 13 nt, Human herpesvirus 6B
cacauagagaaga

SEQ ID NO: 2042348 - RNA, 19 nt, Human herpesvirus 6B
cugcuccguucccuucucg

SEQ ID NO: 2042349 - RNA, 23 nt, Human herpesvirus 6B
cucagcauuguugagaauuuaac

SEQ ID NO: 2042350 - RNA, 13 nt, Human herpesvirus 6B
uaagcugcagaca

SEQ ID NO: 2042351 - RNA, 21 nt, Human herpesvirus 6B
cgcggagcacgcacgagaaca

SEQ ID NO: 2042352 - RNA, 17 nt, Human herpesvirus 6B
uacaagaaaagaaacaa

SEQ ID NO: 2042353 - RNA, 23 nt, Human herpesvirus 6B
uaagugugcguuauuuucuguau

SEQ ID NO: 2042354 - RNA, 21 nt, Human herpesvirus 6B
aaaauaauccucuuagacacu

SEQ ID NO: 2042355 - RNA, 16 nt, Human herpesvirus 6B
cguggccgucuccugc

SEQ ID NO: 2042356 - RNA, 22 nt, Human herpesvirus 6B
gugaucgcaaaagagaaggaaa

SEQ ID NO: 2042357 - RNA, 11 nt, Human herpesvirus 6B
uuauguuugau

SEQ ID NO: 2042358 - RNA, 14 nt, Human herpesvirus 6B
uggacaccaauaaa

SEQ ID NO: 2042359 - RNA, 18 nt, Human herpesvirus 6B
acaaauaauuuuauugac

SEQ ID NO: 2042360 - RNA, 20 nt, Human herpesvirus 6B
ccacugcggaguuuuauggc

SEQ ID NO: 2042361 - RNA, 22 nt, Human herpesvirus 6B
guuauuguguucugcucugugu

SEQ ID NO: 2042362 - RNA, 16 nt, Human herpesvirus 6B
uccggucaacuucuau

SEQ ID NO: 2042363 - RNA, 19 nt, Human herpesvirus 6B
caauaaaaaacuuauaauu

SEQ ID NO: 2042364 - RNA, 18 nt, Human herpesvirus 6B
auuuucuccuuuuuugac

SEQ ID NO: 2042365 - RNA, 17 nt, Human herpesvirus 6B
gaaucacuuaguugaua

SEQ ID NO: 2042366 - RNA, 16 nt, Human herpesvirus 6B
cgagccggacaggagg

SEQ ID NO: 2042367 - RNA, 16 nt, Human herpesvirus 6B
auaucuggauauguau

SEQ ID NO: 2042368 - RNA, 21 nt, Human herpesvirus 6B
uucuuaggaaacuuucaaaau

SEQ ID NO: 2042369 - RNA, 16 nt, Human herpesvirus 6B
gcaaacucaaagaaag

SEQ ID NO: 2042370 - RNA, 14 nt, Human herpesvirus 6B
gaacucucacggcc

SEQ ID NO: 2042371 - RNA, 16 nt, Human herpesvirus 6B
ccagauaggaaaaggu

SEQ ID NO: 2042372 - RNA, 19 nt, Human herpesvirus 6B
ugacggcgaugaaaaagau

SEQ ID NO: 2042373 - RNA, 18 nt, Human herpesvirus 6B
gcagaaucaagaaacacu

SEQ ID NO: 2042374 - RNA, 20 nt, Human herpesvirus 6B
cuugguguaccagacaaaac

SEQ ID NO: 2042375 - RNA, 14 nt, Human herpesvirus 6B
gauugauccuguaa

SEQ ID NO: 2042376 - RNA, 12 nt, Human herpesvirus 6B
aaucacaaauau

SEQ ID NO: 2042377 - RNA, 16 nt, Human herpesvirus 6B
uauuucguauguuuaa

SEQ ID NO: 2042378 - RNA, 13 nt, Human herpesvirus 6B
cgccauaauggaa

SEQ ID NO: 2042379 - RNA, 15 nt, Human herpesvirus 6B
gacugugaggugauu

SEQ ID NO: 2042380 - RNA, 15 nt, Human herpesvirus 6B
aagauuuuuggauuu

SEQ ID NO: 2042381 - RNA, 15 nt, Human herpesvirus 6B
ggccuggggacagac

SEQ ID NO: 2042382 - RNA, 18 nt, Human herpesvirus 6B
ugacggacuuggaaaagg

SEQ ID NO: 2042383 - RNA, 20 nt, Human herpesvirus 6B
cgcggccgucgcgcucgccg

SEQ ID NO: 2042384 - RNA, 15 nt, Human herpesvirus 6B
uuaaagauguguuaa

SEQ ID NO: 2042385 - RNA, 15 nt, Human herpesvirus 6B
aagcaaguuccauuu

SEQ ID NO: 2042386 - RNA, 12 nt, Human herpesvirus 6B
ccccccucuugc

SEQ ID NO: 2042387 - RNA, 14 nt, Human herpesvirus 6B
acacggcgaaagcc

SEQ ID NO: 2042388 - RNA, 13 nt, Human herpesvirus 6B
ggcgucgggcgac

SEQ ID NO: 2042389 - RNA, 13 nt, Human herpesvirus 6B
augcggagaagua

SEQ ID NO: 2042390 - RNA, 16 nt, Human herpesvirus 6B
ggagacugcacagaau

SEQ ID NO: 2042391 - RNA, 23 nt, Human herpesvirus 6B
ucgaguuguauuauaaaaacuaa

SEQ ID NO: 2042392 - RNA, 15 nt, Human herpesvirus 6B
aaaucauauauugaa

SEQ ID NO: 2042393 - RNA, 16 nt, Human herpesvirus 6B
gcagauauauggauca

SEQ ID NO: 2042394 - RNA, 17 nt, Human herpesvirus 6B
cgcuggucgccguggcc

SEQ ID NO: 2042395 - RNA, 16 nt, Human herpesvirus 6B
gcauggugauguguua

SEQ ID NO: 2042396 - RNA, 16 nt, Human herpesvirus 6B
uaaaacaucagaugaa

SEQ ID NO: 2042397 - RNA, 23 nt, Human herpesvirus 6B
auaccauuuuauacgaaaauaaa

SEQ ID NO: 2042398 - RNA, 16 nt, Human herpesvirus 6B
auuguguucugcucug

SEQ ID NO: 2042399 - RNA, 21 nt, Human herpesvirus 6B
ucuguaaaaggauaaauuccu

SEQ ID NO: 2042400 - RNA, 22 nt, Human herpesvirus 6B
aaccgaaaacacccugauggau

SEQ ID NO: 2042401 - RNA, 22 nt, Human herpesvirus 6B
acuaucuccuugaugauacuuu

SEQ ID NO: 2042402 - RNA, 17 nt, Human herpesvirus 6B
aaccaugcaucuugcaa

SEQ ID NO: 2042403 - RNA, 15 nt, Human herpesvirus 6B
agaggaagccggagc

SEQ ID NO: 2042404 - RNA, 22 nt, Human herpesvirus 6B
cacaaacgccuagagaacagau

SEQ ID NO: 2042405 - RNA, 15 nt, Human herpesvirus 6B
uuagagaaauuugug

SEQ ID NO: 2042406 - RNA, 14 nt, Human herpesvirus 6B
gcuuugguggaaaa

SEQ ID NO: 2042407 - RNA, 12 nt, Human herpesvirus 6B
cugccuuuggac

SEQ ID NO: 2042408 - RNA, 15 nt, Human herpesvirus 6B
accuaagcuggacag

SEQ ID NO: 2042409 - RNA, 18 nt, Human herpesvirus 6B
gccaaacauaucacagau

SEQ ID NO: 2042410 - RNA, 19 nt, Human herpesvirus 6B
gguucaaagauagacagug

SEQ ID NO: 2042411 - RNA, 22 nt, Human herpesvirus 6B
cgacacggagugcgacaggaga

SEQ ID NO: 2042412 - RNA, 21 nt, Human herpesvirus 6B
aucuuaaucagauaucugaaa

SEQ ID NO: 2042413 - RNA, 23 nt, Human herpesvirus 6B
aggcacaauucuaacuaaaauua

SEQ ID NO: 2042414 - RNA, 13 nt, Human herpesvirus 6B
aauuauaaaugua

SEQ ID NO: 2042415 - RNA, 21 nt, Human herpesvirus 6B
agcuuguuaugacaaaaccau

SEQ ID NO: 2042416 - RNA, 16 nt, Human herpesvirus 6B
acagcgcauaaauaaa

SEQ ID NO: 2042417 - RNA, 23 nt, Human herpesvirus 6B
ggaguaauuauugugacaaggua

SEQ ID NO: 2042418 - RNA, 23 nt, Human herpesvirus 6B
auuuaaaaagcaaggugaaacau

SEQ ID NO: 2042419 - RNA, 14 nt, Human herpesvirus 6B
agggcguuucucgc

SEQ ID NO: 2042420 - RNA, 22 nt, Human herpesvirus 6B
acggcgaggggacggacagagc

SEQ ID NO: 2042421 - RNA, 20 nt, Human herpesvirus 6B
uuacuguccguuauuguguu

SEQ ID NO: 2042422 - RNA, 15 nt, Human herpesvirus 6B
aucaagacuacucug

SEQ ID NO: 2042423 - RNA, 15 nt, Human herpesvirus 6B
auucaauuucuaaau

SEQ ID NO: 2042424 - RNA, 14 nt, Human herpesvirus 6B
ugaaaucuuuccug

SEQ ID NO: 2042425 - RNA, 17 nt, Human herpesvirus 6B
aggcgagauuuggugga

SEQ ID NO: 2042426 - RNA, 20 nt, Human herpesvirus 6B
aauucucugauugauccugu

SEQ ID NO: 2042427 - RNA, 15 nt, Human herpesvirus 6B
gaucacuuuguuucu

SEQ ID NO: 2042428 - RNA, 20 nt, Human herpesvirus 6B
cauucuugcagauuucacuu

SEQ ID NO: 2042429 - RNA, 20 nt, Human herpesvirus 6B
ccguuauuguguucugcucu

SEQ ID NO: 2042430 - RNA, 16 nt, Human herpesvirus 6B
agcuguucgguuuaau

SEQ ID NO: 2042431 - RNA, 21 nt, Human herpesvirus 6B
gaucuuauaaaugugagcagu

SEQ ID NO: 2042432 - RNA, 22 nt, Human herpesvirus 6B
ccgaagaaucugccgaucacca

SEQ ID NO: 2042433 - RNA, 18 nt, Human herpesvirus 6B
uguuagcaagcugggaaa

SEQ ID NO: 2042434 - RNA, 15 nt, Human herpesvirus 6B
ggagucggucuguuc

SEQ ID NO: 2042435 - RNA, 17 nt, Human herpesvirus 6B
gucuuacaucuaagcug

SEQ ID NO: 2042436 - RNA, 19 nt, Human herpesvirus 6B
cgagaaacggagagcgaca

SEQ ID NO: 2042437 - RNA, 18 nt, Human herpesvirus 6B
cagagauuuuuuaaauaa

SEQ ID NO: 2042438 - RNA, 22 nt, Human herpesvirus 6B
uuuuuaaacagauuuugaggau

SEQ ID NO: 2042439 - RNA, 14 nt, Human herpesvirus 6B
ccagccgcccuccc

SEQ ID NO: 2042440 - RNA, 16 nt, Human herpesvirus 6B
aacgcuucuaacaaua

SEQ ID NO: 2042441 - RNA, 21 nt, Human herpesvirus 6B
ugacguuuagcuuugugaacu

SEQ ID NO: 2042442 - RNA, 14 nt, Human herpesvirus 6B
aaagguuuuugcug

SEQ ID NO: 2042443 - RNA, 22 nt, Human herpesvirus 6B
ccguccccgccgcgcuggucgc

SEQ ID NO: 2042444 - RNA, 21 nt, Human herpesvirus 6B
agucuagagguuuucuuuccc

SEQ ID NO: 2042445 - RNA, 22 nt, Human herpesvirus 6B
ccguucccggggggggggggcc

SEQ ID NO: 2042446 - RNA, 12 nt, Human herpesvirus 6B
uaauuuacuguc

SEQ ID NO: 2042447 - RNA, 22 nt, Human herpesvirus 6B
acaaguggaaguguaaauguca

SEQ ID NO: 2042448 - RNA, 15 nt, Human herpesvirus 6B
aucaaaaaaaugaua

SEQ ID NO: 2042449 - RNA, 22 nt, Human herpesvirus 6B
aacgcaaagggaagccagccgc

SEQ ID NO: 2042450 - RNA, 15 nt, Human herpesvirus 6B
ccugaaaccccacaa

SEQ ID NO: 2042451 - RNA, 19 nt, Human herpesvirus 6B
agcagaugcuuaccggugu

SEQ ID NO: 2042452 - RNA, 14 nt, Human herpesvirus 6B
uucucgccgccucg

SEQ ID NO: 2042453 - RNA, 15 nt, Human herpesvirus 6B
uuauuauguuuuuac

SEQ ID NO: 2042454 - RNA, 18 nt, Human herpesvirus 6B
ggggcuucuaccguaguc

SEQ ID NO: 2042455 - RNA, 17 nt, Human herpesvirus 6B
cucaggucguauuauug

SEQ ID NO: 2042456 - RNA, 12 nt, Human herpesvirus 6B
auuauaaaugua

SEQ ID NO: 2042457 - RNA, 17 nt, Human herpesvirus 6B
cauuuuuuugaaaucac

SEQ ID NO: 2042458 - RNA, 18 nt, Human herpesvirus 6B
uuuguggcuauuugacaa

SEQ ID NO: 2042459 - RNA, 16 nt, Human herpesvirus 6B
guccaaugaauacuuc

SEQ ID NO: 2042460 - RNA, 17 nt, Human herpesvirus 6B
uccagcaagaaaaagag

SEQ ID NO: 2042461 - RNA, 23 nt, Human herpesvirus 6B
acauccagaaaagcaaacaugca

SEQ ID NO: 2042462 - RNA, 19 nt, Human herpesvirus 6B
aaaaguuagaguuggauuu

SEQ ID NO: 2042463 - RNA, 13 nt, Human herpesvirus 6B
ucauacauccaga

SEQ ID NO: 2042464 - RNA, 22 nt, Human herpesvirus 6B
gaaucagaucacucagauuuca

SEQ ID NO: 2042465 - RNA, 13 nt, Human herpesvirus 6B
agauguguggugu

SEQ ID NO: 2042466 - RNA, 22 nt, Human herpesvirus 6B
ggaucucgacacguccauaggc

SEQ ID NO: 2042467 - RNA, 13 nt, Human herpesvirus 6B
ggcgcagaaggag

SEQ ID NO: 2042468 - RNA, 15 nt, Human herpesvirus 6B
aucucgaugccaaag

SEQ ID NO: 2042469 - RNA, 19 nt, Human herpesvirus 6B
cgccgccuucucugucgcu

SEQ ID NO: 2042470 - RNA, 15 nt, Human herpesvirus 6B
cuagacgugucuuca

SEQ ID NO: 2042471 - RNA, 18 nt, Human herpesvirus 6B
ucgugugugaaaauuccu

SEQ ID NO: 2042472 - RNA, 15 nt, Human herpesvirus 6B
ggcacgcgccgucag

SEQ ID NO: 2042473 - RNA, 22 nt, Human herpesvirus 6B
ucuacguauaaaaguccucaaa

SEQ ID NO: 2042474 - RNA, 20 nt, Human herpesvirus 6B
agauucgggaugugcggaga

SEQ ID NO: 2042475 - RNA, 11 nt, Human herpesvirus 6B
ugaacagagau

SEQ ID NO: 2042476 - RNA, 19 nt, Human herpesvirus 6B
uguuaacauugugagaaca

SEQ ID NO: 2042477 - RNA, 21 nt, Human herpesvirus 6B
ucauacgacugacgauuucau

SEQ ID NO: 2042478 - RNA, 21 nt, Human herpesvirus 6B
cucuuuccacacuaucuucga

SEQ ID NO: 2042479 - RNA, 13 nt, Human herpesvirus 6B
uguuguguuugaa

SEQ ID NO: 2042480 - RNA, 14 nt, Human herpesvirus 6B
ucucugcaugucuu

SEQ ID NO: 2042481 - RNA, 21 nt, Human herpesvirus 6B
aauagucccauaaagcuuuca

SEQ ID NO: 2042482 - RNA, 13 nt, Human herpesvirus 6B
gcuuccggagaag

SEQ ID NO: 2042483 - RNA, 17 nt, Human herpesvirus 6B
uacgagaccuguuugag

SEQ ID NO: 2042484 - RNA, 15 nt, Human herpesvirus 6B
cucucacccccacuc

SEQ ID NO: 2042485 - RNA, 13 nt, Human herpesvirus 6B
uacguauaaaagu

SEQ ID NO: 2042486 - RNA, 22 nt, Human herpesvirus 6B
uucauagccgggagauuccucu

SEQ ID NO: 2042487 - RNA, 13 nt, Human herpesvirus 6B
ugaggauggauuc

SEQ ID NO: 2042488 - RNA, 17 nt, Human herpesvirus 6B
caccccccucuugcagu

SEQ ID NO: 2042489 - RNA, 13 nt, Human herpesvirus 6B
ggaagggcucugu

SEQ ID NO: 2042490 - RNA, 23 nt, Human herpesvirus 6B
uaaccugagaauuuucgaaaaga

SEQ ID NO: 2042491 - RNA, 23 nt, Human herpesvirus 6B
auucagaaaauuggugugcauua

SEQ ID NO: 2042492 - RNA, 18 nt, Human herpesvirus 6B
cgccgucgucgcucuccc

SEQ ID NO: 2042493 - RNA, 19 nt, Human herpesvirus 6B
gugauugaugagacggaau

SEQ ID NO: 2042494 - RNA, 17 nt, Human herpesvirus 6B
gaacaaaguaauaugau

SEQ ID NO: 2042495 - RNA, 20 nt, Human herpesvirus 6B
gccgcgugaggugacggagg

SEQ ID NO: 2042496 - RNA, 14 nt, Human herpesvirus 6B
auuacuuuugggau

SEQ ID NO: 2042497 - RNA, 20 nt, Human herpesvirus 6B
caacacggggugagagagcu

SEQ ID NO: 2042498 - RNA, 19 nt, Human herpesvirus 6B
uauucuaauuauaaaugua

SEQ ID NO: 2042499 - RNA, 18 nt, Human herpesvirus 6B
ugcaucuugcaagaaagc

SEQ ID NO: 2042500 - RNA, 11 nt, Human herpesvirus 6B
ccgccuucucu

SEQ ID NO: 2042501 - RNA, 19 nt, Human herpesvirus 6B
aguccaaugaauacuucuc

SEQ ID NO: 2042502 - RNA, 16 nt, Human herpesvirus 6B
uguucuuuugucauug

SEQ ID NO: 2042503 - RNA, 15 nt, Human herpesvirus 6B
agaucuugaaaagcc

SEQ ID NO: 2042504 - RNA, 14 nt, Human herpesvirus 6B
guuaaagaugcuga

SEQ ID NO: 2042505 - RNA, 17 nt, Human herpesvirus 6B
uguaucgauuuaaccuu

SEQ ID NO: 2042506 - RNA, 16 nt, Human herpesvirus 6B
ggggaccacugucguc

SEQ ID NO: 2042507 - RNA, 13 nt, Human herpesvirus 6B
uugcugucgcccg

SEQ ID NO: 2042508 - RNA, 22 nt, Human herpesvirus 6B
uagaauuuaacgauccuuuucu

SEQ ID NO: 2042509 - RNA, 18 nt, Human herpesvirus 6B
agacaaaaacaugugcuu

SEQ ID NO: 2042510 - RNA, 22 nt, Human herpesvirus 6B
agacauugguugauuuuuguaa

SEQ ID NO: 2042511 - RNA, 14 nt, Human herpesvirus 6B
caccccccucuugc

SEQ ID NO: 2042512 - RNA, 21 nt, Human herpesvirus 6B
gggacuccgagccggacagga

SEQ ID NO: 2042513 - RNA, 17 nt, Human herpesvirus 6B
cuaaaagauuguuuuca

SEQ ID NO: 2042514 - RNA, 18 nt, Human herpesvirus 6B
aaaauacuauguggaaau

SEQ ID NO: 2042515 - RNA, 15 nt, Human herpesvirus 6B
acgguaaagaugaga

SEQ ID NO: 2042516 - RNA, 21 nt, Human herpesvirus 6B
aacuagcuccuaaauaccauu

SEQ ID NO: 2042517 - RNA, 23 nt, Human herpesvirus 6B
augacauuuauuagcauucaagu

SEQ ID NO: 2042518 - RNA, 14 nt, Human herpesvirus 6B
gccgcuuaaaucaa

SEQ ID NO: 2042519 - RNA, 18 nt, Human herpesvirus 6B
ggacgcguucggucucug

SEQ ID NO: 2042520 - RNA, 13 nt, Human herpesvirus 6B
cccacgcccccuc

SEQ ID NO: 2042521 - RNA, 16 nt, Human herpesvirus 6B
auaucgauucuguaau

SEQ ID NO: 2042522 - RNA, 20 nt, Human herpesvirus 6B
uauuaugucgauacaauaaa

SEQ ID NO: 2042523 - RNA, 20 nt, Human herpesvirus 6B
uacauucaaucuguauaaga

SEQ ID NO: 2042524 - RNA, 24 nt, Human herpesvirus 6B
ugaacaucuauuaucauuuaugca

SEQ ID NO: 2042525 - RNA, 19 nt, Human herpesvirus 6B
gugacuaaugcgauuucac

SEQ ID NO: 2042526 - RNA, 14 nt, Human herpesvirus 6B
uaggguuaggguua

SEQ ID NO: 2042527 - RNA, 15 nt, Human herpesvirus 6B
gucucugugaagagg

SEQ ID NO: 2042528 - RNA, 17 nt, Human herpesvirus 6B
ccggcccguccaccguc

SEQ ID NO: 2042529 - RNA, 17 nt, Human herpesvirus 6B
acaaaaaaaaaaaacau

SEQ ID NO: 2042530 - RNA, 14 nt, Human herpesvirus 6B
aaagagaaggaaaa

SEQ ID NO: 2042531 - RNA, 18 nt, Human herpesvirus 6B
acuuuaucuuuugcaaag

SEQ ID NO: 2042532 - RNA, 19 nt, Human herpesvirus 6B
aacaacugccgccauauua

SEQ ID NO: 2042533 - RNA, 12 nt, Human herpesvirus 6B
guccguggaaaa

SEQ ID NO: 2042534 - RNA, 23 nt, Human herpesvirus 6B
cuuuugcaaagcuuugcacggcg

SEQ ID NO: 2042535 - RNA, 13 nt, Human herpesvirus 6B
auuaaaugugaac

SEQ ID NO: 2042536 - RNA, 20 nt, Human herpesvirus 6B
uuuugacaccucauaucaaa

SEQ ID NO: 2042537 - RNA, 17 nt, Human herpesvirus 6B
gacccaacagaagccac

SEQ ID NO: 2042538 - RNA, 14 nt, Human herpesvirus 6B
uuuaaaaacacacu

SEQ ID NO: 2042539 - RNA, 16 nt, Human herpesvirus 6B
uaauauuugcaagcag

SEQ ID NO: 2042540 - RNA, 13 nt, Human herpesvirus 6B
ugacagaaaucuu

SEQ ID NO: 2042541 - RNA, 14 nt, Human herpesvirus 6B
ccucccuccauccc

SEQ ID NO: 2042542 - RNA, 22 nt, Human herpesvirus 6B
aacgaagguucgacuauguuag

SEQ ID NO: 2042543 - RNA, 15 nt, Human herpesvirus 6B
ggaaguguaaauguc

SEQ ID NO: 2042544 - RNA, 12 nt, Human herpesvirus 6B
gguuugcuuugg

SEQ ID NO: 2042545 - RNA, 13 nt, Human herpesvirus 6B
cuagacacacaga

SEQ ID NO: 2042546 - RNA, 21 nt, Human herpesvirus 6B
cagauuaauuaucauuaugag

SEQ ID NO: 2042547 - RNA, 21 nt, Human herpesvirus 6B
ucccugcgggacgugaucugc

SEQ ID NO: 2042548 - RNA, 20 nt, Human herpesvirus 6B
cucuuaugguucuugagcag

SEQ ID NO: 2042549 - RNA, 18 nt, Human herpesvirus 6B
gccucgccgcucccgcuc

SEQ ID NO: 2042550 - RNA, 14 nt, Human herpesvirus 6B
cggcauuuguguuu

SEQ ID NO: 2042551 - RNA, 17 nt, Human herpesvirus 6B
gcguguaauuguugaaa

SEQ ID NO: 2042552 - RNA, 22 nt, Human herpesvirus 6B
gaaauguugccuuuguaaaaug

SEQ ID NO: 2042553 - RNA, 20 nt, Human herpesvirus 6B
cugucaguggcuugcugucg

SEQ ID NO: 2042554 - RNA, 22 nt, Human herpesvirus 6B
cuccauacccauuuaucugccg

SEQ ID NO: 2042555 - RNA, 14 nt, Human herpesvirus 6B
uaccaagaaaucac

SEQ ID NO: 2042556 - RNA, 16 nt, Human herpesvirus 6B
aaaugagcaacauuua

SEQ ID NO: 2042557 - RNA, 14 nt, Human herpesvirus 6B
agcaaauuuuacca

SEQ ID NO: 2042558 - RNA, 15 nt, Human herpesvirus 6B
aaacuaaauuuuaug

SEQ ID NO: 2042559 - RNA, 15 nt, Human herpesvirus 6B
cucaccuucagacuc

SEQ ID NO: 2042560 - RNA, 15 nt, Human herpesvirus 6B
uucagauuucuguag

SEQ ID NO: 2042561 - RNA, 17 nt, Human herpesvirus 6B
uugacgucugggaucau

SEQ ID NO: 2042562 - RNA, 14 nt, Human herpesvirus 6B
ucucucaacuuuua

SEQ ID NO: 2042563 - RNA, 18 nt, Human herpesvirus 6B
gcguuaucgacggcagcg

SEQ ID NO: 2042564 - RNA, 15 nt, Human herpesvirus 6B
cauuuaccagagaua

SEQ ID NO: 2042565 - RNA, 14 nt, Human herpesvirus 6B
agauuuaaaaauga

SEQ ID NO: 2042566 - RNA, 23 nt, Human herpesvirus 6B
uggauuaucagagagugacaucu

SEQ ID NO: 2042567 - RNA, 14 nt, Human herpesvirus 6B
agccacagcuuugc

SEQ ID NO: 2042568 - RNA, 20 nt, Human herpesvirus 6B
auguaaacacgaaacugcuu

SEQ ID NO: 2042569 - RNA, 21 nt, Human herpesvirus 6B
guucuugauguuagauaaaau

SEQ ID NO: 2042570 - RNA, 20 nt, Human herpesvirus 6B
caggagcaggcuccccaggc

SEQ ID NO: 2042571 - RNA, 17 nt, Human herpesvirus 6B
agccugaaggcuacuau

SEQ ID NO: 2042572 - RNA, 20 nt, Human herpesvirus 6B
cccugcgggacgugaucugc

SEQ ID NO: 2042573 - RNA, 18 nt, Human herpesvirus 6B
aaaucguaggcaucuuca

SEQ ID NO: 2042574 - RNA, 15 nt, Human herpesvirus 6B
ugcucgggaucacgc

SEQ ID NO: 2042575 - RNA, 19 nt, Human herpesvirus 6B
uacagcaaaaauuucaugc

SEQ ID NO: 2042576 - RNA, 16 nt, Human herpesvirus 6B
gcauggaaaaggcgga

SEQ ID NO: 2042577 - RNA, 16 nt, Human herpesvirus 6B
auauuggucaauguau

SEQ ID NO: 2042578 - RNA, 12 nt, Human herpesvirus 6B
cuccugcaauuu

SEQ ID NO: 2042579 - RNA, 22 nt, Human herpesvirus 6B
ugugaaaagugcuuuauccggc

SEQ ID NO: 2042580 - RNA, 14 nt, Human herpesvirus 6B
gauucuuuaaagau

SEQ ID NO: 2042581 - RNA, 11 nt, Human herpesvirus 6B
cugucuguucc

SEQ ID NO: 2042582 - RNA, 23 nt, Human herpesvirus 6B
agauauauggaucaaucuccaaa

SEQ ID NO: 2042583 - RNA, 18 nt, Human herpesvirus 6B
guucaugcgaauuaaaac

SEQ ID NO: 2042584 - RNA, 19 nt, Human herpesvirus 6B
gggcgcaccggcgacacgc

SEQ ID NO: 2042585 - RNA, 22 nt, Human herpesvirus 6B
auaaucuuguagcucaguguuu

SEQ ID NO: 2042586 - RNA, 19 nt, Human herpesvirus 6B
gcacucuccgaccagcacc

SEQ ID NO: 2042587 - RNA, 21 nt, Human herpesvirus 6B
cucauggaucaggucggcagg

SEQ ID NO: 2042588 - RNA, 17 nt, Human herpesvirus 6B
uuugacaccucauauca

SEQ ID NO: 2042589 - RNA, 17 nt, Human herpesvirus 6B
caggucaagcgccagga

SEQ ID NO: 2042590 - RNA, 21 nt, Human herpesvirus 6B
cagucgcggcggccccgcguc

SEQ ID NO: 2042591 - RNA, 17 nt, Human herpesvirus 6B
agguuacaaaggggcua

SEQ ID NO: 2042592 - RNA, 13 nt, Human herpesvirus 6B
caguauaaauucu

SEQ ID NO: 2042593 - RNA, 14 nt, Human herpesvirus 6B
ucuuuggaaaacgu

SEQ ID NO: 2042594 - RNA, 12 nt, Human herpesvirus 6B
cuuuaaaaauua

SEQ ID NO: 2042595 - RNA, 18 nt, Human herpesvirus 6B
auaauaucauucugauaa

SEQ ID NO: 2042596 - RNA, 13 nt, Human herpesvirus 6B
uuuucuauuaaaa

SEQ ID NO: 2042597 - RNA, 23 nt, Human herpesvirus 6B
cuauauuuucguugaagaauaag

SEQ ID NO: 2042598 - RNA, 12 nt, Human herpesvirus 6B
acuauguggaaa

SEQ ID NO: 2042599 - RNA, 16 nt, Human herpesvirus 6B
cucccgcagcuccuuc

SEQ ID NO: 2042600 - RNA, 16 nt, Human herpesvirus 6B
ggaauauauagaagaa

SEQ ID NO: 2042601 - RNA, 15 nt, Human herpesvirus 6B
ccgggacagcacccg

SEQ ID NO: 2042602 - RNA, 18 nt, Human herpesvirus 6B
ugauuggaaucacaaaau

SEQ ID NO: 2042603 - RNA, 17 nt, Human herpesvirus 6B
gucaugcaaaacagauu

SEQ ID NO: 2042604 - RNA, 20 nt, Human herpesvirus 6B
gaggaagucugaauuuaaug

SEQ ID NO: 2042605 - RNA, 15 nt, Human herpesvirus 6B
gcaggugcugcuaaa

SEQ ID NO: 2042606 - RNA, 22 nt, Human herpesvirus 6B
agagggagaaacggacacgcgc

SEQ ID NO: 2042607 - RNA, 15 nt, Human herpesvirus 6B
cuggcgaaaauuguu

SEQ ID NO: 2042608 - RNA, 14 nt, Human herpesvirus 6B
gcagaggccagacu

SEQ ID NO: 2042609 - RNA, 15 nt, Human herpesvirus 6B
uuaaauccuagaguu

SEQ ID NO: 2042610 - RNA, 19 nt, Human herpesvirus 6B
cugauuccuucaauguuuu

SEQ ID NO: 2042611 - RNA, 21 nt, Human herpesvirus 6B
uaacaucucagaucuagaucu

SEQ ID NO: 2042612 - RNA, 12 nt, Human herpesvirus 6B
ggcgccucccau

SEQ ID NO: 2042613 - RNA, 13 nt, Human herpesvirus 6B
cugccgcguggaa

SEQ ID NO: 2042614 - RNA, 15 nt, Human herpesvirus 6B
ucaucaaaugugauu

SEQ ID NO: 2042615 - RNA, 23 nt, Human herpesvirus 6B
auaugucguuucaugggagaaau

SEQ ID NO: 2042616 - RNA, 21 nt, Human herpesvirus 6B
acaaugcaugucgaacagcuu

SEQ ID NO: 2042617 - RNA, 20 nt, Human herpesvirus 6B
gggacggacagagcggagag

SEQ ID NO: 2042618 - RNA, 14 nt, Human herpesvirus 6B
auauaaaaaaagag

SEQ ID NO: 2042619 - RNA, 17 nt, Human herpesvirus 6B
auugcagguuggcgcuc

SEQ ID NO: 2042620 - RNA, 15 nt, Human herpesvirus 6B
gaaaauguguucuua

SEQ ID NO: 2042621 - RNA, 15 nt, Human herpesvirus 6B
cauauacccucgccc

SEQ ID NO: 2042622 - RNA, 21 nt, Human herpesvirus 6B
ugauuccguugugacagaauu

SEQ ID NO: 2042623 - RNA, 18 nt, Human herpesvirus 6B
gcgaugcgccacagggag

SEQ ID NO: 2042624 - RNA, 16 nt, Human herpesvirus 6B
gaccaggauagaaaaa

SEQ ID NO: 2042625 - RNA, 21 nt, Human herpesvirus 6B
ugaggugauuugaacagagau

SEQ ID NO: 2042626 - RNA, 16 nt, Human herpesvirus 6B
aggaggaagaggagga

SEQ ID NO: 2042627 - RNA, 20 nt, Human herpesvirus 6B
gguugucacacgucccuucu

SEQ ID NO: 2042628 - RNA, 15 nt, Human herpesvirus 6B
uauauugcucaaaau

SEQ ID NO: 2042629 - RNA, 15 nt, Human herpesvirus 6B
gaccacucgggccgg

SEQ ID NO: 2042630 - RNA, 15 nt, Human herpesvirus 6B
agcagagguaaagua

SEQ ID NO: 2042631 - RNA, 23 nt, Human herpesvirus 6B
ucuccguuacccgggagcuucac

SEQ ID NO: 2042632 - RNA, 22 nt, Human herpesvirus 6B
gggucuugguuuuauaagcuca

SEQ ID NO: 2042633 - RNA, 16 nt, Human herpesvirus 6B
gcguguuauggggaag

SEQ ID NO: 2042634 - RNA, 14 nt, Human herpesvirus 6B
uugcagcaucgccu

SEQ ID NO: 2042635 - RNA, 20 nt, Human herpesvirus 6B
gaauuaaagauuuaaaaaug

SEQ ID NO: 2042636 - RNA, 15 nt, Human herpesvirus 6B
caaaugagggagaug

SEQ ID NO: 2042637 - RNA, 16 nt, Human herpesvirus 6B
caaaucucaagaaaca

SEQ ID NO: 2042638 - RNA, 15 nt, Human herpesvirus 6B
cccuccaucccccuc

SEQ ID NO: 2042639 - RNA, 19 nt, Human herpesvirus 6B
agucuagacaugauauucu

SEQ ID NO: 2042640 - RNA, 20 nt, Human herpesvirus 6B
gugcguacacggccacccgc

SEQ ID NO: 2042641 - RNA, 16 nt, Human herpesvirus 6B
cuuuauuucuaaggag

SEQ ID NO: 2042642 - RNA, 18 nt, Human herpesvirus 6B
accugcuaacggagcaac

SEQ ID NO: 2042643 - RNA, 11 nt, Human herpesvirus 6B
ggaugaagaga

SEQ ID NO: 2042644 - RNA, 19 nt, Human herpesvirus 6B
gcgaucauaaaacugccaa

SEQ ID NO: 2042645 - RNA, 13 nt, Human herpesvirus 6B
ucguggaagacgu

SEQ ID NO: 2042646 - RNA, 19 nt, Human herpesvirus 6B
cguguucaaaaaugugguc

SEQ ID NO: 2042647 - RNA, 17 nt, Human herpesvirus 6B
uucaguauagacauuuu

SEQ ID NO: 2042648 - RNA, 14 nt, Human herpesvirus 6B
cugugcucuuuaua

SEQ ID NO: 2042649 - RNA, 22 nt, Human herpesvirus 6B
gccuccucuuuuccccccgccg

SEQ ID NO: 2042650 - RNA, 13 nt, Human herpesvirus 6B
ugaaacguuuucu

SEQ ID NO: 2042651 - RNA, 16 nt, Human herpesvirus 6B
cacgucguggcagaac

SEQ ID NO: 2042652 - RNA, 22 nt, Human herpesvirus 6B
uucuuugugcgucagcuuugac

SEQ ID NO: 2042653 - RNA, 17 nt, Human herpesvirus 6B
aucucgaugccaaagcu

SEQ ID NO: 2042654 - RNA, 16 nt, Human herpesvirus 6B
agaaaacuauauugcc

SEQ ID NO: 2042655 - RNA, 23 nt, Human herpesvirus 6B
acgccuccacggcaacgcuccuc

SEQ ID NO: 2042656 - RNA, 15 nt, Human herpesvirus 6B
aaaaucaucaaaugu

SEQ ID NO: 2042657 - RNA, 16 nt, Human herpesvirus 6B
aguuacuuugcuuuga

SEQ ID NO: 2042658 - RNA, 13 nt, Human herpesvirus 6B
ccauguucgccuc

SEQ ID NO: 2042659 - RNA, 17 nt, Human herpesvirus 6B
uauguaagaaauguuuu

SEQ ID NO: 2042660 - RNA, 16 nt, Human herpesvirus 6B
agcaaaccagacagaa

SEQ ID NO: 2042661 - RNA, 19 nt, Human herpesvirus 6B
uguaaaaaaaauucucuga

SEQ ID NO: 2042662 - RNA, 22 nt, Human herpesvirus 6B
ugcccacaccaucuucagcuca

SEQ ID NO: 2042663 - RNA, 14 nt, Human herpesvirus 6B
cauuuucugaaauc

SEQ ID NO: 2042664 - RNA, 12 nt, Human herpesvirus 6B
ucgauguuucca

SEQ ID NO: 2042665 - RNA, 18 nt, Human herpesvirus 6B
cagcuauacuacgagaaa

SEQ ID NO: 2042666 - RNA, 15 nt, Human herpesvirus 6B
gucugucagaaauau

SEQ ID NO: 2042667 - RNA, 16 nt, Human herpesvirus 6B
uucuaaaaguuuauua

SEQ ID NO: 2042668 - RNA, 13 nt, Human herpesvirus 6B
gugaaaagugcuu

SEQ ID NO: 2042669 - RNA, 18 nt, Human herpesvirus 6B
ucaaacagcgacaugaaa

SEQ ID NO: 2042670 - RNA, 20 nt, Human herpesvirus 6B
cugaucacagagaaaaaaca

SEQ ID NO: 2042671 - RNA, 17 nt, Human herpesvirus 6B
uaugugcaauuacagua

SEQ ID NO: 2042672 - RNA, 15 nt, Human herpesvirus 6B
uccauugcucuuucc

SEQ ID NO: 2042673 - RNA, 22 nt, Human herpesvirus 6B
aucucgaaauauaaaaccaaaa

SEQ ID NO: 2042674 - RNA, 19 nt, Human herpesvirus 6B
agaaugaauuugagaagau

SEQ ID NO: 2042675 - RNA, 16 nt, Human herpesvirus 6B
ugcauugcaagauuuu

SEQ ID NO: 2042676 - RNA, 17 nt, Human herpesvirus 6B
aggaggaggagagggag

SEQ ID NO: 2042677 - RNA, 16 nt, Human herpesvirus 6B
cuggaagcacggcuug

SEQ ID NO: 2042678 - RNA, 14 nt, Human herpesvirus 6B
gccucccauagagg

SEQ ID NO: 2042679 - RNA, 17 nt, Human herpesvirus 6B
cccaggcgcagcagcag

SEQ ID NO: 2042680 - RNA, 17 nt, Human herpesvirus 6B
cauauacgucuuuguuu

SEQ ID NO: 2042681 - RNA, 17 nt, Human herpesvirus 6B
gcgcaaaccaagguguu

SEQ ID NO: 2042682 - RNA, 17 nt, Human herpesvirus 6B
uacauaagcaugaaucu

SEQ ID NO: 2042683 - RNA, 20 nt, Human herpesvirus 6B
uauggcuaaugagucucugc

SEQ ID NO: 2042684 - RNA, 14 nt, Human herpesvirus 6B
uauugugacaaggu

SEQ ID NO: 2042685 - RNA, 13 nt, Human herpesvirus 6B
gcggcgcugggcu

SEQ ID NO: 2042686 - RNA, 17 nt, Human herpesvirus 6B
uuaugcaagacguuuuu

SEQ ID NO: 2042687 - RNA, 18 nt, Human herpesvirus 6B
uccaauaguagauuuuca

SEQ ID NO: 2042688 - RNA, 20 nt, Human herpesvirus 6B
gacaaggguaacgcaggaga

SEQ ID NO: 2042689 - RNA, 22 nt, Human herpesvirus 6B
gcuuaaaucaaaaaaaugauag

SEQ ID NO: 2042690 - RNA, 17 nt, Human herpesvirus 6B
aacuuuuuuaaauaaua

SEQ ID NO: 2042691 - RNA, 14 nt, Human herpesvirus 6B
ggaucaaucuccaa

SEQ ID NO: 2042692 - RNA, 17 nt, Human herpesvirus 6B
uauauuggcacguguac

SEQ ID NO: 2042693 - RNA, 18 nt, Human herpesvirus 6B
ucgaaaagucuauucaga

SEQ ID NO: 2042694 - RNA, 18 nt, Human herpesvirus 6B
aaaaagaacugucgcauc

SEQ ID NO: 2042695 - RNA, 21 nt, Human herpesvirus 6B
augucguguucuuuugucauu

SEQ ID NO: 2042696 - RNA, 14 nt, Human herpesvirus 6B
auguaguguggaau

SEQ ID NO: 2042697 - RNA, 20 nt, Human herpesvirus 6B
uaaacggagacugcacagaa

SEQ ID NO: 2042698 - RNA, 12 nt, Human herpesvirus 6B
gagaauagagau

SEQ ID NO: 2042699 - RNA, 20 nt, Human herpesvirus 6B
gaguaccgaauaaaacaagu

SEQ ID NO: 2042700 - RNA, 22 nt, Human herpesvirus 6B
cacugaaauuuacaaucaucug

SEQ ID NO: 2042701 - RNA, 23 nt, Human herpesvirus 6B
uaaaauaauuuuuguagcaauuu

SEQ ID NO: 2042702 - RNA, 15 nt, Human herpesvirus 6B
ggucuuuuugccaaa

SEQ ID NO: 2042703 - RNA, 13 nt, Human herpesvirus 6B
aaaguuuuugguu

SEQ ID NO: 2042704 - RNA, 14 nt, Human herpesvirus 6B
agugcuucugcucu

SEQ ID NO: 2042705 - RNA, 17 nt, Human herpesvirus 6B
ugccccccuucauccag

SEQ ID NO: 2042706 - RNA, 15 nt, Human herpesvirus 6B
uugucagauuuccca

SEQ ID NO: 2042707 - RNA, 21 nt, Human herpesvirus 6B
aauuucaagucuguuacuaau

SEQ ID NO: 2042708 - RNA, 22 nt, Human herpesvirus 6B
caaugucaaguuagaaauguug

SEQ ID NO: 2042709 - RNA, 21 nt, Human herpesvirus 6B
agaauagagauaaauguauaa

SEQ ID NO: 2042710 - RNA, 22 nt, Human herpesvirus 6B
gcgaagguaggaauggacauga

SEQ ID NO: 2042711 - RNA, 22 nt, Human herpesvirus 6B
agaaacgcaaagggaagccagc

SEQ ID NO: 2042712 - RNA, 23 nt, Human herpesvirus 6B
cacgcccccucgguccccccucc

SEQ ID NO: 2042713 - RNA, 19 nt, Human herpesvirus 6B
caugacugugaggugauuu

SEQ ID NO: 2042714 - RNA, 21 nt, Human herpesvirus 6B
ugucuuggaagagagaugcuu

SEQ ID NO: 2042715 - RNA, 14 nt, Human herpesvirus 6B
acuuaguugauaug

SEQ ID NO: 2042716 - RNA, 17 nt, Human herpesvirus 6B
guggaaguguaaauguc

SEQ ID NO: 2042717 - RNA, 16 nt, Human herpesvirus 6B
cauguucgccucuccc

SEQ ID NO: 2042718 - RNA, 19 nt, Human herpesvirus 6B
acgauagcagcucugcaau

SEQ ID NO: 2042719 - RNA, 17 nt, Human herpesvirus 6B
aaaucgauguagauguu

SEQ ID NO: 2042720 - RNA, 16 nt, Human herpesvirus 6B
auagauugcacgcugg

SEQ ID NO: 2042721 - RNA, 18 nt, Human herpesvirus 6B
ugcuccguucccuucucg

SEQ ID NO: 2042722 - RNA, 20 nt, Human herpesvirus 6B
auuuuggaagcauacgucug

SEQ ID NO: 2042723 - RNA, 18 nt, Human herpesvirus 6B
caacuugugccaaucagu

SEQ ID NO: 2042724 - RNA, 22 nt, Human herpesvirus 6B
ugauaugcuuuuuuuuguggau

SEQ ID NO: 2042725 - RNA, 13 nt, Human herpesvirus 6B
agauuacauguau

SEQ ID NO: 2042726 - RNA, 23 nt, Human herpesvirus 6B
ucaaauuuaccggugcaacgcau

SEQ ID NO: 2042727 - RNA, 18 nt, Human herpesvirus 6B
caccccccucuugcagug

SEQ ID NO: 2042728 - RNA, 23 nt, Human herpesvirus 6B
agacaugauauucuuuaugugca

SEQ ID NO: 2042729 - RNA, 15 nt, Human herpesvirus 6B
caacuuuauuugaaa

SEQ ID NO: 2042730 - RNA, 11 nt, Human herpesvirus 6B
aaagaacagaa

SEQ ID NO: 2042731 - RNA, 19 nt, Human herpesvirus 6B
uggcguuccgaauccugug

SEQ ID NO: 2042732 - RNA, 22 nt, Human herpesvirus 6B
ggcugauauacgauggacagaa

SEQ ID NO: 2042733 - RNA, 15 nt, Human herpesvirus 6B
ggccgucuccugcaa

SEQ ID NO: 2042734 - RNA, 18 nt, Human herpesvirus 6B
uaugaauggggcuacuac

SEQ ID NO: 2042735 - RNA, 16 nt, Human herpesvirus 6B
ucgcauggaauucaug

SEQ ID NO: 2042736 - RNA, 21 nt, Human herpesvirus 6B
acugugaggugauuugaacag

SEQ ID NO: 2042737 - RNA, 19 nt, Human herpesvirus 6B
gauguugucuucugugcuu

SEQ ID NO: 2042738 - RNA, 23 nt, Human herpesvirus 6B
uggagucuggccucugcggcucu

SEQ ID NO: 2042739 - RNA, 16 nt, Human herpesvirus 6B
acgcuccucccacgcc

SEQ ID NO: 2042740 - RNA, 22 nt, Human herpesvirus 6B
aaaggggauacuuuguuuucuu

SEQ ID NO: 2042741 - RNA, 19 nt, Human herpesvirus 6B
gaacauaagggacagcagu

SEQ ID NO: 2042742 - RNA, 18 nt, Human herpesvirus 6B
uaauaguuaaaaaauuga

SEQ ID NO: 2042743 - RNA, 23 nt, Human herpesvirus 6B
caugaauuuauguucagccuugc

SEQ ID NO: 2042744 - RNA, 18 nt, Human herpesvirus 6B
ugcaauuugaauucugcu

SEQ ID NO: 2042745 - RNA, 13 nt, Human herpesvirus 6B
ccgcagaagacuu

SEQ ID NO: 2042746 - RNA, 14 nt, Human herpesvirus 6B
acuucuucugcaga

SEQ ID NO: 2042747 - RNA, 13 nt, Human herpesvirus 6B
gaugaaguuccac

SEQ ID NO: 2042748 - RNA, 13 nt, Human herpesvirus 6B
gccgccuucucug

SEQ ID NO: 2042749 - RNA, 20 nt, Human herpesvirus 6B
uguuuucaaugguauucgaa

SEQ ID NO: 2042750 - RNA, 17 nt, Human herpesvirus 6B
cauaacaaguuuuuguc

SEQ ID NO: 2042751 - RNA, 14 nt, Human herpesvirus 6B
aagguuuugugaau

SEQ ID NO: 2042752 - RNA, 14 nt, Human herpesvirus 6B
aagagcgagaucua

SEQ ID NO: 2042753 - RNA, 14 nt, Human herpesvirus 6B
cccgcgucaggugc

SEQ ID NO: 2042754 - RNA, 19 nt, Human herpesvirus 6B
aagacguuuuuguguagaa

SEQ ID NO: 2042755 - RNA, 23 nt, Human herpesvirus 6B
uccuauguuaacauugugagaac

SEQ ID NO: 2042756 - RNA, 17 nt, Human herpesvirus 6B
guggcagggcuguuguc

SEQ ID NO: 2042757 - RNA, 18 nt, Human herpesvirus 6B
cuccgcgcugcuggggcu

SEQ ID NO: 2042758 - RNA, 21 nt, Human herpesvirus 6B
uugcagaacgagacuggacag

SEQ ID NO: 2042759 - RNA, 11 nt, Human herpesvirus 6B
aucacuuuguu

SEQ ID NO: 2042760 - RNA, 16 nt, Human herpesvirus 6B
aucuugccguuuugau

SEQ ID NO: 2042761 - RNA, 15 nt, Human herpesvirus 6B
uugauaaaaccaucu

SEQ ID NO: 2042762 - RNA, 17 nt, Human herpesvirus 6B
uuuucugccugcguuaa

SEQ ID NO: 2042763 - RNA, 15 nt, Human herpesvirus 6B
uaauuacauuaucca

SEQ ID NO: 2042764 - RNA, 19 nt, Human herpesvirus 6B
gguuuugucguuuguacau

SEQ ID NO: 2042765 - RNA, 14 nt, Human herpesvirus 6B
ggagcaggcucccc

SEQ ID NO: 2042766 - RNA, 15 nt, Human herpesvirus 6B
aauggaaagauugga

SEQ ID NO: 2042767 - RNA, 22 nt, Human herpesvirus 6B
uccuauacaugcggagaaguau

SEQ ID NO: 2042768 - RNA, 21 nt, Human herpesvirus 6B
cggcagauucuucggacgcgg

SEQ ID NO: 2042769 - RNA, 15 nt, Human herpesvirus 6B
uggcgcuuguaggag

SEQ ID NO: 2042770 - RNA, 23 nt, Human herpesvirus 6B
gaauucuuucuacguuagcuucc

SEQ ID NO: 2042771 - RNA, 19 nt, Human herpesvirus 6B
uagagaacagauagaaaau

SEQ ID NO: 2042772 - RNA, 14 nt, Human herpesvirus 6B
gaucuauuucccgu

SEQ ID NO: 2042773 - RNA, 22 nt, Human herpesvirus 6B
cgcgcugggacuccgagccgga

SEQ ID NO: 2042774 - RNA, 18 nt, Human herpesvirus 6B
auucugauuauuaucaca

SEQ ID NO: 2042775 - RNA, 23 nt, Human herpesvirus 6B
gaaugagggauucguaguuuaug

SEQ ID NO: 2042776 - RNA, 19 nt, Human herpesvirus 6B
cacggggauuuagugcagu

SEQ ID NO: 2042777 - RNA, 13 nt, Human herpesvirus 6B
ucuaaucaagaaa

SEQ ID NO: 2042778 - RNA, 13 nt, Human herpesvirus 6B
ugcagauucuguu

SEQ ID NO: 2042779 - RNA, 22 nt, Human herpesvirus 6B
uuuugugcuuaucaaauuacaa

SEQ ID NO: 2042780 - RNA, 12 nt, Human herpesvirus 6B
ugaaaaacagaa

SEQ ID NO: 2042781 - RNA, 18 nt, Human herpesvirus 6B
uucguaaauccgaaacac

SEQ ID NO: 2042782 - RNA, 20 nt, Human herpesvirus 6B
gaugcaagucgcgaagugcu

SEQ ID NO: 2042783 - RNA, 15 nt, Human herpesvirus 6B
cccuccauguugcaa

SEQ ID NO: 2042784 - RNA, 23 nt, Human herpesvirus 6B
gcugugcuuuguauguaucugaa

SEQ ID NO: 2042785 - RNA, 18 nt, Human herpesvirus 6B
augcgccacagggaggug

SEQ ID NO: 2042786 - RNA, 21 nt, Human herpesvirus 6B
agucaccgcauaucaccccca

SEQ ID NO: 2042787 - RNA, 19 nt, Human herpesvirus 6B
acucagauuucaggaaguu

SEQ ID NO: 2042788 - RNA, 20 nt, Human herpesvirus 6B
uuccugaugguuaaggaaaa

SEQ ID NO: 2042789 - RNA, 15 nt, Human herpesvirus 6B
gcagcggggaaggga

SEQ ID NO: 2042790 - RNA, 13 nt, Human herpesvirus 6B
uaacgcgguauau

SEQ ID NO: 2042791 - RNA, 16 nt, Human herpesvirus 6B
gucuccgauccgucag

SEQ ID NO: 2042792 - RNA, 18 nt, Human herpesvirus 6B
cacauaugccgaggcuua

SEQ ID NO: 2042793 - RNA, 18 nt, Human herpesvirus 6B
aucucgaugccaaagcuu

SEQ ID NO: 2042794 - RNA, 16 nt, Human herpesvirus 6B
gagugcgacaggagau

SEQ ID NO: 2042795 - RNA, 18 nt, Human herpesvirus 6B
ccgaucugugcgccuuua

SEQ ID NO: 2042796 - RNA, 20 nt, Human herpesvirus 6B
cugugauaaaucuaccugcc

SEQ ID NO: 2042797 - RNA, 20 nt, Human herpesvirus 6B
guuacccgucaugugcuauu

SEQ ID NO: 2042798 - RNA, 21 nt, Human herpesvirus 6B
cugccuuuaacccgaugagaa

SEQ ID NO: 2042799 - RNA, 13 nt, Human herpesvirus 6B
aauguuucuguau

SEQ ID NO: 2042800 - RNA, 15 nt, Human herpesvirus 6B
gcccucgucuguugc

SEQ ID NO: 2042801 - RNA, 17 nt, Human herpesvirus 6B
uccccucauacauccag

SEQ ID NO: 2042802 - RNA, 17 nt, Human herpesvirus 6B
ccgcgaugcgccacagg

SEQ ID NO: 2042803 - RNA, 17 nt, Human herpesvirus 6B
auggaaaacugcagauu

SEQ ID NO: 2042804 - RNA, 17 nt, Human herpesvirus 6B
acuaaugcgauuucacc

SEQ ID NO: 2042805 - RNA, 17 nt, Human herpesvirus 6B
guauucuucuuccccaa

SEQ ID NO: 2042806 - RNA, 13 nt, Human herpesvirus 6B
acuuuucugauga

SEQ ID NO: 2042807 - RNA, 12 nt, Human herpesvirus 6B
auuuaugugaau

SEQ ID NO: 2042808 - RNA, 17 nt, Human herpesvirus 6B
gaaccgaaauuuccggu

SEQ ID NO: 2042809 - RNA, 13 nt, Human herpesvirus 6B
gcagggaaagagc

SEQ ID NO: 2042810 - RNA, 18 nt, Human herpesvirus 6B
cgaccugaucacagagaa

SEQ ID NO: 2042811 - RNA, 22 nt, Human herpesvirus 6B
guugccuuuguaaaauguuucc

SEQ ID NO: 2042812 - RNA, 15 nt, Human herpesvirus 6B
ugacaauaaacauga

SEQ ID NO: 2042813 - RNA, 19 nt, Human herpesvirus 6B
gccgaagaaagaggcgccg

SEQ ID NO: 2042814 - RNA, 18 nt, Human herpesvirus 6B
gggaauuucauguuuacu

SEQ ID NO: 2042815 - RNA, 12 nt, Human herpesvirus 6B
agguuguccuug

SEQ ID NO: 2042816 - RNA, 15 nt, Human herpesvirus 6B
aguuucagaugauca

SEQ ID NO: 2042817 - RNA, 15 nt, Human herpesvirus 6B
uccgcaaguuuucag

SEQ ID NO: 2042818 - RNA, 16 nt, Human herpesvirus 6B
gcuccccaggcgcagc

SEQ ID NO: 2042819 - RNA, 14 nt, Human herpesvirus 6B
cuggggacagacag

SEQ ID NO: 2042820 - RNA, 18 nt, Human herpesvirus 6B
uguagauccuguuauucu

SEQ ID NO: 2042821 - RNA, 20 nt, Human herpesvirus 6B
cucugcaauuugguucagcu

SEQ ID NO: 2042822 - RNA, 15 nt, Human herpesvirus 6B
cgguuugugugggua

SEQ ID NO: 2042823 - RNA, 17 nt, Human herpesvirus 6B
cguacacggccacccgc

SEQ ID NO: 2042824 - RNA, 17 nt, Human herpesvirus 6B
ugcacgaauaaggagag

SEQ ID NO: 2042825 - RNA, 18 nt, Human herpesvirus 6B
augugcggagaaagggac

SEQ ID NO: 2042826 - RNA, 22 nt, Human herpesvirus 6B
auuuugaggaucacuaacuuca

SEQ ID NO: 2042827 - RNA, 15 nt, Human herpesvirus 6B
ucaaaaaaaaaugac

SEQ ID NO: 2042828 - RNA, 16 nt, Human herpesvirus 6B
uuagaaccgaaauuuc

SEQ ID NO: 2042829 - RNA, 22 nt, Human herpesvirus 6B
ucuuuaugucugucagaaauau

SEQ ID NO: 2042830 - RNA, 17 nt, Human herpesvirus 6B
uuuuucuccugaucuca

SEQ ID NO: 2042831 - RNA, 11 nt, Human herpesvirus 6B
uaagggacagc

SEQ ID NO: 2042832 - RNA, 17 nt, Human herpesvirus 6B
aucgcgaagccuguccg

SEQ ID NO: 2042833 - RNA, 20 nt, Human herpesvirus 6B
ggcccgugggggcagaacug

SEQ ID NO: 2042834 - RNA, 19 nt, Human herpesvirus 6B
uguaagguuucuaaaucug

SEQ ID NO: 2042835 - RNA, 14 nt, Human herpesvirus 6B
aauguucuucugaa

SEQ ID NO: 2042836 - RNA, 15 nt, Human herpesvirus 6B
agaucuuucuagaca

SEQ ID NO: 2042837 - RNA, 18 nt, Human herpesvirus 6B
uggaucuauguuuuucca

SEQ ID NO: 2042838 - RNA, 21 nt, Human herpesvirus 6B
ucugcgcgauauuuuuauggc

SEQ ID NO: 2042839 - RNA, 21 nt, Human herpesvirus 6B
agcgcaucaacuacuucuguu

SEQ ID NO: 2042840 - RNA, 18 nt, Human herpesvirus 6B
auugacggcgugcauaua

SEQ ID NO: 2042841 - RNA, 22 nt, Human herpesvirus 6B
aaaugacaaugugaaguucgau

SEQ ID NO: 2042842 - RNA, 17 nt, Human herpesvirus 6B
cugcgcagacggaaaga

SEQ ID NO: 2042843 - RNA, 20 nt, Human herpesvirus 6B
aaaacuauacuaugauagaa

SEQ ID NO: 2042844 - RNA, 15 nt, Human herpesvirus 6B
ggaacggugaagcgg

SEQ ID NO: 2042845 - RNA, 17 nt, Human herpesvirus 6B
ucucuacaugccacaga

SEQ ID NO: 2042846 - RNA, 15 nt, Human herpesvirus 6B
uauguauauaguuuu

SEQ ID NO: 2042847 - RNA, 22 nt, Human herpesvirus 6B
gccacauuagcugcuaaaugug

SEQ ID NO: 2042848 - RNA, 13 nt, Human herpesvirus 6B
ggcgggcacggag

SEQ ID NO: 2042849 - RNA, 15 nt, Human herpesvirus 6B
cauaagggacagcag

SEQ ID NO: 2042850 - RNA, 21 nt, Human herpesvirus 6B
agggaagccagccgcccuccc

SEQ ID NO: 2042851 - RNA, 23 nt, Human herpesvirus 6B
uaauucggugaugacucaagaau

SEQ ID NO: 2042852 - RNA, 17 nt, Human herpesvirus 6B
gaaaccccacaaagccu

SEQ ID NO: 2042853 - RNA, 20 nt, Human herpesvirus 6B
uaaaucggguaaauauguga

SEQ ID NO: 2042854 - RNA, 15 nt, Human herpesvirus 6B
gcacacgacaaauaa

SEQ ID NO: 2042855 - RNA, 22 nt, Human herpesvirus 6B
gggaagaucuaugagaauuaug

SEQ ID NO: 2042856 - RNA, 18 nt, Human herpesvirus 6B
ugauauacgauggacaga

SEQ ID NO: 2042857 - RNA, 22 nt, Human herpesvirus 6B
augaauuugcgucagaguuuga

SEQ ID NO: 2042858 - RNA, 21 nt, Human herpesvirus 6B
augugaacaguauaaauucuu

SEQ ID NO: 2042859 - RNA, 22 nt, Human herpesvirus 6B
uaaaaaaaaauacuauguggaa

SEQ ID NO: 2042860 - RNA, 17 nt, Human herpesvirus 6B
cucgccgucgucgcucu

SEQ ID NO: 2042861 - RNA, 18 nt, Human herpesvirus 6B
aacaaguuauuuaaaauc

SEQ ID NO: 2042862 - RNA, 16 nt, Human herpesvirus 6B
cgccgguuuccaugag

SEQ ID NO: 2042863 - RNA, 16 nt, Human herpesvirus 6B
gaaacgcaaagggaag

SEQ ID NO: 2042864 - RNA, 11 nt, Human herpesvirus 6B
aggagggaccc

SEQ ID NO: 2042865 - RNA, 13 nt, Human herpesvirus 6B
uuaacugucaugu

SEQ ID NO: 2042866 - RNA, 16 nt, Human herpesvirus 6B
aagagacgagaaguga

SEQ ID NO: 2042867 - RNA, 15 nt, Human herpesvirus 6B
ucuacaugccacaga

SEQ ID NO: 2042868 - RNA, 12 nt, Human herpesvirus 6B
uagagaacagau

SEQ ID NO: 2042869 - RNA, 16 nt, Human herpesvirus 6B
agaaagcguguucaaa

SEQ ID NO: 2042870 - RNA, 20 nt, Human herpesvirus 6B
acacucuauuauaaaaaugc

SEQ ID NO: 2042871 - RNA, 18 nt, Human herpesvirus 6B
cgcguuuuuggugaaaaa

SEQ ID NO: 2042872 - RNA, 17 nt, Human herpesvirus 6B
uuaauaaaggauguuug

SEQ ID NO: 2042873 - RNA, 16 nt, Human herpesvirus 6B
acaaagugcuguaaac

SEQ ID NO: 2042874 - RNA, 14 nt, Human herpesvirus 6B
aucuaugaugcugu

SEQ ID NO: 2042875 - RNA, 22 nt, Human herpesvirus 6B
ugcugcuggguguauguuucua

SEQ ID NO: 2042876 - RNA, 22 nt, Human herpesvirus 6B
agauugauuccagguggugguu

SEQ ID NO: 2042877 - RNA, 18 nt, Human herpesvirus 6B
caggacggggccucccuc

SEQ ID NO: 2042878 - RNA, 16 nt, Human herpesvirus 6B
aaaacgguaaagauga

SEQ ID NO: 2042879 - RNA, 15 nt, Human herpesvirus 6B
gccggagcccugaga

SEQ ID NO: 2042880 - RNA, 16 nt, Human herpesvirus 6B
aauuuggcagaaucuu

SEQ ID NO: 2042881 - RNA, 20 nt, Human herpesvirus 6B
cugagagcaggagcaggcuc

SEQ ID NO: 2042882 - RNA, 19 nt, Human herpesvirus 6B
auguucuucugaaaugguu

SEQ ID NO: 2042883 - RNA, 19 nt, Human herpesvirus 6B
aggcgaagauacuuucaau

SEQ ID NO: 2042884 - RNA, 16 nt, Human herpesvirus 6B
agcauucguuuagaga

SEQ ID NO: 2042885 - RNA, 16 nt, Human herpesvirus 6B
uucucagcauuguuga

SEQ ID NO: 2042886 - RNA, 11 nt, Human herpesvirus 6B
caaacagagau

SEQ ID NO: 2042887 - RNA, 13 nt, Human herpesvirus 6B
cuauguauuggaa

SEQ ID NO: 2042888 - RNA, 11 nt, Human herpesvirus 6B
ccgaacccggc

SEQ ID NO: 2042889 - RNA, 20 nt, Human herpesvirus 6B
uguauaagagucugcaucaa

SEQ ID NO: 2042890 - RNA, 20 nt, Human herpesvirus 6B
gaauuaugacugacaaggua

SEQ ID NO: 2042891 - RNA, 22 nt, Human herpesvirus 6B
uugcagaacgagacuggacagu

SEQ ID NO: 2042892 - RNA, 19 nt, Human herpesvirus 6B
gcgauugcugcuucuguaa

SEQ ID NO: 2042893 - RNA, 18 nt, Human herpesvirus 6B
acuccgagccggacagga

SEQ ID NO: 2042894 - RNA, 16 nt, Human herpesvirus 6B
cacccgaugaggaaaa

SEQ ID NO: 2042895 - RNA, 13 nt, Human herpesvirus 6B
aaaaaccuauuca

SEQ ID NO: 2042896 - RNA, 23 nt, Human herpesvirus 6B
acagaaaaaacaccagaagagcc

SEQ ID NO: 2042897 - RNA, 17 nt, Human herpesvirus 6B
uugacaaucuuggaaaa

SEQ ID NO: 2042898 - RNA, 17 nt, Human herpesvirus 6B
gaaauucuccuguaguu

SEQ ID NO: 2042899 - RNA, 19 nt, Human herpesvirus 6B
gugguuaaccguuaguaaa

SEQ ID NO: 2042900 - RNA, 17 nt, Human herpesvirus 6B
gaagugcuucugcucuc

SEQ ID NO: 2042901 - RNA, 13 nt, Human herpesvirus 6B
aauauuuugaaaa

SEQ ID NO: 2042902 - RNA, 12 nt, Human herpesvirus 6B
aaacuuaacaua

SEQ ID NO: 2042903 - RNA, 17 nt, Human herpesvirus 6B
gaggugauuugaacaga

SEQ ID NO: 2042904 - RNA, 23 nt, Human herpesvirus 6B
cauuuauuucguauguuuaacua

SEQ ID NO: 2042905 - RNA, 13 nt, Human herpesvirus 6B
cuguauuaauuuu

SEQ ID NO: 2042906 - RNA, 23 nt, Human herpesvirus 6B
aauguguucauagagcauccugu

SEQ ID NO: 2042907 - RNA, 20 nt, Human herpesvirus 6B
aggccaggcgauacaacauc

SEQ ID NO: 2042908 - RNA, 19 nt, Human herpesvirus 6B
caauucauuguacgauaau

SEQ ID NO: 2042909 - RNA, 12 nt, Human herpesvirus 6B
auaaacuauugu

SEQ ID NO: 2042910 - RNA, 19 nt, Human herpesvirus 6B
accagcucuguucucuccc

SEQ ID NO: 2042911 - RNA, 12 nt, Human herpesvirus 6B
ggcucggcaggg

SEQ ID NO: 2042912 - RNA, 15 nt, Human herpesvirus 6B
cugaugguuaaggaa

SEQ ID NO: 2042913 - RNA, 15 nt, Human herpesvirus 6B
agggucgaacccuga

SEQ ID NO: 2042914 - RNA, 14 nt, Human herpesvirus 6B
ugucaggaauguaa

SEQ ID NO: 2042915 - RNA, 18 nt, Human herpesvirus 6B
aaucucgaugccaaagcu

SEQ ID NO: 2042916 - RNA, 22 nt, Human herpesvirus 6B
guggcgcgcguuuuuggugaaa

SEQ ID NO: 2042917 - RNA, 23 nt, Human herpesvirus 6B
auacggcggcggaagugaaagca

SEQ ID NO: 2042918 - RNA, 19 nt, Human herpesvirus 6B
ccacaucuuuuccugcucu

SEQ ID NO: 2042919 - RNA, 22 nt, Human herpesvirus 6B
gauguauaauuuacacaauccu

SEQ ID NO: 2042920 - RNA, 14 nt, Human herpesvirus 6B
gaaaagugcuuuau

SEQ ID NO: 2042921 - RNA, 15 nt, Human herpesvirus 6B
aggugauuugaacag

SEQ ID NO: 2042922 - RNA, 23 nt, Human herpesvirus 6B
uauacucugcaacuuuauuugaa

SEQ ID NO: 2042923 - RNA, 14 nt, Human herpesvirus 6B
uggauauguaucca

SEQ ID NO: 2042924 - RNA, 16 nt, Human herpesvirus 6B
aggaauguaaugaauu

SEQ ID NO: 2042925 - RNA, 22 nt, Human herpesvirus 6B
auauaaaaccaaaaaaaaagug

SEQ ID NO: 2042926 - RNA, 15 nt, Human herpesvirus 6B
acucuuggauugcag

SEQ ID NO: 2042927 - RNA, 14 nt, Human herpesvirus 6B
gucucuuuaaacag

SEQ ID NO: 2042928 - RNA, 23 nt, Human herpesvirus 6B
agaauuuccagggugaagacaga

SEQ ID NO: 2042929 - RNA, 19 nt, Human herpesvirus 6B
ugucgguaaauauugucug

SEQ ID NO: 2042930 - RNA, 16 nt, Human herpesvirus 6B
acugcugcgaucuuug

SEQ ID NO: 2042931 - RNA, 15 nt, Human herpesvirus 6B
gcccgggcgcggggc

SEQ ID NO: 2042932 - RNA, 20 nt, Human herpesvirus 6B
caacgguguggagacaccuc

SEQ ID NO: 2042933 - RNA, 16 nt, Human herpesvirus 6B
uucccuccauguugca

SEQ ID NO: 2042934 - RNA, 20 nt, Human herpesvirus 6B
gaauccagauaaacaaaaau

SEQ ID NO: 2042935 - RNA, 17 nt, Human herpesvirus 6B
caagcucgaguucgaga

SEQ ID NO: 2042936 - RNA, 23 nt, Human herpesvirus 6B
acugcuugguggcggauggcuag

SEQ ID NO: 2042937 - RNA, 22 nt, Human herpesvirus 6B
agcucaagaggguuuuuuacaa

SEQ ID NO: 2042938 - RNA, 20 nt, Human herpesvirus 6B
acggcucucuucaggagaag

SEQ ID NO: 2042939 - RNA, 17 nt, Human herpesvirus 6B
auguauauaguuuucug

SEQ ID NO: 2042940 - RNA, 22 nt, Human herpesvirus 6B
auuuugauggucgauuguaauu

SEQ ID NO: 2042941 - RNA, 15 nt, Human herpesvirus 6B
ugcacgaauaaggag

SEQ ID NO: 2042942 - RNA, 15 nt, Human herpesvirus 6B
gcccugagagcagga

SEQ ID NO: 2042943 - RNA, 15 nt, Human herpesvirus 6B
agagcaggagcaggc

SEQ ID NO: 2042944 - RNA, 18 nt, Human herpesvirus 6B
uauaccgugacagcaacu

SEQ ID NO: 2042945 - RNA, 20 nt, Human herpesvirus 6B
gugcacgcacgucacgggca

SEQ ID NO: 2042946 - RNA, 13 nt, Human herpesvirus 6B
aaggcaacggcac

SEQ ID NO: 2042947 - RNA, 14 nt, Human herpesvirus 6B
auuugcaguuugug

SEQ ID NO: 2042948 - RNA, 15 nt, Human herpesvirus 6B
acgcaaagggaagcc

SEQ ID NO: 2042949 - RNA, 15 nt, Human herpesvirus 6B
cuucucgucucuucu

SEQ ID NO: 2042950 - RNA, 23 nt, Human herpesvirus 6B
aauuacucccauagaucuucccc

SEQ ID NO: 2042951 - RNA, 12 nt, Human herpesvirus 6B
aaugauuaguua

SEQ ID NO: 2042952 - RNA, 14 nt, Human herpesvirus 6B
cucuguucucuccc

SEQ ID NO: 2042953 - RNA, 14 nt, Human herpesvirus 6B
uugcaguuugugaa

SEQ ID NO: 2042954 - RNA, 18 nt, Human herpesvirus 6B
ugauuugaacagagauuu

SEQ ID NO: 2042955 - RNA, 19 nt, Human herpesvirus 6B
acuacauccuuuagaauac

SEQ ID NO: 2042956 - RNA, 17 nt, Human herpesvirus 6B
agcugacaucugcaaaa

SEQ ID NO: 2042957 - RNA, 13 nt, Human herpesvirus 6B
uucuuaaauucaa

SEQ ID NO: 2042958 - RNA, 16 nt, Human herpesvirus 6B
gcggacacgacaugug

SEQ ID NO: 2042959 - RNA, 18 nt, Human herpesvirus 6B
cgcgguggacggcgaggg

SEQ ID NO: 2042960 - RNA, 19 nt, Human herpesvirus 6B
uaaagauguguuaaagaau

SEQ ID NO: 2042961 - RNA, 21 nt, Human herpesvirus 6B
uguuaugcaguuguacucaaa

SEQ ID NO: 2042962 - RNA, 18 nt, Human herpesvirus 6B
auuuauuagcauucaagu

SEQ ID NO: 2042963 - RNA, 23 nt, Human herpesvirus 6B
uaauuuuuuguuucugaaaauaa

SEQ ID NO: 2042964 - RNA, 20 nt, Human herpesvirus 6B
aauguuuccaugacugugag

SEQ ID NO: 2042965 - RNA, 16 nt, Human herpesvirus 6B
aguugcggaagggcuc

SEQ ID NO: 2042966 - RNA, 14 nt, Human herpesvirus 6B
acggcgccucccau

SEQ ID NO: 2042967 - RNA, 13 nt, Human herpesvirus 6B
cuguuguuguagu

SEQ ID NO: 2042968 - RNA, 13 nt, Human herpesvirus 6B
cgccgugucuuuc

SEQ ID NO: 2042969 - RNA, 16 nt, Human herpesvirus 6B
uauaccaaacgugaaa

SEQ ID NO: 2042970 - RNA, 21 nt, Human herpesvirus 6B
ccgcacaguucguccagcagc

SEQ ID NO: 2042971 - RNA, 20 nt, Human herpesvirus 6B
agaucuucuucagaaagauu

SEQ ID NO: 2042972 - RNA, 20 nt, Human herpesvirus 6B
ugagaagauuugugugaacg

SEQ ID NO: 2042973 - RNA, 18 nt, Human herpesvirus 6B
uguaggacugaaggagau

SEQ ID NO: 2042974 - RNA, 19 nt, Human herpesvirus 6B
ccucccauagaggcgcgcg

SEQ ID NO: 2042975 - RNA, 23 nt, Human herpesvirus 6B
caagaaaagaaaaaacagagccg

SEQ ID NO: 2042976 - RNA, 14 nt, Human herpesvirus 6B
uaguuuuggaugaa

SEQ ID NO: 2042977 - RNA, 17 nt, Human herpesvirus 6B
uaauggagagaaauucu

SEQ ID NO: 2042978 - RNA, 14 nt, Human herpesvirus 6B
gaugcgaagggagu

SEQ ID NO: 2042979 - RNA, 16 nt, Human herpesvirus 6B
auaauuuuauugacug

SEQ ID NO: 2042980 - RNA, 18 nt, Human herpesvirus 6B
ucuaaucaagaaaccugu

SEQ ID NO: 2042981 - RNA, 16 nt, Human herpesvirus 6B
ucuccaucucuagaau

SEQ ID NO: 2042982 - RNA, 23 nt, Human herpesvirus 6B
cucgggggacggagaggaagccg

SEQ ID NO: 2042983 - RNA, 14 nt, Human herpesvirus 6B
ucgucgcucucccu

SEQ ID NO: 2042984 - RNA, 18 nt, Human herpesvirus 6B
ucgauucuguaauuuuga

SEQ ID NO: 2042985 - RNA, 15 nt, Human herpesvirus 6B
gaauucagcuggaca

SEQ ID NO: 2042986 - RNA, 12 nt, Human herpesvirus 6B
agacguuugcuu

SEQ ID NO: 2042987 - RNA, 14 nt, Human herpesvirus 6B
acaaaucugaaugu

SEQ ID NO: 2042988 - RNA, 17 nt, Human herpesvirus 6B
ggauguaaaugcagaca

SEQ ID NO: 2042989 - RNA, 18 nt, Human herpesvirus 6B
aaguggaaguguaaaugu

SEQ ID NO: 2042990 - RNA, 15 nt, Human herpesvirus 6B
cauacgaggaugaag

SEQ ID NO: 2042991 - RNA, 17 nt, Human herpesvirus 6B
gucuaugacuuuucuga

SEQ ID NO: 2042992 - RNA, 15 nt, Human herpesvirus 6B
acgcuugcuguaaag

SEQ ID NO: 2042993 - RNA, 16 nt, Human herpesvirus 6B
agaaucugcagauuuu

SEQ ID NO: 2042994 - RNA, 20 nt, Human herpesvirus 6B
acgcuugcuguaaaguauug

SEQ ID NO: 2042995 - RNA, 19 nt, Human herpesvirus 6B
ggccgaguuggccaagcug

SEQ ID NO: 2042996 - RNA, 17 nt, Human herpesvirus 6B
cucuauuguuuaaaagg

SEQ ID NO: 2042997 - RNA, 15 nt, Human herpesvirus 6B
cgucgcucucccucu

SEQ ID NO: 2042998 - RNA, 12 nt, Human herpesvirus 6B
uguauguuucua

SEQ ID NO: 2042999 - RNA, 22 nt, Human herpesvirus 6B
gagcggagaggcgcgggacagc

SEQ ID NO: 2043000 - RNA, 16 nt, Human herpesvirus 6B
cuaauuauaaauguag

SEQ ID NO: 2043001 - RNA, 21 nt, Human herpesvirus 6B
acaagcaggagaaaaauuuga

SEQ ID NO: 2043002 - RNA, 22 nt, Human herpesvirus 6B
auuaauuuuuuguuucugaaaa

SEQ ID NO: 2043003 - RNA, 13 nt, Human herpesvirus 6B
ucccgcagcuccu

SEQ ID NO: 2043004 - RNA, 21 nt, Human herpesvirus 6B
cagaucaucgccauagugaaa

SEQ ID NO: 2043005 - RNA, 13 nt, Human herpesvirus 6B
uugaauucugcuc

SEQ ID NO: 2043006 - RNA, 11 nt, Human herpesvirus 6B
uagauaugucg

SEQ ID NO: 2043007 - RNA, 23 nt, Human herpesvirus 6B
agauaugucguuucaugggagaa

SEQ ID NO: 2043008 - RNA, 19 nt, Human herpesvirus 6B
cgcagggaacggugaagcg

SEQ ID NO: 2043009 - RNA, 13 nt, Human herpesvirus 6B
cuguguauuguga

SEQ ID NO: 2043010 - RNA, 22 nt, Human herpesvirus 6B
augaaaucgauguagauguuuu

SEQ ID NO: 2043011 - RNA, 17 nt, Human herpesvirus 6B
aaauuucaaaaagaaug

SEQ ID NO: 2043012 - RNA, 14 nt, Human herpesvirus 6B
acauagaaaaauaa

SEQ ID NO: 2043013 - RNA, 13 nt, Human herpesvirus 6B
uuuugaaaucacu

SEQ ID NO: 2043014 - RNA, 15 nt, Human herpesvirus 6B
uguaguuaguuuuga

SEQ ID NO: 2043015 - RNA, 16 nt, Human herpesvirus 6B
accaaauuuuuaacuc

SEQ ID NO: 2043016 - RNA, 16 nt, Human herpesvirus 6B
aacgugacuguaucaa

SEQ ID NO: 2043017 - RNA, 15 nt, Human herpesvirus 6B
ucaucucccaugguu

SEQ ID NO: 2043018 - RNA, 13 nt, Human herpesvirus 6B
cuuugaaggacua

SEQ ID NO: 2043019 - RNA, 19 nt, Human herpesvirus 6B
acaagaaaacgagagaguu

SEQ ID NO: 2043020 - RNA, 20 nt, Human herpesvirus 6B
auaaaauuuugcgucgucug

SEQ ID NO: 2043021 - RNA, 22 nt, Human herpesvirus 6B
aaguccgauauugaagaacugg

SEQ ID NO: 2043022 - RNA, 15 nt, Human herpesvirus 6B
ugcugugcuuuguau

SEQ ID NO: 2043023 - RNA, 16 nt, Human herpesvirus 6B
cugaugacuuuucuga

SEQ ID NO: 2043024 - RNA, 19 nt, Human herpesvirus 6B
ugaaaucucuuuuaacaca

SEQ ID NO: 2043025 - RNA, 23 nt, Human herpesvirus 6B
ugauacuacguguaauguuuccu

SEQ ID NO: 2043026 - RNA, 12 nt, Human herpesvirus 6B
agaaucuccaaa

SEQ ID NO: 2043027 - RNA, 11 nt, Human herpesvirus 6B
gucuuuccuga

SEQ ID NO: 2043028 - RNA, 15 nt, Human herpesvirus 6B
ucuucauccucgaag

SEQ ID NO: 2043029 - RNA, 15 nt, Human herpesvirus 6B
uugauagcauuauua

SEQ ID NO: 2043030 - RNA, 13 nt, Human herpesvirus 6B
auaacuaugaauu

SEQ ID NO: 2043031 - RNA, 15 nt, Human herpesvirus 6B
guucggacucucguc

SEQ ID NO: 2043032 - RNA, 19 nt, Human herpesvirus 6B
uuuuggaaaauguaaacac

SEQ ID NO: 2043033 - RNA, 22 nt, Human herpesvirus 6B
gcagacauucuuguucgggcca

SEQ ID NO: 2043034 - RNA, 20 nt, Human herpesvirus 6B
cccggcuuucucgccgccuc

SEQ ID NO: 2043035 - RNA, 19 nt, Human herpesvirus 6B
gccugcagcgauauggaaa

SEQ ID NO: 2043036 - RNA, 13 nt, Human herpesvirus 6B
auguuauguaaag

SEQ ID NO: 2043037 - RNA, 20 nt, Human herpesvirus 6B
cggaucugccgcguggaagc

SEQ ID NO: 2043038 - RNA, 13 nt, Human herpesvirus 6B
cuuacgaucuuua

SEQ ID NO: 2043039 - RNA, 16 nt, Human herpesvirus 6B
gcaaaugaauguguuc

SEQ ID NO: 2043040 - RNA, 22 nt, Human herpesvirus 6B
agauaaucgucgaaaacaauuu

SEQ ID NO: 2043041 - RNA, 16 nt, Human herpesvirus 6B
gcauuucuaucuacaa

SEQ ID NO: 2043042 - RNA, 18 nt, Human herpesvirus 6B
uuguuaguguuaauucca

SEQ ID NO: 2043043 - RNA, 13 nt, Human herpesvirus 6B
ccucacccugaag

SEQ ID NO: 2043044 - RNA, 16 nt, Human herpesvirus 6B
gagccacuugagugag

SEQ ID NO: 2043045 - RNA, 19 nt, Human herpesvirus 6B
ccggggagugggaggagcc

SEQ ID NO: 2043046 - RNA, 12 nt, Human herpesvirus 6B
gaauaagaguuu

SEQ ID NO: 2043047 - RNA, 22 nt, Human herpesvirus 6B
gaacgauaugcugccauuauug

SEQ ID NO: 2043048 - RNA, 15 nt, Human herpesvirus 6B
uguucuuugaugaag

SEQ ID NO: 2043049 - RNA, 13 nt, Human herpesvirus 6B
cggcgcgcgccgu

SEQ ID NO: 2043050 - RNA, 13 nt, Human herpesvirus 6B
augucguuucaug

SEQ ID NO: 2043051 - RNA, 13 nt, Human herpesvirus 6B
ugcugucggccga

SEQ ID NO: 2043052 - RNA, 22 nt, Human herpesvirus 6B
ugaaugcuuaccgccuccgcag

SEQ ID NO: 2043053 - RNA, 21 nt, Human herpesvirus 6B
guagauacgaccccuuaugca

SEQ ID NO: 2043054 - RNA, 20 nt, Human herpesvirus 6B
uaucucaacguauugggaag

SEQ ID NO: 2043055 - RNA, 15 nt, Human herpesvirus 6B
gguuguuuuucuaaa

SEQ ID NO: 2043056 - RNA, 16 nt, Human herpesvirus 6B
aaaaaauagcagcaau

SEQ ID NO: 2043057 - RNA, 22 nt, Human herpesvirus 6B
ggaucagacagacgugcggaga

SEQ ID NO: 2043058 - RNA, 16 nt, Human herpesvirus 6B
guguuguguuugaaac

SEQ ID NO: 2043059 - RNA, 14 nt, Human herpesvirus 6B
gucuguugcuguag

SEQ ID NO: 2043060 - RNA, 21 nt, Human herpesvirus 6B
gggccuggggacagacagggg

SEQ ID NO: 2043061 - RNA, 20 nt, Human herpesvirus 6B
auucagaaaauuggugugca

SEQ ID NO: 2043062 - RNA, 13 nt, Human herpesvirus 6B
cacucauuugcaa

SEQ ID NO: 2043063 - RNA, 17 nt, Human herpesvirus 6B
uacucuggcugaaggaa

SEQ ID NO: 2043064 - RNA, 19 nt, Human herpesvirus 6B
uuuucacggaacaucaaaa

SEQ ID NO: 2043065 - RNA, 17 nt, Human herpesvirus 6B
gcagucuccacagggca

SEQ ID NO: 2043066 - RNA, 18 nt, Human herpesvirus 6B
uccccaggcgcagcagca

SEQ ID NO: 2043067 - RNA, 14 nt, Human herpesvirus 6B
cagagcggagaggc

SEQ ID NO: 2043068 - RNA, 19 nt, Human herpesvirus 6B
gacuuagcuagacgugucu

SEQ ID NO: 2043069 - RNA, 23 nt, Human herpesvirus 6B
augaggauggauuccugaugguu

SEQ ID NO: 2043070 - RNA, 18 nt, Human herpesvirus 6B
uaaaaauuauucuggcga

SEQ ID NO: 2043071 - RNA, 14 nt, Human herpesvirus 6B
gcgcgacggagaug

SEQ ID NO: 2043072 - RNA, 21 nt, Human herpesvirus 6B
ggacacgagaagaacaugcag

SEQ ID NO: 2043073 - RNA, 15 nt, Human herpesvirus 6B
cgccaggacggggcc

SEQ ID NO: 2043074 - RNA, 15 nt, Human herpesvirus 6B
cuaauuauaaaugua

SEQ ID NO: 2043075 - RNA, 22 nt, Human herpesvirus 6B
uauuaauuuuuuguuucugaaa

SEQ ID NO: 2043076 - RNA, 15 nt, Human herpesvirus 6B
gaagaagacgaagaa

SEQ ID NO: 2043077 - RNA, 21 nt, Human herpesvirus 6B
ccucgguccccccucccucca

SEQ ID NO: 2043078 - RNA, 13 nt, Human herpesvirus 6B
caaaaagaaaaca

SEQ ID NO: 2043079 - RNA, 19 nt, Human herpesvirus 6B
uuaacauacaacuuucacu

SEQ ID NO: 2043080 - RNA, 20 nt, Human herpesvirus 6B
auugcagagguaaugugaac

SEQ ID NO: 2043081 - RNA, 18 nt, Human herpesvirus 6B
acaucucauaauuugccu

SEQ ID NO: 2043082 - RNA, 23 nt, Human herpesvirus 6B
ccgcaguuucuguuuuucucaua

SEQ ID NO: 2043083 - RNA, 20 nt, Human herpesvirus 6B
ugugaggugauuugaacaga

SEQ ID NO: 2043084 - RNA, 16 nt, Human herpesvirus 6B
uaaaaguggagguaau

SEQ ID NO: 2043085 - RNA, 13 nt, Human herpesvirus 6B
agacgagauguuu

SEQ ID NO: 2043086 - RNA, 20 nt, Human herpesvirus 6B
cugcgguugaaaucuuuccu

SEQ ID NO: 2043087 - RNA, 19 nt, Human herpesvirus 6B
ccaaccaaaugccucgugg

SEQ ID NO: 2043088 - RNA, 14 nt, Human herpesvirus 6B
uuugcgucgucugu

SEQ ID NO: 2043089 - RNA, 16 nt, Human herpesvirus 6B
aucacuacgaaagaac

SEQ ID NO: 2043090 - RNA, 15 nt, Human herpesvirus 6B
uguguauuugugaac

SEQ ID NO: 2043091 - RNA, 11 nt, Human herpesvirus 6B
auauagacacc

SEQ ID NO: 2043092 - RNA, 20 nt, Human herpesvirus 6B
ggcgggcggacggcucgucu

SEQ ID NO: 2043093 - RNA, 16 nt, Human herpesvirus 6B
ggcagcggggaaggga

SEQ ID NO: 2043094 - RNA, 12 nt, Human herpesvirus 6B
uuaggacaauug

SEQ ID NO: 2043095 - RNA, 17 nt, Human herpesvirus 6B
gcguguuuuggaauuuc

SEQ ID NO: 2043096 - RNA, 19 nt, Human herpesvirus 6B
agcauaauccuuuucugug

SEQ ID NO: 2043097 - RNA, 12 nt, Human herpesvirus 6B
gcucaagaugaa

SEQ ID NO: 2043098 - RNA, 12 nt, Human herpesvirus 6B
augcuaaagcac

SEQ ID NO: 2043099 - RNA, 14 nt, Human herpesvirus 6B
aacucucacggcca

SEQ ID NO: 2043100 - RNA, 14 nt, Human herpesvirus 6B
agauggcaaaacaa

SEQ ID NO: 2043101 - RNA, 13 nt, Human herpesvirus 6B
uuccaguuguauu

SEQ ID NO: 2043102 - RNA, 18 nt, Human herpesvirus 6B
gugauuucacgugaaaua

SEQ ID NO: 2043103 - RNA, 18 nt, Human herpesvirus 6B
uguucgcuugugucaugu

SEQ ID NO: 2043104 - RNA, 19 nt, Human herpesvirus 6B
acaccguuguugaacgaga

SEQ ID NO: 2043105 - RNA, 14 nt, Human herpesvirus 6B
aauaaacaugauug

SEQ ID NO: 2043106 - RNA, 13 nt, Human herpesvirus 6B
uuggugugcauua

SEQ ID NO: 2043107 - RNA, 23 nt, Human herpesvirus 6B
acaguacaagaagggguuccuuc

SEQ ID NO: 2043108 - RNA, 23 nt, Human herpesvirus 6B
gguguccucguccguccccgccg

SEQ ID NO: 2043109 - RNA, 18 nt, Human herpesvirus 6B
cugcaauuugguucagcu

SEQ ID NO: 2043110 - RNA, 19 nt, Human herpesvirus 6B
auggcaaauuucaaaaaga

SEQ ID NO: 2043111 - RNA, 20 nt, Human herpesvirus 6B
gaaaaggugaucguggacag

SEQ ID NO: 2043112 - RNA, 13 nt, Human herpesvirus 6B
aaagaacagaauc

SEQ ID NO: 2043113 - RNA, 15 nt, Human herpesvirus 6B
uaucauuaaauuguu

SEQ ID NO: 2043114 - RNA, 23 nt, Human herpesvirus 6B
acuagugauuauggugccucagg

SEQ ID NO: 2043115 - RNA, 17 nt, Human herpesvirus 6B
acagggguaaauuugua

SEQ ID NO: 2043116 - RNA, 17 nt, Human herpesvirus 6B
aaaauuacuaaugugga

SEQ ID NO: 2043117 - RNA, 16 nt, Human herpesvirus 6B
caagucuagacaugau

SEQ ID NO: 2043118 - RNA, 18 nt, Human herpesvirus 6B
gaucagauuaucaaggcu

SEQ ID NO: 2043119 - RNA, 12 nt, Human herpesvirus 6B
gagaugaagagu

SEQ ID NO: 2043120 - RNA, 21 nt, Human herpesvirus 6B
uuaaaacucuaaaaccugcua

SEQ ID NO: 2043121 - RNA, 22 nt, Human herpesvirus 6B
agacaagggugugaaacuauga

SEQ ID NO: 2043122 - RNA, 19 nt, Human herpesvirus 6B
aagucaaaguccuggaaag

SEQ ID NO: 2043123 - RNA, 15 nt, Human herpesvirus 6B
uauugacugugaaaa

SEQ ID NO: 2043124 - RNA, 13 nt, Human herpesvirus 6B
aaaguucaguaag

SEQ ID NO: 2043125 - RNA, 18 nt, Human herpesvirus 6B
aauuuuauugacugugaa

SEQ ID NO: 2043126 - RNA, 14 nt, Human herpesvirus 6B
ucugagacagucaa

SEQ ID NO: 2043127 - RNA, 16 nt, Human herpesvirus 6B
caaucaucugguaaau

SEQ ID NO: 2043128 - RNA, 23 nt, Human herpesvirus 6B
cagaaucuaaaucgcgagacaga

SEQ ID NO: 2043129 - RNA, 13 nt, Human herpesvirus 6B
guauuggaugcuu

SEQ ID NO: 2043130 - RNA, 16 nt, Human herpesvirus 6B
aaugagauagaaguua

SEQ ID NO: 2043131 - RNA, 14 nt, Human herpesvirus 6B
agaguuugaauuac

SEQ ID NO: 2043132 - RNA, 20 nt, Human herpesvirus 6B
uugacugugaaaagugcuuu

SEQ ID NO: 2043133 - RNA, 22 nt, Human herpesvirus 6B
gagacugccgguaacgcugccg

SEQ ID NO: 2043134 - RNA, 20 nt, Human herpesvirus 6B
gagauccauaccgggacagc

SEQ ID NO: 2043135 - RNA, 14 nt, Human herpesvirus 6B
agaauuccaaggcu

SEQ ID NO: 2043136 - RNA, 18 nt, Human herpesvirus 6B
cguguuauuagacaccuc

SEQ ID NO: 2043137 - RNA, 16 nt, Human herpesvirus 6B
uaugucguuucauggg

SEQ ID NO: 2043138 - RNA, 22 nt, Human herpesvirus 6B
aauauggccugaccaacaugcc

SEQ ID NO: 2043139 - RNA, 15 nt, Human herpesvirus 6B
cgacauagaguguuu

SEQ ID NO: 2043140 - RNA, 16 nt, Human herpesvirus 6B
guuuaaagauguguua

SEQ ID NO: 2043141 - RNA, 23 nt, Human herpesvirus 6B
aauuuuauugacugugaaaagug

SEQ ID NO: 2043142 - RNA, 12 nt, Human herpesvirus 6B
gcuggucgccgu

SEQ ID NO: 2043143 - RNA, 19 nt, Human herpesvirus 6B
ggacagaaaaaacaccaga

SEQ ID NO: 2043144 - RNA, 19 nt, Human herpesvirus 6B
gcgacgacggggacuaccg

SEQ ID NO: 2043145 - RNA, 20 nt, Human herpesvirus 6B
caagcugggaaagaucgaga

SEQ ID NO: 2043146 - RNA, 16 nt, Human herpesvirus 6B
cguuuucgauuuagag

SEQ ID NO: 2043147 - RNA, 20 nt, Human herpesvirus 6B
cguuuuuggugaaaaacacg

SEQ ID NO: 2043148 - RNA, 17 nt, Human herpesvirus 6B
ugccguggcagaagaag

SEQ ID NO: 2043149 - RNA, 19 nt, Human herpesvirus 6B
aaacagauuuuacuucuac

SEQ ID NO: 2043150 - RNA, 21 nt, Human herpesvirus 6B
ugccuuuguaaaauguuucca

SEQ ID NO: 2043151 - RNA, 17 nt, Human herpesvirus 6B
auaccauuuuauacgaa

SEQ ID NO: 2043152 - RNA, 19 nt, Human herpesvirus 6B
acugcacagaaucgagauc

SEQ ID NO: 2043153 - RNA, 20 nt, Human herpesvirus 6B
ucgggccuggggacagacag

SEQ ID NO: 2043154 - RNA, 21 nt, Human herpesvirus 6B
uccgcgaugcgccacagggag

SEQ ID NO: 2043155 - RNA, 14 nt, Human herpesvirus 6B
ugccgucaccugca

SEQ ID NO: 2043156 - RNA, 21 nt, Human herpesvirus 6B
cgauauaaaaaaagagaaguu

SEQ ID NO: 2043157 - RNA, 18 nt, Human herpesvirus 6B
acugcgaauccgucuccg

SEQ ID NO: 2043158 - RNA, 13 nt, Human herpesvirus 6B
uagagauuuugga

SEQ ID NO: 2043159 - RNA, 15 nt, Human herpesvirus 6B
cguuccgaauccugu

SEQ ID NO: 2043160 - RNA, 17 nt, Human herpesvirus 6B
auucgaucgagaaucuu

SEQ ID NO: 2043161 - RNA, 23 nt, Human herpesvirus 6B
acuuaguugauaugaaugugaga

SEQ ID NO: 2043162 - RNA, 21 nt, Human herpesvirus 6B
ucuauucguucagaauguucc

SEQ ID NO: 2043163 - RNA, 20 nt, Human herpesvirus 6B
aucaagacuacucuggcuga

SEQ ID NO: 2043164 - RNA, 23 nt, Human herpesvirus 6B
ucucagcaaucaccaucaacaca

SEQ ID NO: 2043165 - RNA, 14 nt, Human herpesvirus 6B
cacugaaauuuaca

SEQ ID NO: 2043166 - RNA, 14 nt, Human herpesvirus 6B
aagacuuagcuaga

SEQ ID NO: 2043167 - RNA, 14 nt, Human herpesvirus 6B
cuaaaaucugcuaa

SEQ ID NO: 2043168 - RNA, 12 nt, Human herpesvirus 6B
cgcucauuuuga

SEQ ID NO: 2043169 - RNA, 20 nt, Human herpesvirus 6B
cguuugucuaugcaaugucu

SEQ ID NO: 2043170 - RNA, 19 nt, Human herpesvirus 6B
uccaaagucguugaauucu

SEQ ID NO: 2043171 - RNA, 14 nt, Human herpesvirus 6B
agaguuucauccug

SEQ ID NO: 2043172 - RNA, 15 nt, Human herpesvirus 6B
uuuucugcaaaacaa

SEQ ID NO: 2043173 - RNA, 20 nt, Human herpesvirus 6B
augaaagcacagaaaaagaa

SEQ ID NO: 2043174 - RNA, 17 nt, Human herpesvirus 6B
gaagaacagaggaagaa

SEQ ID NO: 2043175 - RNA, 16 nt, Human herpesvirus 6B
cgacagcgggugcuca

SEQ ID NO: 2043176 - RNA, 13 nt, Human herpesvirus 6B
gucugucuguucc

SEQ ID NO: 2043177 - RNA, 12 nt, Human herpesvirus 6B
gaacuauuucuu

SEQ ID NO: 2043178 - RNA, 23 nt, Human herpesvirus 6B
uuauaaaaaugcgcauaugacuc

SEQ ID NO: 2043179 - RNA, 21 nt, Human herpesvirus 6B
gauaaauguauaaaagagaaa

SEQ ID NO: 2043180 - RNA, 22 nt, Human herpesvirus 6B
cgucuccgauccgucaggacca

SEQ ID NO: 2043181 - RNA, 17 nt, Human herpesvirus 6B
caucaacacaccugccu

SEQ ID NO: 2043182 - RNA, 21 nt, Human herpesvirus 6B
cuaguacaaagauauuucuau

SEQ ID NO: 2043183 - RNA, 19 nt, Human herpesvirus 6B
cagaucaucgccauaguga

SEQ ID NO: 2043184 - RNA, 17 nt, Human herpesvirus 6B
acgucuccuucuaauau

SEQ ID NO: 2043185 - RNA, 17 nt, Human herpesvirus 6B
gugagggacuucgucuc

SEQ ID NO: 2043186 - RNA, 15 nt, Human herpesvirus 6B
agucuggccucugcg

SEQ ID NO: 2043187 - RNA, 23 nt, Human herpesvirus 6B
aguggcuugcugucgcccgccuc

SEQ ID NO: 2043188 - RNA, 22 nt, Human herpesvirus 6B
caccggcgacacgcgcggacca

SEQ ID NO: 2043189 - RNA, 15 nt, Human herpesvirus 6B
ugcuguaaaccagua

SEQ ID NO: 2043190 - RNA, 19 nt, Human herpesvirus 6B
cgccauaauggaagaaggc

SEQ ID NO: 2043191 - RNA, 13 nt, Human herpesvirus 6B
uguggaguuuucu

SEQ ID NO: 2043192 - RNA, 14 nt, Human herpesvirus 6B
gcacguaacaccag

SEQ ID NO: 2043193 - RNA, 22 nt, Human herpesvirus 6B
ugggucuaacggcaucagauuu

SEQ ID NO: 2043194 - RNA, 21 nt, Human herpesvirus 6B
caccccccucuugcaguggcg

SEQ ID NO: 2043195 - RNA, 22 nt, Human herpesvirus 6B
gggcuacuacguuaguaaggaa

SEQ ID NO: 2043196 - RNA, 23 nt, Human herpesvirus 6B
acaucgugaguuuucaugugaaa

SEQ ID NO: 2043197 - RNA, 17 nt, Human herpesvirus 6B
uugacgguuuauaugca

SEQ ID NO: 2043198 - RNA, 23 nt, Human herpesvirus 6B
acuccguauaugcuuuacuucug

SEQ ID NO: 2043199 - RNA, 16 nt, Human herpesvirus 6B
uauguggaaauuaaaa

SEQ ID NO: 2043200 - RNA, 16 nt, Human herpesvirus 6B
agaaucuccaaauggu

SEQ ID NO: 2043201 - RNA, 15 nt, Human herpesvirus 6B
uguuguucuuggaga

SEQ ID NO: 2043202 - RNA, 17 nt, Human herpesvirus 6B
ucucauaauuugccuga

SEQ ID NO: 2043203 - RNA, 17 nt, Human herpesvirus 6B
cgaggaauguguuucua

SEQ ID NO: 2043204 - RNA, 15 nt, Human herpesvirus 6B
gcauauauaugaauu

SEQ ID NO: 2043205 - RNA, 13 nt, Human herpesvirus 6B
cuggauacuauug

SEQ ID NO: 2043206 - RNA, 15 nt, Human herpesvirus 6B
cugaaucagaaacug

SEQ ID NO: 2043207 - RNA, 17 nt, Human herpesvirus 6B
uucauaagcucuacaca

SEQ ID NO: 2043208 - RNA, 20 nt, Human herpesvirus 6B
cggucgagaauacgcugugu

SEQ ID NO: 2043209 - RNA, 14 nt, Human herpesvirus 6B
acucgauuugauaa

SEQ ID NO: 2043210 - RNA, 22 nt, Human herpesvirus 6B
uauagauuauacgaaauuccga

SEQ ID NO: 2043211 - RNA, 12 nt, Human herpesvirus 6B
auguagcacacg

SEQ ID NO: 2043212 - RNA, 17 nt, Human herpesvirus 6B
cuuaaaugacacagaau

SEQ ID NO: 2043213 - RNA, 18 nt, Human herpesvirus 6B
ucuuuauaaacuuaaaag

SEQ ID NO: 2043214 - RNA, 23 nt, Human herpesvirus 6B
uccugugaugccuugauguuucc

SEQ ID NO: 2043215 - RNA, 21 nt, Human herpesvirus 6B
gaucugugcgccuuugcucag

SEQ ID NO: 2043216 - RNA, 13 nt, Human herpesvirus 6B
auuuuaaaaagaa

SEQ ID NO: 2043217 - RNA, 15 nt, Human herpesvirus 6B
cguggccgucuccug

SEQ ID NO: 2043218 - RNA, 23 nt, Human herpesvirus 6B
ugacuacggcgguuaacuguuuc

SEQ ID NO: 2043219 - RNA, 23 nt, Human herpesvirus 6B
caguuuuugaccggaauaaugaa

SEQ ID NO: 2043220 - RNA, 20 nt, Human herpesvirus 6B
ugcaucucgguuuaccuuuu

SEQ ID NO: 2043221 - RNA, 18 nt, Human herpesvirus 6B
ggagcacgcacgagaaca

SEQ ID NO: 2043222 - RNA, 19 nt, Human herpesvirus 6B
gacacggagugcgacagga

SEQ ID NO: 2043223 - RNA, 15 nt, Human herpesvirus 6B
aaccaucuauuugca

SEQ ID NO: 2043224 - RNA, 16 nt, Human herpesvirus 6B
ccuauguuaacauugu

SEQ ID NO: 2043225 - RNA, 12 nt, Human herpesvirus 6B
uaaaauguuucc

SEQ ID NO: 2043226 - RNA, 15 nt, Human herpesvirus 6B
caccuggcgcaccgc

SEQ ID NO: 2043227 - RNA, 16 nt, Human herpesvirus 6B
uacgaacagaaauuuc

SEQ ID NO: 2043228 - RNA, 12 nt, Human herpesvirus 6B
acugacaaggua

SEQ ID NO: 2043229 - RNA, 20 nt, Human herpesvirus 6B
cgcaguuucuguuuuucuca

SEQ ID NO: 2043230 - RNA, 19 nt, Human herpesvirus 6B
agaaacaaaauuaauucaa

SEQ ID NO: 2043231 - RNA, 15 nt, Human herpesvirus 6B
aaagggaagccagcc

SEQ ID NO: 2043232 - RNA, 13 nt, Human herpesvirus 6B
ggcacgagagccu

SEQ ID NO: 2043233 - RNA, 20 nt, Human herpesvirus 6B
uuuguuucagcguauucaga

SEQ ID NO: 2043234 - RNA, 12 nt, Human herpesvirus 6B
ggcgcuagugau

SEQ ID NO: 2043235 - RNA, 10 nt, Human herpesvirus 6B
cgguaaaaug

SEQ ID NO: 2043236 - RNA, 16 nt, Human herpesvirus 6B
agcugacaucugcaaa

SEQ ID NO: 2043237 - RNA, 22 nt, Human herpesvirus 6B
aucuucgaaucaaauucaaacu

SEQ ID NO: 2043238 - RNA, 22 nt, Human herpesvirus 6B
uguaucgaggaauguguuucua

SEQ ID NO: 2043239 - RNA, 16 nt, Human herpesvirus 6B
gucuguugcuguaguu

SEQ ID NO: 2043240 - RNA, 14 nt, Human herpesvirus 6B
gugugucggcuccg

SEQ ID NO: 2043241 - RNA, 19 nt, Human herpesvirus 6B
uauguccgcucauuuugau

SEQ ID NO: 2043242 - RNA, 15 nt, Human herpesvirus 6B
cugcccccacgggcc

SEQ ID NO: 2043243 - RNA, 23 nt, Human herpesvirus 6B
uuguucagagcugaugauuugaa

SEQ ID NO: 2043244 - RNA, 22 nt, Human herpesvirus 6B
cccggggaggcgacgacgggga

SEQ ID NO: 2043245 - RNA, 9 nt, Human herpesvirus 6B
uugcagugg

SEQ ID NO: 2043246 - RNA, 19 nt, Human herpesvirus 6B
cuguacgauuacuguccgu

SEQ ID NO: 2043247 - RNA, 13 nt, Human herpesvirus 6B
ggugauuuuccaa

SEQ ID NO: 2043248 - RNA, 17 nt, Human herpesvirus 6B
aguauuacgaauaccua

SEQ ID NO: 2043249 - RNA, 19 nt, Human herpesvirus 6B
uauuuuuucagcuuucaua

SEQ ID NO: 2043250 - RNA, 15 nt, Human herpesvirus 6B
uucaggagaagaaca

SEQ ID NO: 2043251 - RNA, 17 nt, Human herpesvirus 6B
gcagcagaggccggcac

SEQ ID NO: 2043252 - RNA, 20 nt, Human herpesvirus 6B
cggauuuuauuuuaucucau

SEQ ID NO: 2043253 - RNA, 14 nt, Human herpesvirus 6B
ccugagaccgagag

SEQ ID NO: 2043254 - RNA, 20 nt, Human herpesvirus 6B
aucacuuuauuucuaaggag

SEQ ID NO: 2043255 - RNA, 16 nt, Human herpesvirus 6B
uaaaauugaauuuaua

SEQ ID NO: 2043256 - RNA, 18 nt, Human herpesvirus 6B
aucuacugguaauaaaca

SEQ ID NO: 2043257 - RNA, 16 nt, Human herpesvirus 6B
acuuuauuugaaacug

SEQ ID NO: 2043258 - RNA, 18 nt, Human herpesvirus 6B
aaugggaugcauuauacu

SEQ ID NO: 2043259 - RNA, 15 nt, Human herpesvirus 6B
aagauuguucagagc

SEQ ID NO: 2043260 - RNA, 16 nt, Human herpesvirus 6B
aguuagugcaccgaga

SEQ ID NO: 2043261 - RNA, 14 nt, Human herpesvirus 6B
agacugcacagaau

SEQ ID NO: 2043262 - RNA, 15 nt, Human herpesvirus 6B
gaacagcgcauaaau

SEQ ID NO: 2043263 - RNA, 17 nt, Human herpesvirus 6B
uggcagccuaaacggag

SEQ ID NO: 2043264 - RNA, 20 nt, Human herpesvirus 6B
aaaacgaaacucuagaauua

SEQ ID NO: 2043265 - RNA, 19 nt, Human herpesvirus 6B
guccgcgaugcgccacagg

SEQ ID NO: 2043266 - RNA, 18 nt, Human herpesvirus 6B
gucccuucuccgucaccc

SEQ ID NO: 2043267 - RNA, 13 nt, Human herpesvirus 6B
auuagaucuucuu

SEQ ID NO: 2043268 - RNA, 18 nt, Human herpesvirus 6B
auuauauguugauugcug

SEQ ID NO: 2043269 - RNA, 14 nt, Human herpesvirus 6B
uuuaucgugcuugu

SEQ ID NO: 2043270 - RNA, 13 nt, Human herpesvirus 6B
cugcaaaaacaaa

SEQ ID NO: 2043271 - RNA, 23 nt, Human herpesvirus 6B
ugucuucgagauuuuagaauaaa

SEQ ID NO: 2043272 - RNA, 23 nt, Human herpesvirus 6B
aauguguucuuacaauguucuug

SEQ ID NO: 2043273 - RNA, 13 nt, Human herpesvirus 6B
gcucuguucucuc

SEQ ID NO: 2043274 - RNA, 18 nt, Human herpesvirus 6B
aguaucagcuaaaaauau

SEQ ID NO: 2043275 - RNA, 19 nt, Human herpesvirus 6B
ccgccuucucugucgcugc

SEQ ID NO: 2043276 - RNA, 12 nt, Human herpesvirus 6B
agacgccucagg

SEQ ID NO: 2043277 - RNA, 16 nt, Human herpesvirus 6B
cccggggagugggagg

SEQ ID NO: 2043278 - RNA, 17 nt, Human herpesvirus 6B
cacauuagcugcuaaau

SEQ ID NO: 2043279 - RNA, 21 nt, Human herpesvirus 6B
ccgccucucuccgccuccucu

SEQ ID NO: 2043280 - RNA, 12 nt, Human herpesvirus 6B
agcggccaggcc

SEQ ID NO: 2043281 - RNA, 15 nt, Human herpesvirus 6B
guuccaugugucucc

SEQ ID NO: 2043282 - RNA, 19 nt, Human herpesvirus 6B
aauaaugcucagaugugga

SEQ ID NO: 2043283 - RNA, 14 nt, Human herpesvirus 6B
auaagcagccgaau

SEQ ID NO: 2043284 - RNA, 14 nt, Human herpesvirus 6B
gagauagagccggc

SEQ ID NO: 2043285 - RNA, 15 nt, Human herpesvirus 6B
ccuaaaaucugcuaa

SEQ ID NO: 2043286 - RNA, 17 nt, Human herpesvirus 6B
ucgacuaacaauuuaua

SEQ ID NO: 2043287 - RNA, 20 nt, Human herpesvirus 6B
gcaccgagggcgggcggacg

SEQ ID NO: 2043288 - RNA, 18 nt, Human herpesvirus 6B
caaguugcggaagggcuc

SEQ ID NO: 2043289 - RNA, 18 nt, Human herpesvirus 6B
gagccgcagaggccagac

SEQ ID NO: 2043290 - RNA, 17 nt, Human herpesvirus 6B
ucggcauuuguguuuuu

SEQ ID NO: 2043291 - RNA, 17 nt, Human herpesvirus 6B
uacaguuucucgaaaau

SEQ ID NO: 2043292 - RNA, 14 nt, Human herpesvirus 6B
uuucauucaaugag

SEQ ID NO: 2043293 - RNA, 14 nt, Human herpesvirus 6B
uauaacagacauau

SEQ ID NO: 2043294 - RNA, 11 nt, Human herpesvirus 6B
cagagcacaca

SEQ ID NO: 2043295 - RNA, 17 nt, Human herpesvirus 6B
aaucuugagguggaaau

SEQ ID NO: 2043296 - RNA, 14 nt, Human herpesvirus 6B
guaguugaugcugu

SEQ ID NO: 2043297 - RNA, 15 nt, Human herpesvirus 6B
ucuagaugaaagagg

SEQ ID NO: 2043298 - RNA, 13 nt, Human herpesvirus 6B
aaaauauuuugaa

SEQ ID NO: 2043299 - RNA, 20 nt, Human herpesvirus 6B
augucaagucuagacaugau

SEQ ID NO: 2043300 - RNA, 14 nt, Human herpesvirus 6B
aaagugcuuuaucc

SEQ ID NO: 2043301 - RNA, 17 nt, Human herpesvirus 6B
cgaggaguuaaaacuaa

SEQ ID NO: 2043302 - RNA, 22 nt, Human herpesvirus 6B
gagucggcuguccaaacagaga

SEQ ID NO: 2043303 - RNA, 13 nt, Human herpesvirus 6B
aacaauaauugca

SEQ ID NO: 2043304 - RNA, 11 nt, Human herpesvirus 6B
cuuuccaagga

SEQ ID NO: 2043305 - RNA, 20 nt, Human herpesvirus 6B
gggucgucgaugcgaaggga

SEQ ID NO: 2043306 - RNA, 13 nt, Human herpesvirus 6B
ugugaucaagugg

SEQ ID NO: 2043307 - RNA, 20 nt, Human herpesvirus 6B
cuguaguuuuuuucugauga

SEQ ID NO: 2043308 - RNA, 19 nt, Human herpesvirus 6B
ucaagguugucagauuucc

SEQ ID NO: 2043309 - RNA, 20 nt, Human herpesvirus 6B
ugggggauggguuaggguua

SEQ ID NO: 2043310 - RNA, 23 nt, Human herpesvirus 6B
ccgcaguuccuguuuuucucaua

SEQ ID NO: 2043311 - RNA, 21 nt, Human herpesvirus 6B
ugugaaguucgauguuauugu

SEQ ID NO: 2043312 - RNA, 18 nt, Human herpesvirus 6B
uucgacaaagaacauuug

SEQ ID NO: 2043313 - RNA, 16 nt, Human herpesvirus 6B
cuauguuauguaaaga

SEQ ID NO: 2043314 - RNA, 18 nt, Human herpesvirus 6B
gcgggacgugaucugcgg

SEQ ID NO: 2043315 - RNA, 17 nt, Human herpesvirus 6B
ucaaaaugaccagagau

SEQ ID NO: 2043316 - RNA, 12 nt, Human herpesvirus 6B
uauugcuacaaa

SEQ ID NO: 2043317 - RNA, 15 nt, Human herpesvirus 6B
acgaacauucaaugg

SEQ ID NO: 2043318 - RNA, 22 nt, Human herpesvirus 6B
gagguuuuuucaccccccucuu

SEQ ID NO: 2043319 - RNA, 20 nt, Human herpesvirus 6B
gccucacuguaaaagggcuc

SEQ ID NO: 2043320 - RNA, 22 nt, Human herpesvirus 6B
guaaucucuagguaaacuucug

SEQ ID NO: 2043321 - RNA, 18 nt, Human herpesvirus 6B
ugguggcgaucuguauau

SEQ ID NO: 2043322 - RNA, 18 nt, Human herpesvirus 6B
agaggaagggauggcaga

SEQ ID NO: 2043323 - RNA, 12 nt, Human herpesvirus 6B
uugaagaacugg

SEQ ID NO: 2043324 - RNA, 13 nt, Human herpesvirus 6B
caaaaucugcuaa

SEQ ID NO: 2043325 - RNA, 13 nt, Human herpesvirus 6B
gcgacacgcgcgg

SEQ ID NO: 2043326 - RNA, 15 nt, Human herpesvirus 6B
cguggaagccgcugc

SEQ ID NO: 2043327 - RNA, 15 nt, Human herpesvirus 6B
uggcuaauagggaau

SEQ ID NO: 2043328 - RNA, 21 nt, Human herpesvirus 6B
ugaaagguguggugaaagaca

SEQ ID NO: 2043329 - RNA, 16 nt, Human herpesvirus 6B
gggccagcccugaaga

SEQ ID NO: 2043330 - RNA, 18 nt, Human herpesvirus 6B
ugauucuguuuucuacgu

SEQ ID NO: 2043331 - RNA, 16 nt, Human herpesvirus 6B
agguuucucucucacc

SEQ ID NO: 2043332 - RNA, 18 nt, Human herpesvirus 6B
cgcgacgccuccgccggg

SEQ ID NO: 2043333 - RNA, 15 nt, Human herpesvirus 6B
uugguauaagaaaga

SEQ ID NO: 2043334 - RNA, 18 nt, Human herpesvirus 6B
ucuaaugcaaagaugucg

SEQ ID NO: 2043335 - RNA, 14 nt, Human herpesvirus 6B
uguacgaaaacgac

SEQ ID NO: 2043336 - RNA, 23 nt, Human herpesvirus 6B
agcugcuaacggagcaaccgcag

SEQ ID NO: 2043337 - RNA, 19 nt, Human herpesvirus 6B
cuuuccauugcucuuucca

SEQ ID NO: 2043338 - RNA, 15 nt, Human herpesvirus 6B
uaacagaguuuucau

SEQ ID NO: 2043339 - RNA, 16 nt, Human herpesvirus 6B
acgacgaggaguuaaa

SEQ ID NO: 2043340 - RNA, 17 nt, Human herpesvirus 6B
uggcgcuuguaggagca

SEQ ID NO: 2043341 - RNA, 19 nt, Human herpesvirus 6B
uucaggcggcaugaauucc

SEQ ID NO: 2043342 - RNA, 16 nt, Human herpesvirus 6B
gcgccucccauagagg

SEQ ID NO: 2043343 - RNA, 15 nt, Human herpesvirus 6B
caacguuuucugcuc

SEQ ID NO: 2043344 - RNA, 17 nt, Human herpesvirus 6B
agaaauuuuuuagaaca

SEQ ID NO: 2043345 - RNA, 12 nt, Human herpesvirus 6B
gcugcuggguac

SEQ ID NO: 2043346 - RNA, 21 nt, Human herpesvirus 6B
ggagguuuuuucaccccccuc

SEQ ID NO: 2043347 - RNA, 16 nt, Human herpesvirus 6B
acggugauguugcgau

SEQ ID NO: 2043348 - RNA, 20 nt, Human herpesvirus 6B
uauuaauuuuuuguuucuga

SEQ ID NO: 2043349 - RNA, 12 nt, Human herpesvirus 6B
cggggcgcaccg

SEQ ID NO: 2043350 - RNA, 14 nt, Human herpesvirus 6B
ugcuguaaaccagu

SEQ ID NO: 2043351 - RNA, 20 nt, Human herpesvirus 6B
ucgucgaaaacaauuuccca

SEQ ID NO: 2043352 - RNA, 16 nt, Human herpesvirus 6B
aguuuuuuucugauga

SEQ ID NO: 2043353 - RNA, 23 nt, Human herpesvirus 6B
gaaaacacccugauggauuacaa

SEQ ID NO: 2043354 - RNA, 18 nt, Human herpesvirus 6B
gcuauuugacaauaaaca

SEQ ID NO: 2043355 - RNA, 18 nt, Human herpesvirus 6B
agaaguauuucgaucaga

SEQ ID NO: 2043356 - RNA, 13 nt, Human herpesvirus 6B
ggcgcgggacagc

SEQ ID NO: 2043357 - RNA, 14 nt, Human herpesvirus 6B
augaaauuuucaau

SEQ ID NO: 2043358 - RNA, 22 nt, Human herpesvirus 6B
uauuugacaauaaacaugauug

SEQ ID NO: 2043359 - RNA, 17 nt, Human herpesvirus 6B
gccaccucuucuccgcc

SEQ ID NO: 2043360 - RNA, 20 nt, Human herpesvirus 6B
uuguuacuuucauaacaagu

SEQ ID NO: 2043361 - RNA, 15 nt, Human herpesvirus 6B
aggaggaagaggagg

SEQ ID NO: 2043362 - RNA, 19 nt, Human herpesvirus 6B
ugugaggugauuugaacag

SEQ ID NO: 2043363 - RNA, 18 nt, Human herpesvirus 6B
acugugaaaagugcuuua

SEQ ID NO: 2043364 - RNA, 17 nt, Human herpesvirus 6B
aaguuuuggaaaaugua

SEQ ID NO: 2043365 - RNA, 19 nt, Human herpesvirus 6B
uaucucgaaaccaagacuu

SEQ ID NO: 2043366 - RNA, 15 nt, Human herpesvirus 6B
cagaauacaaaaacg

SEQ ID NO: 2043367 - RNA, 16 nt, Human herpesvirus 6B
auugauccagaauuau

SEQ ID NO: 2043368 - RNA, 15 nt, Human herpesvirus 6B
caccucgcaaagucu

SEQ ID NO: 2043369 - RNA, 23 nt, Human herpesvirus 6B
aaaucaaugaguugcacauguuu

SEQ ID NO: 2043370 - RNA, 21 nt, Human herpesvirus 6B
agaaagcguguucaaaaaugu

SEQ ID NO: 2043371 - RNA, 18 nt, Human herpesvirus 6B
cagaagauccaaacuaug

SEQ ID NO: 2043372 - RNA, 14 nt, Human herpesvirus 6B
cgggcagggcgggc

SEQ ID NO: 2043373 - RNA, 23 nt, Human herpesvirus 6B
uuuccccccgccgccuucucugu

SEQ ID NO: 2043374 - RNA, 22 nt, Human herpesvirus 6B
uauuuaacauccaaaauacacu

SEQ ID NO: 2043375 - RNA, 22 nt, Human herpesvirus 6B
aggagaauuugcaguuugugaa

SEQ ID NO: 2043376 - RNA, 13 nt, Human herpesvirus 6B
augacugugaggu

SEQ ID NO: 2043377 - RNA, 14 nt, Human herpesvirus 6B
uucagucucagcaa

SEQ ID NO: 2043378 - RNA, 22 nt, Human herpesvirus 6B
agacguuucuauggauaugagu

SEQ ID NO: 2043379 - RNA, 22 nt, Human herpesvirus 6B
uauaacagacauaugcaaucug

SEQ ID NO: 2043380 - RNA, 14 nt, Human herpesvirus 6B
ggucgccguggccg

SEQ ID NO: 2043381 - RNA, 18 nt, Human herpesvirus 6B
ucuauucaggaauauuua

SEQ ID NO: 2043382 - RNA, 14 nt, Human herpesvirus 6B
gaauugguuugcuu

SEQ ID NO: 2043383 - RNA, 18 nt, Human herpesvirus 6B
ugaugcuguugcuguugu

SEQ ID NO: 2043384 - RNA, 13 nt, Human herpesvirus 6B
gucuucugugcuu

SEQ ID NO: 2043385 - RNA, 23 nt, Human herpesvirus 6B
ggucgcguucuaacccaugaaaa

SEQ ID NO: 2043386 - RNA, 21 nt, Human herpesvirus 6B
guugggauggcagauugcaaa

SEQ ID NO: 2043387 - RNA, 14 nt, Human herpesvirus 6B
cccagaugcagucu

SEQ ID NO: 2043388 - RNA, 19 nt, Human herpesvirus 6B
guugcauggugauguguua

SEQ ID NO: 2043389 - RNA, 18 nt, Human herpesvirus 6B
cguggccgucuccugcaa

SEQ ID NO: 2043390 - RNA, 22 nt, Human herpesvirus 6B
acgucuccaucucuagaaucuu

SEQ ID NO: 2043391 - RNA, 21 nt, Human herpesvirus 6B
gcaguuacaauuacuaaauca

SEQ ID NO: 2043392 - RNA, 21 nt, Human herpesvirus 6B
uaaggaguuuaucguuuuuau

SEQ ID NO: 2043393 - RNA, 12 nt, Human herpesvirus 6B
uaaagcagcuag

SEQ ID NO: 2043394 - RNA, 11 nt, Human herpesvirus 6B
uguuguagugg

SEQ ID NO: 2043395 - RNA, 19 nt, Human herpesvirus 6B
auucaauggagucuucaca

SEQ ID NO: 2043396 - RNA, 21 nt, Human herpesvirus 6B
gauaauuucuuuggagggaau

SEQ ID NO: 2043397 - RNA, 11 nt, Human herpesvirus 6B
ccaacugagag

SEQ ID NO: 2043398 - RNA, 16 nt, Human herpesvirus 6B
auaggcucggcagggg

SEQ ID NO: 2043399 - RNA, 14 nt, Human herpesvirus 6B
cuuuauacgucaua

SEQ ID NO: 2043400 - RNA, 13 nt, Human herpesvirus 6B
gccgcgcggagcu

SEQ ID NO: 2043401 - RNA, 16 nt, Human herpesvirus 6B
gcucuccguuucucgg

SEQ ID NO: 2043402 - RNA, 20 nt, Human herpesvirus 6B
acucaguagaaugaaugaaa

SEQ ID NO: 2043403 - RNA, 12 nt, Human herpesvirus 6B
augcauagaagu

SEQ ID NO: 2043404 - RNA, 16 nt, Human herpesvirus 6B
ugugcacgaauaagga

SEQ ID NO: 2043405 - RNA, 18 nt, Human herpesvirus 6B
caucaacuacuucuguua

SEQ ID NO: 2043406 - RNA, 13 nt, Human herpesvirus 6B
aaagcugcuaacg

SEQ ID NO: 2043407 - RNA, 16 nt, Human herpesvirus 6B
cguuuuuucugcaaaa

SEQ ID NO: 2043408 - RNA, 15 nt, Human herpesvirus 6B
cuggcgaugcagaug

SEQ ID NO: 2043409 - RNA, 16 nt, Human herpesvirus 6B
cgcaguuucuguuuuu

SEQ ID NO: 2043410 - RNA, 15 nt, Human herpesvirus 6B
caagguaugaaacga

SEQ ID NO: 2043411 - RNA, 17 nt, Human herpesvirus 6B
cggauucauuuauucuc

SEQ ID NO: 2043412 - RNA, 18 nt, Human herpesvirus 6B
auauuucuaucuggaaau

SEQ ID NO: 2043413 - RNA, 24 nt, Human herpesvirus 6B
gcaugacacaucgugaguuuucau

SEQ ID NO: 2043414 - RNA, 15 nt, Human herpesvirus 6B
acaacgacugggaga

SEQ ID NO: 2043415 - RNA, 16 nt, Human herpesvirus 6B
ccuuguguauuuguga

SEQ ID NO: 2043416 - RNA, 14 nt, Human herpesvirus 6B
aaggucaaaaaacu

SEQ ID NO: 2043417 - RNA, 20 nt, Human herpesvirus 6B
aaacuaugaggaacugauga

SEQ ID NO: 2043418 - RNA, 21 nt, Human herpesvirus 6B
cgaugcgaagggaguaaggag

SEQ ID NO: 2043419 - RNA, 13 nt, Human herpesvirus 6B
cgcgccacagcgg

SEQ ID NO: 2043420 - RNA, 13 nt, Human herpesvirus 6B
ucguugcagaccg

SEQ ID NO: 2043421 - RNA, 9 nt, Human herpesvirus 6B
cuccaagga

SEQ ID NO: 2043422 - RNA, 13 nt, Human herpesvirus 6B
ugaaauacuguga

SEQ ID NO: 2043423 - RNA, 12 nt, Human herpesvirus 6B
gcagaagcuguc

SEQ ID NO: 2043424 - RNA, 20 nt, Human herpesvirus 6B
ugcguguaauuguugaaauu

SEQ ID NO: 2043425 - RNA, 17 nt, Human herpesvirus 6B
cuccgccggguaugagc

SEQ ID NO: 2043426 - RNA, 20 nt, Human herpesvirus 6B
aucucaagaaacaaguacua

SEQ ID NO: 2043427 - RNA, 14 nt, Human herpesvirus 6B
agcugacaucugca

SEQ ID NO: 2043428 - RNA, 22 nt, Human herpesvirus 6B
ccggcgacacgcgcggaccacu

SEQ ID NO: 2043429 - RNA, 17 nt, Human herpesvirus 6B
ggggaucgacgaccagg

SEQ ID NO: 2043430 - RNA, 17 nt, Human herpesvirus 6B
caugacugugaggugau

SEQ ID NO: 2043431 - RNA, 23 nt, Human herpesvirus 6B
ccgcugcagugugucggcuccga

SEQ ID NO: 2043432 - RNA, 12 nt, Human herpesvirus 6B
gccaugauuuug

SEQ ID NO: 2043433 - RNA, 19 nt, Human herpesvirus 6B
uacacagagugcaucuuua

SEQ ID NO: 2043434 - RNA, 13 nt, Human herpesvirus 6B
guuauuaugcugu

SEQ ID NO: 2043435 - RNA, 14 nt, Human herpesvirus 6B
gacggcagcgggga

SEQ ID NO: 2043436 - RNA, 18 nt, Human herpesvirus 6B
cguccguggaaaaacacu

SEQ ID NO: 2043437 - RNA, 15 nt, Human herpesvirus 6B
cagaaaugagcaaca

SEQ ID NO: 2043438 - RNA, 17 nt, Human herpesvirus 6B
uccaguuguauuuugcg

SEQ ID NO: 2043439 - RNA, 19 nt, Human herpesvirus 6B
cauuucuaucuacaaaaua

SEQ ID NO: 2043440 - RNA, 16 nt, Human herpesvirus 6B
gagguagcaacuugcu

SEQ ID NO: 2043441 - RNA, 13 nt, Human herpesvirus 6B
ccggccaauucau

SEQ ID NO: 2043442 - RNA, 13 nt, Human herpesvirus 6B
gaggcccagaggu

SEQ ID NO: 2043443 - RNA, 16 nt, Human herpesvirus 6B
ggagaggaagccggag

SEQ ID NO: 2043444 - RNA, 20 nt, Human herpesvirus 6B
cguccgcgaugcgccacagg

SEQ ID NO: 2043445 - RNA, 13 nt, Human herpesvirus 6B
uacuaauguggau

SEQ ID NO: 2043446 - RNA, 14 nt, Human herpesvirus 6B
accccccucuugca

SEQ ID NO: 2043447 - RNA, 20 nt, Human herpesvirus 6B
gugacgugcgugcacgcgcc

SEQ ID NO: 2043448 - RNA, 19 nt, Human herpesvirus 6B
ggauuuuauuuuaucucau

SEQ ID NO: 2043449 - RNA, 22 nt, Human herpesvirus 6B
guguauaacgauaauagaaaaa

SEQ ID NO: 2043450 - RNA, 17 nt, Human herpesvirus 6B
caaacucaaagaaagcu

SEQ ID NO: 2043451 - RNA, 15 nt, Human herpesvirus 6B
gcgaccucgcucucc

SEQ ID NO: 2043452 - RNA, 16 nt, Human herpesvirus 6B
cauaaacuauuguuua

SEQ ID NO: 2043453 - RNA, 20 nt, Human herpesvirus 6B
augacugugaggugauuuga

SEQ ID NO: 2043454 - RNA, 23 nt, Human herpesvirus 6B
uaccccggcuuucucgccgccuc

SEQ ID NO: 2043455 - RNA, 23 nt, Human herpesvirus 6B
gcgucuuaacguucguccggggu

SEQ ID NO: 2043456 - RNA, 16 nt, Human herpesvirus 6B
gaugcuuuuaguuuca

SEQ ID NO: 2043457 - RNA, 18 nt, Human herpesvirus 6B
uauuugaaacugaagaaa

SEQ ID NO: 2043458 - RNA, 15 nt, Human herpesvirus 6B
ccuaaauaccauuuu

SEQ ID NO: 2043459 - RNA, 20 nt, Human herpesvirus 6B
guugcuguaguugaugcugu

SEQ ID NO: 2043460 - RNA, 17 nt, Human herpesvirus 6B
cgguggugaucggcaga

SEQ ID NO: 2043461 - RNA, 16 nt, Human herpesvirus 6B
aggguaacgcaggaga

SEQ ID NO: 2043462 - RNA, 16 nt, Human herpesvirus 6B
cuuugggaugaagaga

SEQ ID NO: 2043463 - RNA, 13 nt, Human herpesvirus 6B
gggaucgggccug

SEQ ID NO: 2043464 - RNA, 16 nt, Human herpesvirus 6B
agugcugugcucuuua

SEQ ID NO: 2043465 - RNA, 20 nt, Human herpesvirus 6B
gacuuuucugaugacaauau

SEQ ID NO: 2043466 - RNA, 22 nt, Human herpesvirus 6B
auuuugggccguaaacuuauug

SEQ ID NO: 2043467 - RNA, 15 nt, Human herpesvirus 6B
guaaccugucuugga

SEQ ID NO: 2043468 - RNA, 17 nt, Human herpesvirus 6B
uuucaccccccucuugc

SEQ ID NO: 2043469 - RNA, 13 nt, Human herpesvirus 6B
uugagacguuuuu

SEQ ID NO: 2043470 - RNA, 23 nt, Human herpesvirus 6B
ccuauguuaacauugugagaaca

SEQ ID NO: 2043471 - RNA, 16 nt, Human herpesvirus 6B
ucugcguugcccuccc

SEQ ID NO: 2043472 - RNA, 13 nt, Human herpesvirus 6B
uggaaaauuuaua

SEQ ID NO: 2043473 - RNA, 17 nt, Human herpesvirus 6B
ugucuucauucuucgaa

SEQ ID NO: 2043474 - RNA, 22 nt, Human herpesvirus 6B
acucgacguguaucgauuuaac

SEQ ID NO: 2043475 - RNA, 16 nt, Human herpesvirus 6B
ggggagccguggugcg

SEQ ID NO: 2043476 - RNA, 21 nt, Human herpesvirus 6B
gagaguuuccgggcauguuuu

SEQ ID NO: 2043477 - RNA, 13 nt, Human herpesvirus 6B
aaaaaacaguuuc

SEQ ID NO: 2043478 - RNA, 17 nt, Human herpesvirus 6B
ucaccaugaaagcacag

SEQ ID NO: 2043479 - RNA, 15 nt, Human herpesvirus 6B
uuccagggugaagac

SEQ ID NO: 2043480 - RNA, 21 nt, Human herpesvirus 6B
cgggccuggggacagacaggg

SEQ ID NO: 2043481 - RNA, 10 nt, Human herpesvirus 6B
ucuugcagug

SEQ ID NO: 2043482 - RNA, 19 nt, Human herpesvirus 6B
gcgcguuuaucaugagaga

SEQ ID NO: 2043483 - RNA, 19 nt, Human herpesvirus 6B
uuaaaaucaaaaaaaucuc

SEQ ID NO: 2043484 - RNA, 14 nt, Human herpesvirus 6B
ggcggcggcggcug

SEQ ID NO: 2043485 - RNA, 14 nt, Human herpesvirus 6B
auaaacuuaaaaga

SEQ ID NO: 2043486 - RNA, 20 nt, Human herpesvirus 6B
cguguuauggggaagaucua

SEQ ID NO: 2043487 - RNA, 15 nt, Human herpesvirus 6B
ugaugacucaagaau

SEQ ID NO: 2043488 - RNA, 13 nt, Human herpesvirus 6B
uaaauggacggcg

SEQ ID NO: 2043489 - RNA, 12 nt, Human herpesvirus 6B
gacgggcagggc

SEQ ID NO: 2043490 - RNA, 18 nt, Human herpesvirus 6B
ucguaguuuaugaaaucg

SEQ ID NO: 2043491 - RNA, 20 nt, Human herpesvirus 6B
uuguacauguuaacaauaaa

SEQ ID NO: 2043492 - RNA, 22 nt, Human herpesvirus 6B
caucuugccguuuugaucuuug

SEQ ID NO: 2043493 - RNA, 17 nt, Human herpesvirus 6B
ugaacucucacggccau

SEQ ID NO: 2043494 - RNA, 15 nt, Human herpesvirus 6B
cgggcgacgggcagg

SEQ ID NO: 2043495 - RNA, 18 nt, Human herpesvirus 6B
uuucgugguugucuuugu

SEQ ID NO: 2043496 - RNA, 21 nt, Human herpesvirus 6B
guuuaaagugaguuuuggaaa

SEQ ID NO: 2043497 - RNA, 11 nt, Human herpesvirus 6B
augagagagca

SEQ ID NO: 2043498 - RNA, 12 nt, Human herpesvirus 6B
ccaacuuaauaa

SEQ ID NO: 2043499 - RNA, 13 nt, Human herpesvirus 6B
ucuccgucucagu

SEQ ID NO: 2043500 - RNA, 18 nt, Human herpesvirus 6B
acauucguauacuuccuc

SEQ ID NO: 2043501 - RNA, 12 nt, Human herpesvirus 6B
acuuagcuagac

SEQ ID NO: 2043502 - RNA, 19 nt, Human herpesvirus 6B
gaacagagacccuccuggc

SEQ ID NO: 2043503 - RNA, 13 nt, Human herpesvirus 6B
cuccgccuccucu

SEQ ID NO: 2043504 - RNA, 18 nt, Human herpesvirus 6B
cgaauuauguauguguua

SEQ ID NO: 2043505 - RNA, 15 nt, Human herpesvirus 6B
gacggcagcggggaa

SEQ ID NO: 2043506 - RNA, 16 nt, Human herpesvirus 6B
cguggcagaagaagag

SEQ ID NO: 2043507 - RNA, 16 nt, Human herpesvirus 6B
gaaaacuucuguuuua

SEQ ID NO: 2043508 - RNA, 14 nt, Human herpesvirus 6B
ccaggaaaaugugu

SEQ ID NO: 2043509 - RNA, 18 nt, Human herpesvirus 6B
aauaauugcauuuugggc

SEQ ID NO: 2043510 - RNA, 21 nt, Human herpesvirus 6B
auccuguaguuuuuuucugau

SEQ ID NO: 2043511 - RNA, 13 nt, Human herpesvirus 6B
gagagcuccgagc

SEQ ID NO: 2043512 - RNA, 13 nt, Human herpesvirus 6B
auuuuuuaaauaa

SEQ ID NO: 2043513 - RNA, 12 nt, Human herpesvirus 6B
guggaaauuaaa

SEQ ID NO: 2043514 - RNA, 18 nt, Human herpesvirus 6B
ugauacgaguaaaauuga

SEQ ID NO: 2043515 - RNA, 12 nt, Human herpesvirus 6B
cucucucaccug

SEQ ID NO: 2043516 - RNA, 13 nt, Human herpesvirus 6B
ucacauagagaag

SEQ ID NO: 2043517 - RNA, 19 nt, Human herpesvirus 6B
aaagauguguuaaagaaug

SEQ ID NO: 2043518 - RNA, 15 nt, Human herpesvirus 6B
guccuacagaagaaa

SEQ ID NO: 2043519 - RNA, 13 nt, Human herpesvirus 6B
uuuguuucugaaa

SEQ ID NO: 2043520 - RNA, 14 nt, Human herpesvirus 6B
uuauccggccaauu

SEQ ID NO: 2043521 - RNA, 17 nt, Human herpesvirus 6B
ucuaauuauaaauguag

SEQ ID NO: 2043522 - RNA, 17 nt, Human herpesvirus 6B
gugcuuguuuuggugga

SEQ ID NO: 2043523 - RNA, 14 nt, Human herpesvirus 6B
ccgaaccacaucuu

SEQ ID NO: 2043524 - RNA, 13 nt, Human herpesvirus 6B
ucgucauuccagu

SEQ ID NO: 2043525 - RNA, 22 nt, Human herpesvirus 6B
cagcaauuucggcaagaaagcc

SEQ ID NO: 2043526 - RNA, 19 nt, Human herpesvirus 6B
gauauaaauauuuacggga

SEQ ID NO: 2043527 - RNA, 23 nt, Human herpesvirus 6B
ggacggcguucguucggacucuc

SEQ ID NO: 2043528 - RNA, 13 nt, Human herpesvirus 6B
ucuggcugaagga

SEQ ID NO: 2043529 - RNA, 17 nt, Human herpesvirus 6B
uaucacuuuauuucuaa

SEQ ID NO: 2043530 - RNA, 20 nt, Human herpesvirus 6B
cacaguucguccagcagcgg

SEQ ID NO: 2043531 - RNA, 15 nt, Human herpesvirus 6B
ugcaaaaacaaauga

SEQ ID NO: 2043532 - RNA, 22 nt, Human herpesvirus 6B
cucugcggcucucugcccuucu

SEQ ID NO: 2043533 - RNA, 21 nt, Human herpesvirus 6B
gauugucauucugcauuuaua

SEQ ID NO: 2043534 - RNA, 19 nt, Human herpesvirus 6B
cgcgggaccuggcgggcac

SEQ ID NO: 2043535 - RNA, 21 nt, Human herpesvirus 6B
gaagaucuuuauggagggaau

SEQ ID NO: 2043536 - RNA, 17 nt, Human herpesvirus 6B
caguucacacagaugca

SEQ ID NO: 2043537 - RNA, 12 nt, Human herpesvirus 6B
aaacagaauaag

SEQ ID NO: 2043538 - RNA, 20 nt, Human herpesvirus 6B
agauauauugguagacagga

SEQ ID NO: 2043539 - RNA, 16 nt, Human herpesvirus 6B
ggcuccccaggcgcag

SEQ ID NO: 2043540 - RNA, 23 nt, Human herpesvirus 6B
augcaacgucgguucaauaacug

SEQ ID NO: 2043541 - RNA, 13 nt, Human herpesvirus 6B
caguggcaauaau

SEQ ID NO: 2043542 - RNA, 21 nt, Human herpesvirus 6B
ucgggccaagguaaaggaagg

SEQ ID NO: 2043543 - RNA, 12 nt, Human herpesvirus 6B
cucuugugcaaa

SEQ ID NO: 2043544 - RNA, 14 nt, Human herpesvirus 6B
aggaggaagaggag

SEQ ID NO: 2043545 - RNA, 14 nt, Human herpesvirus 6B
caucuaugaugcug

SEQ ID NO: 2043546 - RNA, 18 nt, Human herpesvirus 6B
gcgccgguuuccaugaga

SEQ ID NO: 2043547 - RNA, 20 nt, Human herpesvirus 6B
auucuccucaacuaaaucau

SEQ ID NO: 2043548 - RNA, 21 nt, Human herpesvirus 6B
ugaauccagauaaacaaaaau

SEQ ID NO: 2043549 - RNA, 21 nt, Human herpesvirus 6B
gccgccauauuaaaacccggc

SEQ ID NO: 2043550 - RNA, 14 nt, Human herpesvirus 6B
uauucauaacagau

SEQ ID NO: 2043551 - RNA, 20 nt, Human herpesvirus 6B
acgucauauccagaaaauac

SEQ ID NO: 2043552 - RNA, 21 nt, Human herpesvirus 6B
gagaguacggaagugccuucu

SEQ ID NO: 2043553 - RNA, 21 nt, Human herpesvirus 6B
ucacucacauagagaagaauc

SEQ ID NO: 2043554 - RNA, 20 nt, Human herpesvirus 6B
gcuuuauggagauuugacuu

SEQ ID NO: 2043555 - RNA, 19 nt, Human herpesvirus 6B
guaaucguuuuugauugua

SEQ ID NO: 2043556 - RNA, 20 nt, Human herpesvirus 6B
cucgacaaccaacgugauaa

SEQ ID NO: 2043557 - RNA, 20 nt, Human herpesvirus 6B
ggaauuuaaaucguaugagc

SEQ ID NO: 2043558 - RNA, 22 nt, Human herpesvirus 6B
cuugauaucuucgugcaauaac

SEQ ID NO: 2043559 - RNA, 21 nt, Human herpesvirus 6B
aauaauuacaaagccacagcu

SEQ ID NO: 2043560 - RNA, 15 nt, Human herpesvirus 6B
ucgcggcggccccgc

SEQ ID NO: 2043561 - RNA, 17 nt, Human herpesvirus 6B
uuuuaaacauucuuaaa

SEQ ID NO: 2043562 - RNA, 16 nt, Human herpesvirus 6B
ugacaauaaacaugau

SEQ ID NO: 2043563 - RNA, 15 nt, Human herpesvirus 6B
auuuaauaaaauaac

SEQ ID NO: 2043564 - RNA, 18 nt, Human herpesvirus 6B
augaaguuccacaucuau

SEQ ID NO: 2043565 - RNA, 16 nt, Human herpesvirus 6B
ugaacaaguggaagug

SEQ ID NO: 2043566 - RNA, 20 nt, Human herpesvirus 6B
cacccgcugucgucugagca

SEQ ID NO: 2043567 - RNA, 23 nt, Human herpesvirus 6B
ccgcaucgcaccgcagaucacgu

SEQ ID NO: 2043568 - RNA, 17 nt, Human herpesvirus 6B
uaacuguggguuuucag

SEQ ID NO: 2043569 - RNA, 21 nt, Human herpesvirus 6B
cuuccgcuaccgcccugcucc

SEQ ID NO: 2043570 - RNA, 14 nt, Human herpesvirus 6B
gcggcucucugccc

SEQ ID NO: 2043571 - RNA, 20 nt, Human herpesvirus 6B
cugguucaggauuuguaaaa

SEQ ID NO: 2043572 - RNA, 22 nt, Human herpesvirus 6B
uacauaugccgacuguuucuua

SEQ ID NO: 2043573 - RNA, 23 nt, Human herpesvirus 6B
cccugagagcaggagcaggcucc

SEQ ID NO: 2043574 - RNA, 20 nt, Human herpesvirus 6B
ucauuucgaucuaacuacau

SEQ ID NO: 2043575 - RNA, 16 nt, Human herpesvirus 6B
ucuggugaauguuucu

SEQ ID NO: 2043576 - RNA, 17 nt, Human herpesvirus 6B
aucuuugauaaaaccau

SEQ ID NO: 2043577 - RNA, 18 nt, Human herpesvirus 6B
gaggacgcaaagagagac

SEQ ID NO: 2043578 - RNA, 19 nt, Human herpesvirus 6B
gacaauaaacaugauugua

SEQ ID NO: 2043579 - RNA, 22 nt, Human herpesvirus 6B
auauuccucaagauaugggaaa

SEQ ID NO: 2043580 - RNA, 18 nt, Human herpesvirus 6B
cagacaaaacacaauaaa

SEQ ID NO: 2043581 - RNA, 16 nt, Human herpesvirus 6B
cacuguaaaagggcuc

SEQ ID NO: 2043582 - RNA, 17 nt, Human herpesvirus 6B
ccucccgcagcuccuuc

SEQ ID NO: 2043583 - RNA, 13 nt, Human herpesvirus 6B
ugcuuaaacugaa

SEQ ID NO: 2043584 - RNA, 21 nt, Human herpesvirus 6B
gaucucauaugcaucagaccu

SEQ ID NO: 2043585 - RNA, 19 nt, Human herpesvirus 6B
guacguggccgucuccugc

SEQ ID NO: 2043586 - RNA, 15 nt, Human herpesvirus 6B
uccgucaucuagaga

SEQ ID NO: 2043587 - RNA, 16 nt, Human herpesvirus 6B
gguggacaccaauaaa

SEQ ID NO: 2043588 - RNA, 13 nt, Human herpesvirus 6B
cagcagcagcucc

SEQ ID NO: 2043589 - RNA, 15 nt, Human herpesvirus 6B
caaaaugaccagaga

SEQ ID NO: 2043590 - RNA, 13 nt, Human herpesvirus 6B
cuuuuugccaaaa

SEQ ID NO: 2043591 - RNA, 17 nt, Human herpesvirus 6B
uucauagcguucaaaac

SEQ ID NO: 2043592 - RNA, 19 nt, Human herpesvirus 6B
gauagaggaauugcuuugu

SEQ ID NO: 2043593 - RNA, 23 nt, Human herpesvirus 6B
caugaaaucucuuuuaacacaca

SEQ ID NO: 2043594 - RNA, 17 nt, Human herpesvirus 6B
gauugaugaaagcuuca

SEQ ID NO: 2043595 - RNA, 17 nt, Human herpesvirus 6B
cugauuuguucuagugc

SEQ ID NO: 2043596 - RNA, 14 nt, Human herpesvirus 6B
aggcacugauuuga

SEQ ID NO: 2043597 - RNA, 16 nt, Human herpesvirus 6B
ugacacacagaauaca

SEQ ID NO: 2043598 - RNA, 19 nt, Human herpesvirus 6B
gugauaccgucuuugcaua

SEQ ID NO: 2043599 - RNA, 21 nt, Human herpesvirus 6B
ccacauuagcugcuaaaugug

SEQ ID NO: 2043600 - RNA, 22 nt, Human herpesvirus 6B
cuggcgggcaccgagggcgggc

SEQ ID NO: 2043601 - RNA, 18 nt, Human herpesvirus 6B
cacccauauacccucgcc

SEQ ID NO: 2043602 - RNA, 21 nt, Human herpesvirus 6B
ccgcuccggacccuccacgcc

SEQ ID NO: 2043603 - RNA, 17 nt, Human herpesvirus 6B
uaaauaauaguaaacuu

SEQ ID NO: 2043604 - RNA, 22 nt, Human herpesvirus 6B
uuuagccuauuaagcagccgcg

SEQ ID NO: 2043605 - RNA, 16 nt, Human herpesvirus 6B
aaauauggcagagcug

SEQ ID NO: 2043606 - RNA, 22 nt, Human herpesvirus 6B
gcaacuaagcuguaugacaucu

SEQ ID NO: 2043607 - RNA, 18 nt, Human herpesvirus 6B
guucgcgagucugugcuu

SEQ ID NO: 2043608 - RNA, 18 nt, Human herpesvirus 6B
ucaaggucaaaaaacuca

SEQ ID NO: 2043609 - RNA, 12 nt, Human herpesvirus 6B
uuucuuugacau

SEQ ID NO: 2043610 - RNA, 14 nt, Human herpesvirus 6B
gaaauauggcuaau

SEQ ID NO: 2043611 - RNA, 22 nt, Human herpesvirus 6B
ggauuccccucauacauccaga

SEQ ID NO: 2043612 - RNA, 18 nt, Human herpesvirus 6B
cguccucgugcucuccgc

SEQ ID NO: 2043613 - RNA, 17 nt, Human herpesvirus 6B
agggucagcagaagaag

SEQ ID NO: 2043614 - RNA, 15 nt, Human herpesvirus 6B
acagaaaaagaacug

SEQ ID NO: 2043615 - RNA, 10 nt, Human herpesvirus 6B
gccagccgcc

SEQ ID NO: 2043616 - RNA, 14 nt, Human herpesvirus 6B
ggaagagaaugaau

SEQ ID NO: 2043617 - RNA, 20 nt, Human herpesvirus 6B
uacagcuaagauuaacaacu

SEQ ID NO: 2043618 - RNA, 16 nt, Human herpesvirus 6B
cagaauuacaaacugg

SEQ ID NO: 2043619 - RNA, 15 nt, Human herpesvirus 6B
ccucgugcucuccgc

SEQ ID NO: 2043620 - RNA, 18 nt, Human herpesvirus 6B
uguuccgaauucuuacca

SEQ ID NO: 2043621 - RNA, 16 nt, Human herpesvirus 6B
agaaaauugacaauga

SEQ ID NO: 2043622 - RNA, 19 nt, Human herpesvirus 6B
cgggcagggcgggcacgga

SEQ ID NO: 2043623 - RNA, 20 nt, Human herpesvirus 6B
cguauacgaacaauauggcc

SEQ ID NO: 2043624 - RNA, 19 nt, Human herpesvirus 6B
cugaugacuuuucugauga

SEQ ID NO: 2043625 - RNA, 14 nt, Human herpesvirus 6B
ugcuccuguuucua

SEQ ID NO: 2043626 - RNA, 13 nt, Human herpesvirus 6B
guggcagaagaag

SEQ ID NO: 2043627 - RNA, 18 nt, Human herpesvirus 6B
cuccugugcguccuccuc

SEQ ID NO: 2043628 - RNA, 17 nt, Human herpesvirus 6B
ccagucagauaaugaau

SEQ ID NO: 2043629 - RNA, 16 nt, Human herpesvirus 6B
cuuggggauauugugg

SEQ ID NO: 2043630 - RNA, 22 nt, Human herpesvirus 6B
ggagggacccacacgcggggau

SEQ ID NO: 2043631 - RNA, 23 nt, Human herpesvirus 6B
agaauuccaaggcucuggcaaag

SEQ ID NO: 2043632 - RNA, 18 nt, Human herpesvirus 6B
caugugguaauacgugaa

SEQ ID NO: 2043633 - RNA, 16 nt, Human herpesvirus 6B
aacaucaaaaacaccg

SEQ ID NO: 2043634 - RNA, 21 nt, Human herpesvirus 6B
augagaauauauaaaaaaaac

SEQ ID NO: 2043635 - RNA, 14 nt, Human herpesvirus 6B
aaaauguguuaauu

SEQ ID NO: 2043636 - RNA, 14 nt, Human herpesvirus 6B
ugcucuuagagaua

SEQ ID NO: 2043637 - RNA, 21 nt, Human herpesvirus 6B
gaagaaauaccuuuggccuug

SEQ ID NO: 2043638 - RNA, 18 nt, Human herpesvirus 6B
ccauagaguuucgagaaa

SEQ ID NO: 2043639 - RNA, 21 nt, Human herpesvirus 6B
aagagcuuuaaagcagcuaga

SEQ ID NO: 2043640 - RNA, 16 nt, Human herpesvirus 6B
uuacaugaaaacauuc

SEQ ID NO: 2043641 - RNA, 19 nt, Human herpesvirus 6B
caaauguagcaaaugaaug

SEQ ID NO: 2043642 - RNA, 19 nt, Human herpesvirus 6B
uaaagaucacaacaaacau

SEQ ID NO: 2043643 - RNA, 15 nt, Human herpesvirus 6B
caguaaaaaagccga

SEQ ID NO: 2043644 - RNA, 15 nt, Human herpesvirus 6B
gguucagacugcugc

SEQ ID NO: 2043645 - RNA, 23 nt, Human herpesvirus 6B
agucuucauccucgaagaauugu

SEQ ID NO: 2043646 - RNA, 21 nt, Human herpesvirus 6B
caucgaugauuuuucugccua

SEQ ID NO: 2043647 - RNA, 19 nt, Human herpesvirus 6B
ucuuuccgaugugucugaa

SEQ ID NO: 2043648 - RNA, 20 nt, Human herpesvirus 6B
acgugacuguaucaaauuua

SEQ ID NO: 2043649 - RNA, 18 nt, Human herpesvirus 6B
ggaucgggccuggggaca

SEQ ID NO: 2043650 - RNA, 21 nt, Human herpesvirus 6B
aaaacgagcgacgguuuccaa

SEQ ID NO: 2043651 - RNA, 19 nt, Human herpesvirus 6B
gacgugcggagaugccgug

SEQ ID NO: 2043652 - RNA, 14 nt, Human herpesvirus 6B
uuauuguguucugc

SEQ ID NO: 2043653 - RNA, 14 nt, Human herpesvirus 6B
cagagugucucuca

SEQ ID NO: 2043654 - RNA, 13 nt, Human herpesvirus 6B
aagcuuucuguac

SEQ ID NO: 2043655 - RNA, 16 nt, Human herpesvirus 6B
cauugagguauuggau

SEQ ID NO: 2043656 - RNA, 19 nt, Human herpesvirus 6B
uucuugcgauuuugugaaa

SEQ ID NO: 2043657 - RNA, 17 nt, Human herpesvirus 6B
guuacccgggagcuuca

SEQ ID NO: 2043658 - RNA, 16 nt, Human herpesvirus 6B
uguaauuguugaaauu

SEQ ID NO: 2043659 - RNA, 22 nt, Human herpesvirus 6B
acuuuuugccgaagauagcucu

SEQ ID NO: 2043660 - RNA, 17 nt, Human herpesvirus 6B
aauguugucaaucgugu

SEQ ID NO: 2043661 - RNA, 18 nt, Human herpesvirus 6B
gaugccaaagcuuucugu

SEQ ID NO: 2043662 - RNA, 16 nt, Human herpesvirus 6B
cugagcaaagaaauga

SEQ ID NO: 2043663 - RNA, 22 nt, Human herpesvirus 6B
ccccacucgaaucgcgcaggcg

SEQ ID NO: 2043664 - RNA, 21 nt, Human herpesvirus 6B
aacacaauauaugaaauacug

SEQ ID NO: 2043665 - RNA, 14 nt, Human herpesvirus 6B
cgucguggcagaac

SEQ ID NO: 2043666 - RNA, 19 nt, Human herpesvirus 6B
cuccgcgagacgguacagc

SEQ ID NO: 2043667 - RNA, 22 nt, Human herpesvirus 6B
uaaagugccgugagugcuauuu

SEQ ID NO: 2043668 - RNA, 12 nt, Human herpesvirus 6B
ggucagaugcaa

SEQ ID NO: 2043669 - RNA, 15 nt, Human herpesvirus 6B
gucgcauagaucggg

SEQ ID NO: 2043670 - RNA, 23 nt, Human herpesvirus 6B
ucuuuauagagcaauucaucaaa

SEQ ID NO: 2043671 - RNA, 13 nt, Human herpesvirus 6B
gcggccaggccgc

SEQ ID NO: 2043672 - RNA, 16 nt, Human herpesvirus 6B
acccgcguccuccauc

SEQ ID NO: 2043673 - RNA, 18 nt, Human herpesvirus 6B
acuaagugugcguuauuu

SEQ ID NO: 2043674 - RNA, 16 nt, Human herpesvirus 6B
gugauauaguuauuca

SEQ ID NO: 2043675 - RNA, 16 nt, Human herpesvirus 6B
caugcgacagacaguc

SEQ ID NO: 2043676 - RNA, 15 nt, Human herpesvirus 6B
cucccauagaggcgc

SEQ ID NO: 2043677 - RNA, 16 nt, Human herpesvirus 6B
gccgccuucucugucg

SEQ ID NO: 2043678 - RNA, 17 nt, Human herpesvirus 6B
uaaacaugauuguaaua

SEQ ID NO: 2043679 - RNA, 20 nt, Human herpesvirus 6B
cuguggaccaugcagcugcc

SEQ ID NO: 2043680 - RNA, 19 nt, Human herpesvirus 6B
aacuacuucuguuacagca

SEQ ID NO: 2043681 - RNA, 17 nt, Human herpesvirus 6B
cuaaaucugaaauguag

SEQ ID NO: 2043682 - RNA, 12 nt, Human herpesvirus 6B
ccaacugagaga

SEQ ID NO: 2043683 - RNA, 12 nt, Human herpesvirus 6B
ggcgcagaauua

SEQ ID NO: 2043684 - RNA, 20 nt, Human herpesvirus 6B
aguguuacggggaccacugu

SEQ ID NO: 2043685 - RNA, 14 nt, Human herpesvirus 6B
aaugugagcaguuu

SEQ ID NO: 2043686 - RNA, 20 nt, Human herpesvirus 6B
guuuaucaugagagagcaaa

SEQ ID NO: 2043687 - RNA, 15 nt, Human herpesvirus 6B
guuguguuuguggac

SEQ ID NO: 2043688 - RNA, 16 nt, Human herpesvirus 6B
acgaucucauaugcau

SEQ ID NO: 2043689 - RNA, 17 nt, Human herpesvirus 6B
agaucuggauaaagaua

SEQ ID NO: 2043690 - RNA, 23 nt, Human herpesvirus 6B
aacgcaaagggaagccagccgcc

SEQ ID NO: 2043691 - RNA, 17 nt, Human herpesvirus 6B
agugcguaaucgcaaga

SEQ ID NO: 2043692 - RNA, 19 nt, Human herpesvirus 6B
aaagguuuuugcugucaca

SEQ ID NO: 2043693 - RNA, 18 nt, Human herpesvirus 6B
cggagcccugagagcagg

SEQ ID NO: 2043694 - RNA, 21 nt, Human herpesvirus 6B
gauacuacguguaauguuucc

SEQ ID NO: 2043695 - RNA, 18 nt, Human herpesvirus 6B
ugaccgaauuauguaugu

SEQ ID NO: 2043696 - RNA, 19 nt, Human herpesvirus 6B
ucgcaaaagagaaggaaaa

SEQ ID NO: 2043697 - RNA, 15 nt, Human herpesvirus 6B
uccaugcgaguagau

SEQ ID NO: 2043698 - RNA, 17 nt, Human herpesvirus 6B
gcuaaacuuuacaucaa

SEQ ID NO: 2043699 - RNA, 21 nt, Human herpesvirus 6B
aucuucuuggagucuggccuc

SEQ ID NO: 2043700 - RNA, 22 nt, Human herpesvirus 6B
ucugcauuuauaucaaacuuuu

SEQ ID NO: 2043701 - RNA, 13 nt, Human herpesvirus 6B
cuugcaagaaagc

SEQ ID NO: 2043702 - RNA, 24 nt, Human herpesvirus 6B
uuuaugaaaucgauguagauguuu

SEQ ID NO: 2043703 - RNA, 23 nt, Human herpesvirus 6B
uuaaaggauucgagaaacucugu

SEQ ID NO: 2043704 - RNA, 22 nt, Human herpesvirus 6B
acgucccucacaacaaagaacu

SEQ ID NO: 2043705 - RNA, 15 nt, Human herpesvirus 6B
gaagguaucaaagaa

SEQ ID NO: 2043706 - RNA, 11 nt, Human herpesvirus 6B
aacagugacag

SEQ ID NO: 2043707 - RNA, 16 nt, Human herpesvirus 6B
uaaugagauucuguug

SEQ ID NO: 2043708 - RNA, 17 nt, Human herpesvirus 6B
aucaaacuuuuuuugaa

SEQ ID NO: 2043709 - RNA, 22 nt, Human herpesvirus 6B
agaagccaccaauagugggaga

SEQ ID NO: 2043710 - RNA, 14 nt, Human herpesvirus 6B
ucucgaaaaugcug

SEQ ID NO: 2043711 - RNA, 17 nt, Human herpesvirus 6B
gaaaagguguuguguuu

SEQ ID NO: 2043712 - RNA, 18 nt, Human herpesvirus 6B
accgguuauaauauuaac

SEQ ID NO: 2043713 - RNA, 21 nt, Human herpesvirus 6B
ucggauccaacucuacuaaaa

SEQ ID NO: 2043714 - RNA, 15 nt, Human herpesvirus 6B
aggcuacuauaaaca

SEQ ID NO: 2043715 - RNA, 21 nt, Human herpesvirus 6B
ggaauggacaugacgaaggga

SEQ ID NO: 2043716 - RNA, 15 nt, Human herpesvirus 6B
gaacagauagaaaau

SEQ ID NO: 2043717 - RNA, 14 nt, Human herpesvirus 6B
agauagaaaauugu

SEQ ID NO: 2043718 - RNA, 21 nt, Human herpesvirus 6B
uuauuuacaaaagccugcaua

SEQ ID NO: 2043719 - RNA, 14 nt, Human herpesvirus 6B
auauacccucgccc

SEQ ID NO: 2043720 - RNA, 13 nt, Human herpesvirus 6B
acaacgugugaaa

SEQ ID NO: 2043721 - RNA, 20 nt, Human herpesvirus 6B
cuuagauaugucguuucaug

SEQ ID NO: 2043722 - RNA, 22 nt, Human herpesvirus 6B
gauaacucagauucgcaagacu

SEQ ID NO: 2043723 - RNA, 22 nt, Human herpesvirus 6B
cauaacuaugaauuagcagaag

SEQ ID NO: 2043724 - RNA, 14 nt, Human herpesvirus 6B
ucuaggacaguucc

SEQ ID NO: 2043725 - RNA, 18 nt, Human herpesvirus 6B
uguugaguaauuggacau

SEQ ID NO: 2043726 - RNA, 14 nt, Human herpesvirus 6B
uuuacuugucgugu

SEQ ID NO: 2043727 - RNA, 22 nt, Human herpesvirus 6B
acgacugacgauuucauuagaa

SEQ ID NO: 2043728 - RNA, 21 nt, Human herpesvirus 6B
acaaauaaguggugaugaaua

SEQ ID NO: 2043729 - RNA, 22 nt, Human herpesvirus 6B
uagaaaaauaagacuuagcuag

SEQ ID NO: 2043730 - RNA, 17 nt, Human herpesvirus 6B
gcaggcuccccaggcgc

SEQ ID NO: 2043731 - RNA, 17 nt, Human herpesvirus 6B
cacaaagugcuguaaac

SEQ ID NO: 2043732 - RNA, 14 nt, Human herpesvirus 6B
cuggagcuagagaa

SEQ ID NO: 2043733 - RNA, 22 nt, Human herpesvirus 6B
acgcgcggaccacucgggccgg

SEQ ID NO: 2043734 - RNA, 13 nt, Human herpesvirus 6B
aucggaagaggaa

SEQ ID NO: 2043735 - RNA, 15 nt, Human herpesvirus 6B
cugcagaucuggaua

SEQ ID NO: 2043736 - RNA, 13 nt, Human herpesvirus 6B
acgacaugugguu

SEQ ID NO: 2043737 - RNA, 14 nt, Human herpesvirus 6B
acaguuugaucccu

SEQ ID NO: 2043738 - RNA, 15 nt, Human herpesvirus 6B
uuuuauuuuaucuca

SEQ ID NO: 2043739 - RNA, 15 nt, Human herpesvirus 6B
aacuguuguucuugg

SEQ ID NO: 2043740 - RNA, 12 nt, Human herpesvirus 6B
agagcgacacgg

SEQ ID NO: 2043741 - RNA, 13 nt, Human herpesvirus 6B
ccugaaaccccac

SEQ ID NO: 2043742 - RNA, 23 nt, Human herpesvirus 6B
cucucgugccguugccuuggccg

SEQ ID NO: 2043743 - RNA, 14 nt, Human herpesvirus 6B
ccgcgggccagccc

SEQ ID NO: 2043744 - RNA, 19 nt, Human herpesvirus 6B
aauaccaaaaaauguuaaa

SEQ ID NO: 2043745 - RNA, 14 nt, Human herpesvirus 6B
ccguggcagaagaa

SEQ ID NO: 2043746 - RNA, 20 nt, Human herpesvirus 6B
agguuggcgcagagaaagga

SEQ ID NO: 2043747 - RNA, 19 nt, Human herpesvirus 6B
gccguugccuuggccgcgc

SEQ ID NO: 2043748 - RNA, 13 nt, Human herpesvirus 6B
ucuccaaaacacu

SEQ ID NO: 2043749 - RNA, 15 nt, Human herpesvirus 6B
aaaguuuacugugau

SEQ ID NO: 2043750 - RNA, 13 nt, Human herpesvirus 6B
acggagaggaagc

SEQ ID NO: 2043751 - RNA, 22 nt, Human herpesvirus 6B
guaccucuaugauacuuugaaa

SEQ ID NO: 2043752 - RNA, 13 nt, Human herpesvirus 6B
cuggccucugcgg

SEQ ID NO: 2043753 - RNA, 19 nt, Human herpesvirus 6B
ggcgcccgugguggccguc

SEQ ID NO: 2043754 - RNA, 15 nt, Human herpesvirus 6B
gaugaggaggaggga

SEQ ID NO: 2043755 - RNA, 12 nt, Human herpesvirus 6B
gcaguugucugg

SEQ ID NO: 2043756 - RNA, 17 nt, Human herpesvirus 6B
cgugacacggaaaacca

SEQ ID NO: 2043757 - RNA, 16 nt, Human herpesvirus 6B
caauguucuugacaaa

SEQ ID NO: 2043758 - RNA, 16 nt, Human herpesvirus 6B
aguugguucgaacaaa

SEQ ID NO: 2043759 - RNA, 15 nt, Human herpesvirus 6B
cuugauguuuccuga

SEQ ID NO: 2043760 - RNA, 14 nt, Human herpesvirus 6B
gaauccgcgggcca

SEQ ID NO: 2043761 - RNA, 18 nt, Human herpesvirus 6B
cucaaagaaagcuccgcg

SEQ ID NO: 2043762 - RNA, 23 nt, Human herpesvirus 6B
cuauaugucagauuauaaugaug

SEQ ID NO: 2043763 - RNA, 16 nt, Human herpesvirus 6B
ugacugaggaugugua

SEQ ID NO: 2043764 - RNA, 16 nt, Human herpesvirus 6B
ugaaaaacagaauaag

SEQ ID NO: 2043765 - RNA, 14 nt, Human herpesvirus 6B
uggaagaaggaaaa

SEQ ID NO: 2043766 - RNA, 23 nt, Human herpesvirus 6B
aagaagaucacuuuguuucugaa

SEQ ID NO: 2043767 - RNA, 23 nt, Human herpesvirus 6B
ucuucuacuuuaucuuuugcaaa

SEQ ID NO: 2043768 - RNA, 14 nt, Human herpesvirus 6B
cuuaccuuuuaaga

SEQ ID NO: 2043769 - RNA, 20 nt, Human herpesvirus 6B
ggagcaggcuccccaggcgc

SEQ ID NO: 2043770 - RNA, 12 nt, Human herpesvirus 6B
gaugcucucaga

SEQ ID NO: 2043771 - RNA, 18 nt, Human herpesvirus 6B
gcgcaggcgaagguagga

SEQ ID NO: 2043772 - RNA, 15 nt, Human herpesvirus 6B
auguucgccucuccc

SEQ ID NO: 2043773 - RNA, 12 nt, Human herpesvirus 6B
ccaaaagacuau

SEQ ID NO: 2043774 - RNA, 12 nt, Human herpesvirus 6B
cuuuaaagcagc

SEQ ID NO: 2043775 - RNA, 22 nt, Human herpesvirus 6B
guuacaagcaugcauuguguua

SEQ ID NO: 2043776 - RNA, 22 nt, Human herpesvirus 6B
cucgugugucucugugaagagg

SEQ ID NO: 2043777 - RNA, 18 nt, Human herpesvirus 6B
ucuuuuacguuaaaaggg

SEQ ID NO: 2043778 - RNA, 23 nt, Human herpesvirus 6B
gucuugcaaacagcuuuauuccc

SEQ ID NO: 2043779 - RNA, 23 nt, Human herpesvirus 6B
ugcccacauuuccuucaaaguga

SEQ ID NO: 2043780 - RNA, 17 nt, Human herpesvirus 6B
uauagcuauccuuauau

SEQ ID NO: 2043781 - RNA, 15 nt, Human herpesvirus 6B
cgaaucucaagcaca

SEQ ID NO: 2043782 - RNA, 20 nt, Human herpesvirus 6B
uauguuaacauugugagaac

SEQ ID NO: 2043783 - RNA, 16 nt, Human herpesvirus 6B
uccguucccuucucgu

SEQ ID NO: 2043784 - RNA, 16 nt, Human herpesvirus 6B
ccacgggccacgagag

SEQ ID NO: 2043785 - RNA, 23 nt, Human herpesvirus 6B
ccgcuuaaaucaaaaaaaugaua

SEQ ID NO: 2043786 - RNA, 18 nt, Human herpesvirus 6B
cacguccagcgcauccuu

SEQ ID NO: 2043787 - RNA, 18 nt, Human herpesvirus 6B
auuuguucgcacaaaaug

SEQ ID NO: 2043788 - RNA, 21 nt, Human herpesvirus 6B
gucuccgauccgucaggacca

SEQ ID NO: 2043789 - RNA, 22 nt, Human herpesvirus 6B
cccgcacaguucguccagcagc

SEQ ID NO: 2043790 - RNA, 20 nt, Human herpesvirus 6B
gcuuucucgccgccucgccg

SEQ ID NO: 2043791 - RNA, 21 nt, Human herpesvirus 6B
gaugcagucuccacagggcau

SEQ ID NO: 2043792 - RNA, 12 nt, Human herpesvirus 6B
cuuggaaaaggu

SEQ ID NO: 2043793 - RNA, 14 nt, Human herpesvirus 6B
agaggucuuugcuu

SEQ ID NO: 2043794 - RNA, 13 nt, Human herpesvirus 6B
aaaagguugagaa

SEQ ID NO: 2043795 - RNA, 16 nt, Human herpesvirus 6B
aguauguuuuguacaa

SEQ ID NO: 2043796 - RNA, 21 nt, Human herpesvirus 6B
auguaaacacgaaacugcuug

SEQ ID NO: 2043797 - RNA, 13 nt, Human herpesvirus 6B
aaauauuggauuu

SEQ ID NO: 2043798 - RNA, 16 nt, Human herpesvirus 6B
uguucgagcaacaguu

SEQ ID NO: 2043799 - RNA, 18 nt, Human herpesvirus 6B
gucacucacauagagaag

SEQ ID NO: 2043800 - RNA, 14 nt, Human herpesvirus 6B
ugcuucguuucuuc

SEQ ID NO: 2043801 - RNA, 16 nt, Human herpesvirus 6B
acagaauacaaaaacg

SEQ ID NO: 2043802 - RNA, 13 nt, Human herpesvirus 6B
aaauguagcaaau

SEQ ID NO: 2043803 - RNA, 14 nt, Human herpesvirus 6B
agccggccuuggaa

SEQ ID NO: 2043804 - RNA, 18 nt, Human herpesvirus 6B
cuuugaacaucuauuauc

SEQ ID NO: 2043805 - RNA, 13 nt, Human herpesvirus 6B
ugaaagcagucag

SEQ ID NO: 2043806 - RNA, 15 nt, Human herpesvirus 6B
uaacauugugagaac

SEQ ID NO: 2043807 - RNA, 22 nt, Human herpesvirus 6B
gcaaaaugaaguacaauacuuu

SEQ ID NO: 2043808 - RNA, 23 nt, Human herpesvirus 6B
uguaaagaucacaacaaacaugu

SEQ ID NO: 2043809 - RNA, 18 nt, Human herpesvirus 6B
cugggcgcagaaggagaa

SEQ ID NO: 2043810 - RNA, 13 nt, Human herpesvirus 6B
aaaaaguuaguuu

SEQ ID NO: 2043811 - RNA, 13 nt, Human herpesvirus 6B
aacagaaaggcca

SEQ ID NO: 2043812 - RNA, 15 nt, Human herpesvirus 6B
aaggcuuaggaugua

SEQ ID NO: 2043813 - RNA, 16 nt, Human herpesvirus 6B
uaaagguuagugggua

SEQ ID NO: 2043814 - RNA, 18 nt, Human herpesvirus 6B
gaauucagcuggacagaa

SEQ ID NO: 2043815 - RNA, 19 nt, Human herpesvirus 6B
aaaucucgaugccaaagcu

SEQ ID NO: 2043816 - RNA, 18 nt, Human herpesvirus 6B
gccuuguguauuugugaa

SEQ ID NO: 2043817 - RNA, 18 nt, Human herpesvirus 6B
acgaaagacguuugcuuu

SEQ ID NO: 2043818 - RNA, 21 nt, Human herpesvirus 6B
gagugcgacaggagauagagc

SEQ ID NO: 2043819 - RNA, 22 nt, Human herpesvirus 6B
cccgcgucuccgauccgucagg

SEQ ID NO: 2043820 - RNA, 22 nt, Human herpesvirus 6B
cuguuuacucugggaaccugug

SEQ ID NO: 2043821 - RNA, 22 nt, Human herpesvirus 6B
gacgggcguuaucgacggcagc

SEQ ID NO: 2043822 - RNA, 10 nt, Human herpesvirus 6B
gcuguaguug

SEQ ID NO: 2043823 - RNA, 14 nt, Human herpesvirus 6B
ucuccgccuccucu

SEQ ID NO: 2043824 - RNA, 14 nt, Human herpesvirus 6B
guuuuauggcuggg

SEQ ID NO: 2043825 - RNA, 14 nt, Human herpesvirus 6B
cgcagcuccuuccg

SEQ ID NO: 2043826 - RNA, 17 nt, Human herpesvirus 6B
ucaagaaaccuguuuuu

SEQ ID NO: 2043827 - RNA, 22 nt, Human herpesvirus 6B
cuuuucaguauagacauuuugu

SEQ ID NO: 2043828 - RNA, 13 nt, Human herpesvirus 6B
caagcccggagaa

SEQ ID NO: 2043829 - RNA, 15 nt, Human herpesvirus 6B
cagggaaagagcacg

SEQ ID NO: 2043830 - RNA, 16 nt, Human herpesvirus 6B
cggggaggaggaggaa

SEQ ID NO: 2043831 - RNA, 13 nt, Human herpesvirus 6B
uggugauguguua

SEQ ID NO: 2043832 - RNA, 11 nt, Human herpesvirus 6B
aucuauguuuu

SEQ ID NO: 2043833 - RNA, 23 nt, Human herpesvirus 6B
gucuccgauccgucaggaccagc

SEQ ID NO: 2043834 - RNA, 18 nt, Human herpesvirus 6B
auagguuauuuacaaaag

SEQ ID NO: 2043835 - RNA, 15 nt, Human herpesvirus 6B
acgcacgagaacacg

SEQ ID NO: 2043836 - RNA, 17 nt, Human herpesvirus 6B
auuugcaauuguuugug

SEQ ID NO: 2043837 - RNA, 22 nt, Human herpesvirus 6B
caggcuccccaggcgcagcagc

SEQ ID NO: 2043838 - RNA, 12 nt, Human herpesvirus 6B
aaugagccuggc

SEQ ID NO: 2043839 - RNA, 16 nt, Human herpesvirus 6B
uuucugcgacaaaaaa

SEQ ID NO: 2043840 - RNA, 14 nt, Human herpesvirus 6B
aucaacuauacuua

SEQ ID NO: 2043841 - RNA, 16 nt, Human herpesvirus 6B
aaaaaccguugcacuu

SEQ ID NO: 2043842 - RNA, 15 nt, Human herpesvirus 6B
aaaucacuccgcauc

SEQ ID NO: 2043843 - RNA, 13 nt, Human herpesvirus 6B
uucauuucuguag

SEQ ID NO: 2043844 - RNA, 17 nt, Human herpesvirus 6B
gcacacgucccuaugau

SEQ ID NO: 2043845 - RNA, 17 nt, Human herpesvirus 6B
gaugucgcgaagcucag

SEQ ID NO: 2043846 - RNA, 20 nt, Human herpesvirus 6B
cccuccguuaggaucagaca

SEQ ID NO: 2043847 - RNA, 18 nt, Human herpesvirus 6B
cuuuguccuauguuaaca

SEQ ID NO: 2043848 - RNA, 18 nt, Human herpesvirus 6B
ugccgcguggaagccgcu

SEQ ID NO: 2043849 - RNA, 16 nt, Human herpesvirus 6B
ccuuuguaaaauguuu

SEQ ID NO: 2043850 - RNA, 20 nt, Human herpesvirus 6B
gagaauaagaucuacagagu

SEQ ID NO: 2043851 - RNA, 13 nt, Human herpesvirus 6B
ugguagcaauaac

SEQ ID NO: 2043852 - RNA, 21 nt, Human herpesvirus 6B
cuaacggagcaaccgcaguuc

SEQ ID NO: 2043853 - RNA, 23 nt, Human herpesvirus 6B
accggagcuuauuuaugaaaauu

SEQ ID NO: 2043854 - RNA, 12 nt, Human herpesvirus 6B
aguggcagggcu

SEQ ID NO: 2043855 - RNA, 15 nt, Human herpesvirus 6B
gaaaucuuuccugcu

SEQ ID NO: 2043856 - RNA, 16 nt, Human herpesvirus 6B
acagauagaucuguuu

SEQ ID NO: 2043857 - RNA, 20 nt, Human herpesvirus 6B
cccguccucgugcucuccgc

SEQ ID NO: 2043858 - RNA, 16 nt, Human herpesvirus 6B
aucagauaucugaaac

SEQ ID NO: 2043859 - RNA, 19 nt, Human herpesvirus 6B
caauuucggcaagaaagcc

SEQ ID NO: 2043860 - RNA, 16 nt, Human herpesvirus 6B
gcugucggccgaagga

SEQ ID NO: 2043861 - RNA, 16 nt, Human herpesvirus 6B
ccucgccgcucccgcu

SEQ ID NO: 2043862 - RNA, 15 nt, Human herpesvirus 6B
cucccguccguggaa

SEQ ID NO: 2043863 - RNA, 15 nt, Human herpesvirus 6B
uaauauaaauucuua

SEQ ID NO: 2043864 - RNA, 14 nt, Human herpesvirus 6B
cgcgccgucagcgg

SEQ ID NO: 2043865 - RNA, 16 nt, Human herpesvirus 6B
caguucguccagcagc

SEQ ID NO: 2043866 - RNA, 23 nt, Human herpesvirus 6B
ucccggggggggggggcccgggc

SEQ ID NO: 2043867 - RNA, 15 nt, Human herpesvirus 6B
agcguguucagcauc

SEQ ID NO: 2043868 - RNA, 16 nt, Human herpesvirus 6B
gacaucaaugcgcuau

SEQ ID NO: 2043869 - RNA, 17 nt, Human herpesvirus 6B
gugucugaaaaauggug

SEQ ID NO: 2043870 - RNA, 23 nt, Human herpesvirus 6B
cuuaaauucaauuuaaaauaauu

SEQ ID NO: 2043871 - RNA, 21 nt, Human herpesvirus 6B
acuuuguguaaccugagaauu

SEQ ID NO: 2043872 - RNA, 20 nt, Human herpesvirus 6B
uuaaaggauucgagaaacuc

SEQ ID NO: 2043873 - RNA, 18 nt, Human herpesvirus 6B
caagaaugggaugcauua

SEQ ID NO: 2043874 - RNA, 12 nt, Human herpesvirus 6B
agacuugcuaac

SEQ ID NO: 2043875 - RNA, 15 nt, Human herpesvirus 6B
aauaauuuuuguagc

SEQ ID NO: 2043876 - RNA, 21 nt, Human herpesvirus 6B
ugcgaauuaaaacucuaaaac

SEQ ID NO: 2043877 - RNA, 23 nt, Human herpesvirus 6B
cugcaacuuuauuugaaacugaa

SEQ ID NO: 2043878 - RNA, 15 nt, Human herpesvirus 6B
uacauuguuucucua

SEQ ID NO: 2043879 - RNA, 22 nt, Human herpesvirus 6B
ccugccauagaguuucgagaaa

SEQ ID NO: 2043880 - RNA, 16 nt, Human herpesvirus 6B
ucagugucagcauugu

SEQ ID NO: 2043881 - RNA, 22 nt, Human herpesvirus 6B
ccggcccguccaccgucccucu

SEQ ID NO: 2043882 - RNA, 16 nt, Human herpesvirus 6B
agggaagucaaggaaa

SEQ ID NO: 2043883 - RNA, 13 nt, Human herpesvirus 6B
uuacgacacgcuc

SEQ ID NO: 2043884 - RNA, 18 nt, Human herpesvirus 6B
ccauguucgccucucccg

SEQ ID NO: 2043885 - RNA, 14 nt, Human herpesvirus 6B
cgcgguggacggcg

SEQ ID NO: 2043886 - RNA, 16 nt, Human herpesvirus 6B
ucuuugaugaagaggu

SEQ ID NO: 2043887 - RNA, 21 nt, Human herpesvirus 6B
cuacauuuuaguauuuaugcu

SEQ ID NO: 2043888 - RNA, 15 nt, Human herpesvirus 6B
uaugucgauacaaua

SEQ ID NO: 2043889 - RNA, 16 nt, Human herpesvirus 6B
gucauaauuuuccagc

SEQ ID NO: 2043890 - RNA, 13 nt, Human herpesvirus 6B
agaaugacagaua

SEQ ID NO: 2043891 - RNA, 23 nt, Human herpesvirus 6B
aacaaugaaaauucaguuuuuau

SEQ ID NO: 2043892 - RNA, 21 nt, Human herpesvirus 6B
cugucgcccgccucucuccgc

SEQ ID NO: 2043893 - RNA, 13 nt, Human herpesvirus 6B
auuuaaguaaacu

SEQ ID NO: 2043894 - RNA, 22 nt, Human herpesvirus 6B
ugaacaaguggaaguguaaaug

SEQ ID NO: 2043895 - RNA, 14 nt, Human herpesvirus 6B
uaggaucagacaga

SEQ ID NO: 2043896 - RNA, 14 nt, Human herpesvirus 6B
aaacauagaaucuc

SEQ ID NO: 2043897 - RNA, 20 nt, Human herpesvirus 6B
guaaugcguacacugaaauu

SEQ ID NO: 2043898 - RNA, 16 nt, Human herpesvirus 6B
gagacuggacaguguu

SEQ ID NO: 2043899 - RNA, 18 nt, Human herpesvirus 6B
gaguauucgugugugaaa

SEQ ID NO: 2043900 - RNA, 22 nt, Human herpesvirus 6B
aauuucagcggucgagaaagau

SEQ ID NO: 2043901 - RNA, 20 nt, Human herpesvirus 6B
augacacaucgugaguuuuc

SEQ ID NO: 2043902 - RNA, 15 nt, Human herpesvirus 6B
uauguaugaacaggu

SEQ ID NO: 2043903 - RNA, 15 nt, Human herpesvirus 6B
cacgcgagacaucgg

SEQ ID NO: 2043904 - RNA, 12 nt, Human herpesvirus 6B
gucugcaggacu

SEQ ID NO: 2043905 - RNA, 15 nt, Human herpesvirus 6B
cuuugaacagugaca

SEQ ID NO: 2043906 - RNA, 13 nt, Human herpesvirus 6B
uagaucuguuuaa

SEQ ID NO: 2043907 - RNA, 21 nt, Human herpesvirus 6B
uacugacaccacauaacaaaa

SEQ ID NO: 2043908 - RNA, 16 nt, Human herpesvirus 6B
gacuugcccacagcug

SEQ ID NO: 2043909 - RNA, 22 nt, Human herpesvirus 6B
guggccgcuuucuuggcgcccg

SEQ ID NO: 2043910 - RNA, 11 nt, Human herpesvirus 6B
agaaauguuuu

SEQ ID NO: 2043911 - RNA, 17 nt, Human herpesvirus 6B
aagcugcuaacggagca

SEQ ID NO: 2043912 - RNA, 23 nt, Human herpesvirus 6B
gggcuccucacccugaagggacc

SEQ ID NO: 2043913 - RNA, 17 nt, Human herpesvirus 6B
gcgucuuuuguaaagau

SEQ ID NO: 2043914 - RNA, 23 nt, Human herpesvirus 6B
guauuggggaugaagguggaaac

SEQ ID NO: 2043915 - RNA, 14 nt, Human herpesvirus 6B
gucacuaucuucgc

SEQ ID NO: 2043916 - RNA, 17 nt, Human herpesvirus 6B
gcggagaggcgcgggac

SEQ ID NO: 2043917 - RNA, 16 nt, Human herpesvirus 6B
cucuggcugaaggaau

SEQ ID NO: 2043918 - RNA, 13 nt, Human herpesvirus 6B
uuguacauguuaa

SEQ ID NO: 2043919 - RNA, 23 nt, Human herpesvirus 6B
cuccgcgggaccuggcgggcacc

SEQ ID NO: 2043920 - RNA, 22 nt, Human herpesvirus 6B
caggggccguacgcgccacagc

SEQ ID NO: 2043921 - RNA, 16 nt, Human herpesvirus 6B
uuaagagugauucaag

SEQ ID NO: 2043922 - RNA, 15 nt, Human herpesvirus 6B
gccaaucauaagaaa

SEQ ID NO: 2043923 - RNA, 16 nt, Human herpesvirus 6B
uggugaccgaauuaug

SEQ ID NO: 2043924 - RNA, 14 nt, Human herpesvirus 6B
ucguuucauaccuu

SEQ ID NO: 2043925 - RNA, 21 nt, Human herpesvirus 6B
aaaaucgauacgacucaguag

SEQ ID NO: 2043926 - RNA, 15 nt, Human herpesvirus 6B
aacaauuuugauuua

SEQ ID NO: 2043927 - RNA, 20 nt, Human herpesvirus 6B
caccgucccucucaccccca

SEQ ID NO: 2043928 - RNA, 19 nt, Human herpesvirus 6B
auugucuuuucuggaaaca

SEQ ID NO: 2043929 - RNA, 20 nt, Human herpesvirus 6B
cuaguuacggggaagaucua

SEQ ID NO: 2043930 - RNA, 13 nt, Human herpesvirus 6B
gaacagagauuuu

SEQ ID NO: 2043931 - RNA, 19 nt, Human herpesvirus 6B
ccgcguggaagccgcugca

SEQ ID NO: 2043932 - RNA, 16 nt, Human herpesvirus 6B
uccuuuucaguauaga

SEQ ID NO: 2043933 - RNA, 23 nt, Human herpesvirus 6B
guccuauucagaggugcugauga

SEQ ID NO: 2043934 - RNA, 18 nt, Human herpesvirus 6B
gaagaauccgcgggccag

SEQ ID NO: 2043935 - RNA, 14 nt, Human herpesvirus 6B
cucacauagagaag

SEQ ID NO: 2043936 - RNA, 21 nt, Human herpesvirus 6B
ugaagagguucagacugcugc

SEQ ID NO: 2043937 - RNA, 14 nt, Human herpesvirus 6B
ccaacuuguuuucu

SEQ ID NO: 2043938 - RNA, 17 nt, Human herpesvirus 6B
caacggcacgagagccu

SEQ ID NO: 2043939 - RNA, 17 nt, Human herpesvirus 6B
uggagucuggccucugc

SEQ ID NO: 2043940 - RNA, 19 nt, Human herpesvirus 6B
gugcguuauuuucuguauu

SEQ ID NO: 2043941 - RNA, 14 nt, Human herpesvirus 6B
gccugaccaacaug

SEQ ID NO: 2043942 - RNA, 15 nt, Human herpesvirus 6B
cgacaaaaaaauaaa

SEQ ID NO: 2043943 - RNA, 17 nt, Human herpesvirus 6B
uaauaaaccuaacagag

SEQ ID NO: 2043944 - RNA, 23 nt, Human herpesvirus 6B
ucauuccaguccaaugaauacuu

SEQ ID NO: 2043945 - RNA, 19 nt, Human herpesvirus 6B
ugacugugaaaagugcuuu

SEQ ID NO: 2043946 - RNA, 16 nt, Human herpesvirus 6B
cuucaaaaucugcuaa

SEQ ID NO: 2043947 - RNA, 22 nt, Human herpesvirus 6B
cggaauaaugaaauuuaagaag

SEQ ID NO: 2043948 - RNA, 14 nt, Human herpesvirus 6B
aaaauaauccucuu

SEQ ID NO: 2043949 - RNA, 16 nt, Human herpesvirus 6B
aaucaaaaaaaugaua

SEQ ID NO: 2043950 - RNA, 16 nt, Human herpesvirus 6B
gcucuggcaaaggugu

SEQ ID NO: 2043951 - RNA, 17 nt, Human herpesvirus 6B
uaaacagauuuuaugcc

SEQ ID NO: 2043952 - RNA, 21 nt, Human herpesvirus 6B
ucucagcauuguugagaauuu

SEQ ID NO: 2043953 - RNA, 20 nt, Human herpesvirus 6B
uggcacugaaucagaaacug

SEQ ID NO: 2043954 - RNA, 19 nt, Human herpesvirus 6B
ucuccgucucagugucacu

SEQ ID NO: 2043955 - RNA, 16 nt, Human herpesvirus 6B
gcauuguugagaauuu

SEQ ID NO: 2043956 - RNA, 17 nt, Human herpesvirus 6B
ucuuacuuuguggaaau

SEQ ID NO: 2043957 - RNA, 22 nt, Human herpesvirus 6B
cuaaacggagacugcacagaau

SEQ ID NO: 2043958 - RNA, 17 nt, Human herpesvirus 6B
ugucgcaucaauuacuc

SEQ ID NO: 2043959 - RNA, 16 nt, Human herpesvirus 6B
agaauacgcuguguuu

SEQ ID NO: 2043960 - RNA, 12 nt, Human herpesvirus 6B
gccgguuauuag

SEQ ID NO: 2043961 - RNA, 16 nt, Human herpesvirus 6B
cguccauaggcucggc

SEQ ID NO: 2043962 - RNA, 13 nt, Human herpesvirus 6B
uauaucuggauau

SEQ ID NO: 2043963 - RNA, 13 nt, Human herpesvirus 6B
ugcuugaaagagu

SEQ ID NO: 2043964 - RNA, 21 nt, Human herpesvirus 6B
aaucuguaagauuaaauguga

SEQ ID NO: 2043965 - RNA, 14 nt, Human herpesvirus 6B
ggccgaaggauggu

SEQ ID NO: 2043966 - RNA, 19 nt, Human herpesvirus 6B
aggauguuugugacucuga

SEQ ID NO: 2043967 - RNA, 18 nt, Human herpesvirus 6B
uuaauaguuaaaaaauug

SEQ ID NO: 2043968 - RNA, 15 nt, Human herpesvirus 6B
uuugacaauaaacau

SEQ ID NO: 2043969 - RNA, 14 nt, Human herpesvirus 6B
uuaagaagaaacaa

SEQ ID NO: 2043970 - RNA, 15 nt, Human herpesvirus 6B
aacggaaacaugaac

SEQ ID NO: 2043971 - RNA, 19 nt, Human herpesvirus 6B
cuaugagaaccacagccag

SEQ ID NO: 2043972 - RNA, 18 nt, Human herpesvirus 6B
aacguugaaaaaucucua

SEQ ID NO: 2043973 - RNA, 21 nt, Human herpesvirus 6B
cacgagagccuuaucgaaaga

SEQ ID NO: 2043974 - RNA, 16 nt, Human herpesvirus 6B
uugucauucugcauuu

SEQ ID NO: 2043975 - RNA, 20 nt, Human herpesvirus 6B
gguuuugucguuuguacaug

SEQ ID NO: 2043976 - RNA, 22 nt, Human herpesvirus 6B
guaguggucguuuucgugguug

SEQ ID NO: 2043977 - RNA, 18 nt, Human herpesvirus 6B
uaacaauguuaugcaguu

SEQ ID NO: 2043978 - RNA, 16 nt, Human herpesvirus 6B
uugcgagucugucagu

SEQ ID NO: 2043979 - RNA, 22 nt, Human herpesvirus 6B
gaagagguucagacugcugcug

SEQ ID NO: 2043980 - RNA, 13 nt, Human herpesvirus 6B
aaaauaagacuua

SEQ ID NO: 2043981 - RNA, 20 nt, Human herpesvirus 6B
cguggccgucuccugcaauu

SEQ ID NO: 2043982 - RNA, 14 nt, Human herpesvirus 6B
augucgaaucucaa

SEQ ID NO: 2043983 - RNA, 16 nt, Human herpesvirus 6B
gccgcgcuggucgccg

SEQ ID NO: 2043984 - RNA, 12 nt, Human herpesvirus 6B
agugaaagcagu

SEQ ID NO: 2043985 - RNA, 22 nt, Human herpesvirus 6B
cacagaauguauauagagguuu

SEQ ID NO: 2043986 - RNA, 22 nt, Human herpesvirus 6B
uauuuacugagcaaagaaauga

SEQ ID NO: 2043987 - RNA, 22 nt, Human herpesvirus 6B
aucaugauaaauuguuuccgaa

SEQ ID NO: 2043988 - RNA, 17 nt, Human herpesvirus 6B
gccaaagcuuucuguac

SEQ ID NO: 2043989 - RNA, 12 nt, Human herpesvirus 6B
aggcucuggcaa

SEQ ID NO: 2043990 - RNA, 19 nt, Human herpesvirus 6B
auuuucguugaagaauaag

SEQ ID NO: 2043991 - RNA, 19 nt, Human herpesvirus 6B
ccggagcccugagagcagg

SEQ ID NO: 2043992 - RNA, 19 nt, Human herpesvirus 6B
aggagaaaaauuugauaua

SEQ ID NO: 2043993 - RNA, 21 nt, Human herpesvirus 6B
ggcuauuugacaauaaacaug

SEQ ID NO: 2043994 - RNA, 11 nt, Human herpesvirus 6B
ugcagaagaac

SEQ ID NO: 2043995 - RNA, 13 nt, Human herpesvirus 6B
caguauuuacuga

SEQ ID NO: 2043996 - RNA, 16 nt, Human herpesvirus 6B
auuucccaaaacguga

SEQ ID NO: 2043997 - RNA, 19 nt, Human herpesvirus 6B
cuccguuaggaucagacag

SEQ ID NO: 2043998 - RNA, 14 nt, Human herpesvirus 6B
auuuuauuuugugg

SEQ ID NO: 2043999 - RNA, 13 nt, Human herpesvirus 6B
uguuuccagaaua

SEQ ID NO: 2044000 - RNA, 13 nt, Human herpesvirus 6B
ggcuuagcuacca

SEQ ID NO: 2044001 - RNA, 14 nt, Human herpesvirus 6B
gaacagaaauuucu

SEQ ID NO: 2044002 - RNA, 17 nt, Human herpesvirus 6B
ugcuuuggauccuuugu

SEQ ID NO: 2044003 - RNA, 20 nt, Human herpesvirus 6B
cucuuagauauccauuugcu

SEQ ID NO: 2044004 - RNA, 19 nt, Human herpesvirus 6B
auguagcacacgacaaaua

SEQ ID NO: 2044005 - RNA, 14 nt, Human herpesvirus 6B
aucaaagaacagaa

SEQ ID NO: 2044006 - RNA, 20 nt, Human herpesvirus 6B
gcccucucacgcgcauuaaa

SEQ ID NO: 2044007 - RNA, 16 nt, Human herpesvirus 6B
acucucuuucaguaau

SEQ ID NO: 2044008 - RNA, 16 nt, Human herpesvirus 6B
cacuuagacacggcca

SEQ ID NO: 2044009 - RNA, 22 nt, Human herpesvirus 6B
cauuuuuuaauccauauuugga

SEQ ID NO: 2044010 - RNA, 20 nt, Human herpesvirus 6B
cacggcgaaagccagggcgu

SEQ ID NO: 2044011 - RNA, 15 nt, Human herpesvirus 6B
cgaguuuagacagag

SEQ ID NO: 2044012 - RNA, 18 nt, Human herpesvirus 6B
cacggcaacgcuccuccc

SEQ ID NO: 2044013 - RNA, 21 nt, Human herpesvirus 6B
uuaaaaaugauaacuguuuuu

SEQ ID NO: 2044014 - RNA, 14 nt, Human herpesvirus 6B
aaagcagaucgagu

SEQ ID NO: 2044015 - RNA, 22 nt, Human herpesvirus 6B
auggguacaaugccaacacugu

SEQ ID NO: 2044016 - RNA, 23 nt, Human herpesvirus 6B
acucgaggaaacgcgcugggacu

SEQ ID NO: 2044017 - RNA, 14 nt, Human herpesvirus 6B
guugggggaugggu

SEQ ID NO: 2044018 - RNA, 16 nt, Human herpesvirus 6B
gacauuuaccagagau

SEQ ID NO: 2044019 - RNA, 17 nt, Human herpesvirus 6B
ugguggccgucugucug

SEQ ID NO: 2044020 - RNA, 13 nt, Human herpesvirus 6B
agaucacucagau

SEQ ID NO: 2044021 - RNA, 18 nt, Human herpesvirus 6B
uuuucugcucaacaaugu

SEQ ID NO: 2044022 - RNA, 18 nt, Human herpesvirus 6B
gacgaagaaacgaggacg

SEQ ID NO: 2044023 - RNA, 19 nt, Human herpesvirus 6B
uguugcgauugcugcuucu

SEQ ID NO: 2044024 - RNA, 18 nt, Human herpesvirus 6B
uuuuuggcauauacaaaa

SEQ ID NO: 2044025 - RNA, 14 nt, Human herpesvirus 6B
uuaggauguaaaug

SEQ ID NO: 2044026 - RNA, 22 nt, Human herpesvirus 6B
gacaugcucgggaucacgcagg

SEQ ID NO: 2044027 - RNA, 23 nt, Human herpesvirus 6B
uaaccggcgagguuaagaugucg

SEQ ID NO: 2044028 - RNA, 16 nt, Human herpesvirus 6B
ugaggcggugucuuca

SEQ ID NO: 2044029 - RNA, 20 nt, Human herpesvirus 6B
ugguuugcuucgucaacaau

SEQ ID NO: 2044030 - RNA, 18 nt, Human herpesvirus 6B
gucuccugcaauuugaau

SEQ ID NO: 2044031 - RNA, 17 nt, Human herpesvirus 6B
aaucguguuuucuuaug

SEQ ID NO: 2044032 - RNA, 18 nt, Human herpesvirus 6B
aucgugcuuguuuuggug

SEQ ID NO: 2044033 - RNA, 13 nt, Human herpesvirus 6B
aaaacccggagaa

SEQ ID NO: 2044034 - RNA, 15 nt, Human herpesvirus 6B
acaguucguccagca

SEQ ID NO: 2044035 - RNA, 20 nt, Human herpesvirus 6B
uuauuagcauucaaguccaa

SEQ ID NO: 2044036 - RNA, 18 nt, Human herpesvirus 6B
gaauuucauagauugcac

SEQ ID NO: 2044037 - RNA, 20 nt, Human herpesvirus 6B
cuuuagauggaaaacugcag

SEQ ID NO: 2044038 - RNA, 14 nt, Human herpesvirus 6B
cguugugacagaau

SEQ ID NO: 2044039 - RNA, 19 nt, Human herpesvirus 6B
cgugguggccgucugucug

SEQ ID NO: 2044040 - RNA, 13 nt, Human herpesvirus 6B
gggaggagaggga

SEQ ID NO: 2044041 - RNA, 11 nt, Human herpesvirus 6B
acaaagguuuu

SEQ ID NO: 2044042 - RNA, 17 nt, Human herpesvirus 6B
agaaucguaguuuuguu

SEQ ID NO: 2044043 - RNA, 16 nt, Human herpesvirus 6B
ucuggugagaaagacu

SEQ ID NO: 2044044 - RNA, 15 nt, Human herpesvirus 6B
gaagccggagcccug

SEQ ID NO: 2044045 - RNA, 21 nt, Human herpesvirus 6B
uuguguagaagacaucuuaaa

SEQ ID NO: 2044046 - RNA, 19 nt, Human herpesvirus 6B
uuagacagcugcauuauua

SEQ ID NO: 2044047 - RNA, 24 nt, Human herpesvirus 6B
ggccucccuccguuaggaucagac

SEQ ID NO: 2044048 - RNA, 12 nt, Human herpesvirus 6B
uauguacagaua

SEQ ID NO: 2044049 - RNA, 23 nt, Human herpesvirus 6B
uagcauucugccgaaaagaaaga

SEQ ID NO: 2044050 - RNA, 17 nt, Human herpesvirus 6B
guuggccaagcugucuc

SEQ ID NO: 2044051 - RNA, 14 nt, Human herpesvirus 6B
agauaagagaguuu

SEQ ID NO: 2044052 - RNA, 20 nt, Human herpesvirus 6B
auugcuaagaucugucucca

SEQ ID NO: 2044053 - RNA, 13 nt, Human herpesvirus 6B
aggauuuguaaaa

SEQ ID NO: 2044054 - RNA, 20 nt, Human herpesvirus 6B
aaucuauuaauuuugaagac

SEQ ID NO: 2044055 - RNA, 23 nt, Human herpesvirus 6B
gcaagauuuuagauuuaugaggc

SEQ ID NO: 2044056 - RNA, 16 nt, Human herpesvirus 6B
gauucuguugggugau

SEQ ID NO: 2044057 - RNA, 18 nt, Human herpesvirus 6B
aagacuuagcuagacgug

SEQ ID NO: 2044058 - RNA, 14 nt, Human herpesvirus 6B
acgccuauucuaau

SEQ ID NO: 2044059 - RNA, 19 nt, Human herpesvirus 6B
acagcuuguccgaaauaca

SEQ ID NO: 2044060 - RNA, 13 nt, Human herpesvirus 6B
ccaugacugugag

SEQ ID NO: 2044061 - RNA, 15 nt, Human herpesvirus 6B
acucgcaagaacuag

SEQ ID NO: 2044062 - RNA, 13 nt, Human herpesvirus 6B
agucuaaugcaaa

SEQ ID NO: 2044063 - RNA, 15 nt, Human herpesvirus 6B
aaaaucugcuaacgg

SEQ ID NO: 2044064 - RNA, 19 nt, Human herpesvirus 6B
cucucuucaggagaagaac

SEQ ID NO: 2044065 - RNA, 20 nt, Human herpesvirus 6B
ggaccaugcagcugcccgug

SEQ ID NO: 2044066 - RNA, 17 nt, Human herpesvirus 6B
caggcgcgucggcggga

SEQ ID NO: 2044067 - RNA, 12 nt, Human herpesvirus 6B
ccagcccugaag

SEQ ID NO: 2044068 - RNA, 15 nt, Human herpesvirus 6B
uauaucaaacuuuuu

SEQ ID NO: 2044069 - RNA, 20 nt, Human herpesvirus 6B
ggacuccgagccggacagga

SEQ ID NO: 2044070 - RNA, 22 nt, Human herpesvirus 6B
caccgucccucucacccccacu

SEQ ID NO: 2044071 - RNA, 21 nt, Human herpesvirus 6B
uaaauccuagaguuguuuuua

SEQ ID NO: 2044072 - RNA, 13 nt, Human herpesvirus 6B
cccuccguccagg

SEQ ID NO: 2044073 - RNA, 12 nt, Human herpesvirus 6B
agaagcugucug

SEQ ID NO: 2044074 - RNA, 19 nt, Human herpesvirus 6B
ggagcacgagccaagggga

SEQ ID NO: 2044075 - RNA, 20 nt, Human herpesvirus 6B
gaaaucuuuuucggauuuua

SEQ ID NO: 2044076 - RNA, 14 nt, Human herpesvirus 6B
augucgggccacau

SEQ ID NO: 2044077 - RNA, 20 nt, Human herpesvirus 6B
aucugcuuuguuuucuuaug

SEQ ID NO: 2044078 - RNA, 13 nt, Human herpesvirus 6B
agaucauggugau

SEQ ID NO: 2044079 - RNA, 17 nt, Human herpesvirus 6B
agcccugaagaagaugc

SEQ ID NO: 2044080 - RNA, 19 nt, Human herpesvirus 6B
gaugagcuucaauuguuuu

SEQ ID NO: 2044081 - RNA, 12 nt, Human herpesvirus 6B
uccgcagucucu

SEQ ID NO: 2044082 - RNA, 17 nt, Human herpesvirus 6B
guuacgucuuuggacug

SEQ ID NO: 2044083 - RNA, 19 nt, Human herpesvirus 6B
ugcagcgauauggaaacac

SEQ ID NO: 2044084 - RNA, 22 nt, Human herpesvirus 6B
gagcaugucggagguggcgaau

SEQ ID NO: 2044085 - RNA, 15 nt, Human herpesvirus 6B
caccagauaggaaaa

SEQ ID NO: 2044086 - RNA, 22 nt, Human herpesvirus 6B
acagaaaaaaaaauguuuuguc

SEQ ID NO: 2044087 - RNA, 15 nt, Human herpesvirus 6B
uaucaugagagagca

SEQ ID NO: 2044088 - RNA, 16 nt, Human herpesvirus 6B
agaaucgagaucguuu

SEQ ID NO: 2044089 - RNA, 17 nt, Human herpesvirus 6B
ccgaugacuaagaaaaa

SEQ ID NO: 2044090 - RNA, 23 nt, Human herpesvirus 6B
gcucgccgucgucgcucucccuc

SEQ ID NO: 2044091 - RNA, 15 nt, Human herpesvirus 6B
agaugcgggaguuga

SEQ ID NO: 2044092 - RNA, 16 nt, Human herpesvirus 6B
gccaaucauaagaaac

SEQ ID NO: 2044093 - RNA, 16 nt, Human herpesvirus 6B
aaaacgugagguguau

SEQ ID NO: 2044094 - RNA, 23 nt, Human herpesvirus 6B
gucuuuccuacccaggcuaacga

SEQ ID NO: 2044095 - RNA, 22 nt, Human herpesvirus 6B
gcacuuguagagacgaaagcag

SEQ ID NO: 2044096 - RNA, 12 nt, Human herpesvirus 6B
gccuugauuuuu

SEQ ID NO: 2044097 - RNA, 14 nt, Human herpesvirus 6B
gauugggaugucag

SEQ ID NO: 2044098 - RNA, 22 nt, Human herpesvirus 6B
uuuaaugacguaugauuuucaa

SEQ ID NO: 2044099 - RNA, 14 nt, Human herpesvirus 6B
uuuacugcaugcua

SEQ ID NO: 2044100 - RNA, 19 nt, Human herpesvirus 6B
ucauccugaccgacuuuga

SEQ ID NO: 2044101 - RNA, 19 nt, Human herpesvirus 6B
gugauaaaucuaccugccg

SEQ ID NO: 2044102 - RNA, 16 nt, Human herpesvirus 6B
caugaaaacauucaga

SEQ ID NO: 2044103 - RNA, 15 nt, Human herpesvirus 6B
aagggacagcaguuu

SEQ ID NO: 2044104 - RNA, 20 nt, Human herpesvirus 6B
cauagaguuucgagaaagag

SEQ ID NO: 2044105 - RNA, 21 nt, Human herpesvirus 6B
aaugacauuuauuagcauuca

SEQ ID NO: 2044106 - RNA, 13 nt, Human herpesvirus 6B
gugcaaaugcuca

SEQ ID NO: 2044107 - RNA, 21 nt, Human herpesvirus 6B
aacaugacggacuuggaaaag

SEQ ID NO: 2044108 - RNA, 20 nt, Human herpesvirus 6B
uaagagauuuacuguuucuu

SEQ ID NO: 2044109 - RNA, 19 nt, Human herpesvirus 6B
uuaugacaaaaccaucuuu

SEQ ID NO: 2044110 - RNA, 13 nt, Human herpesvirus 6B
uguucguucucua

SEQ ID NO: 2044111 - RNA, 14 nt, Human herpesvirus 6B
ucuccggcgucacu

SEQ ID NO: 2044112 - RNA, 17 nt, Human herpesvirus 6B
accccccucuugcagug

SEQ ID NO: 2044113 - RNA, 18 nt, Human herpesvirus 6B
gugaaacucgggggcagu

SEQ ID NO: 2044114 - RNA, 17 nt, Human herpesvirus 6B
uguauuaaaaugugaug

SEQ ID NO: 2044115 - RNA, 18 nt, Human herpesvirus 6B
ggaucagcucagcucuga

SEQ ID NO: 2044116 - RNA, 13 nt, Human herpesvirus 6B
aggcgcagcagca

SEQ ID NO: 2044117 - RNA, 19 nt, Human herpesvirus 6B
aagcagaggucuuugcuuu

SEQ ID NO: 2044118 - RNA, 22 nt, Human herpesvirus 6B
cguuuucugcucaacaauguuc

SEQ ID NO: 2044119 - RNA, 20 nt, Human herpesvirus 6B
ggcguuaucgacggcagcgg

SEQ ID NO: 2044120 - RNA, 22 nt, Human herpesvirus 6B
ucuuaaauucaauuuaaaauaa

SEQ ID NO: 2044121 - RNA, 20 nt, Human herpesvirus 6B
auuuugacaccucauaucaa

SEQ ID NO: 2044122 - RNA, 19 nt, Human herpesvirus 6B
gaaaagugcuuuauccggc

SEQ ID NO: 2044123 - RNA, 15 nt, Human herpesvirus 6B
aggggacggacagag

SEQ ID NO: 2044124 - RNA, 21 nt, Human herpesvirus 6B
ccugcaauuugaauucugcuc

SEQ ID NO: 2044125 - RNA, 22 nt, Human herpesvirus 6B
cuuagacgaaaauuguaacuuc

SEQ ID NO: 2044126 - RNA, 22 nt, Human herpesvirus 6B
gaaaauaaaguugaauugauag

SEQ ID NO: 2044127 - RNA, 14 nt, Human herpesvirus 6B
gcagacgugagaca

SEQ ID NO: 2044128 - RNA, 14 nt, Human herpesvirus 6B
ugaaauacugugag

SEQ ID NO: 2044129 - RNA, 13 nt, Human herpesvirus 6B
cgaugcuggccug

SEQ ID NO: 2044130 - RNA, 18 nt, Human herpesvirus 6B
uccccccgccgccuucuc

SEQ ID NO: 2044131 - RNA, 18 nt, Human herpesvirus 6B
acauuucgguuuaauaga

SEQ ID NO: 2044132 - RNA, 17 nt, Human herpesvirus 6B
aaaagucguuacaguaa

SEQ ID NO: 2044133 - RNA, 20 nt, Human herpesvirus 6B
agaguggcgauaauguuauc

SEQ ID NO: 2044134 - RNA, 19 nt, Human herpesvirus 6B
auuacagcuuguccgaaau

SEQ ID NO: 2044135 - RNA, 17 nt, Human herpesvirus 6B
aacaaguuauuuaaaau

SEQ ID NO: 2044136 - RNA, 20 nt, Human herpesvirus 6B
uagguuucagacacguuuau

SEQ ID NO: 2044137 - RNA, 18 nt, Human herpesvirus 6B
uaaaucaaaaaaaugaua

SEQ ID NO: 2044138 - RNA, 20 nt, Human herpesvirus 6B
uacuuuugggauuuuucaua

SEQ ID NO: 2044139 - RNA, 21 nt, Human herpesvirus 6B
auugcacgcugggcuucagua

SEQ ID NO: 2044140 - RNA, 22 nt, Human herpesvirus 6B
gaauauauagaagaagaaauac

SEQ ID NO: 2044141 - RNA, 22 nt, Human herpesvirus 6B
guuaauaguuacuuugauguua

SEQ ID NO: 2044142 - RNA, 18 nt, Human herpesvirus 6B
uuuacaaucaucugguaa

SEQ ID NO: 2044143 - RNA, 19 nt, Human herpesvirus 6B
gggagccguggugcgccug

SEQ ID NO: 2044144 - RNA, 14 nt, Human herpesvirus 6B
ucaaccugaaaaga

SEQ ID NO: 2044145 - RNA, 13 nt, Human herpesvirus 6B
uuccaaagauucu

SEQ ID NO: 2044146 - RNA, 13 nt, Human herpesvirus 6B
cuugaauguuuaa

SEQ ID NO: 2044147 - RNA, 20 nt, Human herpesvirus 6B
ucuccacagggcauagaaag

SEQ ID NO: 2044148 - RNA, 14 nt, Human herpesvirus 6B
ucuucauccucgaa

SEQ ID NO: 2044149 - RNA, 16 nt, Human herpesvirus 6B
auuugacuguagaaaa

SEQ ID NO: 2044150 - RNA, 13 nt, Human herpesvirus 6B
aguuucauccuga

SEQ ID NO: 2044151 - RNA, 21 nt, Human herpesvirus 6B
aauuuuuuucuccugaucuca

SEQ ID NO: 2044152 - RNA, 16 nt, Human herpesvirus 6B
caaagggaagccagcc

SEQ ID NO: 2044153 - RNA, 18 nt, Human herpesvirus 6B
uuucaccccccucuugca

SEQ ID NO: 2044154 - RNA, 22 nt, Human herpesvirus 6B
cugugaggugauuugaacagag

SEQ ID NO: 2044155 - RNA, 21 nt, Human herpesvirus 6B
guaaccugagaauuuucgaaa

SEQ ID NO: 2044156 - RNA, 19 nt, Human herpesvirus 6B
gaauguguucauagagcau

SEQ ID NO: 2044157 - RNA, 22 nt, Human herpesvirus 6B
gaagacaucuuaaauuucuaug

SEQ ID NO: 2044158 - RNA, 19 nt, Human herpesvirus 6B
cagaucuugaaaagccccu

SEQ ID NO: 2044159 - RNA, 14 nt, Human herpesvirus 6B
uauuaagaaugaau

SEQ ID NO: 2044160 - RNA, 14 nt, Human herpesvirus 6B
cuuaacaagagagg

SEQ ID NO: 2044161 - RNA, 11 nt, Human herpesvirus 6B
gauaaacugua

SEQ ID NO: 2044162 - RNA, 18 nt, Human herpesvirus 6B
cagagaucagcaugggca

SEQ ID NO: 2044163 - RNA, 13 nt, Human herpesvirus 6B
gaugccaaagcuu

SEQ ID NO: 2044164 - RNA, 14 nt, Human herpesvirus 6B
ugacugacaaggua

SEQ ID NO: 2044165 - RNA, 17 nt, Human herpesvirus 6B
ucccuccaucccccucc

SEQ ID NO: 2044166 - RNA, 14 nt, Human herpesvirus 6B
ucaagaaacacuuc

SEQ ID NO: 2044167 - RNA, 14 nt, Human herpesvirus 6B
cgucccuucuccgu

SEQ ID NO: 2044168 - RNA, 21 nt, Human herpesvirus 6B
uguaagcgaauugguuugcuu

SEQ ID NO: 2044169 - RNA, 20 nt, Human herpesvirus 6B
cggcggaagugaaagcaguc

SEQ ID NO: 2044170 - RNA, 20 nt, Human herpesvirus 6B
ugugauuccuucggggacag

SEQ ID NO: 2044171 - RNA, 19 nt, Human herpesvirus 6B
caucccuuaaaaaaacaca

SEQ ID NO: 2044172 - RNA, 15 nt, Human herpesvirus 6B
ccgcagaggcggcga

SEQ ID NO: 2044173 - RNA, 20 nt, Human herpesvirus 6B
acaaguacuacguguugcuu

SEQ ID NO: 2044174 - RNA, 17 nt, Human herpesvirus 6B
acaccgacacgucucca

SEQ ID NO: 2044175 - RNA, 20 nt, Human herpesvirus 6B
ccuguucgauguacaguuuc

SEQ ID NO: 2044176 - RNA, 15 nt, Human herpesvirus 6B
caauuugaauucugc

SEQ ID NO: 2044177 - RNA, 22 nt, Human herpesvirus 6B
auggauuacaagggaaauccua

SEQ ID NO: 2044178 - RNA, 14 nt, Human herpesvirus 6B
uuacgucuuuggac

SEQ ID NO: 2044179 - RNA, 20 nt, Human herpesvirus 6B
cacaguugcgugagcaagga

SEQ ID NO: 2044180 - RNA, 19 nt, Human herpesvirus 6B
auuucguauguuuaacuaa

SEQ ID NO: 2044181 - RNA, 20 nt, Human herpesvirus 6B
cuccgaaccacaucuuuucc

SEQ ID NO: 2044182 - RNA, 23 nt, Human herpesvirus 6B
uuccaaaagagaaagaacuuuug

SEQ ID NO: 2044183 - RNA, 13 nt, Human herpesvirus 6B
uccccucauacau

SEQ ID NO: 2044184 - RNA, 19 nt, Human herpesvirus 6B
ugcucuccgcgcugcuggg

SEQ ID NO: 2044185 - RNA, 17 nt, Human herpesvirus 6B
gacugcguuacaagcau

SEQ ID NO: 2044186 - RNA, 14 nt, Human herpesvirus 6B
caaguuuuuaugca

SEQ ID NO: 2044187 - RNA, 18 nt, Human herpesvirus 6B
caugugaacaaguggaag

SEQ ID NO: 2044188 - RNA, 20 nt, Human herpesvirus 6B
gaaaguuuuggaaaauguaa

SEQ ID NO: 2044189 - RNA, 13 nt, Human herpesvirus 6B
uacuguaaacaaa

SEQ ID NO: 2044190 - RNA, 13 nt, Human herpesvirus 6B
caggcuccccagg

SEQ ID NO: 2044191 - RNA, 16 nt, Human herpesvirus 6B
auggaaacacuuucuu

SEQ ID NO: 2044192 - RNA, 20 nt, Human herpesvirus 6B
agauucauaauaggcaauuu

SEQ ID NO: 2044193 - RNA, 16 nt, Human herpesvirus 6B
aagcccggagaacuga

SEQ ID NO: 2044194 - RNA, 14 nt, Human herpesvirus 6B
aaaagcgccugccu

SEQ ID NO: 2044195 - RNA, 22 nt, Human herpesvirus 6B
acuuccucgcgguauaaugcau

SEQ ID NO: 2044196 - RNA, 16 nt, Human herpesvirus 6B
cuuagaaccaaucugu

SEQ ID NO: 2044197 - RNA, 20 nt, Human herpesvirus 6B
uuccuucaggcgcaaaccaa

SEQ ID NO: 2044198 - RNA, 18 nt, Human herpesvirus 6B
auuuuuuugaaaucacuc

SEQ ID NO: 2044199 - RNA, 20 nt, Human herpesvirus 6B
cucgguccccccucccucca

SEQ ID NO: 2044200 - RNA, 21 nt, Human herpesvirus 6B
aauaacgguguugaguuuauc

SEQ ID NO: 2044201 - RNA, 16 nt, Human herpesvirus 6B
cuguaaaccaguaucu

SEQ ID NO: 2044202 - RNA, 20 nt, Human herpesvirus 6B
aggagccaacauacacacga

SEQ ID NO: 2044203 - RNA, 15 nt, Human herpesvirus 6B
aguuuucaugugaaa

SEQ ID NO: 2044204 - RNA, 23 nt, Human herpesvirus 6B
auucuguugggugaucauaggac

SEQ ID NO: 2044205 - RNA, 12 nt, Human herpesvirus 6B
uugugagaacag

SEQ ID NO: 2044206 - RNA, 15 nt, Human herpesvirus 6B
aacgcaggagaaacu

SEQ ID NO: 2044207 - RNA, 22 nt, Human herpesvirus 6B
accccuuaugcaacugcauuuu

SEQ ID NO: 2044208 - RNA, 18 nt, Human herpesvirus 6B
agaucacaacaaacaugu

SEQ ID NO: 2044209 - RNA, 20 nt, Human herpesvirus 6B
cgagccggacaggaggugcg

SEQ ID NO: 2044210 - RNA, 13 nt, Human herpesvirus 6B
gaauacagcugca

SEQ ID NO: 2044211 - RNA, 11 nt, Human herpesvirus 6B
gcccugagagc

SEQ ID NO: 2044212 - RNA, 16 nt, Human herpesvirus 6B
gcuaggcuuaaugaau

SEQ ID NO: 2044213 - RNA, 15 nt, Human herpesvirus 6B
gacucugucuuaguu

SEQ ID NO: 2044214 - RNA, 18 nt, Human herpesvirus 6B
aauaacgguguugaguuu

SEQ ID NO: 2044215 - RNA, 16 nt, Human herpesvirus 6B
gccaaagcuuucugua

SEQ ID NO: 2044216 - RNA, 12 nt, Human herpesvirus 6B
guugcuguaguu

SEQ ID NO: 2044217 - RNA, 13 nt, Human herpesvirus 6B
caggcgcagcagc

SEQ ID NO: 2044218 - RNA, 21 nt, Human herpesvirus 6B
agaauaaaccggaugugcaaa

SEQ ID NO: 2044219 - RNA, 23 nt, Human herpesvirus 6B
ucucacggccauuuaacggaacc

SEQ ID NO: 2044220 - RNA, 23 nt, Human herpesvirus 6B
cagggcauagaaagcggccaggc

SEQ ID NO: 2044221 - RNA, 14 nt, Human herpesvirus 6B
gaccucgcgggaag

SEQ ID NO: 2044222 - RNA, 17 nt, Human herpesvirus 6B
auguucuugacaaauaa

SEQ ID NO: 2044223 - RNA, 13 nt, Human herpesvirus 6B
ucuuccuucucgu

SEQ ID NO: 2044224 - RNA, 17 nt, Human herpesvirus 6B
caauaccaaaaaauguu

SEQ ID NO: 2044225 - RNA, 14 nt, Human herpesvirus 6B
agaguacggaagug

SEQ ID NO: 2044226 - RNA, 17 nt, Human herpesvirus 6B
auacgggaaaagaucaa

SEQ ID NO: 2044227 - RNA, 21 nt, Human herpesvirus 6B
gcugccauuauugauagcauu

SEQ ID NO: 2044228 - RNA, 15 nt, Human herpesvirus 6B
aucucuagguaaacu

SEQ ID NO: 2044229 - RNA, 19 nt, Human herpesvirus 6B
uagcaccccacaaaacuua

SEQ ID NO: 2044230 - RNA, 21 nt, Human herpesvirus 6B
gaaucucuguuccucaugaac

SEQ ID NO: 2044231 - RNA, 14 nt, Human herpesvirus 6B
cgauguacaguuuc

SEQ ID NO: 2044232 - RNA, 20 nt, Human herpesvirus 6B
aguaagccuauugacaugau

SEQ ID NO: 2044233 - RNA, 14 nt, Human herpesvirus 6B
agucucaaaaauua

SEQ ID NO: 2044234 - RNA, 15 nt, Human herpesvirus 6B
ucuucauucuucgaa

SEQ ID NO: 2044235 - RNA, 21 nt, Human herpesvirus 6B
aauaccaaaaaauguuaaaaa

SEQ ID NO: 2044236 - RNA, 20 nt, Human herpesvirus 6B
auuccguugugacagaauua

SEQ ID NO: 2044237 - RNA, 12 nt, Human herpesvirus 6B
uuacagaugucu

SEQ ID NO: 2044238 - RNA, 23 nt, Human herpesvirus 6B
auuucuagcgaucauaaaacugc

SEQ ID NO: 2044239 - RNA, 12 nt, Human herpesvirus 6B
cucuugcagugg

SEQ ID NO: 2044240 - RNA, 19 nt, Human herpesvirus 6B
ccgcggcgcugggcuccuc

SEQ ID NO: 2044241 - RNA, 23 nt, Human herpesvirus 6B
cgaggguuuuuuccgaaaacuag

SEQ ID NO: 2044242 - RNA, 19 nt, Human herpesvirus 6B
augucguuucaugggagaa

SEQ ID NO: 2044243 - RNA, 19 nt, Human herpesvirus 6B
gcagagccguuagaaaaau

SEQ ID NO: 2044244 - RNA, 22 nt, Human herpesvirus 6B
auuuggaagcgaaucgcuuaaa

SEQ ID NO: 2044245 - RNA, 13 nt, Human herpesvirus 6B
gccuauuucucuu

SEQ ID NO: 2044246 - RNA, 13 nt, Human herpesvirus 6B
cgauuaaugccac

SEQ ID NO: 2044247 - RNA, 14 nt, Human herpesvirus 6B
uacgaagacaagcc

SEQ ID NO: 2044248 - RNA, 19 nt, Human herpesvirus 6B
ggcgaggggacggacagag

SEQ ID NO: 2044249 - RNA, 18 nt, Human herpesvirus 6B
auggcagaucuugaaaag

SEQ ID NO: 2044250 - RNA, 16 nt, Human herpesvirus 6B
acuuuuuucuaaaacc

SEQ ID NO: 2044251 - RNA, 16 nt, Human herpesvirus 6B
augcaaucugugggaa

SEQ ID NO: 2044252 - RNA, 14 nt, Human herpesvirus 6B
gcucagauguggaa

SEQ ID NO: 2044253 - RNA, 21 nt, Human herpesvirus 6B
caauugcugcuggguguaugu

SEQ ID NO: 2044254 - RNA, 18 nt, Human herpesvirus 6B
aaugaugcauacagcaug

SEQ ID NO: 2044255 - RNA, 16 nt, Human herpesvirus 6B
ugggaaccugugaaca

SEQ ID NO: 2044256 - RNA, 20 nt, Human herpesvirus 6B
gcggaagggcucuguuacua

SEQ ID NO: 2044257 - RNA, 15 nt, Human herpesvirus 6B
acgccauccacccau

SEQ ID NO: 2044258 - RNA, 12 nt, Human herpesvirus 6B
ugaaugugcuuu

SEQ ID NO: 2044259 - RNA, 15 nt, Human herpesvirus 6B
uuaguaauuuggauu

SEQ ID NO: 2044260 - RNA, 22 nt, Human herpesvirus 6B
uguauuguagcagcuggcgaaa

SEQ ID NO: 2044261 - RNA, 21 nt, Human herpesvirus 6B
cuguucgauguacaguuucuc

SEQ ID NO: 2044262 - RNA, 15 nt, Human herpesvirus 6B
gguuagaucugggga

SEQ ID NO: 2044263 - RNA, 21 nt, Human herpesvirus 6B
uccagaagacugcuccaguca

SEQ ID NO: 2044264 - RNA, 11 nt, Human herpesvirus 6B
guauuuccugu

SEQ ID NO: 2044265 - RNA, 20 nt, Human herpesvirus 6B
cucaaacuuuuagagacuuu

SEQ ID NO: 2044266 - RNA, 21 nt, Human herpesvirus 6B
cugagauucgccaccuccgac

SEQ ID NO: 2044267 - RNA, 20 nt, Human herpesvirus 6B
guuagauaaugagauucugu

SEQ ID NO: 2044268 - RNA, 22 nt, Human herpesvirus 6B
aacacccgaugaggaaaaacgu

SEQ ID NO: 2044269 - RNA, 14 nt, Human herpesvirus 6B
acacuggcgaaggc

SEQ ID NO: 2044270 - RNA, 15 nt, Human herpesvirus 6B
aacaugauuguaaua

SEQ ID NO: 2044271 - RNA, 15 nt, Human herpesvirus 6B
accgacuuugaaauc

SEQ ID NO: 2044272 - RNA, 18 nt, Human herpesvirus 6B
cugauccaugagcacccg

SEQ ID NO: 2044273 - RNA, 21 nt, Human herpesvirus 6B
gaggugauugcuucauuucug

SEQ ID NO: 2044274 - RNA, 16 nt, Human herpesvirus 6B
ugguuugcuuuggauc

SEQ ID NO: 2044275 - RNA, 16 nt, Human herpesvirus 6B
gaagccggagcccuga

SEQ ID NO: 2044276 - RNA, 19 nt, Human herpesvirus 6B
acuuucuucgccuguaaag

SEQ ID NO: 2044277 - RNA, 18 nt, Human herpesvirus 6B
aggggcuaccgucuugga

SEQ ID NO: 2044278 - RNA, 12 nt, Human herpesvirus 6B
ugugauaugcaa

SEQ ID NO: 2044279 - RNA, 20 nt, Human herpesvirus 6B
uaugaacaggugcuucuuuu

SEQ ID NO: 2044280 - RNA, 19 nt, Human herpesvirus 6B
guagugcggcgguaaacaa

SEQ ID NO: 2044281 - RNA, 21 nt, Human herpesvirus 6B
cgcgcggaccacucgggccgg

SEQ ID NO: 2044282 - RNA, 13 nt, Human herpesvirus 6B
uuuauccggccaa

SEQ ID NO: 2044283 - RNA, 14 nt, Human herpesvirus 6B
cuuccccaagcaaa

SEQ ID NO: 2044284 - RNA, 20 nt, Human herpesvirus 6B
acauguuuuugauguuuuca

SEQ ID NO: 2044285 - RNA, 22 nt, Human herpesvirus 6B
gcuaagauuaacaacugccgcc

SEQ ID NO: 2044286 - RNA, 20 nt, Human herpesvirus 6B
acccaauuuugguacaauuu

SEQ ID NO: 2044287 - RNA, 16 nt, Human herpesvirus 6B
cuguaccccaagugaa

SEQ ID NO: 2044288 - RNA, 22 nt, Human herpesvirus 6B
ugucgcagaaucaagaaacacu

SEQ ID NO: 2044289 - RNA, 12 nt, Human herpesvirus 6B
uuuuggugaaaa

SEQ ID NO: 2044290 - RNA, 19 nt, Human herpesvirus 6B
uauugcuaaagaguaugac

SEQ ID NO: 2044291 - RNA, 17 nt, Human herpesvirus 6B
uaacgcggcaaccgcag

SEQ ID NO: 2044292 - RNA, 18 nt, Human herpesvirus 6B
ucgaaaugcauagaaguu

SEQ ID NO: 2044293 - RNA, 22 nt, Human herpesvirus 6B
ccaggcaccauguucgccucuc

SEQ ID NO: 2044294 - RNA, 21 nt, Human herpesvirus 6B
auuaaaaauaaaaaaaaugaa

SEQ ID NO: 2044295 - RNA, 18 nt, Human herpesvirus 6B
caaugacuggccaaucau

SEQ ID NO: 2044296 - RNA, 23 nt, Human herpesvirus 6B
uggucaagggcaagguucucagc

SEQ ID NO: 2044297 - RNA, 18 nt, Human herpesvirus 6B
gaagccuggaagaaggaa

SEQ ID NO: 2044298 - RNA, 16 nt, Human herpesvirus 6B
uccgucaucuagagaa

SEQ ID NO: 2044299 - RNA, 14 nt, Human herpesvirus 6B
gccuggggacagac

SEQ ID NO: 2044300 - RNA, 13 nt, Human herpesvirus 6B
cuucuuuuggaug

SEQ ID NO: 2044301 - RNA, 14 nt, Human herpesvirus 6B
aggucaaaaaacuc

SEQ ID NO: 2044302 - RNA, 20 nt, Human herpesvirus 6B
aacaaugaaaauucaguuuu

SEQ ID NO: 2044303 - RNA, 14 nt, Human herpesvirus 6B
agcgucaaacacuc

SEQ ID NO: 2044304 - RNA, 22 nt, Human herpesvirus 6B
gcuuguuuugguggacaccaau

SEQ ID NO: 2044305 - RNA, 19 nt, Human herpesvirus 6B
cucgccguuuuuguuugac

SEQ ID NO: 2044306 - RNA, 18 nt, Human herpesvirus 6B
ugcuggguguauguuucu

SEQ ID NO: 2044307 - RNA, 19 nt, Human herpesvirus 6B
aauuuccggucaacuucua

SEQ ID NO: 2044308 - RNA, 20 nt, Human herpesvirus 6B
uccucuuuuccccccgccgc

SEQ ID NO: 2044309 - RNA, 18 nt, Human herpesvirus 6B
uccuccgcaaguuuucag

SEQ ID NO: 2044310 - RNA, 14 nt, Human herpesvirus 6B
agccgcccuccccg

SEQ ID NO: 2044311 - RNA, 17 nt, Human herpesvirus 6B
auguagcacacgacaaa

SEQ ID NO: 2044312 - RNA, 22 nt, Human herpesvirus 6B
aaugacgaccauacguggugau

SEQ ID NO: 2044313 - RNA, 21 nt, Human herpesvirus 6B
uugcauauuauaaggucauuu

SEQ ID NO: 2044314 - RNA, 15 nt, Human herpesvirus 6B
ugacuacugugucca

SEQ ID NO: 2044315 - RNA, 18 nt, Human herpesvirus 6B
ccgcauacacccugccga

SEQ ID NO: 2044316 - RNA, 14 nt, Human herpesvirus 6B
ggagcuuuuucaaa

SEQ ID NO: 2044317 - RNA, 14 nt, Human herpesvirus 6B
uauaaauguagcac

SEQ ID NO: 2044318 - RNA, 18 nt, Human herpesvirus 6B
auuuauaccaaacgugaa

SEQ ID NO: 2044319 - RNA, 13 nt, Human herpesvirus 6B
acgcaaagggaag

SEQ ID NO: 2044320 - RNA, 20 nt, Human herpesvirus 6B
agggaggagagggagaaacg

SEQ ID NO: 2044321 - RNA, 17 nt, Human herpesvirus 6B
gugaucauaggacagag

SEQ ID NO: 2044322 - RNA, 15 nt, Human herpesvirus 6B
aauguucuucugaaa

SEQ ID NO: 2044323 - RNA, 15 nt, Human herpesvirus 6B
augacgaagggagug

SEQ ID NO: 2044324 - RNA, 14 nt, Human herpesvirus 6B
uggcgggcaccgag

SEQ ID NO: 2044325 - RNA, 13 nt, Human herpesvirus 6B
auggggcuacuac

SEQ ID NO: 2044326 - RNA, 21 nt, Human herpesvirus 6B
auuuggcagccucuugugcaa

SEQ ID NO: 2044327 - RNA, 19 nt, Human herpesvirus 6B
uauuuaaaccagucuucua

SEQ ID NO: 2044328 - RNA, 23 nt, Human herpesvirus 6B
acugugguguuugauuuucagag

SEQ ID NO: 2044329 - RNA, 20 nt, Human herpesvirus 6B
auuuaaaaaugauaacuguu

SEQ ID NO: 2044330 - RNA, 15 nt, Human herpesvirus 6B
agaauacgaacagaa

SEQ ID NO: 2044331 - RNA, 14 nt, Human herpesvirus 6B
uuagaagcauuugc

SEQ ID NO: 2044332 - RNA, 16 nt, Human herpesvirus 6B
gagacugcccuggggu

SEQ ID NO: 2044333 - RNA, 18 nt, Human herpesvirus 6B
uuugauguugucuucugu

SEQ ID NO: 2044334 - RNA, 16 nt, Human herpesvirus 6B
uguuguucuuggagac

SEQ ID NO: 2044335 - RNA, 19 nt, Human herpesvirus 6B
aguauuuaugcuucauaau

SEQ ID NO: 2044336 - RNA, 16 nt, Human herpesvirus 6B
aucaacacaccugccu

SEQ ID NO: 2044337 - RNA, 13 nt, Human herpesvirus 6B
uggggucuuuccu

SEQ ID NO: 2044338 - RNA, 17 nt, Human herpesvirus 6B
uuucuguuuuucucaua

SEQ ID NO: 2044339 - RNA, 22 nt, Human herpesvirus 6B
uaaaacggauaguuaaaaguug

SEQ ID NO: 2044340 - RNA, 21 nt, Human herpesvirus 6B
gugaguuuucaugugaaauua

SEQ ID NO: 2044341 - RNA, 15 nt, Human herpesvirus 6B
ucugcauuuauauca

SEQ ID NO: 2044342 - RNA, 22 nt, Human herpesvirus 6B
aaugagaaucguaguuuuguuc

SEQ ID NO: 2044343 - RNA, 14 nt, Human herpesvirus 6B
ucccucuucccucu

SEQ ID NO: 2044344 - RNA, 22 nt, Human herpesvirus 6B
uugaggaaaugcagcaguuuuu

SEQ ID NO: 2044345 - RNA, 23 nt, Human herpesvirus 6B
cucgccgccucgccgcucccgcu

SEQ ID NO: 2044346 - RNA, 15 nt, Human herpesvirus 6B
ggugacuacuguguc

SEQ ID NO: 2044347 - RNA, 14 nt, Human herpesvirus 6B
auuaaaguuuacug

SEQ ID NO: 2044348 - RNA, 18 nt, Human herpesvirus 6B
agaccaauuuagauucga

SEQ ID NO: 2044349 - RNA, 19 nt, Human herpesvirus 6B
caaaaaaaaaugacugaua

SEQ ID NO: 2044350 - RNA, 19 nt, Human herpesvirus 6B
guagaaacguuaauguuua

SEQ ID NO: 2044351 - RNA, 17 nt, Human herpesvirus 6B
uuaguugugcgucucuu

SEQ ID NO: 2044352 - RNA, 21 nt, Human herpesvirus 6B
guccuccgcaaguuuucagca

SEQ ID NO: 2044353 - RNA, 18 nt, Human herpesvirus 6B
acuaccgaugcucucaga

SEQ ID NO: 2044354 - RNA, 21 nt, Human herpesvirus 6B
guggaaacgguuucaaagagu

SEQ ID NO: 2044355 - RNA, 14 nt, Human herpesvirus 6B
uucgauuaugugag

SEQ ID NO: 2044356 - RNA, 12 nt, Human herpesvirus 6B
agaucaucgcca

SEQ ID NO: 2044357 - RNA, 16 nt, Human herpesvirus 6B
cgaaauauaaaaccaa

SEQ ID NO: 2044358 - RNA, 19 nt, Human herpesvirus 6B
gagggagaaacggacacgc

SEQ ID NO: 2044359 - RNA, 11 nt, Human herpesvirus 6B
uguccugagaa

SEQ ID NO: 2044360 - RNA, 15 nt, Human herpesvirus 6B
cagaucgagaauaau

SEQ ID NO: 2044361 - RNA, 21 nt, Human herpesvirus 6B
gcugcgggcuuaauaaaggau

SEQ ID NO: 2044362 - RNA, 17 nt, Human herpesvirus 6B
uauaaaugugagcaguu

SEQ ID NO: 2044363 - RNA, 17 nt, Human herpesvirus 6B
aaucgaugcuggccuga

SEQ ID NO: 2044364 - RNA, 17 nt, Human herpesvirus 6B
agggucgaacccugaga

SEQ ID NO: 2044365 - RNA, 19 nt, Human herpesvirus 6B
agugauuauggugccucag

SEQ ID NO: 2044366 - RNA, 12 nt, Human herpesvirus 6B
ggcgggcacgga

SEQ ID NO: 2044367 - RNA, 13 nt, Human herpesvirus 6B
gugucucaaccuu

SEQ ID NO: 2044368 - RNA, 19 nt, Human herpesvirus 6B
cguuacaguaaaaaagccg

SEQ ID NO: 2044369 - RNA, 18 nt, Human herpesvirus 6B
cagacaaauggaaacugg

SEQ ID NO: 2044370 - RNA, 18 nt, Human herpesvirus 6B
aaaauauuggauuuuacg

SEQ ID NO: 2044371 - RNA, 20 nt, Human herpesvirus 6B
cagggacgcuugcuguaaag

SEQ ID NO: 2044372 - RNA, 22 nt, Human herpesvirus 6B
uaccauuuuauacgaaaauaaa

SEQ ID NO: 2044373 - RNA, 14 nt, Human herpesvirus 6B
cgcagcagcagcuc

SEQ ID NO: 2044374 - RNA, 14 nt, Human herpesvirus 6B
acauagaguguuug

SEQ ID NO: 2044375 - RNA, 23 nt, Human herpesvirus 6B
gacagggggaucgacgaccaggc

SEQ ID NO: 2044376 - RNA, 14 nt, Human herpesvirus 6B
cgguccccccuccc

SEQ ID NO: 2044377 - RNA, 15 nt, Human herpesvirus 6B
uguuauaucuggaua

SEQ ID NO: 2044378 - RNA, 18 nt, Human herpesvirus 6B
cucggcgacgagccuugu

SEQ ID NO: 2044379 - RNA, 19 nt, Human herpesvirus 6B
gaaaugagcaacauuuaug

SEQ ID NO: 2044380 - RNA, 18 nt, Human herpesvirus 6B
acagagugcaucuuuaac

SEQ ID NO: 2044381 - RNA, 22 nt, Human herpesvirus 6B
ugagcagaagcugucuguguuu

SEQ ID NO: 2044382 - RNA, 18 nt, Human herpesvirus 6B
uaagacgagauguuucug

SEQ ID NO: 2044383 - RNA, 23 nt, Human herpesvirus 6B
guaucugccccccuucauccagc

SEQ ID NO: 2044384 - RNA, 17 nt, Human herpesvirus 6B
gcccucgucuguugcug

SEQ ID NO: 2044385 - RNA, 22 nt, Human herpesvirus 6B
gcugggacuccgagccggacag

SEQ ID NO: 2044386 - RNA, 15 nt, Human herpesvirus 6B
guguccugagaauga

SEQ ID NO: 2044387 - RNA, 18 nt, Human herpesvirus 6B
agaucuguuuaaugagaa

SEQ ID NO: 2044388 - RNA, 22 nt, Human herpesvirus 6B
gauugcgucacuguccaaagaa

SEQ ID NO: 2044389 - RNA, 22 nt, Human herpesvirus 6B
uucuucaaaaaaagaggaggaa

SEQ ID NO: 2044390 - RNA, 16 nt, Human herpesvirus 6B
auuuuaaacuuaacuu

SEQ ID NO: 2044391 - RNA, 13 nt, Human herpesvirus 6B
acacguuuaucca

SEQ ID NO: 2044392 - RNA, 15 nt, Human herpesvirus 6B
cucuugcaguggcgc

SEQ ID NO: 2044393 - RNA, 12 nt, Human herpesvirus 6B
acagaaauuuca

SEQ ID NO: 2044394 - RNA, 22 nt, Human herpesvirus 6B
aaacuagaugacuauuucuuua

SEQ ID NO: 2044395 - RNA, 16 nt, Human herpesvirus 6B
uauaguaagaggcuua

SEQ ID NO: 2044396 - RNA, 17 nt, Human herpesvirus 6B
ugugucggcuccgaaac

SEQ ID NO: 2044397 - RNA, 16 nt, Human herpesvirus 6B
guagcaagggagaaag

SEQ ID NO: 2044398 - RNA, 15 nt, Human herpesvirus 6B
aaaaugacugauauu

SEQ ID NO: 2044399 - RNA, 14 nt, Human herpesvirus 6B
cccaaacucuugca

SEQ ID NO: 2044400 - RNA, 16 nt, Human herpesvirus 6B
uaugauuuucaauauc

SEQ ID NO: 2044401 - RNA, 17 nt, Human herpesvirus 6B
gucuucauucuucgaau

SEQ ID NO: 2044402 - RNA, 12 nt, Human herpesvirus 6B
guauaauguaaa

SEQ ID NO: 2044403 - RNA, 23 nt, Human herpesvirus 6B
caguggcgcgcguuuuuggugaa

SEQ ID NO: 2044404 - RNA, 23 nt, Human herpesvirus 6B
cuugaauguuuaaaguuuuguga

SEQ ID NO: 2044405 - RNA, 14 nt, Human herpesvirus 6B
ggacggggccuccc

SEQ ID NO: 2044406 - RNA, 23 nt, Human herpesvirus 6B
gagcccauaacgauagcagcucu

SEQ ID NO: 2044407 - RNA, 20 nt, Human herpesvirus 6B
uaacauugugagaacagcgc

SEQ ID NO: 2044408 - RNA, 20 nt, Human herpesvirus 6B
cagaccguuaucggcauuga

SEQ ID NO: 2044409 - RNA, 19 nt, Human herpesvirus 6B
gcaccgccuccgccaccac

SEQ ID NO: 2044410 - RNA, 20 nt, Human herpesvirus 6B
uauuucugguuguguuaauc

SEQ ID NO: 2044411 - RNA, 17 nt, Human herpesvirus 6B
aaaacccggagaaucua

SEQ ID NO: 2044412 - RNA, 19 nt, Human herpesvirus 6B
caccccccucuugcagugg

SEQ ID NO: 2044413 - RNA, 15 nt, Human herpesvirus 6B
agacugcacagaauc

SEQ ID NO: 2044414 - RNA, 13 nt, Human herpesvirus 6B
cuguaagauuaaa

SEQ ID NO: 2044415 - RNA, 15 nt, Human herpesvirus 6B
aaacucuagaauuau

SEQ ID NO: 2044416 - RNA, 14 nt, Human herpesvirus 6B
cacggcgccuccca

SEQ ID NO: 2044417 - RNA, 13 nt, Human herpesvirus 6B
aguacaauacuuu

SEQ ID NO: 2044418 - RNA, 18 nt, Human herpesvirus 6B
caguaaaacauguagugg

SEQ ID NO: 2044419 - RNA, 21 nt, Human herpesvirus 6B
acaguauuuacugagcaaaga

SEQ ID NO: 2044420 - RNA, 20 nt, Human herpesvirus 6B
cuaagugugcguuauuuucu

SEQ ID NO: 2044421 - RNA, 21 nt, Human herpesvirus 6B
aacgaagguucgacuauguua

SEQ ID NO: 2044422 - RNA, 13 nt, Human herpesvirus 6B
cucuuccuucucg

SEQ ID NO: 2044423 - RNA, 19 nt, Human herpesvirus 6B
gccaguaucgcgagcacca

SEQ ID NO: 2044424 - RNA, 15 nt, Human herpesvirus 6B
cuuaagaagggcuuu

SEQ ID NO: 2044425 - RNA, 14 nt, Human herpesvirus 6B
uaaugaaauuuaag

SEQ ID NO: 2044426 - RNA, 13 nt, Human herpesvirus 6B
uuccccguccucg

SEQ ID NO: 2044427 - RNA, 21 nt, Human herpesvirus 6B
gcggggcgcaccggcgacacg

SEQ ID NO: 2044428 - RNA, 15 nt, Human herpesvirus 6B
uaacaauucucucaa

SEQ ID NO: 2044429 - RNA, 22 nt, Human herpesvirus 6B
uaacauagaaaaauaagacuua

SEQ ID NO: 2044430 - RNA, 16 nt, Human herpesvirus 6B
auguaucaaaguguau

SEQ ID NO: 2044431 - RNA, 20 nt, Human herpesvirus 6B
cuuuuuuucccgaaaaacuu

SEQ ID NO: 2044432 - RNA, 20 nt, Human herpesvirus 6B
ucucaaaaaggguuuucuga

SEQ ID NO: 2044433 - RNA, 15 nt, Human herpesvirus 6B
uuacaagggaaaucc

SEQ ID NO: 2044434 - RNA, 20 nt, Human herpesvirus 6B
acaaugccaacacuguuguu

SEQ ID NO: 2044435 - RNA, 20 nt, Human herpesvirus 6B
uuucgacgaucgcgaagccu

SEQ ID NO: 2044436 - RNA, 21 nt, Human herpesvirus 6B
aauuugaauucugcucguuug

SEQ ID NO: 2044437 - RNA, 24 nt, Human herpesvirus 6B
ucgauaucucaccuaugaauaucu

SEQ ID NO: 2044438 - RNA, 16 nt, Human herpesvirus 6B
ggacacgcgcggugga

SEQ ID NO: 2044439 - RNA, 17 nt, Human herpesvirus 6B
gccucaggguuggaguu

SEQ ID NO: 2044440 - RNA, 17 nt, Human herpesvirus 6B
gucucauguugauuuua

SEQ ID NO: 2044441 - RNA, 17 nt, Human herpesvirus 6B
aaggagaauuugcaguu

SEQ ID NO: 2044442 - RNA, 22 nt, Human herpesvirus 6B
gacacaucgugaguuuucaugu

SEQ ID NO: 2044443 - RNA, 21 nt, Human herpesvirus 6B
acgucauguacggacagguuu

SEQ ID NO: 2044444 - RNA, 16 nt, Human herpesvirus 6B
uaucaacuauacuuaa

SEQ ID NO: 2044445 - RNA, 16 nt, Human herpesvirus 6B
auggaagacagucaaa

SEQ ID NO: 2044446 - RNA, 12 nt, Human herpesvirus 6B
ugucgaaucuca

SEQ ID NO: 2044447 - RNA, 13 nt, Human herpesvirus 6B
cucacccagaguu

SEQ ID NO: 2044448 - RNA, 19 nt, Human herpesvirus 6B
caucgcaagcccggagaac

SEQ ID NO: 2044449 - RNA, 14 nt, Human herpesvirus 6B
cacgucguggcaga

SEQ ID NO: 2044450 - RNA, 18 nt, Human herpesvirus 6B
augcaggguguggccggc

SEQ ID NO: 2044451 - RNA, 13 nt, Human herpesvirus 6B
auaauuacagaug

SEQ ID NO: 2044452 - RNA, 13 nt, Human herpesvirus 6B
gagcucaaagaga

SEQ ID NO: 2044453 - RNA, 14 nt, Human herpesvirus 6B
gccagcccugaaga

SEQ ID NO: 2044454 - RNA, 22 nt, Human herpesvirus 6B
caggagaaacuuguaaggcuua

SEQ ID NO: 2044455 - RNA, 16 nt, Human herpesvirus 6B
ucaagggcaagguucu

SEQ ID NO: 2044456 - RNA, 22 nt, Human herpesvirus 6B
uccacaccaaaaaagacgguuc

SEQ ID NO: 2044457 - RNA, 13 nt, Human herpesvirus 6B
ugacguuugcaua

SEQ ID NO: 2044458 - RNA, 19 nt, Human herpesvirus 6B
auucugcauuuauaucaaa

SEQ ID NO: 2044459 - RNA, 17 nt, Human herpesvirus 6B
gcgcggagcacgcacga

SEQ ID NO: 2044460 - RNA, 13 nt, Human herpesvirus 6B
aauaauugcauuu

SEQ ID NO: 2044461 - RNA, 17 nt, Human herpesvirus 6B
aucuuauuccaguggag

SEQ ID NO: 2044462 - RNA, 21 nt, Human herpesvirus 6B
gacgguucaaacgguaaacau

SEQ ID NO: 2044463 - RNA, 16 nt, Human herpesvirus 6B
agaaauucuccuguag

SEQ ID NO: 2044464 - RNA, 20 nt, Human herpesvirus 6B
aaaaguuaguuuuggauggc

SEQ ID NO: 2044465 - RNA, 14 nt, Human herpesvirus 6B
acuuuaccucugcu

SEQ ID NO: 2044466 - RNA, 18 nt, Human herpesvirus 6B
gagcccugagagcaggag

SEQ ID NO: 2044467 - RNA, 16 nt, Human herpesvirus 6B
guccccgccgcgcugg

SEQ ID NO: 2044468 - RNA, 14 nt, Human herpesvirus 6B
aaaaucugcuaacg

SEQ ID NO: 2044469 - RNA, 23 nt, Human herpesvirus 6B
aucccagaugcagucuccacagg

SEQ ID NO: 2044470 - RNA, 24 nt, Human herpesvirus 6B
uaaacuguucuuucaaaaugacca

SEQ ID NO: 2044471 - RNA, 21 nt, Human herpesvirus 6B
uaacugguucaggauuuguaa

SEQ ID NO: 2044472 - RNA, 21 nt, Human herpesvirus 6B
cuaacaauaauugcauuuugg

SEQ ID NO: 2044473 - RNA, 18 nt, Human herpesvirus 6B
aaacgauuauugcuacaa

SEQ ID NO: 2044474 - RNA, 17 nt, Human herpesvirus 6B
uaauaucgaauucagcu

SEQ ID NO: 2044475 - RNA, 20 nt, Human herpesvirus 6B
cauucugcauuuauaucaaa

SEQ ID NO: 2044476 - RNA, 22 nt, Human herpesvirus 6B
ggcggagcacccggggaggcga

SEQ ID NO: 2044477 - RNA, 14 nt, Human herpesvirus 6B
aaaauuuuucugua

SEQ ID NO: 2044478 - RNA, 16 nt, Human herpesvirus 6B
gagaucagcaugggca

SEQ ID NO: 2044479 - RNA, 14 nt, Human herpesvirus 6B
uuacauaacauaga

SEQ ID NO: 2044480 - RNA, 17 nt, Human herpesvirus 6B
gaaauauccguuuaguu

SEQ ID NO: 2044481 - RNA, 13 nt, Human herpesvirus 6B
acuuuuucaauug

SEQ ID NO: 2044482 - RNA, 23 nt, Human herpesvirus 6B
ugagacgccuauucuaauuauaa

SEQ ID NO: 2044483 - RNA, 21 nt, Human herpesvirus 6B
uccagcagcggucugcaccuc

SEQ ID NO: 2044484 - RNA, 17 nt, Human herpesvirus 6B
gaugaaaguuuuggaaa

SEQ ID NO: 2044485 - RNA, 15 nt, Human herpesvirus 6B
ggacagacaggggga

SEQ ID NO: 2044486 - RNA, 14 nt, Human herpesvirus 6B
guuaaaauguguua

SEQ ID NO: 2044487 - RNA, 22 nt, Human herpesvirus 6B
agcuuuaucccaaaauauaauu

SEQ ID NO: 2044488 - RNA, 19 nt, Human herpesvirus 6B
cacuugucgccaaugcaau

SEQ ID NO: 2044489 - RNA, 15 nt, Human herpesvirus 6B
ucgggcgacgggcag

SEQ ID NO: 2044490 - RNA, 19 nt, Human herpesvirus 6B
gccauccacccauauaccc

SEQ ID NO: 2044491 - RNA, 14 nt, Human herpesvirus 6B
aucuccaaaagcgc

SEQ ID NO: 2044492 - RNA, 21 nt, Human herpesvirus 6B
cgccgucgucgcucucccucu

SEQ ID NO: 2044493 - RNA, 14 nt, Human herpesvirus 6B
gaaaucuuuccugc

SEQ ID NO: 2044494 - RNA, 21 nt, Human herpesvirus 6B
aauucuuaccuuuuaagagug

SEQ ID NO: 2044495 - RNA, 15 nt, Human herpesvirus 6B
ucacuuuuugaagag

SEQ ID NO: 2044496 - RNA, 16 nt, Human herpesvirus 6B
cuugcacggaaucucu

SEQ ID NO: 2044497 - RNA, 22 nt, Human herpesvirus 6B
gugauuccuucggggacaguga

SEQ ID NO: 2044498 - RNA, 13 nt, Human herpesvirus 6B
gggaggaggagga

SEQ ID NO: 2044499 - RNA, 21 nt, Human herpesvirus 6B
aguccaucgaguaucgugucu

SEQ ID NO: 2044500 - RNA, 12 nt, Human herpesvirus 6B
guuauaugaaug

SEQ ID NO: 2044501 - RNA, 17 nt, Human herpesvirus 6B
ucugcguugcccucccg

SEQ ID NO: 2044502 - RNA, 13 nt, Human herpesvirus 6B
agggcgggcggac

SEQ ID NO: 2044503 - RNA, 15 nt, Human herpesvirus 6B
ucauauauugaaauu

SEQ ID NO: 2044504 - RNA, 22 nt, Human herpesvirus 6B
gcacuuuuuucuaaaacccgga

SEQ ID NO: 2044505 - RNA, 14 nt, Human herpesvirus 6B
uaaaguuuacugug

SEQ ID NO: 2044506 - RNA, 19 nt, Human herpesvirus 6B
auugacggguauuuuacau

SEQ ID NO: 2044507 - RNA, 17 nt, Human herpesvirus 6B
cauugauaguggcuuca

SEQ ID NO: 2044508 - RNA, 14 nt, Human herpesvirus 6B
cgaccucgcucucc

SEQ ID NO: 2044509 - RNA, 13 nt, Human herpesvirus 6B
cggacagagcgga

SEQ ID NO: 2044510 - RNA, 14 nt, Human herpesvirus 6B
aucuccaaaacacu

SEQ ID NO: 2044511 - RNA, 22 nt, Human herpesvirus 6B
uaucugaaaucgcauuucucua

SEQ ID NO: 2044512 - RNA, 13 nt, Human herpesvirus 6B
gguucgacagaga

SEQ ID NO: 2044513 - RNA, 23 nt, Human herpesvirus 6B
agccuguccgugacacacagaau

SEQ ID NO: 2044514 - RNA, 17 nt, Human herpesvirus 6B
cuccgucgccgcuccgg

SEQ ID NO: 2044515 - RNA, 18 nt, Human herpesvirus 6B
ggaugcagcguuggaaag

SEQ ID NO: 2044516 - RNA, 21 nt, Human herpesvirus 6B
aacaaaucucaagaaacaagu

SEQ ID NO: 2044517 - RNA, 17 nt, Human herpesvirus 6B
aauuuaaacagaaauuu

SEQ ID NO: 2044518 - RNA, 17 nt, Human herpesvirus 6B
aagaagggcagagagcc

SEQ ID NO: 2044519 - RNA, 19 nt, Human herpesvirus 6B
gauauaguuauucagauuu

SEQ ID NO: 2044520 - RNA, 15 nt, Human herpesvirus 6B
aacauguauucuccu

SEQ ID NO: 2044521 - RNA, 16 nt, Human herpesvirus 6B
cuguaaaaaaaauucu

SEQ ID NO: 2044522 - RNA, 23 nt, Human herpesvirus 6B
ugauuccguugugacagaauuau

SEQ ID NO: 2044523 - RNA, 21 nt, Human herpesvirus 6B
cauugaguagagcuuugagca

SEQ ID NO: 2044524 - RNA, 13 nt, Human herpesvirus 6B
agggacgcuugcu

SEQ ID NO: 2044525 - RNA, 22 nt, Human herpesvirus 6B
acugugaggugauuugaacaga

SEQ ID NO: 2044526 - RNA, 18 nt, Human herpesvirus 6B
cuggccaaucauaagaaa

SEQ ID NO: 2044527 - RNA, 16 nt, Human herpesvirus 6B
aucaaacaacuguugu

SEQ ID NO: 2044528 - RNA, 23 nt, Human herpesvirus 6B
uuacauaacauagaaaaauaaga

SEQ ID NO: 2044529 - RNA, 16 nt, Human herpesvirus 6B
caaaaaaaugauagac

SEQ ID NO: 2044530 - RNA, 16 nt, Human herpesvirus 6B
uugacaauaaacauga

SEQ ID NO: 2044531 - RNA, 23 nt, Human herpesvirus 6B
gcuccauaaugguaugccugagc

SEQ ID NO: 2044532 - RNA, 22 nt, Human herpesvirus 6B
auuucguguaucggcagugcaa

SEQ ID NO: 2044533 - RNA, 13 nt, Human herpesvirus 6B
uuaaaagugcaac

SEQ ID NO: 2044534 - RNA, 19 nt, Human herpesvirus 6B
uucaccccccucuugcagu

SEQ ID NO: 2044535 - RNA, 21 nt, Human herpesvirus 6B
cuguucaugcgaauuaaaacu

SEQ ID NO: 2044536 - RNA, 16 nt, Human herpesvirus 6B
uauuaacaauuuugau

SEQ ID NO: 2044537 - RNA, 18 nt, Human herpesvirus 6B
uugaauguuuaaaguuuu

SEQ ID NO: 2044538 - RNA, 20 nt, Human herpesvirus 6B
uauuucgaucagauuaucaa

SEQ ID NO: 2044539 - RNA, 21 nt, Human herpesvirus 6B
ggaacacgucguggcagaaca

SEQ ID NO: 2044540 - RNA, 15 nt, Human herpesvirus 6B
uguucgccucucccg

SEQ ID NO: 2044541 - RNA, 17 nt, Human herpesvirus 6B
ugagggagaugaagagu

SEQ ID NO: 2044542 - RNA, 18 nt, Human herpesvirus 6B
cggcgaagggacacgaga

SEQ ID NO: 2044543 - RNA, 17 nt, Human herpesvirus 6B
auggauuacaagggaaa

SEQ ID NO: 2044544 - RNA, 11 nt, Human herpesvirus 6B
guaccaacaug

SEQ ID NO: 2044545 - RNA, 23 nt, Human herpesvirus 6B
cugauuuucagugucagcauugu

SEQ ID NO: 2044546 - RNA, 23 nt, Human herpesvirus 6B
aaaaagaauggaagcgugguaga

SEQ ID NO: 2044547 - RNA, 15 nt, Human herpesvirus 6B
ucacguacuuaugau

SEQ ID NO: 2044548 - RNA, 22 nt, Human herpesvirus 6B
ugcuacccggcgguuuugcgau

SEQ ID NO: 2044549 - RNA, 16 nt, Human herpesvirus 6B
gaucauaggacagagg

SEQ ID NO: 2044550 - RNA, 19 nt, Human herpesvirus 6B
ggccgaguuuagacagagu

SEQ ID NO: 2044551 - RNA, 23 nt, Human herpesvirus 6B
gcguuucucgccaugggugucag

SEQ ID NO: 2044552 - RNA, 17 nt, Human herpesvirus 6B
ggagugcgacaggagau

SEQ ID NO: 2044553 - RNA, 15 nt, Human herpesvirus 6B
auugugacaagguau

SEQ ID NO: 2044554 - RNA, 20 nt, Human herpesvirus 6B
accgagagccggaaaacaau

SEQ ID NO: 2044555 - RNA, 18 nt, Human herpesvirus 6B
auuagcauucaaguccaa

SEQ ID NO: 2044556 - RNA, 22 nt, Human herpesvirus 6B
agcgggguugcuauagcagcgc

SEQ ID NO: 2044557 - RNA, 16 nt, Human herpesvirus 6B
gccggucggggagggg

SEQ ID NO: 2044558 - RNA, 23 nt, Human herpesvirus 6B
gccuccgccggguaugagccgcc

SEQ ID NO: 2044559 - RNA, 16 nt, Human herpesvirus 6B
ggcgcuuccuguucua

SEQ ID NO: 2044560 - RNA, 19 nt, Human herpesvirus 6B
augucaacgaaaaaaugac

SEQ ID NO: 2044561 - RNA, 13 nt, Human herpesvirus 6B
cuccucccacgcc

SEQ ID NO: 2044562 - RNA, 21 nt, Human herpesvirus 6B
aaguuccacaucuaugaugcu

SEQ ID NO: 2044563 - RNA, 19 nt, Human herpesvirus 6B
uuuauuuucguauaaaaug

SEQ ID NO: 2044564 - RNA, 15 nt, Human herpesvirus 6B
cagcccugaagaaga

SEQ ID NO: 2044565 - RNA, 12 nt, Human herpesvirus 6B
aguauggaaacg

SEQ ID NO: 2044566 - RNA, 22 nt, Human herpesvirus 6B
ggacccgagguccgacacgccc

SEQ ID NO: 2044567 - RNA, 13 nt, Human herpesvirus 6B
acucaaagaaagc

SEQ ID NO: 2044568 - RNA, 17 nt, Human herpesvirus 6B
gaauguugauauggagc

SEQ ID NO: 2044569 - RNA, 13 nt, Human herpesvirus 6B
ucuccugcaauuu

SEQ ID NO: 2044570 - RNA, 15 nt, Human herpesvirus 6B
ccuggaagaaggaaa

SEQ ID NO: 2044571 - RNA, 15 nt, Human herpesvirus 6B
caaaaugggaauuuc

SEQ ID NO: 2044572 - RNA, 21 nt, Human herpesvirus 6B
uccucaaacuuuuagagacuu

SEQ ID NO: 2044573 - RNA, 20 nt, Human herpesvirus 6B
aggugauuuuuauuguaaac

SEQ ID NO: 2044574 - RNA, 16 nt, Human herpesvirus 6B
uauuagaucuucuuca

SEQ ID NO: 2044575 - RNA, 15 nt, Human herpesvirus 6B
gcauacagcaugaac

SEQ ID NO: 2044576 - RNA, 18 nt, Human herpesvirus 6B
ugagagcaggagcaggcu

SEQ ID NO: 2044577 - RNA, 19 nt, Human herpesvirus 6B
ugaauauucacaagaagau

SEQ ID NO: 2044578 - RNA, 14 nt, Human herpesvirus 6B
cgggccagcccuga

SEQ ID NO: 2044579 - RNA, 14 nt, Human herpesvirus 6B
ugcuaaaugugaua

SEQ ID NO: 2044580 - RNA, 17 nt, Human herpesvirus 6B
ccguucccuucucgucu

SEQ ID NO: 2044581 - RNA, 15 nt, Human herpesvirus 6B
ucgauccaaaagauu

SEQ ID NO: 2044582 - RNA, 16 nt, Human herpesvirus 6B
gauuguucgcuugugu

SEQ ID NO: 2044583 - RNA, 15 nt, Human herpesvirus 6B
cggcgaggggacgga

SEQ ID NO: 2044584 - RNA, 18 nt, Human herpesvirus 6B
agcaccccacaaaacuua

SEQ ID NO: 2044585 - RNA, 23 nt, Human herpesvirus 6B
auuaaaguuuucauaaaaacgac

SEQ ID NO: 2044586 - RNA, 17 nt, Human herpesvirus 6B
caacgugugaaaacuag

SEQ ID NO: 2044587 - RNA, 16 nt, Human herpesvirus 6B
ucuccugugcguccuc

SEQ ID NO: 2044588 - RNA, 18 nt, Human herpesvirus 6B
aaaaccaaaaaaaaagug

SEQ ID NO: 2044589 - RNA, 15 nt, Human herpesvirus 6B
cggcggcugucgccg

SEQ ID NO: 2044590 - RNA, 15 nt, Human herpesvirus 6B
gcacgaaccaaaaug

SEQ ID NO: 2044591 - RNA, 17 nt, Human herpesvirus 6B
uaagccuauugacauga

SEQ ID NO: 2044592 - RNA, 22 nt, Human herpesvirus 6B
guuugaguugggacuuggaaac

SEQ ID NO: 2044593 - RNA, 19 nt, Human herpesvirus 6B
gcgguggugaucggcagau

SEQ ID NO: 2044594 - RNA, 15 nt, Human herpesvirus 6B
ggcucucugcccuuc

SEQ ID NO: 2044595 - RNA, 17 nt, Human herpesvirus 6B
cuaauaaaauauaacgc

SEQ ID NO: 2044596 - RNA, 20 nt, Human herpesvirus 6B
uucacuaacaaaaaaaucgu

SEQ ID NO: 2044597 - RNA, 19 nt, Human herpesvirus 6B
auuucauagauugcacgcu

SEQ ID NO: 2044598 - RNA, 10 nt, Human herpesvirus 6B
uauguuucua

SEQ ID NO: 2044599 - RNA, 20 nt, Human herpesvirus 6B
cucaaggucaaaaaacucag

SEQ ID NO: 2044600 - RNA, 22 nt, Human herpesvirus 6B
gaauauuuaaugacguaugauu

SEQ ID NO: 2044601 - RNA, 21 nt, Human herpesvirus 6B
agacaguuuacuaaaaaagau

SEQ ID NO: 2044602 - RNA, 16 nt, Human herpesvirus 6B
aagauccaauggauuu

SEQ ID NO: 2044603 - RNA, 22 nt, Human herpesvirus 6B
auggaucaaucuccaaaacacu

SEQ ID NO: 2044604 - RNA, 20 nt, Human herpesvirus 6B
gccgcguggaagccgcugca

SEQ ID NO: 2044605 - RNA, 17 nt, Human herpesvirus 6B
aggaagaucaugacaag

SEQ ID NO: 2044606 - RNA, 19 nt, Human herpesvirus 6B
ugguuuuucgauguuucca

SEQ ID NO: 2044607 - RNA, 18 nt, Human herpesvirus 6B
auaacucuuggauugcag

SEQ ID NO: 2044608 - RNA, 16 nt, Human herpesvirus 6B
ugcucauggaucaggu

SEQ ID NO: 2044609 - RNA, 17 nt, Human herpesvirus 6B
aacgcuccucccacgcc

SEQ ID NO: 2044610 - RNA, 14 nt, Human herpesvirus 6B
uggauaugagugaa

SEQ ID NO: 2044611 - RNA, 15 nt, Human herpesvirus 6B
aggcaaaguauucuu

SEQ ID NO: 2044612 - RNA, 14 nt, Human herpesvirus 6B
acuaaauuuuaugc

SEQ ID NO: 2044613 - RNA, 11 nt, Human herpesvirus 6B
gucucuagacg

SEQ ID NO: 2044614 - RNA, 13 nt, Human herpesvirus 6B
uccaaucacgaaa

SEQ ID NO: 2044615 - RNA, 19 nt, Human herpesvirus 6B
cacguucuuugaacaguga

SEQ ID NO: 2044616 - RNA, 14 nt, Human herpesvirus 6B
cguccguccccgcc

SEQ ID NO: 2044617 - RNA, 15 nt, Human herpesvirus 6B
cuuugauccauuuuc

SEQ ID NO: 2044618 - RNA, 21 nt, Human herpesvirus 6B
ucaagcuucacgugauuugua

SEQ ID NO: 2044619 - RNA, 23 nt, Human herpesvirus 6B
ggggaggcgacgacggggacuac

SEQ ID NO: 2044620 - RNA, 19 nt, Human herpesvirus 6B
acacgucguggcagaacag

SEQ ID NO: 2044621 - RNA, 19 nt, Human herpesvirus 6B
aagaaguuguuuagaaagc

SEQ ID NO: 2044622 - RNA, 19 nt, Human herpesvirus 6B
aguguuugccaaccaaaug

SEQ ID NO: 2044623 - RNA, 18 nt, Human herpesvirus 6B
auaugcuuuuuuuugugg

SEQ ID NO: 2044624 - RNA, 18 nt, Human herpesvirus 6B
cuaaucaagaaaccuguu

SEQ ID NO: 2044625 - RNA, 16 nt, Human herpesvirus 6B
agacuggacaguguuu

SEQ ID NO: 2044626 - RNA, 15 nt, Human herpesvirus 6B
acgaaaacuuuuugc

SEQ ID NO: 2044627 - RNA, 14 nt, Human herpesvirus 6B
auggguuaggguua

SEQ ID NO: 2044628 - RNA, 21 nt, Human herpesvirus 6B
gccgauagcggccgggcgacg

SEQ ID NO: 2044629 - RNA, 21 nt, Human herpesvirus 6B
uggccaaucauaagaaacuca

SEQ ID NO: 2044630 - RNA, 19 nt, Human herpesvirus 6B
cuaaacugaagaauggaaa

SEQ ID NO: 2044631 - RNA, 15 nt, Human herpesvirus 6B
caauuuugauuuaaa

SEQ ID NO: 2044632 - RNA, 17 nt, Human herpesvirus 6B
uacgcuggaaacuaaac

SEQ ID NO: 2044633 - RNA, 13 nt, Human herpesvirus 6B
aaacggagacugc

SEQ ID NO: 2044634 - RNA, 21 nt, Human herpesvirus 6B
uauuucuuuuuaaaaucaaaa

SEQ ID NO: 2044635 - RNA, 17 nt, Human herpesvirus 6B
aaagguguggugaaaga

SEQ ID NO: 2044636 - RNA, 14 nt, Human herpesvirus 6B
uauuuuauuuugug

SEQ ID NO: 2044637 - RNA, 18 nt, Human herpesvirus 6B
ucccccgaacgccuccac

SEQ ID NO: 2044638 - RNA, 17 nt, Human herpesvirus 6B
acacaacuguuaccgaa

SEQ ID NO: 2044639 - RNA, 15 nt, Human herpesvirus 6B
agaucuggauaaaga

SEQ ID NO: 2044640 - RNA, 23 nt, Human herpesvirus 6B
aaagauuagauuaggggagagac

SEQ ID NO: 2044641 - RNA, 18 nt, Human herpesvirus 6B
agccuaaacggagacugc

SEQ ID NO: 2044642 - RNA, 17 nt, Human herpesvirus 6B
aauauugguauugauuu

SEQ ID NO: 2044643 - RNA, 15 nt, Human herpesvirus 6B
uucuuugaacaguga

SEQ ID NO: 2044644 - RNA, 13 nt, Human herpesvirus 6B
gagcacuugggga

SEQ ID NO: 2044645 - RNA, 20 nt, Human herpesvirus 6B
ugaauaucuuuauaaaucau

SEQ ID NO: 2044646 - RNA, 20 nt, Human herpesvirus 6B
acuacuguguccaguguuac

SEQ ID NO: 2044647 - RNA, 23 nt, Human herpesvirus 6B
agaaaaagaacugucgcaucaau

SEQ ID NO: 2044648 - RNA, 21 nt, Human herpesvirus 6B
uauauugcucaaaauuggcau

SEQ ID NO: 2044649 - RNA, 15 nt, Human herpesvirus 6B
uguaauuuugaaauu

SEQ ID NO: 2044650 - RNA, 19 nt, Human herpesvirus 6B
aaaucgguuaaagaaucug

SEQ ID NO: 2044651 - RNA, 16 nt, Human herpesvirus 6B
agguguauuugaaaug

SEQ ID NO: 2044652 - RNA, 21 nt, Human herpesvirus 6B
uccuuaaaugacacagaaucu

SEQ ID NO: 2044653 - RNA, 20 nt, Human herpesvirus 6B
gggaugugcggagaaaggga

SEQ ID NO: 2044654 - RNA, 19 nt, Human herpesvirus 6B
agaaagaacuuuuggaugu

SEQ ID NO: 2044655 - RNA, 14 nt, Human herpesvirus 6B
uuaacuguuucuuc

SEQ ID NO: 2044656 - RNA, 13 nt, Human herpesvirus 6B
guuauuagacacc

SEQ ID NO: 2044657 - RNA, 22 nt, Human herpesvirus 6B
gcagaugcuuaccgguguuuua

SEQ ID NO: 2044658 - RNA, 23 nt, Human herpesvirus 6B
ggggacagugauuaggauguuug

SEQ ID NO: 2044659 - RNA, 17 nt, Human herpesvirus 6B
gcgaugcgccacaggga

SEQ ID NO: 2044660 - RNA, 21 nt, Human herpesvirus 6B
cuccguuacccgggagcuuca

SEQ ID NO: 2044661 - RNA, 18 nt, Human herpesvirus 6B
cgauccaguggcaauaau

SEQ ID NO: 2044662 - RNA, 20 nt, Human herpesvirus 6B
uggccgcuuucuuggcgccc

SEQ ID NO: 2044663 - RNA, 23 nt, Human herpesvirus 6B
auugacuacggcgguuaacuguu

SEQ ID NO: 2044664 - RNA, 9 nt, Human herpesvirus 6B
aggagaggg

SEQ ID NO: 2044665 - RNA, 20 nt, Human herpesvirus 6B
caguuuuuuguuucuggggg

SEQ ID NO: 2044666 - RNA, 17 nt, Human herpesvirus 6B
aucgucgaaaacaauuu

SEQ ID NO: 2044667 - RNA, 14 nt, Human herpesvirus 6B
gcaguaucaaucac

SEQ ID NO: 2044668 - RNA, 16 nt, Human herpesvirus 6B
agaauaagaucuacag

SEQ ID NO: 2044669 - RNA, 14 nt, Human herpesvirus 6B
aggggacggacaga

SEQ ID NO: 2044670 - RNA, 16 nt, Human herpesvirus 6B
ccgaacgccuccacgg

SEQ ID NO: 2044671 - RNA, 16 nt, Human herpesvirus 6B
cggcacauacacacgc

SEQ ID NO: 2044672 - RNA, 21 nt, Human herpesvirus 6B
auuuuguggcuauuugacaau

SEQ ID NO: 2044673 - RNA, 16 nt, Human herpesvirus 6B
auaugcgaauguuaaa

SEQ ID NO: 2044674 - RNA, 16 nt, Human herpesvirus 6B
gguguuugcagauaag

SEQ ID NO: 2044675 - RNA, 22 nt, Human herpesvirus 6B
agaguacuuucguuuacgaauu

SEQ ID NO: 2044676 - RNA, 16 nt, Human herpesvirus 6B
acgcgccgacucucuc

SEQ ID NO: 2044677 - RNA, 23 nt, Human herpesvirus 6B
ccgaacgguauuuuuagaugucg

SEQ ID NO: 2044678 - RNA, 13 nt, Human herpesvirus 6B
gcgaugcggcagu

SEQ ID NO: 2044679 - RNA, 22 nt, Human herpesvirus 6B
uaugaaaguguauuuggaugaa

SEQ ID NO: 2044680 - RNA, 21 nt, Human herpesvirus 6B
agcaggcuccccaggcgcagc

SEQ ID NO: 2044681 - RNA, 16 nt, Human herpesvirus 6B
aauguauuguucgcug

SEQ ID NO: 2044682 - RNA, 14 nt, Human herpesvirus 6B
gcauauauaugaau

SEQ ID NO: 2044683 - RNA, 15 nt, Human herpesvirus 6B
ugacugugaggugau

SEQ ID NO: 2044684 - RNA, 14 nt, Human herpesvirus 6B
cauagagcauccug

SEQ ID NO: 2044685 - RNA, 17 nt, Human herpesvirus 6B
ggcagggcgggcacgga

SEQ ID NO: 2044686 - RNA, 18 nt, Human herpesvirus 6B
ggaagaggaagggauggc

SEQ ID NO: 2044687 - RNA, 18 nt, Human herpesvirus 6B
aguggaaguguaaauguc

SEQ ID NO: 2044688 - RNA, 18 nt, Human herpesvirus 6B
ucgccauagugaaagagu

SEQ ID NO: 2044689 - RNA, 10 nt, Human herpesvirus 6B
aaaaacacuc

SEQ ID NO: 2044690 - RNA, 18 nt, Human herpesvirus 6B
caggauuauaaaaacaca

SEQ ID NO: 2044691 - RNA, 15 nt, Human herpesvirus 6B
caucuuaaauuucua

SEQ ID NO: 2044692 - RNA, 11 nt, Human herpesvirus 6B
uguagaagaag

SEQ ID NO: 2044693 - RNA, 20 nt, Human herpesvirus 6B
agagggagaaacggacacgc

SEQ ID NO: 2044694 - RNA, 23 nt, Human herpesvirus 6B
auagguucuauucguucagaaug

SEQ ID NO: 2044695 - RNA, 17 nt, Human herpesvirus 6B
uaaggcucgguaguaua

SEQ ID NO: 2044696 - RNA, 17 nt, Human herpesvirus 6B
gauaucaauuccuguga

SEQ ID NO: 2044697 - RNA, 22 nt, Human herpesvirus 6B
auacauccagaaaagcaaacau

SEQ ID NO: 2044698 - RNA, 14 nt, Human herpesvirus 6B
ccaggcgcagcagc

SEQ ID NO: 2044699 - RNA, 13 nt, Human herpesvirus 6B
cagcaaucagcag

SEQ ID NO: 2044700 - RNA, 14 nt, Human herpesvirus 6B
uuauacgaaaauaa

SEQ ID NO: 2044701 - RNA, 15 nt, Human herpesvirus 6B
uuccaugacugugag

SEQ ID NO: 2044702 - RNA, 14 nt, Human herpesvirus 6B
cuccuggguacggc

SEQ ID NO: 2044703 - RNA, 14 nt, Human herpesvirus 6B
caggcuccccaggc

SEQ ID NO: 2044704 - RNA, 16 nt, Human herpesvirus 6B
cuguacacaaaaaccg

SEQ ID NO: 2044705 - RNA, 16 nt, Human herpesvirus 6B
uccaucccccuccccg

SEQ ID NO: 2044706 - RNA, 14 nt, Human herpesvirus 6B
uaagguuguuuucg

SEQ ID NO: 2044707 - RNA, 15 nt, Human herpesvirus 6B
acauugugagaacag

SEQ ID NO: 2044708 - RNA, 17 nt, Human herpesvirus 6B
uucaauaaaaaacuuau

SEQ ID NO: 2044709 - RNA, 17 nt, Human herpesvirus 6B
gugccuauuaaugcuua

SEQ ID NO: 2044710 - RNA, 19 nt, Human herpesvirus 6B
agcaauucuuuugcgaaga

SEQ ID NO: 2044711 - RNA, 18 nt, Human herpesvirus 6B
augcuggcgcugcauaga

SEQ ID NO: 2044712 - RNA, 16 nt, Human herpesvirus 6B
ggccagcccugaagaa

SEQ ID NO: 2044713 - RNA, 23 nt, Human herpesvirus 6B
ccagauaggaaaagguugagaaa

SEQ ID NO: 2044714 - RNA, 22 nt, Human herpesvirus 6B
auauugagacguuuuucacagu

SEQ ID NO: 2044715 - RNA, 13 nt, Human herpesvirus 6B
uaugaaugugaga

SEQ ID NO: 2044716 - RNA, 22 nt, Human herpesvirus 6B
ucaggaauguaaugaauuauua

SEQ ID NO: 2044717 - RNA, 21 nt, Human herpesvirus 6B
uguucagacacaugucuucaa

SEQ ID NO: 2044718 - RNA, 21 nt, Human herpesvirus 6B
caguugucugcggaaauaauu

SEQ ID NO: 2044719 - RNA, 14 nt, Human herpesvirus 6B
guuaggaucagaca

SEQ ID NO: 2044720 - RNA, 23 nt, Human herpesvirus 6B
auuuuuguagcaauuuuaaauau

SEQ ID NO: 2044721 - RNA, 22 nt, Human herpesvirus 6B
cuuugagugguuuuuuggauaa

SEQ ID NO: 2044722 - RNA, 12 nt, Human herpesvirus 6B
ggacucugucuu

SEQ ID NO: 2044723 - RNA, 23 nt, Human herpesvirus 6B
aagguguuugaucuagauaaagu

SEQ ID NO: 2044724 - RNA, 19 nt, Human herpesvirus 6B
gagccuuuaaccauguuuu

SEQ ID NO: 2044725 - RNA, 17 nt, Human herpesvirus 6B
cgucaggaccagcucug

SEQ ID NO: 2044726 - RNA, 21 nt, Human herpesvirus 6B
ggaagcauacgucuguggcga

SEQ ID NO: 2044727 - RNA, 14 nt, Human herpesvirus 6B
uuaaaauguguuaa

SEQ ID NO: 2044728 - RNA, 21 nt, Human herpesvirus 6B
aagacuuuuaucaaauuugca

SEQ ID NO: 2044729 - RNA, 13 nt, Human herpesvirus 6B
cucucuucaggag

SEQ ID NO: 2044730 - RNA, 14 nt, Human herpesvirus 6B
cuucagaaagauug

SEQ ID NO: 2044731 - RNA, 15 nt, Human herpesvirus 6B
ccaucaaucucuaug

SEQ ID NO: 2044732 - RNA, 16 nt, Human herpesvirus 6B
ucgauuuagagaauau

SEQ ID NO: 2044733 - RNA, 15 nt, Human herpesvirus 6B
ucuauuugcaagaau

SEQ ID NO: 2044734 - RNA, 14 nt, Human herpesvirus 6B
uugcugguuugcuu

SEQ ID NO: 2044735 - RNA, 18 nt, Human herpesvirus 6B
ucaucaaauccucuacgu

SEQ ID NO: 2044736 - RNA, 13 nt, Human herpesvirus 6B
ggacggacagagc

SEQ ID NO: 2044737 - RNA, 23 nt, Human herpesvirus 6B
cugugaggugauuugaacagaga

SEQ ID NO: 2044738 - RNA, 13 nt, Human herpesvirus 6B
uucuguaccccaa

SEQ ID NO: 2044739 - RNA, 16 nt, Human herpesvirus 6B
guaaauccgaaacaca

SEQ ID NO: 2044740 - RNA, 14 nt, Human herpesvirus 6B
gagguuuuuucacc

SEQ ID NO: 2044741 - RNA, 20 nt, Human herpesvirus 6B
gccgucgucgcucucccucu

SEQ ID NO: 2044742 - RNA, 13 nt, Human herpesvirus 6B
auaagaguguaaa

SEQ ID NO: 2044743 - RNA, 19 nt, Human herpesvirus 6B
ugcaaaauagguuaaaucu

SEQ ID NO: 2044744 - RNA, 12 nt, Human herpesvirus 6B
agcuggacagaa

SEQ ID NO: 2044745 - RNA, 13 nt, Human herpesvirus 6B
augccacagaaca

SEQ ID NO: 2044746 - RNA, 19 nt, Human herpesvirus 6B
cauacgacugacgauuuca

SEQ ID NO: 2044747 - RNA, 21 nt, Human herpesvirus 6B
gauuucuuuaucuuccuguac

SEQ ID NO: 2044748 - RNA, 15 nt, Human herpesvirus 6B
uccugagaggcugga

SEQ ID NO: 2044749 - RNA, 16 nt, Human herpesvirus 6B
ucagcucgccguuuuu

SEQ ID NO: 2044750 - RNA, 14 nt, Human herpesvirus 6B
ucauuuuuacucau

SEQ ID NO: 2044751 - RNA, 18 nt, Human herpesvirus 6B
uguauaauauaaauucuu

SEQ ID NO: 2044752 - RNA, 12 nt, Human herpesvirus 6B
uagagacuuugc

SEQ ID NO: 2044753 - RNA, 16 nt, Human herpesvirus 6B
augaugaucugcuuug

SEQ ID NO: 2044754 - RNA, 15 nt, Human herpesvirus 6B
uugauguugguugau

SEQ ID NO: 2044755 - RNA, 19 nt, Human herpesvirus 6B
guuaauuccaagaugcagu

SEQ ID NO: 2044756 - RNA, 19 nt, Human herpesvirus 6B
ucacuggacagggguaaau

SEQ ID NO: 2044757 - RNA, 15 nt, Human herpesvirus 6B
agggaggagagggag

SEQ ID NO: 2044758 - RNA, 14 nt, Human herpesvirus 6B
agguggaaacuguu

SEQ ID NO: 2044759 - RNA, 11 nt, Human herpesvirus 6B
auccuuuguuu

SEQ ID NO: 2044760 - RNA, 19 nt, Human herpesvirus 6B
aagaaaggaguuugcauuu

SEQ ID NO: 2044761 - RNA, 23 nt, Human herpesvirus 6B
agauuccgucaucuagagaauau

SEQ ID NO: 2044762 - RNA, 23 nt, Human herpesvirus 6B
cuucuuggagucuggccucugcg

SEQ ID NO: 2044763 - RNA, 10 nt, Human herpesvirus 6B
guuuuuugca

SEQ ID NO: 2044764 - RNA, 15 nt, Human herpesvirus 6B
ugucgcccgccucuc

SEQ ID NO: 2044765 - RNA, 12 nt, Human herpesvirus 6B
ugaauguuucug

SEQ ID NO: 2044766 - RNA, 15 nt, Human herpesvirus 6B
uuauauggaugcugg

SEQ ID NO: 2044767 - RNA, 19 nt, Human herpesvirus 6B
gagaauguucuucugaaau

SEQ ID NO: 2044768 - RNA, 13 nt, Human herpesvirus 6B
acaucuaugaugc

SEQ ID NO: 2044769 - RNA, 19 nt, Human herpesvirus 6B
ugauacgaguaaaauugaa

SEQ ID NO: 2044770 - RNA, 22 nt, Human herpesvirus 6B
uaggacaauuggauaaacaucg

SEQ ID NO: 2044771 - RNA, 15 nt, Human herpesvirus 6B
ucaacuauuuaacau

SEQ ID NO: 2044772 - RNA, 13 nt, Human herpesvirus 6B
acuuuuugaagag

SEQ ID NO: 2044773 - RNA, 16 nt, Human herpesvirus 6B
cggccauuuaacggaa

SEQ ID NO: 2044774 - RNA, 21 nt, Human herpesvirus 6B
auuucaggaaguucuucaaaa

SEQ ID NO: 2044775 - RNA, 18 nt, Human herpesvirus 6B
acaaccuauguacagaua

SEQ ID NO: 2044776 - RNA, 16 nt, Human herpesvirus 6B
agcagcuagagaaauu

SEQ ID NO: 2044777 - RNA, 18 nt, Human herpesvirus 6B
agagacccuccuggcgcu

SEQ ID NO: 2044778 - RNA, 16 nt, Human herpesvirus 6B
acauguauucuccuca

SEQ ID NO: 2044779 - RNA, 13 nt, Human herpesvirus 6B
aaaacuacagaga

SEQ ID NO: 2044780 - RNA, 15 nt, Human herpesvirus 6B
aguaaauuaaaguuu

SEQ ID NO: 2044781 - RNA, 21 nt, Human herpesvirus 6B
uacaagggcuuggggcuauag

SEQ ID NO: 2044782 - RNA, 13 nt, Human herpesvirus 6B
ucaugucuuacag

SEQ ID NO: 2044783 - RNA, 21 nt, Human herpesvirus 6B
auguacguggccgucuccugc

SEQ ID NO: 2044784 - RNA, 15 nt, Human herpesvirus 6B
caaaaaaauauugga

SEQ ID NO: 2044785 - RNA, 15 nt, Human herpesvirus 6B
auuuucugaaaucuu

SEQ ID NO: 2044786 - RNA, 20 nt, Human herpesvirus 6B
gagcauugaguagagcuuug

SEQ ID NO: 2044787 - RNA, 17 nt, Human herpesvirus 6B
aaaauuggugugcauua

SEQ ID NO: 2044788 - RNA, 16 nt, Human herpesvirus 6B
guugcgguuucggaaa

SEQ ID NO: 2044789 - RNA, 12 nt, Human herpesvirus 6B
acaguuuugugg

SEQ ID NO: 2044790 - RNA, 24 nt, Human herpesvirus 6B
caggaaauuaauaagauagauauu

SEQ ID NO: 2044791 - RNA, 13 nt, Human herpesvirus 6B
cucguugggaugg

SEQ ID NO: 2044792 - RNA, 18 nt, Human herpesvirus 6B
auuuaauaaauugcagcu

SEQ ID NO: 2044793 - RNA, 12 nt, Human herpesvirus 6B
ugcuucugcucu

SEQ ID NO: 2044794 - RNA, 20 nt, Human herpesvirus 6B
cucuucuugcgaccucgcuc

SEQ ID NO: 2044795 - RNA, 12 nt, Human herpesvirus 6B
aaagagaaguua

SEQ ID NO: 2044796 - RNA, 19 nt, Human herpesvirus 6B
aggaagccggagcccugag

SEQ ID NO: 2044797 - RNA, 14 nt, Human herpesvirus 6B
augguuaaggaaaa

SEQ ID NO: 2044798 - RNA, 12 nt, Human herpesvirus 6B
acaucuaugaug

SEQ ID NO: 2044799 - RNA, 17 nt, Human herpesvirus 6B
guacaaagguuuuugcu

SEQ ID NO: 2044800 - RNA, 15 nt, Human herpesvirus 6B
gguaacgcaggagaa

SEQ ID NO: 2044801 - RNA, 16 nt, Human herpesvirus 6B
uguuccgaaaacuuua

SEQ ID NO: 2044802 - RNA, 13 nt, Human herpesvirus 6B
uuucauacuguau

SEQ ID NO: 2044803 - RNA, 17 nt, Human herpesvirus 6B
cagaugcagucuccaca

SEQ ID NO: 2044804 - RNA, 14 nt, Human herpesvirus 6B
ugucacacucugaa

SEQ ID NO: 2044805 - RNA, 13 nt, Human herpesvirus 6B
cuacaaucauuua

SEQ ID NO: 2044806 - RNA, 22 nt, Human herpesvirus 6B
acaaggguaacgcaggagaaac

SEQ ID NO: 2044807 - RNA, 15 nt, Human herpesvirus 6B
ugacuuuucugauga

SEQ ID NO: 2044808 - RNA, 18 nt, Human herpesvirus 6B
uucaggcauuaaacugag

SEQ ID NO: 2044809 - RNA, 21 nt, Human herpesvirus 6B
uaccauuuuauacgaaaauaa

SEQ ID NO: 2044810 - RNA, 23 nt, Human herpesvirus 6B
agcuccauguucuauuuuagaga

SEQ ID NO: 2044811 - RNA, 19 nt, Human herpesvirus 6B
augguauuuaggagcuagu

SEQ ID NO: 2044812 - RNA, 20 nt, Human herpesvirus 6B
cuuaucagucucaaaaauua

SEQ ID NO: 2044813 - RNA, 14 nt, Human herpesvirus 6B
ucgagacuagauuu

SEQ ID NO: 2044814 - RNA, 23 nt, Human herpesvirus 6B
augcaaucugugggaaaauaaua

SEQ ID NO: 2044815 - RNA, 19 nt, Human herpesvirus 6B
aucuccggacagaaaauuu

SEQ ID NO: 2044816 - RNA, 13 nt, Human herpesvirus 6B
gccgucuccugca

SEQ ID NO: 2044817 - RNA, 21 nt, Human herpesvirus 6B
uaugaucgcuucauaguuguu

SEQ ID NO: 2044818 - RNA, 23 nt, Human herpesvirus 6B
caacgcagauuuuaaugaugugu

SEQ ID NO: 2044819 - RNA, 13 nt, Human herpesvirus 6B
gauaaacaucgcu

SEQ ID NO: 2044820 - RNA, 20 nt, Human herpesvirus 6B
gaagguaucaaagaacagaa

SEQ ID NO: 2044821 - RNA, 20 nt, Human herpesvirus 6B
cauucgauuaaugccacagg

SEQ ID NO: 2044822 - RNA, 14 nt, Human herpesvirus 6B
ucuaugggaguaau

SEQ ID NO: 2044823 - RNA, 22 nt, Human herpesvirus 6B
cucaagaugaaguuuggggaga

SEQ ID NO: 2044824 - RNA, 18 nt, Human herpesvirus 6B
cuguauaucuaugcuuuu

SEQ ID NO: 2044825 - RNA, 15 nt, Human herpesvirus 6B
aaacacggcgccucc

SEQ ID NO: 2044826 - RNA, 17 nt, Human herpesvirus 6B
ccaccuggcgcaccgcc

SEQ ID NO: 2044827 - RNA, 23 nt, Human herpesvirus 6B
uaacggaacccuagacacacaga

SEQ ID NO: 2044828 - RNA, 15 nt, Human herpesvirus 6B
uacuaaaggacuggc

SEQ ID NO: 2044829 - RNA, 19 nt, Human herpesvirus 6B
ucaaguuagaaauguugcc

SEQ ID NO: 2044830 - RNA, 20 nt, Human herpesvirus 6B
gauuccguugugacagaauu

SEQ ID NO: 2044831 - RNA, 19 nt, Human herpesvirus 6B
uuuucaccccccucuugca

SEQ ID NO: 2044832 - RNA, 22 nt, Human herpesvirus 6B
gccugaaggcuacuauaaacaa

SEQ ID NO: 2044833 - RNA, 21 nt, Human herpesvirus 6B
ugcuguaagguuucuaaaucu

SEQ ID NO: 2044834 - RNA, 17 nt, Human herpesvirus 6B
cgaacgcguccuccgcg

SEQ ID NO: 2044835 - RNA, 12 nt, Human herpesvirus 6B
agaugcaaaaua

SEQ ID NO: 2044836 - RNA, 13 nt, Human herpesvirus 6B
ccugauccaugag

SEQ ID NO: 2044837 - RNA, 13 nt, Human herpesvirus 6B
gcuauguaugaac

SEQ ID NO: 2044838 - RNA, 18 nt, Human herpesvirus 6B
ugcuaccggaacucacac

SEQ ID NO: 2044839 - RNA, 17 nt, Human herpesvirus 6B
acauacaacuuucacug

SEQ ID NO: 2044840 - RNA, 13 nt, Human herpesvirus 6B
uccauaaugguau

SEQ ID NO: 2044841 - RNA, 16 nt, Human herpesvirus 6B
augcuaauaaaauaua

SEQ ID NO: 2044842 - RNA, 18 nt, Human herpesvirus 6B
gggagcggcgcacggguu

SEQ ID NO: 2044843 - RNA, 12 nt, Human herpesvirus 6B
uuuauugacugu

SEQ ID NO: 2044844 - RNA, 18 nt, Human herpesvirus 6B
augauuccacucugcaga

SEQ ID NO: 2044845 - RNA, 16 nt, Human herpesvirus 6B
uaucuaugcuuuugua

SEQ ID NO: 2044846 - RNA, 18 nt, Human herpesvirus 6B
ggcuuaaaggcagcuggc

SEQ ID NO: 2044847 - RNA, 14 nt, Human herpesvirus 6B
gaccagcucuguuc

SEQ ID NO: 2044848 - RNA, 20 nt, Human herpesvirus 6B
acgauggacagaaaaaacac

SEQ ID NO: 2044849 - RNA, 18 nt, Human herpesvirus 6B
ugcugucacacucugaac

SEQ ID NO: 2044850 - RNA, 20 nt, Human herpesvirus 6B
aaacaaacguguauuaagaa

SEQ ID NO: 2044851 - RNA, 20 nt, Human herpesvirus 6B
uaugacuuuucugaaauucu

SEQ ID NO: 2044852 - RNA, 19 nt, Human herpesvirus 6B
gaucaacuccguauaugcu

SEQ ID NO: 2044853 - RNA, 13 nt, Human herpesvirus 6B
aaauggaguuaug

SEQ ID NO: 2044854 - RNA, 22 nt, Human herpesvirus 6B
cucccguccguggaaaaacacu

SEQ ID NO: 2044855 - RNA, 22 nt, Human herpesvirus 6B
acaugcaacccgccacucuaca

SEQ ID NO: 2044856 - RNA, 21 nt, Human herpesvirus 6B
auacuuccucgcgguauaaug

SEQ ID NO: 2044857 - RNA, 16 nt, Human herpesvirus 6B
ccagcucuguucucuc

SEQ ID NO: 2044858 - RNA, 14 nt, Human herpesvirus 6B
acaucgcuccauaa

SEQ ID NO: 2044859 - RNA, 24 nt, Human herpesvirus 6B
gagacggaauauauagaagaagaa

SEQ ID NO: 2044860 - RNA, 21 nt, Human herpesvirus 6B
accuugucacaauaauuacuc

SEQ ID NO: 2044861 - RNA, 21 nt, Human herpesvirus 6B
ugggcauuuuuuugaaaucac

SEQ ID NO: 2044862 - RNA, 17 nt, Human herpesvirus 6B
uuagagauuuuggaagc

SEQ ID NO: 2044863 - RNA, 23 nt, Human herpesvirus 6B
cauguguggcgcauguaugguug

SEQ ID NO: 2044864 - RNA, 17 nt, Human herpesvirus 6B
ucaccgaaauccccaga

SEQ ID NO: 2044865 - RNA, 13 nt, Human herpesvirus 6B
ugauccagaauua

SEQ ID NO: 2044866 - RNA, 22 nt, Human herpesvirus 6B
agucguuacaguaaaaaagccg

SEQ ID NO: 2044867 - RNA, 21 nt, Human herpesvirus 6B
ugggcuccucacccugaaggg

SEQ ID NO: 2044868 - RNA, 14 nt, Human herpesvirus 6B
gaagucuuuccugu

SEQ ID NO: 2044869 - RNA, 16 nt, Human herpesvirus 6B
uuaaagaaucugcaga

SEQ ID NO: 2044870 - RNA, 16 nt, Human herpesvirus 6B
gcacgucacgggcagc

SEQ ID NO: 2044871 - RNA, 12 nt, Human herpesvirus 6B
uguauuuggaug

SEQ ID NO: 2044872 - RNA, 19 nt, Human herpesvirus 6B
ugccgaaaauuugggugau

SEQ ID NO: 2044873 - RNA, 20 nt, Human herpesvirus 6B
cggaggcuacggcuaaggcg

SEQ ID NO: 2044874 - RNA, 21 nt, Human herpesvirus 6B
agacggaucugccgcguggaa

SEQ ID NO: 2044875 - RNA, 18 nt, Human herpesvirus 6B
gugaauugugcaagcugu

SEQ ID NO: 2044876 - RNA, 13 nt, Human herpesvirus 6B
cgggaagacgaua

SEQ ID NO: 2044877 - RNA, 19 nt, Human herpesvirus 6B
auggaucauaaagugucuu

SEQ ID NO: 2044878 - RNA, 15 nt, Human herpesvirus 6B
aggcaucuucauccc

SEQ ID NO: 2044879 - RNA, 23 nt, Human herpesvirus 6B
acucucuacguuuacaucaacua

SEQ ID NO: 2044880 - RNA, 18 nt, Human herpesvirus 6B
cuauguuaacauugugag

SEQ ID NO: 2044881 - RNA, 22 nt, Human herpesvirus 6B
uauuugaggcggugucuucaaa

SEQ ID NO: 2044882 - RNA, 17 nt, Human herpesvirus 6B
cguuuucaaugugaauc

SEQ ID NO: 2044883 - RNA, 15 nt, Human herpesvirus 6B
uguuuuuaguaauaa

SEQ ID NO: 2044884 - RNA, 16 nt, Human herpesvirus 6B
aggaaacgcgcuggga

SEQ ID NO: 2044885 - RNA, 14 nt, Human herpesvirus 6B
cuuacguguguauu

SEQ ID NO: 2044886 - RNA, 20 nt, Human herpesvirus 6B
agagacuuugcugauucugu

SEQ ID NO: 2044887 - RNA, 14 nt, Human herpesvirus 6B
auucugcuaugaug

SEQ ID NO: 2044888 - RNA, 15 nt, Human herpesvirus 6B
ggagaggaagccgga

SEQ ID NO: 2044889 - RNA, 12 nt, Human herpesvirus 6B
aggaagaggagg

SEQ ID NO: 2044890 - RNA, 12 nt, Human herpesvirus 6B
uguuuuugcuac

SEQ ID NO: 2044891 - RNA, 15 nt, Human herpesvirus 6B
guuuggacaggagca

SEQ ID NO: 2044892 - RNA, 12 nt, Human herpesvirus 6B
ugcguguagagu

SEQ ID NO: 2044893 - RNA, 19 nt, Human herpesvirus 6B
gaaugagggauucguaguu

SEQ ID NO: 2044894 - RNA, 17 nt, Human herpesvirus 6B
aucgagaauaauuuacu

SEQ ID NO: 2044895 - RNA, 13 nt, Human herpesvirus 6B
uauauagaagaag

SEQ ID NO: 2044896 - RNA, 13 nt, Human herpesvirus 6B
aacaaugcuuugg

SEQ ID NO: 2044897 - RNA, 16 nt, Human herpesvirus 6B
gggcuuaauaaaggau

SEQ ID NO: 2044898 - RNA, 14 nt, Human herpesvirus 6B
cuacguuagcuucc

SEQ ID NO: 2044899 - RNA, 23 nt, Human herpesvirus 6B
cuucaggagaagaacagaggaag

SEQ ID NO: 2044900 - RNA, 16 nt, Human herpesvirus 6B
uaugaugcuguagaaa

SEQ ID NO: 2044901 - RNA, 21 nt, Human herpesvirus 6B
cgcugucgucugagcagaggu

SEQ ID NO: 2044902 - RNA, 14 nt, Human herpesvirus 6B
agucgcgaagugcu

SEQ ID NO: 2044903 - RNA, 20 nt, Human herpesvirus 6B
ugcaguuugugaauauucag

SEQ ID NO: 2044904 - RNA, 15 nt, Human herpesvirus 6B
ucuccugaucucacg

SEQ ID NO: 2044905 - RNA, 11 nt, Human herpesvirus 6B
cccggggaggc

SEQ ID NO: 2044906 - RNA, 15 nt, Human herpesvirus 6B
uaucucgaaaugcau

SEQ ID NO: 2044907 - RNA, 19 nt, Human herpesvirus 6B
gaauucucauuuaaaagcg

SEQ ID NO: 2044908 - RNA, 17 nt, Human herpesvirus 6B
agacaaaaacaugugcu

SEQ ID NO: 2044909 - RNA, 16 nt, Human herpesvirus 6B
cccacacgcggggauc

SEQ ID NO: 2044910 - RNA, 12 nt, Human herpesvirus 6B
auuauaaaaaug

SEQ ID NO: 2044911 - RNA, 17 nt, Human herpesvirus 6B
aaaugacacagaaucua

SEQ ID NO: 2044912 - RNA, 19 nt, Human herpesvirus 6B
auuugacaauaaacaugau

SEQ ID NO: 2044913 - RNA, 20 nt, Human herpesvirus 6B
cguuauuugugcaaaaugug

SEQ ID NO: 2044914 - RNA, 19 nt, Human herpesvirus 6B
uguaaacaaauucuuacaa

SEQ ID NO: 2044915 - RNA, 20 nt, Human herpesvirus 6B
uccuuaucagucucaaaaau

SEQ ID NO: 2044916 - RNA, 19 nt, Human herpesvirus 6B
gccacguucuuugaacagu

SEQ ID NO: 2044917 - RNA, 14 nt, Human herpesvirus 6B
guguuuggacagga

SEQ ID NO: 2044918 - RNA, 14 nt, Human herpesvirus 6B
agagcggaagacga

SEQ ID NO: 2044919 - RNA, 16 nt, Human herpesvirus 6B
ugcucaugucaguauu

SEQ ID NO: 2044920 - RNA, 13 nt, Human herpesvirus 6B
uuauuugugcaaa

SEQ ID NO: 2044921 - RNA, 16 nt, Human herpesvirus 6B
ccgagcgggcuccguc

SEQ ID NO: 2044922 - RNA, 15 nt, Human herpesvirus 6B
gaagucuuuccugau

SEQ ID NO: 2044923 - RNA, 12 nt, Human herpesvirus 6B
uaccgacaagcc

SEQ ID NO: 2044924 - RNA, 20 nt, Human herpesvirus 6B
caucagaugaauugugcgug

SEQ ID NO: 2044925 - RNA, 15 nt, Human herpesvirus 6B
uaaaauugcuacuaa

SEQ ID NO: 2044926 - RNA, 22 nt, Human herpesvirus 6B
uccuguaguuuuuuucugauga

SEQ ID NO: 2044927 - RNA, 15 nt, Human herpesvirus 6B
cauaucaaacaacug

SEQ ID NO: 2044928 - RNA, 22 nt, Human herpesvirus 6B
uuugccaccagauaggaaaagg

SEQ ID NO: 2044929 - RNA, 14 nt, Human herpesvirus 6B
cgucccucucaccc

SEQ ID NO: 2044930 - RNA, 20 nt, Human herpesvirus 6B
auuaaagauugcaucgcugg

SEQ ID NO: 2044931 - RNA, 21 nt, Human herpesvirus 6B
aaucauccguucagcuuuaua

SEQ ID NO: 2044932 - RNA, 20 nt, Human herpesvirus 6B
cuguaaacaaauucuuacaa

SEQ ID NO: 2044933 - RNA, 14 nt, Human herpesvirus 6B
gcacgagccaaggg

SEQ ID NO: 2044934 - RNA, 14 nt, Human herpesvirus 6B
auugucauucugca

SEQ ID NO: 2044935 - RNA, 12 nt, Human herpesvirus 6B
auuuaccagaga

SEQ ID NO: 2044936 - RNA, 23 nt, Human herpesvirus 6B
aucucaaaaaggguuuucugaau

SEQ ID NO: 2044937 - RNA, 15 nt, Human herpesvirus 6B
uuuaccgguuuggug

SEQ ID NO: 2044938 - RNA, 18 nt, Human herpesvirus 6B
ggagagugcggggagaua

SEQ ID NO: 2044939 - RNA, 19 nt, Human herpesvirus 6B
ucuucuuggagucuggccu

SEQ ID NO: 2044940 - RNA, 13 nt, Human herpesvirus 6B
cucgcucuccugu

SEQ ID NO: 2044941 - RNA, 16 nt, Human herpesvirus 6B
cuaagcuggacagaaa

SEQ ID NO: 2044942 - RNA, 20 nt, Human herpesvirus 6B
auggaaaauuuauaaaaaac

SEQ ID NO: 2044943 - RNA, 23 nt, Human herpesvirus 6B
aaucucaagcacaaaaccaggaa

SEQ ID NO: 2044944 - RNA, 17 nt, Human herpesvirus 6B
ggcgcccgugguggccg

SEQ ID NO: 2044945 - RNA, 16 nt, Human herpesvirus 6B
agagauuuuggaagca

SEQ ID NO: 2044946 - RNA, 21 nt, Human herpesvirus 6B
uuugucguuuguacauguuaa

SEQ ID NO: 2044947 - RNA, 21 nt, Human herpesvirus 6B
ggcugauauacgauggacaga

SEQ ID NO: 2044948 - RNA, 17 nt, Human herpesvirus 6B
ugggcgcagaaggagaa

SEQ ID NO: 2044949 - RNA, 17 nt, Human herpesvirus 6B
caaaagacuauguagua

SEQ ID NO: 2044950 - RNA, 14 nt, Human herpesvirus 6B
aaaaccugcuaacg

SEQ ID NO: 2044951 - RNA, 23 nt, Human herpesvirus 6B
ccaacacuguuguuaaucuguuu

SEQ ID NO: 2044952 - RNA, 21 nt, Human herpesvirus 6B
uggguacaaugccaacacugu

SEQ ID NO: 2044953 - RNA, 15 nt, Human herpesvirus 6B
ggagugcgacaggag

SEQ ID NO: 2044954 - RNA, 17 nt, Human herpesvirus 6B
auccggccaauucauug

SEQ ID NO: 2044955 - RNA, 22 nt, Human herpesvirus 6B
aauacuauguggaaauuaaaaa

SEQ ID NO: 2044956 - RNA, 16 nt, Human herpesvirus 6B
cacgcgcggaccacuc

SEQ ID NO: 2044957 - RNA, 19 nt, Human herpesvirus 6B
cuagaaugccagguccagu

SEQ ID NO: 2044958 - RNA, 22 nt, Human herpesvirus 6B
aguuaccgugaugugggugugg

SEQ ID NO: 2044959 - RNA, 19 nt, Human herpesvirus 6B
aaaauauggaaacgaaugu

SEQ ID NO: 2044960 - RNA, 16 nt, Human herpesvirus 6B
ucgaugccaaagcuuu

SEQ ID NO: 2044961 - RNA, 14 nt, Human herpesvirus 6B
cucggcaggggccg

SEQ ID NO: 2044962 - RNA, 17 nt, Human herpesvirus 6B
uaaaauaacaugugaca

SEQ ID NO: 2044963 - RNA, 14 nt, Human herpesvirus 6B
ccagggugaagaca

SEQ ID NO: 2044964 - RNA, 19 nt, Human herpesvirus 6B
caaaauuaauucaaaugua

SEQ ID NO: 2044965 - RNA, 16 nt, Human herpesvirus 6B
acgaucaauauagagg

SEQ ID NO: 2044966 - RNA, 16 nt, Human herpesvirus 6B
aaacacggcgccuccc

SEQ ID NO: 2044967 - RNA, 20 nt, Human herpesvirus 6B
cuucgagauuuuagaauaaa

SEQ ID NO: 2044968 - RNA, 22 nt, Human herpesvirus 6B
accgcccugcuccguucccuuc

SEQ ID NO: 2044969 - RNA, 16 nt, Human herpesvirus 6B
aaauauaauucugacu

SEQ ID NO: 2044970 - RNA, 22 nt, Human herpesvirus 6B
cuguaguuuuuuucugaugacu

SEQ ID NO: 2044971 - RNA, 11 nt, Human herpesvirus 6B
acguuaaaagg

SEQ ID NO: 2044972 - RNA, 17 nt, Human herpesvirus 6B
auaaguugucauuguau

SEQ ID NO: 2044973 - RNA, 19 nt, Human herpesvirus 6B
gaauucguuacaaucucug

SEQ ID NO: 2044974 - RNA, 18 nt, Human herpesvirus 6B
gucucuggaagcacggcu

SEQ ID NO: 2044975 - RNA, 15 nt, Human herpesvirus 6B
ucgucaacaauaaua

SEQ ID NO: 2044976 - RNA, 20 nt, Human herpesvirus 6B
ucaaugcguuggagcaagcg

SEQ ID NO: 2044977 - RNA, 21 nt, Human herpesvirus 6B
ucacaaccaaacaguuucaga

SEQ ID NO: 2044978 - RNA, 13 nt, Human herpesvirus 6B
cucgaugccaaag

SEQ ID NO: 2044979 - RNA, 20 nt, Human herpesvirus 6B
gcacaauucuaacuaaaauu

SEQ ID NO: 2044980 - RNA, 15 nt, Human herpesvirus 6B
uaaagguuagugggu

SEQ ID NO: 2044981 - RNA, 14 nt, Human herpesvirus 6B
gaucugauuuugau

SEQ ID NO: 2044982 - RNA, 13 nt, Human herpesvirus 6B
agacauuuucuau

SEQ ID NO: 2044983 - RNA, 13 nt, Human herpesvirus 6B
guagcaaaugaau

SEQ ID NO: 2044984 - RNA, 20 nt, Human herpesvirus 6B
uucauaagcucuacacagag

SEQ ID NO: 2044985 - RNA, 15 nt, Human herpesvirus 6B
agugcuuuauccggc

SEQ ID NO: 2044986 - RNA, 15 nt, Human herpesvirus 6B
acguuaguaaggaag

SEQ ID NO: 2044987 - RNA, 15 nt, Human herpesvirus 6B
gguuuuugcugucac

SEQ ID NO: 2044988 - RNA, 17 nt, Human herpesvirus 6B
acucuuggauugcagau

SEQ ID NO: 2044989 - RNA, 16 nt, Human herpesvirus 6B
acaauaauuacuccca

SEQ ID NO: 2044990 - RNA, 21 nt, Human herpesvirus 6B
acaucaccaugaaagcacaga

SEQ ID NO: 2044991 - RNA, 15 nt, Human herpesvirus 6B
acuuuuuucuaaaac

SEQ ID NO: 2044992 - RNA, 14 nt, Human herpesvirus 6B
uaaaguuuugugau

SEQ ID NO: 2044993 - RNA, 20 nt, Human herpesvirus 6B
acacuguuguuaaucuguuu

SEQ ID NO: 2044994 - RNA, 14 nt, Human herpesvirus 6B
acgugaauuucaua

SEQ ID NO: 2044995 - RNA, 18 nt, Human herpesvirus 6B
cgaggucgccagauuggc

SEQ ID NO: 2044996 - RNA, 20 nt, Human herpesvirus 6B
cuuaaagaaaaaaagcagau

SEQ ID NO: 2044997 - RNA, 17 nt, Human herpesvirus 6B
aagaugagauuggagua

SEQ ID NO: 2044998 - RNA, 16 nt, Human herpesvirus 6B
gggcgucgucaacucc

SEQ ID NO: 2044999 - RNA, 13 nt, Human herpesvirus 6B
augcgaauuaaaa

SEQ ID NO: 2045000 - RNA, 18 nt, Human herpesvirus 6B
aggagcacgagccaaggg

SEQ ID NO: 2045001 - RNA, 22 nt, Human herpesvirus 6B
ggacagagcggagaggcgcggg

SEQ ID NO: 2045002 - RNA, 19 nt, Human herpesvirus 6B
uuguuucugaacuauuaaa

SEQ ID NO: 2045003 - RNA, 16 nt, Human herpesvirus 6B
cagggcauagaaagcg

SEQ ID NO: 2045004 - RNA, 23 nt, Human herpesvirus 6B
cgcauguuuauuucaaugcguuu

SEQ ID NO: 2045005 - RNA, 12 nt, Human herpesvirus 6B
acgggaaaagau

SEQ ID NO: 2045006 - RNA, 16 nt, Human herpesvirus 6B
uguucagcuucuucua

SEQ ID NO: 2045007 - RNA, 20 nt, Human herpesvirus 6B
ccuccucuuuuccccccgcc

SEQ ID NO: 2045008 - RNA, 10 nt, Human herpesvirus 6B
ccggccaauu

SEQ ID NO: 2045009 - RNA, 23 nt, Human herpesvirus 6B
ccgcgguugaagucuuuccuguu

SEQ ID NO: 2045010 - RNA, 19 nt, Human herpesvirus 6B
ugcagagguaaugugaacg

SEQ ID NO: 2045011 - RNA, 15 nt, Human herpesvirus 6B
aagagagauacaggu

SEQ ID NO: 2045012 - RNA, 15 nt, Human herpesvirus 6B
cgaccucgcucuccu

SEQ ID NO: 2045013 - RNA, 14 nt, Human herpesvirus 6B
aaaauuggcauuua

SEQ ID NO: 2045014 - RNA, 21 nt, Human herpesvirus 6B
ucaaacaacuguuguguuuga

SEQ ID NO: 2045015 - RNA, 13 nt, Human herpesvirus 6B
aaaggugugguga

SEQ ID NO: 2045016 - RNA, 22 nt, Human herpesvirus 6B
cugugaucaggaaauuaauaag

SEQ ID NO: 2045017 - RNA, 16 nt, Human herpesvirus 6B
uuuuuaaaaacacacu

SEQ ID NO: 2045018 - RNA, 14 nt, Human herpesvirus 6B
cauacauccagaaa

SEQ ID NO: 2045019 - RNA, 14 nt, Human herpesvirus 6B
gcaacuugcugucg

SEQ ID NO: 2045020 - RNA, 18 nt, Human herpesvirus 6B
auugugagaacagcgcau

SEQ ID NO: 2045021 - RNA, 16 nt, Human herpesvirus 6B
agcaauaacucuugga

SEQ ID NO: 2045022 - RNA, 16 nt, Human herpesvirus 6B
ugcuuuaaaaaugcuc

SEQ ID NO: 2045023 - RNA, 19 nt, Human herpesvirus 6B
cggauacgggugcuguccc

SEQ ID NO: 2045024 - RNA, 16 nt, Human herpesvirus 6B
ggacacgagaagaaca

SEQ ID NO: 2045025 - RNA, 19 nt, Human herpesvirus 6B
gcagaaguuuccgcgcugg

SEQ ID NO: 2045026 - RNA, 22 nt, Human herpesvirus 6B
agaaguuacuauuguauuuacu

SEQ ID NO: 2045027 - RNA, 21 nt, Human herpesvirus 6B
ucgugcgaaaaaacaguuucc

SEQ ID NO: 2045028 - RNA, 14 nt, Human herpesvirus 6B
ccccucuugcagug

SEQ ID NO: 2045029 - RNA, 14 nt, Human herpesvirus 6B
ucaaauauggcaga

SEQ ID NO: 2045030 - RNA, 13 nt, Human herpesvirus 6B
ucaaauguagcaa

SEQ ID NO: 2045031 - RNA, 12 nt, Human herpesvirus 6B
gauucaaaggau

SEQ ID NO: 2045032 - RNA, 16 nt, Human herpesvirus 6B
gccugcgcguggaaac

SEQ ID NO: 2045033 - RNA, 13 nt, Human herpesvirus 6B
ucggcaagaaagc

SEQ ID NO: 2045034 - RNA, 19 nt, Human herpesvirus 6B
gagacuuugcugauucugu

SEQ ID NO: 2045035 - RNA, 17 nt, Human herpesvirus 6B
auauacgauggacagaa

SEQ ID NO: 2045036 - RNA, 20 nt, Human herpesvirus 6B
gcuucaguaugucucaguuc

SEQ ID NO: 2045037 - RNA, 16 nt, Human herpesvirus 6B
ggaggaggaagaggag

SEQ ID NO: 2045038 - RNA, 20 nt, Human herpesvirus 6B
gccgucugucuguuccucag

SEQ ID NO: 2045039 - RNA, 22 nt, Human herpesvirus 6B
gcagaucuugaaaagccccugc

SEQ ID NO: 2045040 - RNA, 21 nt, Human herpesvirus 6B
caaagauauuucuaucuggaa

SEQ ID NO: 2045041 - RNA, 21 nt, Human herpesvirus 6B
caaaaaugcacaauuuagccu

SEQ ID NO: 2045042 - RNA, 20 nt, Human herpesvirus 6B
cacucgaggaaacgcgcugg

SEQ ID NO: 2045043 - RNA, 19 nt, Human herpesvirus 6B
aaugcagcaguuuuugugc

SEQ ID NO: 2045044 - RNA, 21 nt, Human herpesvirus 6B
aauaucaugauaaauuguuuc

SEQ ID NO: 2045045 - RNA, 16 nt, Human herpesvirus 6B
auaguaguugucguua

SEQ ID NO: 2045046 - RNA, 17 nt, Human herpesvirus 6B
cgugguggccgucuguc

SEQ ID NO: 2045047 - RNA, 15 nt, Human herpesvirus 6B
auuuggaugaaacgu

SEQ ID NO: 2045048 - RNA, 16 nt, Human herpesvirus 6B
cacucacauagagaag

SEQ ID NO: 2045049 - RNA, 22 nt, Human herpesvirus 6B
uccugcaauuugaauucugcuc

SEQ ID NO: 2045050 - RNA, 17 nt, Human herpesvirus 6B
uuuuucuucaggugucu

SEQ ID NO: 2045051 - RNA, 20 nt, Human herpesvirus 6B
aagcagaccaguuuacaagu

SEQ ID NO: 2045052 - RNA, 23 nt, Human herpesvirus 6B
uaucccucguacaagcuuaauaa

SEQ ID NO: 2045053 - RNA, 16 nt, Human herpesvirus 6B
cgggcgacgggcaggg

SEQ ID NO: 2045054 - RNA, 23 nt, Human herpesvirus 6B
uguuucuuugacauuuaccagag

SEQ ID NO: 2045055 - RNA, 14 nt, Human herpesvirus 6B
ucuaagcugguuac

SEQ ID NO: 2045056 - RNA, 21 nt, Human herpesvirus 6B
cgccuagagaacagauagaaa

SEQ ID NO: 2045057 - RNA, 15 nt, Human herpesvirus 6B
cggcgguuaacuguu

SEQ ID NO: 2045058 - RNA, 16 nt, Human herpesvirus 6B
acggauucgaucgaga

SEQ ID NO: 2045059 - RNA, 21 nt, Human herpesvirus 6B
cugcaauuugaauucugcucg

SEQ ID NO: 2045060 - RNA, 20 nt, Human herpesvirus 6B
gacuuagcuagacgugucuu

SEQ ID NO: 2045061 - RNA, 17 nt, Human herpesvirus 6B
aagaaugggaugcauua

SEQ ID NO: 2045062 - RNA, 15 nt, Human herpesvirus 6B
cggucgaaugagcuu

SEQ ID NO: 2045063 - RNA, 15 nt, Human herpesvirus 6B
acggcgucacacagc

SEQ ID NO: 2045064 - RNA, 17 nt, Human herpesvirus 6B
acagggcauagaaagcg

SEQ ID NO: 2045065 - RNA, 15 nt, Human herpesvirus 6B
auuuuucuuuacaga

SEQ ID NO: 2045066 - RNA, 14 nt, Human herpesvirus 6B
uauccagaagacug

SEQ ID NO: 2045067 - RNA, 20 nt, Human herpesvirus 6B
uguacguggccgucuccugc

SEQ ID NO: 2045068 - RNA, 18 nt, Human herpesvirus 6B
caaccuauguacagauag

SEQ ID NO: 2045069 - RNA, 18 nt, Human herpesvirus 6B
agcugcuaacggagcaac

SEQ ID NO: 2045070 - RNA, 17 nt, Human herpesvirus 6B
cucucacccccacucga

SEQ ID NO: 2045071 - RNA, 16 nt, Human herpesvirus 6B
aacaaagaacuuugug

SEQ ID NO: 2045072 - RNA, 17 nt, Human herpesvirus 6B
ugauaguuauuuuguau

SEQ ID NO: 2045073 - RNA, 11 nt, Human herpesvirus 6B
aaagggaaguc

SEQ ID NO: 2045074 - RNA, 15 nt, Human herpesvirus 6B
cgauagcuucagggc

SEQ ID NO: 2045075 - RNA, 22 nt, Human herpesvirus 6B
uuuauguaaacauagaaucucc

SEQ ID NO: 2045076 - RNA, 19 nt, Human herpesvirus 6B
cgugaaacacaagaagaau

SEQ ID NO: 2045077 - RNA, 18 nt, Human herpesvirus 6B
uggauuacgcuaggaaaa

SEQ ID NO: 2045078 - RNA, 20 nt, Human herpesvirus 6B
aagaaagaagacgcuuuuua

SEQ ID NO: 2045079 - RNA, 13 nt, Human herpesvirus 6B
gcauggaaaaggc

SEQ ID NO: 2045080 - RNA, 14 nt, Human herpesvirus 6B
gaaaaaaagcagau

SEQ ID NO: 2045081 - RNA, 13 nt, Human herpesvirus 6B
uuuuuuuuucaua

SEQ ID NO: 2045082 - RNA, 23 nt, Human herpesvirus 6B
uuaacaaugaaaauucaguuuuu

SEQ ID NO: 2045083 - RNA, 23 nt, Human herpesvirus 6B
cucuuaacaagagaggaugcuuu

SEQ ID NO: 2045084 - RNA, 16 nt, Human herpesvirus 6B
ugagacauuugauguu

SEQ ID NO: 2045085 - RNA, 15 nt, Human herpesvirus 6B
ggcgucaccaagaaa

SEQ ID NO: 2045086 - RNA, 15 nt, Human herpesvirus 6B
acgacuaucuccuug

SEQ ID NO: 2045087 - RNA, 16 nt, Human herpesvirus 6B
ugcuaagaucugucuc

SEQ ID NO: 2045088 - RNA, 22 nt, Human herpesvirus 6B
guggcaccgaauccggaauuua

SEQ ID NO: 2045089 - RNA, 15 nt, Human herpesvirus 6B
acaagcuuaauaagu

SEQ ID NO: 2045090 - RNA, 17 nt, Human herpesvirus 6B
aaaguaugcuuugaaau

SEQ ID NO: 2045091 - RNA, 15 nt, Human herpesvirus 6B
auguagcacacgaca

SEQ ID NO: 2045092 - RNA, 17 nt, Human herpesvirus 6B
gagcuuuaaagcagcua

SEQ ID NO: 2045093 - RNA, 15 nt, Human herpesvirus 6B
ccucucuccgccucc

SEQ ID NO: 2045094 - RNA, 18 nt, Human herpesvirus 6B
cggacuugcgagucuguc

SEQ ID NO: 2045095 - RNA, 12 nt, Human herpesvirus 6B
auauacaaaauu

SEQ ID NO: 2045096 - RNA, 21 nt, Human herpesvirus 6B
guugccuuuguaaaauguuuc

SEQ ID NO: 2045097 - RNA, 16 nt, Human herpesvirus 6B
acgaugugucggagac

SEQ ID NO: 2045098 - RNA, 17 nt, Human herpesvirus 6B
gaauauucuucgugaau

SEQ ID NO: 2045099 - RNA, 19 nt, Human herpesvirus 6B
acuaagugccguggcagaa

SEQ ID NO: 2045100 - RNA, 13 nt, Human herpesvirus 6B
gacuguagaaaac

SEQ ID NO: 2045101 - RNA, 15 nt, Human herpesvirus 6B
cgcacguaacaccag

SEQ ID NO: 2045102 - RNA, 17 nt, Human herpesvirus 6B
aucgagaaucuuccuuu

SEQ ID NO: 2045103 - RNA, 19 nt, Human herpesvirus 6B
agugacaguaacggcggcg

SEQ ID NO: 2045104 - RNA, 18 nt, Human herpesvirus 6B
aacagaaauuuaauugca

SEQ ID NO: 2045105 - RNA, 18 nt, Human herpesvirus 6B
gcaggcgcgucggcggga

SEQ ID NO: 2045106 - RNA, 24 nt, Human herpesvirus 6B
cccagucagauaaugaauuucaau

SEQ ID NO: 2045107 - RNA, 12 nt, Human herpesvirus 6B
uucugaaaucuu

SEQ ID NO: 2045108 - RNA, 14 nt, Human herpesvirus 6B
accagcucuguucu

SEQ ID NO: 2045109 - RNA, 17 nt, Human herpesvirus 6B
auaucaugauaaauugu

SEQ ID NO: 2045110 - RNA, 23 nt, Human herpesvirus 6B
auuuuuuaauccauauuuggaag

SEQ ID NO: 2045111 - RNA, 14 nt, Human herpesvirus 6B
aaauuuuuauguau

SEQ ID NO: 2045112 - RNA, 12 nt, Human herpesvirus 6B
cgaccagcacca

SEQ ID NO: 2045113 - RNA, 20 nt, Human herpesvirus 6B
ucaagggcaagguucucagc

SEQ ID NO: 2045114 - RNA, 20 nt, Human herpesvirus 6B
acgucccuucuccgucaccc

SEQ ID NO: 2045115 - RNA, 12 nt, Human herpesvirus 6B
aaggacuggcug

SEQ ID NO: 2045116 - RNA, 20 nt, Human herpesvirus 6B
cgggcucgaagcgacgcaag

SEQ ID NO: 2045117 - RNA, 16 nt, Human herpesvirus 6B
cucaaagaaagcuccg

SEQ ID NO: 2045118 - RNA, 19 nt, Human herpesvirus 6B
guugcccucccgcagcucc

SEQ ID NO: 2045119 - RNA, 12 nt, Human herpesvirus 6B
aaacgcuuuuuu

SEQ ID NO: 2045120 - RNA, 11 nt, Human herpesvirus 6B
ugggggauggg

SEQ ID NO: 2045121 - RNA, 17 nt, Human herpesvirus 6B
augaaacggaaaccgaa

SEQ ID NO: 2045122 - RNA, 20 nt, Human herpesvirus 6B
gacugaucuguagcgaauuu

SEQ ID NO: 2045123 - RNA, 17 nt, Human herpesvirus 6B
ccgucgucgcucucccu

SEQ ID NO: 2045124 - RNA, 13 nt, Human herpesvirus 6B
ucguccuccgcaa

SEQ ID NO: 2045125 - RNA, 13 nt, Human herpesvirus 6B
cagagagccgcag

SEQ ID NO: 2045126 - RNA, 16 nt, Human herpesvirus 6B
uguaguugaugcuguu

SEQ ID NO: 2045127 - RNA, 14 nt, Human herpesvirus 6B
aaaugaauguguuc

SEQ ID NO: 2045128 - RNA, 20 nt, Human herpesvirus 6B
uguuugaaacguugugcuga

SEQ ID NO: 2045129 - RNA, 12 nt, Human herpesvirus 6B
uccacagggcau

SEQ ID NO: 2045130 - RNA, 18 nt, Human herpesvirus 6B
uccucgucauaauuuucc

SEQ ID NO: 2045131 - RNA, 20 nt, Human herpesvirus 6B
gauacuacguguaauguuuc

SEQ ID NO: 2045132 - RNA, 19 nt, Human herpesvirus 6B
caaggguaacgcaggagaa

SEQ ID NO: 2045133 - RNA, 16 nt, Human herpesvirus 6B
caccagauaggaaaag

SEQ ID NO: 2045134 - RNA, 14 nt, Human herpesvirus 6B
accaacugagagac

SEQ ID NO: 2045135 - RNA, 19 nt, Human herpesvirus 6B
aauccacggauugacacaa

SEQ ID NO: 2045136 - RNA, 19 nt, Human herpesvirus 6B
uugaguuuaucgugcaauu

SEQ ID NO: 2045137 - RNA, 17 nt, Human herpesvirus 6B
uuugauuuucagaguuu

SEQ ID NO: 2045138 - RNA, 21 nt, Human herpesvirus 6B
auugaugggauguaaucaaug

SEQ ID NO: 2045139 - RNA, 19 nt, Human herpesvirus 6B
uccucuuuuccccccgccg

SEQ ID NO: 2045140 - RNA, 22 nt, Human herpesvirus 6B
uaaaauuuugcgucgucugugc

SEQ ID NO: 2045141 - RNA, 21 nt, Human herpesvirus 6B
caaugucgcagaaucaagaaa

SEQ ID NO: 2045142 - RNA, 23 nt, Human herpesvirus 6B
aaccgcaguuccuguuuuucuca

SEQ ID NO: 2045143 - RNA, 15 nt, Human herpesvirus 6B
cuugauuuuugagau

SEQ ID NO: 2045144 - RNA, 17 nt, Human herpesvirus 6B
uaugaaaucgauguaga

SEQ ID NO: 2045145 - RNA, 22 nt, Human herpesvirus 6B
guuuggugacggcgaugaaaaa

SEQ ID NO: 2045146 - RNA, 14 nt, Human herpesvirus 6B
ugugcaaaucagga

SEQ ID NO: 2045147 - RNA, 12 nt, Human herpesvirus 6B
gcgacgagaguc

SEQ ID NO: 2045148 - RNA, 16 nt, Human herpesvirus 6B
cccaggcgcagcagca

SEQ ID NO: 2045149 - RNA, 20 nt, Human herpesvirus 6B
ugacuauuucuuuaagcaag

SEQ ID NO: 2045150 - RNA, 17 nt, Human herpesvirus 6B
aguggcgauaauguuau

SEQ ID NO: 2045151 - RNA, 15 nt, Human herpesvirus 6B
guauguuuuguacaa

SEQ ID NO: 2045152 - RNA, 20 nt, Human herpesvirus 6B
ucacuaacuucaagaauucu

SEQ ID NO: 2045153 - RNA, 15 nt, Human herpesvirus 6B
aaacacuaagugccg

SEQ ID NO: 2045154 - RNA, 23 nt, Human herpesvirus 6B
uuucuagacaugagcgagaaugu

SEQ ID NO: 2045155 - RNA, 16 nt, Human herpesvirus 6B
agauuccucuguaaaa

SEQ ID NO: 2045156 - RNA, 13 nt, Human herpesvirus 6B
cauuucucuacau

SEQ ID NO: 2045157 - RNA, 11 nt, Human herpesvirus 6B
cuggacagaaa

SEQ ID NO: 2045158 - RNA, 23 nt, Human herpesvirus 6B
cguggcagaacagagacccuccu

SEQ ID NO: 2045159 - RNA, 15 nt, Human herpesvirus 6B
cugacugcguuacaa

SEQ ID NO: 2045160 - RNA, 12 nt, Human herpesvirus 6B
gcugcugggugu

SEQ ID NO: 2045161 - RNA, 18 nt, Human herpesvirus 6B
caucaucucucuuucaga

SEQ ID NO: 2045162 - RNA, 19 nt, Human herpesvirus 6B
cuuuuggcaggaagccugu

SEQ ID NO: 2045163 - RNA, 20 nt, Human herpesvirus 6B
uugcacuauuuuaaaugaca

SEQ ID NO: 2045164 - RNA, 17 nt, Human herpesvirus 6B
augaugaaacuccuucu

SEQ ID NO: 2045165 - RNA, 21 nt, Human herpesvirus 6B
guugucuucugugcuuuccaa

SEQ ID NO: 2045166 - RNA, 12 nt, Human herpesvirus 6B
cuguaaaguuug

SEQ ID NO: 2045167 - RNA, 23 nt, Human herpesvirus 6B
cuuacaaguauguuuuguacaaa

SEQ ID NO: 2045168 - RNA, 15 nt, Human herpesvirus 6B
acggagagucuucau

SEQ ID NO: 2045169 - RNA, 12 nt, Human herpesvirus 6B
gggccucccucc

SEQ ID NO: 2045170 - RNA, 15 nt, Human herpesvirus 6B
agaugucgggccaca

SEQ ID NO: 2045171 - RNA, 16 nt, Human herpesvirus 6B
uucgguuuugucguuu

SEQ ID NO: 2045172 - RNA, 22 nt, Human herpesvirus 6B
gggggcccgggcgcggggcgca

SEQ ID NO: 2045173 - RNA, 15 nt, Human herpesvirus 6B
ccaggcgcagcagca

SEQ ID NO: 2045174 - RNA, 16 nt, Human herpesvirus 6B
guguccucguccgucc

SEQ ID NO: 2045175 - RNA, 15 nt, Human herpesvirus 6B
auuuuuaaggauuga

SEQ ID NO: 2045176 - RNA, 22 nt, Human herpesvirus 6B
uacuucucuuuauagagcaauu

SEQ ID NO: 2045177 - RNA, 15 nt, Human herpesvirus 6B
aguguggaauuuaaa

SEQ ID NO: 2045178 - RNA, 20 nt, Human herpesvirus 6B
uagacaauuuaucgugcuug

SEQ ID NO: 2045179 - RNA, 18 nt, Human herpesvirus 6B
ugaaauuuucaauucgga

SEQ ID NO: 2045180 - RNA, 16 nt, Human herpesvirus 6B
aguaacggaaaaauuu

SEQ ID NO: 2045181 - RNA, 15 nt, Human herpesvirus 6B
auaaccuucugauuu

SEQ ID NO: 2045182 - RNA, 15 nt, Human herpesvirus 6B
uuuacgggauaaaga

SEQ ID NO: 2045183 - RNA, 13 nt, Human herpesvirus 6B
auguguucauaga

SEQ ID NO: 2045184 - RNA, 21 nt, Human herpesvirus 6B
gucuuugaucuuacuuaaccu

SEQ ID NO: 2045185 - RNA, 21 nt, Human herpesvirus 6B
acuucuugcgauuuugugaaa

SEQ ID NO: 2045186 - RNA, 16 nt, Human herpesvirus 6B
agcgcauccuuaaaug

SEQ ID NO: 2045187 - RNA, 19 nt, Human herpesvirus 6B
cauaaaaaagagauaaucu

SEQ ID NO: 2045188 - RNA, 13 nt, Human herpesvirus 6B
cggucucuggaag

SEQ ID NO: 2045189 - RNA, 23 nt, Human herpesvirus 6B
ggagaaguauuucgaucagauua

SEQ ID NO: 2045190 - RNA, 23 nt, Human herpesvirus 6B
uuuaugcagcucgggaaagauuu

SEQ ID NO: 2045191 - RNA, 20 nt, Human herpesvirus 6B
gcgagucugucaguggcuug

SEQ ID NO: 2045192 - RNA, 13 nt, Human herpesvirus 6B
cacuaacaaaaaa

SEQ ID NO: 2045193 - RNA, 18 nt, Human herpesvirus 6B
uaaaaucugcuaacggag

SEQ ID NO: 2045194 - RNA, 15 nt, Human herpesvirus 6B
gaaccauagguguuu

SEQ ID NO: 2045195 - RNA, 18 nt, Human herpesvirus 6B
uagaaaauugucuacaau

SEQ ID NO: 2045196 - RNA, 18 nt, Human herpesvirus 6B
uaaauguauaaaagagaa

SEQ ID NO: 2045197 - RNA, 17 nt, Human herpesvirus 6B
ugcuguaaaccaguauc

SEQ ID NO: 2045198 - RNA, 14 nt, Human herpesvirus 6B
ggagugcgacagga

SEQ ID NO: 2045199 - RNA, 15 nt, Human herpesvirus 6B
gcguccuccgcgaga

SEQ ID NO: 2045200 - RNA, 20 nt, Human herpesvirus 6B
acguacauaaacuauuguuu

SEQ ID NO: 2045201 - RNA, 23 nt, Human herpesvirus 6B
cgcauuucucuacaugccacaga

SEQ ID NO: 2045202 - RNA, 24 nt, Human herpesvirus 6B
gcgucuccgauccgucaggaccag

SEQ ID NO: 2045203 - RNA, 18 nt, Human herpesvirus 6B
agaacagcgcauaaauaa

SEQ ID NO: 2045204 - RNA, 14 nt, Human herpesvirus 6B
ggagugggaggagc

SEQ ID NO: 2045205 - RNA, 17 nt, Human herpesvirus 6B
cacuggcgaaggcccgu

SEQ ID NO: 2045206 - RNA, 22 nt, Human herpesvirus 6B
ccugagagcaggagcaggcucc

SEQ ID NO: 2045207 - RNA, 19 nt, Human herpesvirus 6B
cacgccauccacccauaua

SEQ ID NO: 2045208 - RNA, 20 nt, Human herpesvirus 6B
acugccgcaucgcaccgcag

SEQ ID NO: 2045209 - RNA, 16 nt, Human herpesvirus 6B
aaacugccgcuuaaau

SEQ ID NO: 2045210 - RNA, 14 nt, Human herpesvirus 6B
cggcgcgcgccguc

SEQ ID NO: 2045211 - RNA, 18 nt, Human herpesvirus 6B
agccgggagauuccucug

SEQ ID NO: 2045212 - RNA, 14 nt, Human herpesvirus 6B
aggucaagcgccag

SEQ ID NO: 2045213 - RNA, 19 nt, Human herpesvirus 6B
ccccggagcauacgcgccg

SEQ ID NO: 2045214 - RNA, 15 nt, Human herpesvirus 6B
cucgaugccaaagcu

SEQ ID NO: 2045215 - RNA, 19 nt, Human herpesvirus 6B
gccaguucacacagaugca

SEQ ID NO: 2045216 - RNA, 15 nt, Human herpesvirus 6B
ugauguugucuucug

SEQ ID NO: 2045217 - RNA, 14 nt, Human herpesvirus 6B
auggagaaaaacuu

SEQ ID NO: 2045218 - RNA, 18 nt, Human herpesvirus 6B
acgccuauucuaauuaua

SEQ ID NO: 2045219 - RNA, 15 nt, Human herpesvirus 6B
agcucuacacagagu

SEQ ID NO: 2045220 - RNA, 16 nt, Human herpesvirus 6B
uguauuugaaaugacg

SEQ ID NO: 2045221 - RNA, 20 nt, Human herpesvirus 6B
uaucacuuagacacggccag

SEQ ID NO: 2045222 - RNA, 19 nt, Human herpesvirus 6B
gcccugagagcaggagcag

SEQ ID NO: 2045223 - RNA, 11 nt, Human herpesvirus 6B
uauuuggaagc

SEQ ID NO: 2045224 - RNA, 16 nt, Human herpesvirus 6B
ucuacccaccuguccu

SEQ ID NO: 2045225 - RNA, 13 nt, Human herpesvirus 6B
acacaacacaucu

SEQ ID NO: 2045226 - RNA, 15 nt, Human herpesvirus 6B
agcuaucggacaggc

SEQ ID NO: 2045227 - RNA, 20 nt, Human herpesvirus 6B
cacggggauuuagugcagua

SEQ ID NO: 2045228 - RNA, 18 nt, Human herpesvirus 6B
ccugcuccguucccuucu

SEQ ID NO: 2045229 - RNA, 22 nt, Human herpesvirus 6B
uucuguaaccugucuuggaaga

SEQ ID NO: 2045230 - RNA, 19 nt, Human herpesvirus 6B
agagucuguuacaacaaua

SEQ ID NO: 2045231 - RNA, 18 nt, Human herpesvirus 6B
guuuagcaugggugagug

SEQ ID NO: 2045232 - RNA, 18 nt, Human herpesvirus 6B
uggcugggcgcagaagga

SEQ ID NO: 2045233 - RNA, 22 nt, Human herpesvirus 6B
uuaaggagcggacacgacaugu

SEQ ID NO: 2045234 - RNA, 15 nt, Human herpesvirus 6B
ucucgaaaauacaau

SEQ ID NO: 2045235 - RNA, 21 nt, Human herpesvirus 6B
caucucauaauuugccugagu

SEQ ID NO: 2045236 - RNA, 22 nt, Human herpesvirus 6B
guauuaauuuuuuguuucugaa

SEQ ID NO: 2045237 - RNA, 12 nt, Human herpesvirus 6B
acggcaggagca

SEQ ID NO: 2045238 - RNA, 21 nt, Human herpesvirus 6B
cccccucuugcaguggcgcgc

SEQ ID NO: 2045239 - RNA, 19 nt, Human herpesvirus 6B
aauuuuuuguuucugaaaa

SEQ ID NO: 2045240 - RNA, 17 nt, Human herpesvirus 6B
caaagucuuccgcggcg

SEQ ID NO: 2045241 - RNA, 14 nt, Human herpesvirus 6B
caucugcaaaaaca

SEQ ID NO: 2045242 - RNA, 18 nt, Human herpesvirus 6B
acaacacaauauaugaaa

SEQ ID NO: 2045243 - RNA, 13 nt, Human herpesvirus 6B
ucagcuggacaga

SEQ ID NO: 2045244 - RNA, 13 nt, Human herpesvirus 6B
cgcgggacagcgg

SEQ ID NO: 2045245 - RNA, 17 nt, Human herpesvirus 6B
uguaauuuuuagcaguc

SEQ ID NO: 2045246 - RNA, 23 nt, Human herpesvirus 6B
ccgagagaauagagauaaaugua

SEQ ID NO: 2045247 - RNA, 19 nt, Human herpesvirus 6B
acgugaaauaaaguuuaaa

SEQ ID NO: 2045248 - RNA, 16 nt, Human herpesvirus 6B
aagauucugcagaaug

SEQ ID NO: 2045249 - RNA, 20 nt, Human herpesvirus 6B
uccaaaagcgccugccuaca

SEQ ID NO: 2045250 - RNA, 11 nt, Human herpesvirus 6B
gaggaagagga

SEQ ID NO: 2045251 - RNA, 12 nt, Human herpesvirus 6B
gcuuuaaagcag

SEQ ID NO: 2045252 - RNA, 18 nt, Human herpesvirus 6B
accgguacgauuucuguu

SEQ ID NO: 2045253 - RNA, 19 nt, Human herpesvirus 6B
caccgucccucucaccccc

SEQ ID NO: 2045254 - RNA, 15 nt, Human herpesvirus 6B
guuucuacugcugcu

SEQ ID NO: 2045255 - RNA, 15 nt, Human herpesvirus 6B
gaaaugcagcaguuu

SEQ ID NO: 2045256 - RNA, 19 nt, Human herpesvirus 6B
guaucuuacaacacaauau

SEQ ID NO: 2045257 - RNA, 17 nt, Human herpesvirus 6B
cguccucgugcucuccg

SEQ ID NO: 2045258 - RNA, 14 nt, Human herpesvirus 6B
uguuugauuuucag

SEQ ID NO: 2045259 - RNA, 19 nt, Human herpesvirus 6B
agaaucaagaaacacuucu

SEQ ID NO: 2045260 - RNA, 16 nt, Human herpesvirus 6B
auguuuauuucaaugc

SEQ ID NO: 2045261 - RNA, 20 nt, Human herpesvirus 6B
aaguaugggcacaaagugcu

SEQ ID NO: 2045262 - RNA, 23 nt, Human herpesvirus 6B
cuaaaagacgcuugcuguuuucg

SEQ ID NO: 2045263 - RNA, 14 nt, Human herpesvirus 6B
gguuucuuuauccc

SEQ ID NO: 2045264 - RNA, 21 nt, Human herpesvirus 6B
aguaccucuaugauacuuuga

SEQ ID NO: 2045265 - RNA, 12 nt, Human herpesvirus 6B
cgaccucgcucu

SEQ ID NO: 2045266 - RNA, 19 nt, Human herpesvirus 6B
ucucuacaucaccaugaaa

SEQ ID NO: 2045267 - RNA, 15 nt, Human herpesvirus 6B
cccagaguuaaugca

SEQ ID NO: 2045268 - RNA, 18 nt, Human herpesvirus 6B
cagcaguaucaaucacug

SEQ ID NO: 2045269 - RNA, 11 nt, Human herpesvirus 6B
cuauucagagg

SEQ ID NO: 2045270 - RNA, 23 nt, Human herpesvirus 6B
aucggaagaggaagggauggcag

SEQ ID NO: 2045271 - RNA, 18 nt, Human herpesvirus 6B
auuagauaagagaguuuc

SEQ ID NO: 2045272 - RNA, 14 nt, Human herpesvirus 6B
agucggucuguucc

SEQ ID NO: 2045273 - RNA, 22 nt, Human herpesvirus 6B
acagcaguuuuuuggggaagcg

SEQ ID NO: 2045274 - RNA, 14 nt, Human herpesvirus 6B
aaaaauaagacuua

SEQ ID NO: 2045275 - RNA, 14 nt, Human herpesvirus 6B
caauuguauuguga

SEQ ID NO: 2045276 - RNA, 12 nt, Human herpesvirus 6B
cagaaaauguuc

SEQ ID NO: 2045277 - RNA, 22 nt, Human herpesvirus 6B
uuagaugucgggccacauuucg

SEQ ID NO: 2045278 - RNA, 17 nt, Human herpesvirus 6B
aggcggcgaccacagcg

SEQ ID NO: 2045279 - RNA, 12 nt, Human herpesvirus 6B
uuuuucauauuu

SEQ ID NO: 2045280 - RNA, 17 nt, Human herpesvirus 6B
uauuuaacauccaaaau

SEQ ID NO: 2045281 - RNA, 14 nt, Human herpesvirus 6B
aaaccaagguguuu

SEQ ID NO: 2045282 - RNA, 17 nt, Human herpesvirus 6B
ugcagccuaccauggcc

SEQ ID NO: 2045283 - RNA, 13 nt, Human herpesvirus 6B
ucuauucaggaau

SEQ ID NO: 2045284 - RNA, 16 nt, Human herpesvirus 6B
aacuauuaaaaaaccc

SEQ ID NO: 2045285 - RNA, 19 nt, Human herpesvirus 6B
guggccggcacgcgccguc

SEQ ID NO: 2045286 - RNA, 14 nt, Human herpesvirus 6B
uaugcgaauuaaaa

SEQ ID NO: 2045287 - RNA, 21 nt, Human herpesvirus 6B
aaugaguugcacauguuucug

SEQ ID NO: 2045288 - RNA, 16 nt, Human herpesvirus 6B
gauaucguuuuugcuu

SEQ ID NO: 2045289 - RNA, 16 nt, Human herpesvirus 6B
gagccggacaggaggu

SEQ ID NO: 2045290 - RNA, 18 nt, Human herpesvirus 6B
uguacaacgacugggaga

SEQ ID NO: 2045291 - RNA, 16 nt, Human herpesvirus 6B
agguucagacugcugc

SEQ ID NO: 2045292 - RNA, 18 nt, Human herpesvirus 6B
caauuucccaguuaauuu

SEQ ID NO: 2045293 - RNA, 14 nt, Human herpesvirus 6B
agcugaugauuuga

SEQ ID NO: 2045294 - RNA, 17 nt, Human herpesvirus 6B
augcaagucgcgaagug

SEQ ID NO: 2045295 - RNA, 14 nt, Human herpesvirus 6B
auugcucaaaauug

SEQ ID NO: 2045296 - RNA, 14 nt, Human herpesvirus 6B
gcagcagcagcucc

SEQ ID NO: 2045297 - RNA, 23 nt, Human herpesvirus 6B
cgucuacaucaaaauccaaagua

SEQ ID NO: 2045298 - RNA, 13 nt, Human herpesvirus 6B
uugauuuguaaaa

SEQ ID NO: 2045299 - RNA, 22 nt, Human herpesvirus 6B
cugcagauucggggggagacag

SEQ ID NO: 2045300 - RNA, 19 nt, Human herpesvirus 6B
gaggaaacgcgcugggacu

SEQ ID NO: 2045301 - RNA, 15 nt, Human herpesvirus 6B
auaucgauucuguaa

SEQ ID NO: 2045302 - RNA, 19 nt, Human herpesvirus 6B
cagagcugaugauuugaaa

SEQ ID NO: 2045303 - RNA, 17 nt, Human herpesvirus 6B
auagguaaacuguucuu

SEQ ID NO: 2045304 - RNA, 20 nt, Human herpesvirus 6B
acgcaggauuauaaaaacac

SEQ ID NO: 2045305 - RNA, 16 nt, Human herpesvirus 6B
guuagcccgugcagag

SEQ ID NO: 2045306 - RNA, 19 nt, Human herpesvirus 6B
cacuuaguugauaugaaug

SEQ ID NO: 2045307 - RNA, 14 nt, Human herpesvirus 6B
agcugcuaaaugug

SEQ ID NO: 2045308 - RNA, 19 nt, Human herpesvirus 6B
gaggugauuugaacagaga

SEQ ID NO: 2045309 - RNA, 12 nt, Human herpesvirus 6B
agaugaggagga

SEQ ID NO: 2045310 - RNA, 20 nt, Human herpesvirus 6B
gcgccugccuacacugcgaa

SEQ ID NO: 2045311 - RNA, 15 nt, Human herpesvirus 6B
agaucuuuauggagg

SEQ ID NO: 2045312 - RNA, 15 nt, Human herpesvirus 6B
auaacggcgcagaau

SEQ ID NO: 2045313 - RNA, 22 nt, Human herpesvirus 6B
uauuaagaaugaauuugagaag

SEQ ID NO: 2045314 - RNA, 15 nt, Human herpesvirus 6B
gugccggcgcgcaaa

SEQ ID NO: 2045315 - RNA, 19 nt, Human herpesvirus 6B
auguaaagaaacaaaauua

SEQ ID NO: 2045316 - RNA, 19 nt, Human herpesvirus 6B
auuucucuacaugccacag

SEQ ID NO: 2045317 - RNA, 20 nt, Human herpesvirus 6B
gcgauuuugugaaaggugug

SEQ ID NO: 2045318 - RNA, 14 nt, Human herpesvirus 6B
ucaaggaaacguug

SEQ ID NO: 2045319 - RNA, 18 nt, Human herpesvirus 6B
uacuguguauuguguacc

SEQ ID NO: 2045320 - RNA, 18 nt, Human herpesvirus 6B
cgccgccucgccgcuccc

SEQ ID NO: 2045321 - RNA, 17 nt, Human herpesvirus 6B
cuggugaauguuucuga

SEQ ID NO: 2045322 - RNA, 11 nt, Human herpesvirus 6B
guuaauguuua

SEQ ID NO: 2045323 - RNA, 21 nt, Human herpesvirus 6B
ucuuacgggcgcuuuugacgu

SEQ ID NO: 2045324 - RNA, 21 nt, Human herpesvirus 6B
aagauauuaugucgauacaau

SEQ ID NO: 2045325 - RNA, 15 nt, Human herpesvirus 6B
aguacaaagauauuu

SEQ ID NO: 2045326 - RNA, 20 nt, Human herpesvirus 6B
uucagugucagcauugucag

SEQ ID NO: 2045327 - RNA, 18 nt, Human herpesvirus 6B
uaaaauuuuuaaacagau

SEQ ID NO: 2045328 - RNA, 20 nt, Human herpesvirus 6B
cgggcguuaucgacggcagc

SEQ ID NO: 2045329 - RNA, 21 nt, Human herpesvirus 6B
ucucgaaaaugcugauuuuaa

SEQ ID NO: 2045330 - RNA, 19 nt, Human herpesvirus 6B
cuguuauucuacugugcau

SEQ ID NO: 2045331 - RNA, 19 nt, Human herpesvirus 6B
aaugauaacuguuuuuguc

SEQ ID NO: 2045332 - RNA, 15 nt, Human herpesvirus 6B
ccagaugcagucucc

SEQ ID NO: 2045333 - RNA, 18 nt, Human herpesvirus 6B
uuuugcgucgucugugca

SEQ ID NO: 2045334 - RNA, 20 nt, Human herpesvirus 6B
cgaaagcaguuuugcagcau

SEQ ID NO: 2045335 - RNA, 15 nt, Human herpesvirus 6B
aaaacggguuuauuu

SEQ ID NO: 2045336 - RNA, 20 nt, Human herpesvirus 6B
uccaucucuagaaucuuacu

SEQ ID NO: 2045337 - RNA, 13 nt, Human herpesvirus 6B
cggagcacccggg

SEQ ID NO: 2045338 - RNA, 13 nt, Human herpesvirus 6B
uuuuaugcaagac

SEQ ID NO: 2045339 - RNA, 12 nt, Human herpesvirus 6B
uaaccuucugau

SEQ ID NO: 2045340 - RNA, 13 nt, Human herpesvirus 6B
uugucauuucccu

SEQ ID NO: 2045341 - RNA, 21 nt, Human herpesvirus 6B
cugcuaaaagcuauguaugaa

SEQ ID NO: 2045342 - RNA, 18 nt, Human herpesvirus 6B
cguuuguacauguuaaca

SEQ ID NO: 2045343 - RNA, 17 nt, Human herpesvirus 6B
cggagcccugagagcag

SEQ ID NO: 2045344 - RNA, 18 nt, Human herpesvirus 6B
ucuuccuguacagaauuu

SEQ ID NO: 2045345 - RNA, 20 nt, Human herpesvirus 6B
uugauguugucuucugugcu

SEQ ID NO: 2045346 - RNA, 20 nt, Human herpesvirus 6B
uaucguagagcaguuucuuu

SEQ ID NO: 2045347 - RNA, 19 nt, Human herpesvirus 6B
uugucgguaaauauugucu

SEQ ID NO: 2045348 - RNA, 20 nt, Human herpesvirus 6B
uucgggaugugcggagaaag

SEQ ID NO: 2045349 - RNA, 19 nt, Human herpesvirus 6B
aauuaugacugacaaggua

SEQ ID NO: 2045350 - RNA, 16 nt, Human herpesvirus 6B
auuagauaagagaguu

SEQ ID NO: 2045351 - RNA, 12 nt, Human herpesvirus 6B
ggguguggccgg

SEQ ID NO: 2045352 - RNA, 24 nt, Human herpesvirus 6B
uggcagccuaaacggagacugcac

SEQ ID NO: 2045353 - RNA, 19 nt, Human herpesvirus 6B
ccagcucuguucucuccca

SEQ ID NO: 2045354 - RNA, 20 nt, Human herpesvirus 6B
aagagcacgaagaagggcag

SEQ ID NO: 2045355 - RNA, 14 nt, Human herpesvirus 6B
uaauguaaauguua

SEQ ID NO: 2045356 - RNA, 21 nt, Human herpesvirus 6B
cgugaugagagacaucuguuu

SEQ ID NO: 2045357 - RNA, 19 nt, Human herpesvirus 6B
cuccugugcguccuccucg

SEQ ID NO: 2045358 - RNA, 22 nt, Human herpesvirus 6B
ggacaaauaaguggugaugaau

SEQ ID NO: 2045359 - RNA, 15 nt, Human herpesvirus 6B
aagaggaagggaugg

SEQ ID NO: 2045360 - RNA, 19 nt, Human herpesvirus 6B
cuggaucggacggugaugg

SEQ ID NO: 2045361 - RNA, 13 nt, Human herpesvirus 6B
ccgcagcuccuuc

SEQ ID NO: 2045362 - RNA, 16 nt, Human herpesvirus 6B
cuugaaagaguacagg

SEQ ID NO: 2045363 - RNA, 17 nt, Human herpesvirus 6B
cauguucgccucucccg

SEQ ID NO: 2045364 - RNA, 13 nt, Human herpesvirus 6B
gucuggccucugc

SEQ ID NO: 2045365 - RNA, 19 nt, Human herpesvirus 6B
cugcguuccaugugucucc

SEQ ID NO: 2045366 - RNA, 20 nt, Human herpesvirus 6B
ccugcaauuugaauucugcu

SEQ ID NO: 2045367 - RNA, 13 nt, Human herpesvirus 6B
uucaauagcaguu

SEQ ID NO: 2045368 - RNA, 20 nt, Human herpesvirus 6B
ucgcaagcccggagaacuga

SEQ ID NO: 2045369 - RNA, 14 nt, Human herpesvirus 6B
auggaacuucauag

SEQ ID NO: 2045370 - RNA, 17 nt, Human herpesvirus 6B
uccuguuuucccaccua

SEQ ID NO: 2045371 - RNA, 14 nt, Human herpesvirus 6B
gacgggucggucug

SEQ ID NO: 2045372 - RNA, 20 nt, Human herpesvirus 6B
gcugucgcccgccucucucc

SEQ ID NO: 2045373 - RNA, 21 nt, Human herpesvirus 6B
gcuauuugacaauaaacauga

SEQ ID NO: 2045374 - RNA, 22 nt, Human herpesvirus 6B
ugaaaucgauguagauguuuug

SEQ ID NO: 2045375 - RNA, 21 nt, Human herpesvirus 6B
cuaagcucguuaguaauuugg

SEQ ID NO: 2045376 - RNA, 16 nt, Human herpesvirus 6B
uugaggcaacuuuuuu

SEQ ID NO: 2045377 - RNA, 23 nt, Human herpesvirus 6B
ucggggacagugauuaggauguu

SEQ ID NO: 2045378 - RNA, 19 nt, Human herpesvirus 6B
ccggcccguccaccguccc

SEQ ID NO: 2045379 - RNA, 23 nt, Human herpesvirus 6B
auucuuguucgggccaagguaaa

SEQ ID NO: 2045380 - RNA, 15 nt, Human herpesvirus 6B
agaaucuuaaaggau

SEQ ID NO: 2045381 - RNA, 14 nt, Human herpesvirus 6B
auagacgacgcaga

SEQ ID NO: 2045382 - RNA, 19 nt, Human herpesvirus 6B
gacccuccacgccccuccg

SEQ ID NO: 2045383 - RNA, 16 nt, Human herpesvirus 6B
ucugaaaauaaaguug

SEQ ID NO: 2045384 - RNA, 15 nt, Human herpesvirus 6B
cgugcacgcgccugu

SEQ ID NO: 2045385 - RNA, 19 nt, Human herpesvirus 6B
caaguuaaauuucguugua

SEQ ID NO: 2045386 - RNA, 22 nt, Human herpesvirus 6B
gacauugguugauuuuuguaaa

SEQ ID NO: 2045387 - RNA, 20 nt, Human herpesvirus 6B
auguccgaaguaaaaaagau

SEQ ID NO: 2045388 - RNA, 13 nt, Human herpesvirus 6B
uucucugucgcug

SEQ ID NO: 2045389 - RNA, 20 nt, Human herpesvirus 6B
ucuaacuacauuuuaguauu

SEQ ID NO: 2045390 - RNA, 20 nt, Human herpesvirus 6B
gaaaauacgucagcucuuca

SEQ ID NO: 2045391 - RNA, 22 nt, Human herpesvirus 6B
cuggcgcuuguaggagcacgag

SEQ ID NO: 2045392 - RNA, 18 nt, Human herpesvirus 6B
gugguggccgucugucug

SEQ ID NO: 2045393 - RNA, 17 nt, Human herpesvirus 6B
auucgcaagacuacaga

SEQ ID NO: 2045394 - RNA, 13 nt, Human herpesvirus 6B
ugacacaauuucu

SEQ ID NO: 2045395 - RNA, 23 nt, Human herpesvirus 6B
cugcagggaugugguaugagcug

SEQ ID NO: 2045396 - RNA, 15 nt, Human herpesvirus 6B
cagucuccacagggc

SEQ ID NO: 2045397 - RNA, 19 nt, Human herpesvirus 6B
ggagcuaguuacggggaag

SEQ ID NO: 2045398 - RNA, 19 nt, Human herpesvirus 6B
caaaagauuauggcaacau

SEQ ID NO: 2045399 - RNA, 20 nt, Human herpesvirus 6B
aacgauuuaugacagcaaug

SEQ ID NO: 2045400 - RNA, 16 nt, Human herpesvirus 6B
cgcgguugaagucuuu

SEQ ID NO: 2045401 - RNA, 21 nt, Human herpesvirus 6B
ugguuuuucgauguuuccagg

SEQ ID NO: 2045402 - RNA, 22 nt, Human herpesvirus 6B
agagcugaugauuugaaauguu

SEQ ID NO: 2045403 - RNA, 16 nt, Human herpesvirus 6B
caaauguagcaaauga

SEQ ID NO: 2045404 - RNA, 17 nt, Human herpesvirus 6B
guauauaguuuucugau

SEQ ID NO: 2045405 - RNA, 23 nt, Human herpesvirus 6B
auuggcccuuauauggaugcugg

SEQ ID NO: 2045406 - RNA, 22 nt, Human herpesvirus 6B
auuaauucaaauguagcaaaug

SEQ ID NO: 2045407 - RNA, 22 nt, Human herpesvirus 6B
cuauucaggaauauuuaguuua

SEQ ID NO: 2045408 - RNA, 15 nt, Human herpesvirus 6B
aguauucuucuuccc

SEQ ID NO: 2045409 - RNA, 18 nt, Human herpesvirus 6B
cugugaugggaaauguug

SEQ ID NO: 2045410 - RNA, 22 nt, Human herpesvirus 6B
guggaaaucuauuaauuuugaa

SEQ ID NO: 2045411 - RNA, 14 nt, Human herpesvirus 6B
ugaagucuuuccug

SEQ ID NO: 2045412 - RNA, 22 nt, Human herpesvirus 6B
ggcggcgaccacagcggcagcg

SEQ ID NO: 2045413 - RNA, 22 nt, Human herpesvirus 6B
gcucucguggcccgugggggca

SEQ ID NO: 2045414 - RNA, 21 nt, Human herpesvirus 6B
gaauccgcgggccagcccuga

SEQ ID NO: 2045415 - RNA, 17 nt, Human herpesvirus 6B
aaguauucuucuucccc

SEQ ID NO: 2045416 - RNA, 13 nt, Human herpesvirus 6B
caacuguuguguu

SEQ ID NO: 2045417 - RNA, 15 nt, Human herpesvirus 6B
aaagaaacaaagucu

SEQ ID NO: 2045418 - RNA, 17 nt, Human herpesvirus 6B
uacguggccgucuccug

SEQ ID NO: 2045419 - RNA, 17 nt, Human herpesvirus 6B
agaagaucuaaugaaug

SEQ ID NO: 2045420 - RNA, 15 nt, Human herpesvirus 6B
ugaaggguguuucca

SEQ ID NO: 2045421 - RNA, 21 nt, Human herpesvirus 6B
aaagcaaucgucuuugauuua

SEQ ID NO: 2045422 - RNA, 18 nt, Human herpesvirus 6B
auacgugaauuucauaga

SEQ ID NO: 2045423 - RNA, 22 nt, Human herpesvirus 6B
agacauuugauguugucuucug

SEQ ID NO: 2045424 - RNA, 22 nt, Human herpesvirus 6B
aauuuguaucucagaucuucga

SEQ ID NO: 2045425 - RNA, 17 nt, Human herpesvirus 6B
caaugaguuuuuugcaa

SEQ ID NO: 2045426 - RNA, 14 nt, Human herpesvirus 6B
ucgaugccaaagcu

SEQ ID NO: 2045427 - RNA, 16 nt, Human herpesvirus 6B
cggagucggucuguuc

SEQ ID NO: 2045428 - RNA, 18 nt, Human herpesvirus 6B
ucugccgucaccugcacu

SEQ ID NO: 2045429 - RNA, 17 nt, Human herpesvirus 6B
acauccaaaauacacua

SEQ ID NO: 2045430 - RNA, 14 nt, Human herpesvirus 6B
aguaccgaauaaaa

SEQ ID NO: 2045431 - RNA, 22 nt, Human herpesvirus 6B
ccugcaauuugaauucugcucg

SEQ ID NO: 2045432 - RNA, 14 nt, Human herpesvirus 6B
ugauuugaacagag

SEQ ID NO: 2045433 - RNA, 16 nt, Human herpesvirus 6B
uuugaucccuaauacu

SEQ ID NO: 2045434 - RNA, 16 nt, Human herpesvirus 6B
caaaaaaauauuggau

SEQ ID NO: 2045435 - RNA, 19 nt, Human herpesvirus 6B
cuaagaaaccgauuuacca

SEQ ID NO: 2045436 - RNA, 22 nt, Human herpesvirus 6B
cugggacuccgagccggacagg

SEQ ID NO: 2045437 - RNA, 23 nt, Human herpesvirus 6B
ucucccaugguuccgggauguag

SEQ ID NO: 2045438 - RNA, 23 nt, Human herpesvirus 6B
guaucuugcggcauguguaagaa

SEQ ID NO: 2045439 - RNA, 15 nt, Human herpesvirus 6B
gcauaauccuuuucu

SEQ ID NO: 2045440 - RNA, 14 nt, Human herpesvirus 6B
aaacuaacaugaca

SEQ ID NO: 2045441 - RNA, 13 nt, Human herpesvirus 6B
ucuguaaaaggau

SEQ ID NO: 2045442 - RNA, 13 nt, Human herpesvirus 6B
uuaguuuuggaug

SEQ ID NO: 2045443 - RNA, 14 nt, Human herpesvirus 6B
uguaugaggcuauu

SEQ ID NO: 2045444 - RNA, 18 nt, Human herpesvirus 6B
aaagucgcuucgaauguu

SEQ ID NO: 2045445 - RNA, 21 nt, Human herpesvirus 6B
ucauuaccaguagcacgaacc

SEQ ID NO: 2045446 - RNA, 21 nt, Human herpesvirus 6B
acucugcaacuuuauuugaaa

SEQ ID NO: 2045447 - RNA, 18 nt, Human herpesvirus 6B
cgggcgguucucgccagc

SEQ ID NO: 2045448 - RNA, 22 nt, Human herpesvirus 6B
cauguaaaauuaccucaucccu

SEQ ID NO: 2045449 - RNA, 22 nt, Human herpesvirus 6B
uacuguaaacaaauucuuacaa

SEQ ID NO: 2045450 - RNA, 15 nt, Human herpesvirus 6B
ugggaguaauuauug

SEQ ID NO: 2045451 - RNA, 17 nt, Human herpesvirus 6B
ccccucuugcaguggcg

SEQ ID NO: 2045452 - RNA, 18 nt, Human herpesvirus 6B
uccgcucuggcaugcguu

SEQ ID NO: 2045453 - RNA, 15 nt, Human herpesvirus 6B
gcagucgcggcggcc

SEQ ID NO: 2045454 - RNA, 16 nt, Human herpesvirus 6B
gucacucacauagaga

SEQ ID NO: 2045455 - RNA, 21 nt, Human herpesvirus 6B
gauaugucguuucaugggaga

SEQ ID NO: 2045456 - RNA, 11 nt, Human herpesvirus 6B
gcgagaugcag

SEQ ID NO: 2045457 - RNA, 17 nt, Human herpesvirus 6B
aagaagcagcagaugcu

SEQ ID NO: 2045458 - RNA, 23 nt, Human herpesvirus 6B
uccuuuguggcucuauucuacau

SEQ ID NO: 2045459 - RNA, 22 nt, Human herpesvirus 6B
uacaaugaguuuuuugcaauuu

SEQ ID NO: 2045460 - RNA, 20 nt, Human herpesvirus 6B
aauucaugccgccugaaacc

SEQ ID NO: 2045461 - RNA, 20 nt, Human herpesvirus 6B
cgaaguacacuucaugggca

SEQ ID NO: 2045462 - RNA, 21 nt, Human herpesvirus 6B
cggaagugcaugcgacagaca

SEQ ID NO: 2045463 - RNA, 20 nt, Human herpesvirus 6B
gcgacuauuuaacugggaaa

SEQ ID NO: 2045464 - RNA, 14 nt, Human herpesvirus 6B
gaacccuagacaca

SEQ ID NO: 2045465 - RNA, 14 nt, Human herpesvirus 6B
guaauuggacauug

SEQ ID NO: 2045466 - RNA, 18 nt, Human herpesvirus 6B
augucacaaaucuguaag

SEQ ID NO: 2045467 - RNA, 15 nt, Human herpesvirus 6B
cgcagacagauaucu

SEQ ID NO: 2045468 - RNA, 17 nt, Human herpesvirus 6B
cgggaucccagaugcag

SEQ ID NO: 2045469 - RNA, 18 nt, Human herpesvirus 6B
ugaaguguuaugaagaau

SEQ ID NO: 2045470 - RNA, 14 nt, Human herpesvirus 6B
aaauaauauuugca

SEQ ID NO: 2045471 - RNA, 22 nt, Human herpesvirus 6B
acccaauggcggacaaaaauuc

SEQ ID NO: 2045472 - RNA, 15 nt, Human herpesvirus 6B
cucggauuccgcaca

SEQ ID NO: 2045473 - RNA, 12 nt, Human herpesvirus 6B
ucagauguggaa

SEQ ID NO: 2045474 - RNA, 18 nt, Human herpesvirus 6B
ugugaacguguuuggaca

SEQ ID NO: 2045475 - RNA, 16 nt, Human herpesvirus 6B
ugaauugugcaagcug

SEQ ID NO: 2045476 - RNA, 15 nt, Human herpesvirus 6B
gaaauuuacaaucau

SEQ ID NO: 2045477 - RNA, 20 nt, Human herpesvirus 6B
ugacugauauuaacaauccg

SEQ ID NO: 2045478 - RNA, 13 nt, Human herpesvirus 6B
gaauaaugaaauu

SEQ ID NO: 2045479 - RNA, 22 nt, Human herpesvirus 6B
agcccgcucggucucgcacguc

SEQ ID NO: 2045480 - RNA, 9 nt, Human herpesvirus 6B
uuacuauug

SEQ ID NO: 2045481 - RNA, 12 nt, Human herpesvirus 6B
aaaugacucuaa

SEQ ID NO: 2045482 - RNA, 12 nt, Human herpesvirus 6B
gcucggcagggg

SEQ ID NO: 2045483 - RNA, 19 nt, Human herpesvirus 6B
gugacagcaacuaagcugu

SEQ ID NO: 2045484 - RNA, 23 nt, Human herpesvirus 6B
ccuccgcgagacgguacagcgcg

SEQ ID NO: 2045485 - RNA, 19 nt, Human herpesvirus 6B
cgcguggcggcgcgcgccg

SEQ ID NO: 2045486 - RNA, 13 nt, Human herpesvirus 6B
ucuaaaucugaaa

SEQ ID NO: 2045487 - RNA, 21 nt, Human herpesvirus 6B
caaaaaaaaaugacugauauu

SEQ ID NO: 2045488 - RNA, 20 nt, Human herpesvirus 6B
gaucgggccuggggacagac

SEQ ID NO: 2045489 - RNA, 16 nt, Human herpesvirus 6B
ccuccggcacugccgc

SEQ ID NO: 2045490 - RNA, 15 nt, Human herpesvirus 6B
ugccuuuguaaaaug

SEQ ID NO: 2045491 - RNA, 19 nt, Human herpesvirus 6B
cucauacccggcggaggcg

SEQ ID NO: 2045492 - RNA, 22 nt, Human herpesvirus 6B
gguugagaaaacaugacggacu

SEQ ID NO: 2045493 - RNA, 12 nt, Human herpesvirus 6B
cuguuguggauu

SEQ ID NO: 2045494 - RNA, 19 nt, Human herpesvirus 6B
uucuaagacgagauguuuc

SEQ ID NO: 2045495 - RNA, 20 nt, Human herpesvirus 6B
uucuuaccaagaaaucacgu

SEQ ID NO: 2045496 - RNA, 20 nt, Human herpesvirus 6B
cuuuacauaacauagaaaaa

SEQ ID NO: 2045497 - RNA, 13 nt, Human herpesvirus 6B
gcgcgcguugggg

SEQ ID NO: 2045498 - RNA, 18 nt, Human herpesvirus 6B
acauagaaaaauaagacu

SEQ ID NO: 2045499 - RNA, 14 nt, Human herpesvirus 6B
cuccgcgcugcugg

SEQ ID NO: 2045500 - RNA, 14 nt, Human herpesvirus 6B
agcauuaugauggc

SEQ ID NO: 2045501 - RNA, 17 nt, Human herpesvirus 6B
ucggcgugagacaauua

SEQ ID NO: 2045502 - RNA, 21 nt, Human herpesvirus 6B
gcacaaaaccaggaauccuau

SEQ ID NO: 2045503 - RNA, 17 nt, Human herpesvirus 6B
aaagucaaaguccugga

SEQ ID NO: 2045504 - RNA, 19 nt, Human herpesvirus 6B
aaaaccugcuaacggagca

SEQ ID NO: 2045505 - RNA, 22 nt, Human herpesvirus 6B
aacuucauacccgauguucucu

SEQ ID NO: 2045506 - RNA, 16 nt, Human herpesvirus 6B
gcggcucauacccggc

SEQ ID NO: 2045507 - RNA, 14 nt, Human herpesvirus 6B
ugcauuaaggaaaa

SEQ ID NO: 2045508 - RNA, 15 nt, Human herpesvirus 6B
ggaauacaccggaga

SEQ ID NO: 2045509 - RNA, 21 nt, Human herpesvirus 6B
aagauaacggcgcagaauuac

SEQ ID NO: 2045510 - RNA, 20 nt, Human herpesvirus 6B
gccgugagaaacgcaaaggg

SEQ ID NO: 2045511 - RNA, 18 nt, Human herpesvirus 6B
aagccagccgcccucccc

SEQ ID NO: 2045512 - RNA, 14 nt, Human herpesvirus 6B
uguucguugucuga

SEQ ID NO: 2045513 - RNA, 13 nt, Human herpesvirus 6B
uccugcaauuuga

SEQ ID NO: 2045514 - RNA, 16 nt, Human herpesvirus 6B
guuauaauauuaacaa

SEQ ID NO: 2045515 - RNA, 15 nt, Human herpesvirus 6B
gucguaacaugauuc

SEQ ID NO: 2045516 - RNA, 14 nt, Human herpesvirus 6B
ucuuuguccuaugu

SEQ ID NO: 2045517 - RNA, 12 nt, Human herpesvirus 6B
cagacgacagcg

SEQ ID NO: 2045518 - RNA, 23 nt, Human herpesvirus 6B
cuuuucaguauagacauuuugug

SEQ ID NO: 2045519 - RNA, 16 nt, Human herpesvirus 6B
cuccguucccuucucg

SEQ ID NO: 2045520 - RNA, 15 nt, Human herpesvirus 6B
cgcgccgugacacgg

SEQ ID NO: 2045521 - RNA, 13 nt, Human herpesvirus 6B
accucaucccuua

SEQ ID NO: 2045522 - RNA, 21 nt, Human herpesvirus 6B
cuaacgcggcaaccgcaguuc

SEQ ID NO: 2045523 - RNA, 21 nt, Human herpesvirus 6B
gaauaacagaugaggaggagg

SEQ ID NO: 2045524 - RNA, 22 nt, Human herpesvirus 6B
cccagaugcagucuccacaggg

SEQ ID NO: 2045525 - RNA, 14 nt, Human herpesvirus 6B
ugaacagagauuuu

SEQ ID NO: 2045526 - RNA, 17 nt, Human herpesvirus 6B
auuuuauuuuguggcua

SEQ ID NO: 2045527 - RNA, 17 nt, Human herpesvirus 6B
aaacauagaaucuccaa

SEQ ID NO: 2045528 - RNA, 23 nt, Human herpesvirus 6B
aagucuuauuuuucuauguuaug

SEQ ID NO: 2045529 - RNA, 18 nt, Human herpesvirus 6B
augacaaauuuucagcua

SEQ ID NO: 2045530 - RNA, 19 nt, Human herpesvirus 6B
agccccugcuugaaagagu

SEQ ID NO: 2045531 - RNA, 19 nt, Human herpesvirus 6B
gaaucgucgaaaaaaauga

SEQ ID NO: 2045532 - RNA, 15 nt, Human herpesvirus 6B
accacucgggccggu

SEQ ID NO: 2045533 - RNA, 21 nt, Human herpesvirus 6B
auaacgauaucguuuuugcuu

SEQ ID NO: 2045534 - RNA, 17 nt, Human herpesvirus 6B
augaaaucgauguagau

SEQ ID NO: 2045535 - RNA, 19 nt, Human herpesvirus 6B
gaaauguugccuuuguaaa

SEQ ID NO: 2045536 - RNA, 18 nt, Human herpesvirus 6B
aacacacacggagaauac

SEQ ID NO: 2045537 - RNA, 19 nt, Human herpesvirus 6B
guuccuccgcgggaccugg

SEQ ID NO: 2045538 - RNA, 12 nt, Human herpesvirus 6B
uuguucuuggag

SEQ ID NO: 2045539 - RNA, 21 nt, Human herpesvirus 6B
gacgugcggagaugccgugag

SEQ ID NO: 2045540 - RNA, 17 nt, Human herpesvirus 6B
ggaggaggaggaagagg

SEQ ID NO: 2045541 - RNA, 20 nt, Human herpesvirus 6B
ccugaugguuaaggaaaaag

SEQ ID NO: 2045542 - RNA, 23 nt, Human herpesvirus 6B
aaccgcaguuucuguuuuucuca

SEQ ID NO: 2045543 - RNA, 13 nt, Human herpesvirus 6B
auuaauuaucauu

SEQ ID NO: 2045544 - RNA, 14 nt, Human herpesvirus 6B
auagcuggauuauc

SEQ ID NO: 2045545 - RNA, 15 nt, Human herpesvirus 6B
uccccccucccucca

SEQ ID NO: 2045546 - RNA, 17 nt, Human herpesvirus 6B
aucgacgaccaggcacc

SEQ ID NO: 2045547 - RNA, 14 nt, Human herpesvirus 6B
agaagaagauauuu

SEQ ID NO: 2045548 - RNA, 22 nt, Human herpesvirus 6B
caccgagggcgggcggacggcu

SEQ ID NO: 2045549 - RNA, 21 nt, Human herpesvirus 6B
cauauuuaaaccagucuucua

SEQ ID NO: 2045550 - RNA, 21 nt, Human herpesvirus 6B
cucgccgucgucgcucucccu

SEQ ID NO: 2045551 - RNA, 16 nt, Human herpesvirus 6B
cugaucgguauuugcg

SEQ ID NO: 2045552 - RNA, 14 nt, Human herpesvirus 6B
ccgcaguuccuguu

SEQ ID NO: 2045553 - RNA, 18 nt, Human herpesvirus 6B
ucaagcgaagucaugaau

SEQ ID NO: 2045554 - RNA, 14 nt, Human herpesvirus 6B
aaaacaugugcuua

SEQ ID NO: 2045555 - RNA, 23 nt, Human herpesvirus 6B
uuugcccauugcagguuggcgcu

SEQ ID NO: 2045556 - RNA, 22 nt, Human herpesvirus 6B
uuagaaauguugccuuuguaaa

SEQ ID NO: 2045557 - RNA, 16 nt, Human herpesvirus 6B
aggcucggcaggggcc

SEQ ID NO: 2045558 - RNA, 14 nt, Human herpesvirus 6B
acuaugagauuggu

SEQ ID NO: 2045559 - RNA, 16 nt, Human herpesvirus 6B
caaagaugacaaauuu

SEQ ID NO: 2045560 - RNA, 11 nt, Human herpesvirus 6B
agagcauugag

SEQ ID NO: 2045561 - RNA, 14 nt, Human herpesvirus 6B
uaaucuauggugau

SEQ ID NO: 2045562 - RNA, 13 nt, Human herpesvirus 6B
auagagccggccu

SEQ ID NO: 2045563 - RNA, 14 nt, Human herpesvirus 6B
cuaaaaccugcuaa

SEQ ID NO: 2045564 - RNA, 21 nt, Human herpesvirus 6B
uccguuauuguguucugcucu

SEQ ID NO: 2045565 - RNA, 15 nt, Human herpesvirus 6B
uaucgacggcagcgg

SEQ ID NO: 2045566 - RNA, 18 nt, Human herpesvirus 6B
uacgauuuucuaauacua

SEQ ID NO: 2045567 - RNA, 22 nt, Human herpesvirus 6B
ugacuacggcgguuaacuguuu

SEQ ID NO: 2045568 - RNA, 15 nt, Human herpesvirus 6B
gcucucgcaagccag

SEQ ID NO: 2045569 - RNA, 16 nt, Human herpesvirus 6B
guaccgaauaaaacaa

SEQ ID NO: 2045570 - RNA, 22 nt, Human herpesvirus 6B
acuacauuuuaguauuuaugcu

SEQ ID NO: 2045571 - RNA, 15 nt, Human herpesvirus 6B
aagucguuacaguaa

SEQ ID NO: 2045572 - RNA, 11 nt, Human herpesvirus 6B
ucacacagcau

SEQ ID NO: 2045573 - RNA, 13 nt, Human herpesvirus 6B
uagaguuggauuu

SEQ ID NO: 2045574 - RNA, 20 nt, Human herpesvirus 6B
aguccuuaucagucucaaaa

SEQ ID NO: 2045575 - RNA, 19 nt, Human herpesvirus 6B
auacuacguguaauguuuc

SEQ ID NO: 2045576 - RNA, 22 nt, Human herpesvirus 6B
cuuacccaucuaugcgugugaa

SEQ ID NO: 2045577 - RNA, 15 nt, Human herpesvirus 6B
uucuugggaaaucaa

SEQ ID NO: 2045578 - RNA, 18 nt, Human herpesvirus 6B
agcccugagagcaggagc

SEQ ID NO: 2045579 - RNA, 22 nt, Human herpesvirus 6B
gcuguaguugaugcuguugcug

SEQ ID NO: 2045580 - RNA, 12 nt, Human herpesvirus 6B
ccguacccagga

SEQ ID NO: 2045581 - RNA, 14 nt, Human herpesvirus 6B
gguuguccuugguc

SEQ ID NO: 2045582 - RNA, 16 nt, Human herpesvirus 6B
cgguuaacuguuucuu

SEQ ID NO: 2045583 - RNA, 15 nt, Human herpesvirus 6B
uucucugcaugucuu

SEQ ID NO: 2045584 - RNA, 15 nt, Human herpesvirus 6B
gcagauuuuaaugau

SEQ ID NO: 2045585 - RNA, 16 nt, Human herpesvirus 6B
caauagcuaauuugca

SEQ ID NO: 2045586 - RNA, 18 nt, Human herpesvirus 6B
aacagauuuugaggauca

SEQ ID NO: 2045587 - RNA, 14 nt, Human herpesvirus 6B
aauuuugaaauugg

SEQ ID NO: 2045588 - RNA, 22 nt, Human herpesvirus 6B
gguucaccacugugauaugcaa

SEQ ID NO: 2045589 - RNA, 20 nt, Human herpesvirus 6B
augacaaggugaacucaucg

SEQ ID NO: 2045590 - RNA, 17 nt, Human herpesvirus 6B
ggcauguguaagaaaac

SEQ ID NO: 2045591 - RNA, 20 nt, Human herpesvirus 6B
augcuuaaacugaaucacuu

SEQ ID NO: 2045592 - RNA, 20 nt, Human herpesvirus 6B
ugacgggggcacaucuguug

SEQ ID NO: 2045593 - RNA, 14 nt, Human herpesvirus 6B
caaagguuuuguga

SEQ ID NO: 2045594 - RNA, 19 nt, Human herpesvirus 6B
ucgaagacauucaacauuc

SEQ ID NO: 2045595 - RNA, 21 nt, Human herpesvirus 6B
ugucgcugacgcaauacguaa

SEQ ID NO: 2045596 - RNA, 14 nt, Human herpesvirus 6B
ggaauggacaugac

SEQ ID NO: 2045597 - RNA, 21 nt, Human herpesvirus 6B
aaucacuguacggaacguuuc

SEQ ID NO: 2045598 - RNA, 12 nt, Human herpesvirus 6B
gaugccaaagcu

SEQ ID NO: 2045599 - RNA, 19 nt, Human herpesvirus 6B
caaaaggaaaagucaaagu

SEQ ID NO: 2045600 - RNA, 15 nt, Human herpesvirus 6B
ucuuaccaagaaauc

SEQ ID NO: 2045601 - RNA, 14 nt, Human herpesvirus 6B
aaaugaccagagau

SEQ ID NO: 2045602 - RNA, 16 nt, Human herpesvirus 6B
gacuguucuaaaggau

SEQ ID NO: 2045603 - RNA, 23 nt, Human herpesvirus 6B
ucaauguaugcgaggcuuuugau

SEQ ID NO: 2045604 - RNA, 18 nt, Human herpesvirus 6B
ccaugcagcugcccguga

SEQ ID NO: 2045605 - RNA, 16 nt, Human herpesvirus 6B
uggaagacgucgggaa

SEQ ID NO: 2045606 - RNA, 12 nt, Human herpesvirus 6B
aggaaaaagccu

SEQ ID NO: 2045607 - RNA, 16 nt, Human herpesvirus 6B
gccagcccugaagaag

SEQ ID NO: 2045608 - RNA, 15 nt, Human herpesvirus 6B
uugcugucacacucu

SEQ ID NO: 2045609 - RNA, 16 nt, Human herpesvirus 6B
cuuaggauguaaaugc

SEQ ID NO: 2045610 - RNA, 20 nt, Human herpesvirus 6B
gcaagucgcgaagugcuucu

SEQ ID NO: 2045611 - RNA, 20 nt, Human herpesvirus 6B
ucucgauugugauguacgug

SEQ ID NO: 2045612 - RNA, 22 nt, Human herpesvirus 6B
gaaccauagguguuugcagaua

SEQ ID NO: 2045613 - RNA, 22 nt, Human herpesvirus 6B
cggcgacacgcgcggaccacuc

SEQ ID NO: 2045614 - RNA, 12 nt, Human herpesvirus 6B
guaauuguuaac

SEQ ID NO: 2045615 - RNA, 21 nt, Human herpesvirus 6B
guguuauaacagacauaugca

SEQ ID NO: 2045616 - RNA, 14 nt, Human herpesvirus 6B
auuuucagugucag

SEQ ID NO: 2045617 - RNA, 17 nt, Human herpesvirus 6B
ccgacuuauuaucucac

SEQ ID NO: 2045618 - RNA, 16 nt, Human herpesvirus 6B
ugugaggugauuugaa

SEQ ID NO: 2045619 - RNA, 19 nt, Human herpesvirus 6B
augcagucuccacagggca

SEQ ID NO: 2045620 - RNA, 15 nt, Human herpesvirus 6B
aucuauuaucauuua

SEQ ID NO: 2045621 - RNA, 21 nt, Human herpesvirus 6B
uaaaaaagagauaaucuuuga

SEQ ID NO: 2045622 - RNA, 16 nt, Human herpesvirus 6B
ugcaagcagaccaguu

SEQ ID NO: 2045623 - RNA, 15 nt, Human herpesvirus 6B
gacagcgggugcuca

SEQ ID NO: 2045624 - RNA, 14 nt, Human herpesvirus 6B
agccagccaguauc

SEQ ID NO: 2045625 - RNA, 21 nt, Human herpesvirus 6B
gcccucccgcagcuccuuccg

SEQ ID NO: 2045626 - RNA, 18 nt, Human herpesvirus 6B
aacugaucgguauuugcg

SEQ ID NO: 2045627 - RNA, 19 nt, Human herpesvirus 6B
caacgcuaaauuuaucaaa

SEQ ID NO: 2045628 - RNA, 17 nt, Human herpesvirus 6B
acgcaaagggaagccag

SEQ ID NO: 2045629 - RNA, 21 nt, Human herpesvirus 6B
ucauucgauuaaugccacagg

SEQ ID NO: 2045630 - RNA, 13 nt, Human herpesvirus 6B
guaaccugagaau

SEQ ID NO: 2045631 - RNA, 16 nt, Human herpesvirus 6B
cgggcagggcgggcac

SEQ ID NO: 2045632 - RNA, 21 nt, Human herpesvirus 6B
ggccgcuuucuuggcgcccgu

SEQ ID NO: 2045633 - RNA, 12 nt, Human herpesvirus 6B
gccacauuagcu

SEQ ID NO: 2045634 - RNA, 19 nt, Human herpesvirus 6B
agaccgguacgauuucugu

SEQ ID NO: 2045635 - RNA, 14 nt, Human herpesvirus 6B
aaagucggucgaga

SEQ ID NO: 2045636 - RNA, 19 nt, Human herpesvirus 6B
ucccccgaacgccuccacg

SEQ ID NO: 2045637 - RNA, 14 nt, Human herpesvirus 6B
cuuuggaaaguuuu

SEQ ID NO: 2045638 - RNA, 20 nt, Human herpesvirus 6B
cgcucgggggacggagagga

SEQ ID NO: 2045639 - RNA, 21 nt, Human herpesvirus 6B
cuaucacuuagacacggccag

SEQ ID NO: 2045640 - RNA, 22 nt, Human herpesvirus 6B
auauuuguuaguguuaauucca

SEQ ID NO: 2045641 - RNA, 18 nt, Human herpesvirus 6B
acucaagaauuacugcug

SEQ ID NO: 2045642 - RNA, 20 nt, Human herpesvirus 6B
gaucagguauagagguuaua

SEQ ID NO: 2045643 - RNA, 14 nt, Human herpesvirus 6B
caaugagccuggcu

SEQ ID NO: 2045644 - RNA, 14 nt, Human herpesvirus 6B
ggcggcugucgccg

SEQ ID NO: 2045645 - RNA, 15 nt, Human herpesvirus 6B
agugaauugugcaag

SEQ ID NO: 2045646 - RNA, 20 nt, Human herpesvirus 6B
gauaagaauuuccaggguga

SEQ ID NO: 2045647 - RNA, 23 nt, Human herpesvirus 6B
aaaauguuuccaugacugugagg

SEQ ID NO: 2045648 - RNA, 15 nt, Human herpesvirus 6B
cagaaucaagaaaca

SEQ ID NO: 2045649 - RNA, 13 nt, Human herpesvirus 6B
ugaguuuuggaaa

SEQ ID NO: 2045650 - RNA, 13 nt, Human herpesvirus 6B
cuacgcggcaagu

SEQ ID NO: 2045651 - RNA, 20 nt, Human herpesvirus 6B
gagcucaaagagauuggaaa

SEQ ID NO: 2045652 - RNA, 13 nt, Human herpesvirus 6B
acgguggauuaug

SEQ ID NO: 2045653 - RNA, 15 nt, Human herpesvirus 6B
ccugugcguccuccu

SEQ ID NO: 2045654 - RNA, 20 nt, Human herpesvirus 6B
gcauucuuacggaagcaaaa

SEQ ID NO: 2045655 - RNA, 21 nt, Human herpesvirus 6B
cugauauacgauggacagaaa

SEQ ID NO: 2045656 - RNA, 21 nt, Human herpesvirus 6B
caaugcgguuugucuugcaaa

SEQ ID NO: 2045657 - RNA, 19 nt, Human herpesvirus 6B
gcaaaaaaauauuggauuu

SEQ ID NO: 2045658 - RNA, 22 nt, Human herpesvirus 6B
aaauauggcuaaugagucucug

SEQ ID NO: 2045659 - RNA, 19 nt, Human herpesvirus 6B
uguuucugaacuauuaaaa

SEQ ID NO: 2045660 - RNA, 16 nt, Human herpesvirus 6B
aauugacaaucuugga

SEQ ID NO: 2045661 - RNA, 23 nt, Human herpesvirus 6B
aagucguuacaguaaaaaagccg

SEQ ID NO: 2045662 - RNA, 17 nt, Human herpesvirus 6B
ugauaccgucuuugcau

SEQ ID NO: 2045663 - RNA, 13 nt, Human herpesvirus 6B
uacguuagcuucc

SEQ ID NO: 2045664 - RNA, 18 nt, Human herpesvirus 6B
gucucaaaaauuagaccg

SEQ ID NO: 2045665 - RNA, 22 nt, Human herpesvirus 6B
aucaauauagaggacgcaaaga

SEQ ID NO: 2045666 - RNA, 13 nt, Human herpesvirus 6B
ucaaaaucugcua

SEQ ID NO: 2045667 - RNA, 16 nt, Human herpesvirus 6B
gagauuuuuuaaauaa

SEQ ID NO: 2045668 - RNA, 16 nt, Human herpesvirus 6B
cggguaaauaugugaa

SEQ ID NO: 2045669 - RNA, 18 nt, Human herpesvirus 6B
ccguguuggcggauuaca

SEQ ID NO: 2045670 - RNA, 22 nt, Human herpesvirus 6B
uccgucaggaccagcucuguuc

SEQ ID NO: 2045671 - RNA, 16 nt, Human herpesvirus 6B
agcuuguuaugacaaa

SEQ ID NO: 2045672 - RNA, 11 nt, Human herpesvirus 6B
agauuuacaga

SEQ ID NO: 2045673 - RNA, 18 nt, Human herpesvirus 6B
aagauuuaaaaaugauaa

SEQ ID NO: 2045674 - RNA, 14 nt, Human herpesvirus 6B
guuucuuuggaaaa

SEQ ID NO: 2045675 - RNA, 17 nt, Human herpesvirus 6B
acaguucguccagcagc

SEQ ID NO: 2045676 - RNA, 12 nt, Human herpesvirus 6B
cuugcuguaaag

SEQ ID NO: 2045677 - RNA, 21 nt, Human herpesvirus 6B
gcaaguuuucagcaagagaga

SEQ ID NO: 2045678 - RNA, 24 nt, Human herpesvirus 6B
cuuuuauagauuguuacuuucaua

SEQ ID NO: 2045679 - RNA, 14 nt, Human herpesvirus 6B
aggagaauuugcag

SEQ ID NO: 2045680 - RNA, 17 nt, Human herpesvirus 6B
uuguuuauugcuuuugu

SEQ ID NO: 2045681 - RNA, 18 nt, Human herpesvirus 6B
uccucccacgcccccucg

SEQ ID NO: 2045682 - RNA, 21 nt, Human herpesvirus 6B
cacggagaacacuuagagggu

SEQ ID NO: 2045683 - RNA, 18 nt, Human herpesvirus 6B
cggacagagcggagaggc

SEQ ID NO: 2045684 - RNA, 13 nt, Human herpesvirus 6B
uaaaguauuggcu

SEQ ID NO: 2045685 - RNA, 22 nt, Human herpesvirus 6B
uaugcuuuuuuuuguggauggu

SEQ ID NO: 2045686 - RNA, 21 nt, Human herpesvirus 6B
agcaaauuuaguuaauucucg

SEQ ID NO: 2045687 - RNA, 15 nt, Human herpesvirus 6B
guucgacuauguuag

SEQ ID NO: 2045688 - RNA, 16 nt, Human herpesvirus 6B
gcaacggcacgagagc

SEQ ID NO: 2045689 - RNA, 19 nt, Human herpesvirus 6B
agcccugagagcaggagca

SEQ ID NO: 2045690 - RNA, 15 nt, Human herpesvirus 6B
aagcuggacagaaag

SEQ ID NO: 2045691 - RNA, 22 nt, Human herpesvirus 6B
gcagaaaacgauuauugcuaca

SEQ ID NO: 2045692 - RNA, 20 nt, Human herpesvirus 6B
cuggaagaaggaaaaaauuc

SEQ ID NO: 2045693 - RNA, 23 nt, Human herpesvirus 6B
ucuuaggaaacuuucaaaauuuu

SEQ ID NO: 2045694 - RNA, 23 nt, Human herpesvirus 6B
gcgcugggacuccgagccggaca

SEQ ID NO: 2045695 - RNA, 16 nt, Human herpesvirus 6B
cgugugucucugugaa

SEQ ID NO: 2045696 - RNA, 15 nt, Human herpesvirus 6B
ugcaauuugaauucu

SEQ ID NO: 2045697 - RNA, 22 nt, Human herpesvirus 6B
cuuugaaggacuaucugagaca

SEQ ID NO: 2045698 - RNA, 20 nt, Human herpesvirus 6B
gcccugcuccguucccuucu

SEQ ID NO: 2045699 - RNA, 16 nt, Human herpesvirus 6B
gauuuuuguaaaaaug

SEQ ID NO: 2045700 - RNA, 16 nt, Human herpesvirus 6B
acggcgagacuuugug

SEQ ID NO: 2045701 - RNA, 18 nt, Human herpesvirus 6B
auaugucagauuauaaug

SEQ ID NO: 2045702 - RNA, 18 nt, Human herpesvirus 6B
acaguucguccagcagcg

SEQ ID NO: 2045703 - RNA, 21 nt, Human herpesvirus 6B
acacuuucuucgccuguaaag

SEQ ID NO: 2045704 - RNA, 13 nt, Human herpesvirus 6B
uaaaaacacacug

SEQ ID NO: 2045705 - RNA, 19 nt, Human herpesvirus 6B
uacuacguguaauguuucc

SEQ ID NO: 2045706 - RNA, 11 nt, Human herpesvirus 6B
cugugcaaagc

SEQ ID NO: 2045707 - RNA, 13 nt, Human herpesvirus 6B
acauaacauagaa

SEQ ID NO: 2045708 - RNA, 14 nt, Human herpesvirus 6B
agaucgagaucuuu

SEQ ID NO: 2045709 - RNA, 21 nt, Human herpesvirus 6B
gacaaauaaguggugaugaau

SEQ ID NO: 2045710 - RNA, 23 nt, Human herpesvirus 6B
cgcauccuuaaaugacacagaau

SEQ ID NO: 2045711 - RNA, 17 nt, Human herpesvirus 6B
aauuuuaccuauuucua

SEQ ID NO: 2045712 - RNA, 19 nt, Human herpesvirus 6B
cacgcgcggaccacucggg

SEQ ID NO: 2045713 - RNA, 14 nt, Human herpesvirus 6B
ugaaacugaagaaa

SEQ ID NO: 2045714 - RNA, 17 nt, Human herpesvirus 6B
cgcaaagggaagccagc

SEQ ID NO: 2045715 - RNA, 21 nt, Human herpesvirus 6B
cacgcucguauuuuauuuugu

SEQ ID NO: 2045716 - RNA, 13 nt, Human herpesvirus 6B
gcgcccggagucg

SEQ ID NO: 2045717 - RNA, 17 nt, Human herpesvirus 6B
gguuuuucgauguuucc

SEQ ID NO: 2045718 - RNA, 19 nt, Human herpesvirus 6B
cgauaccgaaucggaagag

SEQ ID NO: 2045719 - RNA, 15 nt, Human herpesvirus 6B
uuauuuccucugaau

SEQ ID NO: 2045720 - RNA, 12 nt, Human herpesvirus 6B
aaucaugagagc

SEQ ID NO: 2045721 - RNA, 14 nt, Human herpesvirus 6B
uuguacaaagguuu

SEQ ID NO: 2045722 - RNA, 16 nt, Human herpesvirus 6B
uuuauucuauauggcc

SEQ ID NO: 2045723 - RNA, 20 nt, Human herpesvirus 6B
gcagauaagaauuuccaggg

SEQ ID NO: 2045724 - RNA, 15 nt, Human herpesvirus 6B
gccaacgcgacacgg

SEQ ID NO: 2045725 - RNA, 13 nt, Human herpesvirus 6B
acuucuaaaaugc

SEQ ID NO: 2045726 - RNA, 22 nt, Human herpesvirus 6B
ggcgcgaaaaggggucggauuu

SEQ ID NO: 2045727 - RNA, 16 nt, Human herpesvirus 6B
cagggcgggcacggag

SEQ ID NO: 2045728 - RNA, 12 nt, Human herpesvirus 6B
augaaaacauuc

SEQ ID NO: 2045729 - RNA, 23 nt, Human herpesvirus 6B
ccgcacaguucguccagcagcgg

SEQ ID NO: 2045730 - RNA, 20 nt, Human herpesvirus 6B
caauuucugacucucuuuca

SEQ ID NO: 2045731 - RNA, 20 nt, Human herpesvirus 6B
uacaucaacuauuuaacauc

SEQ ID NO: 2045732 - RNA, 18 nt, Human herpesvirus 6B
aaaucugcuaacggagca

SEQ ID NO: 2045733 - RNA, 18 nt, Human herpesvirus 6B
gacaaaaacaugugcuua

SEQ ID NO: 2045734 - RNA, 17 nt, Human herpesvirus 6B
agaucaagcaaguucca

SEQ ID NO: 2045735 - RNA, 16 nt, Human herpesvirus 6B
uguauaaggauggaua

SEQ ID NO: 2045736 - RNA, 23 nt, Human herpesvirus 6B
gcaaaugaauguguucauagagc

SEQ ID NO: 2045737 - RNA, 14 nt, Human herpesvirus 6B
aauauuuuuacugc

SEQ ID NO: 2045738 - RNA, 16 nt, Human herpesvirus 6B
ugccgcguggaagccg

SEQ ID NO: 2045739 - RNA, 13 nt, Human herpesvirus 6B
cauucugcauuua

SEQ ID NO: 2045740 - RNA, 21 nt, Human herpesvirus 6B
aaugacuuggccgaguuuaga

SEQ ID NO: 2045741 - RNA, 17 nt, Human herpesvirus 6B
uaauuccuuguguugaa

SEQ ID NO: 2045742 - RNA, 18 nt, Human herpesvirus 6B
acuguauggcaaaaccaa

SEQ ID NO: 2045743 - RNA, 20 nt, Human herpesvirus 6B
auguaucccgagaaaaaagc

SEQ ID NO: 2045744 - RNA, 16 nt, Human herpesvirus 6B
ccucgaagaauugucu

SEQ ID NO: 2045745 - RNA, 14 nt, Human herpesvirus 6B
guugcguguggaaa

SEQ ID NO: 2045746 - RNA, 18 nt, Human herpesvirus 6B
cgcggggaucgggccugg

SEQ ID NO: 2045747 - RNA, 22 nt, Human herpesvirus 6B
aagcgccugccuacacugcgaa

SEQ ID NO: 2045748 - RNA, 18 nt, Human herpesvirus 6B
uaacauccaaaauacacu

SEQ ID NO: 2045749 - RNA, 18 nt, Human herpesvirus 6B
cauugugagaacagcgca

SEQ ID NO: 2045750 - RNA, 13 nt, Human herpesvirus 6B
uucagagucuguu

SEQ ID NO: 2045751 - RNA, 15 nt, Human herpesvirus 6B
auuccaauugcugcu

SEQ ID NO: 2045752 - RNA, 15 nt, Human herpesvirus 6B
acaacgguguggaga

SEQ ID NO: 2045753 - RNA, 13 nt, Human herpesvirus 6B
cuuuuuaacaaaa

SEQ ID NO: 2045754 - RNA, 23 nt, Human herpesvirus 6B
ucugauuuucagugucagcauug

SEQ ID NO: 2045755 - RNA, 20 nt, Human herpesvirus 6B
ugaugccuugauguuuccug

SEQ ID NO: 2045756 - RNA, 20 nt, Human herpesvirus 6B
aucgcgguguccucguccgu

SEQ ID NO: 2045757 - RNA, 16 nt, Human herpesvirus 6B
cuagcaaugauacauc

SEQ ID NO: 2045758 - RNA, 17 nt, Human herpesvirus 6B
caaauaaguggugauga

SEQ ID NO: 2045759 - RNA, 12 nt, Human herpesvirus 6B
cuuaccaagaaa

SEQ ID NO: 2045760 - RNA, 20 nt, Human herpesvirus 6B
auacacacgcgcggagcacg

SEQ ID NO: 2045761 - RNA, 15 nt, Human herpesvirus 6B
gacagcuuggccaac

SEQ ID NO: 2045762 - RNA, 10 nt, Human herpesvirus 6B
auuuuacugg

SEQ ID NO: 2045763 - RNA, 22 nt, Human herpesvirus 6B
acagcgugaugaggcccagagg

SEQ ID NO: 2045764 - RNA, 20 nt, Human herpesvirus 6B
ucgggaugugcggagaaagg

SEQ ID NO: 2045765 - RNA, 23 nt, Human herpesvirus 6B
ucgcauuucucuacaugccacag

SEQ ID NO: 2045766 - RNA, 20 nt, Human herpesvirus 6B
uuaaauuguuuuaaacauuc

SEQ ID NO: 2045767 - RNA, 15 nt, Human herpesvirus 6B
aaggacuaucugaga

SEQ ID NO: 2045768 - RNA, 20 nt, Human herpesvirus 6B
cuguuuuucucauaaaguua

SEQ ID NO: 2045769 - RNA, 22 nt, Human herpesvirus 6B
cacguccauaggcucggcaggg

SEQ ID NO: 2045770 - RNA, 16 nt, Human herpesvirus 6B
gcccgggcgcggggcg

SEQ ID NO: 2045771 - RNA, 14 nt, Human herpesvirus 6B
ggacuaccgaugcu

SEQ ID NO: 2045772 - RNA, 15 nt, Human herpesvirus 6B
cacggcgccucccau

SEQ ID NO: 2045773 - RNA, 14 nt, Human herpesvirus 6B
cccucuugcagugg

SEQ ID NO: 2045774 - RNA, 18 nt, Human herpesvirus 6B
gugcaccgagaaauagug

SEQ ID NO: 2045775 - RNA, 22 nt, Human herpesvirus 6B
gccagcaauuucggcaagaaag

SEQ ID NO: 2045776 - RNA, 14 nt, Human herpesvirus 6B
acagaaaaaaauuu

SEQ ID NO: 2045777 - RNA, 18 nt, Human herpesvirus 6B
ucgacauagaguguuugg

SEQ ID NO: 2045778 - RNA, 20 nt, Human herpesvirus 6B
uaacucuuggauugcagaua

SEQ ID NO: 2045779 - RNA, 15 nt, Human herpesvirus 6B
ugucguuuguacaug

SEQ ID NO: 2045780 - RNA, 13 nt, Human herpesvirus 6B
auuuaccagagau

SEQ ID NO: 2045781 - RNA, 24 nt, Human herpesvirus 6B
gcaacaaagagcuuuaaagcagcu

SEQ ID NO: 2045782 - RNA, 23 nt, Human herpesvirus 6B
auuuugcgucgucugugcaaagc

SEQ ID NO: 2045783 - RNA, 15 nt, Human herpesvirus 6B
uucagcuaaucacuu

SEQ ID NO: 2045784 - RNA, 18 nt, Human herpesvirus 6B
uggcauucuugcagauuu

SEQ ID NO: 2045785 - RNA, 16 nt, Human herpesvirus 6B
uccgaaaacuagauga

SEQ ID NO: 2045786 - RNA, 17 nt, Human herpesvirus 6B
gguuuaccuuuuugcug

SEQ ID NO: 2045787 - RNA, 14 nt, Human herpesvirus 6B
ucgaugaaaguuuu

SEQ ID NO: 2045788 - RNA, 20 nt, Human herpesvirus 6B
guugacgacgcccuggcuuu

SEQ ID NO: 2045789 - RNA, 13 nt, Human herpesvirus 6B
guauaagaaagac

SEQ ID NO: 2045790 - RNA, 19 nt, Human herpesvirus 6B
ugacuuggccgaguuuaga

SEQ ID NO: 2045791 - RNA, 16 nt, Human herpesvirus 6B
ucuuugacuauuucga

SEQ ID NO: 2045792 - RNA, 15 nt, Human herpesvirus 6B
gcaugaacgguaguu

SEQ ID NO: 2045793 - RNA, 18 nt, Human herpesvirus 6B
agacuaaacuuaacuuau

SEQ ID NO: 2045794 - RNA, 16 nt, Human herpesvirus 6B
auuaggggacagagcc

SEQ ID NO: 2045795 - RNA, 22 nt, Human herpesvirus 6B
cgggcagacgugagacauuuga

SEQ ID NO: 2045796 - RNA, 23 nt, Human herpesvirus 6B
gacuuagcuagacgugucuucau

SEQ ID NO: 2045797 - RNA, 15 nt, Human herpesvirus 6B
cacuucuucugcaga

SEQ ID NO: 2045798 - RNA, 19 nt, Human herpesvirus 6B
cggggagagaauugccgau

SEQ ID NO: 2045799 - RNA, 15 nt, Human herpesvirus 6B
guaauuuugaaauug

SEQ ID NO: 2045800 - RNA, 16 nt, Human herpesvirus 6B
guaucuggcuggucaa

SEQ ID NO: 2045801 - RNA, 12 nt, Human herpesvirus 6B
auauucaguuuu

SEQ ID NO: 2045802 - RNA, 15 nt, Human herpesvirus 6B
augcaggugcugcua

SEQ ID NO: 2045803 - RNA, 22 nt, Human herpesvirus 6B
cugcucguuuguuuuuuucugc

SEQ ID NO: 2045804 - RNA, 23 nt, Human herpesvirus 6B
aagaauccgcgggccagcccuga

SEQ ID NO: 2045805 - RNA, 16 nt, Human herpesvirus 6B
ccgucgucgcucuccc

SEQ ID NO: 2045806 - RNA, 15 nt, Human herpesvirus 6B
ucgcgauauucagag

SEQ ID NO: 2045807 - RNA, 19 nt, Human herpesvirus 6B
acggaauauauagaagaag

SEQ ID NO: 2045808 - RNA, 23 nt, Human herpesvirus 6B
ugaaacuaugaggaacugaugag

SEQ ID NO: 2045809 - RNA, 15 nt, Human herpesvirus 6B
ucguuuguacauguu

SEQ ID NO: 2045810 - RNA, 18 nt, Human herpesvirus 6B
gagaguucauuuguuccg

SEQ ID NO: 2045811 - RNA, 12 nt, Human herpesvirus 6B
ccgugaaggaau

SEQ ID NO: 2045812 - RNA, 12 nt, Human herpesvirus 6B
uaaaaucugcua

SEQ ID NO: 2045813 - RNA, 20 nt, Human herpesvirus 6B
acauaugcaaucugugggaa

SEQ ID NO: 2045814 - RNA, 13 nt, Human herpesvirus 6B
ucgauguagaugu

SEQ ID NO: 2045815 - RNA, 23 nt, Human herpesvirus 6B
uagcuugcgauuccgaagauugc

SEQ ID NO: 2045816 - RNA, 20 nt, Human herpesvirus 6B
guuacaguaaaaaagccgaa

SEQ ID NO: 2045817 - RNA, 23 nt, Human herpesvirus 6B
cacacgcggggaucgggccuggg

SEQ ID NO: 2045818 - RNA, 17 nt, Human herpesvirus 6B
cgcucuccugugcgucc

SEQ ID NO: 2045819 - RNA, 19 nt, Human herpesvirus 6B
aaucuccugagaggcugga

SEQ ID NO: 2045820 - RNA, 23 nt, Human herpesvirus 6B
gccgaccugauccaugagcaccc

SEQ ID NO: 2045821 - RNA, 18 nt, Human herpesvirus 6B
acaccgcagacaucacaa

SEQ ID NO: 2045822 - RNA, 18 nt, Human herpesvirus 6B
uuacgagaccuguuugag

SEQ ID NO: 2045823 - RNA, 11 nt, Human herpesvirus 6B
cuugcaguggc

SEQ ID NO: 2045824 - RNA, 13 nt, Human herpesvirus 6B
cauggugaaacuu

SEQ ID NO: 2045825 - RNA, 22 nt, Human herpesvirus 6B
uuauugacugugaaaagugcuu

SEQ ID NO: 2045826 - RNA, 21 nt, Human herpesvirus 6B
ucgauacaacgugugaaaacu

SEQ ID NO: 2045827 - RNA, 18 nt, Human herpesvirus 6B
uaaacuccaaaaucuuua

SEQ ID NO: 2045828 - RNA, 22 nt, Human herpesvirus 6B
ucucgugccguugccuuggccg

SEQ ID NO: 2045829 - RNA, 16 nt, Human herpesvirus 6B
auuuuaacgguuuugc

SEQ ID NO: 2045830 - RNA, 21 nt, Human herpesvirus 6B
aucacuuaguugauaugaaug

SEQ ID NO: 2045831 - RNA, 13 nt, Human herpesvirus 6B
aauugugucuuug

SEQ ID NO: 2045832 - RNA, 11 nt, Human herpesvirus 6B
uaauauuugca

SEQ ID NO: 2045833 - RNA, 22 nt, Human herpesvirus 6B
auguacguggccgucuccugca

SEQ ID NO: 2045834 - RNA, 16 nt, Human herpesvirus 6B
ugccuugauguuuccu

SEQ ID NO: 2045835 - RNA, 13 nt, Human herpesvirus 6B
caaacaguuucag

SEQ ID NO: 2045836 - RNA, 13 nt, Human herpesvirus 6B
cgaauaaggagag

SEQ ID NO: 2045837 - RNA, 18 nt, Human herpesvirus 6B
cgauugcugcuucuguaa

SEQ ID NO: 2045838 - RNA, 19 nt, Human herpesvirus 6B
caaugauacuacguguaau

SEQ ID NO: 2045839 - RNA, 21 nt, Human herpesvirus 6B
uuccucgcgguauaaugcaug

SEQ ID NO: 2045840 - RNA, 18 nt, Human herpesvirus 6B
agaaauuuaauugcaauu

SEQ ID NO: 2045841 - RNA, 15 nt, Human herpesvirus 6B
cugagagcaggagca

SEQ ID NO: 2045842 - RNA, 23 nt, Human herpesvirus 6B
cgcaaagagagaccaauuuagau

SEQ ID NO: 2045843 - RNA, 15 nt, Human herpesvirus 6B
gugaucguggacagu

SEQ ID NO: 2045844 - RNA, 19 nt, Human herpesvirus 6B
cuaagcuguaugacaucua

SEQ ID NO: 2045845 - RNA, 23 nt, Human herpesvirus 6B
gcucuccguuaaagaaacagauc

SEQ ID NO: 2045846 - RNA, 19 nt, Human herpesvirus 6B
gaaaauacgucagcucuuc

SEQ ID NO: 2045847 - RNA, 14 nt, Human herpesvirus 6B
ucaaauguagcaaa

SEQ ID NO: 2045848 - RNA, 20 nt, Human herpesvirus 6B
cugucuguguuucagaaggc

SEQ ID NO: 2045849 - RNA, 18 nt, Human herpesvirus 6B
gagaaaccgaaaugugcu

SEQ ID NO: 2045850 - RNA, 15 nt, Human herpesvirus 6B
acgcccccaccuggc

SEQ ID NO: 2045851 - RNA, 14 nt, Human herpesvirus 6B
uauuuucuguauua

SEQ ID NO: 2045852 - RNA, 18 nt, Human herpesvirus 6B
guccgugacacacagaau

SEQ ID NO: 2045853 - RNA, 20 nt, Human herpesvirus 6B
auucuuaccaagaaaucacg

SEQ ID NO: 2045854 - RNA, 15 nt, Human herpesvirus 6B
uuuaccuuuuugcug

SEQ ID NO: 2045855 - RNA, 17 nt, Human herpesvirus 6B
ggcuuacugcggagaac

SEQ ID NO: 2045856 - RNA, 14 nt, Human herpesvirus 6B
cccggaguacacgu

SEQ ID NO: 2045857 - RNA, 22 nt, Human herpesvirus 6B
uuucuaaaacccggagaaucua

SEQ ID NO: 2045858 - RNA, 15 nt, Human herpesvirus 6B
gacuuauuaucucac

SEQ ID NO: 2045859 - RNA, 16 nt, Human herpesvirus 6B
agaaacguuaauguuu

SEQ ID NO: 2045860 - RNA, 19 nt, Human herpesvirus 6B
cugaugauuugaaauguuc

SEQ ID NO: 2045861 - RNA, 13 nt, Human herpesvirus 6B
ucucuacaucacc

SEQ ID NO: 2045862 - RNA, 15 nt, Human herpesvirus 6B
aggagagggagaaac

SEQ ID NO: 2045863 - RNA, 18 nt, Human herpesvirus 6B
caguuaaucauucgauua

SEQ ID NO: 2045864 - RNA, 15 nt, Human herpesvirus 6B
ggacccuccacgccc

SEQ ID NO: 2045865 - RNA, 13 nt, Human herpesvirus 6B
cucucacggccau

SEQ ID NO: 2045866 - RNA, 18 nt, Human herpesvirus 6B
uucugcucguuuguuuuu

SEQ ID NO: 2045867 - RNA, 14 nt, Human herpesvirus 6B
gaacaccagcaugu

SEQ ID NO: 2045868 - RNA, 23 nt, Human herpesvirus 6B
uacguggccgucuccugcaauuu

SEQ ID NO: 2045869 - RNA, 15 nt, Human herpesvirus 6B
uccauauuuggaagc

SEQ ID NO: 2045870 - RNA, 17 nt, Human herpesvirus 6B
aaacugcuugcgauugu

SEQ ID NO: 2045871 - RNA, 18 nt, Human herpesvirus 6B
acacggccacccgcgucu

SEQ ID NO: 2045872 - RNA, 19 nt, Human herpesvirus 6B
cucguaccccggcuuucuc

SEQ ID NO: 2045873 - RNA, 20 nt, Human herpesvirus 6B
uuuuucacagaauguauaua

SEQ ID NO: 2045874 - RNA, 16 nt, Human herpesvirus 6B
gggaauuuggcagaau

SEQ ID NO: 2045875 - RNA, 18 nt, Human herpesvirus 6B
ccagcucuguucucuccc

SEQ ID NO: 2045876 - RNA, 15 nt, Human herpesvirus 6B
caccgaauuuauuca

SEQ ID NO: 2045877 - RNA, 16 nt, Human herpesvirus 6B
uauuuucguauaaaau

SEQ ID NO: 2045878 - RNA, 23 nt, Human herpesvirus 6B
auauggaucaaucuccaaaacac

SEQ ID NO: 2045879 - RNA, 23 nt, Human herpesvirus 6B
cuugugcaaaaaucucuuauggu

SEQ ID NO: 2045880 - RNA, 21 nt, Human herpesvirus 6B
acaguauaaauucuuuugugc

SEQ ID NO: 2045881 - RNA, 16 nt, Human herpesvirus 6B
guuuuguaggacugaa

SEQ ID NO: 2045882 - RNA, 20 nt, Human herpesvirus 6B
auggcaaauuucaaaaagaa

SEQ ID NO: 2045883 - RNA, 14 nt, Human herpesvirus 6B
cccgggcgcggggc

SEQ ID NO: 2045884 - RNA, 13 nt, Human herpesvirus 6B
uacuaaagcaauc

SEQ ID NO: 2045885 - RNA, 12 nt, Human herpesvirus 6B
acaauaauuacu

SEQ ID NO: 2045886 - RNA, 15 nt, Human herpesvirus 6B
ugcaaaacagauuuu

SEQ ID NO: 2045887 - RNA, 16 nt, Human herpesvirus 6B
aauaaguggugaugaa

SEQ ID NO: 2045888 - RNA, 16 nt, Human herpesvirus 6B
aacugauacuguucaa

SEQ ID NO: 2045889 - RNA, 22 nt, Human herpesvirus 6B
ccgucgcgcucgccgucgucgc

SEQ ID NO: 2045890 - RNA, 20 nt, Human herpesvirus 6B
gcacaguucguccagcagcg

SEQ ID NO: 2045891 - RNA, 15 nt, Human herpesvirus 6B
uuaaaugacacagaa

SEQ ID NO: 2045892 - RNA, 12 nt, Human herpesvirus 6B
caaacagagaua

SEQ ID NO: 2045893 - RNA, 16 nt, Human herpesvirus 6B
agacaguuuacuaaaa

SEQ ID NO: 2045894 - RNA, 18 nt, Human herpesvirus 6B
uaaugacguaugauuuuc

SEQ ID NO: 2045895 - RNA, 12 nt, Human herpesvirus 6B
uauaaugugaac

SEQ ID NO: 2045896 - RNA, 12 nt, Human herpesvirus 6B
aaaauaagcaag

SEQ ID NO: 2045897 - RNA, 13 nt, Human herpesvirus 6B
cgggacagcaccc

SEQ ID NO: 2045898 - RNA, 22 nt, Human herpesvirus 6B
gcacccguauccgcgagacagc

SEQ ID NO: 2045899 - RNA, 15 nt, Human herpesvirus 6B
gaauuaugacugaca

SEQ ID NO: 2045900 - RNA, 23 nt, Human herpesvirus 6B
augcgguugucuuguuagacaag

SEQ ID NO: 2045901 - RNA, 14 nt, Human herpesvirus 6B
uucauuguacgaua

SEQ ID NO: 2045902 - RNA, 22 nt, Human herpesvirus 6B
ucauuucgaucuaacuacauuu

SEQ ID NO: 2045903 - RNA, 19 nt, Human herpesvirus 6B
gaaccacaucuuuuccugc

SEQ ID NO: 2045904 - RNA, 19 nt, Human herpesvirus 6B
acugugaaaagugcuuuau

SEQ ID NO: 2045905 - RNA, 13 nt, Human herpesvirus 6B
uaaggucaaauau

SEQ ID NO: 2045906 - RNA, 12 nt, Human herpesvirus 6B
augucaaaauuu

SEQ ID NO: 2045907 - RNA, 20 nt, Human herpesvirus 6B
caaaguccuggaaagcaucc

SEQ ID NO: 2045908 - RNA, 18 nt, Human herpesvirus 6B
ggaauuauauguugauug

SEQ ID NO: 2045909 - RNA, 15 nt, Human herpesvirus 6B
aucgauucuguaauu

SEQ ID NO: 2045910 - RNA, 23 nt, Human herpesvirus 6B
uuauaaaugugagcaguuuuuua

SEQ ID NO: 2045911 - RNA, 18 nt, Human herpesvirus 6B
ucgugggaauuauauguu

SEQ ID NO: 2045912 - RNA, 14 nt, Human herpesvirus 6B
cguccucagagaaa

SEQ ID NO: 2045913 - RNA, 18 nt, Human herpesvirus 6B
cuguaguuuuuuucugau

SEQ ID NO: 2045914 - RNA, 18 nt, Human herpesvirus 6B
ggaaagauuuuuggauuu

SEQ ID NO: 2045915 - RNA, 14 nt, Human herpesvirus 6B
ucacucagauuuca

SEQ ID NO: 2045916 - RNA, 19 nt, Human herpesvirus 6B
gacuccgagccggacagga

SEQ ID NO: 2045917 - RNA, 18 nt, Human herpesvirus 6B
cgcccuccccgcacaguu

SEQ ID NO: 2045918 - RNA, 17 nt, Human herpesvirus 6B
gauuuuuguaaaaaugg

SEQ ID NO: 2045919 - RNA, 15 nt, Human herpesvirus 6B
aaaauucuaccguag

SEQ ID NO: 2045920 - RNA, 16 nt, Human herpesvirus 6B
ugauaaaacucaccca

SEQ ID NO: 2045921 - RNA, 20 nt, Human herpesvirus 6B
gaucccaaacaaacguguau

SEQ ID NO: 2045922 - RNA, 13 nt, Human herpesvirus 6B
ccaaaaaauguua

SEQ ID NO: 2045923 - RNA, 18 nt, Human herpesvirus 6B
gugcaguaucuggcuggu

SEQ ID NO: 2045924 - RNA, 12 nt, Human herpesvirus 6B
agacagaaauuu

SEQ ID NO: 2045925 - RNA, 23 nt, Human herpesvirus 6B
gacaguaacggcggcggcggcug

SEQ ID NO: 2045926 - RNA, 11 nt, Human herpesvirus 6B
uucaaaaugac

SEQ ID NO: 2045927 - RNA, 22 nt, Human herpesvirus 6B
aaaucaaggaagagaaugaauc

SEQ ID NO: 2045928 - RNA, 12 nt, Human herpesvirus 6B
guaaaagggcuc

SEQ ID NO: 2045929 - RNA, 17 nt, Human herpesvirus 6B
guuuuugauuguaagag

SEQ ID NO: 2045930 - RNA, 12 nt, Human herpesvirus 6B
ugcaucuugcaa

SEQ ID NO: 2045931 - RNA, 15 nt, Human herpesvirus 6B
cggugguuucugcuc

SEQ ID NO: 2045932 - RNA, 16 nt, Human herpesvirus 6B
uucaaugcguuucuuc

SEQ ID NO: 2045933 - RNA, 15 nt, Human herpesvirus 6B
cguagggacugcgag

SEQ ID NO: 2045934 - RNA, 15 nt, Human herpesvirus 6B
aauaugauggacaaa

SEQ ID NO: 2045935 - RNA, 17 nt, Human herpesvirus 6B
caaagggaagccagccg

SEQ ID NO: 2045936 - RNA, 13 nt, Human herpesvirus 6B
uuacggggaagau

SEQ ID NO: 2045937 - RNA, 14 nt, Human herpesvirus 6B
augaguggaguuga

SEQ ID NO: 2045938 - RNA, 17 nt, Human herpesvirus 6B
cuuccgcggcgcugggc

SEQ ID NO: 2045939 - RNA, 15 nt, Human herpesvirus 6B
gaugacuuuucugau

SEQ ID NO: 2045940 - RNA, 19 nt, Human herpesvirus 6B
acgugggguaaaaauguua

SEQ ID NO: 2045941 - RNA, 14 nt, Human herpesvirus 6B
gcaacuaagcugua

SEQ ID NO: 2045942 - RNA, 17 nt, Human herpesvirus 6B
uguaguuaguuuugaua

SEQ ID NO: 2045943 - RNA, 17 nt, Human herpesvirus 6B
auagaaagcggccaggc

SEQ ID NO: 2045944 - RNA, 14 nt, Human herpesvirus 6B
gaccgagacgguga

SEQ ID NO: 2045945 - RNA, 17 nt, Human herpesvirus 6B
acaccaaugaucacaca

SEQ ID NO: 2045946 - RNA, 13 nt, Human herpesvirus 6B
auugaauccucuu

SEQ ID NO: 2045947 - RNA, 17 nt, Human herpesvirus 6B
ucgauuaaugccacagg

SEQ ID NO: 2045948 - RNA, 14 nt, Human herpesvirus 6B
ccaggauagaaaaa

SEQ ID NO: 2045949 - RNA, 15 nt, Human herpesvirus 6B
uuauuucauuggaua

SEQ ID NO: 2045950 - RNA, 19 nt, Human herpesvirus 6B
uauaugaaaugucugagca

SEQ ID NO: 2045951 - RNA, 20 nt, Human herpesvirus 6B
ugcagaaccucgcauugaua

SEQ ID NO: 2045952 - RNA, 15 nt, Human herpesvirus 6B
aauaaaucaugugaa

SEQ ID NO: 2045953 - RNA, 18 nt, Human herpesvirus 6B
gcaagcaaacgcucgccg

SEQ ID NO: 2045954 - RNA, 22 nt, Human herpesvirus 6B
uuuucugccugcguuaagugaa

SEQ ID NO: 2045955 - RNA, 17 nt, Human herpesvirus 6B
cuugcacuuuuuucuaa

SEQ ID NO: 2045956 - RNA, 20 nt, Human herpesvirus 6B
guccuuggggucuuuuugcc

SEQ ID NO: 2045957 - RNA, 18 nt, Human herpesvirus 6B
aagaguguaaauguagaa

SEQ ID NO: 2045958 - RNA, 21 nt, Human herpesvirus 6B
ucuucacaaccaaacaguuuc

SEQ ID NO: 2045959 - RNA, 17 nt, Human herpesvirus 6B
gagaaaggaagaaauuc

SEQ ID NO: 2045960 - RNA, 13 nt, Human herpesvirus 6B
auuguacgauaau

SEQ ID NO: 2045961 - RNA, 23 nt, Human herpesvirus 6B
ccuagguuuucgaaacgggagaa

SEQ ID NO: 2045962 - RNA, 12 nt, Human herpesvirus 6B
ucuggugagaaa

SEQ ID NO: 2045963 - RNA, 21 nt, Human herpesvirus 6B
uaugagauugguuguuuuucu

SEQ ID NO: 2045964 - RNA, 14 nt, Human herpesvirus 6B
ggccgucuccugca

SEQ ID NO: 2045965 - RNA, 17 nt, Human herpesvirus 6B
ucgauaaggcucucgug

SEQ ID NO: 2045966 - RNA, 15 nt, Human herpesvirus 6B
auaauccuuuucugu

SEQ ID NO: 2045967 - RNA, 19 nt, Human herpesvirus 6B
gauaucucaccuaugaaua

SEQ ID NO: 2045968 - RNA, 21 nt, Human herpesvirus 6B
agcauccacccugauucucuu

SEQ ID NO: 2045969 - RNA, 18 nt, Human herpesvirus 6B
uaucaaacuuuuuuugaa

SEQ ID NO: 2045970 - RNA, 17 nt, Human herpesvirus 6B
gaagagguggcggcuca

SEQ ID NO: 2045971 - RNA, 14 nt, Human herpesvirus 6B
ccugccuacacugc

SEQ ID NO: 2045972 - RNA, 16 nt, Human herpesvirus 6B
uaggacugaaggagau

SEQ ID NO: 2045973 - RNA, 21 nt, Human herpesvirus 6B
uauaagucuaaugcaaagaug

SEQ ID NO: 2045974 - RNA, 17 nt, Human herpesvirus 6B
caggagcaggcucccca

SEQ ID NO: 2045975 - RNA, 20 nt, Human herpesvirus 6B
aguggcgcgcguuuuuggug

SEQ ID NO: 2045976 - RNA, 14 nt, Human herpesvirus 6B
gggaucgggccugg

SEQ ID NO: 2045977 - RNA, 11 nt, Human herpesvirus 6B
ccauauuugcc

SEQ ID NO: 2045978 - RNA, 12 nt, Human herpesvirus 6B
aauuuagacgaa

SEQ ID NO: 2045979 - RNA, 19 nt, Human herpesvirus 6B
ggagugaaacgauguguua

SEQ ID NO: 2045980 - RNA, 18 nt, Human herpesvirus 6B
agcugaugauuugaaaug

SEQ ID NO: 2045981 - RNA, 18 nt, Human herpesvirus 6B
uuugcgcaauucuucucu

SEQ ID NO: 2045982 - RNA, 14 nt, Human herpesvirus 6B
augcacacguguau

SEQ ID NO: 2045983 - RNA, 19 nt, Human herpesvirus 6B
uguacauguuaacaauaaa

SEQ ID NO: 2045984 - RNA, 20 nt, Human herpesvirus 6B
gagcggagaggcgcgggaca

SEQ ID NO: 2045985 - RNA, 21 nt, Human herpesvirus 6B
gcggcugauauacgauggaca

SEQ ID NO: 2045986 - RNA, 22 nt, Human herpesvirus 6B
agaaaauuggugugcauuaucg

SEQ ID NO: 2045987 - RNA, 15 nt, Human herpesvirus 6B
caucacguauggauc

SEQ ID NO: 2045988 - RNA, 22 nt, Human herpesvirus 6B
acgaaagacguuugcuuuuuua

SEQ ID NO: 2045989 - RNA, 19 nt, Human herpesvirus 6B
ucuuuaugucugucagaaa

SEQ ID NO: 2045990 - RNA, 19 nt, Human herpesvirus 6B
gaaaccaagacuugcauga

SEQ ID NO: 2045991 - RNA, 14 nt, Human herpesvirus 6B
ccuguuuucccacc

SEQ ID NO: 2045992 - RNA, 16 nt, Human herpesvirus 6B
cgaaaccaagacuugc

SEQ ID NO: 2045993 - RNA, 22 nt, Human herpesvirus 6B
agaaucuaaaucgcgagacaga

SEQ ID NO: 2045994 - RNA, 19 nt, Human herpesvirus 6B
ugaauuugcgucagaguuu

SEQ ID NO: 2045995 - RNA, 12 nt, Human herpesvirus 6B
augauaacuguu

SEQ ID NO: 2045996 - RNA, 21 nt, Human herpesvirus 6B
acaccaucuucagcucagaca

SEQ ID NO: 2045997 - RNA, 17 nt, Human herpesvirus 6B
gcgguuagaucugggga

SEQ ID NO: 2045998 - RNA, 15 nt, Human herpesvirus 6B
aagacuugcagauga

SEQ ID NO: 2045999 - RNA, 18 nt, Human herpesvirus 6B
guucuuugaacagugaca

SEQ ID NO: 2046000 - RNA, 12 nt, Human herpesvirus 6B
aaaacuacagag

SEQ ID NO: 2046001 - RNA, 15 nt, Human herpesvirus 6B
uugguacaauuuuua

SEQ ID NO: 2046002 - RNA, 20 nt, Human herpesvirus 6B
aaucuguaagauuaaaugug

SEQ ID NO: 2046003 - RNA, 16 nt, Human herpesvirus 6B
aaccuguuuccagaau

SEQ ID NO: 2046004 - RNA, 14 nt, Human herpesvirus 6B
aauggaagaaggcu

SEQ ID NO: 2046005 - RNA, 21 nt, Human herpesvirus 6B
aguauggugucugaaaaaugg

SEQ ID NO: 2046006 - RNA, 14 nt, Human herpesvirus 6B
cgaugcgccacagg

SEQ ID NO: 2046007 - RNA, 22 nt, Human herpesvirus 6B
caggaacgaggauuuuuucugc

SEQ ID NO: 2046008 - RNA, 15 nt, Human herpesvirus 6B
auguuuacugcaugc

SEQ ID NO: 2046009 - RNA, 23 nt, Human herpesvirus 6B
uaauucaaauguagcaaaugaau

SEQ ID NO: 2046010 - RNA, 22 nt, Human herpesvirus 6B
acaaccaaacaguuucagauga

SEQ ID NO: 2046011 - RNA, 13 nt, Human herpesvirus 6B
ugggacuccgagc

SEQ ID NO: 2046012 - RNA, 20 nt, Human herpesvirus 6B
gaaucagaucacucagauuu

SEQ ID NO: 2046013 - RNA, 15 nt, Human herpesvirus 6B
agaagauauuucccu

SEQ ID NO: 2046014 - RNA, 16 nt, Human herpesvirus 6B
cugcauacagaaauug

SEQ ID NO: 2046015 - RNA, 23 nt, Human herpesvirus 6B
cauuugcugacccgauguggaac

SEQ ID NO: 2046016 - RNA, 19 nt, Human herpesvirus 6B
agaaauuuaauugcaauuu

SEQ ID NO: 2046017 - RNA, 14 nt, Human herpesvirus 6B
gagcuccauguucu

SEQ ID NO: 2046018 - RNA, 12 nt, Human herpesvirus 6B
uaauuuuccagc

SEQ ID NO: 2046019 - RNA, 14 nt, Human herpesvirus 6B
auagagcauccugu

SEQ ID NO: 2046020 - RNA, 12 nt, Human herpesvirus 6B
guuacaguaaaa

SEQ ID NO: 2046021 - RNA, 12 nt, Human herpesvirus 6B
gcagacaucaca

SEQ ID NO: 2046022 - RNA, 15 nt, Human herpesvirus 6B
ccacagcggcagcgg

SEQ ID NO: 2046023 - RNA, 23 nt, Human herpesvirus 6B
ugaauggaguaaauuaaaguuua

SEQ ID NO: 2046024 - RNA, 18 nt, Human herpesvirus 6B
gaucuucuucagaaagau

SEQ ID NO: 2046025 - RNA, 16 nt, Human herpesvirus 6B
gccgucaccugcacug

SEQ ID NO: 2046026 - RNA, 15 nt, Human herpesvirus 6B
augacuaucaaaaua

SEQ ID NO: 2046027 - RNA, 14 nt, Human herpesvirus 6B
auuugaacagagau

SEQ ID NO: 2046028 - RNA, 18 nt, Human herpesvirus 6B
caagaaaagaaaaaacag

SEQ ID NO: 2046029 - RNA, 17 nt, Human herpesvirus 6B
aauuccucuauacucug

SEQ ID NO: 2046030 - RNA, 20 nt, Human herpesvirus 6B
gaccacucgggccggucggg

SEQ ID NO: 2046031 - RNA, 20 nt, Human herpesvirus 6B
agauaacggcgcagaauuac

SEQ ID NO: 2046032 - RNA, 15 nt, Human herpesvirus 6B
gcgcgacggagaugc

SEQ ID NO: 2046033 - RNA, 19 nt, Human herpesvirus 6B
agcucgaguucgagaagau

SEQ ID NO: 2046034 - RNA, 12 nt, Human herpesvirus 6B
guccaaugcucu

SEQ ID NO: 2046035 - RNA, 19 nt, Human herpesvirus 6B
cgcggaccacucgggccgg

SEQ ID NO: 2046036 - RNA, 18 nt, Human herpesvirus 6B
cuagagguuuucuuuccc

SEQ ID NO: 2046037 - RNA, 23 nt, Human herpesvirus 6B
gacgguucaggcucuuugggaaa

SEQ ID NO: 2046038 - RNA, 18 nt, Human herpesvirus 6B
aacgugggguaaaaaugu

SEQ ID NO: 2046039 - RNA, 20 nt, Human herpesvirus 6B
auuaauuuuuuguuucugaa

SEQ ID NO: 2046040 - RNA, 18 nt, Human herpesvirus 6B
cgauccgucaggaccagc

SEQ ID NO: 2046041 - RNA, 15 nt, Human herpesvirus 6B
guugaaaucuuuccu

SEQ ID NO: 2046042 - RNA, 20 nt, Human herpesvirus 6B
acgaggauuuuuucugccug

SEQ ID NO: 2046043 - RNA, 12 nt, Human herpesvirus 6B
acucucuuucag

SEQ ID NO: 2046044 - RNA, 15 nt, Human herpesvirus 6B
gcccucccgcagcuc

SEQ ID NO: 2046045 - RNA, 18 nt, Human herpesvirus 6B
accucaaaaaugcacaau

SEQ ID NO: 2046046 - RNA, 18 nt, Human herpesvirus 6B
cgacacgcgcggaccacu

SEQ ID NO: 2046047 - RNA, 15 nt, Human herpesvirus 6B
agacaauuauguuug

SEQ ID NO: 2046048 - RNA, 16 nt, Human herpesvirus 6B
ugaugaucugcuuugu

SEQ ID NO: 2046049 - RNA, 13 nt, Human herpesvirus 6B
auucagcuggaca

SEQ ID NO: 2046050 - RNA, 20 nt, Human herpesvirus 6B
ucguuucgaaugauagcguu

SEQ ID NO: 2046051 - RNA, 15 nt, Human herpesvirus 6B
gacgaauugaguaga

SEQ ID NO: 2046052 - RNA, 13 nt, Human herpesvirus 6B
cguauuauugugu

SEQ ID NO: 2046053 - RNA, 15 nt, Human herpesvirus 6B
uggacggcgagggga

SEQ ID NO: 2046054 - RNA, 15 nt, Human herpesvirus 6B
guuauggggaagauc

SEQ ID NO: 2046055 - RNA, 19 nt, Human herpesvirus 6B
agaccgcuauggcagaaag

SEQ ID NO: 2046056 - RNA, 15 nt, Human herpesvirus 6B
aucgagacugcccug

SEQ ID NO: 2046057 - RNA, 22 nt, Human herpesvirus 6B
aagaaagcguguucaaaaaugu

SEQ ID NO: 2046058 - RNA, 22 nt, Human herpesvirus 6B
guaccccggcuuucucgccgcc

SEQ ID NO: 2046059 - RNA, 12 nt, Human herpesvirus 6B
cugauaaacucc

SEQ ID NO: 2046060 - RNA, 21 nt, Human herpesvirus 6B
gacagcaguuuuuuggggaag

SEQ ID NO: 2046061 - RNA, 22 nt, Human herpesvirus 6B
uuacuuacaucgauccaaaaga

SEQ ID NO: 2046062 - RNA, 19 nt, Human herpesvirus 6B
accgcuauggcagaaagcu

SEQ ID NO: 2046063 - RNA, 19 nt, Human herpesvirus 6B
guauucgaaaaauauuuua

SEQ ID NO: 2046064 - RNA, 20 nt, Human herpesvirus 6B
uuuguauccgagcauuauga

SEQ ID NO: 2046065 - RNA, 21 nt, Human herpesvirus 6B
cgaaaacacccugauggauua

SEQ ID NO: 2046066 - RNA, 13 nt, Human herpesvirus 6B
gggacggagagga

SEQ ID NO: 2046067 - RNA, 20 nt, Human herpesvirus 6B
acguccgugaugauucaaua

SEQ ID NO: 2046068 - RNA, 15 nt, Human herpesvirus 6B
cauaugcaaucugug

SEQ ID NO: 2046069 - RNA, 16 nt, Human herpesvirus 6B
aagaggaagggauggc

SEQ ID NO: 2046070 - RNA, 17 nt, Human herpesvirus 6B
gucuugcaaacagcuuu

SEQ ID NO: 2046071 - RNA, 12 nt, Human herpesvirus 6B
aacaguuguagc

SEQ ID NO: 2046072 - RNA, 18 nt, Human herpesvirus 6B
ugaacaguauaaauucuu

SEQ ID NO: 2046073 - RNA, 17 nt, Human herpesvirus 6B
ucaagacgccuaguguu

SEQ ID NO: 2046074 - RNA, 20 nt, Human herpesvirus 6B
aaaaauugacaaucuuggaa

SEQ ID NO: 2046075 - RNA, 23 nt, Human herpesvirus 6B
caaugauuuuguuuauugcuuuu

SEQ ID NO: 2046076 - RNA, 15 nt, Human herpesvirus 6B
uuaauccauauuugg

SEQ ID NO: 2046077 - RNA, 12 nt, Human herpesvirus 6B
cuaagcuggaca

SEQ ID NO: 2046078 - RNA, 17 nt, Human herpesvirus 6B
uccauuuucugaaaucu

SEQ ID NO: 2046079 - RNA, 21 nt, Human herpesvirus 6B
uuccuuguguugaagaacaaa

SEQ ID NO: 2046080 - RNA, 21 nt, Human herpesvirus 6B
aacugaggacguccuguucga

SEQ ID NO: 2046081 - RNA, 20 nt, Human herpesvirus 6B
cgggccuggggacagacagg

SEQ ID NO: 2046082 - RNA, 13 nt, Human herpesvirus 6B
uuuacuguuuuga

SEQ ID NO: 2046083 - RNA, 16 nt, Human herpesvirus 6B
uuauaagauuuacaga

SEQ ID NO: 2046084 - RNA, 23 nt, Human herpesvirus 6B
auauccguuuaguuacuuugcuu

SEQ ID NO: 2046085 - RNA, 21 nt, Human herpesvirus 6B
agcaucgauaccagaaaaugu

SEQ ID NO: 2046086 - RNA, 15 nt, Human herpesvirus 6B
acuccaaaaucuuua

SEQ ID NO: 2046087 - RNA, 20 nt, Human herpesvirus 6B
cagauagaaaauugucuaca

SEQ ID NO: 2046088 - RNA, 12 nt, Human herpesvirus 6B
ucaugugaaauu

SEQ ID NO: 2046089 - RNA, 17 nt, Human herpesvirus 6B
uuugcguuauuugugca

SEQ ID NO: 2046090 - RNA, 10 nt, Human herpesvirus 6B
cuugcagugg

SEQ ID NO: 2046091 - RNA, 11 nt, Human herpesvirus 6B
uuuucaagaau

SEQ ID NO: 2046092 - RNA, 19 nt, Human herpesvirus 6B
aucggaauguugguaaacu

SEQ ID NO: 2046093 - RNA, 17 nt, Human herpesvirus 6B
agcucuuuguucugcug

SEQ ID NO: 2046094 - RNA, 16 nt, Human herpesvirus 6B
gaacacgucguggcag

SEQ ID NO: 2046095 - RNA, 13 nt, Human herpesvirus 6B
aaccaaguguuuu

SEQ ID NO: 2046096 - RNA, 20 nt, Human herpesvirus 6B
agagaauagagauaaaugua

SEQ ID NO: 2046097 - RNA, 11 nt, Human herpesvirus 6B
uuugcugucac

SEQ ID NO: 2046098 - RNA, 12 nt, Human herpesvirus 6B
caggagaagaac

SEQ ID NO: 2046099 - RNA, 21 nt, Human herpesvirus 6B
gcaccgcagaucacgucccgc

SEQ ID NO: 2046100 - RNA, 22 nt, Human herpesvirus 6B
caguaugucucaguucaaaauu

SEQ ID NO: 2046101 - RNA, 21 nt, Human herpesvirus 6B
caugccgccugaaaccccaca

SEQ ID NO: 2046102 - RNA, 22 nt, Human herpesvirus 6B
guucuuucaaaaugaccagaga

SEQ ID NO: 2046103 - RNA, 22 nt, Human herpesvirus 6B
ccaugccauugaauacacgugu

SEQ ID NO: 2046104 - RNA, 20 nt, Human herpesvirus 6B
aucaaggucuaucucuuggc

SEQ ID NO: 2046105 - RNA, 20 nt, Human herpesvirus 6B
uucagaaaauuggugugcau

SEQ ID NO: 2046106 - RNA, 16 nt, Human herpesvirus 6B
cuuacaaguauguuuu

SEQ ID NO: 2046107 - RNA, 14 nt, Human herpesvirus 6B
cuauguuaacauug

SEQ ID NO: 2046108 - RNA, 18 nt, Human herpesvirus 6B
cauaagcucuacacagag

SEQ ID NO: 2046109 - RNA, 17 nt, Human herpesvirus 6B
ccccauacacacccagc

SEQ ID NO: 2046110 - RNA, 13 nt, Human herpesvirus 6B
aaucacaaaauga

SEQ ID NO: 2046111 - RNA, 23 nt, Human herpesvirus 6B
auggaagaaggcuaucacuuaga

SEQ ID NO: 2046112 - RNA, 21 nt, Human herpesvirus 6B
cggagcccugagagcaggagc

SEQ ID NO: 2046113 - RNA, 22 nt, Human herpesvirus 6B
cacucgggccggucggggaggg

SEQ ID NO: 2046114 - RNA, 20 nt, Human herpesvirus 6B
auguaauguauuguucgcug

SEQ ID NO: 2046115 - RNA, 22 nt, Human herpesvirus 6B
acggaauauauagaagaagaaa

SEQ ID NO: 2046116 - RNA, 21 nt, Human herpesvirus 6B
cgaauuauguauguguuaaua

SEQ ID NO: 2046117 - RNA, 15 nt, Human herpesvirus 6B
guaugagcguuuaua

SEQ ID NO: 2046118 - RNA, 14 nt, Human herpesvirus 6B
gaaaguuuuggaaa

SEQ ID NO: 2046119 - RNA, 22 nt, Human herpesvirus 6B
ggaacccuagacacacagaaaa

SEQ ID NO: 2046120 - RNA, 15 nt, Human herpesvirus 6B
cgcugggcuccucac

SEQ ID NO: 2046121 - RNA, 17 nt, Human herpesvirus 6B
auuugcauuaaggaaaa

SEQ ID NO: 2046122 - RNA, 16 nt, Human herpesvirus 6B
auaaagcuuucauuuc

SEQ ID NO: 2046123 - RNA, 23 nt, Human herpesvirus 6B
uccugcaauuugaauucugcucg

SEQ ID NO: 2046124 - RNA, 12 nt, Human herpesvirus 6B
gacgauuucauu

SEQ ID NO: 2046125 - RNA, 15 nt, Human herpesvirus 6B
acaagggcuuggggc

SEQ ID NO: 2046126 - RNA, 22 nt, Human herpesvirus 6B
uacagacuccucaccgaaaucc

SEQ ID NO: 2046127 - RNA, 13 nt, Human herpesvirus 6B
uccucgaagaauu

SEQ ID NO: 2046128 - RNA, 11 nt, Human herpesvirus 6B
acgggcagggc

SEQ ID NO: 2046129 - RNA, 20 nt, Human herpesvirus 6B
caauccggaguuaaucucuu

SEQ ID NO: 2046130 - RNA, 12 nt, Human herpesvirus 6B
cacaaaucugua

SEQ ID NO: 2046131 - RNA, 14 nt, Human herpesvirus 6B
gaauuacugcugcg

SEQ ID NO: 2046132 - RNA, 16 nt, Human herpesvirus 6B
cgacgcccauagaaga

SEQ ID NO: 2046133 - RNA, 19 nt, Human herpesvirus 6B
uuauccccaaacucuugca

SEQ ID NO: 2046134 - RNA, 18 nt, Human herpesvirus 6B
guccgacacgcccccacc

SEQ ID NO: 2046135 - RNA, 14 nt, Human herpesvirus 6B
cuacaucaaaaucc

SEQ ID NO: 2046136 - RNA, 13 nt, Human herpesvirus 6B
cgagccggacagg

SEQ ID NO: 2046137 - RNA, 18 nt, Human herpesvirus 6B
ccauaggcucggcagggg

SEQ ID NO: 2046138 - RNA, 19 nt, Human herpesvirus 6B
gacaguauuuacugagcaa

SEQ ID NO: 2046139 - RNA, 15 nt, Human herpesvirus 6B
ccguucaacaagucc

SEQ ID NO: 2046140 - RNA, 15 nt, Human herpesvirus 6B
caaaagcgccugccu

SEQ ID NO: 2046141 - RNA, 14 nt, Human herpesvirus 6B
acaaccaaguguuu

SEQ ID NO: 2046142 - RNA, 19 nt, Human herpesvirus 6B
agggaauaacagaugagga

SEQ ID NO: 2046143 - RNA, 18 nt, Human herpesvirus 6B
uauuuuaaagauuuucua

SEQ ID NO: 2046144 - RNA, 22 nt, Human herpesvirus 6B
guuuaaagugaguuuuggaaau

SEQ ID NO: 2046145 - RNA, 18 nt, Human herpesvirus 6B
ccguccucgugcucuccg

SEQ ID NO: 2046146 - RNA, 20 nt, Human herpesvirus 6B
auaaacaugauuguaauaaa

SEQ ID NO: 2046147 - RNA, 15 nt, Human herpesvirus 6B
guucagagcugauga

SEQ ID NO: 2046148 - RNA, 19 nt, Human herpesvirus 6B
aaagucguuuuggagaaau

SEQ ID NO: 2046149 - RNA, 18 nt, Human herpesvirus 6B
aggcggacagcgugauga

SEQ ID NO: 2046150 - RNA, 17 nt, Human herpesvirus 6B
cgcauucacuggaggcg

SEQ ID NO: 2046151 - RNA, 15 nt, Human herpesvirus 6B
agacgccuauucuaa

SEQ ID NO: 2046152 - RNA, 13 nt, Human herpesvirus 6B
ucguucuuugcac

SEQ ID NO: 2046153 - RNA, 22 nt, Human herpesvirus 6B
augaauuugagaagauaauuac

SEQ ID NO: 2046154 - RNA, 19 nt, Human herpesvirus 6B
gcaugaaguguuaugaaga

SEQ ID NO: 2046155 - RNA, 12 nt, Human herpesvirus 6B
augccuugggga

SEQ ID NO: 2046156 - RNA, 22 nt, Human herpesvirus 6B
aaacgugagguguauuugaaau

SEQ ID NO: 2046157 - RNA, 17 nt, Human herpesvirus 6B
gacaucaggcaaagaug

SEQ ID NO: 2046158 - RNA, 14 nt, Human herpesvirus 6B
gcgucgggcgguuc

SEQ ID NO: 2046159 - RNA, 17 nt, Human herpesvirus 6B
aggauauugagacguuu

SEQ ID NO: 2046160 - RNA, 14 nt, Human herpesvirus 6B
uccauauuuggaag

SEQ ID NO: 2046161 - RNA, 23 nt, Human herpesvirus 6B
uaucugaaaucgcauuucucuac

SEQ ID NO: 2046162 - RNA, 17 nt, Human herpesvirus 6B
agcuagacgugucuuca

SEQ ID NO: 2046163 - RNA, 20 nt, Human herpesvirus 6B
gaaaaagccugaaggcuacu

SEQ ID NO: 2046164 - RNA, 14 nt, Human herpesvirus 6B
ggauaaauuccucu

SEQ ID NO: 2046165 - RNA, 13 nt, Human herpesvirus 6B
uguaaaaaaagau

SEQ ID NO: 2046166 - RNA, 19 nt, Human herpesvirus 6B
uauguaaagaaacaaaauu

SEQ ID NO: 2046167 - RNA, 13 nt, Human herpesvirus 6B
auguaucugaaaa

SEQ ID NO: 2046168 - RNA, 17 nt, Human herpesvirus 6B
uggaaagauuggaaucu

SEQ ID NO: 2046169 - RNA, 15 nt, Human herpesvirus 6B
aaguuuaaguucuca

SEQ ID NO: 2046170 - RNA, 22 nt, Human herpesvirus 6B
uuuugcagaaugaauguaacug

SEQ ID NO: 2046171 - RNA, 15 nt, Human herpesvirus 6B
gaugcauuguugaaa

SEQ ID NO: 2046172 - RNA, 15 nt, Human herpesvirus 6B
cuaagcuggacagaa

SEQ ID NO: 2046173 - RNA, 21 nt, Human herpesvirus 6B
uguuuucaaugguauucgaaa

SEQ ID NO: 2046174 - RNA, 19 nt, Human herpesvirus 6B
ugucugagcauuguguauu

SEQ ID NO: 2046175 - RNA, 16 nt, Human herpesvirus 6B
uuaugacugacaaggu

SEQ ID NO: 2046176 - RNA, 16 nt, Human herpesvirus 6B
uguaggacugaaggag

SEQ ID NO: 2046177 - RNA, 18 nt, Human herpesvirus 6B
auggacagaaaaaacacc

SEQ ID NO: 2046178 - RNA, 22 nt, Human herpesvirus 6B
auccgcuaagagauuuacuguu

SEQ ID NO: 2046179 - RNA, 21 nt, Human herpesvirus 6B
uaaagucgcuucgaauguuga

SEQ ID NO: 2046180 - RNA, 21 nt, Human herpesvirus 6B
uaacagacauaugcaaucugu

SEQ ID NO: 2046181 - RNA, 14 nt, Human herpesvirus 6B
uucuaucuacaaaa

SEQ ID NO: 2046182 - RNA, 14 nt, Human herpesvirus 6B
gaucucauaugcau

SEQ ID NO: 2046183 - RNA, 19 nt, Human herpesvirus 6B
acuugcuaacuaucaugug

SEQ ID NO: 2046184 - RNA, 15 nt, Human herpesvirus 6B
ugcuuguuuuggugg

SEQ ID NO: 2046185 - RNA, 16 nt, Human herpesvirus 6B
caaccaaacaguuuca

SEQ ID NO: 2046186 - RNA, 18 nt, Human herpesvirus 6B
ccgcgucuccgauccguc

SEQ ID NO: 2046187 - RNA, 19 nt, Human herpesvirus 6B
acacguuauuuauuuaacg

SEQ ID NO: 2046188 - RNA, 16 nt, Human herpesvirus 6B
gccguggugcgccugu

SEQ ID NO: 2046189 - RNA, 16 nt, Human herpesvirus 6B
auccuuauaucugaaa

SEQ ID NO: 2046190 - RNA, 14 nt, Human herpesvirus 6B
cuguacacaaaaac

SEQ ID NO: 2046191 - RNA, 21 nt, Human herpesvirus 6B
agauuauggcaacauacccuu

SEQ ID NO: 2046192 - RNA, 19 nt, Human herpesvirus 6B
uauguauaauauaaauucu

SEQ ID NO: 2046193 - RNA, 21 nt, Human herpesvirus 6B
cauuugauguugucuucugug

SEQ ID NO: 2046194 - RNA, 18 nt, Human herpesvirus 6B
aaaauaccugacuguucu

SEQ ID NO: 2046195 - RNA, 23 nt, Human herpesvirus 6B
caacuuaaaauuuuuaaacagau

SEQ ID NO: 2046196 - RNA, 14 nt, Human herpesvirus 6B
gacgagauguuucu

SEQ ID NO: 2046197 - RNA, 19 nt, Human herpesvirus 6B
uuucgugcgaaaaaacagu

SEQ ID NO: 2046198 - RNA, 21 nt, Human herpesvirus 6B
aacuaucuuacuguaaacaaa

SEQ ID NO: 2046199 - RNA, 19 nt, Human herpesvirus 6B
auucaaguccaaugcucug

SEQ ID NO: 2046200 - RNA, 13 nt, Human herpesvirus 6B
gauuuucuagaug

SEQ ID NO: 2046201 - RNA, 16 nt, Human herpesvirus 6B
ugaaaagccccugcuu

SEQ ID NO: 2046202 - RNA, 14 nt, Human herpesvirus 6B
gcgcagcagcagcu

SEQ ID NO: 2046203 - RNA, 16 nt, Human herpesvirus 6B
gugagcagaagcuguc

SEQ ID NO: 2046204 - RNA, 18 nt, Human herpesvirus 6B
cgccauccacccauauac

SEQ ID NO: 2046205 - RNA, 9 nt, Human herpesvirus 6B
gggaggaga

SEQ ID NO: 2046206 - RNA, 16 nt, Human herpesvirus 6B
uccagggugaagacag

SEQ ID NO: 2046207 - RNA, 13 nt, Human herpesvirus 6B
gagucuguuacaa

SEQ ID NO: 2046208 - RNA, 18 nt, Human herpesvirus 6B
ccuggcgggcaccgaggg

SEQ ID NO: 2046209 - RNA, 21 nt, Human herpesvirus 6B
gagugaauugugcaagcugua

SEQ ID NO: 2046210 - RNA, 13 nt, Human herpesvirus 6B
cgucacacagcau

SEQ ID NO: 2046211 - RNA, 17 nt, Human herpesvirus 6B
aaggcuuaggauguaaa

SEQ ID NO: 2046212 - RNA, 17 nt, Human herpesvirus 6B
ggaggagagggaggaga

SEQ ID NO: 2046213 - RNA, 16 nt, Human herpesvirus 6B
cucauguugauuuuag

SEQ ID NO: 2046214 - RNA, 18 nt, Human herpesvirus 6B
gguauucauaaaauuuug

SEQ ID NO: 2046215 - RNA, 19 nt, Human herpesvirus 6B
caucgcgguguccucgucc

SEQ ID NO: 2046216 - RNA, 15 nt, Human herpesvirus 6B
uccaggaguaaugau

SEQ ID NO: 2046217 - RNA, 14 nt, Human herpesvirus 6B
cuucgugcaauaac

SEQ ID NO: 2046218 - RNA, 20 nt, Human herpesvirus 6B
auagagaagaauccgcgggc

SEQ ID NO: 2046219 - RNA, 10 nt, Human herpesvirus 6B
gaggaggagg

SEQ ID NO: 2046220 - RNA, 19 nt, Human herpesvirus 6B
ccagugauucugcuaugau

SEQ ID NO: 2046221 - RNA, 22 nt, Human herpesvirus 6B
cucgccgucgucgcucucccuc

SEQ ID NO: 2046222 - RNA, 16 nt, Human herpesvirus 6B
accgucaagaaguugu

SEQ ID NO: 2046223 - RNA, 12 nt, Human herpesvirus 6B
uuuuuguuugac

SEQ ID NO: 2046224 - RNA, 18 nt, Human herpesvirus 6B
gaagccggagcccugaga

SEQ ID NO: 2046225 - RNA, 19 nt, Human herpesvirus 6B
ugaugccuugauguuuccu

SEQ ID NO: 2046226 - RNA, 14 nt, Human herpesvirus 6B
gagcaauucaucaa

SEQ ID NO: 2046227 - RNA, 12 nt, Human herpesvirus 6B
acuuauuucauu

SEQ ID NO: 2046228 - RNA, 18 nt, Human herpesvirus 6B
agguuucuaaaucugaaa

SEQ ID NO: 2046229 - RNA, 16 nt, Human herpesvirus 6B
acggacagagcggaga

SEQ ID NO: 2046230 - RNA, 18 nt, Human herpesvirus 6B
gguugucagauuucccaa

SEQ ID NO: 2046231 - RNA, 22 nt, Human herpesvirus 6B
auuuaacgauccuuuucucaca

SEQ ID NO: 2046232 - RNA, 14 nt, Human herpesvirus 6B
gguuuucagacaug

SEQ ID NO: 2046233 - RNA, 22 nt, Human herpesvirus 6B
gcaccgagggcgggcggacggc

SEQ ID NO: 2046234 - RNA, 20 nt, Human herpesvirus 6B
gaauguugguaaacuuacca

SEQ ID NO: 2046235 - RNA, 14 nt, Human herpesvirus 6B
auugagcucuugga

SEQ ID NO: 2046236 - RNA, 15 nt, Human herpesvirus 6B
ugaucggaacaaauu

SEQ ID NO: 2046237 - RNA, 19 nt, Human herpesvirus 6B
cuugaucacuucuucugca

SEQ ID NO: 2046238 - RNA, 13 nt, Human herpesvirus 6B
guguucauagagc

SEQ ID NO: 2046239 - RNA, 19 nt, Human herpesvirus 6B
aacaaagagcuuuaaagca

SEQ ID NO: 2046240 - RNA, 21 nt, Human herpesvirus 6B
auuauuguguguccugagaau

SEQ ID NO: 2046241 - RNA, 15 nt, Human herpesvirus 6B
auaccgugacagcaa

SEQ ID NO: 2046242 - RNA, 18 nt, Human herpesvirus 6B
acaugacggacuuggaaa

SEQ ID NO: 2046243 - RNA, 20 nt, Human herpesvirus 6B
ugacugcguuacaagcaugc

SEQ ID NO: 2046244 - RNA, 23 nt, Human herpesvirus 6B
gcaugacacaucgugaguuuuca

SEQ ID NO: 2046245 - RNA, 19 nt, Human herpesvirus 6B
uuguuccacgguggauuau

SEQ ID NO: 2046246 - RNA, 20 nt, Human herpesvirus 6B
cggcguuacuuuaccucugc

SEQ ID NO: 2046247 - RNA, 13 nt, Human herpesvirus 6B
aggaagaggagga

SEQ ID NO: 2046248 - RNA, 23 nt, Human herpesvirus 6B
ggcaacguuuucugcucaacaau

SEQ ID NO: 2046249 - RNA, 22 nt, Human herpesvirus 6B
uuuaucccucguacaagcuuaa

SEQ ID NO: 2046250 - RNA, 16 nt, Human herpesvirus 6B
uuaggacaugugguaa

SEQ ID NO: 2046251 - RNA, 22 nt, Human herpesvirus 6B
ucacaagaagaugcuuuaaaaa

SEQ ID NO: 2046252 - RNA, 15 nt, Human herpesvirus 6B
acccaugaaaaucau

SEQ ID NO: 2046253 - RNA, 15 nt, Human herpesvirus 6B
augacucaagaauua

SEQ ID NO: 2046254 - RNA, 16 nt, Human herpesvirus 6B
gcacucuccgaccagc

SEQ ID NO: 2046255 - RNA, 13 nt, Human herpesvirus 6B
ugggggauggguu

SEQ ID NO: 2046256 - RNA, 18 nt, Human herpesvirus 6B
uaaaaccaucuauuugca

SEQ ID NO: 2046257 - RNA, 22 nt, Human herpesvirus 6B
ggggcgucgggcgacgggcagg

SEQ ID NO: 2046258 - RNA, 15 nt, Human herpesvirus 6B
aagccggagcccuga

SEQ ID NO: 2046259 - RNA, 14 nt, Human herpesvirus 6B
acuugaagagaguu

SEQ ID NO: 2046260 - RNA, 13 nt, Human herpesvirus 6B
acuacagcuaaga

SEQ ID NO: 2046261 - RNA, 13 nt, Human herpesvirus 6B
cuucacgugauuu

SEQ ID NO: 2046262 - RNA, 12 nt, Human herpesvirus 6B
ggcgcaccgccu

SEQ ID NO: 2046263 - RNA, 21 nt, Human herpesvirus 6B
cuaacgacggaauuuacuguu

SEQ ID NO: 2046264 - RNA, 15 nt, Human herpesvirus 6B
auaacaucucagauc

SEQ ID NO: 2046265 - RNA, 19 nt, Human herpesvirus 6B
aagguguuaaacgaaaacu

SEQ ID NO: 2046266 - RNA, 11 nt, Human herpesvirus 6B
ugccgugagaa

SEQ ID NO: 2046267 - RNA, 12 nt, Human herpesvirus 6B
cauuuucugaaa

SEQ ID NO: 2046268 - RNA, 13 nt, Human herpesvirus 6B
agucugucagugg

SEQ ID NO: 2046269 - RNA, 20 nt, Human herpesvirus 6B
uucagagcugaugauuugaa

SEQ ID NO: 2046270 - RNA, 16 nt, Human herpesvirus 6B
ccugacgguuagauuu

SEQ ID NO: 2046271 - RNA, 13 nt, Human herpesvirus 6B
uaacuucaagaau

SEQ ID NO: 2046272 - RNA, 15 nt, Human herpesvirus 6B
gaucuuauaaaugug

SEQ ID NO: 2046273 - RNA, 18 nt, Human herpesvirus 6B
cuccguuccaaccuccuc

SEQ ID NO: 2046274 - RNA, 16 nt, Human herpesvirus 6B
gucugugcuuggaagu

SEQ ID NO: 2046275 - RNA, 18 nt, Human herpesvirus 6B
ccugaugguuaaggaaaa

SEQ ID NO: 2046276 - RNA, 16 nt, Human herpesvirus 6B
cuuuguccuauguuaa

SEQ ID NO: 2046277 - RNA, 15 nt, Human herpesvirus 6B
gauguguuaaagaau

SEQ ID NO: 2046278 - RNA, 21 nt, Human herpesvirus 6B
gggcuuaauaaaggauguuug

SEQ ID NO: 2046279 - RNA, 20 nt, Human herpesvirus 6B
cauagacugaacacaaaaac

SEQ ID NO: 2046280 - RNA, 18 nt, Human herpesvirus 6B
cggcgcugggcuccucac

SEQ ID NO: 2046281 - RNA, 17 nt, Human herpesvirus 6B
uucacacgguucugauu

SEQ ID NO: 2046282 - RNA, 22 nt, Human herpesvirus 6B
auuucuuuuuaaaaucaaaaaa

SEQ ID NO: 2046283 - RNA, 14 nt, Human herpesvirus 6B
accuaagcuggaca

SEQ ID NO: 2046284 - RNA, 19 nt, Human herpesvirus 6B
ugcgucucuuuaaacagau

SEQ ID NO: 2046285 - RNA, 17 nt, Human herpesvirus 6B
auggaucaaucuccaaa

SEQ ID NO: 2046286 - RNA, 18 nt, Human herpesvirus 6B
uacguggccgucuccugc

SEQ ID NO: 2046287 - RNA, 20 nt, Human herpesvirus 6B
cgccaacgcuaaauuuauca

SEQ ID NO: 2046288 - RNA, 17 nt, Human herpesvirus 6B
agaacgagacuggacag

SEQ ID NO: 2046289 - RNA, 15 nt, Human herpesvirus 6B
ugaauuugagaagau

SEQ ID NO: 2046290 - RNA, 13 nt, Human herpesvirus 6B
uauguaucugaaa

SEQ ID NO: 2046291 - RNA, 23 nt, Human herpesvirus 6B
auucuuacaaguauguuuuguac

SEQ ID NO: 2046292 - RNA, 11 nt, Human herpesvirus 6B
uugcugucaca

SEQ ID NO: 2046293 - RNA, 12 nt, Human herpesvirus 6B
uguuucuuagaa

SEQ ID NO: 2046294 - RNA, 13 nt, Human herpesvirus 6B
caacuugcugucg

SEQ ID NO: 2046295 - RNA, 20 nt, Human herpesvirus 6B
uaaaguccuaucugaguugu

SEQ ID NO: 2046296 - RNA, 14 nt, Human herpesvirus 6B
uggaaaacugcaga

SEQ ID NO: 2046297 - RNA, 10 nt, Human herpesvirus 6B
ucagcagaag

SEQ ID NO: 2046298 - RNA, 16 nt, Human herpesvirus 6B
uaacgauguugcacga

SEQ ID NO: 2046299 - RNA, 17 nt, Human herpesvirus 6B
auacggaaguugaaaaa

SEQ ID NO: 2046300 - RNA, 20 nt, Human herpesvirus 6B
agcaaaugaauguguucaua

SEQ ID NO: 2046301 - RNA, 18 nt, Human herpesvirus 6B
uauugcuaagaucugucu

SEQ ID NO: 2046302 - RNA, 14 nt, Human herpesvirus 6B
ccuuuaaccauguu

SEQ ID NO: 2046303 - RNA, 16 nt, Human herpesvirus 6B
uggcuuggccagccac

SEQ ID NO: 2046304 - RNA, 13 nt, Human herpesvirus 6B
ucuguuaauuccu

SEQ ID NO: 2046305 - RNA, 12 nt, Human herpesvirus 6B
gacaggcgcacc

SEQ ID NO: 2046306 - RNA, 14 nt, Human herpesvirus 6B
gcuauacuacgaga

SEQ ID NO: 2046307 - RNA, 19 nt, Human herpesvirus 6B
ucaccuaugaauaucuuua

SEQ ID NO: 2046308 - RNA, 20 nt, Human herpesvirus 6B
ugugauaguuauuuuguaua

SEQ ID NO: 2046309 - RNA, 20 nt, Human herpesvirus 6B
gaguauuuuaaagauuuucu

SEQ ID NO: 2046310 - RNA, 12 nt, Human herpesvirus 6B
ucauuucuguag

SEQ ID NO: 2046311 - RNA, 13 nt, Human herpesvirus 6B
auauauaugaauu

SEQ ID NO: 2046312 - RNA, 13 nt, Human herpesvirus 6B
ggagaccaugcca

SEQ ID NO: 2046313 - RNA, 14 nt, Human herpesvirus 6B
agugcaagcucuuc

SEQ ID NO: 2046314 - RNA, 20 nt, Human herpesvirus 6B
uuaagcaacugauuaagauu

SEQ ID NO: 2046315 - RNA, 16 nt, Human herpesvirus 6B
auuugguacccuugca

SEQ ID NO: 2046316 - RNA, 17 nt, Human herpesvirus 6B
agacauucaacauuccc

SEQ ID NO: 2046317 - RNA, 20 nt, Human herpesvirus 6B
uccauaccgggacagcaccc

SEQ ID NO: 2046318 - RNA, 16 nt, Human herpesvirus 6B
agcuuucauaagcucu

SEQ ID NO: 2046319 - RNA, 18 nt, Human herpesvirus 6B
auacgucagcucuucacu

SEQ ID NO: 2046320 - RNA, 16 nt, Human herpesvirus 6B
acggauugacacaaug

SEQ ID NO: 2046321 - RNA, 19 nt, Human herpesvirus 6B
uguuuuguacaaagguuuu

SEQ ID NO: 2046322 - RNA, 11 nt, Human herpesvirus 6B
gucuuuguccu

SEQ ID NO: 2046323 - RNA, 20 nt, Human herpesvirus 6B
auuccugaugguuaaggaaa

SEQ ID NO: 2046324 - RNA, 13 nt, Human herpesvirus 6B
acagaaaauuuca

SEQ ID NO: 2046325 - RNA, 15 nt, Human herpesvirus 6B
gguguaccagacaaa

SEQ ID NO: 2046326 - RNA, 17 nt, Human herpesvirus 6B
gaauucagcuggacaga

SEQ ID NO: 2046327 - RNA, 17 nt, Human herpesvirus 6B
auugaguagagcuuuga

SEQ ID NO: 2046328 - RNA, 19 nt, Human herpesvirus 6B
cgcauguaugguugcgaaa

SEQ ID NO: 2046329 - RNA, 18 nt, Human herpesvirus 6B
gucauauccagaaaauac

SEQ ID NO: 2046330 - RNA, 19 nt, Human herpesvirus 6B
auugcucaaaauuggcauu

SEQ ID NO: 2046331 - RNA, 19 nt, Human herpesvirus 6B
accccccucuugcaguggc

SEQ ID NO: 2046332 - RNA, 14 nt, Human herpesvirus 6B
cucauuugcaauug

SEQ ID NO: 2046333 - RNA, 23 nt, Human herpesvirus 6B
aagagugauucaagguggagguu

SEQ ID NO: 2046334 - RNA, 16 nt, Human herpesvirus 6B
agugugcguuauuuuc

SEQ ID NO: 2046335 - RNA, 17 nt, Human herpesvirus 6B
auuugugcaaaaugugg

SEQ ID NO: 2046336 - RNA, 19 nt, Human herpesvirus 6B
auaaugugaacuaaauaau

SEQ ID NO: 2046337 - RNA, 14 nt, Human herpesvirus 6B
caauaaacaugauu

SEQ ID NO: 2046338 - RNA, 15 nt, Human herpesvirus 6B
uucuccgcccuccug

SEQ ID NO: 2046339 - RNA, 23 nt, Human herpesvirus 6B
acggccacccgcgucuccgaucc

SEQ ID NO: 2046340 - RNA, 19 nt, Human herpesvirus 6B
aagggucgaagacauucaa

SEQ ID NO: 2046341 - RNA, 23 nt, Human herpesvirus 6B
accugcuaacggagcaaccgcag

SEQ ID NO: 2046342 - RNA, 14 nt, Human herpesvirus 6B
gcuuuuaguuucaa

SEQ ID NO: 2046343 - RNA, 19 nt, Human herpesvirus 6B
gcaggcuccccaggcgcag

SEQ ID NO: 2046344 - RNA, 14 nt, Human herpesvirus 6B
uuaauaucugucaa

SEQ ID NO: 2046345 - RNA, 12 nt, Human herpesvirus 6B
cguggugugcac

SEQ ID NO: 2046346 - RNA, 22 nt, Human herpesvirus 6B
uagacgugucuucauucuucga

SEQ ID NO: 2046347 - RNA, 14 nt, Human herpesvirus 6B
caacacggggugag

SEQ ID NO: 2046348 - RNA, 21 nt, Human herpesvirus 6B
aauauuuuuucagcuuucaua

SEQ ID NO: 2046349 - RNA, 19 nt, Human herpesvirus 6B
ucacacagcaugaacucuc

SEQ ID NO: 2046350 - RNA, 21 nt, Human herpesvirus 6B
gcauuuggcagccuaaacgga

SEQ ID NO: 2046351 - RNA, 15 nt, Human herpesvirus 6B
cauugagguauugga

SEQ ID NO: 2046352 - RNA, 14 nt, Human herpesvirus 6B
ugaccagagauucu

SEQ ID NO: 2046353 - RNA, 14 nt, Human herpesvirus 6B
gcucucccucuucc

SEQ ID NO: 2046354 - RNA, 16 nt, Human herpesvirus 6B
gcugauucuguuuucu

SEQ ID NO: 2046355 - RNA, 14 nt, Human herpesvirus 6B
aauuucuuuggagg

SEQ ID NO: 2046356 - RNA, 15 nt, Human herpesvirus 6B
agaauacgaagacaa

SEQ ID NO: 2046357 - RNA, 14 nt, Human herpesvirus 6B
agucugucaguggc

SEQ ID NO: 2046358 - RNA, 15 nt, Human herpesvirus 6B
augguagcaauaacu

SEQ ID NO: 2046359 - RNA, 16 nt, Human herpesvirus 6B
uugcgaucuauauaaa

SEQ ID NO: 2046360 - RNA, 16 nt, Human herpesvirus 6B
gaugcagcguuggaaa

SEQ ID NO: 2046361 - RNA, 16 nt, Human herpesvirus 6B
caauccaauaauugau

SEQ ID NO: 2046362 - RNA, 16 nt, Human herpesvirus 6B
cucgcccguucccggg

SEQ ID NO: 2046363 - RNA, 21 nt, Human herpesvirus 6B
uuuuacggaggaauggaagac

SEQ ID NO: 2046364 - RNA, 19 nt, Human herpesvirus 6B
aaagauauauugguagaca

SEQ ID NO: 2046365 - RNA, 13 nt, Human herpesvirus 6B
aaacauaaaaugu

SEQ ID NO: 2046366 - RNA, 16 nt, Human herpesvirus 6B
gauguacguggccguc

SEQ ID NO: 2046367 - RNA, 15 nt, Human herpesvirus 6B
aaauaaaguugaauu

SEQ ID NO: 2046368 - RNA, 19 nt, Human herpesvirus 6B
auuuuaaaaagaacgugaa

SEQ ID NO: 2046369 - RNA, 16 nt, Human herpesvirus 6B
cuacaaaguucucaga

SEQ ID NO: 2046370 - RNA, 23 nt, Human herpesvirus 6B
uuuccauugcucuuuccacacua

SEQ ID NO: 2046371 - RNA, 23 nt, Human herpesvirus 6B
ucguccgcgaugcgccacaggga

SEQ ID NO: 2046372 - RNA, 23 nt, Human herpesvirus 6B
uccgcggcgcugggcuccucacc

SEQ ID NO: 2046373 - RNA, 11 nt, Human herpesvirus 6B
uuacuguuuug

SEQ ID NO: 2046374 - RNA, 17 nt, Human herpesvirus 6B
gagaagaacagaggaag

SEQ ID NO: 2046375 - RNA, 16 nt, Human herpesvirus 6B
auaagucgugggaauu

SEQ ID NO: 2046376 - RNA, 18 nt, Human herpesvirus 6B
gugucuccggcgucacuc

SEQ ID NO: 2046377 - RNA, 18 nt, Human herpesvirus 6B
aucuucaucccuguucag

SEQ ID NO: 2046378 - RNA, 17 nt, Human herpesvirus 6B
aaacagauuuugaggau

SEQ ID NO: 2046379 - RNA, 17 nt, Human herpesvirus 6B
cguuuuccaacuuaaua

SEQ ID NO: 2046380 - RNA, 13 nt, Human herpesvirus 6B
aaagugcuguaaa

SEQ ID NO: 2046381 - RNA, 13 nt, Human herpesvirus 6B
agagacgaagucc

SEQ ID NO: 2046382 - RNA, 20 nt, Human herpesvirus 6B
agggaauaacagaugaggag

SEQ ID NO: 2046383 - RNA, 19 nt, Human herpesvirus 6B
acaagccuuuuuauaugca

SEQ ID NO: 2046384 - RNA, 20 nt, Human herpesvirus 6B
gaucaaucuccaaaacacuc

SEQ ID NO: 2046385 - RNA, 22 nt, Human herpesvirus 6B
gauccuguaauaguauugucug

SEQ ID NO: 2046386 - RNA, 13 nt, Human herpesvirus 6B
aaucaaucuuucu

SEQ ID NO: 2046387 - RNA, 21 nt, Human herpesvirus 6B
agcaauucuuuugcgaagaau

SEQ ID NO: 2046388 - RNA, 21 nt, Human herpesvirus 6B
guuuagggucgaacccugaga

SEQ ID NO: 2046389 - RNA, 17 nt, Human herpesvirus 6B
gugaaccuuauguucau

SEQ ID NO: 2046390 - RNA, 13 nt, Human herpesvirus 6B
ugagauacauguu

SEQ ID NO: 2046391 - RNA, 18 nt, Human herpesvirus 6B
uuccagguuuuucauaac

SEQ ID NO: 2046392 - RNA, 14 nt, Human herpesvirus 6B
aggaaaauguguuc

SEQ ID NO: 2046393 - RNA, 13 nt, Human herpesvirus 6B
agucucaaaaauu

SEQ ID NO: 2046394 - RNA, 14 nt, Human herpesvirus 6B
gcccugcuccguuc

SEQ ID NO: 2046395 - RNA, 14 nt, Human herpesvirus 6B
cuuuucugaugacu

SEQ ID NO: 2046396 - RNA, 14 nt, Human herpesvirus 6B
cuaaaagcugcuaa

SEQ ID NO: 2046397 - RNA, 20 nt, Human herpesvirus 6B
auuauggaaguagaauacug

SEQ ID NO: 2046398 - RNA, 21 nt, Human herpesvirus 6B
agcucguuaguaauuuggauu

SEQ ID NO: 2046399 - RNA, 13 nt, Human herpesvirus 6B
gguguggccggca

SEQ ID NO: 2046400 - RNA, 16 nt, Human herpesvirus 6B
caguuucagaugauca

SEQ ID NO: 2046401 - RNA, 15 nt, Human herpesvirus 6B
guaagauuaaaugug

SEQ ID NO: 2046402 - RNA, 16 nt, Human herpesvirus 6B
aauuuuuuguuucuga

SEQ ID NO: 2046403 - RNA, 15 nt, Human herpesvirus 6B
aaagaaaaaacagag

SEQ ID NO: 2046404 - RNA, 11 nt, Human herpesvirus 6B
aucaugagaga

SEQ ID NO: 2046405 - RNA, 22 nt, Human herpesvirus 6B
gagaauuaugacugacaaggua

SEQ ID NO: 2046406 - RNA, 23 nt, Human herpesvirus 6B
cuguuuaaagugaguuuuggaaa

SEQ ID NO: 2046407 - RNA, 18 nt, Human herpesvirus 6B
cacugugauaugcaaacu

SEQ ID NO: 2046408 - RNA, 15 nt, Human herpesvirus 6B
ccguccucgugcucu

SEQ ID NO: 2046409 - RNA, 16 nt, Human herpesvirus 6B
cccgguauggaucuca

SEQ ID NO: 2046410 - RNA, 21 nt, Human herpesvirus 6B
cgagaacccuaaaaucugcua

SEQ ID NO: 2046411 - RNA, 13 nt, Human herpesvirus 6B
gcucauggaucag

SEQ ID NO: 2046412 - RNA, 18 nt, Human herpesvirus 6B
ccaagugucucauggaaa

SEQ ID NO: 2046413 - RNA, 15 nt, Human herpesvirus 6B
uuaccaagaaaucac

SEQ ID NO: 2046414 - RNA, 15 nt, Human herpesvirus 6B
aggcggagacacaua

SEQ ID NO: 2046415 - RNA, 20 nt, Human herpesvirus 6B
auucagcuggacagaaauga

SEQ ID NO: 2046416 - RNA, 22 nt, Human herpesvirus 6B
uccccccgccgccuucucuguc

SEQ ID NO: 2046417 - RNA, 20 nt, Human herpesvirus 6B
auuuuaaaugacaaugugaa

SEQ ID NO: 2046418 - RNA, 12 nt, Human herpesvirus 6B
cccuccaucccc

SEQ ID NO: 2046419 - RNA, 19 nt, Human herpesvirus 6B
acgauguuacgucuuugga

SEQ ID NO: 2046420 - RNA, 13 nt, Human herpesvirus 6B
gauuaauuaucau

SEQ ID NO: 2046421 - RNA, 15 nt, Human herpesvirus 6B
gauccauuuucugaa

SEQ ID NO: 2046422 - RNA, 17 nt, Human herpesvirus 6B
agcauuauaaaacgcuu

SEQ ID NO: 2046423 - RNA, 22 nt, Human herpesvirus 6B
ccacggcaacgcuccucccacg

SEQ ID NO: 2046424 - RNA, 16 nt, Human herpesvirus 6B
uuugaggcaacuuuuu

SEQ ID NO: 2046425 - RNA, 15 nt, Human herpesvirus 6B
aaaaggguuuucuga

SEQ ID NO: 2046426 - RNA, 14 nt, Human herpesvirus 6B
cucucccucuuccc

SEQ ID NO: 2046427 - RNA, 15 nt, Human herpesvirus 6B
gacaagggugugaaa

SEQ ID NO: 2046428 - RNA, 21 nt, Human herpesvirus 6B
cgcacucuccgaccagcacca

SEQ ID NO: 2046429 - RNA, 13 nt, Human herpesvirus 6B
cacaaaaacaggg

SEQ ID NO: 2046430 - RNA, 22 nt, Human herpesvirus 6B
uauauucaguuuuuuguuucug

SEQ ID NO: 2046431 - RNA, 17 nt, Human herpesvirus 6B
agaagcagcagaugcuu

SEQ ID NO: 2046432 - RNA, 12 nt, Human herpesvirus 6B
cuuucaaugucc

SEQ ID NO: 2046433 - RNA, 18 nt, Human herpesvirus 6B
acucuauuauaaaaaugc

SEQ ID NO: 2046434 - RNA, 14 nt, Human herpesvirus 6B
gacgcaaagagaga

SEQ ID NO: 2046435 - RNA, 15 nt, Human herpesvirus 6B
auucugugacauguu

SEQ ID NO: 2046436 - RNA, 23 nt, Human herpesvirus 6B
cucuuuguuuuuuuuuuucugug

SEQ ID NO: 2046437 - RNA, 14 nt, Human herpesvirus 6B
aacgacugggagaa

SEQ ID NO: 2046438 - RNA, 13 nt, Human herpesvirus 6B
cuuuguucugcug

SEQ ID NO: 2046439 - RNA, 11 nt, Human herpesvirus 6B
ggaggagaggg

SEQ ID NO: 2046440 - RNA, 17 nt, Human herpesvirus 6B
cuuuuugaugacuuaua

SEQ ID NO: 2046441 - RNA, 13 nt, Human herpesvirus 6B
guaaggcuuagga

SEQ ID NO: 2046442 - RNA, 12 nt, Human herpesvirus 6B
gaaucacaaaau

SEQ ID NO: 2046443 - RNA, 21 nt, Human herpesvirus 6B
caauaacucuuggauugcaga

SEQ ID NO: 2046444 - RNA, 23 nt, Human herpesvirus 6B
auccuuagcgcgaucguagacgu

SEQ ID NO: 2046445 - RNA, 15 nt, Human herpesvirus 6B
cgaagucaugaauuu

SEQ ID NO: 2046446 - RNA, 21 nt, Human herpesvirus 6B
gucgcggccgucgcgcucgcc

SEQ ID NO: 2046447 - RNA, 22 nt, Human herpesvirus 6B
cgauuacuguccguuauugugu

SEQ ID NO: 2046448 - RNA, 22 nt, Human herpesvirus 6B
acgacaucaaugcgcuaugcca

SEQ ID NO: 2046449 - RNA, 21 nt, Human herpesvirus 6B
uuguuuuuuucugcgacaaaa

SEQ ID NO: 2046450 - RNA, 13 nt, Human herpesvirus 6B
gaaaagugcuuua

SEQ ID NO: 2046451 - RNA, 18 nt, Human herpesvirus 6B
uauuguguaccuuguaau

SEQ ID NO: 2046452 - RNA, 13 nt, Human herpesvirus 6B
agccucuugugca

SEQ ID NO: 2046453 - RNA, 17 nt, Human herpesvirus 6B
aguagugcaaccaugca

SEQ ID NO: 2046454 - RNA, 17 nt, Human herpesvirus 6B
gaaagggacguccccgg

SEQ ID NO: 2046455 - RNA, 21 nt, Human herpesvirus 6B
cagcgugaugaggcccagagg

SEQ ID NO: 2046456 - RNA, 16 nt, Human herpesvirus 6B
ucguuaaaaacguuuu

SEQ ID NO: 2046457 - RNA, 16 nt, Human herpesvirus 6B
guggccgucuccugca

SEQ ID NO: 2046458 - RNA, 17 nt, Human herpesvirus 6B
cggcaacgcuccuccca

SEQ ID NO: 2046459 - RNA, 14 nt, Human herpesvirus 6B
guacauguuaacaa

SEQ ID NO: 2046460 - RNA, 16 nt, Human herpesvirus 6B
ugcauaacaucucaga

SEQ ID NO: 2046461 - RNA, 16 nt, Human herpesvirus 6B
gaaaaugcugauuuua

SEQ ID NO: 2046462 - RNA, 14 nt, Human herpesvirus 6B
ccaugcagcugccc

SEQ ID NO: 2046463 - RNA, 17 nt, Human herpesvirus 6B
aggcaauuuaaacagaa

SEQ ID NO: 2046464 - RNA, 14 nt, Human herpesvirus 6B
gggaaaucaaggaa

SEQ ID NO: 2046465 - RNA, 11 nt, Human herpesvirus 6B
gcuggacagaa

SEQ ID NO: 2046466 - RNA, 15 nt, Human herpesvirus 6B
cuuaucaacuauacu

SEQ ID NO: 2046467 - RNA, 20 nt, Human herpesvirus 6B
cggaaaaauuauagacuugc

SEQ ID NO: 2046468 - RNA, 21 nt, Human herpesvirus 6B
uaaaaauguuaccgaaauauc

SEQ ID NO: 2046469 - RNA, 18 nt, Human herpesvirus 6B
aguauggugucugaaaaa

SEQ ID NO: 2046470 - RNA, 22 nt, Human herpesvirus 6B
ucaaucuccaaaacacuccgcu

SEQ ID NO: 2046471 - RNA, 20 nt, Human herpesvirus 6B
cugguuacgcagaauccugu

SEQ ID NO: 2046472 - RNA, 16 nt, Human herpesvirus 6B
caaaaucguguuuucu

SEQ ID NO: 2046473 - RNA, 16 nt, Human herpesvirus 6B
auugacaugauguuuc

SEQ ID NO: 2046474 - RNA, 15 nt, Human herpesvirus 6B
acucgacuucuuuca

SEQ ID NO: 2046475 - RNA, 18 nt, Human herpesvirus 6B
uagcaauuuuaaauauua

SEQ ID NO: 2046476 - RNA, 21 nt, Human herpesvirus 6B
uuaucagagagugacaucuua

SEQ ID NO: 2046477 - RNA, 20 nt, Human herpesvirus 6B
uccaaagucguugaauucuc

SEQ ID NO: 2046478 - RNA, 22 nt, Human herpesvirus 6B
gccucucuccgccuccucuuuu

SEQ ID NO: 2046479 - RNA, 20 nt, Human herpesvirus 6B
gagaucuggugaauguuucu

SEQ ID NO: 2046480 - RNA, 16 nt, Human herpesvirus 6B
ggcucucgugccguug

SEQ ID NO: 2046481 - RNA, 20 nt, Human herpesvirus 6B
ccucauagauuucauacugu

SEQ ID NO: 2046482 - RNA, 15 nt, Human herpesvirus 6B
aauucuuaccaagaa

SEQ ID NO: 2046483 - RNA, 18 nt, Human herpesvirus 6B
gaaccacagccagaagca

SEQ ID NO: 2046484 - RNA, 18 nt, Human herpesvirus 6B
cacaucgugaguuuucau

SEQ ID NO: 2046485 - RNA, 19 nt, Human herpesvirus 6B
uuauaaauucucugcaugu

SEQ ID NO: 2046486 - RNA, 14 nt, Human herpesvirus 6B
cgucacacagcaug

SEQ ID NO: 2046487 - RNA, 14 nt, Human herpesvirus 6B
cugcguuaagugaa

SEQ ID NO: 2046488 - RNA, 17 nt, Human herpesvirus 6B
ggacggacagagcggag

SEQ ID NO: 2046489 - RNA, 19 nt, Human herpesvirus 6B
uuugauaucgauucuguaa

SEQ ID NO: 2046490 - RNA, 19 nt, Human herpesvirus 6B
ggacucucgucgcccggcc

SEQ ID NO: 2046491 - RNA, 22 nt, Human herpesvirus 6B
gcggaugucgcgaagcucagcu

SEQ ID NO: 2046492 - RNA, 17 nt, Human herpesvirus 6B
uucauaguuguuuuuua

SEQ ID NO: 2046493 - RNA, 13 nt, Human herpesvirus 6B
gacagaaaugagc

SEQ ID NO: 2046494 - RNA, 20 nt, Human herpesvirus 6B
acguugggauugcugcuuga

SEQ ID NO: 2046495 - RNA, 18 nt, Human herpesvirus 6B
auuguugauagguaaacu

SEQ ID NO: 2046496 - RNA, 15 nt, Human herpesvirus 6B
guaccgcgguugaag

SEQ ID NO: 2046497 - RNA, 17 nt, Human herpesvirus 6B
uacgcauugacggguau

SEQ ID NO: 2046498 - RNA, 13 nt, Human herpesvirus 6B
gagagcgggcaca

SEQ ID NO: 2046499 - RNA, 15 nt, Human herpesvirus 6B
cuguucacauuguga

SEQ ID NO: 2046500 - RNA, 13 nt, Human herpesvirus 6B
cuuuauccggcca

SEQ ID NO: 2046501 - RNA, 12 nt, Human herpesvirus 6B
augacuuuucug

SEQ ID NO: 2046502 - RNA, 15 nt, Human herpesvirus 6B
auaagauuuacagac

SEQ ID NO: 2046503 - RNA, 19 nt, Human herpesvirus 6B
cauuuauuucguauguuua

SEQ ID NO: 2046504 - RNA, 23 nt, Human herpesvirus 6B
cauuuugauaucgauucuguaau

SEQ ID NO: 2046505 - RNA, 13 nt, Human herpesvirus 6B
guacgauuucugu

SEQ ID NO: 2046506 - RNA, 18 nt, Human herpesvirus 6B
augcgaccuacggccaga

SEQ ID NO: 2046507 - RNA, 15 nt, Human herpesvirus 6B
ccuaagcuggacaga

SEQ ID NO: 2046508 - RNA, 13 nt, Human herpesvirus 6B
gaucacgcaggcc

SEQ ID NO: 2046509 - RNA, 19 nt, Human herpesvirus 6B
guguugcgauugcugcuuc

SEQ ID NO: 2046510 - RNA, 20 nt, Human herpesvirus 6B
gccuccucuuuuccccccgc

SEQ ID NO: 2046511 - RNA, 23 nt, Human herpesvirus 6B
gucgcccgccucucuccgccucc

SEQ ID NO: 2046512 - RNA, 13 nt, Human herpesvirus 6B
aggcggacagcgu

SEQ ID NO: 2046513 - RNA, 22 nt, Human herpesvirus 6B
aauccgcgggccagcccugaag

SEQ ID NO: 2046514 - RNA, 19 nt, Human herpesvirus 6B
cuuauugaggaaaugcagc

SEQ ID NO: 2046515 - RNA, 22 nt, Human herpesvirus 6B
auaaaccuaacagaguuuucau

SEQ ID NO: 2046516 - RNA, 14 nt, Human herpesvirus 6B
cguugucuauuuuu

SEQ ID NO: 2046517 - RNA, 14 nt, Human herpesvirus 6B
gauccaaugaugaa

SEQ ID NO: 2046518 - RNA, 14 nt, Human herpesvirus 6B
auggugucugaaaa

SEQ ID NO: 2046519 - RNA, 19 nt, Human herpesvirus 6B
auuuaguuuauguuaaaaa

SEQ ID NO: 2046520 - RNA, 14 nt, Human herpesvirus 6B
guugccuuggccgc

SEQ ID NO: 2046521 - RNA, 20 nt, Human herpesvirus 6B
cuaucaacuuucuccgcaca

SEQ ID NO: 2046522 - RNA, 15 nt, Human herpesvirus 6B
auauugcaugcauug

SEQ ID NO: 2046523 - RNA, 21 nt, Human herpesvirus 6B
ccgggcgcggggcgcaccggc

SEQ ID NO: 2046524 - RNA, 15 nt, Human herpesvirus 6B
aguugaugcuguugc

SEQ ID NO: 2046525 - RNA, 19 nt, Human herpesvirus 6B
augccgccugaaaccccac

SEQ ID NO: 2046526 - RNA, 17 nt, Human herpesvirus 6B
aaaugagaaggacacaa

SEQ ID NO: 2046527 - RNA, 19 nt, Human herpesvirus 6B
caggcuccccaggcgcagc

SEQ ID NO: 2046528 - RNA, 16 nt, Human herpesvirus 6B
aaacucaaagaaagcu

SEQ ID NO: 2046529 - RNA, 13 nt, Human herpesvirus 6B
cagauuuuacugg

SEQ ID NO: 2046530 - RNA, 17 nt, Human herpesvirus 6B
cagcggucgagaaagau

SEQ ID NO: 2046531 - RNA, 18 nt, Human herpesvirus 6B
cuacccaccuguccuuuc

SEQ ID NO: 2046532 - RNA, 20 nt, Human herpesvirus 6B
ggggagguuuuuucaccccc

SEQ ID NO: 2046533 - RNA, 20 nt, Human herpesvirus 6B
uauaagucuaaugcaaagau

SEQ ID NO: 2046534 - RNA, 13 nt, Human herpesvirus 6B
uaaugcaaagaug

SEQ ID NO: 2046535 - RNA, 18 nt, Human herpesvirus 6B
gaugcgccacagggaggu

SEQ ID NO: 2046536 - RNA, 14 nt, Human herpesvirus 6B
ccaaaagagaaaga

SEQ ID NO: 2046537 - RNA, 20 nt, Human herpesvirus 6B
gaaaacgguaaagaugagau

SEQ ID NO: 2046538 - RNA, 16 nt, Human herpesvirus 6B
gaaauaccaaagaaau

SEQ ID NO: 2046539 - RNA, 20 nt, Human herpesvirus 6B
aaaaauauugguauugauuu

SEQ ID NO: 2046540 - RNA, 15 nt, Human herpesvirus 6B
ugaguuuuuugcaau

SEQ ID NO: 2046541 - RNA, 11 nt, Human herpesvirus 6B
aaauaaaguuu

SEQ ID NO: 2046542 - RNA, 17 nt, Human herpesvirus 6B
augucucgaaaaagaca

SEQ ID NO: 2046543 - RNA, 15 nt, Human herpesvirus 6B
gugcacauagaaaac

SEQ ID NO: 2046544 - RNA, 16 nt, Human herpesvirus 6B
acgucuuuggacugaa

SEQ ID NO: 2046545 - RNA, 18 nt, Human herpesvirus 6B
gcauucauaauugugaua

SEQ ID NO: 2046546 - RNA, 19 nt, Human herpesvirus 6B
aaggaaaaagccuugauuu

SEQ ID NO: 2046547 - RNA, 20 nt, Human herpesvirus 6B
auuugaaauguucguucucu

SEQ ID NO: 2046548 - RNA, 16 nt, Human herpesvirus 6B
ugacaugauguuuccu

SEQ ID NO: 2046549 - RNA, 13 nt, Human herpesvirus 6B
caugcaaaacaga

SEQ ID NO: 2046550 - RNA, 20 nt, Human herpesvirus 6B
agaucacaacaaacauguau

SEQ ID NO: 2046551 - RNA, 15 nt, Human herpesvirus 6B
guucacacagaugca

SEQ ID NO: 2046552 - RNA, 19 nt, Human herpesvirus 6B
augaauuaccugucuuaga

SEQ ID NO: 2046553 - RNA, 21 nt, Human herpesvirus 6B
aacgcuuuuuuauuauguuuu

SEQ ID NO: 2046554 - RNA, 16 nt, Human herpesvirus 6B
cggcagcggggaaggg

SEQ ID NO: 2046555 - RNA, 14 nt, Human herpesvirus 6B
uucaucgaauccaa

SEQ ID NO: 2046556 - RNA, 17 nt, Human herpesvirus 6B
ccccggcuuucucgccg

SEQ ID NO: 2046557 - RNA, 17 nt, Human herpesvirus 6B
caggcgcagcagcagcu

SEQ ID NO: 2046558 - RNA, 23 nt, Human herpesvirus 6B
gaugugucccucgauaacuauac

SEQ ID NO: 2046559 - RNA, 18 nt, Human herpesvirus 6B
accauguucgccucuccc

SEQ ID NO: 2046560 - RNA, 12 nt, Human herpesvirus 6B
uaaaguuuucau

SEQ ID NO: 2046561 - RNA, 22 nt, Human herpesvirus 6B
aguuagugcaccgagaaauagu

SEQ ID NO: 2046562 - RNA, 15 nt, Human herpesvirus 6B
aaaagucguuacagu

SEQ ID NO: 2046563 - RNA, 19 nt, Human herpesvirus 6B
agggacccacacgcgggga

SEQ ID NO: 2046564 - RNA, 14 nt, Human herpesvirus 6B
augacuaucaaaau

SEQ ID NO: 2046565 - RNA, 16 nt, Human herpesvirus 6B
ucuugcggcaugugua

SEQ ID NO: 2046566 - RNA, 17 nt, Human herpesvirus 6B
uuuuggaauuucauuca

SEQ ID NO: 2046567 - RNA, 16 nt, Human herpesvirus 6B
uaugagacuuacaguu

SEQ ID NO: 2046568 - RNA, 17 nt, Human herpesvirus 6B
gaugccuugauguuucc

SEQ ID NO: 2046569 - RNA, 13 nt, Human herpesvirus 6B
cagcuaaucacuu

SEQ ID NO: 2046570 - RNA, 14 nt, Human herpesvirus 6B
cuguccgugacaca

SEQ ID NO: 2046571 - RNA, 16 nt, Human herpesvirus 6B
uggguuaucuuagaaa

SEQ ID NO: 2046572 - RNA, 17 nt, Human herpesvirus 6B
aggugcguacacggcca

SEQ ID NO: 2046573 - RNA, 20 nt, Human herpesvirus 6B
auuaaaaauaaaaaaaauga

SEQ ID NO: 2046574 - RNA, 20 nt, Human herpesvirus 6B
ugaaaauaucauuaaauugu

SEQ ID NO: 2046575 - RNA, 20 nt, Human herpesvirus 6B
cugcguuacaagcaugcauu

SEQ ID NO: 2046576 - RNA, 17 nt, Human herpesvirus 6B
cacgagccaaggggacg

SEQ ID NO: 2046577 - RNA, 20 nt, Human herpesvirus 6B
gcguucggucucuggaagca

SEQ ID NO: 2046578 - RNA, 19 nt, Human herpesvirus 6B
uggacagaaaaaacaccag

SEQ ID NO: 2046579 - RNA, 16 nt, Human herpesvirus 6B
aaucugugggaaaaua

SEQ ID NO: 2046580 - RNA, 16 nt, Human herpesvirus 6B
caggaaguucuucaaa

SEQ ID NO: 2046581 - RNA, 14 nt, Human herpesvirus 6B
auccauuuucugaa

SEQ ID NO: 2046582 - RNA, 19 nt, Human herpesvirus 6B
uuucaaaaugaccagagau

SEQ ID NO: 2046583 - RNA, 23 nt, Human herpesvirus 6B
uuuguuccagauguagguuucaa

SEQ ID NO: 2046584 - RNA, 15 nt, Human herpesvirus 6B
auaucugaaacacua

SEQ ID NO: 2046585 - RNA, 13 nt, Human herpesvirus 6B
cgggcgacgagag

SEQ ID NO: 2046586 - RNA, 21 nt, Human herpesvirus 6B
cugcguuccaugugucuccgg

SEQ ID NO: 2046587 - RNA, 13 nt, Human herpesvirus 6B
cuccacgccccuc

SEQ ID NO: 2046588 - RNA, 15 nt, Human herpesvirus 6B
uacaaaguucucaga

SEQ ID NO: 2046589 - RNA, 20 nt, Human herpesvirus 6B
ggccggucggggaggggagg

SEQ ID NO: 2046590 - RNA, 22 nt, Human herpesvirus 6B
auaacaugugacacaauuucug

SEQ ID NO: 2046591 - RNA, 14 nt, Human herpesvirus 6B
cgauguuuccaggu

SEQ ID NO: 2046592 - RNA, 18 nt, Human herpesvirus 6B
caguuguacucaaaguau

SEQ ID NO: 2046593 - RNA, 21 nt, Human herpesvirus 6B
ggaucugccgcguggaagccg

SEQ ID NO: 2046594 - RNA, 19 nt, Human herpesvirus 6B
gcauccuguuuucccaccu

SEQ ID NO: 2046595 - RNA, 16 nt, Human herpesvirus 6B
auucauuuauucucca

SEQ ID NO: 2046596 - RNA, 13 nt, Human herpesvirus 6B
aagcgccugccua

SEQ ID NO: 2046597 - RNA, 21 nt, Human herpesvirus 6B
guuaaaguccuaucugaguug

SEQ ID NO: 2046598 - RNA, 22 nt, Human herpesvirus 6B
aagugaaggcggagaugcaaaa

SEQ ID NO: 2046599 - RNA, 23 nt, Human herpesvirus 6B
caaauaauuuuauugacugugaa

SEQ ID NO: 2046600 - RNA, 22 nt, Human herpesvirus 6B
auucuuuugugcuuaucaaauu

SEQ ID NO: 2046601 - RNA, 16 nt, Human herpesvirus 6B
gugcccacuguggugu

SEQ ID NO: 2046602 - RNA, 16 nt, Human herpesvirus 6B
agcgcuguauguuaug

SEQ ID NO: 2046603 - RNA, 22 nt, Human herpesvirus 6B
aaggcagcuggcaaugcaaagc

SEQ ID NO: 2046604 - RNA, 16 nt, Human herpesvirus 6B
acggcaaacucaaaga

SEQ ID NO: 2046605 - RNA, 23 nt, Human herpesvirus 6B
uuuaucccaaaauauaauucuga

SEQ ID NO: 2046606 - RNA, 15 nt, Human herpesvirus 6B
cgcgccgucagcggc

SEQ ID NO: 2046607 - RNA, 17 nt, Human herpesvirus 6B
auuuucuguauuaauuu

SEQ ID NO: 2046608 - RNA, 15 nt, Human herpesvirus 6B
uagaaauuuuuugca

SEQ ID NO: 2046609 - RNA, 14 nt, Human herpesvirus 6B
agucguggcggagc

SEQ ID NO: 2046610 - RNA, 13 nt, Human herpesvirus 6B
uguaauguuuccu

SEQ ID NO: 2046611 - RNA, 16 nt, Human herpesvirus 6B
uauuuaacauccaaaa

SEQ ID NO: 2046612 - RNA, 19 nt, Human herpesvirus 6B
gcacaguucguccagcagc

SEQ ID NO: 2046613 - RNA, 13 nt, Human herpesvirus 6B
uaguacaaagaua

SEQ ID NO: 2046614 - RNA, 19 nt, Human herpesvirus 6B
cuuugacauuuaccagaga

SEQ ID NO: 2046615 - RNA, 14 nt, Human herpesvirus 6B
gagcacgcacgaga

SEQ ID NO: 2046616 - RNA, 18 nt, Human herpesvirus 6B
agucaacaugauuuccga

SEQ ID NO: 2046617 - RNA, 11 nt, Human herpesvirus 6B
aagaaggaaaa

SEQ ID NO: 2046618 - RNA, 15 nt, Human herpesvirus 6B
agugacaaaauuuuu

SEQ ID NO: 2046619 - RNA, 15 nt, Human herpesvirus 6B
agcugcuaaauguga

SEQ ID NO: 2046620 - RNA, 16 nt, Human herpesvirus 6B
uaacuaucaugugugg

SEQ ID NO: 2046621 - RNA, 21 nt, Human herpesvirus 6B
acgucugcguugcccucccgc

SEQ ID NO: 2046622 - RNA, 14 nt, Human herpesvirus 6B
acuuacaucuuggu

SEQ ID NO: 2046623 - RNA, 16 nt, Human herpesvirus 6B
ccuaacagaguuuuca

SEQ ID NO: 2046624 - RNA, 20 nt, Human herpesvirus 6B
aaugucugagcauuguguau

SEQ ID NO: 2046625 - RNA, 20 nt, Human herpesvirus 6B
cguguucaaaaaugugguca

SEQ ID NO: 2046626 - RNA, 16 nt, Human herpesvirus 6B
ccgaagaaagaggcgc

SEQ ID NO: 2046627 - RNA, 18 nt, Human herpesvirus 6B
aggugauuugaacagaga

SEQ ID NO: 2046628 - RNA, 23 nt, Human herpesvirus 6B
caauaaaaaacuuauaauuggaa

SEQ ID NO: 2046629 - RNA, 23 nt, Human herpesvirus 6B
gauaaacuguacgccauacggga

SEQ ID NO: 2046630 - RNA, 17 nt, Human herpesvirus 6B
ugacauuuaccagagau

SEQ ID NO: 2046631 - RNA, 21 nt, Human herpesvirus 6B
agacagaguucgguccaagga

SEQ ID NO: 2046632 - RNA, 13 nt, Human herpesvirus 6B
cccucccgcagcu

SEQ ID NO: 2046633 - RNA, 12 nt, Human herpesvirus 6B
cgacaaagaaca

SEQ ID NO: 2046634 - RNA, 22 nt, Human herpesvirus 6B
ccacauuagcugcuaaauguga

SEQ ID NO: 2046635 - RNA, 12 nt, Human herpesvirus 6B
aaaauaaaguug

SEQ ID NO: 2046636 - RNA, 21 nt, Human herpesvirus 6B
aauacuauguggaaauuaaaa

SEQ ID NO: 2046637 - RNA, 15 nt, Human herpesvirus 6B
ugacaaguagagaga

SEQ ID NO: 2046638 - RNA, 14 nt, Human herpesvirus 6B
aggaacaaaaggaa

SEQ ID NO: 2046639 - RNA, 18 nt, Human herpesvirus 6B
guaaccugucuuggaaga

SEQ ID NO: 2046640 - RNA, 14 nt, Human herpesvirus 6B
gauacaaaugaggg

SEQ ID NO: 2046641 - RNA, 16 nt, Human herpesvirus 6B
auguguucuuacaaug

SEQ ID NO: 2046642 - RNA, 18 nt, Human herpesvirus 6B
gauauacgauggacagaa

SEQ ID NO: 2046643 - RNA, 13 nt, Human herpesvirus 6B
uagagccggccuu

SEQ ID NO: 2046644 - RNA, 17 nt, Human herpesvirus 6B
uaaaagauuguuuucau

SEQ ID NO: 2046645 - RNA, 17 nt, Human herpesvirus 6B
acaugagcgagaauguu

SEQ ID NO: 2046646 - RNA, 17 nt, Human herpesvirus 6B
uuaaacgaaaacuuuuu

SEQ ID NO: 2046647 - RNA, 15 nt, Human herpesvirus 6B
ucgacauagaguguu

SEQ ID NO: 2046648 - RNA, 19 nt, Human herpesvirus 6B
agguguuguguuugaaacg

SEQ ID NO: 2046649 - RNA, 15 nt, Human herpesvirus 6B
ucucuaaucaagaaa

SEQ ID NO: 2046650 - RNA, 21 nt, Human herpesvirus 6B
uuguggcuauuugacaauaaa

SEQ ID NO: 2046651 - RNA, 23 nt, Human herpesvirus 6B
cuuguucgggccaagguaaagga

SEQ ID NO: 2046652 - RNA, 16 nt, Human herpesvirus 6B
aguuuugugauccugu

SEQ ID NO: 2046653 - RNA, 20 nt, Human herpesvirus 6B
gguaauaaaccuaacagagu

SEQ ID NO: 2046654 - RNA, 17 nt, Human herpesvirus 6B
augaaaacauucagaaa

SEQ ID NO: 2046655 - RNA, 22 nt, Human herpesvirus 6B
accaagaaucguuaaaugagau

SEQ ID NO: 2046656 - RNA, 13 nt, Human herpesvirus 6B
auuacaagggaaa

SEQ ID NO: 2046657 - RNA, 19 nt, Human herpesvirus 6B
uuuuuaaauaauaguaaac

SEQ ID NO: 2046658 - RNA, 15 nt, Human herpesvirus 6B
cuuaacauacaacuu

SEQ ID NO: 2046659 - RNA, 14 nt, Human herpesvirus 6B
auuguguucugcuc

SEQ ID NO: 2046660 - RNA, 16 nt, Human herpesvirus 6B
acuguacacaaaaacc

SEQ ID NO: 2046661 - RNA, 21 nt, Human herpesvirus 6B
aauaaucucuggcuucauuuc

SEQ ID NO: 2046662 - RNA, 22 nt, Human herpesvirus 6B
aucaccaucaacacaccugccu

SEQ ID NO: 2046663 - RNA, 19 nt, Human herpesvirus 6B
cagagccuagaccaagaau

SEQ ID NO: 2046664 - RNA, 18 nt, Human herpesvirus 6B
gucuucgcauaauagaca

SEQ ID NO: 2046665 - RNA, 19 nt, Human herpesvirus 6B
aguguaaauguagaagaag

SEQ ID NO: 2046666 - RNA, 20 nt, Human herpesvirus 6B
auuuuaguauuuaugcuuca

SEQ ID NO: 2046667 - RNA, 13 nt, Human herpesvirus 6B
uccaaaauacacu

SEQ ID NO: 2046668 - RNA, 14 nt, Human herpesvirus 6B
auacagguuugcuc

SEQ ID NO: 2046669 - RNA, 14 nt, Human herpesvirus 6B
aaaugacacagaau

SEQ ID NO: 2046670 - RNA, 15 nt, Human herpesvirus 6B
uguuagauaaaauga

SEQ ID NO: 2046671 - RNA, 12 nt, Human herpesvirus 6B
gcgggaccuggc

SEQ ID NO: 2046672 - RNA, 18 nt, Human herpesvirus 6B
aaauuaacugucaugucu

SEQ ID NO: 2046673 - RNA, 15 nt, Human herpesvirus 6B
guuagauucggaaac

SEQ ID NO: 2046674 - RNA, 12 nt, Human herpesvirus 6B
cggaauuuacug

SEQ ID NO: 2046675 - RNA, 15 nt, Human herpesvirus 6B
uaacgguuuugcaga

SEQ ID NO: 2046676 - RNA, 22 nt, Human herpesvirus 6B
uaaaagugcaacaaagagcuuu

SEQ ID NO: 2046677 - RNA, 15 nt, Human herpesvirus 6B
agguuuuuucacccc

SEQ ID NO: 2046678 - RNA, 18 nt, Human herpesvirus 6B
uuguccuauguuaacauu

SEQ ID NO: 2046679 - RNA, 19 nt, Human herpesvirus 6B
aacgagaagacaguuuacu

SEQ ID NO: 2046680 - RNA, 15 nt, Human herpesvirus 6B
auggacagaaaaaac

SEQ ID NO: 2046681 - RNA, 17 nt, Human herpesvirus 6B
ggacaauaaauugauuc

SEQ ID NO: 2046682 - RNA, 11 nt, Human herpesvirus 6B
ucuugcaagaa

SEQ ID NO: 2046683 - RNA, 23 nt, Human herpesvirus 6B
acuuucguuuacgaauucaaugu

SEQ ID NO: 2046684 - RNA, 22 nt, Human herpesvirus 6B
augaagagguucagacugcugc

SEQ ID NO: 2046685 - RNA, 11 nt, Human herpesvirus 6B
caauuccugug

SEQ ID NO: 2046686 - RNA, 19 nt, Human herpesvirus 6B
uucucgccgccucgccgcu

SEQ ID NO: 2046687 - RNA, 13 nt, Human herpesvirus 6B
aggagaagaacag

SEQ ID NO: 2046688 - RNA, 23 nt, Human herpesvirus 6B
uccgcuauggccuauugcauggc

SEQ ID NO: 2046689 - RNA, 22 nt, Human herpesvirus 6B
aucuaugaugcuguagaaacgu

SEQ ID NO: 2046690 - RNA, 20 nt, Human herpesvirus 6B
auaccuuuggccuugauugu

SEQ ID NO: 2046691 - RNA, 22 nt, Human herpesvirus 6B
ccuguccgugacacacagaaua

SEQ ID NO: 2046692 - RNA, 17 nt, Human herpesvirus 6B
cugucuccagcaagaaa

SEQ ID NO: 2046693 - RNA, 24 nt, Human herpesvirus 6B
gucauucgcguggcggcgcgcgcc

SEQ ID NO: 2046694 - RNA, 16 nt, Human herpesvirus 6B
ccccaggcgcagcagc

SEQ ID NO: 2046695 - RNA, 14 nt, Human herpesvirus 6B
cuguaaaagggcuc

SEQ ID NO: 2046696 - RNA, 22 nt, Human herpesvirus 6B
gaacaagagacgaaagacguuu

SEQ ID NO: 2046697 - RNA, 20 nt, Human herpesvirus 6B
uugcgucuaaaaauauggaa

SEQ ID NO: 2046698 - RNA, 18 nt, Human herpesvirus 6B
aauauauuuguugaaaga

SEQ ID NO: 2046699 - RNA, 20 nt, Human herpesvirus 6B
ccgucugucuguuccucaga

SEQ ID NO: 2046700 - RNA, 18 nt, Human herpesvirus 6B
acaacgguguggagacac

SEQ ID NO: 2046701 - RNA, 13 nt, Human herpesvirus 6B
ccgggcgacgaga

SEQ ID NO: 2046702 - RNA, 18 nt, Human herpesvirus 6B
cuccaaauggucccguaa

SEQ ID NO: 2046703 - RNA, 22 nt, Human herpesvirus 6B
cauagccgggagauuccucugu

SEQ ID NO: 2046704 - RNA, 20 nt, Human herpesvirus 6B
acuguaaaaaaaauucucug

SEQ ID NO: 2046705 - RNA, 13 nt, Human herpesvirus 6B
acgucugcguugc

SEQ ID NO: 2046706 - RNA, 15 nt, Human herpesvirus 6B
aaaaucugcuaacgc

SEQ ID NO: 2046707 - RNA, 14 nt, Human herpesvirus 6B
uuacaaguauguuu

SEQ ID NO: 2046708 - RNA, 20 nt, Human herpesvirus 6B
ccaaggcaacggcacgagag

SEQ ID NO: 2046709 - RNA, 11 nt, Human herpesvirus 6B
augauagcuug

SEQ ID NO: 2046710 - RNA, 15 nt, Human herpesvirus 6B
ugacgccugugugcc

SEQ ID NO: 2046711 - RNA, 20 nt, Human herpesvirus 6B
agcaugggugaguguauuau

SEQ ID NO: 2046712 - RNA, 23 nt, Human herpesvirus 6B
gcaggcuccccaggcgcagcagc

SEQ ID NO: 2046713 - RNA, 22 nt, Human herpesvirus 6B
augaaaucucuuuuaacacaca

SEQ ID NO: 2046714 - RNA, 19 nt, Human herpesvirus 6B
uugcaauuuggcugcguug

SEQ ID NO: 2046715 - RNA, 22 nt, Human herpesvirus 6B
uucuaccguagaccguuuuuua

SEQ ID NO: 2046716 - RNA, 14 nt, Human herpesvirus 6B
uguucauagagcau

SEQ ID NO: 2046717 - RNA, 15 nt, Human herpesvirus 6B
ucguuuugcaacuua

SEQ ID NO: 2046718 - RNA, 11 nt, Human herpesvirus 6B
gucuuuccugu

SEQ ID NO: 2046719 - RNA, 17 nt, Human herpesvirus 6B
cuguauaucuaugcuuu

SEQ ID NO: 2046720 - RNA, 13 nt, Human herpesvirus 6B
aaugagcaacauu

SEQ ID NO: 2046721 - RNA, 12 nt, Human herpesvirus 6B
gugccuacggga

SEQ ID NO: 2046722 - RNA, 15 nt, Human herpesvirus 6B
agucuccacagggca

SEQ ID NO: 2046723 - RNA, 18 nt, Human herpesvirus 6B
auccuguuuucccaccua

SEQ ID NO: 2046724 - RNA, 20 nt, Human herpesvirus 6B
aaucggguaaauaugugaaa

SEQ ID NO: 2046725 - RNA, 13 nt, Human herpesvirus 6B
ugagcaacauuua

SEQ ID NO: 2046726 - RNA, 14 nt, Human herpesvirus 6B
uuauguauguguua

SEQ ID NO: 2046727 - RNA, 17 nt, Human herpesvirus 6B
cgaaauuauuuuuaaug

SEQ ID NO: 2046728 - RNA, 14 nt, Human herpesvirus 6B
uagcaaaugaaugu

SEQ ID NO: 2046729 - RNA, 21 nt, Human herpesvirus 6B
cugcucaugucaguauuucgc

SEQ ID NO: 2046730 - RNA, 18 nt, Human herpesvirus 6B
cucuaccgucagaggcuu

SEQ ID NO: 2046731 - RNA, 16 nt, Human herpesvirus 6B
acaaggaucucgaaau

SEQ ID NO: 2046732 - RNA, 15 nt, Human herpesvirus 6B
cacgcgcggagcacg

SEQ ID NO: 2046733 - RNA, 12 nt, Human herpesvirus 6B
ccgcgggccagc

SEQ ID NO: 2046734 - RNA, 19 nt, Human herpesvirus 6B
gguugucuuguuagacaag

SEQ ID NO: 2046735 - RNA, 22 nt, Human herpesvirus 6B
acgauuuucuauuaaaaagacu

SEQ ID NO: 2046736 - RNA, 23 nt, Human herpesvirus 6B
ggcuccucacccugaagggaccg

SEQ ID NO: 2046737 - RNA, 20 nt, Human herpesvirus 6B
uucacagcaguuaucucaaa

SEQ ID NO: 2046738 - RNA, 19 nt, Human herpesvirus 6B
gacaccacauaacaaaaaa

SEQ ID NO: 2046739 - RNA, 14 nt, Human herpesvirus 6B
uauaugaaaugucu

SEQ ID NO: 2046740 - RNA, 16 nt, Human herpesvirus 6B
gaaaucuuuccugcua

SEQ ID NO: 2046741 - RNA, 16 nt, Human herpesvirus 6B
cuguuuuucucauaaa

SEQ ID NO: 2046742 - RNA, 14 nt, Human herpesvirus 6B
uauguuuuguacaa

SEQ ID NO: 2046743 - RNA, 20 nt, Human herpesvirus 6B
caauaucguccucagagaaa

SEQ ID NO: 2046744 - RNA, 22 nt, Human herpesvirus 6B
aacuccggaaaagaaaaguugu

SEQ ID NO: 2046745 - RNA, 20 nt, Human herpesvirus 6B
ucugccccccuucauccagc

SEQ ID NO: 2046746 - RNA, 20 nt, Human herpesvirus 6B
ugguguuguguuuguggaca

SEQ ID NO: 2046747 - RNA, 17 nt, Human herpesvirus 6B
uccucccacgcccccuc

SEQ ID NO: 2046748 - RNA, 19 nt, Human herpesvirus 6B
cggagcccugagagcagga

SEQ ID NO: 2046749 - RNA, 15 nt, Human herpesvirus 6B
agggcagagagccgc

SEQ ID NO: 2046750 - RNA, 15 nt, Human herpesvirus 6B
uccucugaauuucaa

SEQ ID NO: 2046751 - RNA, 20 nt, Human herpesvirus 6B
ucuauauaaaucggguaaau

SEQ ID NO: 2046752 - RNA, 16 nt, Human herpesvirus 6B
uaugcggccagucucg

SEQ ID NO: 2046753 - RNA, 21 nt, Human herpesvirus 6B
uaauuuuuuguuucugaaaau

SEQ ID NO: 2046754 - RNA, 18 nt, Human herpesvirus 6B
aaucaucugguaaauugu

SEQ ID NO: 2046755 - RNA, 23 nt, Human herpesvirus 6B
cagaagcugucuguguuucagaa

SEQ ID NO: 2046756 - RNA, 15 nt, Human herpesvirus 6B
ugcacaguugcaugg

SEQ ID NO: 2046757 - RNA, 18 nt, Human herpesvirus 6B
gcagaggucuuugcuuug

SEQ ID NO: 2046758 - RNA, 23 nt, Human herpesvirus 6B
gccccuccguccaggacccgagg

SEQ ID NO: 2046759 - RNA, 14 nt, Human herpesvirus 6B
uuucguccauccag

SEQ ID NO: 2046760 - RNA, 23 nt, Human herpesvirus 6B
ucuccgucaccguguccacggca

SEQ ID NO: 2046761 - RNA, 19 nt, Human herpesvirus 6B
uggaaaucuauuaauuuug

SEQ ID NO: 2046762 - RNA, 11 nt, Human herpesvirus 6B
uuuuucacccc

SEQ ID NO: 2046763 - RNA, 16 nt, Human herpesvirus 6B
ucguucuuaacauauu

SEQ ID NO: 2046764 - RNA, 17 nt, Human herpesvirus 6B
uucccucuuccuucucg

SEQ ID NO: 2046765 - RNA, 14 nt, Human herpesvirus 6B
ugguucuugagcag

SEQ ID NO: 2046766 - RNA, 17 nt, Human herpesvirus 6B
ggucgaacccugagacc

SEQ ID NO: 2046767 - RNA, 19 nt, Human herpesvirus 6B
gugaauugugcaagcugua

SEQ ID NO: 2046768 - RNA, 20 nt, Human herpesvirus 6B
aguccaaugaauacuucucu

SEQ ID NO: 2046769 - RNA, 16 nt, Human herpesvirus 6B
uccaaacuauguguua

SEQ ID NO: 2046770 - RNA, 13 nt, Human herpesvirus 6B
uccuguuuuccca

SEQ ID NO: 2046771 - RNA, 19 nt, Human herpesvirus 6B
gucaugugcuauuguaaga

SEQ ID NO: 2046772 - RNA, 22 nt, Human herpesvirus 6B
aauuuaaaguuacaucugucua

SEQ ID NO: 2046773 - RNA, 17 nt, Human herpesvirus 6B
uaaaucgcgagacagau

SEQ ID NO: 2046774 - RNA, 16 nt, Human herpesvirus 6B
ugugaaguucgauguu

SEQ ID NO: 2046775 - RNA, 17 nt, Human herpesvirus 6B
uugauguuuccugaauu

SEQ ID NO: 2046776 - RNA, 16 nt, Human herpesvirus 6B
acacggggugagagag

SEQ ID NO: 2046777 - RNA, 23 nt, Human herpesvirus 6B
uggaaguggcguggauaggaacu

SEQ ID NO: 2046778 - RNA, 16 nt, Human herpesvirus 6B
ucaguaaacuuacgua

SEQ ID NO: 2046779 - RNA, 19 nt, Human herpesvirus 6B
ccucaacuaaaucaugucu

SEQ ID NO: 2046780 - RNA, 15 nt, Human herpesvirus 6B
ucgccggcccgucca

SEQ ID NO: 2046781 - RNA, 13 nt, Human herpesvirus 6B
uuaaucggaaugu

SEQ ID NO: 2046782 - RNA, 18 nt, Human herpesvirus 6B
auuuaacauccaaaauac

SEQ ID NO: 2046783 - RNA, 21 nt, Human herpesvirus 6B
aauaauauaaaagaaacucuu

SEQ ID NO: 2046784 - RNA, 13 nt, Human herpesvirus 6B
uuuccuugacagu

SEQ ID NO: 2046785 - RNA, 12 nt, Human herpesvirus 6B
auuuaaugcaaa

SEQ ID NO: 2046786 - RNA, 18 nt, Human herpesvirus 6B
ccugagucggcuguccaa

SEQ ID NO: 2046787 - RNA, 19 nt, Human herpesvirus 6B
ggacuugcgagucugucag

SEQ ID NO: 2046788 - RNA, 19 nt, Human herpesvirus 6B
gacuacucuggcugaagga

SEQ ID NO: 2046789 - RNA, 13 nt, Human herpesvirus 6B
uguguuguuuccu

SEQ ID NO: 2046790 - RNA, 13 nt, Human herpesvirus 6B
guaacaccagaga

SEQ ID NO: 2046791 - RNA, 14 nt, Human herpesvirus 6B
uagcgguuucuagg

SEQ ID NO: 2046792 - RNA, 18 nt, Human herpesvirus 6B
uuuaaacuccggaaaaga

SEQ ID NO: 2046793 - RNA, 22 nt, Human herpesvirus 6B
auaacagaugaggaggagggac

SEQ ID NO: 2046794 - RNA, 12 nt, Human herpesvirus 6B
gauuugaacaga

SEQ ID NO: 2046795 - RNA, 18 nt, Human herpesvirus 6B
caggaccagcucuguucu

SEQ ID NO: 2046796 - RNA, 23 nt, Human herpesvirus 6B
aggacaagccgacuauggaugau

SEQ ID NO: 2046797 - RNA, 11 nt, Human herpesvirus 6B
ccugaaaagac

SEQ ID NO: 2046798 - RNA, 21 nt, Human herpesvirus 6B
agguuucuaaaucugaaaugu

SEQ ID NO: 2046799 - RNA, 14 nt, Human herpesvirus 6B
aaacaugauuguaa

SEQ ID NO: 2046800 - RNA, 15 nt, Human herpesvirus 6B
gugagcagaagcugu

SEQ ID NO: 2046801 - RNA, 20 nt, Human herpesvirus 6B
uauggugaugaauugaacau

SEQ ID NO: 2046802 - RNA, 16 nt, Human herpesvirus 6B
ugauaaguugucauug

SEQ ID NO: 2046803 - RNA, 15 nt, Human herpesvirus 6B
uuuggcauauacaaa

SEQ ID NO: 2046804 - RNA, 15 nt, Human herpesvirus 6B
acucugcuaaaauug

SEQ ID NO: 2046805 - RNA, 19 nt, Human herpesvirus 6B
aggguuccuccgcgggacc

SEQ ID NO: 2046806 - RNA, 15 nt, Human herpesvirus 6B
cgaaaaucauauauu

SEQ ID NO: 2046807 - RNA, 21 nt, Human herpesvirus 6B
ccgcgaugcgccacagggagg

SEQ ID NO: 2046808 - RNA, 14 nt, Human herpesvirus 6B
acugaaucagaaac

SEQ ID NO: 2046809 - RNA, 20 nt, Human herpesvirus 6B
gaaacggugguuucugcucc

SEQ ID NO: 2046810 - RNA, 23 nt, Human herpesvirus 6B
ccaaggauuaugaucauacgagg

SEQ ID NO: 2046811 - RNA, 21 nt, Human herpesvirus 6B
acugcaugcuaauaaaauaua

SEQ ID NO: 2046812 - RNA, 12 nt, Human herpesvirus 6B
uuuggcagaauc

SEQ ID NO: 2046813 - RNA, 10 nt, Human herpesvirus 6B
aaggcucucg

SEQ ID NO: 2046814 - RNA, 14 nt, Human herpesvirus 6B
aucauauauugaaa

SEQ ID NO: 2046815 - RNA, 18 nt, Human herpesvirus 6B
aauuauugugacaaggua

SEQ ID NO: 2046816 - RNA, 22 nt, Human herpesvirus 6B
aucuuccuuuucaguauagaca

SEQ ID NO: 2046817 - RNA, 15 nt, Human herpesvirus 6B
gaauccgcgggccag

SEQ ID NO: 2046818 - RNA, 15 nt, Human herpesvirus 6B
ucacggcuagaugug

SEQ ID NO: 2046819 - RNA, 20 nt, Human herpesvirus 6B
cagaacagagacccuccugg

SEQ ID NO: 2046820 - RNA, 19 nt, Human herpesvirus 6B
cauugagccggcugauaag

SEQ ID NO: 2046821 - RNA, 14 nt, Human herpesvirus 6B
acauagaaucucca

SEQ ID NO: 2046822 - RNA, 16 nt, Human herpesvirus 6B
gcgaagugcuucugcu

SEQ ID NO: 2046823 - RNA, 17 nt, Human herpesvirus 6B
ucuucgugcaauaacga

SEQ ID NO: 2046824 - RNA, 18 nt, Human herpesvirus 6B
acguggccgucuccugca

SEQ ID NO: 2046825 - RNA, 19 nt, Human herpesvirus 6B
uauucacaagaagaugcuu

SEQ ID NO: 2046826 - RNA, 20 nt, Human herpesvirus 6B
gcucuccgcgcugcuggggc

SEQ ID NO: 2046827 - RNA, 17 nt, Human herpesvirus 6B
gaagccgcugcagugug

SEQ ID NO: 2046828 - RNA, 17 nt, Human herpesvirus 6B
ucuauuuuuuauuagua

SEQ ID NO: 2046829 - RNA, 23 nt, Human herpesvirus 6B
guaaacuucugcuauuuuuuuaa

SEQ ID NO: 2046830 - RNA, 15 nt, Human herpesvirus 6B
aagacguuuuugugu

SEQ ID NO: 2046831 - RNA, 19 nt, Human herpesvirus 6B
uucuccucaacuaaaucau

SEQ ID NO: 2046832 - RNA, 21 nt, Human herpesvirus 6B
aacaaaaggucagaugcaaaa

SEQ ID NO: 2046833 - RNA, 15 nt, Human herpesvirus 6B
aaauuuguaacaaug

SEQ ID NO: 2046834 - RNA, 15 nt, Human herpesvirus 6B
auaagcagaagaguu

SEQ ID NO: 2046835 - RNA, 20 nt, Human herpesvirus 6B
acggcagcggggaagggaau

SEQ ID NO: 2046836 - RNA, 21 nt, Human herpesvirus 6B
gggugaucauaggacagagga

SEQ ID NO: 2046837 - RNA, 16 nt, Human herpesvirus 6B
auugggaagauucugc

SEQ ID NO: 2046838 - RNA, 16 nt, Human herpesvirus 6B
cagaaaugagcaacau

SEQ ID NO: 2046839 - RNA, 18 nt, Human herpesvirus 6B
uaaccuaagcuggacaga

SEQ ID NO: 2046840 - RNA, 21 nt, Human herpesvirus 6B
gacagaguucgguccaaggau

SEQ ID NO: 2046841 - RNA, 19 nt, Human herpesvirus 6B
gaauaugaauaugccguau

SEQ ID NO: 2046842 - RNA, 20 nt, Human herpesvirus 6B
auccaaaguaggcacacaug

SEQ ID NO: 2046843 - RNA, 15 nt, Human herpesvirus 6B
caccaugaaagcaca

SEQ ID NO: 2046844 - RNA, 14 nt, Human herpesvirus 6B
guuugaucuagaua

SEQ ID NO: 2046845 - RNA, 17 nt, Human herpesvirus 6B
ggagaggaagccggagc

SEQ ID NO: 2046846 - RNA, 13 nt, Human herpesvirus 6B
guguuuuguaagu

SEQ ID NO: 2046847 - RNA, 20 nt, Human herpesvirus 6B
gcggauuagguaucugcccc

SEQ ID NO: 2046848 - RNA, 17 nt, Human herpesvirus 6B
ucauaggcacuuaccca

SEQ ID NO: 2046849 - RNA, 17 nt, Human herpesvirus 6B
uucagaaggcuguguuu

SEQ ID NO: 2046850 - RNA, 20 nt, Human herpesvirus 6B
gcaagucgccucacuguaaa

SEQ ID NO: 2046851 - RNA, 22 nt, Human herpesvirus 6B
acauucuuguucgggccaaggu

SEQ ID NO: 2046852 - RNA, 11 nt, Human herpesvirus 6B
ugcccaagaac

SEQ ID NO: 2046853 - RNA, 17 nt, Human herpesvirus 6B
cagacgugcggagaugc

SEQ ID NO: 2046854 - RNA, 13 nt, Human herpesvirus 6B
cccccucuugcag

SEQ ID NO: 2046855 - RNA, 21 nt, Human herpesvirus 6B
uguuuuguaggacugaaggag

SEQ ID NO: 2046856 - RNA, 11 nt, Human herpesvirus 6B
gacggaauuua

SEQ ID NO: 2046857 - RNA, 18 nt, Human herpesvirus 6B
guuagagauuuuggaagc

SEQ ID NO: 2046858 - RNA, 15 nt, Human herpesvirus 6B
ggaauaaugaaauuu

SEQ ID NO: 2046859 - RNA, 16 nt, Human herpesvirus 6B
cuauuugacaauaaac

SEQ ID NO: 2046860 - RNA, 13 nt, Human herpesvirus 6B
uuauaaguguuac

SEQ ID NO: 2046861 - RNA, 16 nt, Human herpesvirus 6B
aggacggggccucccu

SEQ ID NO: 2046862 - RNA, 12 nt, Human herpesvirus 6B
uguucucuccca

SEQ ID NO: 2046863 - RNA, 19 nt, Human herpesvirus 6B
gacuaucaaaauaaaaauu

SEQ ID NO: 2046864 - RNA, 15 nt, Human herpesvirus 6B
caaugaauacuucuc

SEQ ID NO: 2046865 - RNA, 18 nt, Human herpesvirus 6B
augauccaauguuucugu

SEQ ID NO: 2046866 - RNA, 13 nt, Human herpesvirus 6B
ugugcuuggaagu

SEQ ID NO: 2046867 - RNA, 18 nt, Human herpesvirus 6B
uaagaaaaccgaaaacac

SEQ ID NO: 2046868 - RNA, 23 nt, Human herpesvirus 6B
aacucgggggcagucggaaaauc

SEQ ID NO: 2046869 - RNA, 23 nt, Human herpesvirus 6B
gaccgcagucgcggcggccccgc

SEQ ID NO: 2046870 - RNA, 18 nt, Human herpesvirus 6B
gaguauggugucugaaaa

SEQ ID NO: 2046871 - RNA, 15 nt, Human herpesvirus 6B
ccuccguccaggacc

SEQ ID NO: 2046872 - RNA, 20 nt, Human herpesvirus 6B
auucugcuugcacuauuuua

SEQ ID NO: 2046873 - RNA, 20 nt, Human herpesvirus 6B
ugggaagauucugcagaaug

SEQ ID NO: 2046874 - RNA, 24 nt, Human herpesvirus 6B
gaacauuguucuaaaagauuguuu

SEQ ID NO: 2046875 - RNA, 21 nt, Human herpesvirus 6B
cucaguagaaugaaugaaaca

SEQ ID NO: 2046876 - RNA, 20 nt, Human herpesvirus 6B
gccgugucuuucgauaaggc

SEQ ID NO: 2046877 - RNA, 18 nt, Human herpesvirus 6B
uagacuaaacuuaacuua

SEQ ID NO: 2046878 - RNA, 15 nt, Human herpesvirus 6B
caacgcauagaagcc

SEQ ID NO: 2046879 - RNA, 22 nt, Human herpesvirus 6B
uacggagauauaccgugacagc

SEQ ID NO: 2046880 - RNA, 22 nt, Human herpesvirus 6B
aguggguaccgcgguugaaguc

SEQ ID NO: 2046881 - RNA, 15 nt, Human herpesvirus 6B
gcauaacuaugaauu

SEQ ID NO: 2046882 - RNA, 17 nt, Human herpesvirus 6B
gucacucacauagagaa

SEQ ID NO: 2046883 - RNA, 23 nt, Human herpesvirus 6B
uuacaucaacuauuuaacaucca

SEQ ID NO: 2046884 - RNA, 19 nt, Human herpesvirus 6B
aucuguauaucuaugcuuu

SEQ ID NO: 2046885 - RNA, 20 nt, Human herpesvirus 6B
ccuacgggaagguguuugau

SEQ ID NO: 2046886 - RNA, 24 nt, Human herpesvirus 6B
ucccuccguuaggaucagacagac

SEQ ID NO: 2046887 - RNA, 15 nt, Human herpesvirus 6B
agguccgacacgccc

SEQ ID NO: 2046888 - RNA, 18 nt, Human herpesvirus 6B
guaccccaagugaaauuc

SEQ ID NO: 2046889 - RNA, 22 nt, Human herpesvirus 6B
cggagauauaccgugacagcaa

SEQ ID NO: 2046890 - RNA, 17 nt, Human herpesvirus 6B
gaagaauugucuuuucg

SEQ ID NO: 2046891 - RNA, 20 nt, Human herpesvirus 6B
uacccaucguucuuaacaua

SEQ ID NO: 2046892 - RNA, 23 nt, Human herpesvirus 6B
uucaacauccuauuaagauucuc

SEQ ID NO: 2046893 - RNA, 16 nt, Human herpesvirus 6B
cgcagcagcagcucca

SEQ ID NO: 2046894 - RNA, 20 nt, Human herpesvirus 6B
uucuauauggcccucucacg

SEQ ID NO: 2046895 - RNA, 12 nt, Human herpesvirus 6B
caauagcaguug

SEQ ID NO: 2046896 - RNA, 16 nt, Human herpesvirus 6B
gaguauggagaaaaac

SEQ ID NO: 2046897 - RNA, 19 nt, Human herpesvirus 6B
uugggaccuucaggaacaa

SEQ ID NO: 2046898 - RNA, 23 nt, Human herpesvirus 6B
aguuagaugcuuaacuuacuuaa

SEQ ID NO: 2046899 - RNA, 18 nt, Human herpesvirus 6B
auucucugcaugucuuua

SEQ ID NO: 2046900 - RNA, 15 nt, Human herpesvirus 6B
cugacaucugcaaaa

SEQ ID NO: 2046901 - RNA, 20 nt, Human herpesvirus 6B
cguugcccucccgcagcucc

SEQ ID NO: 2046902 - RNA, 23 nt, Human herpesvirus 6B
cgaaacgugggguaaaaauguua

SEQ ID NO: 2046903 - RNA, 16 nt, Human herpesvirus 6B
uacuacgagaaaaggu

SEQ ID NO: 2046904 - RNA, 19 nt, Human herpesvirus 6B
uggccgaguuuagacagag

SEQ ID NO: 2046905 - RNA, 14 nt, Human herpesvirus 6B
auuuauguaaacau

SEQ ID NO: 2046906 - RNA, 16 nt, Human herpesvirus 6B
agaucgcuuuucugga

SEQ ID NO: 2046907 - RNA, 18 nt, Human herpesvirus 6B
aucauuucgauaucucac

SEQ ID NO: 2046908 - RNA, 16 nt, Human herpesvirus 6B
caaugaauacuucucu

SEQ ID NO: 2046909 - RNA, 16 nt, Human herpesvirus 6B
gggucgaacccugaga

SEQ ID NO: 2046910 - RNA, 17 nt, Human herpesvirus 6B
caacacuguuguuaauc

SEQ ID NO: 2046911 - RNA, 20 nt, Human herpesvirus 6B
aaccacagccagaagcaauu

SEQ ID NO: 2046912 - RNA, 23 nt, Human herpesvirus 6B
acuguucggauccaaugaugaaa

SEQ ID NO: 2046913 - RNA, 17 nt, Human herpesvirus 6B
auugaauacgacuuugg

SEQ ID NO: 2046914 - RNA, 15 nt, Human herpesvirus 6B
augucucaguucaaa

SEQ ID NO: 2046915 - RNA, 18 nt, Human herpesvirus 6B
caguuuuuuuuucauaug

SEQ ID NO: 2046916 - RNA, 14 nt, Human herpesvirus 6B
gcgcggggcgcacc

SEQ ID NO: 2046917 - RNA, 16 nt, Human herpesvirus 6B
gcuaaguguugacuga

SEQ ID NO: 2046918 - RNA, 14 nt, Human herpesvirus 6B
agaaaaagaacugu

SEQ ID NO: 2046919 - RNA, 19 nt, Human herpesvirus 6B
cuuccgaguauggugucuu

SEQ ID NO: 2046920 - RNA, 16 nt, Human herpesvirus 6B
accaucuauuugcaag

SEQ ID NO: 2046921 - RNA, 17 nt, Human herpesvirus 6B
cagggcauagaaagcgg

SEQ ID NO: 2046922 - RNA, 20 nt, Human herpesvirus 6B
agcaauuucggcaagaaagc

SEQ ID NO: 2046923 - RNA, 14 nt, Human herpesvirus 6B
agaaaagaaacaau

SEQ ID NO: 2046924 - RNA, 12 nt, Human herpesvirus 6B
accgaaaugugc

SEQ ID NO: 2046925 - RNA, 13 nt, Human herpesvirus 6B
gugaguuuuggaa

SEQ ID NO: 2046926 - RNA, 10 nt, Human herpesvirus 6B
cauaaaguua

SEQ ID NO: 2046927 - RNA, 16 nt, Human herpesvirus 6B
ucugauaaacuccaaa

SEQ ID NO: 2046928 - RNA, 13 nt, Human herpesvirus 6B
ugaagucuuuccu

SEQ ID NO: 2046929 - RNA, 17 nt, Human herpesvirus 6B
aggaggaaaagaagaag

SEQ ID NO: 2046930 - RNA, 13 nt, Human herpesvirus 6B
cgggccacgagag

SEQ ID NO: 2046931 - RNA, 18 nt, Human herpesvirus 6B
cgcggcgacgucgcggcc

SEQ ID NO: 2046932 - RNA, 17 nt, Human herpesvirus 6B
aguauucgugugugaaa

SEQ ID NO: 2046933 - RNA, 18 nt, Human herpesvirus 6B
uucuaauuauaaauguag

SEQ ID NO: 2046934 - RNA, 16 nt, Human herpesvirus 6B
uacauuguuucucuaa

SEQ ID NO: 2046935 - RNA, 15 nt, Human herpesvirus 6B
gggcauuuuuuugaa

SEQ ID NO: 2046936 - RNA, 13 nt, Human herpesvirus 6B
auuucgguuuaau

SEQ ID NO: 2046937 - RNA, 21 nt, Human herpesvirus 6B
ugucacaauaauuacucccau

SEQ ID NO: 2046938 - RNA, 20 nt, Human herpesvirus 6B
cccaggcgcagcagcagcuc

SEQ ID NO: 2046939 - RNA, 12 nt, Human herpesvirus 6B
uggaacugcuug

SEQ ID NO: 2046940 - RNA, 14 nt, Human herpesvirus 6B
uuuauauuaaugau

SEQ ID NO: 2046941 - RNA, 19 nt, Human herpesvirus 6B
gcggcaugaguggaguuga

SEQ ID NO: 2046942 - RNA, 22 nt, Human herpesvirus 6B
ucguuaugacgaucaauauaga

SEQ ID NO: 2046943 - RNA, 19 nt, Human herpesvirus 6B
aauauuuuuucagcuuuca

SEQ ID NO: 2046944 - RNA, 20 nt, Human herpesvirus 6B
uugaauccucuuagauaucc

SEQ ID NO: 2046945 - RNA, 17 nt, Human herpesvirus 6B
gaaauguugucaaucgu

SEQ ID NO: 2046946 - RNA, 17 nt, Human herpesvirus 6B
ugaaucccgugaaggaa

SEQ ID NO: 2046947 - RNA, 19 nt, Human herpesvirus 6B
uccuuaucagucucaaaaa

SEQ ID NO: 2046948 - RNA, 20 nt, Human herpesvirus 6B
auaauuuuauugacugugaa

SEQ ID NO: 2046949 - RNA, 15 nt, Human herpesvirus 6B
agguguuugcagaua

SEQ ID NO: 2046950 - RNA, 14 nt, Human herpesvirus 6B
uccaugacugugag

SEQ ID NO: 2046951 - RNA, 19 nt, Human herpesvirus 6B
acgucuccaucucuagaau

SEQ ID NO: 2046952 - RNA, 15 nt, Human herpesvirus 6B
auggauaagauuuac

SEQ ID NO: 2046953 - RNA, 16 nt, Human herpesvirus 6B
cuugaaccaagucacc

SEQ ID NO: 2046954 - RNA, 15 nt, Human herpesvirus 6B
caguaaaacauguag

SEQ ID NO: 2046955 - RNA, 14 nt, Human herpesvirus 6B
gaaacaaaauuaau

SEQ ID NO: 2046956 - RNA, 18 nt, Human herpesvirus 6B
cuucuuggagucuggccu

SEQ ID NO: 2046957 - RNA, 18 nt, Human herpesvirus 6B
gcacccguauccgcgaga

SEQ ID NO: 2046958 - RNA, 14 nt, Human herpesvirus 6B
cauguucuauuuua

SEQ ID NO: 2046959 - RNA, 13 nt, Human herpesvirus 6B
uuuaugucuguca

SEQ ID NO: 2046960 - RNA, 16 nt, Human herpesvirus 6B
ugccuucuguucacau

SEQ ID NO: 2046961 - RNA, 15 nt, Human herpesvirus 6B
gaugaggcccagagg

SEQ ID NO: 2046962 - RNA, 22 nt, Human herpesvirus 6B
ggagucggucuguuccccgucc

SEQ ID NO: 2046963 - RNA, 13 nt, Human herpesvirus 6B
agacaucguggac

SEQ ID NO: 2046964 - RNA, 18 nt, Human herpesvirus 6B
acagaaucuucuuugugc

SEQ ID NO: 2046965 - RNA, 19 nt, Human herpesvirus 6B
caggccgaguuggccaagc

SEQ ID NO: 2046966 - RNA, 16 nt, Human herpesvirus 6B
auaauuacagaugucu

SEQ ID NO: 2046967 - RNA, 13 nt, Human herpesvirus 6B
aucaaauucaaac

SEQ ID NO: 2046968 - RNA, 20 nt, Human herpesvirus 6B
aauguagcacacgacaaaua

SEQ ID NO: 2046969 - RNA, 22 nt, Human herpesvirus 6B
ucucgauugugauguacguggc

SEQ ID NO: 2046970 - RNA, 16 nt, Human herpesvirus 6B
gaaagaggggaauuug

SEQ ID NO: 2046971 - RNA, 12 nt, Human herpesvirus 6B
cacaccaccgca

SEQ ID NO: 2046972 - RNA, 20 nt, Human herpesvirus 6B
ugcgaccucgcucuccugug

SEQ ID NO: 2046973 - RNA, 18 nt, Human herpesvirus 6B
agcuaaaauugcuacuaa

SEQ ID NO: 2046974 - RNA, 14 nt, Human herpesvirus 6B
cuggauuaucagag

SEQ ID NO: 2046975 - RNA, 17 nt, Human herpesvirus 6B
cuuccgcuaccgcccug

SEQ ID NO: 2046976 - RNA, 23 nt, Human herpesvirus 6B
gucuaugacuuuucugaaauucu

SEQ ID NO: 2046977 - RNA, 16 nt, Human herpesvirus 6B
cuauuuaacugggaaa

SEQ ID NO: 2046978 - RNA, 19 nt, Human herpesvirus 6B
acuggagcuagagaaaauu

SEQ ID NO: 2046979 - RNA, 22 nt, Human herpesvirus 6B
ggcggaggcgucgcggugguga

SEQ ID NO: 2046980 - RNA, 19 nt, Human herpesvirus 6B
ucuuggauugcagauaaga

SEQ ID NO: 2046981 - RNA, 22 nt, Human herpesvirus 6B
acugcggagaacgggcaacucc

SEQ ID NO: 2046982 - RNA, 14 nt, Human herpesvirus 6B
gaaagcgcgccaca

SEQ ID NO: 2046983 - RNA, 13 nt, Human herpesvirus 6B
aaauugucuacaa

SEQ ID NO: 2046984 - RNA, 17 nt, Human herpesvirus 6B
gagccuuuaaccauguu

SEQ ID NO: 2046985 - RNA, 15 nt, Human herpesvirus 6B
ugcgucagaguuuga

SEQ ID NO: 2046986 - RNA, 14 nt, Human herpesvirus 6B
auagagauaaaugu

SEQ ID NO: 2046987 - RNA, 12 nt, Human herpesvirus 6B
uuccagauguag

SEQ ID NO: 2046988 - RNA, 14 nt, Human herpesvirus 6B
ggguguauguuucu

SEQ ID NO: 2046989 - RNA, 14 nt, Human herpesvirus 6B
uugaauucugcucg

SEQ ID NO: 2046990 - RNA, 23 nt, Human herpesvirus 6B
gccuauucuaauuauaaauguag

SEQ ID NO: 2046991 - RNA, 17 nt, Human herpesvirus 6B
uguuaugcaguuguacu

SEQ ID NO: 2046992 - RNA, 14 nt, Human herpesvirus 6B
uccagguuuuucau

SEQ ID NO: 2046993 - RNA, 11 nt, Human herpesvirus 6B
ucgaaagagau

SEQ ID NO: 2046994 - RNA, 16 nt, Human herpesvirus 6B
uuaaugagaggacagu

SEQ ID NO: 2046995 - RNA, 22 nt, Human herpesvirus 6B
uggaaacguguuugucuguaug

SEQ ID NO: 2046996 - RNA, 14 nt, Human herpesvirus 6B
auuucuuguagcuu

SEQ ID NO: 2046997 - RNA, 13 nt, Human herpesvirus 6B
aaauuacaugaaa

SEQ ID NO: 2046998 - RNA, 15 nt, Human herpesvirus 6B
ucuaugagacuguuu

SEQ ID NO: 2046999 - RNA, 21 nt, Human herpesvirus 6B
guagaagacaucuuaaauuuc

SEQ ID NO: 2047000 - RNA, 16 nt, Human herpesvirus 6B
aaaguuuuggaaaaug

SEQ ID NO: 2047001 - RNA, 12 nt, Human herpesvirus 6B
uggcugaaggaa

SEQ ID NO: 2047002 - RNA, 20 nt, Human herpesvirus 6B
ugcaaaaucguguuuucuua

SEQ ID NO: 2047003 - RNA, 21 nt, Human herpesvirus 6B
aagcgacuuuuuaacaaaaug

SEQ ID NO: 2047004 - RNA, 18 nt, Human herpesvirus 6B
cagauuucccaaaacgug

SEQ ID NO: 2047005 - RNA, 20 nt, Human herpesvirus 6B
aaauuuguucgcacaaaaug

SEQ ID NO: 2047006 - RNA, 15 nt, Human herpesvirus 6B
uuauucuacugugca

SEQ ID NO: 2047007 - RNA, 19 nt, Human herpesvirus 6B
gggccggucggggagggga

SEQ ID NO: 2047008 - RNA, 13 nt, Human herpesvirus 6B
acggcagcgggga

SEQ ID NO: 2047009 - RNA, 16 nt, Human herpesvirus 6B
ccuggaagaaggaaaa

SEQ ID NO: 2047010 - RNA, 18 nt, Human herpesvirus 6B
gcaauuugaauucugcuc

SEQ ID NO: 2047011 - RNA, 21 nt, Human herpesvirus 6B
agaugcugaauaauuacaaag

SEQ ID NO: 2047012 - RNA, 21 nt, Human herpesvirus 6B
aucaaugucacaaaucuguaa

SEQ ID NO: 2047013 - RNA, 15 nt, Human herpesvirus 6B
gauauaguuauucag

SEQ ID NO: 2047014 - RNA, 21 nt, Human herpesvirus 6B
aauuuccggucaacuucuaua

SEQ ID NO: 2047015 - RNA, 14 nt, Human herpesvirus 6B
agcaggagaaaaau

SEQ ID NO: 2047016 - RNA, 16 nt, Human herpesvirus 6B
acggcagcggggaagg

SEQ ID NO: 2047017 - RNA, 20 nt, Human herpesvirus 6B
caugacggacuuggaaaagg

SEQ ID NO: 2047018 - RNA, 19 nt, Human herpesvirus 6B
cuuuuuuccucgaugguag

SEQ ID NO: 2047019 - RNA, 17 nt, Human herpesvirus 6B
caaaaugaccagagauu

SEQ ID NO: 2047020 - RNA, 16 nt, Human herpesvirus 6B
cauuucuccacacugu

SEQ ID NO: 2047021 - RNA, 22 nt, Human herpesvirus 6B
auacuacguguaauguuuccuu

SEQ ID NO: 2047022 - RNA, 18 nt, Human herpesvirus 6B
uucagacucgacguguau

SEQ ID NO: 2047023 - RNA, 15 nt, Human herpesvirus 6B
cggaagugcaugcga

SEQ ID NO: 2047024 - RNA, 13 nt, Human herpesvirus 6B
cacacgacaaaua

SEQ ID NO: 2047025 - RNA, 20 nt, Human herpesvirus 6B
gggacuccgagccggacagg

SEQ ID NO: 2047026 - RNA, 19 nt, Human herpesvirus 6B
aguaugggcacaaagugcu

SEQ ID NO: 2047027 - RNA, 18 nt, Human herpesvirus 6B
aaccaucuauuugcaaga

SEQ ID NO: 2047028 - RNA, 11 nt, Human herpesvirus 6B
uuacaaguaug

SEQ ID NO: 2047029 - RNA, 14 nt, Human herpesvirus 6B
cacugaaucagaaa

SEQ ID NO: 2047030 - RNA, 11 nt, Human herpesvirus 6B
uaacauauucg

SEQ ID NO: 2047031 - RNA, 23 nt, Human herpesvirus 6B
auaugcuuuuuuuuguggauggu

SEQ ID NO: 2047032 - RNA, 23 nt, Human herpesvirus 6B
aguauuuaugcuucauaauguau

SEQ ID NO: 2047033 - RNA, 16 nt, Human herpesvirus 6B
cgacccaacagaagcc

SEQ ID NO: 2047034 - RNA, 18 nt, Human herpesvirus 6B
gcgaggggacggacagag

SEQ ID NO: 2047035 - RNA, 15 nt, Human herpesvirus 6B
auucugauaaacucc

SEQ ID NO: 2047036 - RNA, 17 nt, Human herpesvirus 6B
gauaacggcgcagaauu

SEQ ID NO: 2047037 - RNA, 16 nt, Human herpesvirus 6B
cagcuuuauucccaug

SEQ ID NO: 2047038 - RNA, 16 nt, Human herpesvirus 6B
cugccgcaucgcaccg

SEQ ID NO: 2047039 - RNA, 17 nt, Human herpesvirus 6B
uuacaugaaaacauuca

SEQ ID NO: 2047040 - RNA, 20 nt, Human herpesvirus 6B
ucggaugguauaauguaaaa

SEQ ID NO: 2047041 - RNA, 15 nt, Human herpesvirus 6B
gaaucccuugucugg

SEQ ID NO: 2047042 - RNA, 19 nt, Human herpesvirus 6B
cgaaaacuagaugacuauu

SEQ ID NO: 2047043 - RNA, 23 nt, Human herpesvirus 6B
agccguuucguucccucucaaac

SEQ ID NO: 2047044 - RNA, 21 nt, Human herpesvirus 6B
cuugcaaacagcuuuauuccc

SEQ ID NO: 2047045 - RNA, 18 nt, Human herpesvirus 6B
cguuacaagcaugcauug

SEQ ID NO: 2047046 - RNA, 19 nt, Human herpesvirus 6B
uccuuaaaugacacagaau

SEQ ID NO: 2047047 - RNA, 20 nt, Human herpesvirus 6B
uucguccggggugaaaucua

SEQ ID NO: 2047048 - RNA, 18 nt, Human herpesvirus 6B
aauuuaugugaauucugu

SEQ ID NO: 2047049 - RNA, 16 nt, Human herpesvirus 6B
cacgggccacgagagc

SEQ ID NO: 2047050 - RNA, 16 nt, Human herpesvirus 6B
aauaauagguuauuua

SEQ ID NO: 2047051 - RNA, 20 nt, Human herpesvirus 6B
uugugaacaaguuauuuaaa

SEQ ID NO: 2047052 - RNA, 19 nt, Human herpesvirus 6B
uuguuaucuuauguauaua

SEQ ID NO: 2047053 - RNA, 23 nt, Human herpesvirus 6B
ucccgcucgggggacggagagga

SEQ ID NO: 2047054 - RNA, 16 nt, Human herpesvirus 6B
aaacauagaaucucca

SEQ ID NO: 2047055 - RNA, 14 nt, Human herpesvirus 6B
caugacgaagggag

SEQ ID NO: 2047056 - RNA, 17 nt, Human herpesvirus 6B
gaugagaacuucaaaau

SEQ ID NO: 2047057 - RNA, 20 nt, Human herpesvirus 6B
uccgccuccucuuuuccccc

SEQ ID NO: 2047058 - RNA, 19 nt, Human herpesvirus 6B
uauauuuucguugaagaau

SEQ ID NO: 2047059 - RNA, 17 nt, Human herpesvirus 6B
cgcagauuuacgacacg

SEQ ID NO: 2047060 - RNA, 17 nt, Human herpesvirus 6B
gaguuuagcauggguga

SEQ ID NO: 2047061 - RNA, 13 nt, Human herpesvirus 6B
gaucacucagauu

SEQ ID NO: 2047062 - RNA, 11 nt, Human herpesvirus 6B
aacaauuuccc

SEQ ID NO: 2047063 - RNA, 22 nt, Human herpesvirus 6B
cuuuacauaacauagaaaaaua

SEQ ID NO: 2047064 - RNA, 14 nt, Human herpesvirus 6B
aaugacacagaauc

SEQ ID NO: 2047065 - RNA, 18 nt, Human herpesvirus 6B
cgcuaucggcggacgacg

SEQ ID NO: 2047066 - RNA, 21 nt, Human herpesvirus 6B
ugcgaauuaaaacucuaaaag

SEQ ID NO: 2047067 - RNA, 22 nt, Human herpesvirus 6B
cugaaaaguuagaguuggauuu

SEQ ID NO: 2047068 - RNA, 22 nt, Human herpesvirus 6B
agggcauagaaagcggccaggc

SEQ ID NO: 2047069 - RNA, 13 nt, Human herpesvirus 6B
cuguccgugagac

SEQ ID NO: 2047070 - RNA, 22 nt, Human herpesvirus 6B
agggauucguaguuuaugaaau

SEQ ID NO: 2047071 - RNA, 13 nt, Human herpesvirus 6B
uugagaaaacaug

SEQ ID NO: 2047072 - RNA, 19 nt, Human herpesvirus 6B
agcgcaucugccgaaagcu

SEQ ID NO: 2047073 - RNA, 15 nt, Human herpesvirus 6B
uuagaucuucuucag

SEQ ID NO: 2047074 - RNA, 21 nt, Human herpesvirus 6B
gugaggugauuugaacagaga

SEQ ID NO: 2047075 - RNA, 15 nt, Human herpesvirus 6B
gauccgucaggacca

SEQ ID NO: 2047076 - RNA, 16 nt, Human herpesvirus 6B
agugaguuuuggaaau

SEQ ID NO: 2047077 - RNA, 12 nt, Human herpesvirus 6B
cuuauaaaugug

SEQ ID NO: 2047078 - RNA, 13 nt, Human herpesvirus 6B
cuaggaaaacuac

SEQ ID NO: 2047079 - RNA, 11 nt, Human herpesvirus 6B
cagcaugucau

SEQ ID NO: 2047080 - RNA, 16 nt, Human herpesvirus 6B
cauagaguuucgagaa

SEQ ID NO: 2047081 - RNA, 23 nt, Human herpesvirus 6B
aauucucugcaugucuuuagaug

SEQ ID NO: 2047082 - RNA, 19 nt, Human herpesvirus 6B
caauuggcgauuuggguua

SEQ ID NO: 2047083 - RNA, 20 nt, Human herpesvirus 6B
ccgcgcugcuggggcucugu

SEQ ID NO: 2047084 - RNA, 12 nt, Human herpesvirus 6B
uuuaugcuucau

SEQ ID NO: 2047085 - RNA, 15 nt, Human herpesvirus 6B
ucaaacacucaugag

SEQ ID NO: 2047086 - RNA, 15 nt, Human herpesvirus 6B
acauuagagaaauuu

SEQ ID NO: 2047087 - RNA, 15 nt, Human herpesvirus 6B
guugaagucuuuccu

SEQ ID NO: 2047088 - RNA, 18 nt, Human herpesvirus 6B
uguuuuuuucaagaaugg

SEQ ID NO: 2047089 - RNA, 19 nt, Human herpesvirus 6B
guuuguggacaaugauacu

SEQ ID NO: 2047090 - RNA, 23 nt, Human herpesvirus 6B
agaacuaggcaaaguauucuucu

SEQ ID NO: 2047091 - RNA, 18 nt, Human herpesvirus 6B
cuugcgauuguucugcga

SEQ ID NO: 2047092 - RNA, 20 nt, Human herpesvirus 6B
ucuuaaucagauaucugaaa

SEQ ID NO: 2047093 - RNA, 11 nt, Human herpesvirus 6B
cgccucucccg

SEQ ID NO: 2047094 - RNA, 12 nt, Human herpesvirus 6B
uguagcagcugg

SEQ ID NO: 2047095 - RNA, 23 nt, Human herpesvirus 6B
uauucgccggacgaauugaguag

SEQ ID NO: 2047096 - RNA, 18 nt, Human herpesvirus 6B
aacauucggcggcauuua

SEQ ID NO: 2047097 - RNA, 22 nt, Human herpesvirus 6B
cuuauguaguguggaauuuaaa

SEQ ID NO: 2047098 - RNA, 11 nt, Human herpesvirus 6B
aaguugucauu

SEQ ID NO: 2047099 - RNA, 22 nt, Human herpesvirus 6B
acugcuccagucauaggcacuu

SEQ ID NO: 2047100 - RNA, 17 nt, Human herpesvirus 6B
agacugcugcuguggag

SEQ ID NO: 2047101 - RNA, 16 nt, Human herpesvirus 6B
ccgggcgcggggcgca

SEQ ID NO: 2047102 - RNA, 16 nt, Human herpesvirus 6B
acccuagacacacaga

SEQ ID NO: 2047103 - RNA, 15 nt, Human herpesvirus 6B
auuuacuguuuugac

SEQ ID NO: 2047104 - RNA, 15 nt, Human herpesvirus 6B
ggagucuggccucug

SEQ ID NO: 2047105 - RNA, 18 nt, Human herpesvirus 6B
auaccuaguacaaagaua

SEQ ID NO: 2047106 - RNA, 15 nt, Human herpesvirus 6B
gaugucgggccacau

SEQ ID NO: 2047107 - RNA, 22 nt, Human herpesvirus 6B
acuaaaauuacgucuuuuaugc

SEQ ID NO: 2047108 - RNA, 14 nt, Human herpesvirus 6B
acggagaguuuaua

SEQ ID NO: 2047109 - RNA, 23 nt, Human herpesvirus 6B
ccgcagaggcggcgaccacagcg

SEQ ID NO: 2047110 - RNA, 16 nt, Human herpesvirus 6B
ccgucucagugucacu

SEQ ID NO: 2047111 - RNA, 21 nt, Human herpesvirus 6B
ucauuuaugcagcucgggaaa

SEQ ID NO: 2047112 - RNA, 12 nt, Human herpesvirus 6B
uaguaaggaaga

SEQ ID NO: 2047113 - RNA, 16 nt, Human herpesvirus 6B
acacucauuugcaauu

SEQ ID NO: 2047114 - RNA, 15 nt, Human herpesvirus 6B
aaaauaagacuuagc

SEQ ID NO: 2047115 - RNA, 17 nt, Human herpesvirus 6B
gaauagagauaaaugua

SEQ ID NO: 2047116 - RNA, 23 nt, Human herpesvirus 6B
uauuaaaaugugaugaaacggaa

SEQ ID NO: 2047117 - RNA, 14 nt, Human herpesvirus 6B
ucuagaaugccagg

SEQ ID NO: 2047118 - RNA, 13 nt, Human herpesvirus 6B
gaccagcucuguu

SEQ ID NO: 2047119 - RNA, 14 nt, Human herpesvirus 6B
ggcgcugggcuccu

SEQ ID NO: 2047120 - RNA, 19 nt, Human herpesvirus 6B
ucaugauaaauuguuuccg

SEQ ID NO: 2047121 - RNA, 15 nt, Human herpesvirus 6B
cgacgggcagggcgg

SEQ ID NO: 2047122 - RNA, 15 nt, Human herpesvirus 6B
ugucuggcuguaucu

SEQ ID NO: 2047123 - RNA, 23 nt, Human herpesvirus 6B
ccauugaauacacguguggcagc

SEQ ID NO: 2047124 - RNA, 19 nt, Human herpesvirus 6B
gacgucaguggacaaauaa

SEQ ID NO: 2047125 - RNA, 14 nt, Human herpesvirus 6B
cucccgcagcuccu

SEQ ID NO: 2047126 - RNA, 13 nt, Human herpesvirus 6B
cccaggcgcagca

SEQ ID NO: 2047127 - RNA, 14 nt, Human herpesvirus 6B
ccgggcgacgagag

SEQ ID NO: 2047128 - RNA, 16 nt, Human herpesvirus 6B
ccaucaacacaccugc

SEQ ID NO: 2047129 - RNA, 15 nt, Human herpesvirus 6B
ggugauuugaacaga

SEQ ID NO: 2047130 - RNA, 20 nt, Human herpesvirus 6B
ucuccaaaagcgccugccua

SEQ ID NO: 2047131 - RNA, 15 nt, Human herpesvirus 6B
ugcccucccgcagcu

SEQ ID NO: 2047132 - RNA, 22 nt, Human herpesvirus 6B
agguucuauucguucagaaugu

SEQ ID NO: 2047133 - RNA, 17 nt, Human herpesvirus 6B
cuauguuaacauuguga

SEQ ID NO: 2047134 - RNA, 23 nt, Human herpesvirus 6B
cacggcgccucccauagaggcgc

SEQ ID NO: 2047135 - RNA, 17 nt, Human herpesvirus 6B
acauuuggcagcgcuug

SEQ ID NO: 2047136 - RNA, 15 nt, Human herpesvirus 6B
ucugagacagucaau

SEQ ID NO: 2047137 - RNA, 12 nt, Human herpesvirus 6B
gcgcagaaggag

SEQ ID NO: 2047138 - RNA, 16 nt, Human herpesvirus 6B
acagaaaaaacaccag

SEQ ID NO: 2047139 - RNA, 14 nt, Human herpesvirus 6B
gcuccguucccuuc

SEQ ID NO: 2047140 - RNA, 21 nt, Human herpesvirus 6B
aauccaaaguaggcacacaug

SEQ ID NO: 2047141 - RNA, 23 nt, Human herpesvirus 6B
ugaacauguuuuugauguuuuca

SEQ ID NO: 2047142 - RNA, 14 nt, Human herpesvirus 6B
accucgcucuccug

SEQ ID NO: 2047143 - RNA, 18 nt, Human herpesvirus 6B
uaaaaccugcuaacggag

SEQ ID NO: 2047144 - RNA, 20 nt, Human herpesvirus 6B
ucaagaaaccuguuuuugcu

SEQ ID NO: 2047145 - RNA, 18 nt, Human herpesvirus 6B
ccuccaucccccuccccg

SEQ ID NO: 2047146 - RNA, 20 nt, Human herpesvirus 6B
guaauuauugugacaaggua

SEQ ID NO: 2047147 - RNA, 12 nt, Human herpesvirus 6B
uuuugaaaaggu

SEQ ID NO: 2047148 - RNA, 16 nt, Human herpesvirus 6B
gaggacggugagaaga

SEQ ID NO: 2047149 - RNA, 15 nt, Human herpesvirus 6B
cauguuaacaauaaa

SEQ ID NO: 2047150 - RNA, 20 nt, Human herpesvirus 6B
cauaagcucuacacagagug

SEQ ID NO: 2047151 - RNA, 16 nt, Human herpesvirus 6B
ggaggaggaggagagg

SEQ ID NO: 2047152 - RNA, 20 nt, Human herpesvirus 6B
ccuaugaaaguguauuugga

SEQ ID NO: 2047153 - RNA, 13 nt, Human herpesvirus 6B
agugcuucugcuc

SEQ ID NO: 2047154 - RNA, 20 nt, Human herpesvirus 6B
ugcaaugucuucgagauuuu

SEQ ID NO: 2047155 - RNA, 22 nt, Human herpesvirus 6B
aagcuauguaugaacaggugcu

SEQ ID NO: 2047156 - RNA, 18 nt, Human herpesvirus 6B
uucuagaugcauuguuga

SEQ ID NO: 2047157 - RNA, 20 nt, Human herpesvirus 6B
auguaaacauagaaucucca

SEQ ID NO: 2047158 - RNA, 20 nt, Human herpesvirus 6B
caggguguaugcggccaguc

SEQ ID NO: 2047159 - RNA, 14 nt, Human herpesvirus 6B
gcccuccuggguac

SEQ ID NO: 2047160 - RNA, 16 nt, Human herpesvirus 6B
aaacagcgacaugaaa

SEQ ID NO: 2047161 - RNA, 14 nt, Human herpesvirus 6B
cgccauggguguca

SEQ ID NO: 2047162 - RNA, 15 nt, Human herpesvirus 6B
gaccgaauuauguau

SEQ ID NO: 2047163 - RNA, 21 nt, Human herpesvirus 6B
aauuuuuuguuucugaaaaua

SEQ ID NO: 2047164 - RNA, 22 nt, Human herpesvirus 6B
uguaucaaaguguauacauuca

SEQ ID NO: 2047165 - RNA, 16 nt, Human herpesvirus 6B
gaauauuuaguuuaug

SEQ ID NO: 2047166 - RNA, 12 nt, Human herpesvirus 6B
caacggagaaaa

SEQ ID NO: 2047167 - RNA, 14 nt, Human herpesvirus 6B
accuggcgcaccgc

SEQ ID NO: 2047168 - RNA, 22 nt, Human herpesvirus 6B
caccugccuagaauucucuccc

SEQ ID NO: 2047169 - RNA, 20 nt, Human herpesvirus 6B
aauaauuuuauugacuguga

SEQ ID NO: 2047170 - RNA, 12 nt, Human herpesvirus 6B
gugagugcuauu

SEQ ID NO: 2047171 - RNA, 22 nt, Human herpesvirus 6B
gacggcgaggggacggacagag

SEQ ID NO: 2047172 - RNA, 13 nt, Human herpesvirus 6B
agugcuuuauccg

SEQ ID NO: 2047173 - RNA, 14 nt, Human herpesvirus 6B
agaucuaaugaaug

SEQ ID NO: 2047174 - RNA, 19 nt, Human herpesvirus 6B
acauccagaaaagcaaaca

SEQ ID NO: 2047175 - RNA, 16 nt, Human herpesvirus 6B
aaucuccaaaacacuc

SEQ ID NO: 2047176 - RNA, 13 nt, Human herpesvirus 6B
uuaggauguuugg

SEQ ID NO: 2047177 - RNA, 17 nt, Human herpesvirus 6B
aucacuuagacacggcc

SEQ ID NO: 2047178 - RNA, 11 nt, Human herpesvirus 6B
gugacaaggua

SEQ ID NO: 2047179 - RNA, 12 nt, Human herpesvirus 6B
ucuucggacgcg

SEQ ID NO: 2047180 - RNA, 13 nt, Human herpesvirus 6B
uggauaaacaucg

SEQ ID NO: 2047181 - RNA, 15 nt, Human herpesvirus 6B
cuuaaucagauaucu

SEQ ID NO: 2047182 - RNA, 21 nt, Human herpesvirus 6B
ggcgacacgcgcggaccacuc

SEQ ID NO: 2047183 - RNA, 15 nt, Human herpesvirus 6B
cuauuuugacaccuc

SEQ ID NO: 2047184 - RNA, 17 nt, Human herpesvirus 6B
augaauuucaaugacug

SEQ ID NO: 2047185 - RNA, 14 nt, Human herpesvirus 6B
aguucuucaaaaaa

SEQ ID NO: 2047186 - RNA, 13 nt, Human herpesvirus 6B
ccucuauacucug

SEQ ID NO: 2047187 - RNA, 23 nt, Human herpesvirus 6B
gcauauuauuaacaaugaaaauu

SEQ ID NO: 2047188 - RNA, 19 nt, Human herpesvirus 6B
uucuccgucaccccccucg

SEQ ID NO: 2047189 - RNA, 19 nt, Human herpesvirus 6B
auuaaacuaacaugacaaa

SEQ ID NO: 2047190 - RNA, 16 nt, Human herpesvirus 6B
gcgauauggaaacacu

SEQ ID NO: 2047191 - RNA, 13 nt, Human herpesvirus 6B
auaaauuccucuc

SEQ ID NO: 2047192 - RNA, 13 nt, Human herpesvirus 6B
uucacuaacaaaa

SEQ ID NO: 2047193 - RNA, 18 nt, Human herpesvirus 6B
uuuuauuuuguggcuauu

SEQ ID NO: 2047194 - RNA, 13 nt, Human herpesvirus 6B
ccaaagcuuucug

SEQ ID NO: 2047195 - RNA, 22 nt, Human herpesvirus 6B
aaacgacuaucuccuugaugau

SEQ ID NO: 2047196 - RNA, 18 nt, Human herpesvirus 6B
gggaucgacgaccaggca

SEQ ID NO: 2047197 - RNA, 15 nt, Human herpesvirus 6B
cgaauaagccuuugc

SEQ ID NO: 2047198 - RNA, 14 nt, Human herpesvirus 6B
gcaaagggaagcca

SEQ ID NO: 2047199 - RNA, 21 nt, Human herpesvirus 6B
gcaagaaagcguguucaaaaa

SEQ ID NO: 2047200 - RNA, 17 nt, Human herpesvirus 6B
cuaccgcccugcuccgu

SEQ ID NO: 2047201 - RNA, 20 nt, Human herpesvirus 6B
uauaucaaacuuuuuuugaa

SEQ ID NO: 2047202 - RNA, 18 nt, Human herpesvirus 6B
agauguguuaaagaaugc

SEQ ID NO: 2047203 - RNA, 12 nt, Human herpesvirus 6B
cuggggacagac

SEQ ID NO: 2047204 - RNA, 11 nt, Human herpesvirus 6B
cgauaucucac

SEQ ID NO: 2047205 - RNA, 16 nt, Human herpesvirus 6B
cgauucccuccgggac

SEQ ID NO: 2047206 - RNA, 17 nt, Human herpesvirus 6B
aaugacuaucaaaauaa

SEQ ID NO: 2047207 - RNA, 14 nt, Human herpesvirus 6B
augccacagguaca

SEQ ID NO: 2047208 - RNA, 22 nt, Human herpesvirus 6B
agucuggccucugcggcucucu

SEQ ID NO: 2047209 - RNA, 13 nt, Human herpesvirus 6B
ccuauucaaaagu

SEQ ID NO: 2047210 - RNA, 18 nt, Human herpesvirus 6B
gaauuauuuccucugaau

SEQ ID NO: 2047211 - RNA, 19 nt, Human herpesvirus 6B
guacaaagguuuuugcugu

SEQ ID NO: 2047212 - RNA, 13 nt, Human herpesvirus 6B
acauguuaacaau

SEQ ID NO: 2047213 - RNA, 19 nt, Human herpesvirus 6B
uucaauagcaguugucugc

SEQ ID NO: 2047214 - RNA, 19 nt, Human herpesvirus 6B
uuacuguccgcuucccagc

SEQ ID NO: 2047215 - RNA, 17 nt, Human herpesvirus 6B
uucucgaccacgguuaa

SEQ ID NO: 2047216 - RNA, 19 nt, Human herpesvirus 6B
cagcuaagauuaacaacug

SEQ ID NO: 2047217 - RNA, 12 nt, Human herpesvirus 6B
acgggcagggcg

SEQ ID NO: 2047218 - RNA, 17 nt, Human herpesvirus 6B
gcuugguguaccagaca

SEQ ID NO: 2047219 - RNA, 23 nt, Human herpesvirus 6B
cggcgaagggacacgagaagaac

SEQ ID NO: 2047220 - RNA, 16 nt, Human herpesvirus 6B
ccguacgcgccacagc

SEQ ID NO: 2047221 - RNA, 11 nt, Human herpesvirus 6B
ggagcacgagc

SEQ ID NO: 2047222 - RNA, 20 nt, Human herpesvirus 6B
ucucgguuuauacuugaaga

SEQ ID NO: 2047223 - RNA, 16 nt, Human herpesvirus 6B
caagggaaauccuaua

SEQ ID NO: 2047224 - RNA, 23 nt, Human herpesvirus 6B
uugucgcugacgcaauacguaaa

SEQ ID NO: 2047225 - RNA, 14 nt, Human herpesvirus 6B
ugaauucugcucgu

SEQ ID NO: 2047226 - RNA, 19 nt, Human herpesvirus 6B
gcguugcccucccgcagcu

SEQ ID NO: 2047227 - RNA, 16 nt, Human herpesvirus 6B
caguugcauggugaug

SEQ ID NO: 2047228 - RNA, 16 nt, Human herpesvirus 6B
ccuguuucuacugcug

SEQ ID NO: 2047229 - RNA, 19 nt, Human herpesvirus 6B
aguucaaaauuuuucugua

SEQ ID NO: 2047230 - RNA, 22 nt, Human herpesvirus 6B
uauggugccgagcaaaccugaa

SEQ ID NO: 2047231 - RNA, 20 nt, Human herpesvirus 6B
agagaaguggaacugcuugg

SEQ ID NO: 2047232 - RNA, 18 nt, Human herpesvirus 6B
guccucguccguccccgc

SEQ ID NO: 2047233 - RNA, 19 nt, Human herpesvirus 6B
cugagaccgagagaauaga

SEQ ID NO: 2047234 - RNA, 18 nt, Human herpesvirus 6B
gaacuguuuccagagcac

SEQ ID NO: 2047235 - RNA, 20 nt, Human herpesvirus 6B
cggagcccugagagcaggag

SEQ ID NO: 2047236 - RNA, 11 nt, Human herpesvirus 6B
auaagaaugcu

SEQ ID NO: 2047237 - RNA, 17 nt, Human herpesvirus 6B
gaaagacguuugcuuuu

SEQ ID NO: 2047238 - RNA, 22 nt, Human herpesvirus 6B
ucaagcucgaguucgagaagau

SEQ ID NO: 2047239 - RNA, 19 nt, Human herpesvirus 6B
uucaaaauuuuucuguaag

SEQ ID NO: 2047240 - RNA, 10 nt, Human herpesvirus 6B
ccuguuucua

SEQ ID NO: 2047241 - RNA, 19 nt, Human herpesvirus 6B
acuuucuaagacgagaugu

SEQ ID NO: 2047242 - RNA, 11 nt, Human herpesvirus 6B
caacaauaaua

SEQ ID NO: 2047243 - RNA, 19 nt, Human herpesvirus 6B
uguuuucccaccuaauaaa

SEQ ID NO: 2047244 - RNA, 20 nt, Human herpesvirus 6B
ugacuguaccauugucaaca

SEQ ID NO: 2047245 - RNA, 16 nt, Human herpesvirus 6B
cuaugcaaugucuucg

SEQ ID NO: 2047246 - RNA, 15 nt, Human herpesvirus 6B
ugguaauaaacagac

SEQ ID NO: 2047247 - RNA, 22 nt, Human herpesvirus 6B
cuaaaaauauugguauugauuu

SEQ ID NO: 2047248 - RNA, 23 nt, Human herpesvirus 6B
uggauauguauccagucuauucu

SEQ ID NO: 2047249 - RNA, 20 nt, Human herpesvirus 6B
uaacgauauugauccagaau

SEQ ID NO: 2047250 - RNA, 20 nt, Human herpesvirus 6B
gaugacaaggugaacucauc

SEQ ID NO: 2047251 - RNA, 13 nt, Human herpesvirus 6B
cacgcgcggacca

SEQ ID NO: 2047252 - RNA, 13 nt, Human herpesvirus 6B
ucgcaaaagagaa

SEQ ID NO: 2047253 - RNA, 12 nt, Human herpesvirus 6B
acuaauguggau

SEQ ID NO: 2047254 - RNA, 12 nt, Human herpesvirus 6B
aauacagcugca

SEQ ID NO: 2047255 - RNA, 21 nt, Human herpesvirus 6B
cacggagaauaccgacaagcc

SEQ ID NO: 2047256 - RNA, 21 nt, Human herpesvirus 6B
uacuuuuuucaauaaugcuca

SEQ ID NO: 2047257 - RNA, 17 nt, Human herpesvirus 6B
auaaaguuaaagaucag

SEQ ID NO: 2047258 - RNA, 21 nt, Human herpesvirus 6B
uuguuuucuguaggcaacuua

SEQ ID NO: 2047259 - RNA, 17 nt, Human herpesvirus 6B
gaaccugugaacaaauu

SEQ ID NO: 2047260 - RNA, 23 nt, Human herpesvirus 6B
cuccugagaggcuggaaaaauuu

SEQ ID NO: 2047261 - RNA, 21 nt, Human herpesvirus 6B
aaauguuuccaugacugugag

SEQ ID NO: 2047262 - RNA, 22 nt, Human herpesvirus 6B
cgcagggaaagagcacgaagaa

SEQ ID NO: 2047263 - RNA, 19 nt, Human herpesvirus 6B
gaaaagccccugcuugaaa

SEQ ID NO: 2047264 - RNA, 17 nt, Human herpesvirus 6B
uaauccauauuuggaag

SEQ ID NO: 2047265 - RNA, 16 nt, Human herpesvirus 6B
agaggcgcgggacagc

SEQ ID NO: 2047266 - RNA, 13 nt, Human herpesvirus 6B
uuuauaugcauuu

SEQ ID NO: 2047267 - RNA, 17 nt, Human herpesvirus 6B
guuguucuuugaugaag

SEQ ID NO: 2047268 - RNA, 21 nt, Human herpesvirus 6B
gaaaauuguuuuugauaugau

SEQ ID NO: 2047269 - RNA, 12 nt, Human herpesvirus 6B
gauguuuccagg

SEQ ID NO: 2047270 - RNA, 15 nt, Human herpesvirus 6B
cuuuuuuucccgaaa

SEQ ID NO: 2047271 - RNA, 23 nt, Human herpesvirus 6B
acaacugccgccauauuaaaacc

SEQ ID NO: 2047272 - RNA, 14 nt, Human herpesvirus 6B
cuggacagaaaguc

SEQ ID NO: 2047273 - RNA, 13 nt, Human herpesvirus 6B
cauuuuauacgaa

SEQ ID NO: 2047274 - RNA, 14 nt, Human herpesvirus 6B
uucagcaguaucaa

SEQ ID NO: 2047275 - RNA, 17 nt, Human herpesvirus 6B
ucuugcacggaaucucu

SEQ ID NO: 2047276 - RNA, 21 nt, Human herpesvirus 6B
aagauugcgucuuuuguaaag

SEQ ID NO: 2047277 - RNA, 15 nt, Human herpesvirus 6B
acgcggcaaccgcag

SEQ ID NO: 2047278 - RNA, 15 nt, Human herpesvirus 6B
caguauagacauuuu

SEQ ID NO: 2047279 - RNA, 16 nt, Human herpesvirus 6B
uuuugaagguaucaaa

SEQ ID NO: 2047280 - RNA, 18 nt, Human herpesvirus 6B
gacaucuuaaauuucuau

SEQ ID NO: 2047281 - RNA, 16 nt, Human herpesvirus 6B
cacccccauacacacc

SEQ ID NO: 2047282 - RNA, 14 nt, Human herpesvirus 6B
auaaauguagcaca

SEQ ID NO: 2047283 - RNA, 13 nt, Human herpesvirus 6B
auugacugugaaa

SEQ ID NO: 2047284 - RNA, 17 nt, Human herpesvirus 6B
uaaugguaugccugagc

SEQ ID NO: 2047285 - RNA, 14 nt, Human herpesvirus 6B
agacguuguuugac

SEQ ID NO: 2047286 - RNA, 14 nt, Human herpesvirus 6B
cagaaaaagaacug

SEQ ID NO: 2047287 - RNA, 16 nt, Human herpesvirus 6B
uacaucguuuguugaa

SEQ ID NO: 2047288 - RNA, 14 nt, Human herpesvirus 6B
uaaacagauuuuga

SEQ ID NO: 2047289 - RNA, 23 nt, Human herpesvirus 6B
cacaaugucgcagaaucaagaaa

SEQ ID NO: 2047290 - RNA, 20 nt, Human herpesvirus 6B
ggcaacuccccauucaacau

SEQ ID NO: 2047291 - RNA, 15 nt, Human herpesvirus 6B
aaauguggucaugga

SEQ ID NO: 2047292 - RNA, 19 nt, Human herpesvirus 6B
ucaugccgccgaagaaaga

SEQ ID NO: 2047293 - RNA, 12 nt, Human herpesvirus 6B
gaaagagggaag

SEQ ID NO: 2047294 - RNA, 16 nt, Human herpesvirus 6B
gaaaggcggagacaca

SEQ ID NO: 2047295 - RNA, 18 nt, Human herpesvirus 6B
agggacgcuugcuguaaa

SEQ ID NO: 2047296 - RNA, 19 nt, Human herpesvirus 6B
uguuuauugcuuuuguuau

SEQ ID NO: 2047297 - RNA, 22 nt, Human herpesvirus 6B
acuucuucugcagaucuggaua

SEQ ID NO: 2047298 - RNA, 12 nt, Human herpesvirus 6B
cugucacacucu

SEQ ID NO: 2047299 - RNA, 15 nt, Human herpesvirus 6B
cgucauuccagucca

SEQ ID NO: 2047300 - RNA, 13 nt, Human herpesvirus 6B
uauaaaucauaaa

SEQ ID NO: 2047301 - RNA, 15 nt, Human herpesvirus 6B
cagguuucuccgcac

SEQ ID NO: 2047302 - RNA, 16 nt, Human herpesvirus 6B
auauuauuaacaauga

SEQ ID NO: 2047303 - RNA, 16 nt, Human herpesvirus 6B
gggcgacgggcagggc

SEQ ID NO: 2047304 - RNA, 18 nt, Human herpesvirus 6B
ccuaaauaccauuuuaua

SEQ ID NO: 2047305 - RNA, 22 nt, Human herpesvirus 6B
uuuuaaaagugcaacaaagagc

SEQ ID NO: 2047306 - RNA, 14 nt, Human herpesvirus 6B
cugcuuuguuuucu

SEQ ID NO: 2047307 - RNA, 16 nt, Human herpesvirus 6B
agauuaaauucagaua

SEQ ID NO: 2047308 - RNA, 13 nt, Human herpesvirus 6B
cacaacacaucua

SEQ ID NO: 2047309 - RNA, 15 nt, Human herpesvirus 6B
ugacauuagagaaau

SEQ ID NO: 2047310 - RNA, 22 nt, Human herpesvirus 6B
cauguuuuuacuugauaaacug

SEQ ID NO: 2047311 - RNA, 17 nt, Human herpesvirus 6B
uagcuagacgugucuuc

SEQ ID NO: 2047312 - RNA, 14 nt, Human herpesvirus 6B
ugauauagaacaau

SEQ ID NO: 2047313 - RNA, 11 nt, Human herpesvirus 6B
uuuucugcaaa

SEQ ID NO: 2047314 - RNA, 13 nt, Human herpesvirus 6B
gccauccacccau

SEQ ID NO: 2047315 - RNA, 17 nt, Human herpesvirus 6B
cccaacagaagccacca

SEQ ID NO: 2047316 - RNA, 16 nt, Human herpesvirus 6B
agaucuugaaaagccc

SEQ ID NO: 2047317 - RNA, 18 nt, Human herpesvirus 6B
gcugguccuucgacauag

SEQ ID NO: 2047318 - RNA, 20 nt, Human herpesvirus 6B
gaauaaaacaaguuaaauuu

SEQ ID NO: 2047319 - RNA, 20 nt, Human herpesvirus 6B
uuuagaugucgggccacauu

SEQ ID NO: 2047320 - RNA, 14 nt, Human herpesvirus 6B
uugaugcuguugcu

SEQ ID NO: 2047321 - RNA, 13 nt, Human herpesvirus 6B
augguauggaaaa

SEQ ID NO: 2047322 - RNA, 14 nt, Human herpesvirus 6B
caacauguauucuc

SEQ ID NO: 2047323 - RNA, 24 nt, Human herpesvirus 6B
guguuaaucggaauguugguaaac

SEQ ID NO: 2047324 - RNA, 14 nt, Human herpesvirus 6B
acgacucaguagaa

SEQ ID NO: 2047325 - RNA, 17 nt, Human herpesvirus 6B
gcgaaucgcuuaaagaa

SEQ ID NO: 2047326 - RNA, 21 nt, Human herpesvirus 6B
aguaacggaaaaauuuuacaa

SEQ ID NO: 2047327 - RNA, 12 nt, Human herpesvirus 6B
aaggcggacagc

SEQ ID NO: 2047328 - RNA, 15 nt, Human herpesvirus 6B
cugagaccgagagaa

SEQ ID NO: 2047329 - RNA, 13 nt, Human herpesvirus 6B
uguuuugcuacgu

SEQ ID NO: 2047330 - RNA, 23 nt, Human herpesvirus 6B
ugagcaugacacaucgugaguuu

SEQ ID NO: 2047331 - RNA, 21 nt, Human herpesvirus 6B
agauucuccgucucaguguca

SEQ ID NO: 2047332 - RNA, 14 nt, Human herpesvirus 6B
cagaagagccaaca

SEQ ID NO: 2047333 - RNA, 15 nt, Human herpesvirus 6B
aaucaagaaacacuu

SEQ ID NO: 2047334 - RNA, 13 nt, Human herpesvirus 6B
gauuuagugcagu

SEQ ID NO: 2047335 - RNA, 15 nt, Human herpesvirus 6B
ugauguugcgauaua

SEQ ID NO: 2047336 - RNA, 14 nt, Human herpesvirus 6B
auccgcgggccagc

SEQ ID NO: 2047337 - RNA, 23 nt, Human herpesvirus 6B
gaaacacuuucuucgccuguaaa

SEQ ID NO: 2047338 - RNA, 14 nt, Human herpesvirus 6B
gcucucgaugaaag

SEQ ID NO: 2047339 - RNA, 18 nt, Human herpesvirus 6B
cuuccgcggcgcugggcu

SEQ ID NO: 2047340 - RNA, 23 nt, Human herpesvirus 6B
uccgcaaguuuucagcaagagag

SEQ ID NO: 2047341 - RNA, 12 nt, Human herpesvirus 6B
ucucucccuacg

SEQ ID NO: 2047342 - RNA, 17 nt, Human herpesvirus 6B
gaggacggugagaagau

SEQ ID NO: 2047343 - RNA, 22 nt, Human herpesvirus 6B
cgcgguggacggcgaggggacg

SEQ ID NO: 2047344 - RNA, 19 nt, Human herpesvirus 6B
agaaauguugccuuuguaa

SEQ ID NO: 2047345 - RNA, 13 nt, Human herpesvirus 6B
ccuagacacacag

SEQ ID NO: 2047346 - RNA, 13 nt, Human herpesvirus 6B
aucuacaaaauag

SEQ ID NO: 2047347 - RNA, 18 nt, Human herpesvirus 6B
caaaagccugcauaugau

SEQ ID NO: 2047348 - RNA, 18 nt, Human herpesvirus 6B
caggcuagcaugguguga

SEQ ID NO: 2047349 - RNA, 12 nt, Human herpesvirus 6B
auggugaaaaua

SEQ ID NO: 2047350 - RNA, 16 nt, Human herpesvirus 6B
uguauuguguaccuug

SEQ ID NO: 2047351 - RNA, 17 nt, Human herpesvirus 6B
aaucucaagaaacaagu

SEQ ID NO: 2047352 - RNA, 18 nt, Human herpesvirus 6B
aucuuccuguacagaauu

SEQ ID NO: 2047353 - RNA, 15 nt, Human herpesvirus 6B
cgagccggacaggag

SEQ ID NO: 2047354 - RNA, 14 nt, Human herpesvirus 6B
cgccgccuucucug

SEQ ID NO: 2047355 - RNA, 17 nt, Human herpesvirus 6B
gcgcguugggggauggg

SEQ ID NO: 2047356 - RNA, 22 nt, Human herpesvirus 6B
ugcugcuucuguaaccugucuu

SEQ ID NO: 2047357 - RNA, 14 nt, Human herpesvirus 6B
gcgcugcuggggcu

SEQ ID NO: 2047358 - RNA, 19 nt, Human herpesvirus 6B
auacaaaauuguauugagc

SEQ ID NO: 2047359 - RNA, 20 nt, Human herpesvirus 6B
auauucacaagaagaugcuu

SEQ ID NO: 2047360 - RNA, 17 nt, Human herpesvirus 6B
cgugcucuccgcgcugc

SEQ ID NO: 2047361 - RNA, 12 nt, Human herpesvirus 6B
gacaucuguuua

SEQ ID NO: 2047362 - RNA, 16 nt, Human herpesvirus 6B
caggagaagaacagag

SEQ ID NO: 2047363 - RNA, 14 nt, Human herpesvirus 6B
uaagaauuuccagg

SEQ ID NO: 2047364 - RNA, 15 nt, Human herpesvirus 6B
auaagggacagcagu

SEQ ID NO: 2047365 - RNA, 18 nt, Human herpesvirus 6B
agucgccucacuguaaaa

SEQ ID NO: 2047366 - RNA, 19 nt, Human herpesvirus 6B
gucccaacuuguuuucugu

SEQ ID NO: 2047367 - RNA, 19 nt, Human herpesvirus 6B
gucccgguauggaucucac

SEQ ID NO: 2047368 - RNA, 19 nt, Human herpesvirus 6B
aucgaauucagcuggacag

SEQ ID NO: 2047369 - RNA, 23 nt, Human herpesvirus 6B
auuacagaugucuauaugucaga

SEQ ID NO: 2047370 - RNA, 17 nt, Human herpesvirus 6B
cugaucacagagaaaaa

SEQ ID NO: 2047371 - RNA, 12 nt, Human herpesvirus 6B
acgcgccacagc

SEQ ID NO: 2047372 - RNA, 21 nt, Human herpesvirus 6B
cgcccgccucucuccgccucc

SEQ ID NO: 2047373 - RNA, 22 nt, Human herpesvirus 6B
cuuugggaccuucaggaacaaa

SEQ ID NO: 2047374 - RNA, 19 nt, Human herpesvirus 6B
ugcaauuugaauucugcuc

SEQ ID NO: 2047375 - RNA, 20 nt, Human herpesvirus 6B
cgugggggcagaacugagau

SEQ ID NO: 2047376 - RNA, 21 nt, Human herpesvirus 6B
acgcgacacggugagucgcau

SEQ ID NO: 2047377 - RNA, 16 nt, Human herpesvirus 6B
guuaauggagagaaau

SEQ ID NO: 2047378 - RNA, 20 nt, Human herpesvirus 6B
gacagucaauuucuaaagau

SEQ ID NO: 2047379 - RNA, 23 nt, Human herpesvirus 6B
gucacgcggaccgacgacaaagg

SEQ ID NO: 2047380 - RNA, 18 nt, Human herpesvirus 6B
agaugcauuguugaaaug

SEQ ID NO: 2047381 - RNA, 13 nt, Human herpesvirus 6B
uucguuuucccgc

SEQ ID NO: 2047382 - RNA, 16 nt, Human herpesvirus 6B
ggacggacagagcgga

SEQ ID NO: 2047383 - RNA, 12 nt, Human herpesvirus 6B
uauggggaagau

SEQ ID NO: 2047384 - RNA, 16 nt, Human herpesvirus 6B
uagaccguucaacaag

SEQ ID NO: 2047385 - RNA, 20 nt, Human herpesvirus 6B
aacggcggcggcggcugucg

SEQ ID NO: 2047386 - RNA, 13 nt, Human herpesvirus 6B
uguguugaagaac

SEQ ID NO: 2047387 - RNA, 22 nt, Human herpesvirus 6B
acaccgugucaaaaaaaaauga

SEQ ID NO: 2047388 - RNA, 16 nt, Human herpesvirus 6B
gugaaacgauguguua

SEQ ID NO: 2047389 - RNA, 15 nt, Human herpesvirus 6B
auccaucguuuguaa

SEQ ID NO: 2047390 - RNA, 17 nt, Human herpesvirus 6B
ucgggccuggggacaga

SEQ ID NO: 2047391 - RNA, 20 nt, Human herpesvirus 6B
cauacauccagaaaagcaaa

SEQ ID NO: 2047392 - RNA, 21 nt, Human herpesvirus 6B
ucuuccggaauuuugagacuu

SEQ ID NO: 2047393 - RNA, 16 nt, Human herpesvirus 6B
caauauaugaaauacu

SEQ ID NO: 2047394 - RNA, 19 nt, Human herpesvirus 6B
ucuaauuauaaauguagca

SEQ ID NO: 2047395 - RNA, 17 nt, Human herpesvirus 6B
aaagauccaauggauuu

SEQ ID NO: 2047396 - RNA, 16 nt, Human herpesvirus 6B
cccacuccaacacggg

SEQ ID NO: 2047397 - RNA, 21 nt, Human herpesvirus 6B
cccgccucucuccgccuccuc

SEQ ID NO: 2047398 - RNA, 22 nt, Human herpesvirus 6B
gggcauagaaagcggccaggcc

SEQ ID NO: 2047399 - RNA, 12 nt, Human herpesvirus 6B
uucgauguuucc

SEQ ID NO: 2047400 - RNA, 15 nt, Human herpesvirus 6B
uuuuuugaaaucacu

SEQ ID NO: 2047401 - RNA, 19 nt, Human herpesvirus 6B
agcagcgcccgaugccaac

SEQ ID NO: 2047402 - RNA, 20 nt, Human herpesvirus 6B
cggacagagcggagaggcgc

SEQ ID NO: 2047403 - RNA, 13 nt, Human herpesvirus 6B
cagauuucuguag

SEQ ID NO: 2047404 - RNA, 17 nt, Human herpesvirus 6B
cgcugggcuccucaccc

SEQ ID NO: 2047405 - RNA, 12 nt, Human herpesvirus 6B
caguuagugcac

SEQ ID NO: 2047406 - RNA, 17 nt, Human herpesvirus 6B
ugggcaauuguuuucca

SEQ ID NO: 2047407 - RNA, 17 nt, Human herpesvirus 6B
aucaugcacacguguau

SEQ ID NO: 2047408 - RNA, 17 nt, Human herpesvirus 6B
ccaguugaacuaugcau

SEQ ID NO: 2047409 - RNA, 18 nt, Human herpesvirus 6B
uguaauaguauugucuga

SEQ ID NO: 2047410 - RNA, 19 nt, Human herpesvirus 6B
cguugcccucccgcagcuc

SEQ ID NO: 2047411 - RNA, 13 nt, Human herpesvirus 6B
guguauuaaaaug

SEQ ID NO: 2047412 - RNA, 14 nt, Human herpesvirus 6B
uuauaucaacgaug

SEQ ID NO: 2047413 - RNA, 22 nt, Human herpesvirus 6B
ucagcaagagagauacagguuu

SEQ ID NO: 2047414 - RNA, 14 nt, Human herpesvirus 6B
caugucuuacagcu

SEQ ID NO: 2047415 - RNA, 21 nt, Human herpesvirus 6B
ugaauacgacuuuggaaaguu

SEQ ID NO: 2047416 - RNA, 14 nt, Human herpesvirus 6B
gaagugaaagcagu

SEQ ID NO: 2047417 - RNA, 14 nt, Human herpesvirus 6B
guggaaauuaaaaa

SEQ ID NO: 2047418 - RNA, 21 nt, Human herpesvirus 6B
ucaggcauuaaacugaggcag

SEQ ID NO: 2047419 - RNA, 18 nt, Human herpesvirus 6B
gcggcauguguaagaaaa

SEQ ID NO: 2047420 - RNA, 19 nt, Human herpesvirus 6B
acagcuuugcagaacgaga

SEQ ID NO: 2047421 - RNA, 20 nt, Human herpesvirus 6B
aaauauuuugaaaagguguu

SEQ ID NO: 2047422 - RNA, 22 nt, Human herpesvirus 6B
gauugagucuccggaguuuauu

SEQ ID NO: 2047423 - RNA, 14 nt, Human herpesvirus 6B
gaggaugcuuugcu

SEQ ID NO: 2047424 - RNA, 17 nt, Human herpesvirus 6B
auuggaaucacaaaaug

SEQ ID NO: 2047425 - RNA, 19 nt, Human herpesvirus 6B
aguaugucucgaaaaagac

SEQ ID NO: 2047426 - RNA, 12 nt, Human herpesvirus 6B
aaggaagagaau

SEQ ID NO: 2047427 - RNA, 22 nt, Human herpesvirus 6B
ccgcggcgcugggcuccucacc

SEQ ID NO: 2047428 - RNA, 13 nt, Human herpesvirus 6B
ccgucuccugcaa

SEQ ID NO: 2047429 - RNA, 15 nt, Human herpesvirus 6B
augacugacaaggua

SEQ ID NO: 2047430 - RNA, 13 nt, Human herpesvirus 6B
ccgugacacacag

SEQ ID NO: 2047431 - RNA, 15 nt, Human herpesvirus 6B
gcaaaagagaaggaa

SEQ ID NO: 2047432 - RNA, 18 nt, Human herpesvirus 6B
aaaagauuauggcaacau

SEQ ID NO: 2047433 - RNA, 14 nt, Human herpesvirus 6B
ugcucuggaucuaa

SEQ ID NO: 2047434 - RNA, 14 nt, Human herpesvirus 6B
gacgugcggagaug

SEQ ID NO: 2047435 - RNA, 19 nt, Human herpesvirus 6B
gggaagccagccgcccucc

SEQ ID NO: 2047436 - RNA, 17 nt, Human herpesvirus 6B
cgguauuuuuagauguc

SEQ ID NO: 2047437 - RNA, 21 nt, Human herpesvirus 6B
gagcucaaagagauuggaaaa

SEQ ID NO: 2047438 - RNA, 16 nt, Human herpesvirus 6B
acaccggagaccgagc

SEQ ID NO: 2047439 - RNA, 17 nt, Human herpesvirus 6B
uuuuauugacugugaaa

SEQ ID NO: 2047440 - RNA, 23 nt, Human herpesvirus 6B
uuuucugcaaaacaaaaguagca

SEQ ID NO: 2047441 - RNA, 21 nt, Human herpesvirus 6B
acacuguuguuaaucuguuua

SEQ ID NO: 2047442 - RNA, 18 nt, Human herpesvirus 6B
uauggagaaaaacuuuua

SEQ ID NO: 2047443 - RNA, 19 nt, Human herpesvirus 6B
ucaccccccucuugcagug

SEQ ID NO: 2047444 - RNA, 14 nt, Human herpesvirus 6B
ugauacuuugaaag

SEQ ID NO: 2047445 - RNA, 16 nt, Human herpesvirus 6B
uacacacgaggucggu

SEQ ID NO: 2047446 - RNA, 21 nt, Human herpesvirus 6B
cuguuuuguaggacugaagga

SEQ ID NO: 2047447 - RNA, 19 nt, Human herpesvirus 6B
ggcuccucacccugaaggg

SEQ ID NO: 2047448 - RNA, 20 nt, Human herpesvirus 6B
caaccuaacgacuacagaag

SEQ ID NO: 2047449 - RNA, 14 nt, Human herpesvirus 6B
cucacgaauuuaaa

SEQ ID NO: 2047450 - RNA, 14 nt, Human herpesvirus 6B
gagggaaugaugaa

SEQ ID NO: 2047451 - RNA, 17 nt, Human herpesvirus 6B
gcucucccucuucccuc

SEQ ID NO: 2047452 - RNA, 16 nt, Human herpesvirus 6B
uaaaagcuauguauga

SEQ ID NO: 2047453 - RNA, 16 nt, Human herpesvirus 6B
aauacgaagacaagcc

SEQ ID NO: 2047454 - RNA, 19 nt, Human herpesvirus 6B
ugauugucuuuucuggaaa

SEQ ID NO: 2047455 - RNA, 14 nt, Human herpesvirus 6B
uauuugaaacugaa

SEQ ID NO: 2047456 - RNA, 14 nt, Human herpesvirus 6B
ugaguuaacagaua

SEQ ID NO: 2047457 - RNA, 16 nt, Human herpesvirus 6B
uaaaauugcuacuaau

SEQ ID NO: 2047458 - RNA, 13 nt, Human herpesvirus 6B
uacggcaggagca

SEQ ID NO: 2047459 - RNA, 16 nt, Human herpesvirus 6B
ugguauugauuucuau

SEQ ID NO: 2047460 - RNA, 15 nt, Human herpesvirus 6B
guuacggggaagauc

SEQ ID NO: 2047461 - RNA, 13 nt, Human herpesvirus 6B
gaaugguaugaau

SEQ ID NO: 2047462 - RNA, 17 nt, Human herpesvirus 6B
aaguuucggcaacugaa

SEQ ID NO: 2047463 - RNA, 16 nt, Human herpesvirus 6B
auccauuuucugaaau

SEQ ID NO: 2047464 - RNA, 21 nt, Human herpesvirus 6B
gaaauaccaaagaaauuuauu

SEQ ID NO: 2047465 - RNA, 20 nt, Human herpesvirus 6B
agcgaucauaaaacugccaa

SEQ ID NO: 2047466 - RNA, 12 nt, Human herpesvirus 6B
agauacagguuu

SEQ ID NO: 2047467 - RNA, 14 nt, Human herpesvirus 6B
uccacucaugccgc

SEQ ID NO: 2047468 - RNA, 18 nt, Human herpesvirus 6B
gcaaucgucuuugauuua

SEQ ID NO: 2047469 - RNA, 15 nt, Human herpesvirus 6B
cucugcccuucuucg

SEQ ID NO: 2047470 - RNA, 20 nt, Human herpesvirus 6B
cauagagcauccuguuuucc

SEQ ID NO: 2047471 - RNA, 17 nt, Human herpesvirus 6B
aaaaucucgaugccaaa

SEQ ID NO: 2047472 - RNA, 17 nt, Human herpesvirus 6B
augaguuuuuugcaauu

SEQ ID NO: 2047473 - RNA, 20 nt, Human herpesvirus 6B
gcgcauggaaaaggcggaca

SEQ ID NO: 2047474 - RNA, 18 nt, Human herpesvirus 6B
aauuuuuuguuucugaaa

SEQ ID NO: 2047475 - RNA, 23 nt, Human herpesvirus 6B
gugcuuuggaccuugaauguuua

SEQ ID NO: 2047476 - RNA, 16 nt, Human herpesvirus 6B
aauaauuuuauugacu

SEQ ID NO: 2047477 - RNA, 14 nt, Human herpesvirus 6B
ggcgacguaaggau

SEQ ID NO: 2047478 - RNA, 20 nt, Human herpesvirus 6B
cuuuguuuaauaugugggcg

SEQ ID NO: 2047479 - RNA, 21 nt, Human herpesvirus 6B
cuaagaaauauugcaugcauu

SEQ ID NO: 2047480 - RNA, 15 nt, Human herpesvirus 6B
uugcauuaaggaaaa

SEQ ID NO: 2047481 - RNA, 11 nt, Human herpesvirus 6B
aaagauugcau

SEQ ID NO: 2047482 - RNA, 21 nt, Human herpesvirus 6B
aaaugucacucacauagagaa

SEQ ID NO: 2047483 - RNA, 13 nt, Human herpesvirus 6B
ugaaaaagguucg

SEQ ID NO: 2047484 - RNA, 18 nt, Human herpesvirus 6B
acuacagcuaagauuaac

SEQ ID NO: 2047485 - RNA, 18 nt, Human herpesvirus 6B
aaguauacggaagugcau

SEQ ID NO: 2047486 - RNA, 22 nt, Human herpesvirus 6B
gugguaauacgugaauuucaua

SEQ ID NO: 2047487 - RNA, 17 nt, Human herpesvirus 6B
ggccgucgcgcucgccg

SEQ ID NO: 2047488 - RNA, 23 nt, Human herpesvirus 6B
ugcaaaaguaugcuuugaaaucu

SEQ ID NO: 2047489 - RNA, 23 nt, Human herpesvirus 6B
ucuuccgcggcgcugggcuccuc

SEQ ID NO: 2047490 - RNA, 20 nt, Human herpesvirus 6B
gacagcgugaugaggcccag

SEQ ID NO: 2047491 - RNA, 18 nt, Human herpesvirus 6B
cccguccucgugcucucc

SEQ ID NO: 2047492 - RNA, 16 nt, Human herpesvirus 6B
cuuauauuaaagauug

SEQ ID NO: 2047493 - RNA, 17 nt, Human herpesvirus 6B
cgggcgcggggcgcacc

SEQ ID NO: 2047494 - RNA, 19 nt, Human herpesvirus 6B
uuaagaugucgcuguuuuu

SEQ ID NO: 2047495 - RNA, 22 nt, Human herpesvirus 6B
aauuuauucacguuuacauaag

SEQ ID NO: 2047496 - RNA, 13 nt, Human herpesvirus 6B
cuuaguuuuggau

SEQ ID NO: 2047497 - RNA, 22 nt, Human herpesvirus 6B
uaaauaccauuuuauacgaaaa

SEQ ID NO: 2047498 - RNA, 12 nt, Human herpesvirus 6B
gcuauuugacaa

SEQ ID NO: 2047499 - RNA, 17 nt, Human herpesvirus 6B
cagacgugagacauuug

SEQ ID NO: 2047500 - RNA, 21 nt, Human herpesvirus 6B
cugugaggugauuugaacaga

SEQ ID NO: 2047501 - RNA, 19 nt, Human herpesvirus 6B
gacgccuaguguuaaagau

SEQ ID NO: 2047502 - RNA, 20 nt, Human herpesvirus 6B
auuaccgguaaagaacccau

SEQ ID NO: 2047503 - RNA, 14 nt, Human herpesvirus 6B
cguugaugaaauaa

SEQ ID NO: 2047504 - RNA, 13 nt, Human herpesvirus 6B
gugaggugauuug

SEQ ID NO: 2047505 - RNA, 13 nt, Human herpesvirus 6B
uaggacugaagga

SEQ ID NO: 2047506 - RNA, 19 nt, Human herpesvirus 6B
uauauuaaugaucauagua

SEQ ID NO: 2047507 - RNA, 19 nt, Human herpesvirus 6B
aaacugaagaauggaaaga

SEQ ID NO: 2047508 - RNA, 15 nt, Human herpesvirus 6B
guauaauauaaauuc

SEQ ID NO: 2047509 - RNA, 20 nt, Human herpesvirus 6B
ucacaaccaaacaguuucag

SEQ ID NO: 2047510 - RNA, 13 nt, Human herpesvirus 6B
gauaucaaagcuc

SEQ ID NO: 2047511 - RNA, 15 nt, Human herpesvirus 6B
gcgccgucagcggca

SEQ ID NO: 2047512 - RNA, 19 nt, Human herpesvirus 6B
caccgaaauccccagaagg

SEQ ID NO: 2047513 - RNA, 19 nt, Human herpesvirus 6B
ccgcagggaaagagcacga

SEQ ID NO: 2047514 - RNA, 16 nt, Human herpesvirus 6B
uuaguuucuuuggaaa

SEQ ID NO: 2047515 - RNA, 16 nt, Human herpesvirus 6B
ucgcguggcggcgcgc

SEQ ID NO: 2047516 - RNA, 15 nt, Human herpesvirus 6B
agcaaugucaaguua

SEQ ID NO: 2047517 - RNA, 16 nt, Human herpesvirus 6B
uaaagugaguuuugga

SEQ ID NO: 2047518 - RNA, 13 nt, Human herpesvirus 6B
acaaaaccaggaa

SEQ ID NO: 2047519 - RNA, 16 nt, Human herpesvirus 6B
uaauuuuuuguuucug

SEQ ID NO: 2047520 - RNA, 17 nt, Human herpesvirus 6B
ugaaguuccacaucuau

SEQ ID NO: 2047521 - RNA, 14 nt, Human herpesvirus 6B
aacagaaucuucuu

SEQ ID NO: 2047522 - RNA, 14 nt, Human herpesvirus 6B
cucguggcccgugg

SEQ ID NO: 2047523 - RNA, 22 nt, Human herpesvirus 6B
uccauuuucugaaaucuuugau

SEQ ID NO: 2047524 - RNA, 23 nt, Human herpesvirus 6B
ccacuccaacacggggugagaga

SEQ ID NO: 2047525 - RNA, 19 nt, Human herpesvirus 6B
ucuaaaucugaaauguaga

SEQ ID NO: 2047526 - RNA, 22 nt, Human herpesvirus 6B
uucugaauacgagaacgguuaa

SEQ ID NO: 2047527 - RNA, 13 nt, Human herpesvirus 6B
gaaagcacagaaa

SEQ ID NO: 2047528 - RNA, 13 nt, Human herpesvirus 6B
aagaacuucauuu

SEQ ID NO: 2047529 - RNA, 21 nt, Human herpesvirus 6B
ugggacuccgagccggacagg

SEQ ID NO: 2047530 - RNA, 15 nt, Human herpesvirus 6B
gugucguucagguca

SEQ ID NO: 2047531 - RNA, 19 nt, Human herpesvirus 6B
aaaccaggaauccuauuca

SEQ ID NO: 2047532 - RNA, 20 nt, Human herpesvirus 6B
gcugaguggacauuggacuu

SEQ ID NO: 2047533 - RNA, 21 nt, Human herpesvirus 6B
cuggguaucuccggacagaaa

SEQ ID NO: 2047534 - RNA, 13 nt, Human herpesvirus 6B
uguauguuucuau

SEQ ID NO: 2047535 - RNA, 22 nt, Human herpesvirus 6B
aguguauacauucaaucuguau

SEQ ID NO: 2047536 - RNA, 14 nt, Human herpesvirus 6B
cucuugcaguggcg

SEQ ID NO: 2047537 - RNA, 22 nt, Human herpesvirus 6B
agccacuugagugagcagaagc

SEQ ID NO: 2047538 - RNA, 16 nt, Human herpesvirus 6B
ggcgggcacggagaac

SEQ ID NO: 2047539 - RNA, 14 nt, Human herpesvirus 6B
ugucacaauaauua

SEQ ID NO: 2047540 - RNA, 16 nt, Human herpesvirus 6B
auguggucauggaaaa

SEQ ID NO: 2047541 - RNA, 20 nt, Human herpesvirus 6B
aaaacuaaaacaucagauga

SEQ ID NO: 2047542 - RNA, 14 nt, Human herpesvirus 6B
gcguguuuuggaau

SEQ ID NO: 2047543 - RNA, 20 nt, Human herpesvirus 6B
uauuguguguacaacgacug

SEQ ID NO: 2047544 - RNA, 21 nt, Human herpesvirus 6B
uaacauagaaaaauaagacuu

SEQ ID NO: 2047545 - RNA, 18 nt, Human herpesvirus 6B
gauaugggaaaagggagu

SEQ ID NO: 2047546 - RNA, 23 nt, Human herpesvirus 6B
ccccaggcgcagcagcagcucca

SEQ ID NO: 2047547 - RNA, 20 nt, Human herpesvirus 6B
agaaucuuccuuuucaguau

SEQ ID NO: 2047548 - RNA, 21 nt, Human herpesvirus 6B
ugacuguagaaaacgauuucu

SEQ ID NO: 2047549 - RNA, 16 nt, Human herpesvirus 6B
aggccggcacauacac

SEQ ID NO: 2047550 - RNA, 13 nt, Human herpesvirus 6B
accuuagcucuaa

SEQ ID NO: 2047551 - RNA, 19 nt, Human herpesvirus 6B
aaagcaguuuugcagcauc

SEQ ID NO: 2047552 - RNA, 11 nt, Human herpesvirus 6B
guguuauucag

SEQ ID NO: 2047553 - RNA, 21 nt, Human herpesvirus 6B
gauagcauaauccuuuucugu

SEQ ID NO: 2047554 - RNA, 20 nt, Human herpesvirus 6B
ugauggguuuggccaugccg

SEQ ID NO: 2047555 - RNA, 12 nt, Human herpesvirus 6B
gcaguuugugaa

SEQ ID NO: 2047556 - RNA, 14 nt, Human herpesvirus 6B
auuaaaguuuucau

SEQ ID NO: 2047557 - RNA, 18 nt, Human herpesvirus 6B
uucuuuggaaaacgucaa

SEQ ID NO: 2047558 - RNA, 22 nt, Human herpesvirus 6B
guggaaguguaaaugucacuca

SEQ ID NO: 2047559 - RNA, 18 nt, Human herpesvirus 6B
guuacuuuaccucugcuc

SEQ ID NO: 2047560 - RNA, 21 nt, Human herpesvirus 6B
accggagcuuauuuaugaaaa

SEQ ID NO: 2047561 - RNA, 20 nt, Human herpesvirus 6B
gauaugagugaauugugcaa

SEQ ID NO: 2047562 - RNA, 16 nt, Human herpesvirus 6B
cgcaguuccuguuuuu

SEQ ID NO: 2047563 - RNA, 17 nt, Human herpesvirus 6B
ucaauuucuaaagauuu

SEQ ID NO: 2047564 - RNA, 23 nt, Human herpesvirus 6B
aguccaaugaauacuucucuuua

SEQ ID NO: 2047565 - RNA, 14 nt, Human herpesvirus 6B
auuugugcaaaaug

SEQ ID NO: 2047566 - RNA, 18 nt, Human herpesvirus 6B
uugaauacgacuuuggaa

SEQ ID NO: 2047567 - RNA, 17 nt, Human herpesvirus 6B
guaaacuguucuuucaa

SEQ ID NO: 2047568 - RNA, 13 nt, Human herpesvirus 6B
cucucuccgccuc

SEQ ID NO: 2047569 - RNA, 16 nt, Human herpesvirus 6B
cuuucuuuuauuuaaa

SEQ ID NO: 2047570 - RNA, 14 nt, Human herpesvirus 6B
acaacaucucauaa

SEQ ID NO: 2047571 - RNA, 18 nt, Human herpesvirus 6B
aucugcuaacggagcaac

SEQ ID NO: 2047572 - RNA, 18 nt, Human herpesvirus 6B
gaccugaucacagagaaa

SEQ ID NO: 2047573 - RNA, 21 nt, Human herpesvirus 6B
uaucucaaauuuuccaaacau

SEQ ID NO: 2047574 - RNA, 16 nt, Human herpesvirus 6B
ggauucgaucgagaau

SEQ ID NO: 2047575 - RNA, 21 nt, Human herpesvirus 6B
augaauguguucauagagcau

SEQ ID NO: 2047576 - RNA, 15 nt, Human herpesvirus 6B
ugccagguccaguca

SEQ ID NO: 2047577 - RNA, 12 nt, Human herpesvirus 6B
ccucgcucuccu

SEQ ID NO: 2047578 - RNA, 18 nt, Human herpesvirus 6B
agcaauaacucuuggauu

SEQ ID NO: 2047579 - RNA, 19 nt, Human herpesvirus 6B
uuuuugaugacuuauaaua

SEQ ID NO: 2047580 - RNA, 19 nt, Human herpesvirus 6B
ccucagaaccaucuuuuca

SEQ ID NO: 2047581 - RNA, 15 nt, Human herpesvirus 6B
ucucuacguuuacau

SEQ ID NO: 2047582 - RNA, 12 nt, Human herpesvirus 6B
acgggauaaaga

SEQ ID NO: 2047583 - RNA, 20 nt, Human herpesvirus 6B
ugcauacaugggaggccagg

SEQ ID NO: 2047584 - RNA, 21 nt, Human herpesvirus 6B
cuuucaauguccgaaguaaaa

SEQ ID NO: 2047585 - RNA, 20 nt, Human herpesvirus 6B
cgcaguuccuguuuuucuca

SEQ ID NO: 2047586 - RNA, 16 nt, Human herpesvirus 6B
caaauucuaucuuaua

SEQ ID NO: 2047587 - RNA, 20 nt, Human herpesvirus 6B
guuuucaaugguauucgaaa

SEQ ID NO: 2047588 - RNA, 22 nt, Human herpesvirus 6B
acacgccauccacccauauacc

SEQ ID NO: 2047589 - RNA, 14 nt, Human herpesvirus 6B
uguuucuguaugaa

SEQ ID NO: 2047590 - RNA, 23 nt, Human herpesvirus 6B
uaauaaaaacgaaacucuagaau

SEQ ID NO: 2047591 - RNA, 15 nt, Human herpesvirus 6B
auuugguuugacauu

SEQ ID NO: 2047592 - RNA, 16 nt, Human herpesvirus 6B
uaucguccucagagaa

SEQ ID NO: 2047593 - RNA, 14 nt, Human herpesvirus 6B
auugugacaaggua

SEQ ID NO: 2047594 - RNA, 18 nt, Human herpesvirus 6B
ucucuauaaccaccugca

SEQ ID NO: 2047595 - RNA, 19 nt, Human herpesvirus 6B
ucggaacaaauucugcuug

SEQ ID NO: 2047596 - RNA, 17 nt, Human herpesvirus 6B
aguuaacggagagucuu

SEQ ID NO: 2047597 - RNA, 18 nt, Human herpesvirus 6B
cgaagacauucaacauuc

SEQ ID NO: 2047598 - RNA, 16 nt, Human herpesvirus 6B
acgcgcggaccacucg

SEQ ID NO: 2047599 - RNA, 14 nt, Human herpesvirus 6B
uuuaacgcagauau

SEQ ID NO: 2047600 - RNA, 13 nt, Human herpesvirus 6B
gucuuugcuuugg

SEQ ID NO: 2047601 - RNA, 18 nt, Human herpesvirus 6B
uccgcgaugcgccacagg

SEQ ID NO: 2047602 - RNA, 23 nt, Human herpesvirus 6B
uguacugguaauucaauuucuaa

SEQ ID NO: 2047603 - RNA, 20 nt, Human herpesvirus 6B
gcggggcgcaccggcgacac

SEQ ID NO: 2047604 - RNA, 13 nt, Human herpesvirus 6B
uauauggugaugu

SEQ ID NO: 2047605 - RNA, 12 nt, Human herpesvirus 6B
ggacugaaggag

SEQ ID NO: 2047606 - RNA, 19 nt, Human herpesvirus 6B
ugcugucacacucugaacu

SEQ ID NO: 2047607 - RNA, 11 nt, Human herpesvirus 6B
auuuucuguau

SEQ ID NO: 2047608 - RNA, 12 nt, Human herpesvirus 6B
augaauuucaau

SEQ ID NO: 2047609 - RNA, 23 nt, Human herpesvirus 6B
uaucuuacuguaaacaaauucuu

SEQ ID NO: 2047610 - RNA, 13 nt, Human herpesvirus 6B
cgaccaggcacca

SEQ ID NO: 2047611 - RNA, 19 nt, Human herpesvirus 6B
uuuguccuauguuaacauu

SEQ ID NO: 2047612 - RNA, 16 nt, Human herpesvirus 6B
uauauagaagaagaaa

SEQ ID NO: 2047613 - RNA, 18 nt, Human herpesvirus 6B
guugcagauuugcggaaa

SEQ ID NO: 2047614 - RNA, 16 nt, Human herpesvirus 6B
uuuuccaacuuaauaa

SEQ ID NO: 2047615 - RNA, 15 nt, Human herpesvirus 6B
uggccgucuccugca

SEQ ID NO: 2047616 - RNA, 23 nt, Human herpesvirus 6B
uuauggacaacgguguggagaca

SEQ ID NO: 2047617 - RNA, 22 nt, Human herpesvirus 6B
gcggaguuuuauggcuggguau

SEQ ID NO: 2047618 - RNA, 15 nt, Human herpesvirus 6B
cucacgucguccgcc

SEQ ID NO: 2047619 - RNA, 19 nt, Human herpesvirus 6B
uagucaggauucggaucac

SEQ ID NO: 2047620 - RNA, 16 nt, Human herpesvirus 6B
uuugucguuuguacau

SEQ ID NO: 2047621 - RNA, 22 nt, Human herpesvirus 6B
agaagaaacaaguugcggaagg

SEQ ID NO: 2047622 - RNA, 22 nt, Human herpesvirus 6B
aggagaagaacagaggaagaaa

SEQ ID NO: 2047623 - RNA, 15 nt, Human herpesvirus 6B
cuguucuaaaaguuu

SEQ ID NO: 2047624 - RNA, 17 nt, Human herpesvirus 6B
uagagcauccuguuuuc

SEQ ID NO: 2047625 - RNA, 17 nt, Human herpesvirus 6B
cggcgaauuuaugugaa

SEQ ID NO: 2047626 - RNA, 20 nt, Human herpesvirus 6B
ugcuuaaacugaaucacuua

SEQ ID NO: 2047627 - RNA, 18 nt, Human herpesvirus 6B
cggcagcggggaagggaa

SEQ ID NO: 2047628 - RNA, 14 nt, Human herpesvirus 6B
gaugcauacagcau

SEQ ID NO: 2047629 - RNA, 23 nt, Human herpesvirus 6B
cacaucgugaaaacgcuucagau

SEQ ID NO: 2047630 - RNA, 15 nt, Human herpesvirus 6B
gagaauuccaaggcu

SEQ ID NO: 2047631 - RNA, 14 nt, Human herpesvirus 6B
caugggagaaauaa

SEQ ID NO: 2047632 - RNA, 19 nt, Human herpesvirus 6B
auuguaauuccaauugcug

SEQ ID NO: 2047633 - RNA, 17 nt, Human herpesvirus 6B
uacuuuguuuucuuggg

SEQ ID NO: 2047634 - RNA, 19 nt, Human herpesvirus 6B
aguaccucuaugauacuuu

SEQ ID NO: 2047635 - RNA, 14 nt, Human herpesvirus 6B
cuccagcuauuuug

SEQ ID NO: 2047636 - RNA, 21 nt, Human herpesvirus 6B
cacgcccccaccuggcgcacc

SEQ ID NO: 2047637 - RNA, 22 nt, Human herpesvirus 6B
ucaaacagcgacaugaaaucuc

SEQ ID NO: 2047638 - RNA, 22 nt, Human herpesvirus 6B
aguguuauaucuggauauguau

SEQ ID NO: 2047639 - RNA, 15 nt, Human herpesvirus 6B
gaaagcgcgccacau

SEQ ID NO: 2047640 - RNA, 12 nt, Human herpesvirus 6B
caacaucucaua

SEQ ID NO: 2047641 - RNA, 15 nt, Human herpesvirus 6B
ucgaaacgaaagcug

SEQ ID NO: 2047642 - RNA, 18 nt, Human herpesvirus 6B
aaguauguuuuguacaaa

SEQ ID NO: 2047643 - RNA, 15 nt, Human herpesvirus 6B
aaaaauauuggauuu

SEQ ID NO: 2047644 - RNA, 22 nt, Human herpesvirus 6B
auagaucuucggcgcugauucc

SEQ ID NO: 2047645 - RNA, 19 nt, Human herpesvirus 6B
ccucgaugguagcaauaac

SEQ ID NO: 2047646 - RNA, 14 nt, Human herpesvirus 6B
ugucugagcauugu

SEQ ID NO: 2047647 - RNA, 11 nt, Human herpesvirus 6B
gaaaacaaugc

SEQ ID NO: 2047648 - RNA, 14 nt, Human herpesvirus 6B
uaguaagaggcuua

SEQ ID NO: 2047649 - RNA, 17 nt, Human herpesvirus 6B
guuagcaagcugggaaa

SEQ ID NO: 2047650 - RNA, 21 nt, Human herpesvirus 6B
aguucacuaacaaaaaaaucg

SEQ ID NO: 2047651 - RNA, 12 nt, Human herpesvirus 6B
ugaaaacuagua

SEQ ID NO: 2047652 - RNA, 15 nt, Human herpesvirus 6B
ccucgucuguugcug

SEQ ID NO: 2047653 - RNA, 14 nt, Human herpesvirus 6B
ccgcgggaccuggc

SEQ ID NO: 2047654 - RNA, 16 nt, Human herpesvirus 6B
uaugaagaauugacuu

SEQ ID NO: 2047655 - RNA, 15 nt, Human herpesvirus 6B
agaauuugcaguuug

SEQ ID NO: 2047656 - RNA, 17 nt, Human herpesvirus 6B
cggggaggaggaggaag

SEQ ID NO: 2047657 - RNA, 13 nt, Human herpesvirus 6B
ccugaucacagag

SEQ ID NO: 2047658 - RNA, 20 nt, Human herpesvirus 6B
accaaacaguuucagaugau

SEQ ID NO: 2047659 - RNA, 15 nt, Human herpesvirus 6B
gggacuuauuucauu

SEQ ID NO: 2047660 - RNA, 18 nt, Human herpesvirus 6B
agcuuugagcaugacaca

SEQ ID NO: 2047661 - RNA, 14 nt, Human herpesvirus 6B
cggcacgcgccguc

SEQ ID NO: 2047662 - RNA, 16 nt, Human herpesvirus 6B
ucauucgcguggcggc

SEQ ID NO: 2047663 - RNA, 12 nt, Human herpesvirus 6B
aaaaacagaaua

SEQ ID NO: 2047664 - RNA, 21 nt, Human herpesvirus 6B
cauuucucuacaugccacaga

SEQ ID NO: 2047665 - RNA, 20 nt, Human herpesvirus 6B
gcacgagaacacgcgagaca

SEQ ID NO: 2047666 - RNA, 21 nt, Human herpesvirus 6B
aauacgccgucguaugucaau

SEQ ID NO: 2047667 - RNA, 15 nt, Human herpesvirus 6B
cuuacgagaggcuuu

SEQ ID NO: 2047668 - RNA, 17 nt, Human herpesvirus 6B
guauuguagcagcuggc

SEQ ID NO: 2047669 - RNA, 16 nt, Human herpesvirus 6B
acucacauagagaaga

SEQ ID NO: 2047670 - RNA, 15 nt, Human herpesvirus 6B
ugcgccacagggagg

SEQ ID NO: 2047671 - RNA, 17 nt, Human herpesvirus 6B
ucauucgcguggcggcg

SEQ ID NO: 2047672 - RNA, 15 nt, Human herpesvirus 6B
ucucacgaaaguuuu

SEQ ID NO: 2047673 - RNA, 20 nt, Human herpesvirus 6B
ggagcccugagagcaggagc

SEQ ID NO: 2047674 - RNA, 19 nt, Human herpesvirus 6B
gauuuucagugucagcauu

SEQ ID NO: 2047675 - RNA, 23 nt, Human herpesvirus 6B
uucaaaaaaagaggaggaaaaga

SEQ ID NO: 2047676 - RNA, 18 nt, Human herpesvirus 6B
cgcggcgcugggcuccuc

SEQ ID NO: 2047677 - RNA, 23 nt, Human herpesvirus 6B
uacagguuugcucgucuguacag

SEQ ID NO: 2047678 - RNA, 16 nt, Human herpesvirus 6B
cucgggggacggagag

SEQ ID NO: 2047679 - RNA, 22 nt, Human herpesvirus 6B
cgcuaagagauuuacuguuucu

SEQ ID NO: 2047680 - RNA, 19 nt, Human herpesvirus 6B
agauaucguagagcaguuu

SEQ ID NO: 2047681 - RNA, 14 nt, Human herpesvirus 6B
acaauaauuacucc

SEQ ID NO: 2047682 - RNA, 22 nt, Human herpesvirus 6B
cuaaagaguaugacagaaaucu

SEQ ID NO: 2047683 - RNA, 19 nt, Human herpesvirus 6B
guggaaauuaacugucaug

SEQ ID NO: 2047684 - RNA, 18 nt, Human herpesvirus 6B
ggcgcaccacggcucccc

SEQ ID NO: 2047685 - RNA, 14 nt, Human herpesvirus 6B
ccauggcgacucaa

SEQ ID NO: 2047686 - RNA, 13 nt, Human herpesvirus 6B
uucuccuguaguu

SEQ ID NO: 2047687 - RNA, 19 nt, Human herpesvirus 6B
gucauucgcguggcggcgc

SEQ ID NO: 2047688 - RNA, 15 nt, Human herpesvirus 6B
uacaaugagccuggc

SEQ ID NO: 2047689 - RNA, 15 nt, Human herpesvirus 6B
cuuguuaugacaaaa

SEQ ID NO: 2047690 - RNA, 17 nt, Human herpesvirus 6B
auuuuuuugaaaucacu

SEQ ID NO: 2047691 - RNA, 23 nt, Human herpesvirus 6B
aaaauaagaaaggcggagacaca

SEQ ID NO: 2047692 - RNA, 17 nt, Human herpesvirus 6B
acagaaaugagcaacau

SEQ ID NO: 2047693 - RNA, 21 nt, Human herpesvirus 6B
agacgaguccuacagaagaaa

SEQ ID NO: 2047694 - RNA, 16 nt, Human herpesvirus 6B
ugaauuagcagaagau

SEQ ID NO: 2047695 - RNA, 23 nt, Human herpesvirus 6B
agaggguuccuccgcgggaccug

SEQ ID NO: 2047696 - RNA, 21 nt, Human herpesvirus 6B
ucuuggcgguuuuuuaauucu

SEQ ID NO: 2047697 - RNA, 12 nt, Human herpesvirus 6B
ggcaucagauuu

SEQ ID NO: 2047698 - RNA, 18 nt, Human herpesvirus 6B
uaauugguauaagaaaga

SEQ ID NO: 2047699 - RNA, 18 nt, Human herpesvirus 6B
gcagauuuacgacacgcu

SEQ ID NO: 2047700 - RNA, 11 nt, Human herpesvirus 6B
ugagcaaagaa

SEQ ID NO: 2047701 - RNA, 18 nt, Human herpesvirus 6B
ggcugauaaguugucauu

SEQ ID NO: 2047702 - RNA, 20 nt, Human herpesvirus 6B
ugcaacccgccacucuacaa

SEQ ID NO: 2047703 - RNA, 13 nt, Human herpesvirus 6B
cagcuggacagaa

SEQ ID NO: 2047704 - RNA, 20 nt, Human herpesvirus 6B
aaggaaucgguaaacuucag

SEQ ID NO: 2047705 - RNA, 19 nt, Human herpesvirus 6B
aggcaugugauugucuuuu

SEQ ID NO: 2047706 - RNA, 14 nt, Human herpesvirus 6B
ucccucucaaacag

SEQ ID NO: 2047707 - RNA, 15 nt, Human herpesvirus 6B
aucucuacaacguga

SEQ ID NO: 2047708 - RNA, 15 nt, Human herpesvirus 6B
aucacgaaagaaugu

SEQ ID NO: 2047709 - RNA, 20 nt, Human herpesvirus 6B
auuuuucugccuauuucucu

SEQ ID NO: 2047710 - RNA, 17 nt, Human herpesvirus 6B
gcucgggggacggagag

SEQ ID NO: 2047711 - RNA, 22 nt, Human herpesvirus 6B
auugcugcuggguguauguuuc

SEQ ID NO: 2047712 - RNA, 14 nt, Human herpesvirus 6B
auagaggaauugcu

SEQ ID NO: 2047713 - RNA, 21 nt, Human herpesvirus 6B
aaaaccccacggagaaaucuu

SEQ ID NO: 2047714 - RNA, 16 nt, Human herpesvirus 6B
aagaagaugcuuuaaa

SEQ ID NO: 2047715 - RNA, 18 nt, Human herpesvirus 6B
gcuuucuguaccccaagu

SEQ ID NO: 2047716 - RNA, 13 nt, Human herpesvirus 6B
gaaggguugcaga

SEQ ID NO: 2047717 - RNA, 15 nt, Human herpesvirus 6B
ugauuuucagaguuu

SEQ ID NO: 2047718 - RNA, 16 nt, Human herpesvirus 6B
ucucgaugccaaagcu

SEQ ID NO: 2047719 - RNA, 21 nt, Human herpesvirus 6B
accucgcucuccugugcgucc

SEQ ID NO: 2047720 - RNA, 18 nt, Human herpesvirus 6B
acucauuugcaauuguuu

SEQ ID NO: 2047721 - RNA, 15 nt, Human herpesvirus 6B
uucaauuguuuuuua

SEQ ID NO: 2047722 - RNA, 15 nt, Human herpesvirus 6B
guuggcgcucucgug

SEQ ID NO: 2047723 - RNA, 19 nt, Human herpesvirus 6B
cacgcggggaucgggccug

SEQ ID NO: 2047724 - RNA, 16 nt, Human herpesvirus 6B
ugaagaaacgauuucu

SEQ ID NO: 2047725 - RNA, 15 nt, Human herpesvirus 6B
auuauaaugaugcau

SEQ ID NO: 2047726 - RNA, 23 nt, Human herpesvirus 6B
ucgguccccccucccuccauccc

SEQ ID NO: 2047727 - RNA, 22 nt, Human herpesvirus 6B
auaacgauagcagcucugcaau

SEQ ID NO: 2047728 - RNA, 21 nt, Human herpesvirus 6B
ugccucaggguuggaguuuag

SEQ ID NO: 2047729 - RNA, 20 nt, Human herpesvirus 6B
caacuaacuucacagggaaa

SEQ ID NO: 2047730 - RNA, 14 nt, Human herpesvirus 6B
uuaguuuuggauga

SEQ ID NO: 2047731 - RNA, 17 nt, Human herpesvirus 6B
uaagacgagauguuucu

SEQ ID NO: 2047732 - RNA, 22 nt, Human herpesvirus 6B
gaaaacaugacggacuuggaaa

SEQ ID NO: 2047733 - RNA, 13 nt, Human herpesvirus 6B
uguuguucuugga

SEQ ID NO: 2047734 - RNA, 12 nt, Human herpesvirus 6B
auacuugaagag

SEQ ID NO: 2047735 - RNA, 14 nt, Human herpesvirus 6B
cuuugaacagugac

SEQ ID NO: 2047736 - RNA, 19 nt, Human herpesvirus 6B
aggcaacggcacgagagcc

SEQ ID NO: 2047737 - RNA, 16 nt, Human herpesvirus 6B
gccuggggacagacag

SEQ ID NO: 2047738 - RNA, 21 nt, Human herpesvirus 6B
gauacuauugcuaagaucugu

SEQ ID NO: 2047739 - RNA, 14 nt, Human herpesvirus 6B
caguaaaacaugua

SEQ ID NO: 2047740 - RNA, 11 nt, Human herpesvirus 6B
cgaucuguaua

SEQ ID NO: 2047741 - RNA, 16 nt, Human herpesvirus 6B
ucugccgaaaagaaag

SEQ ID NO: 2047742 - RNA, 17 nt, Human herpesvirus 6B
auuuacaaaacaaauau

SEQ ID NO: 2047743 - RNA, 18 nt, Human herpesvirus 6B
aacaaagucuuuggcuug

SEQ ID NO: 2047744 - RNA, 18 nt, Human herpesvirus 6B
ucagauaucugaaacacu

SEQ ID NO: 2047745 - RNA, 19 nt, Human herpesvirus 6B
ccucuugcaguggcgcgcg

SEQ ID NO: 2047746 - RNA, 21 nt, Human herpesvirus 6B
uggcgcuuguaggagcacgag

SEQ ID NO: 2047747 - RNA, 17 nt, Human herpesvirus 6B
aagacauugguugauuu

SEQ ID NO: 2047748 - RNA, 13 nt, Human herpesvirus 6B
ugacugugaggug

SEQ ID NO: 2047749 - RNA, 16 nt, Human herpesvirus 6B
aagaugacaaauuuuc

SEQ ID NO: 2047750 - RNA, 18 nt, Human herpesvirus 6B
augguucgauugcgcgau

SEQ ID NO: 2047751 - RNA, 14 nt, Human herpesvirus 6B
aguuucuuuggaaa

SEQ ID NO: 2047752 - RNA, 18 nt, Human herpesvirus 6B
ggcaaccgcaguuccugu

SEQ ID NO: 2047753 - RNA, 13 nt, Human herpesvirus 6B
guauucuacggga

SEQ ID NO: 2047754 - RNA, 18 nt, Human herpesvirus 6B
agacacggcgaaagccag

SEQ ID NO: 2047755 - RNA, 18 nt, Human herpesvirus 6B
caaagguuuuugcuguca

SEQ ID NO: 2047756 - RNA, 18 nt, Human herpesvirus 6B
gacccuccuggcgcuugu

SEQ ID NO: 2047757 - RNA, 17 nt, Human herpesvirus 6B
cuuaagaagggcuuuaa

SEQ ID NO: 2047758 - RNA, 18 nt, Human herpesvirus 6B
gaaucccuugucuggcug

SEQ ID NO: 2047759 - RNA, 10 nt, Human herpesvirus 6B
ccacugugau

SEQ ID NO: 2047760 - RNA, 20 nt, Human herpesvirus 6B
cuaacuguuguucuuggaga

SEQ ID NO: 2047761 - RNA, 17 nt, Human herpesvirus 6B
agacuggacaguguuuu

SEQ ID NO: 2047762 - RNA, 14 nt, Human herpesvirus 6B
cgugucuucauucu

SEQ ID NO: 2047763 - RNA, 14 nt, Human herpesvirus 6B
cccucgcccguucc

SEQ ID NO: 2047764 - RNA, 12 nt, Human herpesvirus 6B
aacguacauaaa

SEQ ID NO: 2047765 - RNA, 22 nt, Human herpesvirus 6B
cccggcuuucucgccgccucgc

SEQ ID NO: 2047766 - RNA, 15 nt, Human herpesvirus 6B
auaggacagaggaau

SEQ ID NO: 2047767 - RNA, 12 nt, Human herpesvirus 6B
uaaaucugaaau

SEQ ID NO: 2047768 - RNA, 19 nt, Human herpesvirus 6B
agaguauuuuaaagauuuu

SEQ ID NO: 2047769 - RNA, 14 nt, Human herpesvirus 6B
gcgacaaaaaaaua

SEQ ID NO: 2047770 - RNA, 17 nt, Human herpesvirus 6B
ucauaauugugauaguu

SEQ ID NO: 2047771 - RNA, 17 nt, Human herpesvirus 6B
guaccgcgguugaaguc

SEQ ID NO: 2047772 - RNA, 17 nt, Human herpesvirus 6B
cauaccgggacagcacc

SEQ ID NO: 2047773 - RNA, 13 nt, Human herpesvirus 6B
ccaacuuaauaaa

SEQ ID NO: 2047774 - RNA, 16 nt, Human herpesvirus 6B
gucaacgaaaaaauga

SEQ ID NO: 2047775 - RNA, 15 nt, Human herpesvirus 6B
aauagagaaaaauaa

SEQ ID NO: 2047776 - RNA, 20 nt, Human herpesvirus 6B
cgauuuggguuaucuuagaa

SEQ ID NO: 2047777 - RNA, 14 nt, Human herpesvirus 6B
ugaaauaaaguuua

SEQ ID NO: 2047778 - RNA, 14 nt, Human herpesvirus 6B
gcagcggggaaggg

SEQ ID NO: 2047779 - RNA, 21 nt, Human herpesvirus 6B
uguacugguaauucaauuucu

SEQ ID NO: 2047780 - RNA, 23 nt, Human herpesvirus 6B
aucuggugagaaagacuucuugc

SEQ ID NO: 2047781 - RNA, 12 nt, Human herpesvirus 6B
aucgggccuggg

SEQ ID NO: 2047782 - RNA, 15 nt, Human herpesvirus 6B
uucacguuuacauaa

SEQ ID NO: 2047783 - RNA, 18 nt, Human herpesvirus 6B
gucaagguugucagauuu

SEQ ID NO: 2047784 - RNA, 23 nt, Human herpesvirus 6B
ucacucgaggaaacgcgcuggga

SEQ ID NO: 2047785 - RNA, 17 nt, Human herpesvirus 6B
ugaugauuugaaauguu

SEQ ID NO: 2047786 - RNA, 15 nt, Human herpesvirus 6B
ucucauaauuugccu

SEQ ID NO: 2047787 - RNA, 14 nt, Human herpesvirus 6B
guuugcuuuggauc

SEQ ID NO: 2047788 - RNA, 20 nt, Human herpesvirus 6B
gagaacuucaaaaucugcua

SEQ ID NO: 2047789 - RNA, 19 nt, Human herpesvirus 6B
aucgcgguguccucguccg

SEQ ID NO: 2047790 - RNA, 18 nt, Human herpesvirus 6B
aaacgauuucuuuaucuu

SEQ ID NO: 2047791 - RNA, 14 nt, Human herpesvirus 6B
agcgccaggacggg

SEQ ID NO: 2047792 - RNA, 20 nt, Human herpesvirus 6B
aagucuuccgcggcgcuggg

SEQ ID NO: 2047793 - RNA, 15 nt, Human herpesvirus 6B
gcgaccacagcggca

SEQ ID NO: 2047794 - RNA, 22 nt, Human herpesvirus 6B
acagaacaccugcuuuugguua

SEQ ID NO: 2047795 - RNA, 15 nt, Human herpesvirus 6B
ugucgggccacauuu

SEQ ID NO: 2047796 - RNA, 16 nt, Human herpesvirus 6B
auuguaagacuaaaug

SEQ ID NO: 2047797 - RNA, 14 nt, Human herpesvirus 6B
uacagacuccucac

SEQ ID NO: 2047798 - RNA, 16 nt, Human herpesvirus 6B
aacugcuuaacuugca

SEQ ID NO: 2047799 - RNA, 15 nt, Human herpesvirus 6B
ggagaacgggcaacu

SEQ ID NO: 2047800 - RNA, 16 nt, Human herpesvirus 6B
uccaaguuuuuaugca

SEQ ID NO: 2047801 - RNA, 21 nt, Human herpesvirus 6B
uccaauguccauuuuuuccca

SEQ ID NO: 2047802 - RNA, 14 nt, Human herpesvirus 6B
ggagaggcgcggga

SEQ ID NO: 2047803 - RNA, 16 nt, Human herpesvirus 6B
cgucgccuccaaggag

SEQ ID NO: 2047804 - RNA, 20 nt, Human herpesvirus 6B
uagacgaaaauuguaacuuc

SEQ ID NO: 2047805 - RNA, 19 nt, Human herpesvirus 6B
aacugagauauuuuaaaug

SEQ ID NO: 2047806 - RNA, 22 nt, Human herpesvirus 6B
gucgacucuuuccgaugugucu

SEQ ID NO: 2047807 - RNA, 21 nt, Human herpesvirus 6B
guacguggccgucuccugcaa

SEQ ID NO: 2047808 - RNA, 14 nt, Human herpesvirus 6B
gaggagagggagga

SEQ ID NO: 2047809 - RNA, 16 nt, Human herpesvirus 6B
aagucgccucacugua

SEQ ID NO: 2047810 - RNA, 22 nt, Human herpesvirus 6B
augaaaauaucauuaaauuguu

SEQ ID NO: 2047811 - RNA, 13 nt, Human herpesvirus 6B
uguauuuggauga

SEQ ID NO: 2047812 - RNA, 20 nt, Human herpesvirus 6B
ucgcuaaguguugacugauc

SEQ ID NO: 2047813 - RNA, 21 nt, Human herpesvirus 6B
caaaaauccaggaguaaugau

SEQ ID NO: 2047814 - RNA, 19 nt, Human herpesvirus 6B
cagaugcagucuccacagg

SEQ ID NO: 2047815 - RNA, 22 nt, Human herpesvirus 6B
ucaguaugucucaguucaaaau

SEQ ID NO: 2047816 - RNA, 23 nt, Human herpesvirus 6B
gagugguuuuuuggauaagcaga

SEQ ID NO: 2047817 - RNA, 14 nt, Human herpesvirus 6B
ugacgcaaacacag

SEQ ID NO: 2047818 - RNA, 19 nt, Human herpesvirus 6B
ugcaaaaacaaaugaaagu

SEQ ID NO: 2047819 - RNA, 14 nt, Human herpesvirus 6B
uuucauauuuuuaa

SEQ ID NO: 2047820 - RNA, 19 nt, Human herpesvirus 6B
aggcuaucacuuagacacg

SEQ ID NO: 2047821 - RNA, 11 nt, Human herpesvirus 6B
acuucuaaaau

SEQ ID NO: 2047822 - RNA, 14 nt, Human herpesvirus 6B
auaaacaugauugu

SEQ ID NO: 2047823 - RNA, 12 nt, Human herpesvirus 6B
gcggaagggcuc

SEQ ID NO: 2047824 - RNA, 21 nt, Human herpesvirus 6B
uggauuacaagggaaauccua

SEQ ID NO: 2047825 - RNA, 17 nt, Human herpesvirus 6B
caccagauaggaaaagg

SEQ ID NO: 2047826 - RNA, 15 nt, Human herpesvirus 6B
auuguagcucucgca

SEQ ID NO: 2047827 - RNA, 17 nt, Human herpesvirus 6B
gcaaagaugcagauucu

SEQ ID NO: 2047828 - RNA, 17 nt, Human herpesvirus 6B
ugaaaucuuuccugcua

SEQ ID NO: 2047829 - RNA, 17 nt, Human herpesvirus 6B
cacgugaaauaaaguuu

SEQ ID NO: 2047830 - RNA, 21 nt, Human herpesvirus 6B
aacucuugcacggaaucucua

SEQ ID NO: 2047831 - RNA, 22 nt, Human herpesvirus 6B
ugcugucgcccgccucucuccg

SEQ ID NO: 2047832 - RNA, 21 nt, Human herpesvirus 6B
cagggggaucgacgaccaggc

SEQ ID NO: 2047833 - RNA, 15 nt, Human herpesvirus 6B
caaagauagacagug

SEQ ID NO: 2047834 - RNA, 14 nt, Human herpesvirus 6B
cacggcgaaagcca

SEQ ID NO: 2047835 - RNA, 19 nt, Human herpesvirus 6B
uuugauccauuuucugaaa

SEQ ID NO: 2047836 - RNA, 22 nt, Human herpesvirus 6B
cugaacggggugauuuuccaaa

SEQ ID NO: 2047837 - RNA, 13 nt, Human herpesvirus 6B
uaagacuuagcua

SEQ ID NO: 2047838 - RNA, 19 nt, Human herpesvirus 6B
ucuuucaaaaugaccagag

SEQ ID NO: 2047839 - RNA, 20 nt, Human herpesvirus 6B
cuguucacauugugacggcu

SEQ ID NO: 2047840 - RNA, 17 nt, Human herpesvirus 6B
aggggacggacagagcg

SEQ ID NO: 2047841 - RNA, 19 nt, Human herpesvirus 6B
auucgauuaaugccacagg

SEQ ID NO: 2047842 - RNA, 14 nt, Human herpesvirus 6B
uuagguaucugccc

SEQ ID NO: 2047843 - RNA, 17 nt, Human herpesvirus 6B
auuugauguugucuucu

SEQ ID NO: 2047844 - RNA, 19 nt, Human herpesvirus 6B
ggcgcagggaacggugaag

SEQ ID NO: 2047845 - RNA, 17 nt, Human herpesvirus 6B
auuugguggaugucaag

SEQ ID NO: 2047846 - RNA, 19 nt, Human herpesvirus 6B
gauuaugcgaauuaaaacu

SEQ ID NO: 2047847 - RNA, 14 nt, Human herpesvirus 6B
ccugauggauuaca

SEQ ID NO: 2047848 - RNA, 19 nt, Human herpesvirus 6B
cuccugucauuuuuacuca

SEQ ID NO: 2047849 - RNA, 16 nt, Human herpesvirus 6B
auaaugugaacuaaau

SEQ ID NO: 2047850 - RNA, 16 nt, Human herpesvirus 6B
uaaucaucccaauaaa

SEQ ID NO: 2047851 - RNA, 19 nt, Human herpesvirus 6B
ucgcagaaucaagaaacac

SEQ ID NO: 2047852 - RNA, 16 nt, Human herpesvirus 6B
cagcaauccaauaauu

SEQ ID NO: 2047853 - RNA, 16 nt, Human herpesvirus 6B
cauggaauucaugccg

SEQ ID NO: 2047854 - RNA, 19 nt, Human herpesvirus 6B
agaucaucgccauagugaa

SEQ ID NO: 2047855 - RNA, 15 nt, Human herpesvirus 6B
ccgcugacagucacc

SEQ ID NO: 2047856 - RNA, 19 nt, Human herpesvirus 6B
uuucuccuuuuuugacguu

SEQ ID NO: 2047857 - RNA, 19 nt, Human herpesvirus 6B
cgucuccgauccgucagga

SEQ ID NO: 2047858 - RNA, 19 nt, Human herpesvirus 6B
aguuuugcagcaucgccuu

SEQ ID NO: 2047859 - RNA, 15 nt, Human herpesvirus 6B
uggagguaaucuaug

SEQ ID NO: 2047860 - RNA, 14 nt, Human herpesvirus 6B
cugacuuagauaug

SEQ ID NO: 2047861 - RNA, 22 nt, Human herpesvirus 6B
cuguucggauccaaugaugaaa

SEQ ID NO: 2047862 - RNA, 21 nt, Human herpesvirus 6B
caaaucuguaagauuaaaugu

SEQ ID NO: 2047863 - RNA, 13 nt, Human herpesvirus 6B
cccgccucucucc

SEQ ID NO: 2047864 - RNA, 17 nt, Human herpesvirus 6B
cucgguauaucuucuug

SEQ ID NO: 2047865 - RNA, 18 nt, Human herpesvirus 6B
gagaaacggagagcgaca

SEQ ID NO: 2047866 - RNA, 16 nt, Human herpesvirus 6B
uuuugcgaagaauugg

SEQ ID NO: 2047867 - RNA, 15 nt, Human herpesvirus 6B
ucgguaaacuucaga

SEQ ID NO: 2047868 - RNA, 16 nt, Human herpesvirus 6B
agggcgggcggacggc

SEQ ID NO: 2047869 - RNA, 15 nt, Human herpesvirus 6B
gggauaaauauuucu

SEQ ID NO: 2047870 - RNA, 20 nt, Human herpesvirus 6B
agaguaccgaauaaaacaag

SEQ ID NO: 2047871 - RNA, 12 nt, Human herpesvirus 6B
auguaaauguua

SEQ ID NO: 2047872 - RNA, 22 nt, Human herpesvirus 6B
uugaaaagguguuguguuugaa

SEQ ID NO: 2047873 - RNA, 15 nt, Human herpesvirus 6B
aaacauaaaauguuu

SEQ ID NO: 2047874 - RNA, 15 nt, Human herpesvirus 6B
cgucugucuguuccu

SEQ ID NO: 2047875 - RNA, 21 nt, Human herpesvirus 6B
uucuggguauuuccuguuuug

SEQ ID NO: 2047876 - RNA, 14 nt, Human herpesvirus 6B
ucauuguaauucca

SEQ ID NO: 2047877 - RNA, 19 nt, Human herpesvirus 6B
gaaaacgcagcaugaugau

SEQ ID NO: 2047878 - RNA, 23 nt, Human herpesvirus 6B
ucgaaaaugcugauuuuaaacua

SEQ ID NO: 2047879 - RNA, 18 nt, Human herpesvirus 6B
gacuuuucugaugacaau

SEQ ID NO: 2047880 - RNA, 19 nt, Human herpesvirus 6B
caagcacaaaaccaggaau

SEQ ID NO: 2047881 - RNA, 16 nt, Human herpesvirus 6B
acaccgaauuuauuca

SEQ ID NO: 2047882 - RNA, 17 nt, Human herpesvirus 6B
uugaacaucuauuauca

SEQ ID NO: 2047883 - RNA, 14 nt, Human herpesvirus 6B
uggggacagacagg

SEQ ID NO: 2047884 - RNA, 17 nt, Human herpesvirus 6B
auauaaagacuuacaga

SEQ ID NO: 2047885 - RNA, 15 nt, Human herpesvirus 6B
acaaauaaaaaauuc

SEQ ID NO: 2047886 - RNA, 22 nt, Human herpesvirus 6B
aauuuguggaacaagagacgaa

SEQ ID NO: 2047887 - RNA, 17 nt, Human herpesvirus 6B
uuacggcgcgaaacaug

SEQ ID NO: 2047888 - RNA, 23 nt, Human herpesvirus 6B
acaaauaauuuuauugacuguga

SEQ ID NO: 2047889 - RNA, 13 nt, Human herpesvirus 6B
uagacacacagaa

SEQ ID NO: 2047890 - RNA, 16 nt, Human herpesvirus 6B
agcgaagucaugaauu

SEQ ID NO: 2047891 - RNA, 15 nt, Human herpesvirus 6B
ugauaaguugucauu

SEQ ID NO: 2047892 - RNA, 12 nt, Human herpesvirus 6B
cccuccccgcac

SEQ ID NO: 2047893 - RNA, 15 nt, Human herpesvirus 6B
cacagcggcagcgga

SEQ ID NO: 2047894 - RNA, 21 nt, Human herpesvirus 6B
ucuacguauaaaaguccucaa

SEQ ID NO: 2047895 - RNA, 17 nt, Human herpesvirus 6B
caagccugcgcguggaa

SEQ ID NO: 2047896 - RNA, 19 nt, Human herpesvirus 6B
agacuuugcugauucuguu

SEQ ID NO: 2047897 - RNA, 15 nt, Human herpesvirus 6B
aacagaugaggagga

SEQ ID NO: 2047898 - RNA, 14 nt, Human herpesvirus 6B
guccaaggauuaug

SEQ ID NO: 2047899 - RNA, 23 nt, Human herpesvirus 6B
gcucucgaugaaaguuuuggaaa

SEQ ID NO: 2047900 - RNA, 13 nt, Human herpesvirus 6B
aaaucucuauugu

SEQ ID NO: 2047901 - RNA, 15 nt, Human herpesvirus 6B
acacgucccuucucc

SEQ ID NO: 2047902 - RNA, 16 nt, Human herpesvirus 6B
auugcugaguggacau

SEQ ID NO: 2047903 - RNA, 22 nt, Human herpesvirus 6B
cggaagacguuucuauggauau

SEQ ID NO: 2047904 - RNA, 14 nt, Human herpesvirus 6B
guacgcgccacagc

SEQ ID NO: 2047905 - RNA, 18 nt, Human herpesvirus 6B
agaugcaaccgaugacaa

SEQ ID NO: 2047906 - RNA, 17 nt, Human herpesvirus 6B
ucauaauuugccugagu

SEQ ID NO: 2047907 - RNA, 21 nt, Human herpesvirus 6B
gaaacucuuauggcaagcacu

SEQ ID NO: 2047908 - RNA, 15 nt, Human herpesvirus 6B
gaccaacaugccgau

SEQ ID NO: 2047909 - RNA, 13 nt, Human herpesvirus 6B
gugccguggcaga

SEQ ID NO: 2047910 - RNA, 22 nt, Human herpesvirus 6B
cgccguccauuuaaccuccggc

SEQ ID NO: 2047911 - RNA, 14 nt, Human herpesvirus 6B
ggcggcgcgcgccg

SEQ ID NO: 2047912 - RNA, 15 nt, Human herpesvirus 6B
aguuuuggaaaaugu

SEQ ID NO: 2047913 - RNA, 20 nt, Human herpesvirus 6B
uugcaguggcgcgcguuuuu

SEQ ID NO: 2047914 - RNA, 20 nt, Human herpesvirus 6B
uucaccccccucuugcagug

SEQ ID NO: 2047915 - RNA, 21 nt, Human herpesvirus 6B
ugcaaaaacaaaugaaagucu

SEQ ID NO: 2047916 - RNA, 13 nt, Human herpesvirus 6B
gcgacaggagaua

SEQ ID NO: 2047917 - RNA, 18 nt, Human herpesvirus 6B
aacguccgugaugauuca

SEQ ID NO: 2047918 - RNA, 15 nt, Human herpesvirus 6B
gagcaaagaaaugac

SEQ ID NO: 2047919 - RNA, 20 nt, Human herpesvirus 6B
aggagugaaacgauguguua

SEQ ID NO: 2047920 - RNA, 22 nt, Human herpesvirus 6B
uuaaaagggaagucaaggaaac

SEQ ID NO: 2047921 - RNA, 22 nt, Human herpesvirus 6B
guuaacggagagucuucauccu

SEQ ID NO: 2047922 - RNA, 15 nt, Human herpesvirus 6B
uaugcaacugcauuu

SEQ ID NO: 2047923 - RNA, 17 nt, Human herpesvirus 6B
gucaagguugucagauu

SEQ ID NO: 2047924 - RNA, 14 nt, Human herpesvirus 6B
ccgaaaagaaagaa

SEQ ID NO: 2047925 - RNA, 15 nt, Human herpesvirus 6B
ugauauggagcagau

SEQ ID NO: 2047926 - RNA, 21 nt, Human herpesvirus 6B
aggguaacgcaggagaaacuu

SEQ ID NO: 2047927 - RNA, 16 nt, Human herpesvirus 6B
ucagauuucuguaguu

SEQ ID NO: 2047928 - RNA, 23 nt, Human herpesvirus 6B
gcucgggggacggagaggaagcc

SEQ ID NO: 2047929 - RNA, 17 nt, Human herpesvirus 6B
aggugauuugaacagag

SEQ ID NO: 2047930 - RNA, 20 nt, Human herpesvirus 6B
guucaggucaagcgccagga

SEQ ID NO: 2047931 - RNA, 22 nt, Human herpesvirus 6B
uaauguaucaaaguguauacau

SEQ ID NO: 2047932 - RNA, 20 nt, Human herpesvirus 6B
uuacgacacgcucguauuuu

SEQ ID NO: 2047933 - RNA, 20 nt, Human herpesvirus 6B
aacuuuagacagcugcauua

SEQ ID NO: 2047934 - RNA, 13 nt, Human herpesvirus 6B
cucagagaaaguu

SEQ ID NO: 2047935 - RNA, 23 nt, Human herpesvirus 6B
uguggcuauuugacaauaaacau

SEQ ID NO: 2047936 - RNA, 13 nt, Human herpesvirus 6B
cggcacgcgccgu

SEQ ID NO: 2047937 - RNA, 19 nt, Human herpesvirus 6B
caucgucuccuauauuuuc

SEQ ID NO: 2047938 - RNA, 20 nt, Human herpesvirus 6B
uucuauuaaaaagacuaaag

SEQ ID NO: 2047939 - RNA, 16 nt, Human herpesvirus 6B
cugguuugcuuuggau

SEQ ID NO: 2047940 - RNA, 22 nt, Human herpesvirus 6B
gugaggugauuugaacagagau

SEQ ID NO: 2047941 - RNA, 16 nt, Human herpesvirus 6B
ucaacacaccugccua

SEQ ID NO: 2047942 - RNA, 19 nt, Human herpesvirus 6B
cuucauccucgaagaauug

SEQ ID NO: 2047943 - RNA, 13 nt, Human herpesvirus 6B
gaagauauuuccc

SEQ ID NO: 2047944 - RNA, 23 nt, Human herpesvirus 6B
aaaggaguuugcauuuggugauu

SEQ ID NO: 2047945 - RNA, 16 nt, Human herpesvirus 6B
agccggagcccugaga

SEQ ID NO: 2047946 - RNA, 14 nt, Human herpesvirus 6B
aucggaagaggaag

SEQ ID NO: 2047947 - RNA, 21 nt, Human herpesvirus 6B
agaacagaggaagaaaggagu

SEQ ID NO: 2047948 - RNA, 20 nt, Human herpesvirus 6B
gcaccggcgacacgcgcgga

SEQ ID NO: 2047949 - RNA, 14 nt, Human herpesvirus 6B
uaauggagagaaau

SEQ ID NO: 2047950 - RNA, 17 nt, Human herpesvirus 6B
uggaaaagaucaacaaa

SEQ ID NO: 2047951 - RNA, 20 nt, Human herpesvirus 6B
acucgcuuacgaucuuuacg

SEQ ID NO: 2047952 - RNA, 17 nt, Human herpesvirus 6B
ucgaaauauaaaaccaa

SEQ ID NO: 2047953 - RNA, 18 nt, Human herpesvirus 6B
cggaagacgaugcagggu

SEQ ID NO: 2047954 - RNA, 16 nt, Human herpesvirus 6B
uuaacugggaaaucug

SEQ ID NO: 2047955 - RNA, 19 nt, Human herpesvirus 6B
acuaucaaaauaaaaauuu

SEQ ID NO: 2047956 - RNA, 15 nt, Human herpesvirus 6B
acucuacuaaaagac

SEQ ID NO: 2047957 - RNA, 17 nt, Human herpesvirus 6B
uacaucccgaguauaac

SEQ ID NO: 2047958 - RNA, 20 nt, Human herpesvirus 6B
cgacucuuuccgaugugucu

SEQ ID NO: 2047959 - RNA, 19 nt, Human herpesvirus 6B
auucuuguucgggccaagg

SEQ ID NO: 2047960 - RNA, 13 nt, Human herpesvirus 6B
guucguuaaaaac

SEQ ID NO: 2047961 - RNA, 15 nt, Human herpesvirus 6B
gcaacgcagauuuua

SEQ ID NO: 2047962 - RNA, 20 nt, Human herpesvirus 6B
uaaaaaagauuuuguuucua

SEQ ID NO: 2047963 - RNA, 17 nt, Human herpesvirus 6B
guccaguaagacagcac

SEQ ID NO: 2047964 - RNA, 15 nt, Human herpesvirus 6B
agagcggagaggcgc

SEQ ID NO: 2047965 - RNA, 15 nt, Human herpesvirus 6B
aggcgaacuaagaaa

SEQ ID NO: 2047966 - RNA, 14 nt, Human herpesvirus 6B
uuuaggacaugugg

SEQ ID NO: 2047967 - RNA, 14 nt, Human herpesvirus 6B
cagaaucuucuuug

SEQ ID NO: 2047968 - RNA, 19 nt, Human herpesvirus 6B
uuuauguugugaucaagug

SEQ ID NO: 2047969 - RNA, 20 nt, Human herpesvirus 6B
agcucuguucucucccacuc

SEQ ID NO: 2047970 - RNA, 14 nt, Human herpesvirus 6B
cagaugaggaggag

SEQ ID NO: 2047971 - RNA, 21 nt, Human herpesvirus 6B
agagguuuuaccuguugguua

SEQ ID NO: 2047972 - RNA, 24 nt, Human herpesvirus 6B
gccgucugucuguuccucagauuc

SEQ ID NO: 2047973 - RNA, 18 nt, Human herpesvirus 6B
augcagaucgagaauaau

SEQ ID NO: 2047974 - RNA, 22 nt, Human herpesvirus 6B
uguauuaauuuuuuguuucuga

SEQ ID NO: 2047975 - RNA, 12 nt, Human herpesvirus 6B
cgcccguucccg

SEQ ID NO: 2047976 - RNA, 15 nt, Human herpesvirus 6B
gagaaaggaagaaau

SEQ ID NO: 2047977 - RNA, 20 nt, Human herpesvirus 6B
ucuccugugcguccuccucg

SEQ ID NO: 2047978 - RNA, 15 nt, Human herpesvirus 6B
auuucuaucuacaaa

SEQ ID NO: 2047979 - RNA, 15 nt, Human herpesvirus 6B
caggguguggccggc

SEQ ID NO: 2047980 - RNA, 15 nt, Human herpesvirus 6B
ucaccccccucuugc

SEQ ID NO: 2047981 - RNA, 17 nt, Human herpesvirus 6B
uaguugaugcuguugcu

SEQ ID NO: 2047982 - RNA, 18 nt, Human herpesvirus 6B
guacuacguguugcuuuu

SEQ ID NO: 2047983 - RNA, 16 nt, Human herpesvirus 6B
cagauaauaaauaucc

SEQ ID NO: 2047984 - RNA, 21 nt, Human herpesvirus 6B
gauggaucggaagacguuucu

SEQ ID NO: 2047985 - RNA, 20 nt, Human herpesvirus 6B
aauaagccgaguuugauaau

SEQ ID NO: 2047986 - RNA, 22 nt, Human herpesvirus 6B
gucaagggcaagguucucagca

SEQ ID NO: 2047987 - RNA, 18 nt, Human herpesvirus 6B
aguuuugugauccuguaa

SEQ ID NO: 2047988 - RNA, 13 nt, Human herpesvirus 6B
agaaguuacaaga

SEQ ID NO: 2047989 - RNA, 14 nt, Human herpesvirus 6B
auuauaaugaugca

SEQ ID NO: 2047990 - RNA, 20 nt, Human herpesvirus 6B
cuccgcgggaccuggcgggc

SEQ ID NO: 2047991 - RNA, 22 nt, Human herpesvirus 6B
auacaccggagaccgagcggcg

SEQ ID NO: 2047992 - RNA, 17 nt, Human herpesvirus 6B
auaauuuuauugacugu

SEQ ID NO: 2047993 - RNA, 19 nt, Human herpesvirus 6B
agauuccgucaucuagaga

SEQ ID NO: 2047994 - RNA, 18 nt, Human herpesvirus 6B
gcaauuuaaacagaaauu

SEQ ID NO: 2047995 - RNA, 19 nt, Human herpesvirus 6B
gcagauuuacgacacgcuc

SEQ ID NO: 2047996 - RNA, 15 nt, Human herpesvirus 6B
ugcuuuuaguuucaa

SEQ ID NO: 2047997 - RNA, 12 nt, Human herpesvirus 6B
agagaaggaaaa

SEQ ID NO: 2047998 - RNA, 22 nt, Human herpesvirus 6B
cagauuuuacuggugauuuaaa

SEQ ID NO: 2047999 - RNA, 17 nt, Human herpesvirus 6B
gucgcagaaucaagaaa

SEQ ID NO: 2048000 - RNA, 13 nt, Human herpesvirus 6B
acauccaaaauac

SEQ ID NO: 2048001 - RNA, 13 nt, Human herpesvirus 6B
cuuugcggugcau

SEQ ID NO: 2048002 - RNA, 24 nt, Human herpesvirus 6B
gacugcggggcgucgggcgacggg

SEQ ID NO: 2048003 - RNA, 23 nt, Human herpesvirus 6B
caaacguguauuaagaaugaauu

SEQ ID NO: 2048004 - RNA, 13 nt, Human herpesvirus 6B
ggggggggggccc

SEQ ID NO: 2048005 - RNA, 13 nt, Human herpesvirus 6B
uuuauaaacuuaa

SEQ ID NO: 2048006 - RNA, 23 nt, Human herpesvirus 6B
agcgcacuauauacuauagaagc

SEQ ID NO: 2048007 - RNA, 14 nt, Human herpesvirus 6B
ucggggggagacag

SEQ ID NO: 2048008 - RNA, 21 nt, Human herpesvirus 6B
gccucccuccguuaggaucag

SEQ ID NO: 2048009 - RNA, 22 nt, Human herpesvirus 6B
aggcguagaccuuugcgcaggc

SEQ ID NO: 2048010 - RNA, 11 nt, Human herpesvirus 6B
augauagaaga

SEQ ID NO: 2048011 - RNA, 22 nt, Human herpesvirus 6B
ucugcaucaagcuucacgugau

SEQ ID NO: 2048012 - RNA, 22 nt, Human herpesvirus 6B
augagaucguccggugcauaua

SEQ ID NO: 2048013 - RNA, 22 nt, Human herpesvirus 6B
gaacuggaccagugauucugcu

SEQ ID NO: 2048014 - RNA, 19 nt, Human herpesvirus 6B
ggcgcaaaccaagguguuu

SEQ ID NO: 2048015 - RNA, 20 nt, Human herpesvirus 6B
cuuauugaggaaaugcagca

SEQ ID NO: 2048016 - RNA, 22 nt, Human herpesvirus 6B
cgcucgggggacggagaggaag

SEQ ID NO: 2048017 - RNA, 15 nt, Human herpesvirus 6B
agccggagcccugag

SEQ ID NO: 2048018 - RNA, 14 nt, Human herpesvirus 6B
acacgcccccaccu

SEQ ID NO: 2048019 - RNA, 23 nt, Human herpesvirus 6B
ucuaaauggcucguucagcagua

SEQ ID NO: 2048020 - RNA, 19 nt, Human herpesvirus 6B
uaauagaaaaaucaucaaa

SEQ ID NO: 2048021 - RNA, 19 nt, Human herpesvirus 6B
uuuacucgugugucucugu

SEQ ID NO: 2048022 - RNA, 12 nt, Human herpesvirus 6B
aaucaaggaaga

SEQ ID NO: 2048023 - RNA, 12 nt, Human herpesvirus 6B
uuuuucuguaag

SEQ ID NO: 2048024 - RNA, 14 nt, Human herpesvirus 6B
aaaauauuggauuu

SEQ ID NO: 2048025 - RNA, 21 nt, Human herpesvirus 6B
augagaauguucuucugaaau

SEQ ID NO: 2048026 - RNA, 22 nt, Human herpesvirus 6B
gagacuuuguguaaccugagaa

SEQ ID NO: 2048027 - RNA, 14 nt, Human herpesvirus 6B
auaguuauucagau

SEQ ID NO: 2048028 - RNA, 14 nt, Human herpesvirus 6B
uaauucaaauguag

SEQ ID NO: 2048029 - RNA, 18 nt, Human herpesvirus 6B
guaaauuuguaucucaga

SEQ ID NO: 2048030 - RNA, 20 nt, Human herpesvirus 6B
acaaaauuuuuuauggucug

SEQ ID NO: 2048031 - RNA, 17 nt, Human herpesvirus 6B
ccucacccugaagggac

SEQ ID NO: 2048032 - RNA, 15 nt, Human herpesvirus 6B
gggacuccgagccgg

SEQ ID NO: 2048033 - RNA, 15 nt, Human herpesvirus 6B
uucaaaaucugcuaa

SEQ ID NO: 2048034 - RNA, 19 nt, Human herpesvirus 6B
auguaaacacgaaacugcu

SEQ ID NO: 2048035 - RNA, 21 nt, Human herpesvirus 6B
ucuguggcauauuuaaaccag

SEQ ID NO: 2048036 - RNA, 16 nt, Human herpesvirus 6B
uuugcagucgguauuu

SEQ ID NO: 2048037 - RNA, 13 nt, Human herpesvirus 6B
augguuaaggaaa

SEQ ID NO: 2048038 - RNA, 18 nt, Human herpesvirus 6B
agggaagccagccgcccu

SEQ ID NO: 2048039 - RNA, 18 nt, Human herpesvirus 6B
uucaaccuguuuccagaa

SEQ ID NO: 2048040 - RNA, 23 nt, Human herpesvirus 6B
uaauuucagcuuugaacaucuau

SEQ ID NO: 2048041 - RNA, 18 nt, Human herpesvirus 6B
aguugggacuuggaaacg

SEQ ID NO: 2048042 - RNA, 15 nt, Human herpesvirus 6B
cccucgucuguugcu

SEQ ID NO: 2048043 - RNA, 21 nt, Human herpesvirus 6B
aacgagaauuccaaggcucug

SEQ ID NO: 2048044 - RNA, 22 nt, Human herpesvirus 6B
uggccuauugcauggcauguga

SEQ ID NO: 2048045 - RNA, 16 nt, Human herpesvirus 6B
aaucaaauucaaacuu

SEQ ID NO: 2048046 - RNA, 17 nt, Human herpesvirus 6B
caacaacccuuauuuua

SEQ ID NO: 2048047 - RNA, 23 nt, Human herpesvirus 6B
aagugccgugagugcuauuugca

SEQ ID NO: 2048048 - RNA, 23 nt, Human herpesvirus 6B
uggauuccauccgcuaagagauu

SEQ ID NO: 2048049 - RNA, 13 nt, Human herpesvirus 6B
gagagcaggagca

SEQ ID NO: 2048050 - RNA, 18 nt, Human herpesvirus 6B
gccgccuucucugucgcu

SEQ ID NO: 2048051 - RNA, 14 nt, Human herpesvirus 6B
cuagauaacucaga

SEQ ID NO: 2048052 - RNA, 14 nt, Human herpesvirus 6B
aaggaugguagggu

SEQ ID NO: 2048053 - RNA, 17 nt, Human herpesvirus 6B
cggcgcugggcuccuca

SEQ ID NO: 2048054 - RNA, 18 nt, Human herpesvirus 6B
cgguguccucguccgucc

SEQ ID NO: 2048055 - RNA, 11 nt, Human herpesvirus 6B
cuauucuaauu

SEQ ID NO: 2048056 - RNA, 12 nt, Human herpesvirus 6B
uggacaggagca

SEQ ID NO: 2048057 - RNA, 14 nt, Human herpesvirus 6B
gaaucggaagagga

SEQ ID NO: 2048058 - RNA, 22 nt, Human herpesvirus 6B
gacggaauauauagaagaagaa

SEQ ID NO: 2048059 - RNA, 15 nt, Human herpesvirus 6B
aagaucuacagagua

SEQ ID NO: 2048060 - RNA, 16 nt, Human herpesvirus 6B
uggaaguguaaauguc

SEQ ID NO: 2048061 - RNA, 23 nt, Human herpesvirus 6B
caacugagagacggaucugccgc

SEQ ID NO: 2048062 - RNA, 16 nt, Human herpesvirus 6B
gcgcggggcgcaccgg

SEQ ID NO: 2048063 - RNA, 17 nt, Human herpesvirus 6B
cuuauggcaagcacuga

SEQ ID NO: 2048064 - RNA, 15 nt, Human herpesvirus 6B
aucggcccuugguga

SEQ ID NO: 2048065 - RNA, 12 nt, Human herpesvirus 6B
gaucugcuuugu

SEQ ID NO: 2048066 - RNA, 13 nt, Human herpesvirus 6B
gauuucuguaguu

SEQ ID NO: 2048067 - RNA, 17 nt, Human herpesvirus 6B
uuuuuggcauauacaaa

SEQ ID NO: 2048068 - RNA, 14 nt, Human herpesvirus 6B
uccucacccugaag

SEQ ID NO: 2048069 - RNA, 13 nt, Human herpesvirus 6B
auguguaagaaaa

SEQ ID NO: 2048070 - RNA, 21 nt, Human herpesvirus 6B
ggcuugcugucgcccgccucu

SEQ ID NO: 2048071 - RNA, 21 nt, Human herpesvirus 6B
cauacgacugacgauuucauu

SEQ ID NO: 2048072 - RNA, 17 nt, Human herpesvirus 6B
gucacuuauauaaaaua

SEQ ID NO: 2048073 - RNA, 23 nt, Human herpesvirus 6B
ggcggagcacccggggaggcgac

SEQ ID NO: 2048074 - RNA, 16 nt, Human herpesvirus 6B
ccuacggccagagaca

SEQ ID NO: 2048075 - RNA, 22 nt, Human herpesvirus 6B
uugguuguuuuucuaaacugaa

SEQ ID NO: 2048076 - RNA, 22 nt, Human herpesvirus 6B
ccaacggucaagggugaugagg

SEQ ID NO: 2048077 - RNA, 16 nt, Human herpesvirus 6B
gaguaugacagaaauc

SEQ ID NO: 2048078 - RNA, 16 nt, Human herpesvirus 6B
uguuagauaaaaugaa

SEQ ID NO: 2048079 - RNA, 15 nt, Human herpesvirus 6B
agaugcaaaacuguu

SEQ ID NO: 2048080 - RNA, 19 nt, Human herpesvirus 6B
cuuagacacuguaauuugg

SEQ ID NO: 2048081 - RNA, 14 nt, Human herpesvirus 6B
acuguucuuucaaa

SEQ ID NO: 2048082 - RNA, 13 nt, Human herpesvirus 6B
ugcaugcauugcg

SEQ ID NO: 2048083 - RNA, 13 nt, Human herpesvirus 6B
guuucuuuggaaa

SEQ ID NO: 2048084 - RNA, 16 nt, Human herpesvirus 6B
cuacuguguauugugu

SEQ ID NO: 2048085 - RNA, 21 nt, Human herpesvirus 6B
ccauagaguuucgagaaagag

SEQ ID NO: 2048086 - RNA, 16 nt, Human herpesvirus 6B
cacccugaagggaccg

SEQ ID NO: 2048087 - RNA, 13 nt, Human herpesvirus 6B
guucuugagcagg

SEQ ID NO: 2048088 - RNA, 19 nt, Human herpesvirus 6B
uguugcuguaguugaugcu

SEQ ID NO: 2048089 - RNA, 14 nt, Human herpesvirus 6B
ccagaauauaucga

SEQ ID NO: 2048090 - RNA, 21 nt, Human herpesvirus 6B
ccgagacggugauguugcgau

SEQ ID NO: 2048091 - RNA, 15 nt, Human herpesvirus 6B
ggcugggcgcagaag

SEQ ID NO: 2048092 - RNA, 19 nt, Human herpesvirus 6B
gagcaaccgcaguuccugu

SEQ ID NO: 2048093 - RNA, 15 nt, Human herpesvirus 6B
cucuaaucaagaaac

SEQ ID NO: 2048094 - RNA, 15 nt, Human herpesvirus 6B
uggauuauguuaauu

SEQ ID NO: 2048095 - RNA, 23 nt, Human herpesvirus 6B
aaacggagacugcacagaaucga

SEQ ID NO: 2048096 - RNA, 16 nt, Human herpesvirus 6B
acauucguauacuucc

SEQ ID NO: 2048097 - RNA, 18 nt, Human herpesvirus 6B
caaggguaccaaauguuc

SEQ ID NO: 2048098 - RNA, 21 nt, Human herpesvirus 6B
gccgucgucgcucucccucuu

SEQ ID NO: 2048099 - RNA, 23 nt, Human herpesvirus 6B
ccagcaauuucggcaagaaagcc

SEQ ID NO: 2048100 - RNA, 17 nt, Human herpesvirus 6B
aaaaaagauauauuggu

SEQ ID NO: 2048101 - RNA, 24 nt, Human herpesvirus 6B
cuguuccccguccucgugcucucc

SEQ ID NO: 2048102 - RNA, 21 nt, Human herpesvirus 6B
guuuauuuucucgacaucgcu

SEQ ID NO: 2048103 - RNA, 17 nt, Human herpesvirus 6B
auauggaucaaucucca

SEQ ID NO: 2048104 - RNA, 18 nt, Human herpesvirus 6B
cguuagacaaaaacaugu

SEQ ID NO: 2048105 - RNA, 21 nt, Human herpesvirus 6B
aaaauguuuccaugacuguga

SEQ ID NO: 2048106 - RNA, 18 nt, Human herpesvirus 6B
cacacuggcgaaggcccg

SEQ ID NO: 2048107 - RNA, 15 nt, Human herpesvirus 6B
gucacacgucccuuc

SEQ ID NO: 2048108 - RNA, 22 nt, Human herpesvirus 6B
gcuuaggauguaaaugcagaca

SEQ ID NO: 2048109 - RNA, 13 nt, Human herpesvirus 6B
aacgcaaagggaa

SEQ ID NO: 2048110 - RNA, 14 nt, Human herpesvirus 6B
aagaaucugccgau

SEQ ID NO: 2048111 - RNA, 15 nt, Human herpesvirus 6B
ugauuccuucaaugu

SEQ ID NO: 2048112 - RNA, 15 nt, Human herpesvirus 6B
augauucaauagcag

SEQ ID NO: 2048113 - RNA, 23 nt, Human herpesvirus 6B
cugaauggaguaaauuaaaguuu

SEQ ID NO: 2048114 - RNA, 17 nt, Human herpesvirus 6B
auugaauuuauaucaca

SEQ ID NO: 2048115 - RNA, 14 nt, Human herpesvirus 6B
gcugguuugcuuug

SEQ ID NO: 2048116 - RNA, 13 nt, Human herpesvirus 6B
accaagaaaucac

SEQ ID NO: 2048117 - RNA, 17 nt, Human herpesvirus 6B
aguugcacauguuucug

SEQ ID NO: 2048118 - RNA, 20 nt, Human herpesvirus 6B
uugucuuuguccuauguuaa

SEQ ID NO: 2048119 - RNA, 13 nt, Human herpesvirus 6B
gcucgggaucacg

SEQ ID NO: 2048120 - RNA, 22 nt, Human herpesvirus 6B
uaucaagcucgaguucgagaag

SEQ ID NO: 2048121 - RNA, 16 nt, Human herpesvirus 6B
cugagagcaggagcag

SEQ ID NO: 2048122 - RNA, 19 nt, Human herpesvirus 6B
caaagaugacaaauuuuca

SEQ ID NO: 2048123 - RNA, 20 nt, Human herpesvirus 6B
gaagacauuaauacugguuu

SEQ ID NO: 2048124 - RNA, 18 nt, Human herpesvirus 6B
accagcucuguucucucc

SEQ ID NO: 2048125 - RNA, 22 nt, Human herpesvirus 6B
cgcugggcuccucacccugaag

SEQ ID NO: 2048126 - RNA, 12 nt, Human herpesvirus 6B
uucacagcaguu

SEQ ID NO: 2048127 - RNA, 14 nt, Human herpesvirus 6B
gccaggccgcgucg

SEQ ID NO: 2048128 - RNA, 15 nt, Human herpesvirus 6B
cgaaucggaagagga

SEQ ID NO: 2048129 - RNA, 17 nt, Human herpesvirus 6B
gcaugcgacagacaguc

SEQ ID NO: 2048130 - RNA, 16 nt, Human herpesvirus 6B
agcaggagaaaaauuu

SEQ ID NO: 2048131 - RNA, 14 nt, Human herpesvirus 6B
gucugagcagaggu

SEQ ID NO: 2048132 - RNA, 20 nt, Human herpesvirus 6B
cgcauuucucuacaugccac

SEQ ID NO: 2048133 - RNA, 21 nt, Human herpesvirus 6B
ccugagaauuuucgaaaagau

SEQ ID NO: 2048134 - RNA, 16 nt, Human herpesvirus 6B
ugauuuuccaaagauu

SEQ ID NO: 2048135 - RNA, 23 nt, Human herpesvirus 6B
cacagcaugaacucucacggcca

SEQ ID NO: 2048136 - RNA, 20 nt, Human herpesvirus 6B
cacggagugcgacaggagau

SEQ ID NO: 2048137 - RNA, 21 nt, Human herpesvirus 6B
uaugagaauguucuucugaaa

SEQ ID NO: 2048138 - RNA, 13 nt, Human herpesvirus 6B
gcuccgcgcggcc

SEQ ID NO: 2048139 - RNA, 13 nt, Human herpesvirus 6B
auauuuuuacugc

SEQ ID NO: 2048140 - RNA, 15 nt, Human herpesvirus 6B
gaagaacaugcagaa

SEQ ID NO: 2048141 - RNA, 15 nt, Human herpesvirus 6B
uguuuaacuaauaaa

SEQ ID NO: 2048142 - RNA, 14 nt, Human herpesvirus 6B
uccgaccagcacca

SEQ ID NO: 2048143 - RNA, 16 nt, Human herpesvirus 6B
auagaaagaaccagug

SEQ ID NO: 2048144 - RNA, 16 nt, Human herpesvirus 6B
aaugguuucaaagucg

SEQ ID NO: 2048145 - RNA, 14 nt, Human herpesvirus 6B
caagcgccaggacg

SEQ ID NO: 2048146 - RNA, 19 nt, Human herpesvirus 6B
gugcuuguuuugguggaca

SEQ ID NO: 2048147 - RNA, 16 nt, Human herpesvirus 6B
gauuguuacuagugau

SEQ ID NO: 2048148 - RNA, 22 nt, Human herpesvirus 6B
aaauccuagaguuguuuuuagu

SEQ ID NO: 2048149 - RNA, 19 nt, Human herpesvirus 6B
gaaaaaucucuauuguuua

SEQ ID NO: 2048150 - RNA, 15 nt, Human herpesvirus 6B
agguggcugcauaua

SEQ ID NO: 2048151 - RNA, 16 nt, Human herpesvirus 6B
uuuuuaauccauauuu

SEQ ID NO: 2048152 - RNA, 17 nt, Human herpesvirus 6B
aaguuagaguuggauuu

SEQ ID NO: 2048153 - RNA, 13 nt, Human herpesvirus 6B
cuauguuaacauu

SEQ ID NO: 2048154 - RNA, 10 nt, Human herpesvirus 6B
ucaaggaaac

SEQ ID NO: 2048155 - RNA, 14 nt, Human herpesvirus 6B
cgugguugucuuug

SEQ ID NO: 2048156 - RNA, 19 nt, Human herpesvirus 6B
ccugaaaccccacaaagcc

SEQ ID NO: 2048157 - RNA, 23 nt, Human herpesvirus 6B
agaacugucgcaucaauuacucg

SEQ ID NO: 2048158 - RNA, 14 nt, Human herpesvirus 6B
ccgccucucuccgc

SEQ ID NO: 2048159 - RNA, 21 nt, Human herpesvirus 6B
uguacgccauacgggaaaaga

SEQ ID NO: 2048160 - RNA, 22 nt, Human herpesvirus 6B
ucugauuauuaucacaaaguuu

SEQ ID NO: 2048161 - RNA, 12 nt, Human herpesvirus 6B
guguugaagaac

SEQ ID NO: 2048162 - RNA, 15 nt, Human herpesvirus 6B
gucaagcgccaggac

SEQ ID NO: 2048163 - RNA, 14 nt, Human herpesvirus 6B
augacuuuucugau

SEQ ID NO: 2048164 - RNA, 12 nt, Human herpesvirus 6B
aauaauuacaaa

SEQ ID NO: 2048165 - RNA, 19 nt, Human herpesvirus 6B
cucugcaacuuuauuugaa

SEQ ID NO: 2048166 - RNA, 13 nt, Human herpesvirus 6B
agauccaauggau

SEQ ID NO: 2048167 - RNA, 17 nt, Human herpesvirus 6B
uaaauaucaugauaaau

SEQ ID NO: 2048168 - RNA, 18 nt, Human herpesvirus 6B
aacugauacuguucaagu

SEQ ID NO: 2048169 - RNA, 21 nt, Human herpesvirus 6B
cuguuaauuccuuguguugaa

SEQ ID NO: 2048170 - RNA, 17 nt, Human herpesvirus 6B
uuaaacucgacuucuuu

SEQ ID NO: 2048171 - RNA, 14 nt, Human herpesvirus 6B
caacgcuccuccca

SEQ ID NO: 2048172 - RNA, 17 nt, Human herpesvirus 6B
auuuaacauccaaaaua

SEQ ID NO: 2048173 - RNA, 20 nt, Human herpesvirus 6B
uaaaacucuaaaagcugcua

SEQ ID NO: 2048174 - RNA, 15 nt, Human herpesvirus 6B
aacucaaagaaagcu

SEQ ID NO: 2048175 - RNA, 13 nt, Human herpesvirus 6B
auaagacuuagcu

SEQ ID NO: 2048176 - RNA, 13 nt, Human herpesvirus 6B
ccaaaagagaaag

SEQ ID NO: 2048177 - RNA, 21 nt, Human herpesvirus 6B
cugaacuguuuccagagcaca

SEQ ID NO: 2048178 - RNA, 19 nt, Human herpesvirus 6B
ucagcuucuucuacuuuau

SEQ ID NO: 2048179 - RNA, 20 nt, Human herpesvirus 6B
uggaugucaagucuagacau

SEQ ID NO: 2048180 - RNA, 18 nt, Human herpesvirus 6B
ggacagaaaugagcaaca

SEQ ID NO: 2048181 - RNA, 14 nt, Human herpesvirus 6B
cuacgguaaucguu

SEQ ID NO: 2048182 - RNA, 20 nt, Human herpesvirus 6B
acaccucauaucaaacaacu

SEQ ID NO: 2048183 - RNA, 16 nt, Human herpesvirus 6B
cagaggaagaaaggag

SEQ ID NO: 2048184 - RNA, 22 nt, Human herpesvirus 6B
aaacuggauacuauugcuaaga

SEQ ID NO: 2048185 - RNA, 19 nt, Human herpesvirus 6B
caagguaaaggaaggcgua

SEQ ID NO: 2048186 - RNA, 18 nt, Human herpesvirus 6B
uacaugaaaacauucaga

SEQ ID NO: 2048187 - RNA, 11 nt, Human herpesvirus 6B
aucggaagagg

SEQ ID NO: 2048188 - RNA, 16 nt, Human herpesvirus 6B
caauaucguccucaga

SEQ ID NO: 2048189 - RNA, 19 nt, Human herpesvirus 6B
gggcauagaaagcggccag

SEQ ID NO: 2048190 - RNA, 20 nt, Human herpesvirus 6B
uccucguccguccccgccgc

SEQ ID NO: 2048191 - RNA, 15 nt, Human herpesvirus 6B
uagaagaagaaauac

SEQ ID NO: 2048192 - RNA, 14 nt, Human herpesvirus 6B
cuacaugccacaga

SEQ ID NO: 2048193 - RNA, 14 nt, Human herpesvirus 6B
uaaugaauuucaau

SEQ ID NO: 2048194 - RNA, 21 nt, Human herpesvirus 6B
aaauauuggauuuuacgcaaa

SEQ ID NO: 2048195 - RNA, 19 nt, Human herpesvirus 6B
aaagucguuacaguaaaaa

SEQ ID NO: 2048196 - RNA, 18 nt, Human herpesvirus 6B
aaaggucagaugcaaaaa

SEQ ID NO: 2048197 - RNA, 12 nt, Human herpesvirus 6B
aaagguguuaaa

SEQ ID NO: 2048198 - RNA, 22 nt, Human herpesvirus 6B
aaagauggaaaauuuauaaaaa

SEQ ID NO: 2048199 - RNA, 21 nt, Human herpesvirus 6B
auggaucggaagacguuucua

SEQ ID NO: 2048200 - RNA, 14 nt, Human herpesvirus 6B
auggcguuccgaau

SEQ ID NO: 2048201 - RNA, 15 nt, Human herpesvirus 6B
caaaaaauguuaaaa

SEQ ID NO: 2048202 - RNA, 20 nt, Human herpesvirus 6B
caaagauagacagugaaaaa

SEQ ID NO: 2048203 - RNA, 19 nt, Human herpesvirus 6B
caagccgugcuuccagaga

SEQ ID NO: 2048204 - RNA, 20 nt, Human herpesvirus 6B
caagucgccucacuguaaaa

SEQ ID NO: 2048205 - RNA, 18 nt, Human herpesvirus 6B
ccaaaguaggcacacaug

SEQ ID NO: 2048206 - RNA, 11 nt, Human herpesvirus 6B
cauguuuacug

SEQ ID NO: 2048207 - RNA, 19 nt, Human herpesvirus 6B
ccauaccgggacagcaccc

SEQ ID NO: 2048208 - RNA, 20 nt, Human herpesvirus 6B
ucaguguuugccaaccaaau

SEQ ID NO: 2048209 - RNA, 19 nt, Human herpesvirus 6B
uccaaguuuuuaugcaacg

SEQ ID NO: 2048210 - RNA, 22 nt, Human herpesvirus 6B
ggggacggacagagcggagagg

SEQ ID NO: 2048211 - RNA, 19 nt, Human herpesvirus 6B
ggggaggaggaggaagagg

SEQ ID NO: 2048212 - RNA, 17 nt, Human herpesvirus 6B
acgcguguuuuggaauu

SEQ ID NO: 2048213 - RNA, 16 nt, Human herpesvirus 6B
agacaagggugugaaa

SEQ ID NO: 2048214 - RNA, 22 nt, Human herpesvirus 6B
agacaugagcgagaauguugaa

SEQ ID NO: 2048215 - RNA, 21 nt, Human herpesvirus 6B
acuuuguguaaccugagaauu

SEQ ID NO: 2048216 - RNA, 17 nt, Human herpesvirus 6B
ccgcaucgcaccgcaga

SEQ ID NO: 2048217 - RNA, 19 nt, Human herpesvirus 6B
cagaaguuauagugaaaaa

SEQ ID NO: 2048218 - RNA, 19 nt, Human herpesvirus 6B
aagacuuagcuagacgugu

SEQ ID NO: 2048219 - RNA, 19 nt, Human herpesvirus 6B
aagaugucgcuguuuuuca

SEQ ID NO: 2048220 - RNA, 22 nt, Human herpesvirus 6B
aagauugcgucuuuuguaaaga

SEQ ID NO: 2048221 - RNA, 23 nt, Human herpesvirus 6B
aguauguauaauauaaauucuua

SEQ ID NO: 2048222 - RNA, 14 nt, Human herpesvirus 6B
aguauaaauucuuu

SEQ ID NO: 2048223 - RNA, 12 nt, Human herpesvirus 6B
aguaaaaaagcc

SEQ ID NO: 2048224 - RNA, 19 nt, Human herpesvirus 6B
agccuugauuuuugagauu

SEQ ID NO: 2048225 - RNA, 19 nt, Human herpesvirus 6B
caucuaugcgugugaaagu

SEQ ID NO: 2048226 - RNA, 14 nt, Human herpesvirus 6B
caugauuguaauaa

SEQ ID NO: 2048227 - RNA, 21 nt, Human herpesvirus 6B
cgccuccgccaccaccgcuga

SEQ ID NO: 2048228 - RNA, 17 nt, Human herpesvirus 6B
cggagcaaccgcaguuc

SEQ ID NO: 2048229 - RNA, 15 nt, Human herpesvirus 6B
cggcaaccgcaguuc

SEQ ID NO: 2048230 - RNA, 18 nt, Human herpesvirus 6B
cgaagcgacgcaagccgu

SEQ ID NO: 2048231 - RNA, 18 nt, Human herpesvirus 6B
cgagacgguacagcgcgu

SEQ ID NO: 2048232 - RNA, 21 nt, Human herpesvirus 6B
cgagacuggccgcauacaccc

SEQ ID NO: 2048233 - RNA, 22 nt, Human herpesvirus 6B
cgagaguccgaacgaacgccgu

SEQ ID NO: 2048234 - RNA, 16 nt, Human herpesvirus 6B
cgagauucuuuaaaga

SEQ ID NO: 2048235 - RNA, 20 nt, Human herpesvirus 6B
ccagaguuaaugcauacaug

SEQ ID NO: 2048236 - RNA, 20 nt, Human herpesvirus 6B
guaaucucuagguaaacuuc

SEQ ID NO: 2048237 - RNA, 18 nt, Human herpesvirus 6B
gcgacgggcagggcgggc

SEQ ID NO: 2048238 - RNA, 22 nt, Human herpesvirus 6B
gcccuccuggguacggcaaacu

SEQ ID NO: 2048239 - RNA, 20 nt, Human herpesvirus 6B
gcauagaucgggacugcuug

SEQ ID NO: 2048240 - RNA, 19 nt, Human herpesvirus 6B
cuuagauaugucguuucau

SEQ ID NO: 2048241 - RNA, 15 nt, Human herpesvirus 6B
cuucaauguuuuuca

SEQ ID NO: 2048242 - RNA, 16 nt, Human herpesvirus 6B
gaccguaucccucccu

SEQ ID NO: 2048243 - RNA, 19 nt, Human herpesvirus 6B
uuuuauagccggugucauc

SEQ ID NO: 2048244 - RNA, 18 nt, Human herpesvirus 6B
acugaucgguauuugcga

SEQ ID NO: 2048245 - RNA, 12 nt, Human herpesvirus 6B
acuaccgaugcu

SEQ ID NO: 2048246 - RNA, 14 nt, Human herpesvirus 6B
cagagagccgcaga

SEQ ID NO: 2048247 - RNA, 20 nt, Human herpesvirus 6B
cacgguagucguggcggagc

SEQ ID NO: 2048248 - RNA, 22 nt, Human herpesvirus 6B
cagaucuucgauuacuguaaaa

SEQ ID NO: 2048249 - RNA, 11 nt, Human herpesvirus 6B
gauuguucgcu

SEQ ID NO: 2048250 - RNA, 12 nt, Human herpesvirus 6B
gauucgacauca

SEQ ID NO: 2048251 - RNA, 20 nt, Human herpesvirus 6B
gauuuuucugccuauuucuc

SEQ ID NO: 2048252 - RNA, 21 nt, Human herpesvirus 6B
gauuuuugcgcaauucuucuc

SEQ ID NO: 2048253 - RNA, 20 nt, Human herpesvirus 6B
cgugaaaacgcuucagauuc

SEQ ID NO: 2048254 - RNA, 19 nt, Human herpesvirus 6B
gcacagaaucgagaucguu

SEQ ID NO: 2048255 - RNA, 13 nt, Human herpesvirus 6B
uugcuguuuacga

SEQ ID NO: 2048256 - RNA, 18 nt, Human herpesvirus 6B
uugcauucaguauuacga

SEQ ID NO: 2048257 - RNA, 16 nt, Human herpesvirus 6B
uuccuguccgugagac

SEQ ID NO: 2048258 - RNA, 16 nt, Human herpesvirus 6B
uucuaauuauaaaugu

SEQ ID NO: 2048259 - RNA, 17 nt, Human herpesvirus 6B
uucuuugacuauuucga

SEQ ID NO: 2048260 - RNA, 19 nt, Human herpesvirus 6B
uguuuccagagcacacaua

SEQ ID NO: 2048261 - RNA, 12 nt, Human herpesvirus 6B
uuaaucauucga

SEQ ID NO: 2048262 - RNA, 16 nt, Human herpesvirus 6B
uuacgugccguguuac

SEQ ID NO: 2048263 - RNA, 13 nt, Human herpesvirus 6B
uuacucauacaga

SEQ ID NO: 2048264 - RNA, 19 nt, Human herpesvirus 6B
uuaugcaacugcauuuucu

SEQ ID NO: 2048265 - RNA, 20 nt, Human herpesvirus 6B
uuaccagagauacgugauac

SEQ ID NO: 2048266 - RNA, 14 nt, Human herpesvirus 6B
uuauugacugugaa

SEQ ID NO: 2048267 - RNA, 18 nt, Human herpesvirus 6B
uuaucaaauuugcauuca

SEQ ID NO: 2048268 - RNA, 20 nt, Human herpesvirus 6B
ugguaauccaugaacuacag

SEQ ID NO: 2048269 - RNA, 21 nt, Human herpesvirus 6B
uguaauuuggaucugugcgcc

SEQ ID NO: 2048270 - RNA, 13 nt, Human herpesvirus 6B
guuaaaagggaag

SEQ ID NO: 2048271 - RNA, 21 nt, Human herpesvirus 6B
guuacauuugguuugacauua

SEQ ID NO: 2048272 - RNA, 20 nt, Human herpesvirus 6B
guuaguggguaccgcgguug

SEQ ID NO: 2048273 - RNA, 17 nt, Human herpesvirus 6B
uagaacauaagggacag

SEQ ID NO: 2048274 - RNA, 10 nt, Human herpesvirus 6B
uacuuccugu

SEQ ID NO: 2048275 - RNA, 16 nt, Human herpesvirus 6B
ugauaaacuguacgcc

SEQ ID NO: 2048276 - RNA, 18 nt, Human herpesvirus 6B
gugaaaaacacggcgccu

SEQ ID NO: 2048277 - RNA, 21 nt, Human herpesvirus 6B
gugcaacaaagagcuuuaaag

SEQ ID NO: 2048278 - RNA, 20 nt, Human herpesvirus 6B
gugaccguaucccucccugc

SEQ ID NO: 2048279 - RNA, 17 nt, Human herpesvirus 6B
gcguguaauuguugaaa

SEQ ID NO: 2048280 - RNA, 18 nt, Human herpesvirus 6B
cggggcgcaccggcgaca

SEQ ID NO: 2048281 - RNA, 19 nt, Human herpesvirus 6B
cuuuccgcccuccguuuca

SEQ ID NO: 2048282 - RNA, 14 nt, Human herpesvirus 6B
cuuugauaaaacca

SEQ ID NO: 2048283 - RNA, 18 nt, Human herpesvirus 6B
ccugauccaugagcaccc

SEQ ID NO: 2048284 - RNA, 20 nt, Human herpesvirus 6B
cgacgcagauuuacgacacg

SEQ ID NO: 2048285 - RNA, 14 nt, Human herpesvirus 6B
caggauuuguaaaa

SEQ ID NO: 2048286 - RNA, 15 nt, Human herpesvirus 6B
caggauuuguaaaaa

SEQ ID NO: 2048287 - RNA, 19 nt, Human herpesvirus 6B
cagcugcaugguccacaga

SEQ ID NO: 2048288 - RNA, 13 nt, Human herpesvirus 6B
caauucauuguac

SEQ ID NO: 2048289 - RNA, 18 nt, Human herpesvirus 6B
caauguccgaaguaaaaa

SEQ ID NO: 2048290 - RNA, 15 nt, Human herpesvirus 6B
auacggaaguugaaa

SEQ ID NO: 2048291 - RNA, 21 nt, Human herpesvirus 6B
agggacccacacgcggggauc

SEQ ID NO: 2048292 - RNA, 20 nt, Human herpesvirus 6B
aucaucgccauagugaaaga

SEQ ID NO: 2048293 - RNA, 19 nt, Human herpesvirus 6B
auauuauaaggucauuuua

SEQ ID NO: 2048294 - RNA, 21 nt, Human herpesvirus 6B
auaucugaaaucgcauuucuc

SEQ ID NO: 2048295 - RNA, 14 nt, Human herpesvirus 6B
auauggcgaaugcc

SEQ ID NO: 2048296 - RNA, 23 nt, Human herpesvirus 6B
aucaugauaaauuguuuccgaau

SEQ ID NO: 2048297 - RNA, 21 nt, Human herpesvirus 6B
caagucgccucacuguaaaag

SEQ ID NO: 2048298 - RNA, 23 nt, Human herpesvirus 6B
caacgugugaaaacuaguaaaaa

SEQ ID NO: 2048299 - RNA, 19 nt, Human herpesvirus 6B
aagguaugaaacgaaugcc

SEQ ID NO: 2048300 - RNA, 15 nt, Human herpesvirus 6B
acagacagggggauc

SEQ ID NO: 2048301 - RNA, 13 nt, Human herpesvirus 6B
acagcaguuuuuu

SEQ ID NO: 2048302 - RNA, 16 nt, Human herpesvirus 6B
aauccuggauuucgac

SEQ ID NO: 2048303 - RNA, 17 nt, Human herpesvirus 6B
aaugcagcaguuuuugu

SEQ ID NO: 2048304 - RNA, 20 nt, Human herpesvirus 6B
acauuucgguuuaauagauu

SEQ ID NO: 2048305 - RNA, 15 nt, Human herpesvirus 6B
ucgcccguucccggg

SEQ ID NO: 2048306 - RNA, 21 nt, Human herpesvirus 6B
uccggccaauucauuguacga

SEQ ID NO: 2048307 - RNA, 19 nt, Human herpesvirus 6B
gcgcgugaccguaucccuc

SEQ ID NO: 2048308 - RNA, 13 nt, Human herpesvirus 6B
uaaauaaucaacu

SEQ ID NO: 2048309 - RNA, 19 nt, Human herpesvirus 6B
uaaacuuaacuuaucaacu

SEQ ID NO: 2048310 - RNA, 9 nt, Human herpesvirus 6B
uaugagaau

SEQ ID NO: 2048311 - RNA, 14 nt, Human herpesvirus 6B
ucaauuucuaaaga

SEQ ID NO: 2048312 - RNA, 19 nt, Human herpesvirus 6B
uggaaacacuuucuucgcc

SEQ ID NO: 2048313 - RNA, 14 nt, Human herpesvirus 6B
ugccggcgcgcaaa

SEQ ID NO: 2048314 - RNA, 20 nt, Human herpesvirus 6B
ucacgcggaccgacgacaaa

SEQ ID NO: 2048315 - RNA, 19 nt, Human herpesvirus 6B
ucagcggguaccgcgguug

SEQ ID NO: 2048316 - RNA, 23 nt, Human herpesvirus 6B
ugagacaucgagauucuuuaaag

SEQ ID NO: 2048317 - RNA, 12 nt, Human herpesvirus 6B
gcuuggccaacu

SEQ ID NO: 2048318 - RNA, 22 nt, Human herpesvirus 6B
ggaggggaauacaccggagacc

SEQ ID NO: 2048319 - RNA, 15 nt, Human herpesvirus 6B
ggauuacaagggaaa

SEQ ID NO: 2048320 - RNA, 12 nt, Human herpesvirus 6B
ggcaaccgcagu

SEQ ID NO: 2048321 - RNA, 14 nt, Human herpesvirus 6B
gagaaagagggaag

SEQ ID NO: 2048322 - RNA, 12 nt, Human herpesvirus 6B
gccaauucauug

SEQ ID NO: 2048323 - RNA, 22 nt, Human herpesvirus 6B
cgguuugucuugcaaacagcuu

SEQ ID NO: 2048324 - RNA, 16 nt, Human herpesvirus 6B
gaaacauaaacgcaaa

SEQ ID NO: 2048325 - RNA, 22 nt, Human herpesvirus 6B
gaacaaaaggucagaugcaaaa

SEQ ID NO: 2048326 - RNA, 20 nt, Human herpesvirus 6B
gacagaucagcauuuggcag

SEQ ID NO: 2048327 - RNA, 22 nt, Human herpesvirus 6B
gaagggauggcagaucuugaaa

SEQ ID NO: 2048328 - RNA, 15 nt, Human herpesvirus 6B
cggcggauggagccc

SEQ ID NO: 2048329 - RNA, 19 nt, Human herpesvirus 6B
auuguguguccugagaaug

SEQ ID NO: 2048330 - RNA, 14 nt, Human herpesvirus 6B
auuaucgacauaca

SEQ ID NO: 2048331 - RNA, 22 nt, Human herpesvirus 6B
auuuuuuauuaguauccuucuc

SEQ ID NO: 2048332 - RNA, 14 nt, Human herpesvirus 6B
cauauaaacagauu

SEQ ID NO: 2048333 - RNA, 22 nt, Human herpesvirus 6B
cauauauugaaauuuguaacaa

SEQ ID NO: 2048334 - RNA, 20 nt, Human herpesvirus 6B
aauuccauacggucgaauga

SEQ ID NO: 2048335 - RNA, 19 nt, Human herpesvirus 6B
aauuccauaugucgaaugc

SEQ ID NO: 2048336 - RNA, 16 nt, Human herpesvirus 6B
aauguuccaauugauu

SEQ ID NO: 2048337 - RNA, 19 nt, Human herpesvirus 6B
aauggauuuuagauucgac

SEQ ID NO: 2048338 - RNA, 20 nt, Human herpesvirus 6B
aauuuuaaauauuaauaguu

SEQ ID NO: 2048339 - RNA, 16 nt, Human herpesvirus 6B
aauuaaucauuucgau

SEQ ID NO: 2048340 - RNA, 22 nt, Human herpesvirus 6B
aauuuguucgcacaaaaugauu

SEQ ID NO: 2048341 - RNA, 14 nt, Human herpesvirus 6B
aauuuaaaauaauu

SEQ ID NO: 2048342 - RNA, 14 nt, Human herpesvirus 6B
aauuuauauucgac

SEQ ID NO: 2048343 - RNA, 14 nt, Human herpesvirus 6B
acaauguuccgaaa

SEQ ID NO: 2048344 - RNA, 15 nt, Human herpesvirus 6B
auaaaguggccauaa

SEQ ID NO: 2048345 - RNA, 15 nt, Human herpesvirus 6B
auaaaucgccauaau

SEQ ID NO: 2048346 - RNA, 16 nt, Human herpesvirus 6B
aggaacugaugagaaa

SEQ ID NO: 2048347 - RNA, 20 nt, Human herpesvirus 6B
agcgcccgaugccaacgcga

SEQ ID NO: 2048348 - RNA, 13 nt, Human herpesvirus 6B
agaggcgcgggac

SEQ ID NO: 2048349 - RNA, 20 nt, Human herpesvirus 6B
agaggguuccuccgcgggac

SEQ ID NO: 2048350 - RNA, 17 nt, Human herpesvirus 6B
acgacgcagauuuacga

SEQ ID NO: 2048351 - RNA, 19 nt, Human herpesvirus 6B
aacgauuuucuauuaaaaa

SEQ ID NO: 2048352 - RNA, 21 nt, Human herpesvirus 6B
aaccgcaguuccuguuuuucu

SEQ ID NO: 2048353 - RNA, 21 nt, Human herpesvirus 6B
aaccgcaguuucuguuuuucu

SEQ ID NO: 2048354 - RNA, 15 nt, Human herpesvirus 6B
aaccauguuuuuacu

SEQ ID NO: 2048355 - RNA, 14 nt, Human herpesvirus 6B
aaccacguuuuucc

SEQ ID NO: 2048356 - RNA, 20 nt, Human herpesvirus 6B
ucggcgaauguacacaguca

SEQ ID NO: 2048357 - RNA, 14 nt, Human herpesvirus 6B
gcgcgcgcgcguug

SEQ ID NO: 2048358 - RNA, 14 nt, Human herpesvirus 6B
gcgcaccggcgaca

SEQ ID NO: 2048359 - RNA, 19 nt, Human herpesvirus 6B
gauaccgaaucggaagagg

SEQ ID NO: 2048360 - RNA, 15 nt, Human herpesvirus 6B
gcaccgagggcgggc

SEQ ID NO: 2048361 - RNA, 13 nt, Human herpesvirus 6B
gagcaaccgcagu

SEQ ID NO: 2048362 - RNA, 23 nt, Human herpesvirus 6B
ccggcgacacgcgcggaccacuc

SEQ ID NO: 2048363 - RNA, 12 nt, Human
aaaaaauuuaaa

SEQ ID NO: 2048364 - RNA, 19 nt, Human
aaaaacagcauugcuuucu

SEQ ID NO: 2048365 - RNA, 20 nt, Human
aaaaacagcauugcuuucug

SEQ ID NO: 2048366 - RNA, 21 nt, Human
aaaaacagcauugcuuucuga

SEQ ID NO: 2048367 - RNA, 19 nt, Human
aaaaacagccucacagaag

SEQ ID NO: 2048368 - RNA, 16 nt, Human
aaaaaauuuccaguga

SEQ ID NO: 2048369 - RNA, 11 nt, Human
aaaaaauuuug

SEQ ID NO: 2048370 - RNA, 19 nt, Human
aaaaaauuuuguaauuuuc

SEQ ID NO: 2048371 - RNA, 14 nt, Human
aaaaacacaaaagu

SEQ ID NO: 2048372 - RNA, 11 nt, Human
aaaaagaaugu

SEQ ID NO: 2048373 - RNA, 13 nt, Human
aaaaagaauguca

SEQ ID NO: 2048374 - RNA, 22 nt, Human
aaaaagauggccuuugcuuaug

SEQ ID NO: 2048375 - RNA, 18 nt, Human
aaaaacaauauuuauugu

SEQ ID NO: 2048376 - RNA, 12 nt, Human
aaaaacugaaug

SEQ ID NO: 2048377 - RNA, 19 nt, Human
aaaaacuucaguaaguacg

SEQ ID NO: 2048378 - RNA, 12 nt, Human
aaaaacuuguaa

SEQ ID NO: 2048379 - RNA, 18 nt, Human
aaaaacuuguaaaugcug

SEQ ID NO: 2048380 - RNA, 12 nt, Human
aaaaacuuuuau

SEQ ID NO: 2048381 - RNA, 17 nt, Human
aaaaacuuuuauaaauu

SEQ ID NO: 2048382 - RNA, 21 nt, Human
aaaaagaaucugcauuuagca

SEQ ID NO: 2048383 - RNA, 12 nt, Human
aaaacaaagaag

SEQ ID NO: 2048384 - RNA, 10 nt, Human
aaaacaaaau

SEQ ID NO: 2048385 - RNA, 12 nt, Human
aaaacaaaaaac

SEQ ID NO: 2048386 - RNA, 14 nt, Human
aaaacaaaaaacaa

SEQ ID NO: 2048387 - RNA, 15 nt, Human
aaaacaaaaaacaau

SEQ ID NO: 2048388 - RNA, 14 nt, Human
aaaaauuuuguaau

SEQ ID NO: 2048389 - RNA, 19 nt, Human
aaaaauuuuguaauuuucu

SEQ ID NO: 2048390 - RNA, 23 nt, Human
aaaacaaaaauucacaagcugcc

SEQ ID NO: 2048391 - RNA, 12 nt, Human
aaaacaacaaaa

SEQ ID NO: 2048392 - RNA, 13 nt, Human
aaaacaacaaaaa

SEQ ID NO: 2048393 - RNA, 21 nt, Human
aaaaauuuaagcauuguuugc

SEQ ID NO: 2048394 - RNA, 22 nt, Human
aaaaauuuaagcauuguuugcu

SEQ ID NO: 2048395 - RNA, 23 nt, Human
aaaaauuguuucaaaauaaaaac

SEQ ID NO: 2048396 - RNA, 14 nt, Human
aaaaauuuaagcau

SEQ ID NO: 2048397 - RNA, 15 nt, Human
aaaaauuuaagcauu

SEQ ID NO: 2048398 - RNA, 16 nt, Human
aaaaauuuaagcauug

SEQ ID NO: 2048399 - RNA, 18 nt, Human
aaaaauuuaagcauuguu

SEQ ID NO: 2048400 - RNA, 20 nt, Human
aaaaauuuaagcauuguuug

SEQ ID NO: 2048401 - RNA, 12 nt, Human
aaaaauuugaac

SEQ ID NO: 2048402 - RNA, 20 nt, Human
aaaaauuugaaccaaaacau

SEQ ID NO: 2048403 - RNA, 23 nt, Human
aaaaauuuggaauucuguucauu

SEQ ID NO: 2048404 - RNA, 21 nt, Human
aaaaauuuuuggauugacagu

SEQ ID NO: 2048405 - RNA, 22 nt, Human
aaaaauuuuuggauugacagua

SEQ ID NO: 2048406 - RNA, 22 nt, Human
aaaaauuuuauaaaauuaagca

SEQ ID NO: 2048407 - RNA, 15 nt, Human
aaaacaauauuguuu

SEQ ID NO: 2048408 - RNA, 17 nt, Human
aaaacaauauuguuucu

SEQ ID NO: 2048409 - RNA, 18 nt, Human
aaaacaauauuguuucua

SEQ ID NO: 2048410 - RNA, 14 nt, Human
aaaacaauauuuau

SEQ ID NO: 2048411 - RNA, 17 nt, Human
aaaacaauauuuauugu

SEQ ID NO: 2048412 - RNA, 19 nt, Human
aaaacaauauuuauuguau

SEQ ID NO: 2048413 - RNA, 20 nt, Human
aaaacaauauuuauuguauu

SEQ ID NO: 2048414 - RNA, 23 nt, Human
aaaacaauauuuauuguauuuua

SEQ ID NO: 2048415 - RNA, 13 nt, Human
aaaacaaugaaga

SEQ ID NO: 2048416 - RNA, 18 nt, Human
aaaacaagaaaguuuccc

SEQ ID NO: 2048417 - RNA, 17 nt, Human
aaaacaagaaaguuucc

SEQ ID NO: 2048418 - RNA, 18 nt, Human
aaaacaacuucuuuguaa

SEQ ID NO: 2048419 - RNA, 13 nt, Human
aagugguauagaa

SEQ ID NO: 2048420 - RNA, 17 nt, Human
aagugguauagaaaugc

SEQ ID NO: 2048421 - RNA, 15 nt, Human
aaguuguuaauaaaa

SEQ ID NO: 2048422 - RNA, 17 nt, Human
aaguuguuaacuaaauu

SEQ ID NO: 2048423 - RNA, 15 nt, Human
aaguuguuucauuga

SEQ ID NO: 2048424 - RNA, 22 nt, Human
aauaaacuguccucuuucagaa

SEQ ID NO: 2048425 - RNA, 17 nt, Human
aauaaacuguguuuacu

SEQ ID NO: 2048426 - RNA, 22 nt, Human
aauaaguuaacuauuuuauuuu

SEQ ID NO: 2048427 - RNA, 23 nt, Human
aauaaaauuaaagcugaaaacug

SEQ ID NO: 2048428 - RNA, 21 nt, Human
aauaaaaugugauuuuucuga

SEQ ID NO: 2048429 - RNA, 12 nt, Human
aauaaaauuaag

SEQ ID NO: 2048430 - RNA, 14 nt, Human
aauaaaauuaagaa

SEQ ID NO: 2048431 - RNA, 17 nt, Human
aauaaaauuaagaaugu

SEQ ID NO: 2048432 - RNA, 13 nt, Human
aauaaaaugugau

SEQ ID NO: 2048433 - RNA, 14 nt, Human
aauaaaaugugauu

SEQ ID NO: 2048434 - RNA, 13 nt, Human
aauaaucggccca

SEQ ID NO: 2048435 - RNA, 16 nt, Human
aauaaucggcccacag

SEQ ID NO: 2048436 - RNA, 15 nt, Human
aauaaacuauuggaa

SEQ ID NO: 2048437 - RNA, 22 nt, Human
aauaaugaauggacucaaacug

SEQ ID NO: 2048438 - RNA, 14 nt, Human
aauaaucuuugggu

SEQ ID NO: 2048439 - RNA, 13 nt, Human
aauaauaaacuuu

SEQ ID NO: 2048440 - RNA, 15 nt, Human
aauaaugucuuguua

SEQ ID NO: 2048441 - RNA, 18 nt, Human
aauaaugucuuguuaaua

SEQ ID NO: 2048442 - RNA, 20 nt, Human
aauaaugucuuguuaauauu

SEQ ID NO: 2048443 - RNA, 23 nt, Human
aauaaugucuuguuaauauucuu

SEQ ID NO: 2048444 - RNA, 19 nt, Human
aauaauguacaucuggccu

SEQ ID NO: 2048445 - RNA, 22 nt, Human
aagugcugggauuacaggugug

SEQ ID NO: 2048446 - RNA, 16 nt, Human
aagucucugcuggccc

SEQ ID NO: 2048447 - RNA, 21 nt, Human
aagucucugcuggcccagcca

SEQ ID NO: 2048448 - RNA, 11 nt, Human
aagucucugug

SEQ ID NO: 2048449 - RNA, 12 nt, Human
aagucucuguga

SEQ ID NO: 2048450 - RNA, 14 nt, Human
aagucucugugaau

SEQ ID NO: 2048451 - RNA, 14 nt, Human
aagucuccuucccc

SEQ ID NO: 2048452 - RNA, 17 nt, Human
aagucucuagguucuga

SEQ ID NO: 2048453 - RNA, 13 nt, Human
aagucucuauuua

SEQ ID NO: 2048454 - RNA, 14 nt, Human
aagucucuauuuaa

SEQ ID NO: 2048455 - RNA, 15 nt, Human
aagucucuauuuaaa

SEQ ID NO: 2048456 - RNA, 18 nt, Human
aagucucuauuuaaauuc

SEQ ID NO: 2048457 - RNA, 19 nt, Human
aagucucuauuuaaauucu

SEQ ID NO: 2048458 - RNA, 20 nt, Human
aagucucuauuuaaauucuu

SEQ ID NO: 2048459 - RNA, 15 nt, Human
aagucucugcuggcc

SEQ ID NO: 2048460 - RNA, 20 nt, Human
aagucccaccgguugcuucu

SEQ ID NO: 2048461 - RNA, 23 nt, Human
aagucccaccgguugcuucuggg

SEQ ID NO: 2048462 - RNA, 14 nt, Human
aaguccccaggccc

SEQ ID NO: 2048463 - RNA, 18 nt, Human
aaguccccaggccccagg

SEQ ID NO: 2048464 - RNA, 21 nt, Human
aaguccccaggccccaggaag

SEQ ID NO: 2048465 - RNA, 23 nt, Human
aaguccccaggccccaggaagcc

SEQ ID NO: 2048466 - RNA, 19 nt, Human
aagucccugacucucugug

SEQ ID NO: 2048467 - RNA, 22 nt, Human
aaguccccaggccccaggaagc

SEQ ID NO: 2048468 - RNA, 16 nt, Human
aagucuccagcccacg

SEQ ID NO: 2048469 - RNA, 16 nt, Human
aagucuuagauguaua

SEQ ID NO: 2048470 - RNA, 11 nt, Human
aaguacuucuu

SEQ ID NO: 2048471 - RNA, 18 nt, Human
aaguauauaaauuggcuu

SEQ ID NO: 2048472 - RNA, 12 nt, Human
aaguaucagaaa

SEQ ID NO: 2048473 - RNA, 13 nt, Human
aaguaucagaaag

SEQ ID NO: 2048474 - RNA, 22 nt, Human
aaguauauaauuuuuuuauguu

SEQ ID NO: 2048475 - RNA, 11 nt, Human
aaguauauaua

SEQ ID NO: 2048476 - RNA, 16 nt, Human
aaguauauauagaauc

SEQ ID NO: 2048477 - RNA, 13 nt, Human
aaguauauauuua

SEQ ID NO: 2048478 - RNA, 13 nt, Human
aaguaugugagug

SEQ ID NO: 2048479 - RNA, 18 nt, Human
aaguaugugagugugucc

SEQ ID NO: 2048480 - RNA, 19 nt, Human
aaguccaggucgggcucag

SEQ ID NO: 2048481 - RNA, 21 nt, Human
aaguccaggucgggcucagcu

SEQ ID NO: 2048482 - RNA, 16 nt, Human
aaguaucauggaaaua

SEQ ID NO: 2048483 - RNA, 17 nt, Human
aaguaucauggaaauau

SEQ ID NO: 2048484 - RNA, 21 nt, Human
aaguaucauggaaauauuaug

SEQ ID NO: 2048485 - RNA, 17 nt, Human
aaguaugagggaaaaug

SEQ ID NO: 2048486 - RNA, 21 nt, Human
aaguaugagggaaaaugagua

SEQ ID NO: 2048487 - RNA, 19 nt, Human
aaguaucuucguucuuguu

SEQ ID NO: 2048488 - RNA, 20 nt, Human
aagguuaauguucaucaucc

SEQ ID NO: 2048489 - RNA, 17 nt, Human
aagguucuuacugcuug

SEQ ID NO: 2048490 - RNA, 21 nt, Human
aagguucuucccuuuuacaua

SEQ ID NO: 2048491 - RNA, 17 nt, Human
aagguuguauugcauau

SEQ ID NO: 2048492 - RNA, 13 nt, Human
aagguuguauugc

SEQ ID NO: 2048493 - RNA, 22 nt, Human
aagguugacaauaaaugugcuu

SEQ ID NO: 2048494 - RNA, 22 nt, Human
aaggugggccuugcuaccucaa

SEQ ID NO: 2048495 - RNA, 18 nt, Human
aaggugggcugagcccug

SEQ ID NO: 2048496 - RNA, 19 nt, Human
aaggugggcugagcccugg

SEQ ID NO: 2048497 - RNA, 17 nt, Human
aaggugggccuugcuac

SEQ ID NO: 2048498 - RNA, 16 nt, Human
aaggugggcugagccc

SEQ ID NO: 2048499 - RNA, 15 nt, Human
aagguuaauaaagua

SEQ ID NO: 2048500 - RNA, 16 nt, Human
aagguuaauaaaguaa

SEQ ID NO: 2048501 - RNA, 11 nt, Human
aaggugggagg

SEQ ID NO: 2048502 - RNA, 20 nt, Human
aaggugcuguugucauugcu

SEQ ID NO: 2048503 - RNA, 21 nt, Human
aaggugcuguugucauugcuu

SEQ ID NO: 2048504 - RNA, 22 nt, Human
aaggugcuguugucauugcuuu

SEQ ID NO: 2048505 - RNA, 23 nt, Human
aaggugcuguugucauugcuuua

SEQ ID NO: 2048506 - RNA, 20 nt, Human
aagguggacuggaaggggcc

SEQ ID NO: 2048507 - RNA, 14 nt, Human
aagguggaguggau

SEQ ID NO: 2048508 - RNA, 15 nt, Human
aagguggaguggaug

SEQ ID NO: 2048509 - RNA, 21 nt, Human
aagaaauuuccacucaggucu

SEQ ID NO: 2048510 - RNA, 17 nt, Human
aagaaauuuaaaagaca

SEQ ID NO: 2048511 - RNA, 21 nt, Human
aagaacacaaagcggggggag

SEQ ID NO: 2048512 - RNA, 14 nt, Human
aagaacaacggcaa

SEQ ID NO: 2048513 - RNA, 14 nt, Human
aagaacaagaauuu

SEQ ID NO: 2048514 - RNA, 12 nt, Human
aagaacauagaa

SEQ ID NO: 2048515 - RNA, 13 nt, Human
aagaaaugcacaa

SEQ ID NO: 2048516 - RNA, 14 nt, Human
aagaaaugcacaau

SEQ ID NO: 2048517 - RNA, 16 nt, Human
aagaaaugcacaaugu

SEQ ID NO: 2048518 - RNA, 19 nt, Human
aagaaaugcacaaugucuu

SEQ ID NO: 2048519 - RNA, 15 nt, Human
aagaaauucccugga

SEQ ID NO: 2048520 - RNA, 16 nt, Human
aagaacauagaacucu

SEQ ID NO: 2048521 - RNA, 18 nt, Human
aagaacauccaaggagaa

SEQ ID NO: 2048522 - RNA, 16 nt, Human
aagauugcuuaaaaua

SEQ ID NO: 2048523 - RNA, 17 nt, Human
aagauuuaauuugccaa

SEQ ID NO: 2048524 - RNA, 18 nt, Human
aagauuuaauuugccaaa

SEQ ID NO: 2048525 - RNA, 23 nt, Human
aagauuuaauuugccaaaauaau

SEQ ID NO: 2048526 - RNA, 14 nt, Human
aagauuuauuuugu

SEQ ID NO: 2048527 - RNA, 23 nt, Human
aagauuuauuuuguuaaaaucuc

SEQ ID NO: 2048528 - RNA, 17 nt, Human
aagauuuggaauaaagu

SEQ ID NO: 2048529 - RNA, 15 nt, Human
aagauuugcccauuu

SEQ ID NO: 2048530 - RNA, 21 nt, Human
aagauuugcccauuuacacuu

SEQ ID NO: 2048531 - RNA, 16 nt, Human
aagauuugcuuuaauu

SEQ ID NO: 2048532 - RNA, 13 nt, Human
aagauuucuugag

SEQ ID NO: 2048533 - RNA, 21 nt, Human
aagauuuguacuacaguucuu

SEQ ID NO: 2048534 - RNA, 14 nt, Human
aagcagaggaagga

SEQ ID NO: 2048535 - RNA, 13 nt, Human
aagauuuuaaauu

SEQ ID NO: 2048536 - RNA, 16 nt, Human
aagcaggaagcucaga

SEQ ID NO: 2048537 - RNA, 11 nt, Human
aagcaggaagc

SEQ ID NO: 2048538 - RNA, 12 nt, Human
aagcaggaagcu

SEQ ID NO: 2048539 - RNA, 13 nt, Human
aagcaggaagcuc

SEQ ID NO: 2048540 - RNA, 11 nt, Human
aagccagacag

SEQ ID NO: 2048541 - RNA, 13 nt, Human
aagccagaagcug

SEQ ID NO: 2048542 - RNA, 14 nt, Human
aagccagaagcuga

SEQ ID NO: 2048543 - RNA, 17 nt, Human
aagccagaagcugagca

SEQ ID NO: 2048544 - RNA, 20 nt, Human
aagccagaagcugagcacca

SEQ ID NO: 2048545 - RNA, 12 nt, Human
aagccagaagcu

SEQ ID NO: 2048546 - RNA, 21 nt, Human
aagccagcugcagcugggcug

SEQ ID NO: 2048547 - RNA, 15 nt, Human
aagccagcugccgac

SEQ ID NO: 2048548 - RNA, 21 nt, Human
aagccagcugccgaccagagc

SEQ ID NO: 2048549 - RNA, 23 nt, Human
aagccagcugccgaccagagccc

SEQ ID NO: 2048550 - RNA, 12 nt, Human
aagccauguuua

SEQ ID NO: 2048551 - RNA, 14 nt, Human
aagccauguuuaag

SEQ ID NO: 2048552 - RNA, 15 nt, Human
aagccauguuuaaga

SEQ ID NO: 2048553 - RNA, 16 nt, Human
aagccauguuuaagau

SEQ ID NO: 2048554 - RNA, 17 nt, Human
aagccauguuuaagauu

SEQ ID NO: 2048555 - RNA, 18 nt, Human
aagccauguuuaagauuu

SEQ ID NO: 2048556 - RNA, 19 nt, Human
aagccauguuuaagauuua

SEQ ID NO: 2048557 - RNA, 22 nt, Human
aagccauguuuaagauuuaauu

SEQ ID NO: 2048558 - RNA, 18 nt, Human
aagccauaauuguucuua

SEQ ID NO: 2048559 - RNA, 18 nt, Human
aagccaucauguaaauua

SEQ ID NO: 2048560 - RNA, 11 nt, Human
aagcuaaagag

SEQ ID NO: 2048561 - RNA, 17 nt, Human
aagcuaauaaaauauca

SEQ ID NO: 2048562 - RNA, 21 nt, Human
aagcugcacccucaggcaggu

SEQ ID NO: 2048563 - RNA, 20 nt, Human
aagcugcacccucaggcagg

SEQ ID NO: 2048564 - RNA, 22 nt, Human
aagcugcacccucaggcaggug

SEQ ID NO: 2048565 - RNA, 18 nt, Human
aagcuaauaaaauaucau

SEQ ID NO: 2048566 - RNA, 20 nt, Human
aagcuaauaaaauaucauuc

SEQ ID NO: 2048567 - RNA, 14 nt, Human
aagcugccucccug

SEQ ID NO: 2048568 - RNA, 15 nt, Human
aagcugccucccugu

SEQ ID NO: 2048569 - RNA, 17 nt, Human
aagcugccucccugucc

SEQ ID NO: 2048570 - RNA, 18 nt, Human
aagcugccucccugucca

SEQ ID NO: 2048571 - RNA, 19 nt, Human
aagcugccucccuguccac

SEQ ID NO: 2048572 - RNA, 20 nt, Human
aagcugccucccuguccacc

SEQ ID NO: 2048573 - RNA, 22 nt, Human
aagcugccucccuguccacccc

SEQ ID NO: 2048574 - RNA, 14 nt, Human
aagcugccuguagu

SEQ ID NO: 2048575 - RNA, 17 nt, Human
aaggauugugauauuuu

SEQ ID NO: 2048576 - RNA, 15 nt, Human
aaggacugcauggua

SEQ ID NO: 2048577 - RNA, 21 nt, Human
aaggacugcaugguaauuuau

SEQ ID NO: 2048578 - RNA, 22 nt, Human
aaggacugcaugguaauuuaua

SEQ ID NO: 2048579 - RNA, 22 nt, Human
aaggacugccgaccgaggcugg

SEQ ID NO: 2048580 - RNA, 21 nt, Human
aaggacccggaggggccuggc

SEQ ID NO: 2048581 - RNA, 18 nt, Human
aaggacccggaggggccu

SEQ ID NO: 2048582 - RNA, 13 nt, Human
aaggaccccucac

SEQ ID NO: 2048583 - RNA, 15 nt, Human
aaggaccccucaccu

SEQ ID NO: 2048584 - RNA, 20 nt, Human
aaggaccccucaccuugcaa

SEQ ID NO: 2048585 - RNA, 22 nt, Human
aagcuggccgaggguccuggcu

SEQ ID NO: 2048586 - RNA, 21 nt, Human
aagcuggccgaggguccuggc

SEQ ID NO: 2048587 - RNA, 11 nt, Human
aagcugggcag

SEQ ID NO: 2048588 - RNA, 15 nt, Human
aagcugcuaaaucuc

SEQ ID NO: 2048589 - RNA, 22 nt, Human
aagcugcuaaaucuccuauuuu

SEQ ID NO: 2048590 - RNA, 22 nt, Human
aagcugccuguaguuaggaaau

SEQ ID NO: 2048591 - RNA, 15 nt, Human
aagcugccuguaguu

SEQ ID NO: 2048592 - RNA, 16 nt, Human
aagcugccuguaguua

SEQ ID NO: 2048593 - RNA, 19 nt, Human
aagcugccuguaguuagga

SEQ ID NO: 2048594 - RNA, 21 nt, Human
aagcugccuguaguuaggaaa

SEQ ID NO: 2048595 - RNA, 18 nt, Human
aaggacauugcggacagc

SEQ ID NO: 2048596 - RNA, 19 nt, Human
aaggaccaacaagggcagu

SEQ ID NO: 2048597 - RNA, 12 nt, Human
aaggaccaggac

SEQ ID NO: 2048598 - RNA, 13 nt, Human
aaggaccaggacu

SEQ ID NO: 2048599 - RNA, 13 nt, Human
aagcugggcaggu

SEQ ID NO: 2048600 - RNA, 15 nt, Human
aaggcaccagccggg

SEQ ID NO: 2048601 - RNA, 19 nt, Human
aaggcacccacaaauaaau

SEQ ID NO: 2048602 - RNA, 20 nt, Human
aaggcacccacaaauaaaug

SEQ ID NO: 2048603 - RNA, 15 nt, Human
aaggcacaauauggg

SEQ ID NO: 2048604 - RNA, 22 nt, Human
aaggcaccuauaaaacagguca

SEQ ID NO: 2048605 - RNA, 21 nt, Human
aaugaugauccuaggcauuug

SEQ ID NO: 2048606 - RNA, 21 nt, Human
aaugaagauaccaucagcaaa

SEQ ID NO: 2048607 - RNA, 17 nt, Human
aaugaaccccacugggu

SEQ ID NO: 2048608 - RNA, 22 nt, Human
aaucugcuuuuuaaagaaugcu

SEQ ID NO: 2048609 - RNA, 17 nt, Human
aaucugcauuuagcaca

SEQ ID NO: 2048610 - RNA, 20 nt, Human
aaucugcauuuagcacaaaa

SEQ ID NO: 2048611 - RNA, 19 nt, Human
aaucugccuauugcagcug

SEQ ID NO: 2048612 - RNA, 23 nt, Human
aaugaaccacaucuugcucugcu

SEQ ID NO: 2048613 - RNA, 17 nt, Human
aaugaaccacaucuugc

SEQ ID NO: 2048614 - RNA, 16 nt, Human
aaugaaccacaucuug

SEQ ID NO: 2048615 - RNA, 19 nt, Human
aauccauguuaguuuuuac

SEQ ID NO: 2048616 - RNA, 22 nt, Human
aauccauguuaguuuuuacuuu

SEQ ID NO: 2048617 - RNA, 17 nt, Human
aaugaucuuuucaaguu

SEQ ID NO: 2048618 - RNA, 12 nt, Human
aaugaugaugac

SEQ ID NO: 2048619 - RNA, 23 nt, Human
aaugaugaugacgacgacaacga

SEQ ID NO: 2048620 - RNA, 17 nt, Human
aaugaugaugauaauga

SEQ ID NO: 2048621 - RNA, 18 nt, Human
aaugaugaugauaaugau

SEQ ID NO: 2048622 - RNA, 12 nt, Human
aaugaugcacau

SEQ ID NO: 2048623 - RNA, 13 nt, Human
aaugaugcacauu

SEQ ID NO: 2048624 - RNA, 18 nt, Human
aaugaugcacauuucaug

SEQ ID NO: 2048625 - RNA, 21 nt, Human
aaugaugauguggaagaacuu

SEQ ID NO: 2048626 - RNA, 11 nt, Human
aauauaauuau

SEQ ID NO: 2048627 - RNA, 14 nt, Human
aauauaauuaucgg

SEQ ID NO: 2048628 - RNA, 23 nt, Human
aauauaaggaaagcaauaaauga

SEQ ID NO: 2048629 - RNA, 18 nt, Human
aauauaaggaaagcaaua

SEQ ID NO: 2048630 - RNA, 19 nt, Human
aauauaaggaaagcaauaa

SEQ ID NO: 2048631 - RNA, 21 nt, Human
aauauaaggaaagcaauaaau

SEQ ID NO: 2048632 - RNA, 17 nt, Human
aauauggacucaguuuu

SEQ ID NO: 2048633 - RNA, 12 nt, Human
aauauaauuguu

SEQ ID NO: 2048634 - RNA, 13 nt, Human
aauauacacacag

SEQ ID NO: 2048635 - RNA, 18 nt, Human
aauauaauuuuuuagaga

SEQ ID NO: 2048636 - RNA, 22 nt, Human
aauauaacugccuuaaaacuuu

SEQ ID NO: 2048637 - RNA, 14 nt, Human
aaucaacugaaagu

SEQ ID NO: 2048638 - RNA, 16 nt, Human
aaucaacugaaagugu

SEQ ID NO: 2048639 - RNA, 17 nt, Human
aaucaacugaaaguguu

SEQ ID NO: 2048640 - RNA, 18 nt, Human
aaucaacugaaaguguuu

SEQ ID NO: 2048641 - RNA, 20 nt, Human
aaucaacugaaaguguuucc

SEQ ID NO: 2048642 - RNA, 14 nt, Human
aaucaacucuaaua

SEQ ID NO: 2048643 - RNA, 15 nt, Human
aaucaacagggcagc

SEQ ID NO: 2048644 - RNA, 22 nt, Human
aaucaaauuuguaggguuucua

SEQ ID NO: 2048645 - RNA, 20 nt, Human
aaucaaauuuguaggguuuc

SEQ ID NO: 2048646 - RNA, 12 nt, Human
aauauuaugcaa

SEQ ID NO: 2048647 - RNA, 17 nt, Human
aauauuaugcaaauucc

SEQ ID NO: 2048648 - RNA, 19 nt, Human
aauauuaugcaaauuccca

SEQ ID NO: 2048649 - RNA, 20 nt, Human
aauauuaugcaaauucccag

SEQ ID NO: 2048650 - RNA, 21 nt, Human
aauauuaugcaaauucccaga

SEQ ID NO: 2048651 - RNA, 20 nt, Human
aauauuaucuuuguaauuau

SEQ ID NO: 2048652 - RNA, 20 nt, Human
aaugucucuuuaaugucaca

SEQ ID NO: 2048653 - RNA, 22 nt, Human
aaugucuaguuguaacaccaug

SEQ ID NO: 2048654 - RNA, 16 nt, Human
aauggugcucauuuca

SEQ ID NO: 2048655 - RNA, 18 nt, Human
aauggugcucauuucaug

SEQ ID NO: 2048656 - RNA, 22 nt, Human
aaugguggggaacuauaaagaa

SEQ ID NO: 2048657 - RNA, 21 nt, Human
aauggugguuguuucuuccaa

SEQ ID NO: 2048658 - RNA, 23 nt, Human
aauggugguuguuucuuccaaga

SEQ ID NO: 2048659 - RNA, 22 nt, Human
aauggugaaaauaaaauaaagc

SEQ ID NO: 2048660 - RNA, 22 nt, Human
aauggucuuucuaaugugugaa

SEQ ID NO: 2048661 - RNA, 15 nt, Human
aauggucgcccagga

SEQ ID NO: 2048662 - RNA, 16 nt, Human
aauggucgcccaggag

SEQ ID NO: 2048663 - RNA, 22 nt, Human
aaugggaacugccucuuuccug

SEQ ID NO: 2048664 - RNA, 13 nt, Human
aaugguaaaauug

SEQ ID NO: 2048665 - RNA, 15 nt, Human
aaugguaaaauugca

SEQ ID NO: 2048666 - RNA, 17 nt, Human
aaugguaaaauugcaug

SEQ ID NO: 2048667 - RNA, 16 nt, Human
aaugguauaaauuuca

SEQ ID NO: 2048668 - RNA, 19 nt, Human
aaugguagucuaaccaaau

SEQ ID NO: 2048669 - RNA, 22 nt, Human
aaugguagucuaaccaaaugca

SEQ ID NO: 2048670 - RNA, 24 nt, Human
aaugguagucuaaccaaaugcauc

SEQ ID NO: 2048671 - RNA, 18 nt, Human
aauggcuuuggucucuug

SEQ ID NO: 2048672 - RNA, 21 nt, Human
aauggcuuuggucucuugcuu

SEQ ID NO: 2048673 - RNA, 12 nt, Human
aauuaaagaaaa

SEQ ID NO: 2048674 - RNA, 13 nt, Human
aauuaaagaaaau

SEQ ID NO: 2048675 - RNA, 14 nt, Human
aauuaaagaaaaua

SEQ ID NO: 2048676 - RNA, 17 nt, Human
aauuaaagaaaauaaaa

SEQ ID NO: 2048677 - RNA, 18 nt, Human
aauuaaagaaaauaaaau

SEQ ID NO: 2048678 - RNA, 14 nt, Human
aauuaaauaaaaua

SEQ ID NO: 2048679 - RNA, 17 nt, Human
aauuaaauaaaauaacc

SEQ ID NO: 2048680 - RNA, 14 nt, Human
aauuaaauauaugu

SEQ ID NO: 2048681 - RNA, 16 nt, Human
aauuaaauauauguau

SEQ ID NO: 2048682 - RNA, 19 nt, Human
aauuaaauauauguaugua

SEQ ID NO: 2048683 - RNA, 23 nt, Human
aauuaaauauauguauguaaaaa

SEQ ID NO: 2048684 - RNA, 11 nt, Human
aauuaaaugua

SEQ ID NO: 2048685 - RNA, 12 nt, Human
aauuaaauguag

SEQ ID NO: 2048686 - RNA, 14 nt, Human
aauuaaauuaggaa

SEQ ID NO: 2048687 - RNA, 19 nt, Human
aauguuugccucugccucu

SEQ ID NO: 2048688 - RNA, 13 nt, Human
aaugucuuguuaa

SEQ ID NO: 2048689 - RNA, 12 nt, Human
aauguuugcuau

SEQ ID NO: 2048690 - RNA, 19 nt, Human
aaugucuugguacuugcug

SEQ ID NO: 2048691 - RNA, 17 nt, Human
aaugucuuguaagcaaa

SEQ ID NO: 2048692 - RNA, 17 nt, Human
aauguuuuauacuguuu

SEQ ID NO: 2048693 - RNA, 18 nt, Human
aauguuugccucugccuc

SEQ ID NO: 2048694 - RNA, 17 nt, Human
aaugucuguuaacuuaa

SEQ ID NO: 2048695 - RNA, 23 nt, Human
aaugucuguagcuccucaacuca

SEQ ID NO: 2048696 - RNA, 16 nt, Human
aauguuuuuaaauaua

SEQ ID NO: 2048697 - RNA, 17 nt, Human
aauguuuuuaaauauau

SEQ ID NO: 2048698 - RNA, 22 nt, Human
aaugucuggagaauaauucuuu

SEQ ID NO: 2048699 - RNA, 15 nt, Human
aauguuuuucugcca

SEQ ID NO: 2048700 - RNA, 21 nt, Human
aauguuuuucugccagggagc

SEQ ID NO: 2048701 - RNA, 17 nt, Human
aauuaaaaaauuuccag

SEQ ID NO: 2048702 - RNA, 11 nt, Human
aauuaaaacaa

SEQ ID NO: 2048703 - RNA, 12 nt, Human
aauuaaaacaau

SEQ ID NO: 2048704 - RNA, 14 nt, Human
aauuaaaacaaugu

SEQ ID NO: 2048705 - RNA, 20 nt, Human
aauuaaaacaaugucaaggu

SEQ ID NO: 2048706 - RNA, 21 nt, Human
aauuaaaacaaugucaaggug

SEQ ID NO: 2048707 - RNA, 14 nt, Human
aauuaaacaauuua

SEQ ID NO: 2048708 - RNA, 19 nt, Human
aauuaaacaauuuauuuua

SEQ ID NO: 2048709 - RNA, 21 nt, Human
aauuaguuguguacucuggcc

SEQ ID NO: 2048710 - RNA, 16 nt, Human
aaagggaacugaacau

SEQ ID NO: 2048711 - RNA, 21 nt, Human
aaagggaacugaacauuccag

SEQ ID NO: 2048712 - RNA, 14 nt, Human
aaagggaaacuauu

SEQ ID NO: 2048713 - RNA, 12 nt, Human
aaagucucuauu

SEQ ID NO: 2048714 - RNA, 13 nt, Human
aaagucucuauuu

SEQ ID NO: 2048715 - RNA, 14 nt, Human
aaagucucuauuua

SEQ ID NO: 2048716 - RNA, 15 nt, Human
aaagucucuauuuaa

SEQ ID NO: 2048717 - RNA, 17 nt, Human
aaagucucuauuuaaau

SEQ ID NO: 2048718 - RNA, 20 nt, Human
aaagucucuauuuaaauucu

SEQ ID NO: 2048719 - RNA, 21 nt, Human
aaagucucuauuuaaauucuu

SEQ ID NO: 2048720 - RNA, 23 nt, Human
aaagucucuauuuaaauucuuuu

SEQ ID NO: 2048721 - RNA, 20 nt, Human
aaagggaacaggaaaagaaa

SEQ ID NO: 2048722 - RNA, 12 nt, Human
aaagggacauga

SEQ ID NO: 2048723 - RNA, 14 nt, Human
aaagucuccagccc

SEQ ID NO: 2048724 - RNA, 15 nt, Human
aaagucuccagccca

SEQ ID NO: 2048725 - RNA, 23 nt, Human
aaagucuugugacuagugcugaa

SEQ ID NO: 2048726 - RNA, 17 nt, Human
aaagucuucaagggcug

SEQ ID NO: 2048727 - RNA, 15 nt, Human
aaagucuugugacua

SEQ ID NO: 2048728 - RNA, 13 nt, Human
aaagucuugcugu

SEQ ID NO: 2048729 - RNA, 20 nt, Human
aaagucuugcuguggucucu

SEQ ID NO: 2048730 - RNA, 23 nt, Human
aaagucuugcuguggucucuuug

SEQ ID NO: 2048731 - RNA, 18 nt, Human
aaagucuugugacuagug

SEQ ID NO: 2048732 - RNA, 19 nt, Human
aaagucuugugacuagugc

SEQ ID NO: 2048733 - RNA, 21 nt, Human
aaagucuugugacuagugcug

SEQ ID NO: 2048734 - RNA, 22 nt, Human
aaagucuugugacuagugcuga

SEQ ID NO: 2048735 - RNA, 13 nt, Human
aaagugaagcaaa

SEQ ID NO: 2048736 - RNA, 15 nt, Human
aaagugaauaaaaau

SEQ ID NO: 2048737 - RNA, 12 nt, Human
aaagugaauuug

SEQ ID NO: 2048738 - RNA, 23 nt, Human
aaagugaagcaaaucagaaacuu

SEQ ID NO: 2048739 - RNA, 15 nt, Human
aaagugaauuugaau

SEQ ID NO: 2048740 - RNA, 17 nt, Human
aaagugaauuugaauga

SEQ ID NO: 2048741 - RNA, 19 nt, Human
aaagugaauuugaaugaaa

SEQ ID NO: 2048742 - RNA, 20 nt, Human
aaagugaauuugaaugaaaa

SEQ ID NO: 2048743 - RNA, 19 nt, Human
aaagucugcauuacauucc

SEQ ID NO: 2048744 - RNA, 12 nt, Human
aaagugcuggga

SEQ ID NO: 2048745 - RNA, 14 nt, Human
aaagugcugggauu

SEQ ID NO: 2048746 - RNA, 16 nt, Human
aaauaaaagugaucaa

SEQ ID NO: 2048747 - RNA, 14 nt, Human
aaauaaaauaaagc

SEQ ID NO: 2048748 - RNA, 12 nt, Human
aaauaaaauaua

SEQ ID NO: 2048749 - RNA, 13 nt, Human
aaauaaaauauaa

SEQ ID NO: 2048750 - RNA, 15 nt, Human
aaauaaaauauaauu

SEQ ID NO: 2048751 - RNA, 13 nt, Human
aaauaaaauaacc

SEQ ID NO: 2048752 - RNA, 23 nt, Human
aaagugagacuuugaggguguau

SEQ ID NO: 2048753 - RNA, 19 nt, Human
aaagugagcaugcuuucug

SEQ ID NO: 2048754 - RNA, 15 nt, Human
aaagugauaauuucu

SEQ ID NO: 2048755 - RNA, 21 nt, Human
aaagugaauuugaaugaaaaa

SEQ ID NO: 2048756 - RNA, 22 nt, Human
aaagugaauuugaaugaaaaau

SEQ ID NO: 2048757 - RNA, 11 nt, Human
aaagugcuggg

SEQ ID NO: 2048758 - RNA, 18 nt, Human
aaauaaaggauuucuaga

SEQ ID NO: 2048759 - RNA, 13 nt, Human
aaauaaaguauau

SEQ ID NO: 2048760 - RNA, 15 nt, Human
aaauaaagcaucuca

SEQ ID NO: 2048761 - RNA, 22 nt, Human
aaauaaaauuaaagcugaaaac

SEQ ID NO: 2048762 - RNA, 15 nt, Human
aaauaaaauuaagaa

SEQ ID NO: 2048763 - RNA, 13 nt, Human
aaauaaaauuaug

SEQ ID NO: 2048764 - RNA, 19 nt, Human
aaauaaauuugguucuaau

SEQ ID NO: 2048765 - RNA, 15 nt, Human
aaauaaaguauauau

SEQ ID NO: 2048766 - RNA, 22 nt, Human
aaauacuguuuuuaacaacuau

SEQ ID NO: 2048767 - RNA, 14 nt, Human
aaauacuuauucau

SEQ ID NO: 2048768 - RNA, 15 nt, Human
aaauacuuauucauu

SEQ ID NO: 2048769 - RNA, 17 nt, Human
aaauacuuauucauugu

SEQ ID NO: 2048770 - RNA, 18 nt, Human
aaauagaaaacaggaaaa

SEQ ID NO: 2048771 - RNA, 16 nt, Human
aaauagaaccacuaug

SEQ ID NO: 2048772 - RNA, 22 nt, Human
aaauagaagaauacaaacauau

SEQ ID NO: 2048773 - RNA, 15 nt, Human
aaauagacaguauau

SEQ ID NO: 2048774 - RNA, 16 nt, Human
aaauagacaguauauu

SEQ ID NO: 2048775 - RNA, 19 nt, Human
aaauagacaguauauuuau

SEQ ID NO: 2048776 - RNA, 16 nt, Human
aaauaguaaaaauaaa

SEQ ID NO: 2048777 - RNA, 13 nt, Human
aaauaguaaaaau

SEQ ID NO: 2048778 - RNA, 18 nt, Human
aaauauaaagcaucuaaa

SEQ ID NO: 2048779 - RNA, 19 nt, Human
aaauauaaagcaucuaaac

SEQ ID NO: 2048780 - RNA, 20 nt, Human
aaauauaaagcaucuaaacu

SEQ ID NO: 2048781 - RNA, 14 nt, Human
aaauauaauugaca

SEQ ID NO: 2048782 - RNA, 17 nt, Human
aaaucuuggcacagaaa

SEQ ID NO: 2048783 - RNA, 17 nt, Human
aaauggaaguggcaaua

SEQ ID NO: 2048784 - RNA, 14 nt, Human
aaagaaaauaaaau

SEQ ID NO: 2048785 - RNA, 14 nt, Human
aaagaaagaaggaa

SEQ ID NO: 2048786 - RNA, 17 nt, Human
aaacugcauuagaaauu

SEQ ID NO: 2048787 - RNA, 14 nt, Human
aaacugaagccaga

SEQ ID NO: 2048788 - RNA, 14 nt, Human
aaacugcauuagaa

SEQ ID NO: 2048789 - RNA, 14 nt, Human
aaacugaauggaag

SEQ ID NO: 2048790 - RNA, 16 nt, Human
aaagauacauuuguau

SEQ ID NO: 2048791 - RNA, 19 nt, Human
aaagauacauuuguauguu

SEQ ID NO: 2048792 - RNA, 16 nt, Human
aaagauacgacuuuau

SEQ ID NO: 2048793 - RNA, 20 nt, Human
aaagauacgacuuuauuuuc

SEQ ID NO: 2048794 - RNA, 22 nt, Human
aaagauacgacuuuauuuucug

SEQ ID NO: 2048795 - RNA, 11 nt, Human
aaagagguuuu

SEQ ID NO: 2048796 - RNA, 19 nt, Human
aaagaaauucccuggacca

SEQ ID NO: 2048797 - RNA, 17 nt, Human
aaagaaagccucagaga

SEQ ID NO: 2048798 - RNA, 18 nt, Human
aaagaaagccucagagaa

SEQ ID NO: 2048799 - RNA, 20 nt, Human
aaacagaggccauggcagaa

SEQ ID NO: 2048800 - RNA, 22 nt, Human
aaacagagacaggcccaagaga

SEQ ID NO: 2048801 - RNA, 16 nt, Human
aaacagagaugugaua

SEQ ID NO: 2048802 - RNA, 20 nt, Human
aaacagauuuggugaauuug

SEQ ID NO: 2048803 - RNA, 22 nt, Human
aaacagauuuggugaauuugaa

SEQ ID NO: 2048804 - RNA, 23 nt, Human
aaacagauuuggugaauuugaau

SEQ ID NO: 2048805 - RNA, 15 nt, Human
aaacagagacaggcc

SEQ ID NO: 2048806 - RNA, 16 nt, Human
aaacagagacaggccc

SEQ ID NO: 2048807 - RNA, 24 nt, Human
aaacacuugcggauauucuggacu

SEQ ID NO: 2048808 - RNA, 22 nt, Human
aaaauuggacauuaagcaucac

SEQ ID NO: 2048809 - RNA, 19 nt, Human
aaaauuggcauuaaaacuu

SEQ ID NO: 2048810 - RNA, 20 nt, Human
aaaauuggcuaguugaaucu

SEQ ID NO: 2048811 - RNA, 13 nt, Human
aaaauucagugga

SEQ ID NO: 2048812 - RNA, 23 nt, Human
aaaacacagacauucugccaggc

SEQ ID NO: 2048813 - RNA, 15 nt, Human
aacugaauuuugucu

SEQ ID NO: 2048814 - RNA, 15 nt, Human
aacugacaaaucaag

SEQ ID NO: 2048815 - RNA, 18 nt, Human
aacugacaaaucaaguuu

SEQ ID NO: 2048816 - RNA, 19 nt, Human
aacugacaaaucaaguuuc

SEQ ID NO: 2048817 - RNA, 23 nt, Human
aacugacacaugcugaacaucac

SEQ ID NO: 2048818 - RNA, 19 nt, Human
aacugaccagccuccaugc

SEQ ID NO: 2048819 - RNA, 14 nt, Human
aacugaccagccuc

SEQ ID NO: 2048820 - RNA, 20 nt, Human
aacuuaaaaagucugcauua

SEQ ID NO: 2048821 - RNA, 13 nt, Human
aacugauucauaa

SEQ ID NO: 2048822 - RNA, 13 nt, Human
aacuuaaauaaua

SEQ ID NO: 2048823 - RNA, 14 nt, Human
aacuuaaauaauaa

SEQ ID NO: 2048824 - RNA, 19 nt, Human
aacuuagcauguguugaaa

SEQ ID NO: 2048825 - RNA, 21 nt, Human
aacuuaggcaugcacagcugu

SEQ ID NO: 2048826 - RNA, 23 nt, Human
aacuuagugcggacaaguuuuaa

SEQ ID NO: 2048827 - RNA, 13 nt, Human
aacuuaaaauauu

SEQ ID NO: 2048828 - RNA, 14 nt, Human
aacuuaaaauauuu

SEQ ID NO: 2048829 - RNA, 16 nt, Human
aacuuaaaauauuuua

SEQ ID NO: 2048830 - RNA, 15 nt, Human
aacuuaaauaaaugu

SEQ ID NO: 2048831 - RNA, 19 nt, Human
aacuuaaauaaaugucauu

SEQ ID NO: 2048832 - RNA, 22 nt, Human
aacuuagugcggacaaguuuua

SEQ ID NO: 2048833 - RNA, 19 nt, Human
aacuuauccuaaaacaaau

SEQ ID NO: 2048834 - RNA, 17 nt, Human
aacuuaucuuacaaagu

SEQ ID NO: 2048835 - RNA, 19 nt, Human
aacuuaucuuacaaagugu

SEQ ID NO: 2048836 - RNA, 14 nt, Human
aacugaauuuuguc

SEQ ID NO: 2048837 - RNA, 18 nt, Human
aacucaguuuuaacuaga

SEQ ID NO: 2048838 - RNA, 15 nt, Human
aacucaguuuuaacu

SEQ ID NO: 2048839 - RNA, 15 nt, Human
aacucaggacuccag

SEQ ID NO: 2048840 - RNA, 16 nt, Human
aacucaggacuccagc

SEQ ID NO: 2048841 - RNA, 18 nt, Human
aacucaggacuccagccc

SEQ ID NO: 2048842 - RNA, 20 nt, Human
aacucaggacuccagcccau

SEQ ID NO: 2048843 - RNA, 20 nt, Human
aacucaccugcuggccccuc

SEQ ID NO: 2048844 - RNA, 21 nt, Human
aacucaccugcuggccccuca

SEQ ID NO: 2048845 - RNA, 14 nt, Human
aacucaauauuuuc

SEQ ID NO: 2048846 - RNA, 20 nt, Human
aacucaauauuuuccaugaa

SEQ ID NO: 2048847 - RNA, 21 nt, Human
aacucaauauuuuccaugaaa

SEQ ID NO: 2048848 - RNA, 12 nt, Human
aacucaauauuu

SEQ ID NO: 2048849 - RNA, 13 nt, Human
aacucaauauuuu

SEQ ID NO: 2048850 - RNA, 15 nt, Human
aacucaccauguaaa

SEQ ID NO: 2048851 - RNA, 16 nt, Human
aacucaccauguaaaa

SEQ ID NO: 2048852 - RNA, 21 nt, Human
aacucaccauguaaaagaguc

SEQ ID NO: 2048853 - RNA, 21 nt, Human
aacucaccuaauguuuaugag

SEQ ID NO: 2048854 - RNA, 17 nt, Human
aacucaccucucaaggu

SEQ ID NO: 2048855 - RNA, 12 nt, Human
aacucaccugcu

SEQ ID NO: 2048856 - RNA, 16 nt, Human
aacucaccugcuggcc

SEQ ID NO: 2048857 - RNA, 22 nt, Human
aacucaccugcuggccccucac

SEQ ID NO: 2048858 - RNA, 22 nt, Human
aacuucaagugcaugcucucug

SEQ ID NO: 2048859 - RNA, 20 nt, Human
aacuuuuuuuuaaguuacac

SEQ ID NO: 2048860 - RNA, 19 nt, Human
aacuuuuuugaaauaauaa

SEQ ID NO: 2048861 - RNA, 14 nt, Human
aacuuuuuuuuaag

SEQ ID NO: 2048862 - RNA, 14 nt, Human
aagaaaugacacuu

SEQ ID NO: 2048863 - RNA, 14 nt, Human
aagaaaugaaauuu

SEQ ID NO: 2048864 - RNA, 16 nt, Human
aagaaaugaaauuuua

SEQ ID NO: 2048865 - RNA, 18 nt, Human
aagaaaugaaauuuuacc

SEQ ID NO: 2048866 - RNA, 20 nt, Human
aagaaaugaaauuuuaccaa

SEQ ID NO: 2048867 - RNA, 18 nt, Human
aacuuuucuauuaaaagu

SEQ ID NO: 2048868 - RNA, 16 nt, Human
aacuuuuauaaauuaa

SEQ ID NO: 2048869 - RNA, 17 nt, Human
aacuuuuauaaauuaaa

SEQ ID NO: 2048870 - RNA, 18 nt, Human
aacuuuuauaaauuaaau

SEQ ID NO: 2048871 - RNA, 19 nt, Human
aacuuuuauaaauuaaaua

SEQ ID NO: 2048872 - RNA, 20 nt, Human
aacuuuuauaaauuaaauau

SEQ ID NO: 2048873 - RNA, 22 nt, Human
aacuuuuauaaauuaaauauau

SEQ ID NO: 2048874 - RNA, 15 nt, Human
aacuuuugugugaaa

SEQ ID NO: 2048875 - RNA, 21 nt, Human
aacuuuucuuaaaaaguuaua

SEQ ID NO: 2048876 - RNA, 14 nt, Human
aacuuuuguaaaua

SEQ ID NO: 2048877 - RNA, 14 nt, Human
aacuuucucuugua

SEQ ID NO: 2048878 - RNA, 16 nt, Human
aacaacuucuuuguaa

SEQ ID NO: 2048879 - RNA, 17 nt, Human
aacaacuucuuuguaau

SEQ ID NO: 2048880 - RNA, 15 nt, Human
aacaagaaaguuucc

SEQ ID NO: 2048881 - RNA, 12 nt, Human
aacaagaaaaca

SEQ ID NO: 2048882 - RNA, 13 nt, Human
aacaagaaaacau

SEQ ID NO: 2048883 - RNA, 14 nt, Human
aacaagaaaacaua

SEQ ID NO: 2048884 - RNA, 12 nt, Human
aacaagaaagga

SEQ ID NO: 2048885 - RNA, 16 nt, Human
aacaagaaaggagagu

SEQ ID NO: 2048886 - RNA, 17 nt, Human
aacaagaaaggagaguc

SEQ ID NO: 2048887 - RNA, 14 nt, Human
aacaacuacuacuu

SEQ ID NO: 2048888 - RNA, 16 nt, Human
aacaacuaggcuucag

SEQ ID NO: 2048889 - RNA, 17 nt, Human
aacaaagaagacaacau

SEQ ID NO: 2048890 - RNA, 12 nt, Human
aacaaagccaga

SEQ ID NO: 2048891 - RNA, 14 nt, Human
aacaaagccagaag

SEQ ID NO: 2048892 - RNA, 17 nt, Human
aacaaagccagaagcug

SEQ ID NO: 2048893 - RNA, 11 nt, Human
aacaaagccag

SEQ ID NO: 2048894 - RNA, 16 nt, Human
aacaagaaaguuuccc

SEQ ID NO: 2048895 - RNA, 21 nt, Human
aacaacuuucucuuguaaacg

SEQ ID NO: 2048896 - RNA, 22 nt, Human
aacaccaagacuugaaggugcc

SEQ ID NO: 2048897 - RNA, 18 nt, Human
aaauuggauuagccugga

SEQ ID NO: 2048898 - RNA, 14 nt, Human
aaauuggcauuaaa

SEQ ID NO: 2048899 - RNA, 17 nt, Human
aaauuggcauuaaaacu

SEQ ID NO: 2048900 - RNA, 18 nt, Human
aaauuggcauuaaaacuu

SEQ ID NO: 2048901 - RNA, 16 nt, Human
aaauuggcuaguugaa

SEQ ID NO: 2048902 - RNA, 19 nt, Human
aaauuggcuaguugaaucu

SEQ ID NO: 2048903 - RNA, 15 nt, Human
aaauugggaaaggag

SEQ ID NO: 2048904 - RNA, 20 nt, Human
aaauugggaaaggaguagaa

SEQ ID NO: 2048905 - RNA, 16 nt, Human
aaauugcuugaaagaa

SEQ ID NO: 2048906 - RNA, 13 nt, Human
aaauugcuugaaa

SEQ ID NO: 2048907 - RNA, 18 nt, Human
aaauugcauuuccugaca

SEQ ID NO: 2048908 - RNA, 16 nt, Human
aaauugcaugcugcuu

SEQ ID NO: 2048909 - RNA, 17 nt, Human
aaauugcaugcugcuuu

SEQ ID NO: 2048910 - RNA, 18 nt, Human
aaauugcaugcugcuuua

SEQ ID NO: 2048911 - RNA, 19 nt, Human
aaauugcaugcugcuuuaa

SEQ ID NO: 2048912 - RNA, 21 nt, Human
aaauugcaugcugcuuuaauu

SEQ ID NO: 2048913 - RNA, 22 nt, Human
aaauugcauggguuuuguaggu

SEQ ID NO: 2048914 - RNA, 23 nt, Human
aaauugcauggguuuuguaggua

SEQ ID NO: 2048915 - RNA, 17 nt, Human
aacaaacuguguaacug

SEQ ID NO: 2048916 - RNA, 20 nt, Human
aacaaacuguguaacugccc

SEQ ID NO: 2048917 - RNA, 11 nt, Human
aacaaaaauuu

SEQ ID NO: 2048918 - RNA, 14 nt, Human
aacaaaaauuugaa

SEQ ID NO: 2048919 - RNA, 14 nt, Human
aacaaaaagcuucc

SEQ ID NO: 2048920 - RNA, 16 nt, Human
aacaaaaagcuucccc

SEQ ID NO: 2048921 - RNA, 22 nt, Human
aacaccuucagaggcugaggug

SEQ ID NO: 2048922 - RNA, 19 nt, Human
aacagcugaggucucuuga

SEQ ID NO: 2048923 - RNA, 21 nt, Human
aacagcugaggucucuugagg

SEQ ID NO: 2048924 - RNA, 20 nt, Human
aacagcugaggucucuugag

SEQ ID NO: 2048925 - RNA, 12 nt, Human
aacaucaauguu

SEQ ID NO: 2048926 - RNA, 13 nt, Human
aacaucaauguuc

SEQ ID NO: 2048927 - RNA, 14 nt, Human
aacaucaauguuca

SEQ ID NO: 2048928 - RNA, 14 nt, Human
aacagcucaggcug

SEQ ID NO: 2048929 - RNA, 14 nt, Human
aacaugaugaaacc

SEQ ID NO: 2048930 - RNA, 19 nt, Human
aacaugcaauuuugcauuu

SEQ ID NO: 2048931 - RNA, 22 nt, Human
aacaugcaauuuugcauuugaa

SEQ ID NO: 2048932 - RNA, 22 nt, Human
aacaugccugccccaaacaaau

SEQ ID NO: 2048933 - RNA, 21 nt, Human
aacaugccugccccaaacaaa

SEQ ID NO: 2048934 - RNA, 18 nt, Human
aacaucaguuacucugaa

SEQ ID NO: 2048935 - RNA, 19 nt, Human
aacaucaguuacucugaag

SEQ ID NO: 2048936 - RNA, 21 nt, Human
aacaucaguuacucugaaggg

SEQ ID NO: 2048937 - RNA, 13 nt, Human
aacaucacacaca

SEQ ID NO: 2048938 - RNA, 18 nt, Human
aacaucaauguucauugu

SEQ ID NO: 2048939 - RNA, 19 nt, Human
aacaucaauguucauugua

SEQ ID NO: 2048940 - RNA, 17 nt, Human
aacaucacugaaaugcu

SEQ ID NO: 2048941 - RNA, 12 nt, Human
aacccugccccu

SEQ ID NO: 2048942 - RNA, 14 nt, Human
aacccugccccugc

SEQ ID NO: 2048943 - RNA, 11 nt, Human
aacccugcccc

SEQ ID NO: 2048944 - RNA, 14 nt, Human
aaccaguguagccu

SEQ ID NO: 2048945 - RNA, 14 nt, Human
aaccagucugaagu

SEQ ID NO: 2048946 - RNA, 15 nt, Human
aaccagucugaaguu

SEQ ID NO: 2048947 - RNA, 21 nt, Human
aaccagucugaaguuucauuu

SEQ ID NO: 2048948 - RNA, 22 nt, Human
aaccagucugaaguuucauuua

SEQ ID NO: 2048949 - RNA, 23 nt, Human
aaccagucugaaguuucauuuau

SEQ ID NO: 2048950 - RNA, 12 nt, Human
aaccacugcuuc

SEQ ID NO: 2048951 - RNA, 13 nt, Human
aaccacugcuucc

SEQ ID NO: 2048952 - RNA, 20 nt, Human
aaccacugcuuccauuuaau

SEQ ID NO: 2048953 - RNA, 23 nt, Human
aacauguaauuaaguacuaugua

SEQ ID NO: 2048954 - RNA, 14 nt, Human
aacauguaauuaag

SEQ ID NO: 2048955 - RNA, 21 nt, Human
aacauguaauuaaguacuaug

SEQ ID NO: 2048956 - RNA, 21 nt, Human
aaccacgucugucuucacagc

SEQ ID NO: 2048957 - RNA, 15 nt, Human
aacccuguuuuauac

SEQ ID NO: 2048958 - RNA, 19 nt, Human
aacccugccccugccccgu

SEQ ID NO: 2048959 - RNA, 19 nt, Human
acgugauuuugcuguagaa

SEQ ID NO: 2048960 - RNA, 23 nt, Human
acgccacugcacuccagccuggg

SEQ ID NO: 2048961 - RNA, 16 nt, Human
acgugcacgcacacug

SEQ ID NO: 2048962 - RNA, 21 nt, Human
acgugcaccuguacucaggag

SEQ ID NO: 2048963 - RNA, 23 nt, Human
acgugcaccuguacucaggaggc

SEQ ID NO: 2048964 - RNA, 20 nt, Human
acgugcaccuguacucagga

SEQ ID NO: 2048965 - RNA, 18 nt, Human
acuaagauguucacugug

SEQ ID NO: 2048966 - RNA, 22 nt, Human
acuaauaaaagcauaaaugcaa

SEQ ID NO: 2048967 - RNA, 18 nt, Human
acgccacugcacuauagc

SEQ ID NO: 2048968 - RNA, 14 nt, Human
acgccacugcacuc

SEQ ID NO: 2048969 - RNA, 20 nt, Human
acgccacugcacuccagccu

SEQ ID NO: 2048970 - RNA, 21 nt, Human
acgccacugcacuccagccug

SEQ ID NO: 2048971 - RNA, 22 nt, Human
acgccacugcacuccagccugg

SEQ ID NO: 2048972 - RNA, 18 nt, Human
acgauuuagaaagaagcc

SEQ ID NO: 2048973 - RNA, 22 nt, Human
acgauguggcccuggccugcug

SEQ ID NO: 2048974 - RNA, 16 nt, Human
acgauguggcccuggc

SEQ ID NO: 2048975 - RNA, 17 nt, Human
acgauguggcccuggcc

SEQ ID NO: 2048976 - RNA, 18 nt, Human
acgauguggcccuggccu

SEQ ID NO: 2048977 - RNA, 19 nt, Human
acgauguggcccuggccug

SEQ ID NO: 2048978 - RNA, 14 nt, Human
acgauguggcccug

SEQ ID NO: 2048979 - RNA, 14 nt, Human
acgaugaaaaacuu

SEQ ID NO: 2048980 - RNA, 14 nt, Human
accuuggcugcagg

SEQ ID NO: 2048981 - RNA, 21 nt, Human
accuuuauuccuucauuucau

SEQ ID NO: 2048982 - RNA, 23 nt, Human
accuuuauuccuucauuucaucu

SEQ ID NO: 2048983 - RNA, 12 nt, Human
accuuggcucaa

SEQ ID NO: 2048984 - RNA, 19 nt, Human
accugucaaacaaagccag

SEQ ID NO: 2048985 - RNA, 20 nt, Human
accugucaaacaaagccaga

SEQ ID NO: 2048986 - RNA, 24 nt, Human
accugucaaacaaagccagaagcu

SEQ ID NO: 2048987 - RNA, 12 nt, Human
accugucaauac

SEQ ID NO: 2048988 - RNA, 14 nt, Human
accugucaauacua

SEQ ID NO: 2048989 - RNA, 12 nt, Human
accuuggcugca

SEQ ID NO: 2048990 - RNA, 14 nt, Human
accuuggcucaagu

SEQ ID NO: 2048991 - RNA, 17 nt, Human
accugcccccuucuccc

SEQ ID NO: 2048992 - RNA, 15 nt, Human
accugcccccuucuc

SEQ ID NO: 2048993 - RNA, 16 nt, Human
accugcccccuucucc

SEQ ID NO: 2048994 - RNA, 17 nt, Human
accuguagucccagcua

SEQ ID NO: 2048995 - RNA, 18 nt, Human
accuguagucccagcuac

SEQ ID NO: 2048996 - RNA, 12 nt, Human
accuguacucag

SEQ ID NO: 2048997 - RNA, 14 nt, Human
accuguacuggaga

SEQ ID NO: 2048998 - RNA, 15 nt, Human
accuguacuggagag

SEQ ID NO: 2048999 - RNA, 14 nt, Human
accuguagucccag

SEQ ID NO: 2049000 - RNA, 17 nt, Human
accuuuauuuuagaauu

SEQ ID NO: 2049001 - RNA, 17 nt, Human
accuuucaaauuucaca

SEQ ID NO: 2049002 - RNA, 21 nt, Human
accucugcacaagcugcaccc

SEQ ID NO: 2049003 - RNA, 13 nt, Human
accucuuccccag

SEQ ID NO: 2049004 - RNA, 14 nt, Human
accucuuccccaga

SEQ ID NO: 2049005 - RNA, 16 nt, Human
accucugcacaagcug

SEQ ID NO: 2049006 - RNA, 18 nt, Human
accucugcacaagcugca

SEQ ID NO: 2049007 - RNA, 12 nt, Human
accugcccccuu

SEQ ID NO: 2049008 - RNA, 15 nt, Human
accugcccccuggug

SEQ ID NO: 2049009 - RNA, 18 nt, Human
accugcccccuucuccca

SEQ ID NO: 2049010 - RNA, 13 nt, Human
accugcccccugg

SEQ ID NO: 2049011 - RNA, 13 nt, Human
accugccccaucc

SEQ ID NO: 2049012 - RNA, 14 nt, Human
accugccccauccc

SEQ ID NO: 2049013 - RNA, 19 nt, Human
accucuuccggagauguag

SEQ ID NO: 2049014 - RNA, 22 nt, Human
accucuuccccagaaaggagac

SEQ ID NO: 2049015 - RNA, 23 nt, Human
accucuuccccagaaaggagacu

SEQ ID NO: 2049016 - RNA, 13 nt, Human
accugcccaaccu

SEQ ID NO: 2049017 - RNA, 21 nt, Human
accugcccaaccugcucuccu

SEQ ID NO: 2049018 - RNA, 20 nt, Human
accugcccagaucccagaag

SEQ ID NO: 2049019 - RNA, 15 nt, Human
accugcccaucacag

SEQ ID NO: 2049020 - RNA, 22 nt, Human
accugcccagaucccagaagga

SEQ ID NO: 2049021 - RNA, 15 nt, Human
acuagccucuccagg

SEQ ID NO: 2049022 - RNA, 21 nt, Human
acuagggauucaggcugcuug

SEQ ID NO: 2049023 - RNA, 16 nt, Human
acuagggauucaggcu

SEQ ID NO: 2049024 - RNA, 17 nt, Human
acuagggauucaggcug

SEQ ID NO: 2049025 - RNA, 18 nt, Human
acuagggauucaggcugc

SEQ ID NO: 2049026 - RNA, 19 nt, Human
acuagggauucaggcugcu

SEQ ID NO: 2049027 - RNA, 15 nt, Human
acuaguuacacaucu

SEQ ID NO: 2049028 - RNA, 18 nt, Human
acuaguuacacaucuuca

SEQ ID NO: 2049029 - RNA, 22 nt, Human
acuaguuacacaucuucaacag

SEQ ID NO: 2049030 - RNA, 21 nt, Human
acuaggcaguuagagaugccu

SEQ ID NO: 2049031 - RNA, 16 nt, Human
acuaggacucugaggc

SEQ ID NO: 2049032 - RNA, 17 nt, Human
acuaggacucugaggcu

SEQ ID NO: 2049033 - RNA, 19 nt, Human
acuagcuaucuagguggag

SEQ ID NO: 2049034 - RNA, 23 nt, Human
acuagcuagaagugggccaggac

SEQ ID NO: 2049035 - RNA, 22 nt, Human
acuagcuggaauuuuuuauucu

SEQ ID NO: 2049036 - RNA, 23 nt, Human
acuagcuggaauuuuuuauucuu

SEQ ID NO: 2049037 - RNA, 24 nt, Human
acuagcuggaauuuuuuauucuug

SEQ ID NO: 2049038 - RNA, 14 nt, Human
acuagcuuacauga

SEQ ID NO: 2049039 - RNA, 19 nt, Human
acuagcuuacaugagaaca

SEQ ID NO: 2049040 - RNA, 20 nt, Human
acuagcuuacaugagaacag

SEQ ID NO: 2049041 - RNA, 13 nt, Human
acucaguuuguca

SEQ ID NO: 2049042 - RNA, 14 nt, Human
acucaguuugucag

SEQ ID NO: 2049043 - RNA, 15 nt, Human
acucaguuugucaga

SEQ ID NO: 2049044 - RNA, 19 nt, Human
acucaguuugucagacuuu

SEQ ID NO: 2049045 - RNA, 13 nt, Human
acucagggcccca

SEQ ID NO: 2049046 - RNA, 14 nt, Human
acucagggccccag

SEQ ID NO: 2049047 - RNA, 21 nt, Human
acucagcccugggccccacca

SEQ ID NO: 2049048 - RNA, 12 nt, Human
acuccccugcac

SEQ ID NO: 2049049 - RNA, 16 nt, Human
acuccccugcacugga

SEQ ID NO: 2049050 - RNA, 22 nt, Human
acuccccugcacuggaguccag

SEQ ID NO: 2049051 - RNA, 14 nt, Human
acucccccaggugg

SEQ ID NO: 2049052 - RNA, 22 nt, Human
acucaguuugucagacuuuaaa

SEQ ID NO: 2049053 - RNA, 13 nt, Human
acucaguuuucuu

SEQ ID NO: 2049054 - RNA, 22 nt, Human
acucaguuuuaacuagaauuua

SEQ ID NO: 2049055 - RNA, 15 nt, Human
acucaguuuuaacua

SEQ ID NO: 2049056 - RNA, 18 nt, Human
acuauaaagguugacaau

SEQ ID NO: 2049057 - RNA, 20 nt, Human
acuauaaagaaguaacaaaa

SEQ ID NO: 2049058 - RNA, 23 nt, Human
acuaguuuuuagaaaagaaagca

SEQ ID NO: 2049059 - RNA, 18 nt, Human
acucaaaagcugggcagg

SEQ ID NO: 2049060 - RNA, 11 nt, Human
acuauaaugua

SEQ ID NO: 2049061 - RNA, 17 nt, Human
acucaaacucuuaaaac

SEQ ID NO: 2049062 - RNA, 16 nt, Human
acucaaacucuuaaaa

SEQ ID NO: 2049063 - RNA, 13 nt, Human
acucaaacacaga

SEQ ID NO: 2049064 - RNA, 15 nt, Human
acucaaacacagaga

SEQ ID NO: 2049065 - RNA, 21 nt, Human
acucaaacugccuuggcuuca

SEQ ID NO: 2049066 - RNA, 17 nt, Human
acucaaaggguggaaua

SEQ ID NO: 2049067 - RNA, 20 nt, Human
acucaaaguuaaccuaccug

SEQ ID NO: 2049068 - RNA, 13 nt, Human
acucagcagcccu

SEQ ID NO: 2049069 - RNA, 15 nt, Human
acuaggaaaauugga

SEQ ID NO: 2049070 - RNA, 21 nt, Human
acucagauggaaccgcaggaa

SEQ ID NO: 2049071 - RNA, 22 nt, Human
acucagauggaaccgcaggaag

SEQ ID NO: 2049072 - RNA, 23 nt, Human
acucagauggaaccgcaggaagc

SEQ ID NO: 2049073 - RNA, 22 nt, Human
acucagaugucucuggcgugug

SEQ ID NO: 2049074 - RNA, 14 nt, Human
acucagcagcccuc

SEQ ID NO: 2049075 - RNA, 15 nt, Human
acucagcagcccucc

SEQ ID NO: 2049076 - RNA, 15 nt, Human
acucagcccugaggu

SEQ ID NO: 2049077 - RNA, 17 nt, Human
acucagcagcccuccuc

SEQ ID NO: 2049078 - RNA, 12 nt, Human
acucagcccugg

SEQ ID NO: 2049079 - RNA, 13 nt, Human
acucagcccuggg

SEQ ID NO: 2049080 - RNA, 14 nt, Human
acucagcccugggc

SEQ ID NO: 2049081 - RNA, 15 nt, Human
acucagcccugggcc

SEQ ID NO: 2049082 - RNA, 16 nt, Human
acucagcccugggccc

SEQ ID NO: 2049083 - RNA, 22 nt, Human
acucagcccugggccccaccac

SEQ ID NO: 2049084 - RNA, 13 nt, Human
acucccuccucac

SEQ ID NO: 2049085 - RNA, 13 nt, Human
acucccuucuccu

SEQ ID NO: 2049086 - RNA, 20 nt, Human
acuccccuugagcugagaug

SEQ ID NO: 2049087 - RNA, 15 nt, Human
acuccccuugagcug

SEQ ID NO: 2049088 - RNA, 17 nt, Human
acuccccuugagcugag

SEQ ID NO: 2049089 - RNA, 15 nt, Human
acucuauagacucua

SEQ ID NO: 2049090 - RNA, 18 nt, Human
acucuauagacucuagga

SEQ ID NO: 2049091 - RNA, 19 nt, Human
acucugggaaauaagagag

SEQ ID NO: 2049092 - RNA, 13 nt, Human
acucugggaaaua

SEQ ID NO: 2049093 - RNA, 12 nt, Human
acucuggccucu

SEQ ID NO: 2049094 - RNA, 13 nt, Human
acucuggccucug

SEQ ID NO: 2049095 - RNA, 14 nt, Human
acucuggccucugu

SEQ ID NO: 2049096 - RNA, 16 nt, Human
acucuggccucuguca

SEQ ID NO: 2049097 - RNA, 17 nt, Human
acucugggcugcuaccc

SEQ ID NO: 2049098 - RNA, 16 nt, Human
acucugugucaggugg

SEQ ID NO: 2049099 - RNA, 17 nt, Human
acucuguggggccuugg

SEQ ID NO: 2049100 - RNA, 15 nt, Human
acucuguggccaaag

SEQ ID NO: 2049101 - RNA, 16 nt, Human
acucuguggggccuug

SEQ ID NO: 2049102 - RNA, 11 nt, Human
acucuuaaaac

SEQ ID NO: 2049103 - RNA, 18 nt, Human
acucuuaaaacccaagug

SEQ ID NO: 2049104 - RNA, 20 nt, Human
acucuguuccuucacauccu

SEQ ID NO: 2049105 - RNA, 22 nt, Human
acucuguuccuucacauccugu

SEQ ID NO: 2049106 - RNA, 17 nt, Human
acucuguuccuucacau

SEQ ID NO: 2049107 - RNA, 12 nt, Human
acucuguuccug

SEQ ID NO: 2049108 - RNA, 15 nt, Human
acucuguuccuggcu

SEQ ID NO: 2049109 - RNA, 16 nt, Human
acucuguuccuggcuc

SEQ ID NO: 2049110 - RNA, 14 nt, Human
acucuguuccuuca

SEQ ID NO: 2049111 - RNA, 13 nt, Human
acucuaccucaua

SEQ ID NO: 2049112 - RNA, 22 nt, Human
acucuaccucauaucaguuugc

SEQ ID NO: 2049113 - RNA, 21 nt, Human
acucuacccucuuagaaaaac

SEQ ID NO: 2049114 - RNA, 13 nt, Human
acucuacccucuu

SEQ ID NO: 2049115 - RNA, 18 nt, Human
acucuacccucuuagaaa

SEQ ID NO: 2049116 - RNA, 15 nt, Human
acuuauuuauauaaa

SEQ ID NO: 2049117 - RNA, 17 nt, Human
acuucacacacaggcaa

SEQ ID NO: 2049118 - RNA, 19 nt, Human
acuucacacacaggcaacu

SEQ ID NO: 2049119 - RNA, 13 nt, Human
acuucacacugca

SEQ ID NO: 2049120 - RNA, 14 nt, Human
acuucacacugcaa

SEQ ID NO: 2049121 - RNA, 15 nt, Human
acuucacacugcaag

SEQ ID NO: 2049122 - RNA, 16 nt, Human
acuucacacugcaaga

SEQ ID NO: 2049123 - RNA, 19 nt, Human
acuucacacugcaagagcc

SEQ ID NO: 2049124 - RNA, 23 nt, Human
acuucacacugcaagagccuugg

SEQ ID NO: 2049125 - RNA, 13 nt, Human
acuuauugcuuug

SEQ ID NO: 2049126 - RNA, 14 nt, Human
acuuauugcuuuga

SEQ ID NO: 2049127 - RNA, 15 nt, Human
acuuauugcuuugaa

SEQ ID NO: 2049128 - RNA, 16 nt, Human
acuuauugcuuugaaa

SEQ ID NO: 2049129 - RNA, 18 nt, Human
acuuauugcuuugaaacu

SEQ ID NO: 2049130 - RNA, 16 nt, Human
acuguuuauucaacaa

SEQ ID NO: 2049131 - RNA, 12 nt, Human
acuguuuguuau

SEQ ID NO: 2049132 - RNA, 20 nt, Human
acuguuuacaagaaaaaaug

SEQ ID NO: 2049133 - RNA, 15 nt, Human
acuucuuuuauaacu

SEQ ID NO: 2049134 - RNA, 22 nt, Human
acuucuuuuauaacuaguccuu

SEQ ID NO: 2049135 - RNA, 19 nt, Human
acuucugccauauucuguu

SEQ ID NO: 2049136 - RNA, 18 nt, Human
acuucugccauauucugu

SEQ ID NO: 2049137 - RNA, 16 nt, Human
acuucugaccacacuu

SEQ ID NO: 2049138 - RNA, 18 nt, Human
acuuguaaaugugguaaa

SEQ ID NO: 2049139 - RNA, 14 nt, Human
acuuguaaaugcug

SEQ ID NO: 2049140 - RNA, 14 nt, Human
acuuguaaguugcu

SEQ ID NO: 2049141 - RNA, 20 nt, Human
acuuguaaaugugguaaaga

SEQ ID NO: 2049142 - RNA, 12 nt, Human
acugucuucagu

SEQ ID NO: 2049143 - RNA, 12 nt, Human
acugucuuucag

SEQ ID NO: 2049144 - RNA, 23 nt, Human
acugugaucaggcuauguaugga

SEQ ID NO: 2049145 - RNA, 10 nt, Human
acugucuuaa

SEQ ID NO: 2049146 - RNA, 11 nt, Human
acugucuuaau

SEQ ID NO: 2049147 - RNA, 14 nt, Human
acugucuuaauuaa

SEQ ID NO: 2049148 - RNA, 17 nt, Human
acugucuuaauuaagua

SEQ ID NO: 2049149 - RNA, 19 nt, Human
acugucuuaauuaaguaaa

SEQ ID NO: 2049150 - RNA, 13 nt, Human
acugugaugccac

SEQ ID NO: 2049151 - RNA, 20 nt, Human
acugugaugccacacagagu

SEQ ID NO: 2049152 - RNA, 22 nt, Human
acugugaugccacacagagugg

SEQ ID NO: 2049153 - RNA, 16 nt, Human
acugugccaugugcca

SEQ ID NO: 2049154 - RNA, 20 nt, Human
acugguggcccgacagccug

SEQ ID NO: 2049155 - RNA, 22 nt, Human
acugguggcccgacagccuggc

SEQ ID NO: 2049156 - RNA, 21 nt, Human
acugguggcccgacagccugg

SEQ ID NO: 2049157 - RNA, 23 nt, Human
acugguggcccgacagccuggca

SEQ ID NO: 2049158 - RNA, 14 nt, Human
acugguguccagcu

SEQ ID NO: 2049159 - RNA, 20 nt, Human
acuggugggaucugugccca

SEQ ID NO: 2049160 - RNA, 14 nt, Human
acuggacucaggau

SEQ ID NO: 2049161 - RNA, 20 nt, Human
acuggacucaggaugcccag

SEQ ID NO: 2049162 - RNA, 21 nt, Human
acuggacucaggaugcccagg

SEQ ID NO: 2049163 - RNA, 23 nt, Human
acuggacucaggaugcccagggc

SEQ ID NO: 2049164 - RNA, 22 nt, Human
acuggacuugagcuuggcagcu

SEQ ID NO: 2049165 - RNA, 18 nt, Human
acuggguggggugaggac

SEQ ID NO: 2049166 - RNA, 20 nt, Human
acuggguggggugaggacca

SEQ ID NO: 2049167 - RNA, 22 nt, Human
acuggguggggugaggaccacu

SEQ ID NO: 2049168 - RNA, 13 nt, Human
acuggguugacuu

SEQ ID NO: 2049169 - RNA, 20 nt, Human
acuggguugacuuucaggua

SEQ ID NO: 2049170 - RNA, 20 nt, Human
acuggguuucucuguauagu

SEQ ID NO: 2049171 - RNA, 17 nt, Human
acugccccgugcagacu

SEQ ID NO: 2049172 - RNA, 18 nt, Human
acugccccgugcagacug

SEQ ID NO: 2049173 - RNA, 19 nt, Human
acugccccgugcagacugg

SEQ ID NO: 2049174 - RNA, 23 nt, Human
acugccccgugcagacuggaggg

SEQ ID NO: 2049175 - RNA, 14 nt, Human
acugcccgagcugg

SEQ ID NO: 2049176 - RNA, 15 nt, Human
acugcccgagcuggu

SEQ ID NO: 2049177 - RNA, 16 nt, Human
acugcccgagcuggug

SEQ ID NO: 2049178 - RNA, 18 nt, Human
acugcccgagcuggugca

SEQ ID NO: 2049179 - RNA, 14 nt, Human
acuggaagcacagc

SEQ ID NO: 2049180 - RNA, 21 nt, Human
acugcccgagcuggugcauua

SEQ ID NO: 2049181 - RNA, 15 nt, Human
acuggaagcacagcu

SEQ ID NO: 2049182 - RNA, 16 nt, Human
acuggaagcacagcuu

SEQ ID NO: 2049183 - RNA, 12 nt, Human
acuggaagcaca

SEQ ID NO: 2049184 - RNA, 14 nt, Human
acuggaagcacaga

SEQ ID NO: 2049185 - RNA, 19 nt, Human
acugcccgagcuggugcau

SEQ ID NO: 2049186 - RNA, 20 nt, Human
acugcccgagcuggugcauu

SEQ ID NO: 2049187 - RNA, 13 nt, Human
acugaaggagaag

SEQ ID NO: 2049188 - RNA, 14 nt, Human
acugaaggagaagg

SEQ ID NO: 2049189 - RNA, 21 nt, Human
acugaaggagaaggugcccca

SEQ ID NO: 2049190 - RNA, 13 nt, Human
acugaagcuuuuu

SEQ ID NO: 2049191 - RNA, 14 nt, Human
acugaagcuuuuua

SEQ ID NO: 2049192 - RNA, 11 nt, Human
acugaaggaga

SEQ ID NO: 2049193 - RNA, 14 nt, Human
acugaaggcuuuca

SEQ ID NO: 2049194 - RNA, 20 nt, Human
acugaaggcuuucagggccu

SEQ ID NO: 2049195 - RNA, 17 nt, Human
acugaagguaaaauuga

SEQ ID NO: 2049196 - RNA, 22 nt, Human
acugccacacgucugacccucu

SEQ ID NO: 2049197 - RNA, 21 nt, Human
acugccaaagggaaauaucau

SEQ ID NO: 2049198 - RNA, 20 nt, Human
agaaaagggaacugaacauu

SEQ ID NO: 2049199 - RNA, 17 nt, Human
acuuuucuuaaaaaguu

SEQ ID NO: 2049200 - RNA, 15 nt, Human
agaaaaguaagcccu

SEQ ID NO: 2049201 - RNA, 12 nt, Human
acuuuucguuaa

SEQ ID NO: 2049202 - RNA, 16 nt, Human
acuuuucguuaacauu

SEQ ID NO: 2049203 - RNA, 17 nt, Human
acuuuucguuaacauug

SEQ ID NO: 2049204 - RNA, 22 nt, Human
acuuuucguuaacauugaccaa

SEQ ID NO: 2049205 - RNA, 17 nt, Human
acuuuucuauuaaaagu

SEQ ID NO: 2049206 - RNA, 15 nt, Human
acuuuucuccaugag

SEQ ID NO: 2049207 - RNA, 11 nt, Human
acuuuucugua

SEQ ID NO: 2049208 - RNA, 12 nt, Human
acuuuuccuucc

SEQ ID NO: 2049209 - RNA, 13 nt, Human
acuuuuccuuccc

SEQ ID NO: 2049210 - RNA, 23 nt, Human
acuuuuccuucccucaaagcuuc

SEQ ID NO: 2049211 - RNA, 15 nt, Human
acuuuuauaaauuaa

SEQ ID NO: 2049212 - RNA, 16 nt, Human
acuuuuauaaauuaaa

SEQ ID NO: 2049213 - RNA, 17 nt, Human
acuuuuauaaauuaaau

SEQ ID NO: 2049214 - RNA, 18 nt, Human
acuuuuauaaauuaaaua

SEQ ID NO: 2049215 - RNA, 21 nt, Human
acuuuuauaaauuaaauauau

SEQ ID NO: 2049216 - RNA, 13 nt, Human
agaaaauaaaauu

SEQ ID NO: 2049217 - RNA, 18 nt, Human
agaaaauaaaauuaagaa

SEQ ID NO: 2049218 - RNA, 19 nt, Human
agaaaauaaaauuaagaau

SEQ ID NO: 2049219 - RNA, 21 nt, Human
agaaaauaaaauuaagaaugu

SEQ ID NO: 2049220 - RNA, 22 nt, Human
agaaaauaaaauuaagaauguu

SEQ ID NO: 2049221 - RNA, 19 nt, Human
agaaaauguaaauaaagga

SEQ ID NO: 2049222 - RNA, 12 nt, Human
agaaacaaaccc

SEQ ID NO: 2049223 - RNA, 13 nt, Human
agaaaauugaauu

SEQ ID NO: 2049224 - RNA, 14 nt, Human
agaaaauugaauuu

SEQ ID NO: 2049225 - RNA, 16 nt, Human
agaaaauugaauuuaa

SEQ ID NO: 2049226 - RNA, 17 nt, Human
agaaaauugaauuuaac

SEQ ID NO: 2049227 - RNA, 18 nt, Human
agaaaauugaauuuaaca

SEQ ID NO: 2049228 - RNA, 19 nt, Human
agaaaauugaauuuaacaa

SEQ ID NO: 2049229 - RNA, 20 nt, Human
agaaaauugaauuuaacaau

SEQ ID NO: 2049230 - RNA, 22 nt, Human
agaaaauugaauuuaacaaugc

SEQ ID NO: 2049231 - RNA, 23 nt, Human
acuuuccuucauucaacccaccu

SEQ ID NO: 2049232 - RNA, 16 nt, Human
acuuuccacccccucc

SEQ ID NO: 2049233 - RNA, 18 nt, Human
acuuuccacccccucccu

SEQ ID NO: 2049234 - RNA, 19 nt, Human
acuuuccacccccucccug

SEQ ID NO: 2049235 - RNA, 20 nt, Human
acuuuccacccccucccugg

SEQ ID NO: 2049236 - RNA, 18 nt, Human
acuuucagugaaagcauc

SEQ ID NO: 2049237 - RNA, 13 nt, Human
acuuucauugcca

SEQ ID NO: 2049238 - RNA, 16 nt, Human
acuuucauugccagug

SEQ ID NO: 2049239 - RNA, 17 nt, Human
acuuucauugccagugu

SEQ ID NO: 2049240 - RNA, 18 nt, Human
acuuucauugccaguguc

SEQ ID NO: 2049241 - RNA, 20 nt, Human
acuuucauugccagugucuu

SEQ ID NO: 2049242 - RNA, 21 nt, Human
acuuucauugccagugucuuu

SEQ ID NO: 2049243 - RNA, 19 nt, Human
acuuucauuaaagcauuua

SEQ ID NO: 2049244 - RNA, 11 nt, Human
agaaaggagac

SEQ ID NO: 2049245 - RNA, 12 nt, Human
agaaaggagagu

SEQ ID NO: 2049246 - RNA, 18 nt, Human
agaaaggagagucuugca

SEQ ID NO: 2049247 - RNA, 19 nt, Human
agaaaggagagucuugcag

SEQ ID NO: 2049248 - RNA, 23 nt, Human
agaaaggaggggauagagagaga

SEQ ID NO: 2049249 - RNA, 20 nt, Human
agaaaggaggggauagagag

SEQ ID NO: 2049250 - RNA, 15 nt, Human
agaaauaaaguuucu

SEQ ID NO: 2049251 - RNA, 18 nt, Human
agaaauaaaguuucuguu

SEQ ID NO: 2049252 - RNA, 21 nt, Human
agaaauaaaguuggugacaga

SEQ ID NO: 2049253 - RNA, 19 nt, Human
agaaauaaaguuggugaca

SEQ ID NO: 2049254 - RNA, 17 nt, Human
acauguuaaacuuacuu

SEQ ID NO: 2049255 - RNA, 16 nt, Human
acauguuacugaccag

SEQ ID NO: 2049256 - RNA, 19 nt, Human
acauguuacugaccagcaa

SEQ ID NO: 2049257 - RNA, 17 nt, Human
acauguuacugaccagc

SEQ ID NO: 2049258 - RNA, 21 nt, Human
acauguuuuucuucucccuca

SEQ ID NO: 2049259 - RNA, 15 nt, Human
acauguucccuucuc

SEQ ID NO: 2049260 - RNA, 15 nt, Human
acauguugguauuua

SEQ ID NO: 2049261 - RNA, 18 nt, Human
acauguugguauuuaucu

SEQ ID NO: 2049262 - RNA, 20 nt, Human
acauguugguauuuaucuau

SEQ ID NO: 2049263 - RNA, 12 nt, Human
acauuaaagcag

SEQ ID NO: 2049264 - RNA, 13 nt, Human
acauuaaagcagu

SEQ ID NO: 2049265 - RNA, 14 nt, Human
acauuaaagcaguc

SEQ ID NO: 2049266 - RNA, 15 nt, Human
acauuaaaacaauau

SEQ ID NO: 2049267 - RNA, 22 nt, Human
acauuaaaacaauauuguuucu

SEQ ID NO: 2049268 - RNA, 12 nt, Human
acauuaaauaau

SEQ ID NO: 2049269 - RNA, 12 nt, Human
acauuaaacaca

SEQ ID NO: 2049270 - RNA, 23 nt, Human
acauccuguguuucuagggaaau

SEQ ID NO: 2049271 - RNA, 12 nt, Human
acauccuugugg

SEQ ID NO: 2049272 - RNA, 15 nt, Human
acauccuuguggcac

SEQ ID NO: 2049273 - RNA, 18 nt, Human
acauccuuguggcacauu

SEQ ID NO: 2049274 - RNA, 20 nt, Human
acauccuuguggcacauuuu

SEQ ID NO: 2049275 - RNA, 14 nt, Human
acauccuguguuuc

SEQ ID NO: 2049276 - RNA, 16 nt, Human
acauccuguguuucua

SEQ ID NO: 2049277 - RNA, 14 nt, Human
acaucgcccuccac

SEQ ID NO: 2049278 - RNA, 20 nt, Human
acauccauuucaucuauuuc

SEQ ID NO: 2049279 - RNA, 20 nt, Human
acaucccacucacaacagcu

SEQ ID NO: 2049280 - RNA, 23 nt, Human
acauaaauaaauuaaauaaaaua

SEQ ID NO: 2049281 - RNA, 19 nt, Human
acauccaggcaauggccua

SEQ ID NO: 2049282 - RNA, 23 nt, Human
acauccaaggagaaacagagaca

SEQ ID NO: 2049283 - RNA, 13 nt, Human
acauccaaggaga

SEQ ID NO: 2049284 - RNA, 14 nt, Human
acauccaaggagaa

SEQ ID NO: 2049285 - RNA, 22 nt, Human
acauccaaggagaaacagagac

SEQ ID NO: 2049286 - RNA, 18 nt, Human
acauaaagguuauuuucu

SEQ ID NO: 2049287 - RNA, 22 nt, Human
acauaaagguuauuuucuccug

SEQ ID NO: 2049288 - RNA, 23 nt, Human
acauaaagguuauuuucuccuga

SEQ ID NO: 2049289 - RNA, 13 nt, Human
acauaaaggauaa

SEQ ID NO: 2049290 - RNA, 17 nt, Human
acauaaaggauaaacuu

SEQ ID NO: 2049291 - RNA, 21 nt, Human
acauaaaggugguaugugugu

SEQ ID NO: 2049292 - RNA, 13 nt, Human
acauaaauuagag

SEQ ID NO: 2049293 - RNA, 16 nt, Human
acauccaagcuuccuu

SEQ ID NO: 2049294 - RNA, 12 nt, Human
acauaaaaaguu

SEQ ID NO: 2049295 - RNA, 13 nt, Human
acauaaaaaguua

SEQ ID NO: 2049296 - RNA, 17 nt, Human
acauaaaaaguuaaaaa

SEQ ID NO: 2049297 - RNA, 22 nt, Human
acauaaaaaguuaaaaaaaaua

SEQ ID NO: 2049298 - RNA, 13 nt, Human
accaaggaccccu

SEQ ID NO: 2049299 - RNA, 16 nt, Human
accaaggaccccucac

SEQ ID NO: 2049300 - RNA, 20 nt, Human
accacgauguggcccuggcc

SEQ ID NO: 2049301 - RNA, 21 nt, Human
accacgauguggcccuggccu

SEQ ID NO: 2049302 - RNA, 22 nt, Human
accacgauguggcccuggccug

SEQ ID NO: 2049303 - RNA, 17 nt, Human
accaagcucacaguucc

SEQ ID NO: 2049304 - RNA, 14 nt, Human
accaagcugcugug

SEQ ID NO: 2049305 - RNA, 20 nt, Human
accaagcugugacccucaau

SEQ ID NO: 2049306 - RNA, 18 nt, Human
accaagcucacaguuccu

SEQ ID NO: 2049307 - RNA, 19 nt, Human
accaagcucacaguuccuc

SEQ ID NO: 2049308 - RNA, 23 nt, Human
accacuaaaagaucgcaguuugc

SEQ ID NO: 2049309 - RNA, 13 nt, Human
accagcagccugg

SEQ ID NO: 2049310 - RNA, 14 nt, Human
accagcagccugga

SEQ ID NO: 2049311 - RNA, 17 nt, Human
accagcagccuggaccc

SEQ ID NO: 2049312 - RNA, 17 nt, Human
accacuacaugcagccc

SEQ ID NO: 2049313 - RNA, 14 nt, Human
acauuuggguaaau

SEQ ID NO: 2049314 - RNA, 17 nt, Human
acauuuggguaaaucau

SEQ ID NO: 2049315 - RNA, 18 nt, Human
acauuuggguaaaucaug

SEQ ID NO: 2049316 - RNA, 11 nt, Human
accaacuggaa

SEQ ID NO: 2049317 - RNA, 13 nt, Human
accaacuggaagc

SEQ ID NO: 2049318 - RNA, 17 nt, Human
accaacuggaagcacag

SEQ ID NO: 2049319 - RNA, 18 nt, Human
accaacuggaagcacaga

SEQ ID NO: 2049320 - RNA, 19 nt, Human
accaacuggcccucuucuu

SEQ ID NO: 2049321 - RNA, 20 nt, Human
accaacuggcccucuucuua

SEQ ID NO: 2049322 - RNA, 14 nt, Human
accaacugggccca

SEQ ID NO: 2049323 - RNA, 18 nt, Human
accccgaccaccugccca

SEQ ID NO: 2049324 - RNA, 13 nt, Human
accccgagcccua

SEQ ID NO: 2049325 - RNA, 14 nt, Human
accccgagcccuac

SEQ ID NO: 2049326 - RNA, 15 nt, Human
accccaaagccccuu

SEQ ID NO: 2049327 - RNA, 16 nt, Human
accccaaagccccuug

SEQ ID NO: 2049328 - RNA, 18 nt, Human
accccaaagccccuugcu

SEQ ID NO: 2049329 - RNA, 18 nt, Human
acccccuucucugcccau

SEQ ID NO: 2049330 - RNA, 21 nt, Human
acccccuucucugcccauucc

SEQ ID NO: 2049331 - RNA, 22 nt, Human
acccccuucucugcccauuccc

SEQ ID NO: 2049332 - RNA, 16 nt, Human
acccccuucucugcuc

SEQ ID NO: 2049333 - RNA, 17 nt, Human
acccccuucucugcucc

SEQ ID NO: 2049334 - RNA, 18 nt, Human
acccccuucucugcucca

SEQ ID NO: 2049335 - RNA, 19 nt, Human
acccccuucucugcuccac

SEQ ID NO: 2049336 - RNA, 20 nt, Human
acccccuucucugcuccacc

SEQ ID NO: 2049337 - RNA, 23 nt, Human
acccccuucucugcuccaccaca

SEQ ID NO: 2049338 - RNA, 22 nt, Human
accccuaaagagauacuuugau

SEQ ID NO: 2049339 - RNA, 17 nt, Human
accccgugaagcaucca

SEQ ID NO: 2049340 - RNA, 22 nt, Human
accccgucugggguucagcccc

SEQ ID NO: 2049341 - RNA, 23 nt, Human
accccgucugggguucagccccu

SEQ ID NO: 2049342 - RNA, 13 nt, Human
accccgggcucuc

SEQ ID NO: 2049343 - RNA, 15 nt, Human
accccgggcucucug

SEQ ID NO: 2049344 - RNA, 16 nt, Human
accccgggcucucugc

SEQ ID NO: 2049345 - RNA, 17 nt, Human
accccgggcucucugcu

SEQ ID NO: 2049346 - RNA, 18 nt, Human
accccgggcucucugcug

SEQ ID NO: 2049347 - RNA, 21 nt, Human
accccgggcucucugcuguac

SEQ ID NO: 2049348 - RNA, 16 nt, Human
acccaagugggggcag

SEQ ID NO: 2049349 - RNA, 15 nt, Human
acccaaggaggaaaa

SEQ ID NO: 2049350 - RNA, 21 nt, Human
acccaucugcaccccccuggg

SEQ ID NO: 2049351 - RNA, 22 nt, Human
acccaucugcaccccccugggc

SEQ ID NO: 2049352 - RNA, 14 nt, Human
acccauccuagaga

SEQ ID NO: 2049353 - RNA, 19 nt, Human
acccaucgguguccauuua

SEQ ID NO: 2049354 - RNA, 21 nt, Human
acccaucgguguccauuuaua

SEQ ID NO: 2049355 - RNA, 16 nt, Human
acccaucuaccccugg

SEQ ID NO: 2049356 - RNA, 17 nt, Human
acccaucuaccccugga

SEQ ID NO: 2049357 - RNA, 13 nt, Human
acccaucugcacc

SEQ ID NO: 2049358 - RNA, 20 nt, Human
acccaucugcaccccccugg

SEQ ID NO: 2049359 - RNA, 22 nt, Human
acccaauuaaguccuacuuuac

SEQ ID NO: 2049360 - RNA, 20 nt, Human
acccacaaaaguacaauuua

SEQ ID NO: 2049361 - RNA, 19 nt, Human
acccaugaagacaggacag

SEQ ID NO: 2049362 - RNA, 20 nt, Human
acccaugaagacaggacagu

SEQ ID NO: 2049363 - RNA, 13 nt, Human
acccaugaggcaa

SEQ ID NO: 2049364 - RNA, 20 nt, Human
acccaugaggcaaugucagg

SEQ ID NO: 2049365 - RNA, 18 nt, Human
acccaugaugagcuccuc

SEQ ID NO: 2049366 - RNA, 17 nt, Human
accaucaugucuggcua

SEQ ID NO: 2049367 - RNA, 16 nt, Human
accaucaugucuggcu

SEQ ID NO: 2049368 - RNA, 14 nt, Human
accaucaugucugg

SEQ ID NO: 2049369 - RNA, 20 nt, Human
accccucaacaccucugcac

SEQ ID NO: 2049370 - RNA, 24 nt, Human
acaacuugcacguauuuuaauagc

SEQ ID NO: 2049371 - RNA, 17 nt, Human
acaacuucaagugcaug

SEQ ID NO: 2049372 - RNA, 19 nt, Human
acaacuaggcuucagcaua

SEQ ID NO: 2049373 - RNA, 15 nt, Human
acaaguaaaacugug

SEQ ID NO: 2049374 - RNA, 16 nt, Human
acaaguaaaacugugg

SEQ ID NO: 2049375 - RNA, 16 nt, Human
acaacuuucucuugua

SEQ ID NO: 2049376 - RNA, 18 nt, Human
acaacuuucucuuguaaa

SEQ ID NO: 2049377 - RNA, 17 nt, Human
acaacuucuaauugcca

SEQ ID NO: 2049378 - RNA, 14 nt, Human
acaacuucuuugua

SEQ ID NO: 2049379 - RNA, 21 nt, Human
acaagucauuuuaacuuuauc

SEQ ID NO: 2049380 - RNA, 23 nt, Human
acaagucauuuuaacuuuaucac

SEQ ID NO: 2049381 - RNA, 23 nt, Human
acaaguaugaauaaagacaccua

SEQ ID NO: 2049382 - RNA, 21 nt, Human
acaaguaugaauaaagacacc

SEQ ID NO: 2049383 - RNA, 12 nt, Human
acaagugccacu

SEQ ID NO: 2049384 - RNA, 22 nt, Human
acaagugacuguaucuguguag

SEQ ID NO: 2049385 - RNA, 18 nt, Human
acaagugaaaaacaucca

SEQ ID NO: 2049386 - RNA, 20 nt, Human
acaaguagaugccugaacuu

SEQ ID NO: 2049387 - RNA, 18 nt, Human
acaagugacuguaucugu

SEQ ID NO: 2049388 - RNA, 19 nt, Human
acaagugacuguaucugug

SEQ ID NO: 2049389 - RNA, 20 nt, Human
acaagugacuguaucugugu

SEQ ID NO: 2049390 - RNA, 17 nt, Human
acaagugagacaaaaag

SEQ ID NO: 2049391 - RNA, 19 nt, Human
acaagugagacaaaaagca

SEQ ID NO: 2049392 - RNA, 21 nt, Human
acaagugagacaaaaagcacu

SEQ ID NO: 2049393 - RNA, 23 nt, Human
aauuauaacuuaaaauauuuuau

SEQ ID NO: 2049394 - RNA, 14 nt, Human
aauuauaaggacug

SEQ ID NO: 2049395 - RNA, 15 nt, Human
aauuauaaggacugc

SEQ ID NO: 2049396 - RNA, 16 nt, Human
aauuauaaggacugca

SEQ ID NO: 2049397 - RNA, 17 nt, Human
aauuauaaggacugcau

SEQ ID NO: 2049398 - RNA, 18 nt, Human
aauuauaaggacugcaug

SEQ ID NO: 2049399 - RNA, 17 nt, Human
aauuauaacuuaaaaua

SEQ ID NO: 2049400 - RNA, 20 nt, Human
aauuuuauagcucaguuuau

SEQ ID NO: 2049401 - RNA, 16 nt, Human
aauuuuaucucuuauu

SEQ ID NO: 2049402 - RNA, 12 nt, Human
aauuuuauuccu

SEQ ID NO: 2049403 - RNA, 12 nt, Human
aauuuuaugaac

SEQ ID NO: 2049404 - RNA, 19 nt, Human
aauuuuaugaacugcaugu

SEQ ID NO: 2049405 - RNA, 20 nt, Human
aauuuuaugaacugcaugua

SEQ ID NO: 2049406 - RNA, 22 nt, Human
aauuuuaugaacugcauguaua

SEQ ID NO: 2049407 - RNA, 12 nt, Human
aauuuuaugaau

SEQ ID NO: 2049408 - RNA, 19 nt, Human
aauuuuauagcucaguuua

SEQ ID NO: 2049409 - RNA, 19 nt, Human
acaaagacaaauucuguuu

SEQ ID NO: 2049410 - RNA, 22 nt, Human
acaaagacaaauucuguuucuu

SEQ ID NO: 2049411 - RNA, 18 nt, Human
acaacuaugauuuggaaa

SEQ ID NO: 2049412 - RNA, 15 nt, Human
acaaacgggcucagc

SEQ ID NO: 2049413 - RNA, 18 nt, Human
acaaagacaaauucuguu

SEQ ID NO: 2049414 - RNA, 18 nt, Human
acaaagaagacaacauua

SEQ ID NO: 2049415 - RNA, 14 nt, Human
acaaaccagaagca

SEQ ID NO: 2049416 - RNA, 23 nt, Human
acaaaccugaaaagauguugugu

SEQ ID NO: 2049417 - RNA, 20 nt, Human
acaaaauguaggguuauaau

SEQ ID NO: 2049418 - RNA, 15 nt, Human
acaaaauggaauuca

SEQ ID NO: 2049419 - RNA, 22 nt, Human
acaaaauggaauucauucuggu

SEQ ID NO: 2049420 - RNA, 21 nt, Human
aauuuucuuuuuaauaaaaag

SEQ ID NO: 2049421 - RNA, 21 nt, Human
aauuuugaauaaauaaaugua

SEQ ID NO: 2049422 - RNA, 12 nt, Human
acaccagagccc

SEQ ID NO: 2049423 - RNA, 12 nt, Human
acacagcucugu

SEQ ID NO: 2049424 - RNA, 11 nt, Human
acacagcucug

SEQ ID NO: 2049425 - RNA, 14 nt, Human
acacagaaaccaau

SEQ ID NO: 2049426 - RNA, 23 nt, Human
acacagacauucugccaggcccc

SEQ ID NO: 2049427 - RNA, 16 nt, Human
acacagacuauugaca

SEQ ID NO: 2049428 - RNA, 20 nt, Human
acacagacuauugacaucag

SEQ ID NO: 2049429 - RNA, 15 nt, Human
acacuaaccacgcug

SEQ ID NO: 2049430 - RNA, 14 nt, Human
acacuaaccacgcu

SEQ ID NO: 2049431 - RNA, 14 nt, Human
acacggaggcaucu

SEQ ID NO: 2049432 - RNA, 15 nt, Human
acacggacacucaaa

SEQ ID NO: 2049433 - RNA, 14 nt, Human
acaaugugucugag

SEQ ID NO: 2049434 - RNA, 12 nt, Human
acaauuuauuuu

SEQ ID NO: 2049435 - RNA, 14 nt, Human
acaauuuauuuuau

SEQ ID NO: 2049436 - RNA, 15 nt, Human
acaauuuauuuuauu

SEQ ID NO: 2049437 - RNA, 20 nt, Human
acaauuuauuuuauuuuagc

SEQ ID NO: 2049438 - RNA, 12 nt, Human
acaauuuuguac

SEQ ID NO: 2049439 - RNA, 15 nt, Human
acaauuuuguacaaa

SEQ ID NO: 2049440 - RNA, 18 nt, Human
acacaaacgggcucagca

SEQ ID NO: 2049441 - RNA, 12 nt, Human
acacaaagagag

SEQ ID NO: 2049442 - RNA, 22 nt, Human
acacaaagagaguuaaucaacu

SEQ ID NO: 2049443 - RNA, 21 nt, Human
acacugcugcuccagugcagg

SEQ ID NO: 2049444 - RNA, 18 nt, Human
acacugcuaggugggcca

SEQ ID NO: 2049445 - RNA, 13 nt, Human
acacugucuugaa

SEQ ID NO: 2049446 - RNA, 23 nt, Human
acacugcuaggugggccagcccc

SEQ ID NO: 2049447 - RNA, 20 nt, Human
acacugucaaacaucuggaa

SEQ ID NO: 2049448 - RNA, 12 nt, Human
acagaacacugu

SEQ ID NO: 2049449 - RNA, 14 nt, Human
acagaacacugucu

SEQ ID NO: 2049450 - RNA, 16 nt, Human
acagaagaaggcagca

SEQ ID NO: 2049451 - RNA, 17 nt, Human
acagaagucaugaagcc

SEQ ID NO: 2049452 - RNA, 20 nt, Human
acagaagaaggcagcaggug

SEQ ID NO: 2049453 - RNA, 19 nt, Human
acacugaaguuaacagaga

SEQ ID NO: 2049454 - RNA, 18 nt, Human
acacugaauauuuauauu

SEQ ID NO: 2049455 - RNA, 23 nt, Human
acacugaauauuuauauuucacu

SEQ ID NO: 2049456 - RNA, 17 nt, Human
acacugaccauccacuc

SEQ ID NO: 2049457 - RNA, 14 nt, Human
acacugaggcaggg

SEQ ID NO: 2049458 - RNA, 16 nt, Human
acacugaggcagggaa

SEQ ID NO: 2049459 - RNA, 17 nt, Human
acacugaggcagggaag

SEQ ID NO: 2049460 - RNA, 22 nt, Human
acagcaggguagucugguuucu

SEQ ID NO: 2049461 - RNA, 11 nt, Human
acagcaggugu

SEQ ID NO: 2049462 - RNA, 19 nt, Human
acagagucucacuguugcc

SEQ ID NO: 2049463 - RNA, 17 nt, Human
acagagucucacuguug

SEQ ID NO: 2049464 - RNA, 18 nt, Human
acagaauacuagccagag

SEQ ID NO: 2049465 - RNA, 14 nt, Human
acagagucucacug

SEQ ID NO: 2049466 - RNA, 12 nt, Human
acagagucucac

SEQ ID NO: 2049467 - RNA, 15 nt, Human
acagaauaaugaaug

SEQ ID NO: 2049468 - RNA, 18 nt, Human
acagaagucaugaagccc

SEQ ID NO: 2049469 - RNA, 17 nt, Human
acagcauggugcaugcc

SEQ ID NO: 2049470 - RNA, 15 nt, Human
acagcauugcuuucu

SEQ ID NO: 2049471 - RNA, 12 nt, Human
acagcauugcuu

SEQ ID NO: 2049472 - RNA, 13 nt, Human
acagcauugcuuu

SEQ ID NO: 2049473 - RNA, 13 nt, Human
acagcauguguau

SEQ ID NO: 2049474 - RNA, 19 nt, Human
acagcauucuugucacaau

SEQ ID NO: 2049475 - RNA, 23 nt, Human
acagcauucuugucacaauaaau

SEQ ID NO: 2049476 - RNA, 11 nt, Human
acagcauugcu

SEQ ID NO: 2049477 - RNA, 19 nt, Human
acagccacggccaggccag

SEQ ID NO: 2049478 - RNA, 16 nt, Human
acagcccaaagaagga

SEQ ID NO: 2049479 - RNA, 17 nt, Human
acagcccaaagaaggaa

SEQ ID NO: 2049480 - RNA, 18 nt, Human
acagcccaaagaaggaaa

SEQ ID NO: 2049481 - RNA, 16 nt, Human
acaggcaagcaccucc

SEQ ID NO: 2049482 - RNA, 15 nt, Human
acaggcaagcaccuc

SEQ ID NO: 2049483 - RNA, 18 nt, Human
acaggcaagcaccuccug

SEQ ID NO: 2049484 - RNA, 19 nt, Human
acaggcaagcaccuccugc

SEQ ID NO: 2049485 - RNA, 12 nt, Human
acaggggcuggu

SEQ ID NO: 2049486 - RNA, 19 nt, Human
acaggggcuggugggcacc

SEQ ID NO: 2049487 - RNA, 17 nt, Human
acaggggaauauuuuau

SEQ ID NO: 2049488 - RNA, 19 nt, Human
acaggggaauauuuuauuc

SEQ ID NO: 2049489 - RNA, 20 nt, Human
acaggggaauauuuuauuca

SEQ ID NO: 2049490 - RNA, 22 nt, Human
acaggggaauauuuuauucaag

SEQ ID NO: 2049491 - RNA, 16 nt, Human
acaggucucagaaucu

SEQ ID NO: 2049492 - RNA, 14 nt, Human
acaggucuccucuu

SEQ ID NO: 2049493 - RNA, 18 nt, Human
acaggucuccucuuaaaa

SEQ ID NO: 2049494 - RNA, 23 nt, Human
acaggugugaaccaccacaccca

SEQ ID NO: 2049495 - RNA, 20 nt, Human
acaggugugaaccaccacac

SEQ ID NO: 2049496 - RNA, 23 nt, Human
acaggucaauacaguacaggcag

SEQ ID NO: 2049497 - RNA, 22 nt, Human
acaggucaauacaguacaggca

SEQ ID NO: 2049498 - RNA, 14 nt, Human
acaggguccugcua

SEQ ID NO: 2049499 - RNA, 17 nt, Human
acaggguagcagguacc

SEQ ID NO: 2049500 - RNA, 17 nt, Human
acaggguaaauuauuca

SEQ ID NO: 2049501 - RNA, 14 nt, Human
acagcuccuucugu

SEQ ID NO: 2049502 - RNA, 13 nt, Human
acagcuccuucug

SEQ ID NO: 2049503 - RNA, 12 nt, Human
acagcuccuucu

SEQ ID NO: 2049504 - RNA, 17 nt, Human
auaugcaguuuuccuua

SEQ ID NO: 2049505 - RNA, 13 nt, Human
auauccugagcca

SEQ ID NO: 2049506 - RNA, 14 nt, Human
auauccugagccau

SEQ ID NO: 2049507 - RNA, 15 nt, Human
auauccugagccauc

SEQ ID NO: 2049508 - RNA, 18 nt, Human
auauuagaaguguuaacu

SEQ ID NO: 2049509 - RNA, 18 nt, Human
auauggacucaguuuucu

SEQ ID NO: 2049510 - RNA, 14 nt, Human
auaugcuuauacac

SEQ ID NO: 2049511 - RNA, 16 nt, Human
auaugcuuauacacuu

SEQ ID NO: 2049512 - RNA, 19 nt, Human
auaugcuuauacacuuaca

SEQ ID NO: 2049513 - RNA, 12 nt, Human
auauccauguac

SEQ ID NO: 2049514 - RNA, 14 nt, Human
auauccauguacug

SEQ ID NO: 2049515 - RNA, 15 nt, Human
auauccauguacugu

SEQ ID NO: 2049516 - RNA, 17 nt, Human
auauccauguacuguag

SEQ ID NO: 2049517 - RNA, 18 nt, Human
auauccauguacuguagu

SEQ ID NO: 2049518 - RNA, 19 nt, Human
auauuuagauuguuaaaau

SEQ ID NO: 2049519 - RNA, 20 nt, Human
auauuauacuaagaaaagau

SEQ ID NO: 2049520 - RNA, 15 nt, Human
auauuagcauuuagu

SEQ ID NO: 2049521 - RNA, 22 nt, Human
auauuagcauuuaguccaaugu

SEQ ID NO: 2049522 - RNA, 20 nt, Human
auauuagcuuuacuguuugu

SEQ ID NO: 2049523 - RNA, 21 nt, Human
auauuagcuuuacuguuuguu

SEQ ID NO: 2049524 - RNA, 22 nt, Human
auauuauaauuuuuuucaauau

SEQ ID NO: 2049525 - RNA, 19 nt, Human
auauuagucauagaagaac

SEQ ID NO: 2049526 - RNA, 17 nt, Human
auauuauaacuuaaaaa

SEQ ID NO: 2049527 - RNA, 15 nt, Human
auauuaggaaaauau

SEQ ID NO: 2049528 - RNA, 14 nt, Human
auauuuauuaccuc

SEQ ID NO: 2049529 - RNA, 15 nt, Human
auauuuauaacucau

SEQ ID NO: 2049530 - RNA, 11 nt, Human
auauuuauaac

SEQ ID NO: 2049531 - RNA, 16 nt, Human
auauuuauaacagcau

SEQ ID NO: 2049532 - RNA, 13 nt, Human
auauuuauaacuc

SEQ ID NO: 2049533 - RNA, 16 nt, Human
auauuuauuaccucug

SEQ ID NO: 2049534 - RNA, 14 nt, Human
auauaauuaucgga

SEQ ID NO: 2049535 - RNA, 21 nt, Human
auauaauuaucggaagcagug

SEQ ID NO: 2049536 - RNA, 11 nt, Human
auauaauuaug

SEQ ID NO: 2049537 - RNA, 14 nt, Human
auauaauuauguua

SEQ ID NO: 2049538 - RNA, 19 nt, Human
auauaauuauguuauugaa

SEQ ID NO: 2049539 - RNA, 16 nt, Human
auaguaugguggcugg

SEQ ID NO: 2049540 - RNA, 15 nt, Human
auaguaugguggcug

SEQ ID NO: 2049541 - RNA, 17 nt, Human
auaguagcauacauuua

SEQ ID NO: 2049542 - RNA, 16 nt, Human
auaguauauuaaaaau

SEQ ID NO: 2049543 - RNA, 17 nt, Human
auaguauauuaaaaaug

SEQ ID NO: 2049544 - RNA, 20 nt, Human
auaguauauuaaaaauggua

SEQ ID NO: 2049545 - RNA, 22 nt, Human
auacuucagcucacacaugaga

SEQ ID NO: 2049546 - RNA, 18 nt, Human
auauagcuugaaacauag

SEQ ID NO: 2049547 - RNA, 18 nt, Human
auauacauucaaacuuaa

SEQ ID NO: 2049548 - RNA, 14 nt, Human
auauaccauuuauc

SEQ ID NO: 2049549 - RNA, 18 nt, Human
auauaauuguuuuuuauc

SEQ ID NO: 2049550 - RNA, 21 nt, Human
auauaauuguuuuuuaucuuu

SEQ ID NO: 2049551 - RNA, 22 nt, Human
auauaauuguuuuuuaucuuuu

SEQ ID NO: 2049552 - RNA, 14 nt, Human
auauacauaacagg

SEQ ID NO: 2049553 - RNA, 20 nt, Human
auauaauuuuuuagagagcu

SEQ ID NO: 2049554 - RNA, 22 nt, Human
auauacuaagauguucacugug

SEQ ID NO: 2049555 - RNA, 21 nt, Human
auauagcuauuuuuauggaau

SEQ ID NO: 2049556 - RNA, 14 nt, Human
auaccugucaauac

SEQ ID NO: 2049557 - RNA, 16 nt, Human
auaccccgugaagcau

SEQ ID NO: 2049558 - RNA, 16 nt, Human
auaccucuuugaaaga

SEQ ID NO: 2049559 - RNA, 17 nt, Human
auaccucuuugaaagaa

SEQ ID NO: 2049560 - RNA, 14 nt, Human
auacacacacaaag

SEQ ID NO: 2049561 - RNA, 17 nt, Human
auacacacacaaagaga

SEQ ID NO: 2049562 - RNA, 19 nt, Human
auacacacacaaagagagu

SEQ ID NO: 2049563 - RNA, 19 nt, Human
auaccccuuacuuagcaug

SEQ ID NO: 2049564 - RNA, 15 nt, Human
auacacaacacacac

SEQ ID NO: 2049565 - RNA, 22 nt, Human
auacuuagcaaaguuuuaccug

SEQ ID NO: 2049566 - RNA, 21 nt, Human
auacuuauauuuuuaauaaaa

SEQ ID NO: 2049567 - RNA, 14 nt, Human
auacuuauucauug

SEQ ID NO: 2049568 - RNA, 15 nt, Human
auacuuauucauugu

SEQ ID NO: 2049569 - RNA, 22 nt, Human
auaaguuaacuauuuuauuuuc

SEQ ID NO: 2049570 - RNA, 10 nt, Human
auaaugucuu

SEQ ID NO: 2049571 - RNA, 13 nt, Human
auaaugucuuguu

SEQ ID NO: 2049572 - RNA, 16 nt, Human
auaaugucuuguuaau

SEQ ID NO: 2049573 - RNA, 17 nt, Human
auaaugucuuguuaaua

SEQ ID NO: 2049574 - RNA, 19 nt, Human
auaaugucuuguuaauauu

SEQ ID NO: 2049575 - RNA, 20 nt, Human
auaaugucuuguuaauauuc

SEQ ID NO: 2049576 - RNA, 19 nt, Human
auaaguacuguguacagaa

SEQ ID NO: 2049577 - RNA, 21 nt, Human
auaaguccuugcaagaaucag

SEQ ID NO: 2049578 - RNA, 23 nt, Human
auaacacuauaaagguugacaau

SEQ ID NO: 2049579 - RNA, 16 nt, Human
auaacaguaaaugugc

SEQ ID NO: 2049580 - RNA, 16 nt, Human
auaacaggguaaauua

SEQ ID NO: 2049581 - RNA, 18 nt, Human
auaacaggguaaauuauu

SEQ ID NO: 2049582 - RNA, 19 nt, Human
auaacaggguaaauuauuc

SEQ ID NO: 2049583 - RNA, 20 nt, Human
auaacaggguaaauuauuca

SEQ ID NO: 2049584 - RNA, 22 nt, Human
auaacaggguaaauuauucagu

SEQ ID NO: 2049585 - RNA, 20 nt, Human
auaacagcuaccaugacaac

SEQ ID NO: 2049586 - RNA, 16 nt, Human
auaacagaaugcacca

SEQ ID NO: 2049587 - RNA, 23 nt, Human
aguuguuaauaaaaguacauguu

SEQ ID NO: 2049588 - RNA, 20 nt, Human
aguugaauggccugccuuga

SEQ ID NO: 2049589 - RNA, 17 nt, Human
aguuguaucucuuuuga

SEQ ID NO: 2049590 - RNA, 22 nt, Human
aguuguaucucuuuugaaucca

SEQ ID NO: 2049591 - RNA, 14 nt, Human
aguuguaucucuuu

SEQ ID NO: 2049592 - RNA, 15 nt, Human
aguuguaucucuuuu

SEQ ID NO: 2049593 - RNA, 16 nt, Human
aguuguaucucuuuug

SEQ ID NO: 2049594 - RNA, 19 nt, Human
aguugucaagucucugcug

SEQ ID NO: 2049595 - RNA, 20 nt, Human
agugaucaauaaaaugugau

SEQ ID NO: 2049596 - RNA, 15 nt, Human
agugucuuucuuugg

SEQ ID NO: 2049597 - RNA, 21 nt, Human
agugucuuucuuuggugccuu

SEQ ID NO: 2049598 - RNA, 22 nt, Human
agugucuuucuuuggugccuuu

SEQ ID NO: 2049599 - RNA, 23 nt, Human
agugucuuucuuuggugccuuuc

SEQ ID NO: 2049600 - RNA, 19 nt, Human
agugucuucacggcaggac

SEQ ID NO: 2049601 - RNA, 13 nt, Human
agugucuuccaua

SEQ ID NO: 2049602 - RNA, 14 nt, Human
agugucuuccauaa

SEQ ID NO: 2049603 - RNA, 15 nt, Human
agugucuuccauaau

SEQ ID NO: 2049604 - RNA, 15 nt, Human
agugugaaauagaca

SEQ ID NO: 2049605 - RNA, 23 nt, Human
agugugacaaggauugcuacugu

SEQ ID NO: 2049606 - RNA, 16 nt, Human
aguuaacuauuuuauu

SEQ ID NO: 2049607 - RNA, 14 nt, Human
aguuaacuuucaga

SEQ ID NO: 2049608 - RNA, 14 nt, Human
aguuaagaaaaaaa

SEQ ID NO: 2049609 - RNA, 17 nt, Human
aguuaagaaaaaaauaa

SEQ ID NO: 2049610 - RNA, 18 nt, Human
aguuaagaaaaaaauaau

SEQ ID NO: 2049611 - RNA, 20 nt, Human
aguuaagaaaaaaauaauuu

SEQ ID NO: 2049612 - RNA, 16 nt, Human
aguccacaguggaacc

SEQ ID NO: 2049613 - RNA, 12 nt, Human
aguccaccugag

SEQ ID NO: 2049614 - RNA, 18 nt, Human
aguccaaugucuuuuuaa

SEQ ID NO: 2049615 - RNA, 17 nt, Human
aguccaccugagcugcc

SEQ ID NO: 2049616 - RNA, 16 nt, Human
aguccugccucagccu

SEQ ID NO: 2049617 - RNA, 13 nt, Human
aguccugccuggc

SEQ ID NO: 2049618 - RNA, 14 nt, Human
aguccugccuggcc

SEQ ID NO: 2049619 - RNA, 15 nt, Human
aguccugccuggcca

SEQ ID NO: 2049620 - RNA, 16 nt, Human
aguccugccuggccag

SEQ ID NO: 2049621 - RNA, 17 nt, Human
aguccugccuggccagg

SEQ ID NO: 2049622 - RNA, 20 nt, Human
aguccugccuggccaggcag

SEQ ID NO: 2049623 - RNA, 21 nt, Human
aguccugccuggccaggcaga

SEQ ID NO: 2049624 - RNA, 14 nt, Human
agugacaaggcccc

SEQ ID NO: 2049625 - RNA, 15 nt, Human
agugacaaggcccca

SEQ ID NO: 2049626 - RNA, 16 nt, Human
agugacaaggccccag

SEQ ID NO: 2049627 - RNA, 18 nt, Human
agugacaaggccccagag

SEQ ID NO: 2049628 - RNA, 20 nt, Human
agugacaaggccccagagac

SEQ ID NO: 2049629 - RNA, 21 nt, Human
agugacaaggccccagagacu

SEQ ID NO: 2049630 - RNA, 23 nt, Human
agugacaaggccccagagacuca

SEQ ID NO: 2049631 - RNA, 14 nt, Human
aguccugcucucua

SEQ ID NO: 2049632 - RNA, 20 nt, Human
aguccugcucucuacccagc

SEQ ID NO: 2049633 - RNA, 23 nt, Human
agugacacuucagagagcuggua

SEQ ID NO: 2049634 - RNA, 15 nt, Human
agugacacuucagag

SEQ ID NO: 2049635 - RNA, 18 nt, Human
agugacacuucagagagc

SEQ ID NO: 2049636 - RNA, 20 nt, Human
agugacacuucagagagcug

SEQ ID NO: 2049637 - RNA, 21 nt, Human
agugacacuucagagagcugg

SEQ ID NO: 2049638 - RNA, 22 nt, Human
agugacacuucagagagcuggu

SEQ ID NO: 2049639 - RNA, 16 nt, Human
agugaucaauaaaaug

SEQ ID NO: 2049640 - RNA, 17 nt, Human
agugaucaauaaaaugu

SEQ ID NO: 2049641 - RNA, 19 nt, Human
agugaucaauaaaauguga

SEQ ID NO: 2049642 - RNA, 13 nt, Human
agugauccuccca

SEQ ID NO: 2049643 - RNA, 16 nt, Human
agucaagugaaaaagg

SEQ ID NO: 2049644 - RNA, 16 nt, Human
agucaaggaguggcuu

SEQ ID NO: 2049645 - RNA, 20 nt, Human
agucaagugaaaaaggagga

SEQ ID NO: 2049646 - RNA, 17 nt, Human
aguccaaugucuuuuua

SEQ ID NO: 2049647 - RNA, 22 nt, Human
agucauuaugagaggcaaugau

SEQ ID NO: 2049648 - RNA, 15 nt, Human
aucucucuucuuuuc

SEQ ID NO: 2049649 - RNA, 23 nt, Human
aucucucuacuccuaccucagcc

SEQ ID NO: 2049650 - RNA, 15 nt, Human
aucucucucuguugu

SEQ ID NO: 2049651 - RNA, 17 nt, Human
aucucucucuguugugu

SEQ ID NO: 2049652 - RNA, 21 nt, Human
aucucucucuguuguguucgu

SEQ ID NO: 2049653 - RNA, 22 nt, Human
aucucucugaauccuaagggcu

SEQ ID NO: 2049654 - RNA, 21 nt, Human
aucucuagaauuuuaagugcu

SEQ ID NO: 2049655 - RNA, 20 nt, Human
aucucuacuaaaaauacaaa

SEQ ID NO: 2049656 - RNA, 15 nt, Human
aucucuagaauuuua

SEQ ID NO: 2049657 - RNA, 16 nt, Human
aucucuagaauuuuaa

SEQ ID NO: 2049658 - RNA, 18 nt, Human
aucucuagaauuuuaagu

SEQ ID NO: 2049659 - RNA, 18 nt, Human
aucucuacuaaaaauaca

SEQ ID NO: 2049660 - RNA, 21 nt, Human
aucucucuacuccuaccucag

SEQ ID NO: 2049661 - RNA, 22 nt, Human
aucucucuacuccuaccucagc

SEQ ID NO: 2049662 - RNA, 17 nt, Human
aucugggacccuuuccu

SEQ ID NO: 2049663 - RNA, 20 nt, Human
aucugggacccuuuccuucc

SEQ ID NO: 2049664 - RNA, 22 nt, Human
aucugggacccuuuccuuccuu

SEQ ID NO: 2049665 - RNA, 23 nt, Human
aucugggacccuuuccuuccuuc

SEQ ID NO: 2049666 - RNA, 22 nt, Human
aucuucauaucuaucagaguau

SEQ ID NO: 2049667 - RNA, 19 nt, Human
aucuuccaacucaaacucu

SEQ ID NO: 2049668 - RNA, 14 nt, Human
aucuucaguuuuau

SEQ ID NO: 2049669 - RNA, 20 nt, Human
aucuucaguuuuaucuuuaa

SEQ ID NO: 2049670 - RNA, 22 nt, Human
aucuucaguuuuaucuuuaauc

SEQ ID NO: 2049671 - RNA, 13 nt, Human
aucuucacuucua

SEQ ID NO: 2049672 - RNA, 23 nt, Human
aucuucacuucuaaaugcauauc

SEQ ID NO: 2049673 - RNA, 17 nt, Human
aucuugaaaugaaagua

SEQ ID NO: 2049674 - RNA, 16 nt, Human
aucuucucacucccuu

SEQ ID NO: 2049675 - RNA, 17 nt, Human
aucuucuuuauaauucu

SEQ ID NO: 2049676 - RNA, 15 nt, Human
aucuucuccaucugg

SEQ ID NO: 2049677 - RNA, 19 nt, Human
aucuucuccaucuggcagg

SEQ ID NO: 2049678 - RNA, 14 nt, Human
aucuucucuggcga

SEQ ID NO: 2049679 - RNA, 22 nt, Human
aucuucuccaucuggcagggug

SEQ ID NO: 2049680 - RNA, 17 nt, Human
aucuucucuuugacaau

SEQ ID NO: 2049681 - RNA, 13 nt, Human
augaaaacaugua

SEQ ID NO: 2049682 - RNA, 22 nt, Human
augaaaauacaacuuaaauaau

SEQ ID NO: 2049683 - RNA, 13 nt, Human
augaaaauacaac

SEQ ID NO: 2049684 - RNA, 17 nt, Human
augaaaauacaacuuaa

SEQ ID NO: 2049685 - RNA, 19 nt, Human
augaaaacguuuuauugug

SEQ ID NO: 2049686 - RNA, 18 nt, Human
augaaaacguuuuauugu

SEQ ID NO: 2049687 - RNA, 20 nt, Human
augaaaacguuuuauugugu

SEQ ID NO: 2049688 - RNA, 17 nt, Human
augacucacaugaugca

SEQ ID NO: 2049689 - RNA, 19 nt, Human
augacuagaggcagggagg

SEQ ID NO: 2049690 - RNA, 18 nt, Human
augacuagaaagugaaua

SEQ ID NO: 2049691 - RNA, 20 nt, Human
augacuagaaagugaauaaa

SEQ ID NO: 2049692 - RNA, 15 nt, Human
augacuagaggcagg

SEQ ID NO: 2049693 - RNA, 21 nt, Human
augaccugugaccagcacugu

SEQ ID NO: 2049694 - RNA, 19 nt, Human
augaccugugaccagcacu

SEQ ID NO: 2049695 - RNA, 22 nt, Human
augacuagaggcagggagggga

SEQ ID NO: 2049696 - RNA, 11 nt, Human
augaccccucc

SEQ ID NO: 2049697 - RNA, 23 nt, Human
augacccugcgaaggggcccugg

SEQ ID NO: 2049698 - RNA, 22 nt, Human
augaccucaccauuuuuguucu

SEQ ID NO: 2049699 - RNA, 16 nt, Human
augagcucauguagca

SEQ ID NO: 2049700 - RNA, 13 nt, Human
augagcuccagac

SEQ ID NO: 2049701 - RNA, 13 nt, Human
augagccuggcaa

SEQ ID NO: 2049702 - RNA, 14 nt, Human
augagccuggcaag

SEQ ID NO: 2049703 - RNA, 14 nt, Human
augagcuccagacc

SEQ ID NO: 2049704 - RNA, 12 nt, Human
auccuuuucucc

SEQ ID NO: 2049705 - RNA, 16 nt, Human
auccuuuucuccuauc

SEQ ID NO: 2049706 - RNA, 15 nt, Human
auccuuuucugcaga

SEQ ID NO: 2049707 - RNA, 23 nt, Human
aucgaugggggagucugaagcag

SEQ ID NO: 2049708 - RNA, 15 nt, Human
aucgaggaaccagag

SEQ ID NO: 2049709 - RNA, 20 nt, Human
aucgaugggggaugcuucau

SEQ ID NO: 2049710 - RNA, 21 nt, Human
aucgaugggggaugcuucaug

SEQ ID NO: 2049711 - RNA, 23 nt, Human
aucgaugggggaugcuucaugug

SEQ ID NO: 2049712 - RNA, 15 nt, Human
auccuuuuucuuuau

SEQ ID NO: 2049713 - RNA, 13 nt, Human
aucgaugcagugc

SEQ ID NO: 2049714 - RNA, 11 nt, Human
auccuccccuu

SEQ ID NO: 2049715 - RNA, 13 nt, Human
auccuccccuucc

SEQ ID NO: 2049716 - RNA, 15 nt, Human
auccuccccuucccu

SEQ ID NO: 2049717 - RNA, 18 nt, Human
auccuccccuucccugca

SEQ ID NO: 2049718 - RNA, 19 nt, Human
auccuccccuucccugcaa

SEQ ID NO: 2049719 - RNA, 15 nt, Human
auccuccguccagcc

SEQ ID NO: 2049720 - RNA, 16 nt, Human
auccuccguccagccg

SEQ ID NO: 2049721 - RNA, 14 nt, Human
auccacccagccca

SEQ ID NO: 2049722 - RNA, 13 nt, Human
auccacccagccc

SEQ ID NO: 2049723 - RNA, 15 nt, Human
auccacccagcccau

SEQ ID NO: 2049724 - RNA, 20 nt, Human
aucccgauucacccugucca

SEQ ID NO: 2049725 - RNA, 15 nt, Human
aucccgauucacccu

SEQ ID NO: 2049726 - RNA, 20 nt, Human
auccacccaccucagccucc

SEQ ID NO: 2049727 - RNA, 18 nt, Human
auccacccaccucagccu

SEQ ID NO: 2049728 - RNA, 22 nt, Human
aucccgccucuucuucuucaga

SEQ ID NO: 2049729 - RNA, 16 nt, Human
aucccgcucuuuuccu

SEQ ID NO: 2049730 - RNA, 17 nt, Human
aucccgcucuuuuccua

SEQ ID NO: 2049731 - RNA, 19 nt, Human
aucccuagucuucaagcag

SEQ ID NO: 2049732 - RNA, 21 nt, Human
aucccuagucuucaagcagau

SEQ ID NO: 2049733 - RNA, 14 nt, Human
aucccuaugcugcc

SEQ ID NO: 2049734 - RNA, 19 nt, Human
aucccuaugcugccuaggc

SEQ ID NO: 2049735 - RNA, 17 nt, Human
aucccuaugggauucag

SEQ ID NO: 2049736 - RNA, 12 nt, Human
aucaccuccccu

SEQ ID NO: 2049737 - RNA, 15 nt, Human
aucaccucaggccag

SEQ ID NO: 2049738 - RNA, 15 nt, Human
aucaccuccccuccu

SEQ ID NO: 2049739 - RNA, 12 nt, Human
aucaccugaggu

SEQ ID NO: 2049740 - RNA, 13 nt, Human
aucaccuccccuc

SEQ ID NO: 2049741 - RNA, 14 nt, Human
aucaccucaggcca

SEQ ID NO: 2049742 - RNA, 13 nt, Human
aucagccagugac

SEQ ID NO: 2049743 - RNA, 15 nt, Human
aucagccacauucua

SEQ ID NO: 2049744 - RNA, 16 nt, Human
aucagccuacaggccu

SEQ ID NO: 2049745 - RNA, 20 nt, Human
aucagccuaggggucaggga

SEQ ID NO: 2049746 - RNA, 23 nt, Human
aucagcccugcccuucagcaucc

SEQ ID NO: 2049747 - RNA, 24 nt, Human
aucagcccugcccuucagcauccu

SEQ ID NO: 2049748 - RNA, 11 nt, Human
aucagccucuu

SEQ ID NO: 2049749 - RNA, 13 nt, Human
aucagccucuuaa

SEQ ID NO: 2049750 - RNA, 15 nt, Human
aucagccucuuaaag

SEQ ID NO: 2049751 - RNA, 11 nt, Human
aucagccuggg

SEQ ID NO: 2049752 - RNA, 20 nt, Human
aucagccugggcaaugugau

SEQ ID NO: 2049753 - RNA, 21 nt, Human
aucagccugggcaaugugaua

SEQ ID NO: 2049754 - RNA, 12 nt, Human
aucagcugcuac

SEQ ID NO: 2049755 - RNA, 13 nt, Human
aucagcugcuacu

SEQ ID NO: 2049756 - RNA, 23 nt, Human
aucagcugcuacuacuccuguag

SEQ ID NO: 2049757 - RNA, 19 nt, Human
aucauggagguuugaagau

SEQ ID NO: 2049758 - RNA, 21 nt, Human
aucaucuauugcuggcaaaga

SEQ ID NO: 2049759 - RNA, 15 nt, Human
aucauggcucacugc

SEQ ID NO: 2049760 - RNA, 18 nt, Human
aucauggcucacugcagc

SEQ ID NO: 2049761 - RNA, 20 nt, Human
aucauggcucacugcagccu

SEQ ID NO: 2049762 - RNA, 19 nt, Human
aucauggcuaagcuuaaaa

SEQ ID NO: 2049763 - RNA, 21 nt, Human
aucauggcuaagcuuaaaaaa

SEQ ID NO: 2049764 - RNA, 22 nt, Human
aucauggcuaagcuuaaaaaaa

SEQ ID NO: 2049765 - RNA, 15 nt, Human
aucauguacauuucu

SEQ ID NO: 2049766 - RNA, 14 nt, Human
aucauguacauuuc

SEQ ID NO: 2049767 - RNA, 14 nt, Human
aucauguaaauuac

SEQ ID NO: 2049768 - RNA, 13 nt, Human
aucauguacauuu

SEQ ID NO: 2049769 - RNA, 19 nt, Human
augggaaggagggagguau

SEQ ID NO: 2049770 - RNA, 14 nt, Human
augggaaggaggga

SEQ ID NO: 2049771 - RNA, 17 nt, Human
augggaaggagggaggu

SEQ ID NO: 2049772 - RNA, 18 nt, Human
auggcugacuuugcucuu

SEQ ID NO: 2049773 - RNA, 17 nt, Human
auggagcgcaccugccc

SEQ ID NO: 2049774 - RNA, 23 nt, Human
auggagcgcaccugcccccuggu

SEQ ID NO: 2049775 - RNA, 14 nt, Human
auggauggcuucua

SEQ ID NO: 2049776 - RNA, 12 nt, Human
auggaugugcuu

SEQ ID NO: 2049777 - RNA, 15 nt, Human
auggaaauauuaugc

SEQ ID NO: 2049778 - RNA, 17 nt, Human
auggaaauauuaugcaa

SEQ ID NO: 2049779 - RNA, 22 nt, Human
auggaaauauuaugcaaauucc

SEQ ID NO: 2049780 - RNA, 12 nt, Human
auggaaaaggaa

SEQ ID NO: 2049781 - RNA, 11 nt, Human
augcuugccua

SEQ ID NO: 2049782 - RNA, 16 nt, Human
augcuugccuagggcc

SEQ ID NO: 2049783 - RNA, 20 nt, Human
augcuugccuagggccuggu

SEQ ID NO: 2049784 - RNA, 21 nt, Human
augcuugccuagggccugguc

SEQ ID NO: 2049785 - RNA, 23 nt, Human
augcuugccuagggccuggucca

SEQ ID NO: 2049786 - RNA, 16 nt, Human
augcuugaaugccacg

SEQ ID NO: 2049787 - RNA, 18 nt, Human
augcuugaugguuuaugu

SEQ ID NO: 2049788 - RNA, 12 nt, Human
augcacagcugu

SEQ ID NO: 2049789 - RNA, 15 nt, Human
augcauuguugaggu

SEQ ID NO: 2049790 - RNA, 16 nt, Human
augcauuguugaggug

SEQ ID NO: 2049791 - RNA, 13 nt, Human
augcauuugaggu

SEQ ID NO: 2049792 - RNA, 17 nt, Human
augcauuugaggucaag

SEQ ID NO: 2049793 - RNA, 17 nt, Human
augccugguggcagcug

SEQ ID NO: 2049794 - RNA, 16 nt, Human
augccugguggcagcu

SEQ ID NO: 2049795 - RNA, 15 nt, Human
augccugguggcagc

SEQ ID NO: 2049796 - RNA, 19 nt, Human
augcaaugacaucuucaaa

SEQ ID NO: 2049797 - RNA, 12 nt, Human
augcaaugagau

SEQ ID NO: 2049798 - RNA, 23 nt, Human
augcaaugagauagaagauguuu

SEQ ID NO: 2049799 - RNA, 13 nt, Human
augcaaugugcua

SEQ ID NO: 2049800 - RNA, 16 nt, Human
augcaaugugcuacug

SEQ ID NO: 2049801 - RNA, 17 nt, Human
augcaaugugcuacuga

SEQ ID NO: 2049802 - RNA, 18 nt, Human
augcaaugugcuacugau

SEQ ID NO: 2049803 - RNA, 14 nt, Human
augcaauauguauu

SEQ ID NO: 2049804 - RNA, 13 nt, Human
augcaauauguau

SEQ ID NO: 2049805 - RNA, 19 nt, Human
augaugugggucaaggaau

SEQ ID NO: 2049806 - RNA, 12 nt, Human
augccuuuguaa

SEQ ID NO: 2049807 - RNA, 14 nt, Human
augccuuuuauuuc

SEQ ID NO: 2049808 - RNA, 23 nt, Human
augcauuugaggucaaguaagaa

SEQ ID NO: 2049809 - RNA, 13 nt, Human
augccuuuguaag

SEQ ID NO: 2049810 - RNA, 15 nt, Human
augccuuuguaaguu

SEQ ID NO: 2049811 - RNA, 16 nt, Human
augccuuuguaaguua

SEQ ID NO: 2049812 - RNA, 19 nt, Human
augucuuggguaggcggga

SEQ ID NO: 2049813 - RNA, 13 nt, Human
augucuugguacu

SEQ ID NO: 2049814 - RNA, 15 nt, Human
augucuugguacuug

SEQ ID NO: 2049815 - RNA, 18 nt, Human
augucuugguacuugcug

SEQ ID NO: 2049816 - RNA, 23 nt, Human
augucuugguacuugcugcuauu

SEQ ID NO: 2049817 - RNA, 18 nt, Human
augucuuguaagcaaaag

SEQ ID NO: 2049818 - RNA, 17 nt, Human
auguaaguaaaugucug

SEQ ID NO: 2049819 - RNA, 16 nt, Human
auguaauaaugugaau

SEQ ID NO: 2049820 - RNA, 19 nt, Human
auguaauaaaaaguauaug

SEQ ID NO: 2049821 - RNA, 14 nt, Human
auguaauaauguga

SEQ ID NO: 2049822 - RNA, 17 nt, Human
auguaagcucuacugag

SEQ ID NO: 2049823 - RNA, 20 nt, Human
auggugaaaccccaucucua

SEQ ID NO: 2049824 - RNA, 21 nt, Human
auggugaaaccccaucucuac

SEQ ID NO: 2049825 - RNA, 24 nt, Human
auggugaaaccccgucucuacuaa

SEQ ID NO: 2049826 - RNA, 13 nt, Human
auguaagaaucau

SEQ ID NO: 2049827 - RNA, 15 nt, Human
auguaagaaucauug

SEQ ID NO: 2049828 - RNA, 16 nt, Human
auguaagagcuuuaca

SEQ ID NO: 2049829 - RNA, 19 nt, Human
auguaagagcuuuacaaaa

SEQ ID NO: 2049830 - RNA, 20 nt, Human
auguaagagcuuuacaaaaa

SEQ ID NO: 2049831 - RNA, 21 nt, Human
auguaagagcuuuacaaaaag

SEQ ID NO: 2049832 - RNA, 22 nt, Human
auguaagagcuuuacaaaaaga

SEQ ID NO: 2049833 - RNA, 23 nt, Human
auguaagagcuuuacaaaaagac

SEQ ID NO: 2049834 - RNA, 14 nt, Human
auguacaauauuuu

SEQ ID NO: 2049835 - RNA, 19 nt, Human
auguacaauauuuuaagca

SEQ ID NO: 2049836 - RNA, 20 nt, Human
auguacaauauuuuaagcau

SEQ ID NO: 2049837 - RNA, 21 nt, Human
auguacaauauuuuaagcauu

SEQ ID NO: 2049838 - RNA, 16 nt, Human
augucaacuuuaugca

SEQ ID NO: 2049839 - RNA, 17 nt, Human
augucaaggugcuguug

SEQ ID NO: 2049840 - RNA, 20 nt, Human
augucaaggugcuguuguca

SEQ ID NO: 2049841 - RNA, 21 nt, Human
augucaaggugcuguugucau

SEQ ID NO: 2049842 - RNA, 14 nt, Human
augucagauuccuu

SEQ ID NO: 2049843 - RNA, 15 nt, Human
augucagauuccuuu

SEQ ID NO: 2049844 - RNA, 16 nt, Human
augucagauuccuuuc

SEQ ID NO: 2049845 - RNA, 18 nt, Human
augucagauuccuuuccc

SEQ ID NO: 2049846 - RNA, 16 nt, Human
augucagacuggcugg

SEQ ID NO: 2049847 - RNA, 16 nt, Human
augucacuaaagcagg

SEQ ID NO: 2049848 - RNA, 22 nt, Human
augucacuaaagcaggccuuuu

SEQ ID NO: 2049849 - RNA, 19 nt, Human
augucagaaaaacaauaag

SEQ ID NO: 2049850 - RNA, 23 nt, Human
augucagaaaaacaauaagagcg

SEQ ID NO: 2049851 - RNA, 17 nt, Human
augucacaggcaggucc

SEQ ID NO: 2049852 - RNA, 16 nt, Human
augucacaggcagguc

SEQ ID NO: 2049853 - RNA, 14 nt, Human
augucacaggcagg

SEQ ID NO: 2049854 - RNA, 15 nt, Human
augucacaggcaggu

SEQ ID NO: 2049855 - RNA, 20 nt, Human
auguguauuuccagugcaau

SEQ ID NO: 2049856 - RNA, 17 nt, Human
auguguauuuuauuaca

SEQ ID NO: 2049857 - RNA, 21 nt, Human
augugucacuacucacagucu

SEQ ID NO: 2049858 - RNA, 16 nt, Human
auguguccaucccagc

SEQ ID NO: 2049859 - RNA, 18 nt, Human
auguucucugaggacacu

SEQ ID NO: 2049860 - RNA, 18 nt, Human
auguucugacauuaacag

SEQ ID NO: 2049861 - RNA, 19 nt, Human
auguucugacauuaacagu

SEQ ID NO: 2049862 - RNA, 20 nt, Human
auguucugacauuaacaguu

SEQ ID NO: 2049863 - RNA, 13 nt, Human
augugucuucaau

SEQ ID NO: 2049864 - RNA, 20 nt, Human
auguucuuaguggauguucu

SEQ ID NO: 2049865 - RNA, 22 nt, Human
auguucugacccugcuucaaau

SEQ ID NO: 2049866 - RNA, 14 nt, Human
auguucugacauua

SEQ ID NO: 2049867 - RNA, 15 nt, Human
auguucugacauuaa

SEQ ID NO: 2049868 - RNA, 16 nt, Human
auguucugacauuaac

SEQ ID NO: 2049869 - RNA, 17 nt, Human
auguucugacauuaaca

SEQ ID NO: 2049870 - RNA, 15 nt, Human
auguuuuaaggcuuc

SEQ ID NO: 2049871 - RNA, 20 nt, Human
auguuuuaaauauagaauuu

SEQ ID NO: 2049872 - RNA, 18 nt, Human
auguuuuaagaggcaggg

SEQ ID NO: 2049873 - RNA, 16 nt, Human
auguuuuaagaggcag

SEQ ID NO: 2049874 - RNA, 11 nt, Human
auuaaauuaug

SEQ ID NO: 2049875 - RNA, 14 nt, Human
auguguaaguauuc

SEQ ID NO: 2049876 - RNA, 15 nt, Human
augugguuacacacu

SEQ ID NO: 2049877 - RNA, 15 nt, Human
auguggugggacagg

SEQ ID NO: 2049878 - RNA, 21 nt, Human
auguggugggacagggaccca

SEQ ID NO: 2049879 - RNA, 20 nt, Human
augugguugcaaggccgcug

SEQ ID NO: 2049880 - RNA, 16 nt, Human
augugggucaaggaau

SEQ ID NO: 2049881 - RNA, 11 nt, Human
agccuccugag

SEQ ID NO: 2049882 - RNA, 19 nt, Human
agccgucagccaaauguaa

SEQ ID NO: 2049883 - RNA, 22 nt, Human
agccucccgaguagcugggacu

SEQ ID NO: 2049884 - RNA, 12 nt, Human
agccucccugaa

SEQ ID NO: 2049885 - RNA, 22 nt, Human
agccucccucugaccugcaggc

SEQ ID NO: 2049886 - RNA, 11 nt, Human
agccucccuga

SEQ ID NO: 2049887 - RNA, 13 nt, Human
agccucccucuga

SEQ ID NO: 2049888 - RNA, 14 nt, Human
agccucccucugac

SEQ ID NO: 2049889 - RNA, 15 nt, Human
agccucccucugacc

SEQ ID NO: 2049890 - RNA, 21 nt, Human
agccucccucugaccugcagg

SEQ ID NO: 2049891 - RNA, 17 nt, Human
agccucccgaguagcug

SEQ ID NO: 2049892 - RNA, 22 nt, Human
agccucccgaauagcugggacu

SEQ ID NO: 2049893 - RNA, 20 nt, Human
agccucccgaauagcuggga

SEQ ID NO: 2049894 - RNA, 19 nt, Human
agccucccgaauagcuggg

SEQ ID NO: 2049895 - RNA, 18 nt, Human
agccucccgaauagcugg

SEQ ID NO: 2049896 - RNA, 20 nt, Human
agccucccaaagugcuggga

SEQ ID NO: 2049897 - RNA, 17 nt, Human
agccucccaaagugcug

SEQ ID NO: 2049898 - RNA, 16 nt, Human
agccgucagccaaaug

SEQ ID NO: 2049899 - RNA, 19 nt, Human
agccucccaaagugcuggg

SEQ ID NO: 2049900 - RNA, 18 nt, Human
agccucccaaagugcugg

SEQ ID NO: 2049901 - RNA, 19 nt, Human
agccggagugacagaguaa

SEQ ID NO: 2049902 - RNA, 15 nt, Human
agccggggccugccu

SEQ ID NO: 2049903 - RNA, 18 nt, Human
agccggggccugccuagc

SEQ ID NO: 2049904 - RNA, 19 nt, Human
agccggggccugccuagca

SEQ ID NO: 2049905 - RNA, 21 nt, Human
agccgagaucacgccacugca

SEQ ID NO: 2049906 - RNA, 19 nt, Human
agccgagauugcaccacug

SEQ ID NO: 2049907 - RNA, 20 nt, Human
agccgagauugcaccacugc

SEQ ID NO: 2049908 - RNA, 14 nt, Human
agccgcagccuccc

SEQ ID NO: 2049909 - RNA, 18 nt, Human
agccgcagccucccucug

SEQ ID NO: 2049910 - RNA, 16 nt, Human
agccgcaucccagacu

SEQ ID NO: 2049911 - RNA, 16 nt, Human
agccgcaucuucucca

SEQ ID NO: 2049912 - RNA, 17 nt, Human
agccgcaucuucuccau

SEQ ID NO: 2049913 - RNA, 19 nt, Human
agccuccugaguagcugga

SEQ ID NO: 2049914 - RNA, 20 nt, Human
agcccaaagugguauagaaa

SEQ ID NO: 2049915 - RNA, 23 nt, Human
agcccaaagugguauagaaaugc

SEQ ID NO: 2049916 - RNA, 16 nt, Human
agcccaaagcuguugg

SEQ ID NO: 2049917 - RNA, 19 nt, Human
agccccacccucagaugca

SEQ ID NO: 2049918 - RNA, 13 nt, Human
agccccagcacca

SEQ ID NO: 2049919 - RNA, 21 nt, Human
agccccagcaccaccaggucu

SEQ ID NO: 2049920 - RNA, 12 nt, Human
agccccagcacu

SEQ ID NO: 2049921 - RNA, 15 nt, Human
agccccagcacuaac

SEQ ID NO: 2049922 - RNA, 14 nt, Human
agccccagcccagc

SEQ ID NO: 2049923 - RNA, 15 nt, Human
agccccagcccagcc

SEQ ID NO: 2049924 - RNA, 17 nt, Human
agccccagcccagccca

SEQ ID NO: 2049925 - RNA, 23 nt, Human
agccccagcccagcccagcugcu

SEQ ID NO: 2049926 - RNA, 20 nt, Human
agccgagaucacgccacugc

SEQ ID NO: 2049927 - RNA, 19 nt, Human
agccgagaucacgccacug

SEQ ID NO: 2049928 - RNA, 21 nt, Human
agcccugaggugaaagggagc

SEQ ID NO: 2049929 - RNA, 22 nt, Human
agcccugaggugaaagggagcu

SEQ ID NO: 2049930 - RNA, 15 nt, Human
agcccugagcuuucu

SEQ ID NO: 2049931 - RNA, 23 nt, Human
agccccauaauuuuuuuuuuccu

SEQ ID NO: 2049932 - RNA, 17 nt, Human
agccccaucagcuccag

SEQ ID NO: 2049933 - RNA, 23 nt, Human
agccccagggucuucccuaccuc

SEQ ID NO: 2049934 - RNA, 16 nt, Human
agccccagugcccaca

SEQ ID NO: 2049935 - RNA, 13 nt, Human
agccccaggcagg

SEQ ID NO: 2049936 - RNA, 16 nt, Human
agccccaggcaggcug

SEQ ID NO: 2049937 - RNA, 20 nt, Human
agccccaggcaggcugugcg

SEQ ID NO: 2049938 - RNA, 18 nt, Human
agccccagggucuucccu

SEQ ID NO: 2049939 - RNA, 20 nt, Human
agccccagggucuucccuac

SEQ ID NO: 2049940 - RNA, 22 nt, Human
agccccagggucuucccuaccu

SEQ ID NO: 2049941 - RNA, 15 nt, Human
agccccacugcccuu

SEQ ID NO: 2049942 - RNA, 17 nt, Human
agcaguuguuauuacau

SEQ ID NO: 2049943 - RNA, 13 nt, Human
agcaugaaaaagc

SEQ ID NO: 2049944 - RNA, 14 nt, Human
agcaugaaaaagca

SEQ ID NO: 2049945 - RNA, 20 nt, Human
agcaucuucacuucuaaaug

SEQ ID NO: 2049946 - RNA, 23 nt, Human
agcaucuucacuucuaaaugcau

SEQ ID NO: 2049947 - RNA, 19 nt, Human
agcaucuucucacucccuu

SEQ ID NO: 2049948 - RNA, 23 nt, Human
agccaaagcuaggccuggccaga

SEQ ID NO: 2049949 - RNA, 20 nt, Human
agccaaagcuaggccuggcc

SEQ ID NO: 2049950 - RNA, 19 nt, Human
agccaaagcuaggccuggc

SEQ ID NO: 2049951 - RNA, 15 nt, Human
agcaugaagacagag

SEQ ID NO: 2049952 - RNA, 12 nt, Human
agcaugaagaca

SEQ ID NO: 2049953 - RNA, 13 nt, Human
agcaugcacaaag

SEQ ID NO: 2049954 - RNA, 14 nt, Human
agcaugcacaaagu

SEQ ID NO: 2049955 - RNA, 16 nt, Human
agcaugcacaaagugu

SEQ ID NO: 2049956 - RNA, 18 nt, Human
agcaugcacaaaguguau

SEQ ID NO: 2049957 - RNA, 19 nt, Human
agcaugcacaaaguguauu

SEQ ID NO: 2049958 - RNA, 21 nt, Human
agcaugcacaaaguguauuca

SEQ ID NO: 2049959 - RNA, 18 nt, Human
agccauuaccauggagac

SEQ ID NO: 2049960 - RNA, 20 nt, Human
agccauuaccauggagacaa

SEQ ID NO: 2049961 - RNA, 16 nt, Human
agcccaaagaaggaaa

SEQ ID NO: 2049962 - RNA, 16 nt, Human
agcagugagucucuuc

SEQ ID NO: 2049963 - RNA, 14 nt, Human
agcagugagccgca

SEQ ID NO: 2049964 - RNA, 22 nt, Human
agcagugagccgcaucuucucc

SEQ ID NO: 2049965 - RNA, 21 nt, Human
agcagucuacccaccucagcc

SEQ ID NO: 2049966 - RNA, 23 nt, Human
agcagucuacccaccucagccuc

SEQ ID NO: 2049967 - RNA, 13 nt, Human
agcagccagcucu

SEQ ID NO: 2049968 - RNA, 14 nt, Human
agcagccagcucuc

SEQ ID NO: 2049969 - RNA, 15 nt, Human
agcagccagcucuca

SEQ ID NO: 2049970 - RNA, 23 nt, Human
agcagccagcucucagccaacga

SEQ ID NO: 2049971 - RNA, 16 nt, Human
agcagccagcucucag

SEQ ID NO: 2049972 - RNA, 17 nt, Human
agcagccagcucucagc

SEQ ID NO: 2049973 - RNA, 18 nt, Human
agcagccagcucucagcc

SEQ ID NO: 2049974 - RNA, 19 nt, Human
agcagccagcucucagcca

SEQ ID NO: 2049975 - RNA, 12 nt, Human
agcagcccuccu

SEQ ID NO: 2049976 - RNA, 13 nt, Human
agcagcccuccuc

SEQ ID NO: 2049977 - RNA, 14 nt, Human
agcagcccuccuca

SEQ ID NO: 2049978 - RNA, 19 nt, Human
agcacuaaggugugcucug

SEQ ID NO: 2049979 - RNA, 16 nt, Human
agcacuaaagcagugg

SEQ ID NO: 2049980 - RNA, 17 nt, Human
agcacuaaagcagugga

SEQ ID NO: 2049981 - RNA, 20 nt, Human
agcacuaaagcaguggacac

SEQ ID NO: 2049982 - RNA, 23 nt, Human
agcacuaaagcaguggacaccag

SEQ ID NO: 2049983 - RNA, 20 nt, Human
agcacuaaggugugcucuga

SEQ ID NO: 2049984 - RNA, 16 nt, Human
agcacuaacguaaaua

SEQ ID NO: 2049985 - RNA, 17 nt, Human
agcacgugguaaaacac

SEQ ID NO: 2049986 - RNA, 16 nt, Human
agcacguuuaaaguuc

SEQ ID NO: 2049987 - RNA, 17 nt, Human
agcacguuuaaaguucu

SEQ ID NO: 2049988 - RNA, 18 nt, Human
agcacguuuaaaguucug

SEQ ID NO: 2049989 - RNA, 13 nt, Human
agcacuaaagcag

SEQ ID NO: 2049990 - RNA, 14 nt, Human
agcacuaaagcagu

SEQ ID NO: 2049991 - RNA, 19 nt, Human
agaugggacugggagggcc

SEQ ID NO: 2049992 - RNA, 15 nt, Human
agaugggacugggag

SEQ ID NO: 2049993 - RNA, 21 nt, Human
agauguaagagcuuuacaaaa

SEQ ID NO: 2049994 - RNA, 14 nt, Human
agacggauugcauu

SEQ ID NO: 2049995 - RNA, 16 nt, Human
agacggcacccaccca

SEQ ID NO: 2049996 - RNA, 19 nt, Human
agacggagucccaccuugg

SEQ ID NO: 2049997 - RNA, 15 nt, Human
agaccauagugacca

SEQ ID NO: 2049998 - RNA, 20 nt, Human
agaccacaggguucaaaaug

SEQ ID NO: 2049999 - RNA, 21 nt, Human
agaccacaggguucaaaaugu

SEQ ID NO: 2050000 - RNA, 14 nt, Human
agaccaaccugacc

SEQ ID NO: 2050001 - RNA, 13 nt, Human
agaccaagcuugu

SEQ ID NO: 2050002 - RNA, 17 nt, Human
agaccaagacucugaaa

SEQ ID NO: 2050003 - RNA, 16 nt, Human
agaccaagcuugucca

SEQ ID NO: 2050004 - RNA, 14 nt, Human
agaccaaggcggga

SEQ ID NO: 2050005 - RNA, 17 nt, Human
agaccaaggcgggagca

SEQ ID NO: 2050006 - RNA, 23 nt, Human
agaccaaggcgggagcaucucuu

SEQ ID NO: 2050007 - RNA, 20 nt, Human
agacacaaacaaacaagcua

SEQ ID NO: 2050008 - RNA, 21 nt, Human
agacugcaagugagcaaaccu

SEQ ID NO: 2050009 - RNA, 20 nt, Human
agagccugguugcccaggga

SEQ ID NO: 2050010 - RNA, 21 nt, Human
agagcccuguaucaacccaga

SEQ ID NO: 2050011 - RNA, 17 nt, Human
agagccugcugcauggg

SEQ ID NO: 2050012 - RNA, 13 nt, Human
agagccugcugga

SEQ ID NO: 2050013 - RNA, 16 nt, Human
agagccugcuggaucu

SEQ ID NO: 2050014 - RNA, 18 nt, Human
agagccuggugcugcugc

SEQ ID NO: 2050015 - RNA, 16 nt, Human
agagccuggugcugcu

SEQ ID NO: 2050016 - RNA, 10 nt, Human
agagccuggu

SEQ ID NO: 2050017 - RNA, 17 nt, Human
agagccccacacggagg

SEQ ID NO: 2050018 - RNA, 15 nt, Human
agagccccacacgga

SEQ ID NO: 2050019 - RNA, 21 nt, Human
agagccccgcaaaacccacug

SEQ ID NO: 2050020 - RNA, 22 nt, Human
agagccccgcaaaacccacuga

SEQ ID NO: 2050021 - RNA, 16 nt, Human
agagaguggcuccucc

SEQ ID NO: 2050022 - RNA, 14 nt, Human
agagaguggcuccu

SEQ ID NO: 2050023 - RNA, 23 nt, Human
agagaggguggugaccucugccu

SEQ ID NO: 2050024 - RNA, 14 nt, Human
agagaggagaaaca

SEQ ID NO: 2050025 - RNA, 16 nt, Human
agagaggagaaacaca

SEQ ID NO: 2050026 - RNA, 18 nt, Human
agagaggagaaacacauc

SEQ ID NO: 2050027 - RNA, 22 nt, Human
agagaggucaagcccaggagga

SEQ ID NO: 2050028 - RNA, 23 nt, Human
agagaggucaagcccaggaggac

SEQ ID NO: 2050029 - RNA, 15 nt, Human
agagaaggggaggag

SEQ ID NO: 2050030 - RNA, 14 nt, Human
agagaaggcagcag

SEQ ID NO: 2050031 - RNA, 12 nt, Human
agagaaggcagg

SEQ ID NO: 2050032 - RNA, 13 nt, Human
agagaaggcagga

SEQ ID NO: 2050033 - RNA, 20 nt, Human
agagaaggcaggaaugugug

SEQ ID NO: 2050034 - RNA, 22 nt, Human
agagaaggggaagcacucgugu

SEQ ID NO: 2050035 - RNA, 12 nt, Human
agagaaggggag

SEQ ID NO: 2050036 - RNA, 14 nt, Human
agagaggaaucaga

SEQ ID NO: 2050037 - RNA, 17 nt, Human
agagaggaaucagacuu

SEQ ID NO: 2050038 - RNA, 18 nt, Human
agagaggacgugggcggc

SEQ ID NO: 2050039 - RNA, 13 nt, Human
agagaaggaaugu

SEQ ID NO: 2050040 - RNA, 16 nt, Human
agagaaggaaugucuu

SEQ ID NO: 2050041 - RNA, 20 nt, Human
agagaaggaaugucuuuggu

SEQ ID NO: 2050042 - RNA, 14 nt, Human
agagaagccuuggu

SEQ ID NO: 2050043 - RNA, 18 nt, Human
agagaaaguacuucucca

SEQ ID NO: 2050044 - RNA, 12 nt, Human
agagaaagggga

SEQ ID NO: 2050045 - RNA, 10 nt, Human
agagaagaga

SEQ ID NO: 2050046 - RNA, 21 nt, Human
agagaagagauugugguuuca

SEQ ID NO: 2050047 - RNA, 14 nt, Human
agauaguacauaaa

SEQ ID NO: 2050048 - RNA, 18 nt, Human
agauaguacauaaaggug

SEQ ID NO: 2050049 - RNA, 17 nt, Human
agauaguagcauacauu

SEQ ID NO: 2050050 - RNA, 15 nt, Human
agauaguuacuauau

SEQ ID NO: 2050051 - RNA, 21 nt, Human
agaugagcccagcccuguucu

SEQ ID NO: 2050052 - RNA, 23 nt, Human
agauggcugugccucugccuguc

SEQ ID NO: 2050053 - RNA, 17 nt, Human
agaugagaauucagcug

SEQ ID NO: 2050054 - RNA, 19 nt, Human
agaugagaauucagcugcc

SEQ ID NO: 2050055 - RNA, 20 nt, Human
agaugagaauucagcugccc

SEQ ID NO: 2050056 - RNA, 14 nt, Human
agaugacugagucc

SEQ ID NO: 2050057 - RNA, 15 nt, Human
agaugacugaguccu

SEQ ID NO: 2050058 - RNA, 14 nt, Human
agaugaccccuccc

SEQ ID NO: 2050059 - RNA, 19 nt, Human
agaucugugccccaugccu

SEQ ID NO: 2050060 - RNA, 12 nt, Human
agaucugugccc

SEQ ID NO: 2050061 - RNA, 13 nt, Human
agaucugugcccc

SEQ ID NO: 2050062 - RNA, 14 nt, Human
agaucugugcccca

SEQ ID NO: 2050063 - RNA, 16 nt, Human
agaucugugccccaug

SEQ ID NO: 2050064 - RNA, 11 nt, Human
agauagaaaua

SEQ ID NO: 2050065 - RNA, 15 nt, Human
agauagaaauaaaua

SEQ ID NO: 2050066 - RNA, 18 nt, Human
agauagaaauaaauagcu

SEQ ID NO: 2050067 - RNA, 22 nt, Human
agauagaaauaaauagcuauau

SEQ ID NO: 2050068 - RNA, 13 nt, Human
agauagaagaaaa

SEQ ID NO: 2050069 - RNA, 14 nt, Human
agauagaagaaaaa

SEQ ID NO: 2050070 - RNA, 14 nt, Human
agaguuaaucaacu

SEQ ID NO: 2050071 - RNA, 19 nt, Human
agaguuaaucaacugaaag

SEQ ID NO: 2050072 - RNA, 21 nt, Human
agauacuuggaccgaguagag

SEQ ID NO: 2050073 - RNA, 22 nt, Human
agauacuuggggggcugaggug

SEQ ID NO: 2050074 - RNA, 12 nt, Human
agaguuaagaau

SEQ ID NO: 2050075 - RNA, 13 nt, Human
agaguuaagaaug

SEQ ID NO: 2050076 - RNA, 14 nt, Human
agaguuaagaaugu

SEQ ID NO: 2050077 - RNA, 20 nt, Human
agaguuaauauauagaaggg

SEQ ID NO: 2050078 - RNA, 23 nt, Human
agaggguggugaccucugccuga

SEQ ID NO: 2050079 - RNA, 18 nt, Human
agaggggcuuucuggaga

SEQ ID NO: 2050080 - RNA, 15 nt, Human
agaggggcagaacag

SEQ ID NO: 2050081 - RNA, 16 nt, Human
agaggggcagaacagc

SEQ ID NO: 2050082 - RNA, 23 nt, Human
agaguuaaauagaguauaugcac

SEQ ID NO: 2050083 - RNA, 13 nt, Human
agaggguuccugu

SEQ ID NO: 2050084 - RNA, 22 nt, Human
agaggggaacagacuggaagca

SEQ ID NO: 2050085 - RNA, 22 nt, Human
agaggggaaaccaguguagccu

SEQ ID NO: 2050086 - RNA, 19 nt, Human
agaggggaauaauagaaga

SEQ ID NO: 2050087 - RNA, 20 nt, Human
agaggggaauaauagaagaa

SEQ ID NO: 2050088 - RNA, 13 nt, Human
agaggagaggggc

SEQ ID NO: 2050089 - RNA, 20 nt, Human
agggacucaucauuuccauu

SEQ ID NO: 2050090 - RNA, 17 nt, Human
agggacuaggagcacug

SEQ ID NO: 2050091 - RNA, 20 nt, Human
aggcugucuucucaggcucu

SEQ ID NO: 2050092 - RNA, 21 nt, Human
aggcugucuucucaggcucug

SEQ ID NO: 2050093 - RNA, 22 nt, Human
aggcugucuucucaggcucugc

SEQ ID NO: 2050094 - RNA, 23 nt, Human
aggcugucuucucaggcucugcc

SEQ ID NO: 2050095 - RNA, 15 nt, Human
aggcugugggccuca

SEQ ID NO: 2050096 - RNA, 18 nt, Human
aggcugugggccucaagg

SEQ ID NO: 2050097 - RNA, 18 nt, Human
aggcugccucucccauca

SEQ ID NO: 2050098 - RNA, 19 nt, Human
aggcugccugagcaccucc

SEQ ID NO: 2050099 - RNA, 23 nt, Human
aggcugccugagcaccucccagc

SEQ ID NO: 2050100 - RNA, 23 nt, Human
aggcuauacuugucuuguucacc

SEQ ID NO: 2050101 - RNA, 14 nt, Human
aggcucuucuccuu

SEQ ID NO: 2050102 - RNA, 15 nt, Human
aggcucuuucugggc

SEQ ID NO: 2050103 - RNA, 18 nt, Human
aggcucuuucugggccaa

SEQ ID NO: 2050104 - RNA, 20 nt, Human
aggcucuuucugggccaagu

SEQ ID NO: 2050105 - RNA, 13 nt, Human
aggcugaaagagg

SEQ ID NO: 2050106 - RNA, 15 nt, Human
aggcugaccaagaga

SEQ ID NO: 2050107 - RNA, 17 nt, Human
aggcugaccaagagaga

SEQ ID NO: 2050108 - RNA, 14 nt, Human
aggcugaccaagag

SEQ ID NO: 2050109 - RNA, 16 nt, Human
aggcugaaagaggcca

SEQ ID NO: 2050110 - RNA, 17 nt, Human
aggcugaaagaggccaa

SEQ ID NO: 2050111 - RNA, 18 nt, Human
aggcugaccaagagagaa

SEQ ID NO: 2050112 - RNA, 22 nt, Human
aggcugaggggaggaucacugg

SEQ ID NO: 2050113 - RNA, 15 nt, Human
aggcugcagcgagcu

SEQ ID NO: 2050114 - RNA, 13 nt, Human
aggcagacagcag

SEQ ID NO: 2050115 - RNA, 14 nt, Human
aggcagacagcagc

SEQ ID NO: 2050116 - RNA, 15 nt, Human
aggcagacagcagcu

SEQ ID NO: 2050117 - RNA, 18 nt, Human
aggcagacagcagcucag

SEQ ID NO: 2050118 - RNA, 19 nt, Human
aggcagacagcagcucagg

SEQ ID NO: 2050119 - RNA, 20 nt, Human
aggcagacagcagcucaggc

SEQ ID NO: 2050120 - RNA, 21 nt, Human
aggcagacagcagcucaggca

SEQ ID NO: 2050121 - RNA, 17 nt, Human
agggcacaccgggcacu

SEQ ID NO: 2050122 - RNA, 21 nt, Human
agggcacaccgggcacucaga

SEQ ID NO: 2050123 - RNA, 20 nt, Human
agggcacaccgggcacucag

SEQ ID NO: 2050124 - RNA, 19 nt, Human
agggcgggaggauguucug

SEQ ID NO: 2050125 - RNA, 21 nt, Human
aggggauagagagagaccacu

SEQ ID NO: 2050126 - RNA, 16 nt, Human
agggcgugacucaccc

SEQ ID NO: 2050127 - RNA, 19 nt, Human
aggggcaaacaccugcuga

SEQ ID NO: 2050128 - RNA, 19 nt, Human
aggggauguauccaugggg

SEQ ID NO: 2050129 - RNA, 22 nt, Human
aggggauguauccaugggggca

SEQ ID NO: 2050130 - RNA, 15 nt, Human
agggcgugacucacc

SEQ ID NO: 2050131 - RNA, 14 nt, Human
aggggaugggaggu

SEQ ID NO: 2050132 - RNA, 15 nt, Human
aggggcacagggucu

SEQ ID NO: 2050133 - RNA, 14 nt, Human
aggggcagaacagc

SEQ ID NO: 2050134 - RNA, 18 nt, Human
aggggcaacgaagaaaaa

SEQ ID NO: 2050135 - RNA, 19 nt, Human
aggggcaacgaagaaaaaa

SEQ ID NO: 2050136 - RNA, 20 nt, Human
aggggcaacgaagaaaaaaa

SEQ ID NO: 2050137 - RNA, 17 nt, Human
aggggcagaaaaacucu

SEQ ID NO: 2050138 - RNA, 12 nt, Human
aggggcccuggu

SEQ ID NO: 2050139 - RNA, 14 nt, Human
aggggcccguggga

SEQ ID NO: 2050140 - RNA, 15 nt, Human
agguacagagaagga

SEQ ID NO: 2050141 - RNA, 16 nt, Human
agguacagagaaggaa

SEQ ID NO: 2050142 - RNA, 17 nt, Human
agguaccccagcucugc

SEQ ID NO: 2050143 - RNA, 19 nt, Human
agguaccccagcucugcuu

SEQ ID NO: 2050144 - RNA, 20 nt, Human
agguaccccagcucugcuug

SEQ ID NO: 2050145 - RNA, 21 nt, Human
agguaccccagcucugcuugc

SEQ ID NO: 2050146 - RNA, 21 nt, Human
agguaccacugauuuggagau

SEQ ID NO: 2050147 - RNA, 13 nt, Human
agguucagcuugu

SEQ ID NO: 2050148 - RNA, 16 nt, Human
agguucacuaaagcag

SEQ ID NO: 2050149 - RNA, 15 nt, Human
agguucaugcccaag

SEQ ID NO: 2050150 - RNA, 21 nt, Human
agguucaugccaccauggcca

SEQ ID NO: 2050151 - RNA, 14 nt, Human
agguuaauguucau

SEQ ID NO: 2050152 - RNA, 15 nt, Human
agguuaauaaaguaa

SEQ ID NO: 2050153 - RNA, 15 nt, Human
agguggcagcccugu

SEQ ID NO: 2050154 - RNA, 13 nt, Human
agguggcagcccu

SEQ ID NO: 2050155 - RNA, 14 nt, Human
agguggcagcccug

SEQ ID NO: 2050156 - RNA, 17 nt, Human
aggugcugccauccagg

SEQ ID NO: 2050157 - RNA, 16 nt, Human
aggugcugccauccag

SEQ ID NO: 2050158 - RNA, 16 nt, Human
agguccuucugcugga

SEQ ID NO: 2050159 - RNA, 16 nt, Human
agguccugggggccug

SEQ ID NO: 2050160 - RNA, 17 nt, Human
agguccugggggccuga

SEQ ID NO: 2050161 - RNA, 18 nt, Human
agguccugggggccugac

SEQ ID NO: 2050162 - RNA, 19 nt, Human
agguccugggggccugacc

SEQ ID NO: 2050163 - RNA, 21 nt, Human
agguccugggggccugaccuc

SEQ ID NO: 2050164 - RNA, 22 nt, Human
agguccugggggccugaccucc

SEQ ID NO: 2050165 - RNA, 21 nt, Human
aggucgaccccaaagccccuu

SEQ ID NO: 2050166 - RNA, 14 nt, Human
aggucgaggcagga

SEQ ID NO: 2050167 - RNA, 12 nt, Human
aggugcugggag

SEQ ID NO: 2050168 - RNA, 13 nt, Human
aggugcugggagg

SEQ ID NO: 2050169 - RNA, 14 nt, Human
aggugcuguuguca

SEQ ID NO: 2050170 - RNA, 19 nt, Human
aggugcuguugucauugcu

SEQ ID NO: 2050171 - RNA, 21 nt, Human
aggugcuguugucauugcuuu

SEQ ID NO: 2050172 - RNA, 23 nt, Human
aggugcuguugucauugcuuuac

SEQ ID NO: 2050173 - RNA, 15 nt, Human
aggugcugggaggga

SEQ ID NO: 2050174 - RNA, 23 nt, Human
aggugcuuauucucaaagcagga

SEQ ID NO: 2050175 - RNA, 13 nt, Human
agguggaaaaaca

SEQ ID NO: 2050176 - RNA, 18 nt, Human
agguggaaaaacaucuga

SEQ ID NO: 2050177 - RNA, 15 nt, Human
agguggaagcccucc

SEQ ID NO: 2050178 - RNA, 16 nt, Human
agguggaagcccuccu

SEQ ID NO: 2050179 - RNA, 11 nt, Human
agguggaagcc

SEQ ID NO: 2050180 - RNA, 13 nt, Human
agguggaagcccu

SEQ ID NO: 2050181 - RNA, 14 nt, Human
agguggaagcccuc

SEQ ID NO: 2050182 - RNA, 17 nt, Human
aggacccggaggggccu

SEQ ID NO: 2050183 - RNA, 15 nt, Human
aggaccccucaccuu

SEQ ID NO: 2050184 - RNA, 23 nt, Human
aggaccccucaccuugcaacaca

SEQ ID NO: 2050185 - RNA, 14 nt, Human
aggaccucagguga

SEQ ID NO: 2050186 - RNA, 20 nt, Human
aggaccucaggugagaagca

SEQ ID NO: 2050187 - RNA, 16 nt, Human
aggagaagaaggaaau

SEQ ID NO: 2050188 - RNA, 20 nt, Human
aggagaagaaggaaaugaau

SEQ ID NO: 2050189 - RNA, 11 nt, Human
aggaccucugg

SEQ ID NO: 2050190 - RNA, 12 nt, Human
aggaccucuggg

SEQ ID NO: 2050191 - RNA, 13 nt, Human
aggaccucugggc

SEQ ID NO: 2050192 - RNA, 14 nt, Human
aggaccucugggcu

SEQ ID NO: 2050193 - RNA, 14 nt, Human
aggagaaccacuac

SEQ ID NO: 2050194 - RNA, 15 nt, Human
aggagaaccacuaca

SEQ ID NO: 2050195 - RNA, 15 nt, Human
aggagagcuagcagc

SEQ ID NO: 2050196 - RNA, 12 nt, Human
aggagagccugg

SEQ ID NO: 2050197 - RNA, 13 nt, Human
aggagagccuggu

SEQ ID NO: 2050198 - RNA, 14 nt, Human
aggagaggggcaca

SEQ ID NO: 2050199 - RNA, 16 nt, Human
aggagaggggcacagg

SEQ ID NO: 2050200 - RNA, 18 nt, Human
aggagaggggcacagggu

SEQ ID NO: 2050201 - RNA, 13 nt, Human
aggagaggggcag

SEQ ID NO: 2050202 - RNA, 18 nt, Human
aggagaggggcagaacag

SEQ ID NO: 2050203 - RNA, 19 nt, Human
aggagaggggcagaacagc

SEQ ID NO: 2050204 - RNA, 20 nt, Human
aggaccccuccaugugggcu

SEQ ID NO: 2050205 - RNA, 13 nt, Human
aggaccccucacc

SEQ ID NO: 2050206 - RNA, 17 nt, Human
aggaccaaaaaaauaag

SEQ ID NO: 2050207 - RNA, 18 nt, Human
aggaccaacaagggcagu

SEQ ID NO: 2050208 - RNA, 19 nt, Human
aggaccaacaagggcagug

SEQ ID NO: 2050209 - RNA, 12 nt, Human
aggaccacuccu

SEQ ID NO: 2050210 - RNA, 16 nt, Human
aggaccacuccuguac

SEQ ID NO: 2050211 - RNA, 22 nt, Human
aggaccacuccuguacacugaa

SEQ ID NO: 2050212 - RNA, 20 nt, Human
aggaacgguaaauuucugug

SEQ ID NO: 2050213 - RNA, 23 nt, Human
aggcagaagaauugaacccagga

SEQ ID NO: 2050214 - RNA, 16 nt, Human
aggcacuguacuaggc

SEQ ID NO: 2050215 - RNA, 22 nt, Human
aggcagaagaauugaacccagg

SEQ ID NO: 2050216 - RNA, 22 nt, Human
aggcacugcugcccagccucca

SEQ ID NO: 2050217 - RNA, 16 nt, Human
aggcacugcugcccag

SEQ ID NO: 2050218 - RNA, 14 nt, Human
aggcacugcugccc

SEQ ID NO: 2050219 - RNA, 20 nt, Human
aggauguucugggacacagu

SEQ ID NO: 2050220 - RNA, 14 nt, Human
aggagggucaggaa

SEQ ID NO: 2050221 - RNA, 17 nt, Human
aggagggucaggaagga

SEQ ID NO: 2050222 - RNA, 18 nt, Human
aggagggucaggaaggau

SEQ ID NO: 2050223 - RNA, 17 nt, Human
aggaggggauagagaga

SEQ ID NO: 2050224 - RNA, 16 nt, Human
aggauucuuccucccu

SEQ ID NO: 2050225 - RNA, 12 nt, Human
aggauucuuccu

SEQ ID NO: 2050226 - RNA, 13 nt, Human
aggauucuaugag

SEQ ID NO: 2050227 - RNA, 15 nt, Human
aggauucuaugaggc

SEQ ID NO: 2050228 - RNA, 16 nt, Human
aggauucuaugaggca

SEQ ID NO: 2050229 - RNA, 14 nt, Human
aggauucuccuuuu

SEQ ID NO: 2050230 - RNA, 16 nt, Human
agcugacaaaauuuug

SEQ ID NO: 2050231 - RNA, 19 nt, Human
agcugacaaaauuuugcuc

SEQ ID NO: 2050232 - RNA, 21 nt, Human
agcuccuccuugucuuggcag

SEQ ID NO: 2050233 - RNA, 22 nt, Human
agcuccuccuugucuuggcagc

SEQ ID NO: 2050234 - RNA, 17 nt, Human
agcuccucugggcagga

SEQ ID NO: 2050235 - RNA, 19 nt, Human
agcuccucugggcaggacc

SEQ ID NO: 2050236 - RNA, 20 nt, Human
agcuccucugggcaggaccu

SEQ ID NO: 2050237 - RNA, 13 nt, Human
agcuccucuuccu

SEQ ID NO: 2050238 - RNA, 22 nt, Human
agcuccuggucuugagaugucu

SEQ ID NO: 2050239 - RNA, 16 nt, Human
agcuccugggaaggcu

SEQ ID NO: 2050240 - RNA, 23 nt, Human
agcuccugggaaggcuacucacc

SEQ ID NO: 2050241 - RNA, 20 nt, Human
agcuccuggucuugagaugu

SEQ ID NO: 2050242 - RNA, 23 nt, Human
agcuccucaacucaccuaauguu

SEQ ID NO: 2050243 - RNA, 16 nt, Human
agcuccucaacucacc

SEQ ID NO: 2050244 - RNA, 21 nt, Human
agcuggucccacucaguccau

SEQ ID NO: 2050245 - RNA, 19 nt, Human
agcuggugcauuacagaga

SEQ ID NO: 2050246 - RNA, 20 nt, Human
agcuggugcauuacagagag

SEQ ID NO: 2050247 - RNA, 21 nt, Human
agcuggugcauuacagagagg

SEQ ID NO: 2050248 - RNA, 22 nt, Human
agcuggugcauuacagagagga

SEQ ID NO: 2050249 - RNA, 10 nt, Human
agcuggugca

SEQ ID NO: 2050250 - RNA, 12 nt, Human
agcuggugcauu

SEQ ID NO: 2050251 - RNA, 13 nt, Human
agcuggugcauua

SEQ ID NO: 2050252 - RNA, 14 nt, Human
agcuggugcauuac

SEQ ID NO: 2050253 - RNA, 17 nt, Human
agcuggugcauuacaga

SEQ ID NO: 2050254 - RNA, 18 nt, Human
agcuggugcauuacagag

SEQ ID NO: 2050255 - RNA, 22 nt, Human
agcugggugucaagagggucug

SEQ ID NO: 2050256 - RNA, 17 nt, Human
agcugggugucaagagg

SEQ ID NO: 2050257 - RNA, 22 nt, Human
agcugggugaguggggagacac

SEQ ID NO: 2050258 - RNA, 16 nt, Human
agcugcucugucuucu

SEQ ID NO: 2050259 - RNA, 12 nt, Human
agcugcucugcc

SEQ ID NO: 2050260 - RNA, 13 nt, Human
agcugcucugccc

SEQ ID NO: 2050261 - RNA, 14 nt, Human
agcugcucugccca

SEQ ID NO: 2050262 - RNA, 15 nt, Human
agcugcucugcccag

SEQ ID NO: 2050263 - RNA, 16 nt, Human
agcugcucugcccaga

SEQ ID NO: 2050264 - RNA, 17 nt, Human
agcugcucugcccagag

SEQ ID NO: 2050265 - RNA, 18 nt, Human
agcugcucugcccagagc

SEQ ID NO: 2050266 - RNA, 19 nt, Human
agcugcucugcccagagcu

SEQ ID NO: 2050267 - RNA, 20 nt, Human
agcugcucugcccagagcug

SEQ ID NO: 2050268 - RNA, 21 nt, Human
agcugcucugcccagagcugg

SEQ ID NO: 2050269 - RNA, 21 nt, Human
agcugaggucucuugagggag

SEQ ID NO: 2050270 - RNA, 23 nt, Human
agcugaggucucuugagggagcu

SEQ ID NO: 2050271 - RNA, 18 nt, Human
agcugaggucucuugagg

SEQ ID NO: 2050272 - RNA, 23 nt, Human
agcugacccagccccuugagaaa

SEQ ID NO: 2050273 - RNA, 16 nt, Human
agcugacccagccccu

SEQ ID NO: 2050274 - RNA, 15 nt, Human
agcugcuccccuccc

SEQ ID NO: 2050275 - RNA, 13 nt, Human
agcugcuccccuc

SEQ ID NO: 2050276 - RNA, 14 nt, Human
agcugcuccccucc

SEQ ID NO: 2050277 - RNA, 19 nt, Human
agcugcuccccucccuccu

SEQ ID NO: 2050278 - RNA, 12 nt, Human
agcugcuccccu

SEQ ID NO: 2050279 - RNA, 14 nt, Human
agcuggugcccgga

SEQ ID NO: 2050280 - RNA, 22 nt, Human
agcuguaagaagagacugggaa

SEQ ID NO: 2050281 - RNA, 23 nt, Human
agcuguaagaagagacugggaag

SEQ ID NO: 2050282 - RNA, 20 nt, Human
agcuguaggugugcgggacc

SEQ ID NO: 2050283 - RNA, 11 nt, Human
agcuguaucaa

SEQ ID NO: 2050284 - RNA, 15 nt, Human
agcugagugagcuga

SEQ ID NO: 2050285 - RNA, 15 nt, Human
agcuucagccaggag

SEQ ID NO: 2050286 - RNA, 17 nt, Human
agcuucauauaccagca

SEQ ID NO: 2050287 - RNA, 20 nt, Human
agcuucagccaggagcuggg

SEQ ID NO: 2050288 - RNA, 19 nt, Human
agcuucagccaggagcugg

SEQ ID NO: 2050289 - RNA, 17 nt, Human
agcuucagccaggagcu

SEQ ID NO: 2050290 - RNA, 19 nt, Human
agcuucucauccugcaggc

SEQ ID NO: 2050291 - RNA, 23 nt, Human
agcuuccuuuguuuuuuuuuccu

SEQ ID NO: 2050292 - RNA, 23 nt, Human
agcuucuagugauuucuggggcc

SEQ ID NO: 2050293 - RNA, 12 nt, Human
aggaaaaaggac

SEQ ID NO: 2050294 - RNA, 14 nt, Human
aggaaaaaggacag

SEQ ID NO: 2050295 - RNA, 20 nt, Human
aggaaaaaggacaggcagaa

SEQ ID NO: 2050296 - RNA, 22 nt, Human
aggaaaaaggacaggcagaaag

SEQ ID NO: 2050297 - RNA, 23 nt, Human
aggaaaaaguaucauggaaauau

SEQ ID NO: 2050298 - RNA, 14 nt, Human
aggaaaucucaccc

SEQ ID NO: 2050299 - RNA, 19 nt, Human
aggaaccuggaccaaagcu

SEQ ID NO: 2050300 - RNA, 20 nt, Human
aggaaccuggaccaaagcug

SEQ ID NO: 2050301 - RNA, 16 nt, Human
aggaacgguaaauuuc

SEQ ID NO: 2050302 - RNA, 22 nt, Human
aggaaaucuuguccagagacaa

SEQ ID NO: 2050303 - RNA, 16 nt, Human
aggaaaugaauuucuc

SEQ ID NO: 2050304 - RNA, 16 nt, Human
aggaaaucucacccca

SEQ ID NO: 2050305 - RNA, 16 nt, Human
agcuucuuaaaugaga

SEQ ID NO: 2050306 - RNA, 18 nt, Human
agcuucuuaaaugagaag

SEQ ID NO: 2050307 - RNA, 20 nt, Human
agcuucuuaauauaacugcc

SEQ ID NO: 2050308 - RNA, 21 nt, Human
agcuucuuaauauaacugccu

SEQ ID NO: 2050309 - RNA, 22 nt, Human
agcuucuuaauauaacugccuu

SEQ ID NO: 2050310 - RNA, 23 nt, Human
agcuucuuaauauaacugccuua

SEQ ID NO: 2050311 - RNA, 13 nt, Human
agcuuuucccuuc

SEQ ID NO: 2050312 - RNA, 16 nt, Human
agcuuuucccuucuuu

SEQ ID NO: 2050313 - RNA, 17 nt, Human
cuccuaaaguagacuuc

SEQ ID NO: 2050314 - RNA, 23 nt, Human
cuccucuucaacugaccagccuc

SEQ ID NO: 2050315 - RNA, 18 nt, Human
cuccucuucaacugacca

SEQ ID NO: 2050316 - RNA, 19 nt, Human
cuccucuuaaaaaauaaaa

SEQ ID NO: 2050317 - RNA, 20 nt, Human
cuccucuuaaaaaauaaaaa

SEQ ID NO: 2050318 - RNA, 21 nt, Human
cuccucuuaaaaaauaaaaac

SEQ ID NO: 2050319 - RNA, 23 nt, Human
cuccucuuaaaaaauaaaaacug

SEQ ID NO: 2050320 - RNA, 18 nt, Human
cuccucucuaaccuccuu

SEQ ID NO: 2050321 - RNA, 19 nt, Human
cuccucucuaaccuccuuu

SEQ ID NO: 2050322 - RNA, 16 nt, Human
cuccuggcccacugca

SEQ ID NO: 2050323 - RNA, 18 nt, Human
cuccuggcccacugcauc

SEQ ID NO: 2050324 - RNA, 12 nt, Human
cuccugggaagg

SEQ ID NO: 2050325 - RNA, 22 nt, Human
cuccugggaaggcuacucaccu

SEQ ID NO: 2050326 - RNA, 23 nt, Human
cuccugggaaggcuacucaccuu

SEQ ID NO: 2050327 - RNA, 13 nt, Human
cuccugggccccu

SEQ ID NO: 2050328 - RNA, 17 nt, Human
cucccccauccuccccu

SEQ ID NO: 2050329 - RNA, 13 nt, Human
cuccccccacugc

SEQ ID NO: 2050330 - RNA, 14 nt, Human
cuccccccacugca

SEQ ID NO: 2050331 - RNA, 15 nt, Human
cuccccccacugcag

SEQ ID NO: 2050332 - RNA, 16 nt, Human
cuccccccacugcagg

SEQ ID NO: 2050333 - RNA, 15 nt, Human
cucccccauccuccc

SEQ ID NO: 2050334 - RNA, 12 nt, Human
cucccccauccu

SEQ ID NO: 2050335 - RNA, 11 nt, Human
cucccccaucc

SEQ ID NO: 2050336 - RNA, 21 nt, Human
cucccccaacccccaccccac

SEQ ID NO: 2050337 - RNA, 23 nt, Human
cucccccaacccccaccccacac

SEQ ID NO: 2050338 - RNA, 14 nt, Human
cucccccacccccu

SEQ ID NO: 2050339 - RNA, 19 nt, Human
cucccccacccccucccca

SEQ ID NO: 2050340 - RNA, 15 nt, Human
cucgaacuggcugca

SEQ ID NO: 2050341 - RNA, 14 nt, Human
cucgaacuggcugc

SEQ ID NO: 2050342 - RNA, 13 nt, Human
cucgaacuggcug

SEQ ID NO: 2050343 - RNA, 22 nt, Human
cuccuggggguucuuucuuccu

SEQ ID NO: 2050344 - RNA, 20 nt, Human
cuccuggggguucuuucuuc

SEQ ID NO: 2050345 - RNA, 18 nt, Human
cuccuggggguucuuucu

SEQ ID NO: 2050346 - RNA, 14 nt, Human
cuccuggggguucu

SEQ ID NO: 2050347 - RNA, 23 nt, Human
cuccuggggguucuuucuuccuc

SEQ ID NO: 2050348 - RNA, 14 nt, Human
cucgaacuccuggg

SEQ ID NO: 2050349 - RNA, 15 nt, Human
cucgaacuccugggc

SEQ ID NO: 2050350 - RNA, 17 nt, Human
cucgaacuccugggcuc

SEQ ID NO: 2050351 - RNA, 20 nt, Human
cuccugggccccucccuacc

SEQ ID NO: 2050352 - RNA, 22 nt, Human
cuccugggccccucccuaccuc

SEQ ID NO: 2050353 - RNA, 23 nt, Human
cuccugggccccucccuaccuca

SEQ ID NO: 2050354 - RNA, 21 nt, Human
cucgugguaggacuguagaaa

SEQ ID NO: 2050355 - RNA, 18 nt, Human
cucguuagggaagagaaa

SEQ ID NO: 2050356 - RNA, 22 nt, Human
cucguuagggaagagaaacagg

SEQ ID NO: 2050357 - RNA, 16 nt, Human
cucucaggcaugccug

SEQ ID NO: 2050358 - RNA, 14 nt, Human
cucucaggaucaag

SEQ ID NO: 2050359 - RNA, 12 nt, Human
cucucaccuccu

SEQ ID NO: 2050360 - RNA, 14 nt, Human
cucuaucucacagc

SEQ ID NO: 2050361 - RNA, 18 nt, Human
cucuaucucacagcacac

SEQ ID NO: 2050362 - RNA, 11 nt, Human
cucuauauuua

SEQ ID NO: 2050363 - RNA, 22 nt, Human
cucuauauuuagauuguuaaaa

SEQ ID NO: 2050364 - RNA, 17 nt, Human
cucuaaaauagccacuu

SEQ ID NO: 2050365 - RNA, 14 nt, Human
cuccaaccuggaca

SEQ ID NO: 2050366 - RNA, 14 nt, Human
cuccaagcuccauc

SEQ ID NO: 2050367 - RNA, 19 nt, Human
cuccaagcuccaucuccac

SEQ ID NO: 2050368 - RNA, 18 nt, Human
cuccaagcuccaucucca

SEQ ID NO: 2050369 - RNA, 16 nt, Human
cuccacuggauggagg

SEQ ID NO: 2050370 - RNA, 16 nt, Human
cucagucucaggagca

SEQ ID NO: 2050371 - RNA, 21 nt, Human
cucaugccaaccccgcccuag

SEQ ID NO: 2050372 - RNA, 18 nt, Human
cucaucuuagugccugag

SEQ ID NO: 2050373 - RNA, 13 nt, Human
cucaucugucugg

SEQ ID NO: 2050374 - RNA, 23 nt, Human
cucaucugucuggaggggagcuc

SEQ ID NO: 2050375 - RNA, 12 nt, Human
cucaucugugau

SEQ ID NO: 2050376 - RNA, 14 nt, Human
cucagucucaggag

SEQ ID NO: 2050377 - RNA, 15 nt, Human
cucagucucaggagc

SEQ ID NO: 2050378 - RNA, 18 nt, Human
cucaguagucagacugga

SEQ ID NO: 2050379 - RNA, 13 nt, Human
cucagucucagga

SEQ ID NO: 2050380 - RNA, 20 nt, Human
cucagguuugccugagggcg

SEQ ID NO: 2050381 - RNA, 14 nt, Human
cucaguaaaaugaa

SEQ ID NO: 2050382 - RNA, 21 nt, Human
cuccacuucuuguuccccacu

SEQ ID NO: 2050383 - RNA, 23 nt, Human
cucccacccccuucucugcucca

SEQ ID NO: 2050384 - RNA, 16 nt, Human
cuccccaugugccugc

SEQ ID NO: 2050385 - RNA, 20 nt, Human
cuccccaugugccugcacca

SEQ ID NO: 2050386 - RNA, 21 nt, Human
cuccccaugugccugcaccag

SEQ ID NO: 2050387 - RNA, 23 nt, Human
cuccccaugugccugcaccagga

SEQ ID NO: 2050388 - RNA, 21 nt, Human
cuccccauuagagucagccuu

SEQ ID NO: 2050389 - RNA, 18 nt, Human
cuccagggccacgugcca

SEQ ID NO: 2050390 - RNA, 19 nt, Human
cuccagggccacgugccag

SEQ ID NO: 2050391 - RNA, 23 nt, Human
cuccagggccacgugccaggccc

SEQ ID NO: 2050392 - RNA, 13 nt, Human
cucccaccacagc

SEQ ID NO: 2050393 - RNA, 14 nt, Human
cucccaccacagca

SEQ ID NO: 2050394 - RNA, 19 nt, Human
cucccaccacagcaggugu

SEQ ID NO: 2050395 - RNA, 12 nt, Human
cucccaccccac

SEQ ID NO: 2050396 - RNA, 13 nt, Human
cucccaccccacc

SEQ ID NO: 2050397 - RNA, 19 nt, Human
cucccaccccacccccuuc

SEQ ID NO: 2050398 - RNA, 22 nt, Human
cucccaccccacccccuucagu

SEQ ID NO: 2050399 - RNA, 23 nt, Human
cucccaccccacccccuucagug

SEQ ID NO: 2050400 - RNA, 15 nt, Human
cucccacccccaucu

SEQ ID NO: 2050401 - RNA, 19 nt, Human
cucccacccccaucucucc

SEQ ID NO: 2050402 - RNA, 20 nt, Human
cucccacccccaucucuccc

SEQ ID NO: 2050403 - RNA, 22 nt, Human
cucccacccccaucucucccuc

SEQ ID NO: 2050404 - RNA, 18 nt, Human
cucccacccccuucucug

SEQ ID NO: 2050405 - RNA, 22 nt, Human
cucccacccccuucucugcucc

SEQ ID NO: 2050406 - RNA, 17 nt, Human
cucuucaggccucccuc

SEQ ID NO: 2050407 - RNA, 13 nt, Human
cucuucaggccuc

SEQ ID NO: 2050408 - RNA, 14 nt, Human
cucuucaggccucc

SEQ ID NO: 2050409 - RNA, 15 nt, Human
cucuucaggccuccc

SEQ ID NO: 2050410 - RNA, 16 nt, Human
cucuucaggccucccu

SEQ ID NO: 2050411 - RNA, 17 nt, Human
cucuucaacugaccagc

SEQ ID NO: 2050412 - RNA, 16 nt, Human
cucuucaacugaccag

SEQ ID NO: 2050413 - RNA, 20 nt, Human
cucuucaacugaccagccuc

SEQ ID NO: 2050414 - RNA, 15 nt, Human
cucuuauuuuacaau

SEQ ID NO: 2050415 - RNA, 14 nt, Human
cucuucaaucucuu

SEQ ID NO: 2050416 - RNA, 11 nt, Human
cucuucagaaa

SEQ ID NO: 2050417 - RNA, 13 nt, Human
cucuuauugccca

SEQ ID NO: 2050418 - RNA, 21 nt, Human
cucuguccagggcccugagcu

SEQ ID NO: 2050419 - RNA, 22 nt, Human
cucuguccagggcccugagcuc

SEQ ID NO: 2050420 - RNA, 20 nt, Human
cucuuauugcccacgcugga

SEQ ID NO: 2050421 - RNA, 19 nt, Human
cucuuauugcccacgcugg

SEQ ID NO: 2050422 - RNA, 15 nt, Human
cucuuauugcccacg

SEQ ID NO: 2050423 - RNA, 14 nt, Human
cucuuauugcccac

SEQ ID NO: 2050424 - RNA, 20 nt, Human
cucuggugacaccagccuuu

SEQ ID NO: 2050425 - RNA, 16 nt, Human
cucuggugacaccagc

SEQ ID NO: 2050426 - RNA, 18 nt, Human
cucuggugacaccagccu

SEQ ID NO: 2050427 - RNA, 19 nt, Human
cucuggugacaccagccuu

SEQ ID NO: 2050428 - RNA, 19 nt, Human
cucuggucuccucuuuguu

SEQ ID NO: 2050429 - RNA, 22 nt, Human
cucuggucuccucuuuguuuug

SEQ ID NO: 2050430 - RNA, 12 nt, Human
cucuguccaggc

SEQ ID NO: 2050431 - RNA, 13 nt, Human
cucugucagaugg

SEQ ID NO: 2050432 - RNA, 17 nt, Human
cucugguagacacagga

SEQ ID NO: 2050433 - RNA, 16 nt, Human
cucugucauaucuuca

SEQ ID NO: 2050434 - RNA, 14 nt, Human
cucuguccagggcc

SEQ ID NO: 2050435 - RNA, 20 nt, Human
cucuguccagggcccugagc

SEQ ID NO: 2050436 - RNA, 23 nt, Human
cucugucagaugggaagacauga

SEQ ID NO: 2050437 - RNA, 16 nt, Human
cucugcugacagacac

SEQ ID NO: 2050438 - RNA, 14 nt, Human
cucugcugacagac

SEQ ID NO: 2050439 - RNA, 13 nt, Human
cucugcugacaga

SEQ ID NO: 2050440 - RNA, 14 nt, Human
cucugcugaagguu

SEQ ID NO: 2050441 - RNA, 15 nt, Human
cucugguaaccucuu

SEQ ID NO: 2050442 - RNA, 20 nt, Human
cucugcuccucuccccagca

SEQ ID NO: 2050443 - RNA, 18 nt, Human
cucugcuccucuccccag

SEQ ID NO: 2050444 - RNA, 13 nt, Human
cucugcuccucuc

SEQ ID NO: 2050445 - RNA, 21 nt, Human
cucucaggcaugccuguguga

SEQ ID NO: 2050446 - RNA, 18 nt, Human
cucucaggcaugccugug

SEQ ID NO: 2050447 - RNA, 19 nt, Human
cucucaggcaugccugugu

SEQ ID NO: 2050448 - RNA, 20 nt, Human
cucucaggcaugccugugug

SEQ ID NO: 2050449 - RNA, 20 nt, Human
cucuccccucuuauguaccu

SEQ ID NO: 2050450 - RNA, 16 nt, Human
cucuccccuucucugu

SEQ ID NO: 2050451 - RNA, 15 nt, Human
cucuccccugcccug

SEQ ID NO: 2050452 - RNA, 16 nt, Human
cucuccccugcccugc

SEQ ID NO: 2050453 - RNA, 17 nt, Human
cucuccccugcccugcu

SEQ ID NO: 2050454 - RNA, 18 nt, Human
cucuccccugcccugcug

SEQ ID NO: 2050455 - RNA, 15 nt, Human
cugacaaaucaaguu

SEQ ID NO: 2050456 - RNA, 16 nt, Human
cugacaaaucaaguuu

SEQ ID NO: 2050457 - RNA, 23 nt, Human
cugacaaaucaaguuuccaagca

SEQ ID NO: 2050458 - RNA, 23 nt, Human
cugaaggacauugcggacagcca

SEQ ID NO: 2050459 - RNA, 18 nt, Human
cugaaggacccuucagag

SEQ ID NO: 2050460 - RNA, 12 nt, Human
cugaaggagaag

SEQ ID NO: 2050461 - RNA, 13 nt, Human
cugaagccugcag

SEQ ID NO: 2050462 - RNA, 15 nt, Human
cugaagccugcagga

SEQ ID NO: 2050463 - RNA, 12 nt, Human
cugaagccgcca

SEQ ID NO: 2050464 - RNA, 18 nt, Human
cugaagccgccaggaccg

SEQ ID NO: 2050465 - RNA, 13 nt, Human
cugaaacaggaga

SEQ ID NO: 2050466 - RNA, 15 nt, Human
cugaaacuaaugaaa

SEQ ID NO: 2050467 - RNA, 16 nt, Human
cugaaacuaaugaaag

SEQ ID NO: 2050468 - RNA, 14 nt, Human
cugaaacaggagag

SEQ ID NO: 2050469 - RNA, 17 nt, Human
cugaaacuuacacacaa

SEQ ID NO: 2050470 - RNA, 20 nt, Human
cugaaacuucaagcaccagg

SEQ ID NO: 2050471 - RNA, 14 nt, Human
cugaaagaaacagu

SEQ ID NO: 2050472 - RNA, 15 nt, Human
cugaaagaaacaguu

SEQ ID NO: 2050473 - RNA, 16 nt, Human
cugaaagaaacaguua

SEQ ID NO: 2050474 - RNA, 19 nt, Human
cugaaagaaacaguuaacu

SEQ ID NO: 2050475 - RNA, 20 nt, Human
cugaaagaaacaguuaacuu

SEQ ID NO: 2050476 - RNA, 21 nt, Human
cugaaagaaacaguuaacuuu

SEQ ID NO: 2050477 - RNA, 22 nt, Human
cucuuuuccuuugguccuucaa

SEQ ID NO: 2050478 - RNA, 14 nt, Human
cucuuuucugcauc

SEQ ID NO: 2050479 - RNA, 15 nt, Human
cucuuuucugcauca

SEQ ID NO: 2050480 - RNA, 23 nt, Human
cucuuuuccuacuuuuccuuccc

SEQ ID NO: 2050481 - RNA, 13 nt, Human
cucuuuucucuuu

SEQ ID NO: 2050482 - RNA, 20 nt, Human
cucuuuugaauccaugcuug

SEQ ID NO: 2050483 - RNA, 11 nt, Human
cucuuuuuaag

SEQ ID NO: 2050484 - RNA, 21 nt, Human
cucuuuuuccaucauaauucu

SEQ ID NO: 2050485 - RNA, 22 nt, Human
cugacaaccaccgcuccccagc

SEQ ID NO: 2050486 - RNA, 13 nt, Human
cugacaacuugaa

SEQ ID NO: 2050487 - RNA, 21 nt, Human
cugacaaccaccgcuccccag

SEQ ID NO: 2050488 - RNA, 20 nt, Human
cugacaaccaccgcucccca

SEQ ID NO: 2050489 - RNA, 12 nt, Human
cugaccugcagg

SEQ ID NO: 2050490 - RNA, 13 nt, Human
cugaccugcaggc

SEQ ID NO: 2050491 - RNA, 22 nt, Human
cugagaggacuuuucuuugugg

SEQ ID NO: 2050492 - RNA, 21 nt, Human
cugagaggacuuuucuuugug

SEQ ID NO: 2050493 - RNA, 19 nt, Human
cugagaguauuuaggcaga

SEQ ID NO: 2050494 - RNA, 20 nt, Human
cugagaguauuuaggcagau

SEQ ID NO: 2050495 - RNA, 13 nt, Human
cugagagaucugc

SEQ ID NO: 2050496 - RNA, 15 nt, Human
cugagagaucugcug

SEQ ID NO: 2050497 - RNA, 16 nt, Human
cugagagaucugcugu

SEQ ID NO: 2050498 - RNA, 14 nt, Human
cugagacugcggga

SEQ ID NO: 2050499 - RNA, 15 nt, Human
cugagagacccaagg

SEQ ID NO: 2050500 - RNA, 17 nt, Human
cugagagacccaaggag

SEQ ID NO: 2050501 - RNA, 19 nt, Human
cugagagacccaaggagga

SEQ ID NO: 2050502 - RNA, 20 nt, Human
cugagagacccaaggaggaa

SEQ ID NO: 2050503 - RNA, 20 nt, Human
cugaguagcuggauuacagg

SEQ ID NO: 2050504 - RNA, 21 nt, Human
cugaguaucuccucgcaagcu

SEQ ID NO: 2050505 - RNA, 22 nt, Human
cugaguaucuccucgcaagcug

SEQ ID NO: 2050506 - RNA, 13 nt, Human
cugaguaugugga

SEQ ID NO: 2050507 - RNA, 18 nt, Human
cugaguauguggaaggca

SEQ ID NO: 2050508 - RNA, 14 nt, Human
cugagucaccagga

SEQ ID NO: 2050509 - RNA, 15 nt, Human
cugagucaccaggaa

SEQ ID NO: 2050510 - RNA, 17 nt, Human
cugagucaccaggaaug

SEQ ID NO: 2050511 - RNA, 20 nt, Human
cugagucacccaugaagaca

SEQ ID NO: 2050512 - RNA, 19 nt, Human
cugaguagcuggauuacag

SEQ ID NO: 2050513 - RNA, 12 nt, Human
cugaggugggag

SEQ ID NO: 2050514 - RNA, 19 nt, Human
cugaggugaaagggagcua

SEQ ID NO: 2050515 - RNA, 17 nt, Human
cugaggugaaagggagc

SEQ ID NO: 2050516 - RNA, 16 nt, Human
cugaggucucuugagg

SEQ ID NO: 2050517 - RNA, 19 nt, Human
cugaggucucuugagggag

SEQ ID NO: 2050518 - RNA, 21 nt, Human
cugaggucucuugagggagcu

SEQ ID NO: 2050519 - RNA, 15 nt, Human
cugaggacugcacca

SEQ ID NO: 2050520 - RNA, 23 nt, Human
cugaggacugcaccauugcugcu

SEQ ID NO: 2050521 - RNA, 11 nt, Human
cugaggagaaa

SEQ ID NO: 2050522 - RNA, 14 nt, Human
cugaggagcagcag

SEQ ID NO: 2050523 - RNA, 14 nt, Human
cugaggaccagcca

SEQ ID NO: 2050524 - RNA, 22 nt, Human
cugaggacuuaaaauauuccug

SEQ ID NO: 2050525 - RNA, 14 nt, Human
cugaggaauccaga

SEQ ID NO: 2050526 - RNA, 16 nt, Human
cugaggaaaggccagc

SEQ ID NO: 2050527 - RNA, 17 nt, Human
cugaggaaaggccagcu

SEQ ID NO: 2050528 - RNA, 18 nt, Human
cugaggaaaggccagcug

SEQ ID NO: 2050529 - RNA, 19 nt, Human
cugaggaaaggccagcugg

SEQ ID NO: 2050530 - RNA, 20 nt, Human
cugaggaaaggccagcuggc

SEQ ID NO: 2050531 - RNA, 22 nt, Human
cugaggaaaggccagcuggcag

SEQ ID NO: 2050532 - RNA, 20 nt, Human
cugaggaauccagacccggc

SEQ ID NO: 2050533 - RNA, 17 nt, Human
cugaggaauccagaccc

SEQ ID NO: 2050534 - RNA, 20 nt, Human
cugaggacacuaaccacgcu

SEQ ID NO: 2050535 - RNA, 21 nt, Human
cugaggaauccagacccggcu

SEQ ID NO: 2050536 - RNA, 23 nt, Human
cugaggacacuaaccacgcugga

SEQ ID NO: 2050537 - RNA, 21 nt, Human
cugagaucaaaacgguuuuac

SEQ ID NO: 2050538 - RNA, 14 nt, Human
cugagaucgugccg

SEQ ID NO: 2050539 - RNA, 23 nt, Human
cugagauggaacccuuuuggccc

SEQ ID NO: 2050540 - RNA, 15 nt, Human
cugagauggcccucu

SEQ ID NO: 2050541 - RNA, 17 nt, Human
cugagauggcccucugg

SEQ ID NO: 2050542 - RNA, 18 nt, Human
cugagauggcccucuggu

SEQ ID NO: 2050543 - RNA, 14 nt, Human
cugagcuuucugcu

SEQ ID NO: 2050544 - RNA, 15 nt, Human
cugagcuuucugcua

SEQ ID NO: 2050545 - RNA, 21 nt, Human
cugagcuuuggacacacacag

SEQ ID NO: 2050546 - RNA, 22 nt, Human
cugagcuuuggacacacacagc

SEQ ID NO: 2050547 - RNA, 23 nt, Human
cugagcuuuggacacacacagcu

SEQ ID NO: 2050548 - RNA, 21 nt, Human
cugagcuuuggacgcacacag

SEQ ID NO: 2050549 - RNA, 22 nt, Human
cugagcuuuggacgcacacagc

SEQ ID NO: 2050550 - RNA, 23 nt, Human
cugagcuuuggacgcacacagcu

SEQ ID NO: 2050551 - RNA, 15 nt, Human
cugaggaaaggccag

SEQ ID NO: 2050552 - RNA, 18 nt, Human
cgugauuuugcuguagaa

SEQ ID NO: 2050553 - RNA, 17 nt, Human
cgugaugccucccuguu

SEQ ID NO: 2050554 - RNA, 23 nt, Human
cgugauguaggguaaggugccuu

SEQ ID NO: 2050555 - RNA, 18 nt, Human
cgugcaaaacaugcuacc

SEQ ID NO: 2050556 - RNA, 14 nt, Human
cgugcacacaccag

SEQ ID NO: 2050557 - RNA, 13 nt, Human
cgugaucuuggcu

SEQ ID NO: 2050558 - RNA, 22 nt, Human
cguggugauuuagcaggaagcu

SEQ ID NO: 2050559 - RNA, 20 nt, Human
cguguaaccauggacccaau

SEQ ID NO: 2050560 - RNA, 21 nt, Human
cgguuuggggagcagagacac

SEQ ID NO: 2050561 - RNA, 16 nt, Human
cgguuuuacugcagcu

SEQ ID NO: 2050562 - RNA, 17 nt, Human
cgggccacagagaaagu

SEQ ID NO: 2050563 - RNA, 21 nt, Human
cgggcaugguggcgcaagccu

SEQ ID NO: 2050564 - RNA, 12 nt, Human
cgggccaaggac

SEQ ID NO: 2050565 - RNA, 14 nt, Human
cgggccaaggacug

SEQ ID NO: 2050566 - RNA, 20 nt, Human
cgggccaaggacugccgacc

SEQ ID NO: 2050567 - RNA, 11 nt, Human
cgggcucagca

SEQ ID NO: 2050568 - RNA, 19 nt, Human
cgggcgagucacugccucu

SEQ ID NO: 2050569 - RNA, 17 nt, Human
cgggcgagucacugccu

SEQ ID NO: 2050570 - RNA, 15 nt, Human
cgggcucagcaaaag

SEQ ID NO: 2050571 - RNA, 13 nt, Human
cgguguggagaag

SEQ ID NO: 2050572 - RNA, 15 nt, Human
cggggacagcuccuu

SEQ ID NO: 2050573 - RNA, 18 nt, Human
cgguguggagaagcggcu

SEQ ID NO: 2050574 - RNA, 16 nt, Human
cggugugggcuguguc

SEQ ID NO: 2050575 - RNA, 14 nt, Human
cgggcugcccugcc

SEQ ID NO: 2050576 - RNA, 14 nt, Human
cggggacagcuccu

SEQ ID NO: 2050577 - RNA, 14 nt, Human
cgggccacagagaa

SEQ ID NO: 2050578 - RNA, 12 nt, Human
cgggccacagag

SEQ ID NO: 2050579 - RNA, 16 nt, Human
cggcuccaggcuccuu

SEQ ID NO: 2050580 - RNA, 15 nt, Human
cggcuccaggcuccu

SEQ ID NO: 2050581 - RNA, 14 nt, Human
cggcuccaggcucc

SEQ ID NO: 2050582 - RNA, 13 nt, Human
cggcuccaggcuc

SEQ ID NO: 2050583 - RNA, 12 nt, Human
cggcuccaggcu

SEQ ID NO: 2050584 - RNA, 17 nt, Human
cggcucacugcagccuc

SEQ ID NO: 2050585 - RNA, 16 nt, Human
cggcucacugcagccu

SEQ ID NO: 2050586 - RNA, 14 nt, Human
cggcucacugcagc

SEQ ID NO: 2050587 - RNA, 15 nt, Human
cggcucacugcagcc

SEQ ID NO: 2050588 - RNA, 20 nt, Human
cggagucccaccuuggcugc

SEQ ID NO: 2050589 - RNA, 18 nt, Human
cggagucccaccuuggcu

SEQ ID NO: 2050590 - RNA, 20 nt, Human
cggagcuaacacuggccccu

SEQ ID NO: 2050591 - RNA, 11 nt, Human
cggaggagaag

SEQ ID NO: 2050592 - RNA, 19 nt, Human
cggaggagaagaaggaaau

SEQ ID NO: 2050593 - RNA, 12 nt, Human
cggaggcaaaag

SEQ ID NO: 2050594 - RNA, 21 nt, Human
cggaggcaaaaggcagugggg

SEQ ID NO: 2050595 - RNA, 16 nt, Human
cggagucccaccuugg

SEQ ID NO: 2050596 - RNA, 21 nt, Human
cggagcuaacacuggccccua

SEQ ID NO: 2050597 - RNA, 19 nt, Human
cgcugcaaccuguugauag

SEQ ID NO: 2050598 - RNA, 13 nt, Human
cgcugauauaugu

SEQ ID NO: 2050599 - RNA, 16 nt, Human
cgccuguaaucccagc

SEQ ID NO: 2050600 - RNA, 17 nt, Human
cgccuguaaucccagca

SEQ ID NO: 2050601 - RNA, 20 nt, Human
cgccuguaaucccagcacuu

SEQ ID NO: 2050602 - RNA, 18 nt, Human
cgccuguaaucccagcac

SEQ ID NO: 2050603 - RNA, 18 nt, Human
cgccuguaaucccagcag

SEQ ID NO: 2050604 - RNA, 20 nt, Human
cgccuguaaucccagcuacu

SEQ ID NO: 2050605 - RNA, 17 nt, Human
cgacugccaucuuggac

SEQ ID NO: 2050606 - RNA, 17 nt, Human
cgacugcccggcagggu

SEQ ID NO: 2050607 - RNA, 22 nt, Human
cgacggugggcauuugugaggc

SEQ ID NO: 2050608 - RNA, 20 nt, Human
cgaccgaggcuggagcuggc

SEQ ID NO: 2050609 - RNA, 19 nt, Human
cgaccgaggcuggagcugg

SEQ ID NO: 2050610 - RNA, 15 nt, Human
cgaccgaggcuggag

SEQ ID NO: 2050611 - RNA, 20 nt, Human
cgacucuauagacucuagga

SEQ ID NO: 2050612 - RNA, 18 nt, Human
cgacucuauagacucuag

SEQ ID NO: 2050613 - RNA, 14 nt, Human
cgacagccuggcac

SEQ ID NO: 2050614 - RNA, 22 nt, Human
cgacagagggaagaaaagagcu

SEQ ID NO: 2050615 - RNA, 13 nt, Human
cgacagccuggca

SEQ ID NO: 2050616 - RNA, 12 nt, Human
cgacagccuggc

SEQ ID NO: 2050617 - RNA, 16 nt, Human
cgacagagcgagacuu

SEQ ID NO: 2050618 - RNA, 18 nt, Human
cgacaaccgaugcuccag

SEQ ID NO: 2050619 - RNA, 21 nt, Human
cgacaaccgaugcuccagcca

SEQ ID NO: 2050620 - RNA, 15 nt, Human
cgacaaccgaugcuc

SEQ ID NO: 2050621 - RNA, 13 nt, Human
cgacaaagcugcu

SEQ ID NO: 2050622 - RNA, 17 nt, Human
cgacaaagcugcuaaau

SEQ ID NO: 2050623 - RNA, 21 nt, Human
cgacaaagcugcuaaaucucc

SEQ ID NO: 2050624 - RNA, 15 nt, Human
ccuuuuuacuccccu

SEQ ID NO: 2050625 - RNA, 23 nt, Human
ccuuuuuacuccccuugagcuga

SEQ ID NO: 2050626 - RNA, 17 nt, Human
ccuuucauccccaccuu

SEQ ID NO: 2050627 - RNA, 12 nt, Human
ccuuucagggaa

SEQ ID NO: 2050628 - RNA, 20 nt, Human
ccuuucagggaauuucagga

SEQ ID NO: 2050629 - RNA, 14 nt, Human
ccuuuuuacucccc

SEQ ID NO: 2050630 - RNA, 22 nt, Human
ccuuuugagggacaaauuuaaa

SEQ ID NO: 2050631 - RNA, 15 nt, Human
ccuuucacaaccuuc

SEQ ID NO: 2050632 - RNA, 21 nt, Human
ccuuucacagagcagagucug

SEQ ID NO: 2050633 - RNA, 21 nt, Human
ccuuucacaaaauuuuauucc

SEQ ID NO: 2050634 - RNA, 22 nt, Human
ccuuucacaaaauuuuauuccu

SEQ ID NO: 2050635 - RNA, 16 nt, Human
ccuuuacccucaucug

SEQ ID NO: 2050636 - RNA, 18 nt, Human
ccuuuacccucaucuguc

SEQ ID NO: 2050637 - RNA, 16 nt, Human
ccuugcuguccuaggc

SEQ ID NO: 2050638 - RNA, 22 nt, Human
ccuugcucuccccugcccugcu

SEQ ID NO: 2050639 - RNA, 22 nt, Human
ccuugcccagggcucagccugg

SEQ ID NO: 2050640 - RNA, 18 nt, Human
ccuugcccggauucuggg

SEQ ID NO: 2050641 - RNA, 19 nt, Human
ccuugcccggauucuggga

SEQ ID NO: 2050642 - RNA, 21 nt, Human
ccuugcccagggcucagccug

SEQ ID NO: 2050643 - RNA, 22 nt, Human
cgcaggauucuuccucccuccc

SEQ ID NO: 2050644 - RNA, 13 nt, Human
cgcaggaagcugc

SEQ ID NO: 2050645 - RNA, 15 nt, Human
cgcaggaagcugcuc

SEQ ID NO: 2050646 - RNA, 19 nt, Human
cgaucauggcucacugcag

SEQ ID NO: 2050647 - RNA, 20 nt, Human
cgaucauggcucacugcagc

SEQ ID NO: 2050648 - RNA, 21 nt, Human
cgaucauggcucacugcagcc

SEQ ID NO: 2050649 - RNA, 23 nt, Human
cgaucauggcucacugcagccuc

SEQ ID NO: 2050650 - RNA, 15 nt, Human
cgauccaccugucuc

SEQ ID NO: 2050651 - RNA, 16 nt, Human
cgcaugcagcagcuug

SEQ ID NO: 2050652 - RNA, 15 nt, Human
cgcaugcccucaauc

SEQ ID NO: 2050653 - RNA, 18 nt, Human
cgcauggaguguguauug

SEQ ID NO: 2050654 - RNA, 22 nt, Human
cgcauggaguguguauuguucc

SEQ ID NO: 2050655 - RNA, 16 nt, Human
cgcaugcggcccagga

SEQ ID NO: 2050656 - RNA, 14 nt, Human
cgcaugcggcccag

SEQ ID NO: 2050657 - RNA, 14 nt, Human
cgcauuccaggcuc

SEQ ID NO: 2050658 - RNA, 15 nt, Human
cgcauuccaggcucc

SEQ ID NO: 2050659 - RNA, 12 nt, Human
cgcauucccuga

SEQ ID NO: 2050660 - RNA, 23 nt, Human
cgcauggaguguguauuguuccc

SEQ ID NO: 2050661 - RNA, 13 nt, Human
cgcauucccugag

SEQ ID NO: 2050662 - RNA, 22 nt, Human
cgagucacugccucucccuggc

SEQ ID NO: 2050663 - RNA, 15 nt, Human
cgagucacugccucu

SEQ ID NO: 2050664 - RNA, 18 nt, Human
cgagucacugccucuccc

SEQ ID NO: 2050665 - RNA, 16 nt, Human
cgagucaauccccuca

SEQ ID NO: 2050666 - RNA, 20 nt, Human
cgagucaauccccucauuca

SEQ ID NO: 2050667 - RNA, 12 nt, Human
cgagucacugcc

SEQ ID NO: 2050668 - RNA, 14 nt, Human
cgagucacugccuc

SEQ ID NO: 2050669 - RNA, 16 nt, Human
cgccuaugaucccagc

SEQ ID NO: 2050670 - RNA, 17 nt, Human
cgccucaaugugguugc

SEQ ID NO: 2050671 - RNA, 22 nt, Human
cgccucaaugugguugcaaggc

SEQ ID NO: 2050672 - RNA, 23 nt, Human
cgccagaacugcuuuaucccacg

SEQ ID NO: 2050673 - RNA, 20 nt, Human
cgccuaguggggucucccuc

SEQ ID NO: 2050674 - RNA, 21 nt, Human
cgccuaguggggucucccucu

SEQ ID NO: 2050675 - RNA, 22 nt, Human
cgccacuacacuccagccugag

SEQ ID NO: 2050676 - RNA, 15 nt, Human
cgccacucgcuuccc

SEQ ID NO: 2050677 - RNA, 18 nt, Human
cgccaaagaaugccuuga

SEQ ID NO: 2050678 - RNA, 21 nt, Human
cgccacugcacucuagccgga

SEQ ID NO: 2050679 - RNA, 23 nt, Human
cgccacucgcuucccccauagcc

SEQ ID NO: 2050680 - RNA, 13 nt, Human
cgccacugcacuc

SEQ ID NO: 2050681 - RNA, 21 nt, Human
cgccacugcacuccagccugg

SEQ ID NO: 2050682 - RNA, 22 nt, Human
cgccacugcacuccagccuggg

SEQ ID NO: 2050683 - RNA, 23 nt, Human
cgccacugcacuccagccugggc

SEQ ID NO: 2050684 - RNA, 13 nt, Human
cgccucugcauuc

SEQ ID NO: 2050685 - RNA, 13 nt, Human
cgccucugcuggc

SEQ ID NO: 2050686 - RNA, 19 nt, Human
cgccucuucuucuucagaa

SEQ ID NO: 2050687 - RNA, 11 nt, Human
cgccuggcaga

SEQ ID NO: 2050688 - RNA, 20 nt, Human
cgccuggcagaacugagcuc

SEQ ID NO: 2050689 - RNA, 17 nt, Human
cgccugcuugucccugc

SEQ ID NO: 2050690 - RNA, 13 nt, Human
cuacaguguacag

SEQ ID NO: 2050691 - RNA, 22 nt, Human
cuacaguugaaaaacagcugag

SEQ ID NO: 2050692 - RNA, 20 nt, Human
cuacaguuguuuuuugaaaa

SEQ ID NO: 2050693 - RNA, 22 nt, Human
cuacaguuguuuuuugaaaaca

SEQ ID NO: 2050694 - RNA, 19 nt, Human
cuacaguugaaaaacagcu

SEQ ID NO: 2050695 - RNA, 21 nt, Human
cuacaguugaaaaacagcuga

SEQ ID NO: 2050696 - RNA, 21 nt, Human
cuaauuuaucuugucucuggg

SEQ ID NO: 2050697 - RNA, 14 nt, Human
cuacucacucaagu

SEQ ID NO: 2050698 - RNA, 15 nt, Human
cuacucacucaaguu

SEQ ID NO: 2050699 - RNA, 16 nt, Human
cuacucacucaaguuc

SEQ ID NO: 2050700 - RNA, 22 nt, Human
cuacucacucaaguucaaggac

SEQ ID NO: 2050701 - RNA, 13 nt, Human
cuacucagaagcc

SEQ ID NO: 2050702 - RNA, 16 nt, Human
cuacucagaagccuga

SEQ ID NO: 2050703 - RNA, 17 nt, Human
cuacucagaagccugag

SEQ ID NO: 2050704 - RNA, 19 nt, Human
cuacucagaagccugaggc

SEQ ID NO: 2050705 - RNA, 21 nt, Human
cuacucagaagccugaggcug

SEQ ID NO: 2050706 - RNA, 17 nt, Human
cuacguuaccaggcagg

SEQ ID NO: 2050707 - RNA, 21 nt, Human
cuacgcucuccuuucuuucua

SEQ ID NO: 2050708 - RNA, 13 nt, Human
cuaccuuuucucu

SEQ ID NO: 2050709 - RNA, 14 nt, Human
cuaccuuuucucuu

SEQ ID NO: 2050710 - RNA, 14 nt, Human
cuacgcucuccuuu

SEQ ID NO: 2050711 - RNA, 14 nt, Human
cuaccuguaacuuu

SEQ ID NO: 2050712 - RNA, 15 nt, Human
cuacaucgcccucca

SEQ ID NO: 2050713 - RNA, 17 nt, Human
cuacaucgcccuccaca

SEQ ID NO: 2050714 - RNA, 22 nt, Human
cuacaugcaaggcacuguacua

SEQ ID NO: 2050715 - RNA, 14 nt, Human
cuacaugcagccca

SEQ ID NO: 2050716 - RNA, 15 nt, Human
cuacaugcagcccau

SEQ ID NO: 2050717 - RNA, 17 nt, Human
cuacaugcagcccaugc

SEQ ID NO: 2050718 - RNA, 21 nt, Human
cuacaugcagcccaugcccac

SEQ ID NO: 2050719 - RNA, 23 nt, Human
cuacaugcagcccaugcccaccu

SEQ ID NO: 2050720 - RNA, 16 nt, Human
cguguguguugucuga

SEQ ID NO: 2050721 - RNA, 20 nt, Human
cguguggcucacguguguga

SEQ ID NO: 2050722 - RNA, 20 nt, Human
cgugugugugcguccugucg

SEQ ID NO: 2050723 - RNA, 17 nt, Human
cguguguccaugugugu

SEQ ID NO: 2050724 - RNA, 22 nt, Human
cgugugugcaagugucugugug

SEQ ID NO: 2050725 - RNA, 23 nt, Human
cuaagugauccucccaccucagc

SEQ ID NO: 2050726 - RNA, 17 nt, Human
cuaaguguuucauaaau

SEQ ID NO: 2050727 - RNA, 21 nt, Human
cuaagugguacuaacuuuccu

SEQ ID NO: 2050728 - RNA, 18 nt, Human
cuaauucuaaccagagca

SEQ ID NO: 2050729 - RNA, 24 nt, Human
cuaauucuaaccagagcaagcuuu

SEQ ID NO: 2050730 - RNA, 13 nt, Human
cuaauugccaugu

SEQ ID NO: 2050731 - RNA, 19 nt, Human
cuagaauuuuaagugcuuu

SEQ ID NO: 2050732 - RNA, 13 nt, Human
cuagacaacccug

SEQ ID NO: 2050733 - RNA, 15 nt, Human
cuagacaacccugca

SEQ ID NO: 2050734 - RNA, 16 nt, Human
cuagacaacccugcaa

SEQ ID NO: 2050735 - RNA, 17 nt, Human
cuagaauuucauuuauu

SEQ ID NO: 2050736 - RNA, 15 nt, Human
cuagaauuuauucaa

SEQ ID NO: 2050737 - RNA, 23 nt, Human
cuagaauuuauucaauuccucug

SEQ ID NO: 2050738 - RNA, 22 nt, Human
cuagaauuuauucaauuccucu

SEQ ID NO: 2050739 - RNA, 19 nt, Human
cuagaagugggccaggaca

SEQ ID NO: 2050740 - RNA, 20 nt, Human
cuagaagugggccaggacag

SEQ ID NO: 2050741 - RNA, 21 nt, Human
cuagaagugggccaggacagg

SEQ ID NO: 2050742 - RNA, 17 nt, Human
cuagaagugggccagga

SEQ ID NO: 2050743 - RNA, 13 nt, Human
cuagaagggaagg

SEQ ID NO: 2050744 - RNA, 20 nt, Human
cuagaagggccaguccugcc

SEQ ID NO: 2050745 - RNA, 23 nt, Human
cuagaagggccaguccugccugg

SEQ ID NO: 2050746 - RNA, 22 nt, Human
cuagaagauuuugaaauuuuua

SEQ ID NO: 2050747 - RNA, 18 nt, Human
cuagaacaucccugccag

SEQ ID NO: 2050748 - RNA, 20 nt, Human
cuacucaggaggcugaggca

SEQ ID NO: 2050749 - RNA, 23 nt, Human
cuacucaggaggcugaggcagaa

SEQ ID NO: 2050750 - RNA, 13 nt, Human
cuacucaggaggc

SEQ ID NO: 2050751 - RNA, 15 nt, Human
cuacucaggaggcug

SEQ ID NO: 2050752 - RNA, 16 nt, Human
cuacucaggaggcuga

SEQ ID NO: 2050753 - RNA, 15 nt, Human
cuacucagcagcccu

SEQ ID NO: 2050754 - RNA, 16 nt, Human
cuacucagcagcccuc

SEQ ID NO: 2050755 - RNA, 17 nt, Human
cuacucagcagcccucc

SEQ ID NO: 2050756 - RNA, 18 nt, Human
cuacucagcagcccuccu

SEQ ID NO: 2050757 - RNA, 19 nt, Human
cuacucagcagcccuccuc

SEQ ID NO: 2050758 - RNA, 20 nt, Human
cuacucagcagcccuccuca

SEQ ID NO: 2050759 - RNA, 21 nt, Human
cuacucagcagcccuccucac

SEQ ID NO: 2050760 - RNA, 22 nt, Human
cuacucagcagcccuccucacc

SEQ ID NO: 2050761 - RNA, 14 nt, Human
cucaaacuccugac

SEQ ID NO: 2050762 - RNA, 13 nt, Human
cucaaacuccuga

SEQ ID NO: 2050763 - RNA, 20 nt, Human
cucaaacucuugaccucagg

SEQ ID NO: 2050764 - RNA, 18 nt, Human
cucaaaccuccaaaagcc

SEQ ID NO: 2050765 - RNA, 20 nt, Human
cucaaaccuccaaaagcccu

SEQ ID NO: 2050766 - RNA, 11 nt, Human
cucaauauuuu

SEQ ID NO: 2050767 - RNA, 18 nt, Human
cucaauauuccugaauga

SEQ ID NO: 2050768 - RNA, 16 nt, Human
cucaauauuccugaau

SEQ ID NO: 2050769 - RNA, 13 nt, Human
cucaauuguuuuu

SEQ ID NO: 2050770 - RNA, 15 nt, Human
cucaauuguuuuugu

SEQ ID NO: 2050771 - RNA, 15 nt, Human
cucaaugcacugaca

SEQ ID NO: 2050772 - RNA, 13 nt, Human
cucaaugcacuga

SEQ ID NO: 2050773 - RNA, 13 nt, Human
cucaauauuuucc

SEQ ID NO: 2050774 - RNA, 16 nt, Human
cuauuaagcaguaaaa

SEQ ID NO: 2050775 - RNA, 20 nt, Human
cuauuaagcaguaaaaacug

SEQ ID NO: 2050776 - RNA, 21 nt, Human
cuauuaagcaguaaaaacugu

SEQ ID NO: 2050777 - RNA, 22 nt, Human
cuauuaagcaguaaaaacuguu

SEQ ID NO: 2050778 - RNA, 12 nt, Human
cuauuuuuguag

SEQ ID NO: 2050779 - RNA, 13 nt, Human
cuauuuuuguaga

SEQ ID NO: 2050780 - RNA, 14 nt, Human
cuauuuuuguagaa

SEQ ID NO: 2050781 - RNA, 15 nt, Human
cuauuuuuguagaag

SEQ ID NO: 2050782 - RNA, 18 nt, Human
cucaaaagcugggcaggu

SEQ ID NO: 2050783 - RNA, 17 nt, Human
cucaaaaaaagaaaaag

SEQ ID NO: 2050784 - RNA, 17 nt, Human
cuauuuuuuuaaaauca

SEQ ID NO: 2050785 - RNA, 19 nt, Human
cuauuuuuuuaaaaucacu

SEQ ID NO: 2050786 - RNA, 20 nt, Human
cuauuuuuuuaaaaucacua

SEQ ID NO: 2050787 - RNA, 21 nt, Human
cuauuuuuuuaaaaucacuaa

SEQ ID NO: 2050788 - RNA, 14 nt, Human
cucaaacacagaga

SEQ ID NO: 2050789 - RNA, 16 nt, Human
cucaaaaugacagcca

SEQ ID NO: 2050790 - RNA, 20 nt, Human
cucaaaagcacccuugacgu

SEQ ID NO: 2050791 - RNA, 18 nt, Human
cuaucaugucaaacguga

SEQ ID NO: 2050792 - RNA, 14 nt, Human
cuaucuaaauguug

SEQ ID NO: 2050793 - RNA, 20 nt, Human
cuaucuagguggaguugaaa

SEQ ID NO: 2050794 - RNA, 22 nt, Human
cuaucuagguggaguugaaaga

SEQ ID NO: 2050795 - RNA, 16 nt, Human
cuagcaugaagacaga

SEQ ID NO: 2050796 - RNA, 16 nt, Human
cuagcaucucaugagu

SEQ ID NO: 2050797 - RNA, 23 nt, Human
ccgcaggauuugggcucuuggaa

SEQ ID NO: 2050798 - RNA, 12 nt, Human
ccgcaggaagcu

SEQ ID NO: 2050799 - RNA, 13 nt, Human
ccgcaggaagcug

SEQ ID NO: 2050800 - RNA, 14 nt, Human
ccgcaggaagcugc

SEQ ID NO: 2050801 - RNA, 15 nt, Human
ccgcaggaagcugcu

SEQ ID NO: 2050802 - RNA, 19 nt, Human
ccgcaggaagcugcuccgu

SEQ ID NO: 2050803 - RNA, 17 nt, Human
ccgcaguuccugucccu

SEQ ID NO: 2050804 - RNA, 12 nt, Human
ccgcaucuucuc

SEQ ID NO: 2050805 - RNA, 15 nt, Human
ccgcaucuucuccau

SEQ ID NO: 2050806 - RNA, 16 nt, Human
ccgcaucuucuccauc

SEQ ID NO: 2050807 - RNA, 19 nt, Human
ccgcaucuucuccaucugg

SEQ ID NO: 2050808 - RNA, 20 nt, Human
ccgcaucuucuccaucuggc

SEQ ID NO: 2050809 - RNA, 22 nt, Human
ccgcaucuucuccaucuggcag

SEQ ID NO: 2050810 - RNA, 14 nt, Human
ccgcaugcagcagc

SEQ ID NO: 2050811 - RNA, 20 nt, Human
ccgcaugcagcagcuugcug

SEQ ID NO: 2050812 - RNA, 17 nt, Human
ccgcaugcggcccagga

SEQ ID NO: 2050813 - RNA, 16 nt, Human
ccgcaugcggcccagg

SEQ ID NO: 2050814 - RNA, 14 nt, Human
ccgcauucccugag

SEQ ID NO: 2050815 - RNA, 14 nt, Human
ccgcauuccaggcu

SEQ ID NO: 2050816 - RNA, 15 nt, Human
ccgcauuccaggcuc

SEQ ID NO: 2050817 - RNA, 16 nt, Human
ccgcauuccaggcucc

SEQ ID NO: 2050818 - RNA, 13 nt, Human
ccgcauucccuga

SEQ ID NO: 2050819 - RNA, 15 nt, Human
cccuucgcuccugug

SEQ ID NO: 2050820 - RNA, 14 nt, Human
cccuucgcuccugu

SEQ ID NO: 2050821 - RNA, 23 nt, Human
cccugucuaggucaguacccacc

SEQ ID NO: 2050822 - RNA, 17 nt, Human
cccuucgcguauuucag

SEQ ID NO: 2050823 - RNA, 18 nt, Human
cccuucucugcccauucc

SEQ ID NO: 2050824 - RNA, 19 nt, Human
cccuucucugcccauuccc

SEQ ID NO: 2050825 - RNA, 13 nt, Human
cccuucucugcuc

SEQ ID NO: 2050826 - RNA, 14 nt, Human
cccuucucugcucc

SEQ ID NO: 2050827 - RNA, 15 nt, Human
cccuucucugcucca

SEQ ID NO: 2050828 - RNA, 16 nt, Human
cccuucucugcuccac

SEQ ID NO: 2050829 - RNA, 17 nt, Human
cccuucucugcuccacc

SEQ ID NO: 2050830 - RNA, 20 nt, Human
cccuucucugcuccaccaca

SEQ ID NO: 2050831 - RNA, 23 nt, Human
cccuucucugcuccaccacaucc

SEQ ID NO: 2050832 - RNA, 14 nt, Human
ccgcagccucccuc

SEQ ID NO: 2050833 - RNA, 13 nt, Human
ccggccccugcug

SEQ ID NO: 2050834 - RNA, 13 nt, Human
cccuucgcuccug

SEQ ID NO: 2050835 - RNA, 19 nt, Human
cccugucuccucucucugu

SEQ ID NO: 2050836 - RNA, 20 nt, Human
cccugucucaaaaaaagaaa

SEQ ID NO: 2050837 - RNA, 23 nt, Human
cccugucucaaaaaaagaaaaag

SEQ ID NO: 2050838 - RNA, 17 nt, Human
ccucccaccucagccuc

SEQ ID NO: 2050839 - RNA, 15 nt, Human
ccucccaccucagcc

SEQ ID NO: 2050840 - RNA, 12 nt, Human
ccucccaccccc

SEQ ID NO: 2050841 - RNA, 13 nt, Human
ccucccaccccca

SEQ ID NO: 2050842 - RNA, 17 nt, Human
ccucccacccccaucuc

SEQ ID NO: 2050843 - RNA, 13 nt, Human
ccucccacccccu

SEQ ID NO: 2050844 - RNA, 23 nt, Human
ccucauuuuugaauacaggcaua

SEQ ID NO: 2050845 - RNA, 19 nt, Human
ccucaugguggguucaggg

SEQ ID NO: 2050846 - RNA, 16 nt, Human
ccuccccaacccugcc

SEQ ID NO: 2050847 - RNA, 21 nt, Human
ccuccccaacccugccccugc

SEQ ID NO: 2050848 - RNA, 20 nt, Human
ccucccacccccuucucugc

SEQ ID NO: 2050849 - RNA, 21 nt, Human
ccucccacccccuucucugcu

SEQ ID NO: 2050850 - RNA, 16 nt, Human
ccucaaaagcacccuu

SEQ ID NO: 2050851 - RNA, 15 nt, Human
ccucaaagcuuccau

SEQ ID NO: 2050852 - RNA, 18 nt, Human
ccucaaagcuuccauucc

SEQ ID NO: 2050853 - RNA, 20 nt, Human
ccucaaagcuuccauuccac

SEQ ID NO: 2050854 - RNA, 11 nt, Human
ccucagccugu

SEQ ID NO: 2050855 - RNA, 12 nt, Human
ccucagccugug

SEQ ID NO: 2050856 - RNA, 22 nt, Human
ccucagccuuccccuugcccag

SEQ ID NO: 2050857 - RNA, 16 nt, Human
ccucagccugugcugc

SEQ ID NO: 2050858 - RNA, 13 nt, Human
ccucaggacccuc

SEQ ID NO: 2050859 - RNA, 15 nt, Human
ccucaggacccucgc

SEQ ID NO: 2050860 - RNA, 16 nt, Human
ccucaggacccucgcu

SEQ ID NO: 2050861 - RNA, 17 nt, Human
ccucaggacccucgcug

SEQ ID NO: 2050862 - RNA, 18 nt, Human
ccucaggacccucgcugg

SEQ ID NO: 2050863 - RNA, 19 nt, Human
ccucaggacccucgcuggc

SEQ ID NO: 2050864 - RNA, 21 nt, Human
ccucaggacccucgcuggccc

SEQ ID NO: 2050865 - RNA, 22 nt, Human
ccucaggacccucgcuggcccc

SEQ ID NO: 2050866 - RNA, 23 nt, Human
ccucaggacccucgcuggccccc

SEQ ID NO: 2050867 - RNA, 20 nt, Human
ccucagcugccucacuuccu

SEQ ID NO: 2050868 - RNA, 19 nt, Human
ccucagcugccucacuucc

SEQ ID NO: 2050869 - RNA, 14 nt, Human
ccggccccugcugg

SEQ ID NO: 2050870 - RNA, 19 nt, Human
ccugccucgaacuggcugc

SEQ ID NO: 2050871 - RNA, 23 nt, Human
ccugccucgaacuggcugcaaag

SEQ ID NO: 2050872 - RNA, 21 nt, Human
ccugccucgaacuggcugcaa

SEQ ID NO: 2050873 - RNA, 23 nt, Human
ccugcugccgccucccagccugg

SEQ ID NO: 2050874 - RNA, 13 nt, Human
ccugcugccuccc

SEQ ID NO: 2050875 - RNA, 15 nt, Human
ccugcugccucccca

SEQ ID NO: 2050876 - RNA, 16 nt, Human
ccugcugccuccccaa

SEQ ID NO: 2050877 - RNA, 17 nt, Human
ccugcugccuccccaac

SEQ ID NO: 2050878 - RNA, 21 nt, Human
ccugcugccuccccaacccug

SEQ ID NO: 2050879 - RNA, 19 nt, Human
ccugcugccuccccaaccc

SEQ ID NO: 2050880 - RNA, 20 nt, Human
ccugcugccuccccaacccu

SEQ ID NO: 2050881 - RNA, 23 nt, Human
ccugcugccuccccaacccugcc

SEQ ID NO: 2050882 - RNA, 17 nt, Human
ccugccccagggcuccc

SEQ ID NO: 2050883 - RNA, 13 nt, Human
ccugccccauccc

SEQ ID NO: 2050884 - RNA, 15 nt, Human
ccugcccccacaccu

SEQ ID NO: 2050885 - RNA, 16 nt, Human
ccugcccccacaccug

SEQ ID NO: 2050886 - RNA, 18 nt, Human
ccugcccccacaccuggc

SEQ ID NO: 2050887 - RNA, 19 nt, Human
ccugcccccacaccuggcc

SEQ ID NO: 2050888 - RNA, 20 nt, Human
ccugcccccacaccuggccc

SEQ ID NO: 2050889 - RNA, 21 nt, Human
ccugcccccacaccuggcccu

SEQ ID NO: 2050890 - RNA, 22 nt, Human
ccugcccccacaccuggcccug

SEQ ID NO: 2050891 - RNA, 18 nt, Human
ccugcccagaucccagaa

SEQ ID NO: 2050892 - RNA, 12 nt, Human
ccugcccaggag

SEQ ID NO: 2050893 - RNA, 20 nt, Human
ccugcccaggagagccagcc

SEQ ID NO: 2050894 - RNA, 22 nt, Human
ccugcccaggagagccagcccu

SEQ ID NO: 2050895 - RNA, 23 nt, Human
ccugcccaggagagccagcccuc

SEQ ID NO: 2050896 - RNA, 14 nt, Human
ccugcccaccuguc

SEQ ID NO: 2050897 - RNA, 22 nt, Human
ccugcccacccguggagauggg

SEQ ID NO: 2050898 - RNA, 13 nt, Human
ccugcccaccugu

SEQ ID NO: 2050899 - RNA, 13 nt, Human
ccugcccaggccc

SEQ ID NO: 2050900 - RNA, 12 nt, Human
ccugcccacccg

SEQ ID NO: 2050901 - RNA, 13 nt, Human
ccugcccacccgu

SEQ ID NO: 2050902 - RNA, 19 nt, Human
ccugcacuugcagacucua

SEQ ID NO: 2050903 - RNA, 18 nt, Human
ccugcacuugcagacucu

SEQ ID NO: 2050904 - RNA, 19 nt, Human
ccugcagaggggaaaccag

SEQ ID NO: 2050905 - RNA, 17 nt, Human
ccugcacuugcagacuc

SEQ ID NO: 2050906 - RNA, 16 nt, Human
ccugcacuugcagacu

SEQ ID NO: 2050907 - RNA, 15 nt, Human
ccugagucaccagga

SEQ ID NO: 2050908 - RNA, 13 nt, Human
ccugagucaccag

SEQ ID NO: 2050909 - RNA, 14 nt, Human
ccugagucaccagg

SEQ ID NO: 2050910 - RNA, 15 nt, Human
ccugagucacccaug

SEQ ID NO: 2050911 - RNA, 18 nt, Human
ccugagucacccaugaag

SEQ ID NO: 2050912 - RNA, 13 nt, Human
ccucuuucccucc

SEQ ID NO: 2050913 - RNA, 20 nt, Human
ccugaccacgcuuucuagcu

SEQ ID NO: 2050914 - RNA, 19 nt, Human
ccugaccaacauggagaaa

SEQ ID NO: 2050915 - RNA, 22 nt, Human
ccugcagccccgcgccuccuuc

SEQ ID NO: 2050916 - RNA, 14 nt, Human
ccugcagcagagcc

SEQ ID NO: 2050917 - RNA, 15 nt, Human
ccugcagcagagccu

SEQ ID NO: 2050918 - RNA, 21 nt, Human
ccugcagcagagccuggaaga

SEQ ID NO: 2050919 - RNA, 11 nt, Human
ccucuuucccu

SEQ ID NO: 2050920 - RNA, 16 nt, Human
ccucuuucagaaaaca

SEQ ID NO: 2050921 - RNA, 17 nt, Human
ccucuuucagaaaacag

SEQ ID NO: 2050922 - RNA, 21 nt, Human
ccucuuucagaaaacagaaaa

SEQ ID NO: 2050923 - RNA, 23 nt, Human
ccucuuucagaaaacagaaaaaa

SEQ ID NO: 2050924 - RNA, 21 nt, Human
ccuguccuucucucaccuccu

SEQ ID NO: 2050925 - RNA, 12 nt, Human
ccuguccuugca

SEQ ID NO: 2050926 - RNA, 16 nt, Human
ccugucggagcccugu

SEQ ID NO: 2050927 - RNA, 21 nt, Human
ccugucggagcccugucuccu

SEQ ID NO: 2050928 - RNA, 17 nt, Human
ccugucggagcccuguc

SEQ ID NO: 2050929 - RNA, 13 nt, Human
ccuguaaucccag

SEQ ID NO: 2050930 - RNA, 15 nt, Human
ccuguaaucccagca

SEQ ID NO: 2050931 - RNA, 18 nt, Human
ccuguaaucccagcacuu

SEQ ID NO: 2050932 - RNA, 19 nt, Human
ccuguccugaccugucuca

SEQ ID NO: 2050933 - RNA, 16 nt, Human
ccuguaaucccagcac

SEQ ID NO: 2050934 - RNA, 14 nt, Human
ccuguaaucccagc

SEQ ID NO: 2050935 - RNA, 17 nt, Human
ccugguuucacuggccc

SEQ ID NO: 2050936 - RNA, 18 nt, Human
ccugguuucacuggccca

SEQ ID NO: 2050937 - RNA, 17 nt, Human
ccugguggccucugccc

SEQ ID NO: 2050938 - RNA, 14 nt, Human
ccuggugggccucc

SEQ ID NO: 2050939 - RNA, 18 nt, Human
ccuggugggccuccucug

SEQ ID NO: 2050940 - RNA, 20 nt, Human
ccuggugggccuccucuguc

SEQ ID NO: 2050941 - RNA, 21 nt, Human
ccugguggcagugggagcugc

SEQ ID NO: 2050942 - RNA, 15 nt, Human
ccugggggccugacc

SEQ ID NO: 2050943 - RNA, 16 nt, Human
ccugggggccugaccu

SEQ ID NO: 2050944 - RNA, 17 nt, Human
ccugggggccugaccuc

SEQ ID NO: 2050945 - RNA, 19 nt, Human
ccugggggccugaccuccc

SEQ ID NO: 2050946 - RNA, 22 nt, Human
ccugggggccugaccucccccu

SEQ ID NO: 2050947 - RNA, 23 nt, Human
ccugggggccugaccucccccuc

SEQ ID NO: 2050948 - RNA, 16 nt, Human
ccugggggaagcccug

SEQ ID NO: 2050949 - RNA, 17 nt, Human
ccugggggaagcccugg

SEQ ID NO: 2050950 - RNA, 19 nt, Human
ccugggggaagcccuggau

SEQ ID NO: 2050951 - RNA, 18 nt, Human
ccugggggaagcccugga

SEQ ID NO: 2050952 - RNA, 12 nt, Human
ccuggggccucg

SEQ ID NO: 2050953 - RNA, 22 nt, Human
ccuggggccucggagccucauc

SEQ ID NO: 2050954 - RNA, 13 nt, Human
ccuggggccucuu

SEQ ID NO: 2050955 - RNA, 23 nt, Human
ccuggggcagucaccugcccaga

SEQ ID NO: 2050956 - RNA, 19 nt, Human
ccugugaaauaguucaaag

SEQ ID NO: 2050957 - RNA, 17 nt, Human
ccugugaccagcacugu

SEQ ID NO: 2050958 - RNA, 16 nt, Human
ccugugaccagcacug

SEQ ID NO: 2050959 - RNA, 22 nt, Human
ccugucggagcccugucuccuc

SEQ ID NO: 2050960 - RNA, 21 nt, Human
ccugucuaggucaguacccac

SEQ ID NO: 2050961 - RNA, 22 nt, Human
ccugucuaggucaguacccacc

SEQ ID NO: 2050962 - RNA, 23 nt, Human
ccugucuaggucaguacccaccu

SEQ ID NO: 2050963 - RNA, 14 nt, Human
ccugucugccagcc

SEQ ID NO: 2050964 - RNA, 15 nt, Human
ccugucugccagcca

SEQ ID NO: 2050965 - RNA, 16 nt, Human
ccugucugccagccag

SEQ ID NO: 2050966 - RNA, 17 nt, Human
ccugucugccagccagc

SEQ ID NO: 2050967 - RNA, 19 nt, Human
ccugucugccagccagcag

SEQ ID NO: 2050968 - RNA, 20 nt, Human
ccugucugccagccagcagc

SEQ ID NO: 2050969 - RNA, 11 nt, Human
ccugggggccu

SEQ ID NO: 2050970 - RNA, 18 nt, Human
ccugucucauccccaggg

SEQ ID NO: 2050971 - RNA, 17 nt, Human
ccugucucauccccagg

SEQ ID NO: 2050972 - RNA, 13 nt, Human
ccugucucagccu

SEQ ID NO: 2050973 - RNA, 14 nt, Human
ccugucucagccuc

SEQ ID NO: 2050974 - RNA, 15 nt, Human
ccugucucagccucc

SEQ ID NO: 2050975 - RNA, 16 nt, Human
ccugucucagccuccc

SEQ ID NO: 2050976 - RNA, 14 nt, Human
ccugucuuuaagga

SEQ ID NO: 2050977 - RNA, 17 nt, Human
ccugucuuuaaggaaaa

SEQ ID NO: 2050978 - RNA, 22 nt, Human
ccugucuuccugcauucaccca

SEQ ID NO: 2050979 - RNA, 15 nt, Human
ccugucuuccugcau

SEQ ID NO: 2050980 - RNA, 19 nt, Human
ccugucuuccugcauucac

SEQ ID NO: 2050981 - RNA, 21 nt, Human
ccugucugccagccagcagcc

SEQ ID NO: 2050982 - RNA, 23 nt, Human
ccugucugccagccagcagccag

SEQ ID NO: 2050983 - RNA, 23 nt, Human
ccugggccccaccaccuaggcca

SEQ ID NO: 2050984 - RNA, 21 nt, Human
ccugggccccaccaccuaggc

SEQ ID NO: 2050985 - RNA, 13 nt, Human
ccugggccccucc

SEQ ID NO: 2050986 - RNA, 15 nt, Human
ccugggccccucccu

SEQ ID NO: 2050987 - RNA, 18 nt, Human
ccugggccccucccuacc

SEQ ID NO: 2050988 - RNA, 19 nt, Human
ccugggccccucccuaccu

SEQ ID NO: 2050989 - RNA, 20 nt, Human
ccugggccccucccuaccuc

SEQ ID NO: 2050990 - RNA, 22 nt, Human
ccugggccccucccuaccucaa

SEQ ID NO: 2050991 - RNA, 11 nt, Human
cccagcuguuu

SEQ ID NO: 2050992 - RNA, 23 nt, Human
cccagcugugcucuggacaggca

SEQ ID NO: 2050993 - RNA, 21 nt, Human
cccagcugugcucuggacagg

SEQ ID NO: 2050994 - RNA, 12 nt, Human
cccaggaagccg

SEQ ID NO: 2050995 - RNA, 16 nt, Human
cccaggcuggucucaa

SEQ ID NO: 2050996 - RNA, 21 nt, Human
cccagggcuacccucccccag

SEQ ID NO: 2050997 - RNA, 14 nt, Human
cccagggcucagcc

SEQ ID NO: 2050998 - RNA, 15 nt, Human
cccagggcucagccu

SEQ ID NO: 2050999 - RNA, 16 nt, Human
cccagggcucagccug

SEQ ID NO: 2051000 - RNA, 21 nt, Human
cccaggcuggcgugcaguggu

SEQ ID NO: 2051001 - RNA, 22 nt, Human
cccaggaaugaagauaccauca

SEQ ID NO: 2051002 - RNA, 22 nt, Human
cccaggaauuugaagcugcagu

SEQ ID NO: 2051003 - RNA, 15 nt, Human
cccagcaggugggga

SEQ ID NO: 2051004 - RNA, 19 nt, Human
cccagccauuaccauggag

SEQ ID NO: 2051005 - RNA, 20 nt, Human
cccagccauuaccauggaga

SEQ ID NO: 2051006 - RNA, 22 nt, Human
cccagccauuaccauggagaca

SEQ ID NO: 2051007 - RNA, 16 nt, Human
cccagcccaaagcugu

SEQ ID NO: 2051008 - RNA, 14 nt, Human
cccagcccacuucu

SEQ ID NO: 2051009 - RNA, 21 nt, Human
cccagcacuuugggaggcuga

SEQ ID NO: 2051010 - RNA, 13 nt, Human
cccagcagggccu

SEQ ID NO: 2051011 - RNA, 19 nt, Human
cccagcagggccucaaagu

SEQ ID NO: 2051012 - RNA, 16 nt, Human
cccagcagguggggag

SEQ ID NO: 2051013 - RNA, 15 nt, Human
cccagcacuuuggga

SEQ ID NO: 2051014 - RNA, 17 nt, Human
ccauuucuauuuauuua

SEQ ID NO: 2051015 - RNA, 14 nt, Human
ccauuucuauuuau

SEQ ID NO: 2051016 - RNA, 13 nt, Human
ccauuucuauuua

SEQ ID NO: 2051017 - RNA, 12 nt, Human
ccauuucuauuu

SEQ ID NO: 2051018 - RNA, 23 nt, Human
ccauuucuagaacaucccugcca

SEQ ID NO: 2051019 - RNA, 22 nt, Human
cccauucugccugcccaggccc

SEQ ID NO: 2051020 - RNA, 21 nt, Human
cccauucugccugcccaggcc

SEQ ID NO: 2051021 - RNA, 20 nt, Human
cccauucugccugcccaggc

SEQ ID NO: 2051022 - RNA, 20 nt, Human
cccauuucuauuuauuuacu

SEQ ID NO: 2051023 - RNA, 20 nt, Human
cccauuucuagaacaucccu

SEQ ID NO: 2051024 - RNA, 19 nt, Human
cccauuucuauuuauuuac

SEQ ID NO: 2051025 - RNA, 20 nt, Human
ccccagcaagugagagcugg

SEQ ID NO: 2051026 - RNA, 19 nt, Human
ccccagcaagugagagcug

SEQ ID NO: 2051027 - RNA, 17 nt, Human
ccccagcaagugagagc

SEQ ID NO: 2051028 - RNA, 23 nt, Human
ccccagauugcaacaggcugggc

SEQ ID NO: 2051029 - RNA, 22 nt, Human
ccccagauugcaacaggcuggg

SEQ ID NO: 2051030 - RNA, 21 nt, Human
ccccagauugcaacaggcugg

SEQ ID NO: 2051031 - RNA, 16 nt, Human
cccauuuacacuuuug

SEQ ID NO: 2051032 - RNA, 18 nt, Human
cccauuucacaccugaaa

SEQ ID NO: 2051033 - RNA, 17 nt, Human
cccauuucuauuuauuu

SEQ ID NO: 2051034 - RNA, 16 nt, Human
cccauuucuauuuauu

SEQ ID NO: 2051035 - RNA, 15 nt, Human
cccauuucuauuuau

SEQ ID NO: 2051036 - RNA, 18 nt, Human
cccauuucuaaaggccuc

SEQ ID NO: 2051037 - RNA, 21 nt, Human
cccauuucuaaaggccucuuc

SEQ ID NO: 2051038 - RNA, 23 nt, Human
cccaguuugcagaaaagcaccug

SEQ ID NO: 2051039 - RNA, 23 nt, Human
cccauaauuuuuuuuuuccuuuu

SEQ ID NO: 2051040 - RNA, 22 nt, Human
cccauaauuuuuuuuuuccuuu

SEQ ID NO: 2051041 - RNA, 19 nt, Human
cccauaauuuucuucaugc

SEQ ID NO: 2051042 - RNA, 15 nt, Human
cccaguuugcagaaa

SEQ ID NO: 2051043 - RNA, 16 nt, Human
cccaguuugcagaaaa

SEQ ID NO: 2051044 - RNA, 22 nt, Human
cccaguuugcagaaaagcaccu

SEQ ID NO: 2051045 - RNA, 20 nt, Human
cccagggcucagccuggugg

SEQ ID NO: 2051046 - RNA, 17 nt, Human
cccagggcucagccugg

SEQ ID NO: 2051047 - RNA, 18 nt, Human
cccagggcucagccuggu

SEQ ID NO: 2051048 - RNA, 17 nt, Human
ccccuucgcuccugugu

SEQ ID NO: 2051049 - RNA, 15 nt, Human
ccccuucgcuccugu

SEQ ID NO: 2051050 - RNA, 14 nt, Human
ccccuucgcuccug

SEQ ID NO: 2051051 - RNA, 19 nt, Human
ccccuucuacacucuccug

SEQ ID NO: 2051052 - RNA, 20 nt, Human
ccccuucuacacucuccugg

SEQ ID NO: 2051053 - RNA, 21 nt, Human
ccccuucuacacucuccuggg

SEQ ID NO: 2051054 - RNA, 22 nt, Human
ccccuucuacacucuccugggc

SEQ ID NO: 2051055 - RNA, 23 nt, Human
ccccuucuacacucuccugggcc

SEQ ID NO: 2051056 - RNA, 19 nt, Human
ccccuucgcuccugugucu

SEQ ID NO: 2051057 - RNA, 16 nt, Human
ccccuucucccacacu

SEQ ID NO: 2051058 - RNA, 13 nt, Human
ccccuucucccac

SEQ ID NO: 2051059 - RNA, 21 nt, Human
ccccugagacaaauggaggcc

SEQ ID NO: 2051060 - RNA, 18 nt, Human
ccccugaccucacuguga

SEQ ID NO: 2051061 - RNA, 22 nt, Human
ccccugcacuggaguccagucu

SEQ ID NO: 2051062 - RNA, 14 nt, Human
ccccauucugccug

SEQ ID NO: 2051063 - RNA, 13 nt, Human
ccccauucugccu

SEQ ID NO: 2051064 - RNA, 15 nt, Human
ccccauucugccugc

SEQ ID NO: 2051065 - RNA, 20 nt, Human
ccccaugaagccacagccca

SEQ ID NO: 2051066 - RNA, 13 nt, Human
ccccaugccaaag

SEQ ID NO: 2051067 - RNA, 22 nt, Human
ccccaugccaaagcuagggugg

SEQ ID NO: 2051068 - RNA, 12 nt, Human
cccggcugcgga

SEQ ID NO: 2051069 - RNA, 22 nt, Human
cccucaaggacaaagucuccag

SEQ ID NO: 2051070 - RNA, 23 nt, Human
cccucaaggacaaagucuccagc

SEQ ID NO: 2051071 - RNA, 16 nt, Human
cccuauggggaugguc

SEQ ID NO: 2051072 - RNA, 18 nt, Human
cccuauggggauggucca

SEQ ID NO: 2051073 - RNA, 13 nt, Human
cccuaugcugccu

SEQ ID NO: 2051074 - RNA, 17 nt, Human
cccuauggaagcauauu

SEQ ID NO: 2051075 - RNA, 13 nt, Human
cccucagagccac

SEQ ID NO: 2051076 - RNA, 19 nt, Human
ccagcagccuggacccugu

SEQ ID NO: 2051077 - RNA, 20 nt, Human
ccagcagccuggacccugug

SEQ ID NO: 2051078 - RNA, 15 nt, Human
ccagcagccuggacc

SEQ ID NO: 2051079 - RNA, 14 nt, Human
ccagcagccuggac

SEQ ID NO: 2051080 - RNA, 19 nt, Human
ccagcagaucccagcucac

SEQ ID NO: 2051081 - RNA, 21 nt, Human
ccagcagaucccagcucacgu

SEQ ID NO: 2051082 - RNA, 15 nt, Human
ccagcucagucccau

SEQ ID NO: 2051083 - RNA, 12 nt, Human
ccagcucagcag

SEQ ID NO: 2051084 - RNA, 15 nt, Human
ccagcucagcaguga

SEQ ID NO: 2051085 - RNA, 15 nt, Human
ccagcucacgucaca

SEQ ID NO: 2051086 - RNA, 14 nt, Human
ccagcucacgucac

SEQ ID NO: 2051087 - RNA, 13 nt, Human
ccagcucagaggg

SEQ ID NO: 2051088 - RNA, 21 nt, Human
ccagcuaaggacauuucccag

SEQ ID NO: 2051089 - RNA, 23 nt, Human
ccagcuaaggacauuucccaggg

SEQ ID NO: 2051090 - RNA, 16 nt, Human
ccagcuuaucucaggg

SEQ ID NO: 2051091 - RNA, 17 nt, Human
ccagcucagucuucccu

SEQ ID NO: 2051092 - RNA, 18 nt, Human
ccagcucagucuucccua

SEQ ID NO: 2051093 - RNA, 22 nt, Human
ccagcucagucccaucagagag

SEQ ID NO: 2051094 - RNA, 22 nt, Human
ccaggaacacccgacuccucaa

SEQ ID NO: 2051095 - RNA, 15 nt, Human
ccagcagaucccagc

SEQ ID NO: 2051096 - RNA, 16 nt, Human
ccagcagaucccagcu

SEQ ID NO: 2051097 - RNA, 17 nt, Human
ccagcagaucccagcuc

SEQ ID NO: 2051098 - RNA, 18 nt, Human
ccagcagaucccagcuca

SEQ ID NO: 2051099 - RNA, 21 nt, Human
ccacucugcuuugacugagca

SEQ ID NO: 2051100 - RNA, 14 nt, Human
ccacucugccucug

SEQ ID NO: 2051101 - RNA, 16 nt, Human
ccacucugccucugcc

SEQ ID NO: 2051102 - RNA, 17 nt, Human
ccacucuccccacacua

SEQ ID NO: 2051103 - RNA, 18 nt, Human
ccaggaggucgaccccaa

SEQ ID NO: 2051104 - RNA, 20 nt, Human
ccaggaguucgaggcugcag

SEQ ID NO: 2051105 - RNA, 21 nt, Human
ccaggaguguggccacguggg

SEQ ID NO: 2051106 - RNA, 17 nt, Human
ccaggcaacuugggaac

SEQ ID NO: 2051107 - RNA, 13 nt, Human
ccaggcaauggcc

SEQ ID NO: 2051108 - RNA, 19 nt, Human
ccaggcaauggccuaaacu

SEQ ID NO: 2051109 - RNA, 23 nt, Human
ccaggcaauggccuaaacuucag

SEQ ID NO: 2051110 - RNA, 14 nt, Human
ccagucccccugcc

SEQ ID NO: 2051111 - RNA, 19 nt, Human
ccauuucuaaaggccucuu

SEQ ID NO: 2051112 - RNA, 21 nt, Human
ccauuucuaaaggccucuucc

SEQ ID NO: 2051113 - RNA, 14 nt, Human
ccauuuauagaaua

SEQ ID NO: 2051114 - RNA, 19 nt, Human
ccauuuaguucuuuguuau

SEQ ID NO: 2051115 - RNA, 12 nt, Human
ccauuuacacuu

SEQ ID NO: 2051116 - RNA, 13 nt, Human
ccauuuacacuuu

SEQ ID NO: 2051117 - RNA, 18 nt, Human
ccauuuacacuuuugaga

SEQ ID NO: 2051118 - RNA, 14 nt, Human
ccauugaaaaugua

SEQ ID NO: 2051119 - RNA, 13 nt, Human
ccauucuuugcuu

SEQ ID NO: 2051120 - RNA, 15 nt, Human
ccauucuuugcuuga

SEQ ID NO: 2051121 - RNA, 20 nt, Human
ccauucuuugcuugaacaca

SEQ ID NO: 2051122 - RNA, 22 nt, Human
ccauucuuugcuugaacacagu

SEQ ID NO: 2051123 - RNA, 15 nt, Human
ccaugggccuccugu

SEQ ID NO: 2051124 - RNA, 14 nt, Human
ccaugggccuccug

SEQ ID NO: 2051125 - RNA, 20 nt, Human
ccauaauuuuuuuuuuccuu

SEQ ID NO: 2051126 - RNA, 12 nt, Human
ccaucccacacc

SEQ ID NO: 2051127 - RNA, 14 nt, Human
ccaucccacacccu

SEQ ID NO: 2051128 - RNA, 16 nt, Human
ccaucccacacccugg

SEQ ID NO: 2051129 - RNA, 13 nt, Human
ccaucccaccucu

SEQ ID NO: 2051130 - RNA, 23 nt, Human
ccaguuugcagaaaagcaccugc

SEQ ID NO: 2051131 - RNA, 14 nt, Human
ccaguuugcagaaa

SEQ ID NO: 2051132 - RNA, 13 nt, Human
ccaugggccuccu

SEQ ID NO: 2051133 - RNA, 19 nt, Human
ccaugagccucagcauccu

SEQ ID NO: 2051134 - RNA, 18 nt, Human
ccaugagccucagcaucc

SEQ ID NO: 2051135 - RNA, 14 nt, Human
ccaugagccucagc

SEQ ID NO: 2051136 - RNA, 16 nt, Human
ccauccccuguagagu

SEQ ID NO: 2051137 - RNA, 22 nt, Human
ccauccccuguagagugggagc

SEQ ID NO: 2051138 - RNA, 17 nt, Human
ccauccccuauggacca

SEQ ID NO: 2051139 - RNA, 21 nt, Human
ccauccuaaucauccaaugcu

SEQ ID NO: 2051140 - RNA, 22 nt, Human
ccauccuaaucauccaaugcuc

SEQ ID NO: 2051141 - RNA, 23 nt, Human
ccauccuaaucauccaaugcuca

SEQ ID NO: 2051142 - RNA, 15 nt, Human
auuucagauuuguga

SEQ ID NO: 2051143 - RNA, 14 nt, Human
auuucaucuauuuc

SEQ ID NO: 2051144 - RNA, 15 nt, Human
auuucaucuauuucu

SEQ ID NO: 2051145 - RNA, 16 nt, Human
auuucaucuauuucug

SEQ ID NO: 2051146 - RNA, 14 nt, Human
auuucagaugcuuu

SEQ ID NO: 2051147 - RNA, 16 nt, Human
auuucagaugcuuuag

SEQ ID NO: 2051148 - RNA, 18 nt, Human
auuuaucagugacagagu

SEQ ID NO: 2051149 - RNA, 17 nt, Human
auuuaucagugacagag

SEQ ID NO: 2051150 - RNA, 15 nt, Human
auuucaagaccuucu

SEQ ID NO: 2051151 - RNA, 19 nt, Human
auuuaucacacaaagcaga

SEQ ID NO: 2051152 - RNA, 16 nt, Human
auuuaucacacuucug

SEQ ID NO: 2051153 - RNA, 14 nt, Human
auuuaucacacaaa

SEQ ID NO: 2051154 - RNA, 17 nt, Human
auuuaucacacaaagca

SEQ ID NO: 2051155 - RNA, 14 nt, Human
auuuaucagugaca

SEQ ID NO: 2051156 - RNA, 15 nt, Human
auuuaucagugacag

SEQ ID NO: 2051157 - RNA, 13 nt, Human
auuuauauuucac

SEQ ID NO: 2051158 - RNA, 18 nt, Human
auuuauauuuuuauuuua

SEQ ID NO: 2051159 - RNA, 13 nt, Human
auuuauauuuuug

SEQ ID NO: 2051160 - RNA, 16 nt, Human
auuuauaguuuauaca

SEQ ID NO: 2051161 - RNA, 17 nt, Human
auuuauaguuuauacag

SEQ ID NO: 2051162 - RNA, 18 nt, Human
auuuauaguuuauacagu

SEQ ID NO: 2051163 - RNA, 20 nt, Human
auuuauaguuuauacaguuu

SEQ ID NO: 2051164 - RNA, 14 nt, Human
auuuauacuauuua

SEQ ID NO: 2051165 - RNA, 14 nt, Human
auuuaaugaaagac

SEQ ID NO: 2051166 - RNA, 18 nt, Human
auuuaaucuuuuuuaugu

SEQ ID NO: 2051167 - RNA, 13 nt, Human
auuuaauuaaaaa

SEQ ID NO: 2051168 - RNA, 12 nt, Human
auuuauaauuuu

SEQ ID NO: 2051169 - RNA, 19 nt, Human
auuuauaauuuuaagauuc

SEQ ID NO: 2051170 - RNA, 14 nt, Human
auuuauaauguuag

SEQ ID NO: 2051171 - RNA, 16 nt, Human
auuuauaauguuagua

SEQ ID NO: 2051172 - RNA, 20 nt, Human
auuuauaauguuaguagaaa

SEQ ID NO: 2051173 - RNA, 14 nt, Human
auuuauaauguuug

SEQ ID NO: 2051174 - RNA, 19 nt, Human
auuuaauauagcuauuuuu

SEQ ID NO: 2051175 - RNA, 14 nt, Human
auuuaauauagcua

SEQ ID NO: 2051176 - RNA, 16 nt, Human
auuuaauauagcuauu

SEQ ID NO: 2051177 - RNA, 17 nt, Human
auuuaauauagcuauuu

SEQ ID NO: 2051178 - RNA, 15 nt, Human
auuucuccauacgca

SEQ ID NO: 2051179 - RNA, 11 nt, Human
auuucucccag

SEQ ID NO: 2051180 - RNA, 20 nt, Human
auuucaucuauuucugagaa

SEQ ID NO: 2051181 - RNA, 18 nt, Human
auuucuauuuuuguagaa

SEQ ID NO: 2051182 - RNA, 18 nt, Human
auuucaucuauuucugag

SEQ ID NO: 2051183 - RNA, 19 nt, Human
auuucaucuauuucugaga

SEQ ID NO: 2051184 - RNA, 13 nt, Human
auuguacaguuuu

SEQ ID NO: 2051185 - RNA, 19 nt, Human
auuguacacaccuuauauu

SEQ ID NO: 2051186 - RNA, 20 nt, Human
auuguacagaaucauugcuu

SEQ ID NO: 2051187 - RNA, 21 nt, Human
auuguacagaaucauugcuua

SEQ ID NO: 2051188 - RNA, 13 nt, Human
auuguacaaccug

SEQ ID NO: 2051189 - RNA, 21 nt, Human
auuguucccagugacacuuca

SEQ ID NO: 2051190 - RNA, 13 nt, Human
auuguuccuaagu

SEQ ID NO: 2051191 - RNA, 16 nt, Human
auuguuccuaaguucu

SEQ ID NO: 2051192 - RNA, 17 nt, Human
auuguuccuaaguucuu

SEQ ID NO: 2051193 - RNA, 19 nt, Human
auuguuccuaaguucuuag

SEQ ID NO: 2051194 - RNA, 20 nt, Human
auuguuccuaaguucuuaga

SEQ ID NO: 2051195 - RNA, 23 nt, Human
auuguuccuaaguucuuagauau

SEQ ID NO: 2051196 - RNA, 19 nt, Human
auuguucuuaguuugcagu

SEQ ID NO: 2051197 - RNA, 16 nt, Human
auuguucccagugaca

SEQ ID NO: 2051198 - RNA, 19 nt, Human
auuguucccagugacacuu

SEQ ID NO: 2051199 - RNA, 22 nt, Human
auuguuccaagacauugucaau

SEQ ID NO: 2051200 - RNA, 19 nt, Human
auuguuucaaaauaaaaac

SEQ ID NO: 2051201 - RNA, 19 nt, Human
auuguuuauuuaucaguga

SEQ ID NO: 2051202 - RNA, 21 nt, Human
auuguuuauuuaucagugaca

SEQ ID NO: 2051203 - RNA, 15 nt, Human
auuguuuauuuauca

SEQ ID NO: 2051204 - RNA, 17 nt, Human
auuguuuauuuaucagu

SEQ ID NO: 2051205 - RNA, 18 nt, Human
auuguuuauuuaucagug

SEQ ID NO: 2051206 - RNA, 21 nt, Human
auuguuuaaguguuguaaaua

SEQ ID NO: 2051207 - RNA, 21 nt, Human
auugaucauuuuccccccacu

SEQ ID NO: 2051208 - RNA, 19 nt, Human
auugaucauuuucccccca

SEQ ID NO: 2051209 - RNA, 20 nt, Human
auugaucauuuuccccccac

SEQ ID NO: 2051210 - RNA, 17 nt, Human
auuguaaaacugaggca

SEQ ID NO: 2051211 - RNA, 14 nt, Human
auuccugcagccug

SEQ ID NO: 2051212 - RNA, 15 nt, Human
auuccugcagccugg

SEQ ID NO: 2051213 - RNA, 17 nt, Human
auuccugcagccuggag

SEQ ID NO: 2051214 - RNA, 10 nt, Human
auucucucuc

SEQ ID NO: 2051215 - RNA, 16 nt, Human
auucucucuccugucc

SEQ ID NO: 2051216 - RNA, 17 nt, Human
auucucucuccugucca

SEQ ID NO: 2051217 - RNA, 15 nt, Human
auucucucuccugua

SEQ ID NO: 2051218 - RNA, 12 nt, Human
auucucucuccu

SEQ ID NO: 2051219 - RNA, 15 nt, Human
auucucucuccuguc

SEQ ID NO: 2051220 - RNA, 13 nt, Human
auuccugcagccu

SEQ ID NO: 2051221 - RNA, 13 nt, Human
auuccugaaagaa

SEQ ID NO: 2051222 - RNA, 17 nt, Human
auuccugaaugaaauau

SEQ ID NO: 2051223 - RNA, 19 nt, Human
auuccugaaugaaauauca

SEQ ID NO: 2051224 - RNA, 17 nt, Human
auucuugucacaauaaa

SEQ ID NO: 2051225 - RNA, 18 nt, Human
auucuugucacaauaaau

SEQ ID NO: 2051226 - RNA, 12 nt, Human
auucuugugaau

SEQ ID NO: 2051227 - RNA, 13 nt, Human
auucuugugaaua

SEQ ID NO: 2051228 - RNA, 17 nt, Human
auucuugugaauaugua

SEQ ID NO: 2051229 - RNA, 19 nt, Human
auucuugugaauauguaca

SEQ ID NO: 2051230 - RNA, 12 nt, Human
auucuuguauau

SEQ ID NO: 2051231 - RNA, 17 nt, Human
auugagaauuuuaaauu

SEQ ID NO: 2051232 - RNA, 21 nt, Human
auugagaauuuuaaauuauaa

SEQ ID NO: 2051233 - RNA, 14 nt, Human
auugagacaaaaau

SEQ ID NO: 2051234 - RNA, 15 nt, Human
auugagacaaaaauu

SEQ ID NO: 2051235 - RNA, 16 nt, Human
auugagacaaaaauua

SEQ ID NO: 2051236 - RNA, 18 nt, Human
auugagacaaaaauuauc

SEQ ID NO: 2051237 - RNA, 19 nt, Human
auugagacaaaaauuaucu

SEQ ID NO: 2051238 - RNA, 20 nt, Human
auugagacaaaaauuaucua

SEQ ID NO: 2051239 - RNA, 22 nt, Human
auugagagaauggaaaacagac

SEQ ID NO: 2051240 - RNA, 18 nt, Human
auugaucauuuucccccc

SEQ ID NO: 2051241 - RNA, 16 nt, Human
auugagaaagaaacua

SEQ ID NO: 2051242 - RNA, 19 nt, Human
auugagaagcguauguuuu

SEQ ID NO: 2051243 - RNA, 22 nt, Human
auugagaacugcauauguuucg

SEQ ID NO: 2051244 - RNA, 14 nt, Human
auugagaacugcau

SEQ ID NO: 2051245 - RNA, 18 nt, Human
auugagaacugcauaugu

SEQ ID NO: 2051246 - RNA, 13 nt, Human
auugagaauuuua

SEQ ID NO: 2051247 - RNA, 19 nt, Human
auucaagaaaaguaagccc

SEQ ID NO: 2051248 - RNA, 16 nt, Human
auucaagaaagccagu

SEQ ID NO: 2051249 - RNA, 22 nt, Human
auucaagaaagccagucuuaac

SEQ ID NO: 2051250 - RNA, 23 nt, Human
auucaagaaagccagucuuaaca

SEQ ID NO: 2051251 - RNA, 15 nt, Human
auuauguguguuuug

SEQ ID NO: 2051252 - RNA, 22 nt, Human
auucaauuuucuuuaaccaguc

SEQ ID NO: 2051253 - RNA, 19 nt, Human
auucaauuuauucaagaaa

SEQ ID NO: 2051254 - RNA, 15 nt, Human
auuaaauuuaauuag

SEQ ID NO: 2051255 - RNA, 20 nt, Human
auucauauuuacuucuuaua

SEQ ID NO: 2051256 - RNA, 18 nt, Human
auucauauuuacuucuua

SEQ ID NO: 2051257 - RNA, 19 nt, Human
auucauauuuacuucuuau

SEQ ID NO: 2051258 - RNA, 18 nt, Human
auucauauuuaugaaucu

SEQ ID NO: 2051259 - RNA, 22 nt, Human
auuccucugggaauguuacauu

SEQ ID NO: 2051260 - RNA, 13 nt, Human
auuccucugggaa

SEQ ID NO: 2051261 - RNA, 12 nt, Human
auuccucuggga

SEQ ID NO: 2051262 - RNA, 17 nt, Human
auucaucucucuuuaau

SEQ ID NO: 2051263 - RNA, 22 nt, Human
auucaucucucuuuaauauaaa

SEQ ID NO: 2051264 - RNA, 20 nt, Human
auuuuuaaagaaaaguuuug

SEQ ID NO: 2051265 - RNA, 13 nt, Human
auuuuuaaagaaa

SEQ ID NO: 2051266 - RNA, 17 nt, Human
auuuuuaaaguauauau

SEQ ID NO: 2051267 - RNA, 19 nt, Human
auuuuuaaauguaaaacau

SEQ ID NO: 2051268 - RNA, 21 nt, Human
auuuuuaagcaaaauauuauu

SEQ ID NO: 2051269 - RNA, 18 nt, Human
auuuugauccaagcuggu

SEQ ID NO: 2051270 - RNA, 15 nt, Human
auuuucuuugaaauu

SEQ ID NO: 2051271 - RNA, 16 nt, Human
auuuucuuuuguaaau

SEQ ID NO: 2051272 - RNA, 17 nt, Human
auuuucuuuuguaaaug

SEQ ID NO: 2051273 - RNA, 17 nt, Human
auuuugaccuacucuca

SEQ ID NO: 2051274 - RNA, 18 nt, Human
auuuugaccuacucucau

SEQ ID NO: 2051275 - RNA, 19 nt, Human
auuuucuuuuguaaauguu

SEQ ID NO: 2051276 - RNA, 20 nt, Human
auuuucuuuuuaauaaaaag

SEQ ID NO: 2051277 - RNA, 22 nt, Human
auuuucuuuaaccagucugaag

SEQ ID NO: 2051278 - RNA, 19 nt, Human
auuuucuugaugacuggaa

SEQ ID NO: 2051279 - RNA, 21 nt, Human
auuuucuugaugacuggaauu

SEQ ID NO: 2051280 - RNA, 21 nt, Human
auuuucuuccaagcaaaggug

SEQ ID NO: 2051281 - RNA, 15 nt, Human
auuuuaucucuuauu

SEQ ID NO: 2051282 - RNA, 15 nt, Human
auuuuauacauuaac

SEQ ID NO: 2051283 - RNA, 12 nt, Human
auuuuauaauuu

SEQ ID NO: 2051284 - RNA, 19 nt, Human
auuuuauauuagaaguguu

SEQ ID NO: 2051285 - RNA, 20 nt, Human
auuuuauauuagaaguguua

SEQ ID NO: 2051286 - RNA, 15 nt, Human
caaaaaaaauuuaaa

SEQ ID NO: 2051287 - RNA, 17 nt, Human
caaaaaaaauuuaaaaa

SEQ ID NO: 2051288 - RNA, 20 nt, Human
caaaaaaaguugaaggccuu

SEQ ID NO: 2051289 - RNA, 16 nt, Human
caaaaaaauaaggugu

SEQ ID NO: 2051290 - RNA, 11 nt, Human
caaaagccucu

SEQ ID NO: 2051291 - RNA, 13 nt, Human
caaaagccucuca

SEQ ID NO: 2051292 - RNA, 20 nt, Human
auuuuuaccuuuuuccuucc

SEQ ID NO: 2051293 - RNA, 22 nt, Human
auuuuuacagaauugcuuguuu

SEQ ID NO: 2051294 - RNA, 14 nt, Human
auuuuuacagaauu

SEQ ID NO: 2051295 - RNA, 16 nt, Human
auuuuuacagaauugc

SEQ ID NO: 2051296 - RNA, 20 nt, Human
auuuuuaauguuuuuaaaua

SEQ ID NO: 2051297 - RNA, 16 nt, Human
caaaaguaucgggggc

SEQ ID NO: 2051298 - RNA, 17 nt, Human
caaaaguaucgggggcu

SEQ ID NO: 2051299 - RNA, 18 nt, Human
caaaaguaucgggggcug

SEQ ID NO: 2051300 - RNA, 22 nt, Human
caaaaguaucgggggcuggggc

SEQ ID NO: 2051301 - RNA, 20 nt, Human
caaaagguucacuaaagcag

SEQ ID NO: 2051302 - RNA, 15 nt, Human
caaaagcugggcagg

SEQ ID NO: 2051303 - RNA, 19 nt, Human
caaaagucaaaaggugccu

SEQ ID NO: 2051304 - RNA, 13 nt, Human
caaaagugcuuug

SEQ ID NO: 2051305 - RNA, 14 nt, Human
caaaagugcuuugg

SEQ ID NO: 2051306 - RNA, 15 nt, Human
caaaagugcuuugga

SEQ ID NO: 2051307 - RNA, 17 nt, Human
caacuaugauuuggaaa

SEQ ID NO: 2051308 - RNA, 22 nt, Human
caacuaugauuuggaaaauaaa

SEQ ID NO: 2051309 - RNA, 19 nt, Human
caacuaugauuuggaaaau

SEQ ID NO: 2051310 - RNA, 18 nt, Human
caacuaugauuuggaaaa

SEQ ID NO: 2051311 - RNA, 17 nt, Human
caacccccagccugcua

SEQ ID NO: 2051312 - RNA, 16 nt, Human
caacccccagccugcu

SEQ ID NO: 2051313 - RNA, 15 nt, Human
caacccccagccugc

SEQ ID NO: 2051314 - RNA, 19 nt, Human
caacccaucuaccccugga

SEQ ID NO: 2051315 - RNA, 20 nt, Human
caacccaucuaccccuggau

SEQ ID NO: 2051316 - RNA, 22 nt, Human
caacccaugaugagcuccucuu

SEQ ID NO: 2051317 - RNA, 16 nt, Human
caacccaaaccuggag

SEQ ID NO: 2051318 - RNA, 17 nt, Human
caacccaaaccuggaga

SEQ ID NO: 2051319 - RNA, 18 nt, Human
caacccaaaccuggagau

SEQ ID NO: 2051320 - RNA, 14 nt, Human
caaccauuccccau

SEQ ID NO: 2051321 - RNA, 22 nt, Human
caaccaccgcuccccagcccag

SEQ ID NO: 2051322 - RNA, 14 nt, Human
caaccacuguaaaa

SEQ ID NO: 2051323 - RNA, 17 nt, Human
caaccacuguaaaauga

SEQ ID NO: 2051324 - RNA, 21 nt, Human
caaccacuguaaaaugaaauu

SEQ ID NO: 2051325 - RNA, 19 nt, Human
caaccacuguaaaaugaaa

SEQ ID NO: 2051326 - RNA, 22 nt, Human
caagaaggguuuuccacccugg

SEQ ID NO: 2051327 - RNA, 22 nt, Human
caacuaugauaugguaaaaguu

SEQ ID NO: 2051328 - RNA, 23 nt, Human
caagaaggguuuuccacccugga

SEQ ID NO: 2051329 - RNA, 19 nt, Human
caagaagucaaaguaaaac

SEQ ID NO: 2051330 - RNA, 12 nt, Human
caagaaggcugg

SEQ ID NO: 2051331 - RNA, 13 nt, Human
caagaaggcuggg

SEQ ID NO: 2051332 - RNA, 14 nt, Human
caagaaggcugggg

SEQ ID NO: 2051333 - RNA, 14 nt, Human
caagauuaaaugua

SEQ ID NO: 2051334 - RNA, 15 nt, Human
caagaccccugucuu

SEQ ID NO: 2051335 - RNA, 14 nt, Human
caagacccugucuc

SEQ ID NO: 2051336 - RNA, 15 nt, Human
caagacccugucucu

SEQ ID NO: 2051337 - RNA, 15 nt, Human
caagacacaucccua

SEQ ID NO: 2051338 - RNA, 13 nt, Human
caagacagaugcc

SEQ ID NO: 2051339 - RNA, 22 nt, Human
caagacagaugccccagagcug

SEQ ID NO: 2051340 - RNA, 16 nt, Human
caagacagaugcccca

SEQ ID NO: 2051341 - RNA, 21 nt, Human
caagacagaugccccagagcu

SEQ ID NO: 2051342 - RNA, 22 nt, Human
caagaauuugaucguuccaguu

SEQ ID NO: 2051343 - RNA, 22 nt, Human
caagaauuucuugguaagaagc

SEQ ID NO: 2051344 - RNA, 23 nt, Human
caagaauuucuugguaagaagcc

SEQ ID NO: 2051345 - RNA, 20 nt, Human
caaccaccgcuccccagccc

SEQ ID NO: 2051346 - RNA, 21 nt, Human
caaccaccgcuccccagccca

SEQ ID NO: 2051347 - RNA, 19 nt, Human
caaccaccgcuccccagcc

SEQ ID NO: 2051348 - RNA, 17 nt, Human
caaccaccgcuccccag

SEQ ID NO: 2051349 - RNA, 17 nt, Human
caacaaaaagcuucccc

SEQ ID NO: 2051350 - RNA, 10 nt, Human
caacaaaaau

SEQ ID NO: 2051351 - RNA, 12 nt, Human
caacaaaaauuu

SEQ ID NO: 2051352 - RNA, 13 nt, Human
caacaaaaauuug

SEQ ID NO: 2051353 - RNA, 23 nt, Human
caacaaaaauuugaaccaaaaca

SEQ ID NO: 2051354 - RNA, 10 nt, Human
caacaaaaaa

SEQ ID NO: 2051355 - RNA, 13 nt, Human
caacaaaaaauaa

SEQ ID NO: 2051356 - RNA, 16 nt, Human
caacaaaaagcuuccc

SEQ ID NO: 2051357 - RNA, 15 nt, Human
caaauuuuggccaaa

SEQ ID NO: 2051358 - RNA, 13 nt, Human
caaauuuuggcca

SEQ ID NO: 2051359 - RNA, 21 nt, Human
caaaucugccuauugcagcug

SEQ ID NO: 2051360 - RNA, 21 nt, Human
caaaucugcuuuuuaaagaau

SEQ ID NO: 2051361 - RNA, 23 nt, Human
caaaucuaagggaaaaagccuug

SEQ ID NO: 2051362 - RNA, 17 nt, Human
caaaucagcugcuacua

SEQ ID NO: 2051363 - RNA, 21 nt, Human
caaaguaaaacuugcugccug

SEQ ID NO: 2051364 - RNA, 22 nt, Human
caacaccucugcacaagcugca

SEQ ID NO: 2051365 - RNA, 22 nt, Human
caacaccuucagaggcugaggu

SEQ ID NO: 2051366 - RNA, 23 nt, Human
caacaccuucagaggcugaggug

SEQ ID NO: 2051367 - RNA, 22 nt, Human
caaguaauccaccugccucggc

SEQ ID NO: 2051368 - RNA, 23 nt, Human
caagauucccagagacaggaaaa

SEQ ID NO: 2051369 - RNA, 18 nt, Human
caagauucccagagacag

SEQ ID NO: 2051370 - RNA, 19 nt, Human
caagauucccagagacagg

SEQ ID NO: 2051371 - RNA, 14 nt, Human
caagauucccagag

SEQ ID NO: 2051372 - RNA, 15 nt, Human
caagauucccagaga

SEQ ID NO: 2051373 - RNA, 16 nt, Human
caagauucccagagac

SEQ ID NO: 2051374 - RNA, 17 nt, Human
caagauucccagagaca

SEQ ID NO: 2051375 - RNA, 13 nt, Human
caagauucccaga

SEQ ID NO: 2051376 - RNA, 11 nt, Human
caaguaauugu

SEQ ID NO: 2051377 - RNA, 23 nt, Human
caaguaauugugaaaaaguuaaa

SEQ ID NO: 2051378 - RNA, 16 nt, Human
caaguacugcuguaaa

SEQ ID NO: 2051379 - RNA, 13 nt, Human
caaguacugcugu

SEQ ID NO: 2051380 - RNA, 14 nt, Human
caaguacugcugua

SEQ ID NO: 2051381 - RNA, 18 nt, Human
caaguagaugccugaacu

SEQ ID NO: 2051382 - RNA, 20 nt, Human
caaguagaugccugaacuug

SEQ ID NO: 2051383 - RNA, 17 nt, Human
caaguauguuuuagcau

SEQ ID NO: 2051384 - RNA, 13 nt, Human
caaguucuauuua

SEQ ID NO: 2051385 - RNA, 14 nt, Human
caaguuggacuggg

SEQ ID NO: 2051386 - RNA, 15 nt, Human
caaguugcgacggag

SEQ ID NO: 2051387 - RNA, 20 nt, Human
caaguugcgacggagagaaa

SEQ ID NO: 2051388 - RNA, 23 nt, Human
caaguugcgacggagagaaaaaa

SEQ ID NO: 2051389 - RNA, 14 nt, Human
caauaaaaaucaua

SEQ ID NO: 2051390 - RNA, 17 nt, Human
caauaaaccucuuuucu

SEQ ID NO: 2051391 - RNA, 11 nt, Human
caauaaacuau

SEQ ID NO: 2051392 - RNA, 17 nt, Human
caauuguuuuuguugug

SEQ ID NO: 2051393 - RNA, 12 nt, Human
caauuuaaagca

SEQ ID NO: 2051394 - RNA, 15 nt, Human
cacaagauucccaga

SEQ ID NO: 2051395 - RNA, 16 nt, Human
cacaagauucccagag

SEQ ID NO: 2051396 - RNA, 17 nt, Human
cacaagauucccagaga

SEQ ID NO: 2051397 - RNA, 18 nt, Human
cacaagauucccagagac

SEQ ID NO: 2051398 - RNA, 19 nt, Human
cacaagauucccagagaca

SEQ ID NO: 2051399 - RNA, 22 nt, Human
cacaagauucccagagacagga

SEQ ID NO: 2051400 - RNA, 23 nt, Human
caaugcuggcuguuggcuggggg

SEQ ID NO: 2051401 - RNA, 22 nt, Human
caaugcuggcuguuggcugggg

SEQ ID NO: 2051402 - RNA, 19 nt, Human
caauauuuauuauuuucac

SEQ ID NO: 2051403 - RNA, 17 nt, Human
caauucuuacaaacaug

SEQ ID NO: 2051404 - RNA, 18 nt, Human
caauucuuacaaacaugu

SEQ ID NO: 2051405 - RNA, 19 nt, Human
caauucuuacaaacaugug

SEQ ID NO: 2051406 - RNA, 17 nt, Human
caauuguguggucagug

SEQ ID NO: 2051407 - RNA, 13 nt, Human
caauggaagauuu

SEQ ID NO: 2051408 - RNA, 14 nt, Human
caauggaagauuug

SEQ ID NO: 2051409 - RNA, 17 nt, Human
caauggaagauuugccc

SEQ ID NO: 2051410 - RNA, 21 nt, Human
caaugcuuugccccugagaca

SEQ ID NO: 2051411 - RNA, 13 nt, Human
caauauuuauugu

SEQ ID NO: 2051412 - RNA, 14 nt, Human
caauauuuauugua

SEQ ID NO: 2051413 - RNA, 16 nt, Human
caauauuuauuguauu

SEQ ID NO: 2051414 - RNA, 22 nt, Human
caauauuuauuguauuuuagua

SEQ ID NO: 2051415 - RNA, 14 nt, Human
cacauuuuucagau

SEQ ID NO: 2051416 - RNA, 18 nt, Human
cacaucuugcucugcuga

SEQ ID NO: 2051417 - RNA, 19 nt, Human
cacaucuugcucugcugac

SEQ ID NO: 2051418 - RNA, 18 nt, Human
cacauuuccccagaccug

SEQ ID NO: 2051419 - RNA, 17 nt, Human
cacauuugauucugugu

SEQ ID NO: 2051420 - RNA, 18 nt, Human
cacauuuuucagauauaa

SEQ ID NO: 2051421 - RNA, 18 nt, Human
cacauuuuuuuuuuuaau

SEQ ID NO: 2051422 - RNA, 19 nt, Human
cacauuuuuuuuuuuaauu

SEQ ID NO: 2051423 - RNA, 21 nt, Human
cacauuuuuuuuuuuaauuuu

SEQ ID NO: 2051424 - RNA, 22 nt, Human
cacauuuuuuuuuuuaauuuug

SEQ ID NO: 2051425 - RNA, 17 nt, Human
cacaucuugcucugcug

SEQ ID NO: 2051426 - RNA, 16 nt, Human
cacaucuugcucugcu

SEQ ID NO: 2051427 - RNA, 14 nt, Human
cacauccuccgucc

SEQ ID NO: 2051428 - RNA, 18 nt, Human
cacauccuccguccagcc

SEQ ID NO: 2051429 - RNA, 17 nt, Human
cacauccuguguuucua

SEQ ID NO: 2051430 - RNA, 20 nt, Human
cacauccggaggagaagaag

SEQ ID NO: 2051431 - RNA, 24 nt, Human
cacaucagcuccacuuucagugaa

SEQ ID NO: 2051432 - RNA, 16 nt, Human
cacauccccgcuggcu

SEQ ID NO: 2051433 - RNA, 18 nt, Human
cacauccccgcuggcugg

SEQ ID NO: 2051434 - RNA, 18 nt, Human
cacaucagcuagcaaaag

SEQ ID NO: 2051435 - RNA, 19 nt, Human
cacaucagcuagcaaaaga

SEQ ID NO: 2051436 - RNA, 23 nt, Human
cacccaggagccccgaggccuuc

SEQ ID NO: 2051437 - RNA, 20 nt, Human
cacccaggagccccgaggcc

SEQ ID NO: 2051438 - RNA, 19 nt, Human
cacccagcccacuucugcc

SEQ ID NO: 2051439 - RNA, 12 nt, Human
cacccagcccau

SEQ ID NO: 2051440 - RNA, 13 nt, Human
cacccagcccauu

SEQ ID NO: 2051441 - RNA, 24 nt, Human
cacccaggagccccgaggccuucu

SEQ ID NO: 2051442 - RNA, 15 nt, Human
cacccagcccauucu

SEQ ID NO: 2051443 - RNA, 22 nt, Human
cacccagcccauucucucuccu

SEQ ID NO: 2051444 - RNA, 11 nt, Human
cacccaggagg

SEQ ID NO: 2051445 - RNA, 21 nt, Human
caccagcccuuagcagggaaa

SEQ ID NO: 2051446 - RNA, 15 nt, Human
caccagcagccugga

SEQ ID NO: 2051447 - RNA, 14 nt, Human
caccagccugcacu

SEQ ID NO: 2051448 - RNA, 20 nt, Human
caccagccuuucucccaggc

SEQ ID NO: 2051449 - RNA, 22 nt, Human
caccagccuuucucccaggcca

SEQ ID NO: 2051450 - RNA, 16 nt, Human
caccagccggggaaga

SEQ ID NO: 2051451 - RNA, 13 nt, Human
caccagccugcac

SEQ ID NO: 2051452 - RNA, 14 nt, Human
caccaacaucccau

SEQ ID NO: 2051453 - RNA, 14 nt, Human
caccagcagccugg

SEQ ID NO: 2051454 - RNA, 12 nt, Human
caccagcagccu

SEQ ID NO: 2051455 - RNA, 21 nt, Human
caccaggcugcucagggcugg

SEQ ID NO: 2051456 - RNA, 14 nt, Human
caccaggcugcuca

SEQ ID NO: 2051457 - RNA, 17 nt, Human
cacccagcccacuucug

SEQ ID NO: 2051458 - RNA, 16 nt, Human
cacccagcccacuucu

SEQ ID NO: 2051459 - RNA, 19 nt, Human
cacaguauuacuucugcua

SEQ ID NO: 2051460 - RNA, 18 nt, Human
cacaguauuacuucugcu

SEQ ID NO: 2051461 - RNA, 16 nt, Human
cacaguauuacuucug

SEQ ID NO: 2051462 - RNA, 14 nt, Human
cacagcucuguguu

SEQ ID NO: 2051463 - RNA, 10 nt, Human
cacagcucuu

SEQ ID NO: 2051464 - RNA, 23 nt, Human
cacagcucuguccugggagugag

SEQ ID NO: 2051465 - RNA, 20 nt, Human
cacagcucuguccugggagu

SEQ ID NO: 2051466 - RNA, 19 nt, Human
cacagcucccaccccaccc

SEQ ID NO: 2051467 - RNA, 22 nt, Human
cacagcucccaccccacccccu

SEQ ID NO: 2051468 - RNA, 14 nt, Human
cacagcucccaccc

SEQ ID NO: 2051469 - RNA, 15 nt, Human
cacagcucccacccc

SEQ ID NO: 2051470 - RNA, 16 nt, Human
cacagcucccacccca

SEQ ID NO: 2051471 - RNA, 17 nt, Human
cacagcucccaccccac

SEQ ID NO: 2051472 - RNA, 16 nt, Human
cacagcucaggaacua

SEQ ID NO: 2051473 - RNA, 15 nt, Human
cacagcuaccucuuc

SEQ ID NO: 2051474 - RNA, 20 nt, Human
cacagggcauccaacugaga

SEQ ID NO: 2051475 - RNA, 14 nt, Human
cacagggccccaga

SEQ ID NO: 2051476 - RNA, 19 nt, Human
cacagggccccagaaggca

SEQ ID NO: 2051477 - RNA, 22 nt, Human
cacagggccccagaaggcaggg

SEQ ID NO: 2051478 - RNA, 13 nt, Human
cacagggcagagc

SEQ ID NO: 2051479 - RNA, 14 nt, Human
cacagggcagagcc

SEQ ID NO: 2051480 - RNA, 17 nt, Human
cacagggcagagccggg

SEQ ID NO: 2051481 - RNA, 13 nt, Human
cacagggcuaaga

SEQ ID NO: 2051482 - RNA, 21 nt, Human
cacaggguucaaaaugucugu

SEQ ID NO: 2051483 - RNA, 14 nt, Human
cacaggguugggcc

SEQ ID NO: 2051484 - RNA, 16 nt, Human
cacaggguugggccca

SEQ ID NO: 2051485 - RNA, 23 nt, Human
cacagguaugaccuucuaggaag

SEQ ID NO: 2051486 - RNA, 23 nt, Human
cacaggguugggcccagaucugg

SEQ ID NO: 2051487 - RNA, 18 nt, Human
cacaggguugggcccaga

SEQ ID NO: 2051488 - RNA, 22 nt, Human
cacaggguugggcccagaucug

SEQ ID NO: 2051489 - RNA, 19 nt, Human
cacagaagugcuuucuucu

SEQ ID NO: 2051490 - RNA, 20 nt, Human
cacagcggggccccagggcu

SEQ ID NO: 2051491 - RNA, 23 nt, Human
caccuacaguguacagucuugua

SEQ ID NO: 2051492 - RNA, 16 nt, Human
caccuaagucucugug

SEQ ID NO: 2051493 - RNA, 17 nt, Human
caccuaagucucuguga

SEQ ID NO: 2051494 - RNA, 15 nt, Human
caccuaagucucugu

SEQ ID NO: 2051495 - RNA, 21 nt, Human
caccguuggggauuggggaag

SEQ ID NO: 2051496 - RNA, 14 nt, Human
caccguucauucag

SEQ ID NO: 2051497 - RNA, 12 nt, Human
caccuauuuuag

SEQ ID NO: 2051498 - RNA, 21 nt, Human
caccuacuacaucgcccucca

SEQ ID NO: 2051499 - RNA, 18 nt, Human
caccuaccuucaaagcug

SEQ ID NO: 2051500 - RNA, 19 nt, Human
caccuaccuucaaagcuga

SEQ ID NO: 2051501 - RNA, 20 nt, Human
caccuacuacaucgcccucc

SEQ ID NO: 2051502 - RNA, 14 nt, Human
caccuauuucaaaa

SEQ ID NO: 2051503 - RNA, 12 nt, Human
caccuuuauuaa

SEQ ID NO: 2051504 - RNA, 14 nt, Human
caccuuuauuaaaa

SEQ ID NO: 2051505 - RNA, 15 nt, Human
caccuuuauuaaaau

SEQ ID NO: 2051506 - RNA, 17 nt, Human
caccuuuauuaaaaucu

SEQ ID NO: 2051507 - RNA, 18 nt, Human
caccuuuauuaaaaucuu

SEQ ID NO: 2051508 - RNA, 13 nt, Human
caccuuggcucaa

SEQ ID NO: 2051509 - RNA, 22 nt, Human
caccuugcagcucuccccuucu

SEQ ID NO: 2051510 - RNA, 18 nt, Human
caccuugcaacacacaga

SEQ ID NO: 2051511 - RNA, 21 nt, Human
caccuugcaacacacagacac

SEQ ID NO: 2051512 - RNA, 19 nt, Human
caccuugacagggcacacc

SEQ ID NO: 2051513 - RNA, 15 nt, Human
caccuugcagcucuc

SEQ ID NO: 2051514 - RNA, 13 nt, Human
caccuugcagcuc

SEQ ID NO: 2051515 - RNA, 22 nt, Human
caccugccauuugcacccuccg

SEQ ID NO: 2051516 - RNA, 17 nt, Human
caccugccauuugcacc

SEQ ID NO: 2051517 - RNA, 16 nt, Human
caccuugcaacacaca

SEQ ID NO: 2051518 - RNA, 17 nt, Human
caccuugcaacacacag

SEQ ID NO: 2051519 - RNA, 17 nt, Human
cacuacucacagucucu

SEQ ID NO: 2051520 - RNA, 23 nt, Human
cacuacggaauaguuggcuagga

SEQ ID NO: 2051521 - RNA, 15 nt, Human
cacuaauacaccagg

SEQ ID NO: 2051522 - RNA, 20 nt, Human
cacggcaggacaacgaggaa

SEQ ID NO: 2051523 - RNA, 17 nt, Human
cacuaauuugauguuua

SEQ ID NO: 2051524 - RNA, 21 nt, Human
cacggaggcaucugcacccuc

SEQ ID NO: 2051525 - RNA, 20 nt, Human
cacggauccauguagcagga

SEQ ID NO: 2051526 - RNA, 23 nt, Human
cacggauccauguagcaggacug

SEQ ID NO: 2051527 - RNA, 16 nt, Human
cacggccaggccagag

SEQ ID NO: 2051528 - RNA, 15 nt, Human
cacggccaggccaga

SEQ ID NO: 2051529 - RNA, 14 nt, Human
cacggccaggccag

SEQ ID NO: 2051530 - RNA, 15 nt, Human
cacuccccaccuuca

SEQ ID NO: 2051531 - RNA, 14 nt, Human
cacuccccaccuuc

SEQ ID NO: 2051532 - RNA, 14 nt, Human
cacuagccucucca

SEQ ID NO: 2051533 - RNA, 16 nt, Human
cacuagccucuccagg

SEQ ID NO: 2051534 - RNA, 17 nt, Human
cacuagccucuccagga

SEQ ID NO: 2051535 - RNA, 16 nt, Human
cacuaggacucugagg

SEQ ID NO: 2051536 - RNA, 21 nt, Human
cacuagccucuccaggaaugc

SEQ ID NO: 2051537 - RNA, 17 nt, Human
cacuaggacucugaggc

SEQ ID NO: 2051538 - RNA, 18 nt, Human
cacuaggacucugaggcu

SEQ ID NO: 2051539 - RNA, 19 nt, Human
cacucuuauugcccacgcu

SEQ ID NO: 2051540 - RNA, 18 nt, Human
cacucuuauugcccacgc

SEQ ID NO: 2051541 - RNA, 17 nt, Human
cacucuuauugcccacg

SEQ ID NO: 2051542 - RNA, 13 nt, Human
cacuccccugcac

SEQ ID NO: 2051543 - RNA, 21 nt, Human
cacugaaacuucaagcaccag

SEQ ID NO: 2051544 - RNA, 20 nt, Human
cacugaaauauacacacagc

SEQ ID NO: 2051545 - RNA, 21 nt, Human
cacugaaaugccuuacuuugu

SEQ ID NO: 2051546 - RNA, 22 nt, Human
cacugaaaugccuuacuuugua

SEQ ID NO: 2051547 - RNA, 16 nt, Human
cacugaaauauacaca

SEQ ID NO: 2051548 - RNA, 19 nt, Human
cacuuagaaauugcauuuc

SEQ ID NO: 2051549 - RNA, 17 nt, Human
cacuuagaaauugcauu

SEQ ID NO: 2051550 - RNA, 22 nt, Human
cacuuaccuucaauaaaguauc

SEQ ID NO: 2051551 - RNA, 12 nt, Human
cacuguuucucu

SEQ ID NO: 2051552 - RNA, 14 nt, Human
cacuguuucucugc

SEQ ID NO: 2051553 - RNA, 18 nt, Human
cacuguuucucugcuguu

SEQ ID NO: 2051554 - RNA, 17 nt, Human
cacuguuuacaagaaaa

SEQ ID NO: 2051555 - RNA, 18 nt, Human
cacuguuuacaagaaaaa

SEQ ID NO: 2051556 - RNA, 17 nt, Human
cacuguugcccaggcug

SEQ ID NO: 2051557 - RNA, 20 nt, Human
cacuuagaaauugcauuucc

SEQ ID NO: 2051558 - RNA, 16 nt, Human
cacuugguuggguccu

SEQ ID NO: 2051559 - RNA, 19 nt, Human
cacuugguuggguccucac

SEQ ID NO: 2051560 - RNA, 20 nt, Human
cacuuguaauuuuguaucuu

SEQ ID NO: 2051561 - RNA, 20 nt, Human
cacuugguuggguccucaca

SEQ ID NO: 2051562 - RNA, 21 nt, Human
cacuugguuggguccucacau

SEQ ID NO: 2051563 - RNA, 16 nt, Human
cacuguugcccaggcu

SEQ ID NO: 2051564 - RNA, 15 nt, Human
cacuguugcccaggc

SEQ ID NO: 2051565 - RNA, 21 nt, Human
cacugguggcccgacagccug

SEQ ID NO: 2051566 - RNA, 13 nt, Human
cacugguggcccg

SEQ ID NO: 2051567 - RNA, 22 nt, Human
cacugguggcccgacagccugg

SEQ ID NO: 2051568 - RNA, 14 nt, Human
cacuguugcccagg

SEQ ID NO: 2051569 - RNA, 21 nt, Human
cacuggggaaauaacagcugu

SEQ ID NO: 2051570 - RNA, 17 nt, Human
cacuuucacauagaugu

SEQ ID NO: 2051571 - RNA, 14 nt, Human
cacuuuauuuacuu

SEQ ID NO: 2051572 - RNA, 15 nt, Human
cacuuuauuuacuuc

SEQ ID NO: 2051573 - RNA, 17 nt, Human
cacuuuauuuacuucgu

SEQ ID NO: 2051574 - RNA, 14 nt, Human
cacuuucauugcca

SEQ ID NO: 2051575 - RNA, 16 nt, Human
cacuuucauugccagu

SEQ ID NO: 2051576 - RNA, 17 nt, Human
cacuuucauugccagug

SEQ ID NO: 2051577 - RNA, 20 nt, Human
cacuuucauugccagugucu

SEQ ID NO: 2051578 - RNA, 21 nt, Human
cacuuucauugccagugucuu

SEQ ID NO: 2051579 - RNA, 22 nt, Human
cacuuucauugccagugucuuu

SEQ ID NO: 2051580 - RNA, 23 nt, Human
cacuuucauugccagugucuuuc

SEQ ID NO: 2051581 - RNA, 22 nt, Human
cacuuuccccgugggccauggc

SEQ ID NO: 2051582 - RNA, 17 nt, Human
cacuuucagugaaagca

SEQ ID NO: 2051583 - RNA, 14 nt, Human
cacuuucaggaaca

SEQ ID NO: 2051584 - RNA, 17 nt, Human
cacuuucaggaacacuc

SEQ ID NO: 2051585 - RNA, 18 nt, Human
cacuuucagugaaagcau

SEQ ID NO: 2051586 - RNA, 19 nt, Human
cacuuucagugaaagcauc

SEQ ID NO: 2051587 - RNA, 19 nt, Human
cagaaguuugucaagucaa

SEQ ID NO: 2051588 - RNA, 22 nt, Human
cagaauaaaguucugaguguuu

SEQ ID NO: 2051589 - RNA, 20 nt, Human
cagaauacuagccagagcuc

SEQ ID NO: 2051590 - RNA, 14 nt, Human
cagaauaaugaaug

SEQ ID NO: 2051591 - RNA, 23 nt, Human
cagaauaaugaauggacucaaac

SEQ ID NO: 2051592 - RNA, 17 nt, Human
cagaauaaucuuugggu

SEQ ID NO: 2051593 - RNA, 14 nt, Human
cagaauaguauuuu

SEQ ID NO: 2051594 - RNA, 16 nt, Human
cagaaauuagccgggc

SEQ ID NO: 2051595 - RNA, 14 nt, Human
cagaacagcagagg

SEQ ID NO: 2051596 - RNA, 14 nt, Human
cagaacacauucuu

SEQ ID NO: 2051597 - RNA, 11 nt, Human
cagaacacugu

SEQ ID NO: 2051598 - RNA, 12 nt, Human
cagaacagcaga

SEQ ID NO: 2051599 - RNA, 21 nt, Human
cagaacagcagagguucuuuu

SEQ ID NO: 2051600 - RNA, 19 nt, Human
cagaagucaugaagcccaa

SEQ ID NO: 2051601 - RNA, 18 nt, Human
cagaacacacuccaucag

SEQ ID NO: 2051602 - RNA, 22 nt, Human
cagaaauuuaauucauguuucu

SEQ ID NO: 2051603 - RNA, 23 nt, Human
cagaaauuuaauucauguuucuu

SEQ ID NO: 2051604 - RNA, 21 nt, Human
cagcuguuuaugcauagauaa

SEQ ID NO: 2051605 - RNA, 23 nt, Human
cagcuguugagccccuccuaguu

SEQ ID NO: 2051606 - RNA, 14 nt, Human
cagcuguuugucau

SEQ ID NO: 2051607 - RNA, 15 nt, Human
cagcuguuugucaua

SEQ ID NO: 2051608 - RNA, 20 nt, Human
cagcugugcucuggacaggc

SEQ ID NO: 2051609 - RNA, 19 nt, Human
cagcugugcucuggacagg

SEQ ID NO: 2051610 - RNA, 24 nt, Human
cagcugugcucuggacaggcaugu

SEQ ID NO: 2051611 - RNA, 18 nt, Human
cagcugauuuuaacaaua

SEQ ID NO: 2051612 - RNA, 19 nt, Human
cagcugagggugagugggu

SEQ ID NO: 2051613 - RNA, 19 nt, Human
cagcugaggucucuugagg

SEQ ID NO: 2051614 - RNA, 20 nt, Human
cagcugaggucucuugaggg

SEQ ID NO: 2051615 - RNA, 12 nt, Human
cagcugauuuua

SEQ ID NO: 2051616 - RNA, 12 nt, Human
cagcugccugca

SEQ ID NO: 2051617 - RNA, 22 nt, Human
cagcugccuggaagagcagccc

SEQ ID NO: 2051618 - RNA, 15 nt, Human
cagcugauuuuaaca

SEQ ID NO: 2051619 - RNA, 17 nt, Human
cagcugauuuuaacaau

SEQ ID NO: 2051620 - RNA, 22 nt, Human
cagcucccccgacggugggcau

SEQ ID NO: 2051621 - RNA, 22 nt, Human
cagcucccaccccacccccuuc

SEQ ID NO: 2051622 - RNA, 23 nt, Human
cagcucccaccccacccccuuca

SEQ ID NO: 2051623 - RNA, 20 nt, Human
cagcucccuaggagaccaag

SEQ ID NO: 2051624 - RNA, 18 nt, Human
cagcucccuaggagacca

SEQ ID NO: 2051625 - RNA, 19 nt, Human
cagcucccuaggagaccaa

SEQ ID NO: 2051626 - RNA, 15 nt, Human
cagcucccuaggaga

SEQ ID NO: 2051627 - RNA, 14 nt, Human
cagcucccucugcc

SEQ ID NO: 2051628 - RNA, 15 nt, Human
cagcucccucugccu

SEQ ID NO: 2051629 - RNA, 16 nt, Human
cagcucccucugccug

SEQ ID NO: 2051630 - RNA, 16 nt, Human
caggaaaagcugcuga

SEQ ID NO: 2051631 - RNA, 15 nt, Human
caggaaaagcugcug

SEQ ID NO: 2051632 - RNA, 18 nt, Human
caggaaaagcugcugaca

SEQ ID NO: 2051633 - RNA, 23 nt, Human
caggaaaacugacagaggagggc

SEQ ID NO: 2051634 - RNA, 21 nt, Human
cagcggggacagcuccuucug

SEQ ID NO: 2051635 - RNA, 18 nt, Human
cagcggggccccagggcu

SEQ ID NO: 2051636 - RNA, 19 nt, Human
cagcggggacagcuccuuc

SEQ ID NO: 2051637 - RNA, 18 nt, Human
cagcggggacagcuccuu

SEQ ID NO: 2051638 - RNA, 22 nt, Human
cagcgccuaguggggucucccu

SEQ ID NO: 2051639 - RNA, 23 nt, Human
cagcgccuaguggggucucccuc

SEQ ID NO: 2051640 - RNA, 12 nt, Human
cagccugcucca

SEQ ID NO: 2051641 - RNA, 14 nt, Human
cagccugcguggcu

SEQ ID NO: 2051642 - RNA, 15 nt, Human
cagccugcguggcug

SEQ ID NO: 2051643 - RNA, 16 nt, Human
cagccugcguggcuga

SEQ ID NO: 2051644 - RNA, 17 nt, Human
cagccugcguggcugac

SEQ ID NO: 2051645 - RNA, 18 nt, Human
cagccugcguggcugacc

SEQ ID NO: 2051646 - RNA, 19 nt, Human
cagccugcguggcugaccc

SEQ ID NO: 2051647 - RNA, 21 nt, Human
cagccugcguggcugaccccc

SEQ ID NO: 2051648 - RNA, 23 nt, Human
cagccugcguggcugaccccccu

SEQ ID NO: 2051649 - RNA, 19 nt, Human
cagccugcuaauuccccag

SEQ ID NO: 2051650 - RNA, 19 nt, Human
cagccucugagccccuggg

SEQ ID NO: 2051651 - RNA, 21 nt, Human
cagccucugagccccugggac

SEQ ID NO: 2051652 - RNA, 18 nt, Human
cagccucugagccccugg

SEQ ID NO: 2051653 - RNA, 17 nt, Human
cagccucugaaaaccaa

SEQ ID NO: 2051654 - RNA, 12 nt, Human
cagccucugaag

SEQ ID NO: 2051655 - RNA, 20 nt, Human
cagccucugaaguuggacag

SEQ ID NO: 2051656 - RNA, 21 nt, Human
cagccucugaaguuggacagc

SEQ ID NO: 2051657 - RNA, 20 nt, Human
cagccgcuccugucugccag

SEQ ID NO: 2051658 - RNA, 21 nt, Human
cagccgcuccugucugccagc

SEQ ID NO: 2051659 - RNA, 22 nt, Human
cagccgcuccugucugccagcc

SEQ ID NO: 2051660 - RNA, 23 nt, Human
cagccgcuccugucugccagcca

SEQ ID NO: 2051661 - RNA, 20 nt, Human
cagcccuuugggaggcugag

SEQ ID NO: 2051662 - RNA, 23 nt, Human
cagcccuuugggaggcugaggcg

SEQ ID NO: 2051663 - RNA, 19 nt, Human
cagcccuuugggaggcuga

SEQ ID NO: 2051664 - RNA, 14 nt, Human
cagccgcuccuguc

SEQ ID NO: 2051665 - RNA, 16 nt, Human
cagccgcuccugucug

SEQ ID NO: 2051666 - RNA, 17 nt, Human
cagccgcuccugucugc

SEQ ID NO: 2051667 - RNA, 18 nt, Human
cagccgcuccugucugcc

SEQ ID NO: 2051668 - RNA, 19 nt, Human
cagccgcuccugucugcca

SEQ ID NO: 2051669 - RNA, 20 nt, Human
cagcccuugagcuccccaaa

SEQ ID NO: 2051670 - RNA, 12 nt, Human
cagccagcucuc

SEQ ID NO: 2051671 - RNA, 15 nt, Human
cagccagcucucagc

SEQ ID NO: 2051672 - RNA, 16 nt, Human
cagccagcucucagcc

SEQ ID NO: 2051673 - RNA, 21 nt, Human
cagccagcucucagccaacga

SEQ ID NO: 2051674 - RNA, 17 nt, Human
cagccagcucucagcca

SEQ ID NO: 2051675 - RNA, 18 nt, Human
cagccagcucucagccaa

SEQ ID NO: 2051676 - RNA, 20 nt, Human
cagcaucauggagguuugaa

SEQ ID NO: 2051677 - RNA, 19 nt, Human
cagcagugagucucuucag

SEQ ID NO: 2051678 - RNA, 21 nt, Human
cagcagugagucucuucagaa

SEQ ID NO: 2051679 - RNA, 14 nt, Human
cagcaguuguuauu

SEQ ID NO: 2051680 - RNA, 17 nt, Human
cagcaguuugggagguc

SEQ ID NO: 2051681 - RNA, 14 nt, Human
cagcauaagggagc

SEQ ID NO: 2051682 - RNA, 17 nt, Human
cagcauaagggagcgua

SEQ ID NO: 2051683 - RNA, 17 nt, Human
cagcauagaaguaacuu

SEQ ID NO: 2051684 - RNA, 12 nt, Human
cagauugaaaag

SEQ ID NO: 2051685 - RNA, 14 nt, Human
cagauugaaaagga

SEQ ID NO: 2051686 - RNA, 17 nt, Human
cagauugcaacaggcug

SEQ ID NO: 2051687 - RNA, 11 nt, Human
cagauccuacc

SEQ ID NO: 2051688 - RNA, 12 nt, Human
cagauccuaccc

SEQ ID NO: 2051689 - RNA, 20 nt, Human
cagaucauagauuucugauu

SEQ ID NO: 2051690 - RNA, 21 nt, Human
cagaucauagauuucugauuu

SEQ ID NO: 2051691 - RNA, 23 nt, Human
cagaucauagauuucugauuuua

SEQ ID NO: 2051692 - RNA, 17 nt, Human
cagaguaagcugcuuuu

SEQ ID NO: 2051693 - RNA, 14 nt, Human
cagaaucauugcuu

SEQ ID NO: 2051694 - RNA, 15 nt, Human
cagaaucauugcuua

SEQ ID NO: 2051695 - RNA, 20 nt, Human
cagaaucauugcuuaugaca

SEQ ID NO: 2051696 - RNA, 21 nt, Human
cagaaucgcuccaccuugcag

SEQ ID NO: 2051697 - RNA, 17 nt, Human
cagaaguguuucaugca

SEQ ID NO: 2051698 - RNA, 23 nt, Human
cagagggguggguuccucuuccc

SEQ ID NO: 2051699 - RNA, 22 nt, Human
cagaucacagcuucagccagga

SEQ ID NO: 2051700 - RNA, 18 nt, Human
cagaucacagcuucagcc

SEQ ID NO: 2051701 - RNA, 14 nt, Human
cagaucacgagguc

SEQ ID NO: 2051702 - RNA, 18 nt, Human
cagagguugcagugagcu

SEQ ID NO: 2051703 - RNA, 17 nt, Human
cagagguugcagugugg

SEQ ID NO: 2051704 - RNA, 18 nt, Human
cagagguagggcugccac

SEQ ID NO: 2051705 - RNA, 16 nt, Human
caggggaauauuuuau

SEQ ID NO: 2051706 - RNA, 17 nt, Human
caggggaauauuuuauu

SEQ ID NO: 2051707 - RNA, 18 nt, Human
caggggaauauuuuauuc

SEQ ID NO: 2051708 - RNA, 19 nt, Human
caggggaauauuuuauuca

SEQ ID NO: 2051709 - RNA, 23 nt, Human
caggggaauauuuuauucaaggu

SEQ ID NO: 2051710 - RNA, 21 nt, Human
cagggcugacacguccacccc

SEQ ID NO: 2051711 - RNA, 20 nt, Human
caggggaaaaucagccugcu

SEQ ID NO: 2051712 - RNA, 19 nt, Human
caggggaaaaucagccugc

SEQ ID NO: 2051713 - RNA, 23 nt, Human
cagggcucagcggggacagcucc

SEQ ID NO: 2051714 - RNA, 21 nt, Human
cagggcucagcggggacagcu

SEQ ID NO: 2051715 - RNA, 17 nt, Human
cagggauggggccacag

SEQ ID NO: 2051716 - RNA, 18 nt, Human
cagggauggggccacagc

SEQ ID NO: 2051717 - RNA, 19 nt, Human
cagggauggggccacagcc

SEQ ID NO: 2051718 - RNA, 15 nt, Human
cagggagcugggaca

SEQ ID NO: 2051719 - RNA, 23 nt, Human
cagggaugccaucugugggcacg

SEQ ID NO: 2051720 - RNA, 22 nt, Human
cagggagcggaaagcagcucaa

SEQ ID NO: 2051721 - RNA, 18 nt, Human
cagggagcggaaagcagc

SEQ ID NO: 2051722 - RNA, 19 nt, Human
cagggagcggaaagcagcu

SEQ ID NO: 2051723 - RNA, 20 nt, Human
caggcugggcuucaguggca

SEQ ID NO: 2051724 - RNA, 22 nt, Human
caggcugggcuucaguggcagc

SEQ ID NO: 2051725 - RNA, 21 nt, Human
caggcugggcuucaguggcag

SEQ ID NO: 2051726 - RNA, 13 nt, Human
cagggagcggaaa

SEQ ID NO: 2051727 - RNA, 16 nt, Human
cagggagcggaaagca

SEQ ID NO: 2051728 - RNA, 17 nt, Human
cagggagcggaaagcag

SEQ ID NO: 2051729 - RNA, 16 nt, Human
caggccagagggagug

SEQ ID NO: 2051730 - RNA, 15 nt, Human
caggcacacuucuuc

SEQ ID NO: 2051731 - RNA, 15 nt, Human
caggcaauggccuaa

SEQ ID NO: 2051732 - RNA, 22 nt, Human
caggcaauggccuaaacuucag

SEQ ID NO: 2051733 - RNA, 14 nt, Human
caggcagagaauca

SEQ ID NO: 2051734 - RNA, 15 nt, Human
caggcagagaaucau

SEQ ID NO: 2051735 - RNA, 23 nt, Human
caggcagagaaucauacuuagca

SEQ ID NO: 2051736 - RNA, 15 nt, Human
caggccagagggagu

SEQ ID NO: 2051737 - RNA, 13 nt, Human
caggccagaggga

SEQ ID NO: 2051738 - RNA, 18 nt, Human
caggcagauacaggaaaa

SEQ ID NO: 2051739 - RNA, 15 nt, Human
caggccacuugauga

SEQ ID NO: 2051740 - RNA, 16 nt, Human
caggugccccucucuc

SEQ ID NO: 2051741 - RNA, 18 nt, Human
caggugccccucucucca

SEQ ID NO: 2051742 - RNA, 22 nt, Human
caggugccccucucuccaucag

SEQ ID NO: 2051743 - RNA, 23 nt, Human
cagguugucugaagucacugcac

SEQ ID NO: 2051744 - RNA, 18 nt, Human
cagguuguaguaaagaaa

SEQ ID NO: 2051745 - RNA, 22 nt, Human
cagguugucugaagucacugca

SEQ ID NO: 2051746 - RNA, 21 nt, Human
cagguuggugggggccucggu

SEQ ID NO: 2051747 - RNA, 15 nt, Human
cagguuuuguaaaga

SEQ ID NO: 2051748 - RNA, 14 nt, Human
cagguuuaagcugu

SEQ ID NO: 2051749 - RNA, 19 nt, Human
cagguuguaguaaagaaau

SEQ ID NO: 2051750 - RNA, 23 nt, Human
caggugauccacccaccucagcc

SEQ ID NO: 2051751 - RNA, 22 nt, Human
caggugauccacccaccucagc

SEQ ID NO: 2051752 - RNA, 21 nt, Human
caggugauccacccaccucag

SEQ ID NO: 2051753 - RNA, 17 nt, Human
cagucaccugcccagau

SEQ ID NO: 2051754 - RNA, 13 nt, Human
caguaaagagaaa

SEQ ID NO: 2051755 - RNA, 14 nt, Human
caguaaagagaaac

SEQ ID NO: 2051756 - RNA, 15 nt, Human
caguaaagagaaacu

SEQ ID NO: 2051757 - RNA, 16 nt, Human
caguaaagagaaacuu

SEQ ID NO: 2051758 - RNA, 17 nt, Human
caguaaagagaaacuuu

SEQ ID NO: 2051759 - RNA, 18 nt, Human
caguaaagagaaacuuug

SEQ ID NO: 2051760 - RNA, 19 nt, Human
caguaaagagaaacuuugu

SEQ ID NO: 2051761 - RNA, 20 nt, Human
caguaaagagaaacuuugug

SEQ ID NO: 2051762 - RNA, 23 nt, Human
caguaaagagaaacuuugugcua

SEQ ID NO: 2051763 - RNA, 17 nt, Human
cagucaaggaguggcuu

SEQ ID NO: 2051764 - RNA, 12 nt, Human
cagugcaucuca

SEQ ID NO: 2051765 - RNA, 17 nt, Human
cagucuggaaugcagug

SEQ ID NO: 2051766 - RNA, 15 nt, Human
cagucuggaaugcag

SEQ ID NO: 2051767 - RNA, 23 nt, Human
cagucugcuuauccuuccacgga

SEQ ID NO: 2051768 - RNA, 18 nt, Human
cagucugcugcccuccau

SEQ ID NO: 2051769 - RNA, 21 nt, Human
cagucugcugcccuccauccc

SEQ ID NO: 2051770 - RNA, 22 nt, Human
cagucugcugcccuccaucccg

SEQ ID NO: 2051771 - RNA, 18 nt, Human
cagugcaucucagcccac

SEQ ID NO: 2051772 - RNA, 17 nt, Human
cagugcaucucagccca

SEQ ID NO: 2051773 - RNA, 16 nt, Human
cagugcaucucagccc

SEQ ID NO: 2051774 - RNA, 15 nt, Human
cagugcaucucagcc

SEQ ID NO: 2051775 - RNA, 15 nt, Human
cagucucuuuaaucu

SEQ ID NO: 2051776 - RNA, 19 nt, Human
cagucucuuuaaucuucag

SEQ ID NO: 2051777 - RNA, 20 nt, Human
cagucucuuuaaucuucagu

SEQ ID NO: 2051778 - RNA, 22 nt, Human
cagucucuuuaaucuucaguuu

SEQ ID NO: 2051779 - RNA, 13 nt, Human
cagucugaaguuu

SEQ ID NO: 2051780 - RNA, 14 nt, Human
cagucugcugcccu

SEQ ID NO: 2051781 - RNA, 15 nt, Human
cagucugcugcccuc

SEQ ID NO: 2051782 - RNA, 23 nt, Human
cagugggagcugccuguucagcu

SEQ ID NO: 2051783 - RNA, 20 nt, Human
cagugggagcugccuguuca

SEQ ID NO: 2051784 - RNA, 17 nt, Human
cagugcccacaggauca

SEQ ID NO: 2051785 - RNA, 15 nt, Human
cagugcccacaggau

SEQ ID NO: 2051786 - RNA, 13 nt, Human
cagugcccacagg

SEQ ID NO: 2051787 - RNA, 21 nt, Human
caguggugcgaucuggguuca

SEQ ID NO: 2051788 - RNA, 20 nt, Human
caguggugcgaucuggguuc

SEQ ID NO: 2051789 - RNA, 16 nt, Human
cauguuggccaggcug

SEQ ID NO: 2051790 - RNA, 20 nt, Human
cauguugguauuuaucuauu

SEQ ID NO: 2051791 - RNA, 15 nt, Human
cauguuggccaggcu

SEQ ID NO: 2051792 - RNA, 14 nt, Human
cauguuggccaggc

SEQ ID NO: 2051793 - RNA, 14 nt, Human
cauguuaugauaaa

SEQ ID NO: 2051794 - RNA, 20 nt, Human
cauguuaugauaaaaaauuu

SEQ ID NO: 2051795 - RNA, 21 nt, Human
cauguuaugauaaaaaauuuu

SEQ ID NO: 2051796 - RNA, 22 nt, Human
cauguuaugauaaaaaauuuug

SEQ ID NO: 2051797 - RNA, 23 nt, Human
cauguuaugauaaaaaauuuugu

SEQ ID NO: 2051798 - RNA, 17 nt, Human
cauguuacugaccagca

SEQ ID NO: 2051799 - RNA, 14 nt, Human
cauguuaggaaaau

SEQ ID NO: 2051800 - RNA, 18 nt, Human
cauguuaggaaaauuuca

SEQ ID NO: 2051801 - RNA, 19 nt, Human
cauguuaggaaaauuucac

SEQ ID NO: 2051802 - RNA, 23 nt, Human
caugucccuaccgagucucuucu

SEQ ID NO: 2051803 - RNA, 17 nt, Human
caugucccuacaccccu

SEQ ID NO: 2051804 - RNA, 19 nt, Human
caugucaaacgugaaaaug

SEQ ID NO: 2051805 - RNA, 14 nt, Human
caugucaaacguga

SEQ ID NO: 2051806 - RNA, 22 nt, Human
caugucccuaccgagucucuuc

SEQ ID NO: 2051807 - RNA, 16 nt, Human
caugucccuaccgagu

SEQ ID NO: 2051808 - RNA, 23 nt, Human
cauguagcaaucagauuuuccug

SEQ ID NO: 2051809 - RNA, 14 nt, Human
cauguagcaggacu

SEQ ID NO: 2051810 - RNA, 20 nt, Human
cauguagcaggacugaauug

SEQ ID NO: 2051811 - RNA, 23 nt, Human
cauucuagguaggggcccacuuc

SEQ ID NO: 2051812 - RNA, 13 nt, Human
cauuauauugcaa

SEQ ID NO: 2051813 - RNA, 15 nt, Human
cauuauauugcaaug

SEQ ID NO: 2051814 - RNA, 16 nt, Human
cauuauauugcaauga

SEQ ID NO: 2051815 - RNA, 20 nt, Human
cauuauaacugaaggagaag

SEQ ID NO: 2051816 - RNA, 18 nt, Human
cauuauaacugaaggaga

SEQ ID NO: 2051817 - RNA, 13 nt, Human
cauuauaaacgug

SEQ ID NO: 2051818 - RNA, 11 nt, Human
cauguuuaaga

SEQ ID NO: 2051819 - RNA, 13 nt, Human
cauguuuaagauu

SEQ ID NO: 2051820 - RNA, 14 nt, Human
cauguuuaagauuu

SEQ ID NO: 2051821 - RNA, 16 nt, Human
cauguuuaagauuuaa

SEQ ID NO: 2051822 - RNA, 19 nt, Human
cauguuuaagauuuaauuu

SEQ ID NO: 2051823 - RNA, 16 nt, Human
cauggcuaaggcacca

SEQ ID NO: 2051824 - RNA, 18 nt, Human
cauggcuaaggcaccagc

SEQ ID NO: 2051825 - RNA, 19 nt, Human
cauggcuaaggcaccagcc

SEQ ID NO: 2051826 - RNA, 22 nt, Human
cauggcuaaggcaccagccggg

SEQ ID NO: 2051827 - RNA, 22 nt, Human
cauggcuaagcuuaaaaaaaac

SEQ ID NO: 2051828 - RNA, 14 nt, Human
cauggcucacugca

SEQ ID NO: 2051829 - RNA, 15 nt, Human
cauggcucacugcag

SEQ ID NO: 2051830 - RNA, 16 nt, Human
cauggcucacugcagc

SEQ ID NO: 2051831 - RNA, 20 nt, Human
cauggcuccagucugcugcc

SEQ ID NO: 2051832 - RNA, 22 nt, Human
cauggcuccagucugcugcccu

SEQ ID NO: 2051833 - RNA, 13 nt, Human
cauggcuccaguc

SEQ ID NO: 2051834 - RNA, 14 nt, Human
cauggcuccagucu

SEQ ID NO: 2051835 - RNA, 15 nt, Human
cauggcuccagucug

SEQ ID NO: 2051836 - RNA, 13 nt, Human
caugcucucugca

SEQ ID NO: 2051837 - RNA, 20 nt, Human
caugcuaccugaucccacuc

SEQ ID NO: 2051838 - RNA, 22 nt, Human
caugcuaccugaucccacuccu

SEQ ID NO: 2051839 - RNA, 19 nt, Human
caugcugaaggcugaaaga

SEQ ID NO: 2051840 - RNA, 21 nt, Human
caugcucucugcagccagccc

SEQ ID NO: 2051841 - RNA, 14 nt, Human
caugcucucugcag

SEQ ID NO: 2051842 - RNA, 15 nt, Human
caugcucucugcagc

SEQ ID NO: 2051843 - RNA, 16 nt, Human
caugcucucugcagcc

SEQ ID NO: 2051844 - RNA, 19 nt, Human
caugcucucugcagccagc

SEQ ID NO: 2051845 - RNA, 20 nt, Human
caugcucucugcagccagcc

SEQ ID NO: 2051846 - RNA, 23 nt, Human
caugcucucugcagccagcccag

SEQ ID NO: 2051847 - RNA, 18 nt, Human
caugcuggacaggucugg

SEQ ID NO: 2051848 - RNA, 20 nt, Human
caugcuggacaggucuggga

SEQ ID NO: 2051849 - RNA, 22 nt, Human
caugcuggacaggucugggaga

SEQ ID NO: 2051850 - RNA, 12 nt, Human
caugcugcuuua

SEQ ID NO: 2051851 - RNA, 13 nt, Human
caugcugcuuuaa

SEQ ID NO: 2051852 - RNA, 14 nt, Human
caugcugcuuuaau

SEQ ID NO: 2051853 - RNA, 18 nt, Human
caugcugcuuuaauugug

SEQ ID NO: 2051854 - RNA, 20 nt, Human
caugcugcuuuaauugugaa

SEQ ID NO: 2051855 - RNA, 21 nt, Human
caugcugcuuuaauugugaau

SEQ ID NO: 2051856 - RNA, 20 nt, Human
caugcuggggcaagucccug

SEQ ID NO: 2051857 - RNA, 19 nt, Human
caugcuggcucccagggcc

SEQ ID NO: 2051858 - RNA, 20 nt, Human
caugcuggcucccagggcca

SEQ ID NO: 2051859 - RNA, 22 nt, Human
caugcuggcucccagggccaug

SEQ ID NO: 2051860 - RNA, 22 nt, Human
caugauguuaaccagaauaaag

SEQ ID NO: 2051861 - RNA, 19 nt, Human
caugauguuaaccagaaua

SEQ ID NO: 2051862 - RNA, 19 nt, Human
caucacuggagcaccaggc

SEQ ID NO: 2051863 - RNA, 18 nt, Human
cauauucuguuggccagu

SEQ ID NO: 2051864 - RNA, 17 nt, Human
cauauucuguuggccag

SEQ ID NO: 2051865 - RNA, 17 nt, Human
cauauuccugcagccug

SEQ ID NO: 2051866 - RNA, 18 nt, Human
cauauuccugcagccugg

SEQ ID NO: 2051867 - RNA, 21 nt, Human
cauauuccugcagccuggagg

SEQ ID NO: 2051868 - RNA, 22 nt, Human
cauauguuucgcugauauaugu

SEQ ID NO: 2051869 - RNA, 22 nt, Human
cauauuccugcagccuggaggc

SEQ ID NO: 2051870 - RNA, 15 nt, Human
cauccuggcacccgg

SEQ ID NO: 2051871 - RNA, 12 nt, Human
caucccuacccc

SEQ ID NO: 2051872 - RNA, 14 nt, Human
caucccuacccccu

SEQ ID NO: 2051873 - RNA, 16 nt, Human
caucccgcucuuuucc

SEQ ID NO: 2051874 - RNA, 17 nt, Human
caucccgcucuuuuccu

SEQ ID NO: 2051875 - RNA, 18 nt, Human
caucccgcucuuuuccua

SEQ ID NO: 2051876 - RNA, 20 nt, Human
caucccgugcaaaacaugcu

SEQ ID NO: 2051877 - RNA, 21 nt, Human
caucccgugcaaaacaugcua

SEQ ID NO: 2051878 - RNA, 12 nt, Human
caucacuucccu

SEQ ID NO: 2051879 - RNA, 14 nt, Human
caucacuucccuac

SEQ ID NO: 2051880 - RNA, 21 nt, Human
cauccccuguagagugggagc

SEQ ID NO: 2051881 - RNA, 23 nt, Human
caucccgacauggacccggagcu

SEQ ID NO: 2051882 - RNA, 22 nt, Human
cauccuggcacccggccccugc

SEQ ID NO: 2051883 - RNA, 22 nt, Human
caucggugaaacuaacagauaa

SEQ ID NO: 2051884 - RNA, 17 nt, Human
caucgguccugucuccc

SEQ ID NO: 2051885 - RNA, 22 nt, Human
caucgguccugucuccccucug

SEQ ID NO: 2051886 - RNA, 21 nt, Human
caucggugaaacuaacagaua

SEQ ID NO: 2051887 - RNA, 17 nt, Human
caucgguguccauuuau

SEQ ID NO: 2051888 - RNA, 18 nt, Human
caucgguguccauuuaua

SEQ ID NO: 2051889 - RNA, 15 nt, Human
caucguaggugauuu

SEQ ID NO: 2051890 - RNA, 18 nt, Human
caucguaggugauuugaa

SEQ ID NO: 2051891 - RNA, 21 nt, Human
caucguauaacacaauaugaa

SEQ ID NO: 2051892 - RNA, 16 nt, Human
caucuggaaaauaaaa

SEQ ID NO: 2051893 - RNA, 17 nt, Human
caucuggaaaauaaaag

SEQ ID NO: 2051894 - RNA, 22 nt, Human
caucuggaaaauaaaaggucua

SEQ ID NO: 2051895 - RNA, 15 nt, Human
caucugugauucccu

SEQ ID NO: 2051896 - RNA, 17 nt, Human
caucugugggcacgcug

SEQ ID NO: 2051897 - RNA, 14 nt, Human
caucuguguccugg

SEQ ID NO: 2051898 - RNA, 17 nt, Human
ccaaucaagauaaagga

SEQ ID NO: 2051899 - RNA, 17 nt, Human
ccaauauuuaccagacc

SEQ ID NO: 2051900 - RNA, 14 nt, Human
ccaauauuuguaga

SEQ ID NO: 2051901 - RNA, 18 nt, Human
ccaauauuucucagacau

SEQ ID NO: 2051902 - RNA, 22 nt, Human
ccaagcuggagugcaguggugc

SEQ ID NO: 2051903 - RNA, 15 nt, Human
ccaaugauggucacc

SEQ ID NO: 2051904 - RNA, 19 nt, Human
ccaaugaggucugaaaugg

SEQ ID NO: 2051905 - RNA, 13 nt, Human
ccaagcucugcuc

SEQ ID NO: 2051906 - RNA, 17 nt, Human
ccaagcucugcuccucu

SEQ ID NO: 2051907 - RNA, 12 nt, Human
ccaagcucugcu

SEQ ID NO: 2051908 - RNA, 14 nt, Human
ccaagcuccuuggg

SEQ ID NO: 2051909 - RNA, 15 nt, Human
ccaagcuccuuggga

SEQ ID NO: 2051910 - RNA, 17 nt, Human
ccaagcuccuugggagg

SEQ ID NO: 2051911 - RNA, 19 nt, Human
ccaagcuccuugggaggcc

SEQ ID NO: 2051912 - RNA, 18 nt, Human
ccaagcucugcuccucuc

SEQ ID NO: 2051913 - RNA, 22 nt, Human
ccaagcuccuugggaggcccca

SEQ ID NO: 2051914 - RNA, 22 nt, Human
ccaacugagaaaacgaaacugc

SEQ ID NO: 2051915 - RNA, 15 nt, Human
ccaacuccuggaagc

SEQ ID NO: 2051916 - RNA, 19 nt, Human
ccaacuccuggaagcugug

SEQ ID NO: 2051917 - RNA, 22 nt, Human
ccaacuccuggaagcugugucc

SEQ ID NO: 2051918 - RNA, 14 nt, Human
ccaacugcugcccc

SEQ ID NO: 2051919 - RNA, 15 nt, Human
ccaacugcugcccca

SEQ ID NO: 2051920 - RNA, 15 nt, Human
ccaacuggaagcaca

SEQ ID NO: 2051921 - RNA, 16 nt, Human
ccaacuggaagcacag

SEQ ID NO: 2051922 - RNA, 17 nt, Human
ccaacuggaagcacaga

SEQ ID NO: 2051923 - RNA, 16 nt, Human
ccaacuggcccucuuc

SEQ ID NO: 2051924 - RNA, 18 nt, Human
ccaacuggcccucuucuu

SEQ ID NO: 2051925 - RNA, 16 nt, Human
ccaacugggcccaaga

SEQ ID NO: 2051926 - RNA, 17 nt, Human
ccaacugggcccaagac

SEQ ID NO: 2051927 - RNA, 18 nt, Human
ccaaauguaauugaauaa

SEQ ID NO: 2051928 - RNA, 22 nt, Human
ccaaauguaauugaauaaaguu

SEQ ID NO: 2051929 - RNA, 13 nt, Human
cauuugugugugu

SEQ ID NO: 2051930 - RNA, 19 nt, Human
cauuugugugugugcaagu

SEQ ID NO: 2051931 - RNA, 11 nt, Human
cauuugugagg

SEQ ID NO: 2051932 - RNA, 15 nt, Human
cauuugugaggccca

SEQ ID NO: 2051933 - RNA, 12 nt, Human
cauuugugaggc

SEQ ID NO: 2051934 - RNA, 14 nt, Human
cauuuguauguugu

SEQ ID NO: 2051935 - RNA, 15 nt, Human
cauuuguauguugug

SEQ ID NO: 2051936 - RNA, 23 nt, Human
cauuuguauguugugaagauguu

SEQ ID NO: 2051937 - RNA, 22 nt, Human
cauuugugugugugcaagugug

SEQ ID NO: 2051938 - RNA, 15 nt, Human
ccacccuuugggggg

SEQ ID NO: 2051939 - RNA, 23 nt, Human
ccacccuuuggggggggcccgcc

SEQ ID NO: 2051940 - RNA, 21 nt, Human
ccacgcccucauuacggcucc

SEQ ID NO: 2051941 - RNA, 23 nt, Human
ccacgcccucauuacggcuccuc

SEQ ID NO: 2051942 - RNA, 18 nt, Human
ccacagaugccuccaccc

SEQ ID NO: 2051943 - RNA, 13 nt, Human
ccacagcucccac

SEQ ID NO: 2051944 - RNA, 15 nt, Human
ccacagcucccaccc

SEQ ID NO: 2051945 - RNA, 16 nt, Human
ccacagcucccacccc

SEQ ID NO: 2051946 - RNA, 17 nt, Human
ccacagcucccacccca

SEQ ID NO: 2051947 - RNA, 17 nt, Human
ccacagccucugccugu

SEQ ID NO: 2051948 - RNA, 17 nt, Human
ccacagcagccucugaa

SEQ ID NO: 2051949 - RNA, 19 nt, Human
ccacagcagccucugaagu

SEQ ID NO: 2051950 - RNA, 20 nt, Human
ccacagcagccucugaaguu

SEQ ID NO: 2051951 - RNA, 12 nt, Human
ccacagcaggug

SEQ ID NO: 2051952 - RNA, 20 nt, Human
ccacccuuggaggcugucuu

SEQ ID NO: 2051953 - RNA, 19 nt, Human
ccacccuuggccugucuca

SEQ ID NO: 2051954 - RNA, 16 nt, Human
ccacccuuggccuguc

SEQ ID NO: 2051955 - RNA, 17 nt, Human
ccacccuuggccugucu

SEQ ID NO: 2051956 - RNA, 12 nt, Human
ccacccuuggcc

SEQ ID NO: 2051957 - RNA, 13 nt, Human
ccacccuuggccu

SEQ ID NO: 2051958 - RNA, 14 nt, Human
ccacccuuggccug

SEQ ID NO: 2051959 - RNA, 15 nt, Human
ccacccuuggccugu

SEQ ID NO: 2051960 - RNA, 14 nt, Human
ccacccuuccccuc

SEQ ID NO: 2051961 - RNA, 18 nt, Human
ccaccauauucagugcug

SEQ ID NO: 2051962 - RNA, 22 nt, Human
ccaccauauucagugcuguggc

SEQ ID NO: 2051963 - RNA, 23 nt, Human
ccaccauauucagugcuguggcc

SEQ ID NO: 2051964 - RNA, 19 nt, Human
ccacagcucccaccccacc

SEQ ID NO: 2051965 - RNA, 17 nt, Human
ccaccacacccagccca

SEQ ID NO: 2051966 - RNA, 17 nt, Human
ccaccacaccgcagaag

SEQ ID NO: 2051967 - RNA, 23 nt, Human
ccacagccagaaccccgagcccu

SEQ ID NO: 2051968 - RNA, 11 nt, Human
ccaccacccaa

SEQ ID NO: 2051969 - RNA, 14 nt, Human
ccaccaccccagcu

SEQ ID NO: 2051970 - RNA, 14 nt, Human
ccacucucauuccc

SEQ ID NO: 2051971 - RNA, 16 nt, Human
ccacucucauucccca

SEQ ID NO: 2051972 - RNA, 17 nt, Human
ccacucucauuccccag

SEQ ID NO: 2051973 - RNA, 18 nt, Human
ccacucucauuccccagg

SEQ ID NO: 2051974 - RNA, 19 nt, Human
ccacucucauuccccaggu

SEQ ID NO: 2051975 - RNA, 12 nt, Human
ccacucucccca

SEQ ID NO: 2051976 - RNA, 13 nt, Human
ccacucuccccac

SEQ ID NO: 2051977 - RNA, 14 nt, Human
ccacucuccccaca

SEQ ID NO: 2051978 - RNA, 15 nt, Human
ccacucuccccacac

SEQ ID NO: 2051979 - RNA, 16 nt, Human
ccacucuccccacacu

SEQ ID NO: 2051980 - RNA, 21 nt, Human
ccacucuacccucccaccccc

SEQ ID NO: 2051981 - RNA, 19 nt, Human
ccacucuacccucccaccc

SEQ ID NO: 2051982 - RNA, 20 nt, Human
ccacucuacccucccacccc

SEQ ID NO: 2051983 - RNA, 18 nt, Human
ccacucuacccucccacc

SEQ ID NO: 2051984 - RNA, 12 nt, Human
ccacuccuccaa

SEQ ID NO: 2051985 - RNA, 16 nt, Human
ccacuccuccaaagga

SEQ ID NO: 2051986 - RNA, 13 nt, Human
cuggcagccgugc

SEQ ID NO: 2051987 - RNA, 18 nt, Human
cuggcucuguggcuugcu

SEQ ID NO: 2051988 - RNA, 14 nt, Human
cuggcucuguggcu

SEQ ID NO: 2051989 - RNA, 15 nt, Human
cuggcucuguggcuu

SEQ ID NO: 2051990 - RNA, 17 nt, Human
cugggacuacaggugug

SEQ ID NO: 2051991 - RNA, 21 nt, Human
cugggacuacaggcacccacc

SEQ ID NO: 2051992 - RNA, 17 nt, Human
cugggacuacaggcacc

SEQ ID NO: 2051993 - RNA, 18 nt, Human
cuggcucccacaggcccu

SEQ ID NO: 2051994 - RNA, 19 nt, Human
cuggcucccacaggcccuu

SEQ ID NO: 2051995 - RNA, 22 nt, Human
cuggcucccacaggcccuuccu

SEQ ID NO: 2051996 - RNA, 14 nt, Human
cuggcucccagggc

SEQ ID NO: 2051997 - RNA, 15 nt, Human
cuggcucccagggcc

SEQ ID NO: 2051998 - RNA, 16 nt, Human
cuggcucccagggcca

SEQ ID NO: 2051999 - RNA, 18 nt, Human
cuggcucccagggccaug

SEQ ID NO: 2052000 - RNA, 16 nt, Human
cuggcccucaguuucc

SEQ ID NO: 2052001 - RNA, 19 nt, Human
cuggcccucaccccugccc

SEQ ID NO: 2052002 - RNA, 21 nt, Human
cuggcccucaccccugcccug

SEQ ID NO: 2052003 - RNA, 22 nt, Human
cuggcccucaccccugcccugg

SEQ ID NO: 2052004 - RNA, 23 nt, Human
cuggcccucaccccugcccuggg

SEQ ID NO: 2052005 - RNA, 22 nt, Human
cuggcccgucauguuccucaaa

SEQ ID NO: 2052006 - RNA, 17 nt, Human
cuggcccucaccccugc

SEQ ID NO: 2052007 - RNA, 18 nt, Human
cuggcagccgugccuuca

SEQ ID NO: 2052008 - RNA, 17 nt, Human
cuggcagccgugccuuc

SEQ ID NO: 2052009 - RNA, 20 nt, Human
cuggaucuccauucucucag

SEQ ID NO: 2052010 - RNA, 13 nt, Human
cuggaucucccag

SEQ ID NO: 2052011 - RNA, 16 nt, Human
cuggaucucccagggc

SEQ ID NO: 2052012 - RNA, 17 nt, Human
cuggaucucccagggcu

SEQ ID NO: 2052013 - RNA, 18 nt, Human
cuggaucucccagggcua

SEQ ID NO: 2052014 - RNA, 19 nt, Human
cuggaucucccagggcuac

SEQ ID NO: 2052015 - RNA, 19 nt, Human
cuggauccaucaggccacu

SEQ ID NO: 2052016 - RNA, 15 nt, Human
cugcuucagcuugcu

SEQ ID NO: 2052017 - RNA, 23 nt, Human
cugcuucagccucccgaguagcu

SEQ ID NO: 2052018 - RNA, 19 nt, Human
cuggaaaauaaaaggucua

SEQ ID NO: 2052019 - RNA, 17 nt, Human
cuggauccaucaggcca

SEQ ID NO: 2052020 - RNA, 13 nt, Human
cuggaucaguccu

SEQ ID NO: 2052021 - RNA, 17 nt, Human
cuggaucaguccuuuga

SEQ ID NO: 2052022 - RNA, 20 nt, Human
cuggaucaguccuuugauca

SEQ ID NO: 2052023 - RNA, 21 nt, Human
cuggaucaguccuuugaucag

SEQ ID NO: 2052024 - RNA, 15 nt, Human
cuggagaacuagaga

SEQ ID NO: 2052025 - RNA, 14 nt, Human
cuggagaacuagag

SEQ ID NO: 2052026 - RNA, 20 nt, Human
cuggacuccucuguccaggc

SEQ ID NO: 2052027 - RNA, 23 nt, Human
cuggaaaggcucagucucaggag

SEQ ID NO: 2052028 - RNA, 13 nt, Human
cuggaaaggcuca

SEQ ID NO: 2052029 - RNA, 14 nt, Human
cuggaaaggcucag

SEQ ID NO: 2052030 - RNA, 15 nt, Human
cuggaaaggcucagu

SEQ ID NO: 2052031 - RNA, 17 nt, Human
cuggaaaggcucagucu

SEQ ID NO: 2052032 - RNA, 20 nt, Human
cuggaaaggcucagucucag

SEQ ID NO: 2052033 - RNA, 21 nt, Human
cuggaaaggcucagucucagg

SEQ ID NO: 2052034 - RNA, 22 nt, Human
cuggaaaggcucagucucagga

SEQ ID NO: 2052035 - RNA, 23 nt, Human
cuggacuccucuguccaggcacu

SEQ ID NO: 2052036 - RNA, 22 nt, Human
cuggacuccucuguccaggcac

SEQ ID NO: 2052037 - RNA, 18 nt, Human
cugcugagggaccagcca

SEQ ID NO: 2052038 - RNA, 17 nt, Human
cugcugagggaccagcc

SEQ ID NO: 2052039 - RNA, 15 nt, Human
cugcugagagaccca

SEQ ID NO: 2052040 - RNA, 16 nt, Human
cugcugagagacccaa

SEQ ID NO: 2052041 - RNA, 21 nt, Human
cugcugagagacccaaggagg

SEQ ID NO: 2052042 - RNA, 22 nt, Human
cugcugagagacccaaggagga

SEQ ID NO: 2052043 - RNA, 13 nt, Human
cugcuauuuccca

SEQ ID NO: 2052044 - RNA, 17 nt, Human
cugcuauuucccaagcu

SEQ ID NO: 2052045 - RNA, 18 nt, Human
cugcuauuucccaagcug

SEQ ID NO: 2052046 - RNA, 19 nt, Human
cugcuauuucccaagcugg

SEQ ID NO: 2052047 - RNA, 21 nt, Human
cugcuauuucccaagcuggag

SEQ ID NO: 2052048 - RNA, 23 nt, Human
cugcuauuucccaagcuggagug

SEQ ID NO: 2052049 - RNA, 24 nt, Human
cugcuauuucccaagcuggagugc

SEQ ID NO: 2052050 - RNA, 13 nt, Human
cugcuauuuuacu

SEQ ID NO: 2052051 - RNA, 15 nt, Human
cugcuauuuuacugu

SEQ ID NO: 2052052 - RNA, 17 nt, Human
cugcuauuuuacugucu

SEQ ID NO: 2052053 - RNA, 20 nt, Human
cugcuauuuuacugucuuaa

SEQ ID NO: 2052054 - RNA, 21 nt, Human
cugcuauuuuacugucuuaau

SEQ ID NO: 2052055 - RNA, 17 nt, Human
cugcuaucaaagagguu

SEQ ID NO: 2052056 - RNA, 16 nt, Human
cugcuauccugccaaa

SEQ ID NO: 2052057 - RNA, 14 nt, Human
cugcuaugcuugaa

SEQ ID NO: 2052058 - RNA, 15 nt, Human
cugcuaugcuugaau

SEQ ID NO: 2052059 - RNA, 16 nt, Human
cugcugaauaauaaac

SEQ ID NO: 2052060 - RNA, 22 nt, Human
cugcugaaugauuuccaaagag

SEQ ID NO: 2052061 - RNA, 23 nt, Human
cugcugaaugauuuccaaagaga

SEQ ID NO: 2052062 - RNA, 19 nt, Human
cugccuguucccauucuug

SEQ ID NO: 2052063 - RNA, 15 nt, Human
cugccuguucccauu

SEQ ID NO: 2052064 - RNA, 13 nt, Human
cugccugucuccu

SEQ ID NO: 2052065 - RNA, 15 nt, Human
cugccugugagccag

SEQ ID NO: 2052066 - RNA, 16 nt, Human
cugccugugagccagu

SEQ ID NO: 2052067 - RNA, 17 nt, Human
cugccugugagccaguc

SEQ ID NO: 2052068 - RNA, 18 nt, Human
cugccugugagccagucu

SEQ ID NO: 2052069 - RNA, 21 nt, Human
cugccugugcacggccagcug

SEQ ID NO: 2052070 - RNA, 12 nt, Human
cugccugugcug

SEQ ID NO: 2052071 - RNA, 23 nt, Human
cugccuguucagcuccagcucac

SEQ ID NO: 2052072 - RNA, 20 nt, Human
cugccuguucagcuccagcu

SEQ ID NO: 2052073 - RNA, 22 nt, Human
cugcuacucuguuccuucacau

SEQ ID NO: 2052074 - RNA, 17 nt, Human
cugcuacucuguuccuu

SEQ ID NO: 2052075 - RNA, 18 nt, Human
cugcuacucuguuccuuc

SEQ ID NO: 2052076 - RNA, 18 nt, Human
cugcuaccucacuggggu

SEQ ID NO: 2052077 - RNA, 13 nt, Human
cugcuagaaaugg

SEQ ID NO: 2052078 - RNA, 14 nt, Human
cugcuagcacuugg

SEQ ID NO: 2052079 - RNA, 21 nt, Human
cugcuagcacuuggagccaag

SEQ ID NO: 2052080 - RNA, 22 nt, Human
cugcuagcacuuggagccaagg

SEQ ID NO: 2052081 - RNA, 14 nt, Human
cugccucgaacugg

SEQ ID NO: 2052082 - RNA, 20 nt, Human
cugccucgaacuggcugcaa

SEQ ID NO: 2052083 - RNA, 19 nt, Human
cugccucgaacuggcugca

SEQ ID NO: 2052084 - RNA, 19 nt, Human
cugccugucccucucaggc

SEQ ID NO: 2052085 - RNA, 20 nt, Human
cugccugucccucucaggca

SEQ ID NO: 2052086 - RNA, 23 nt, Human
cugccugucccucucaggcaugc

SEQ ID NO: 2052087 - RNA, 12 nt, Human
cugccugucucc

SEQ ID NO: 2052088 - RNA, 16 nt, Human
cugccugucccucuca

SEQ ID NO: 2052089 - RNA, 18 nt, Human
cugccugucccucucagg

SEQ ID NO: 2052090 - RNA, 22 nt, Human
cugccuguaguuaggaaauaaa

SEQ ID NO: 2052091 - RNA, 17 nt, Human
cugccuguaguuaggaa

SEQ ID NO: 2052092 - RNA, 18 nt, Human
cugccuguaguuaggaaa

SEQ ID NO: 2052093 - RNA, 19 nt, Human
cugccuguaguuaggaaau

SEQ ID NO: 2052094 - RNA, 20 nt, Human
cugccuguaguuaggaaaua

SEQ ID NO: 2052095 - RNA, 21 nt, Human
cugccuguaguuaggaaauaa

SEQ ID NO: 2052096 - RNA, 16 nt, Human
cugcccuucagcaucc

SEQ ID NO: 2052097 - RNA, 12 nt, Human
cugcccccuggu

SEQ ID NO: 2052098 - RNA, 13 nt, Human
cugcccccuggug

SEQ ID NO: 2052099 - RNA, 14 nt, Human
cugcccccuggugg

SEQ ID NO: 2052100 - RNA, 22 nt, Human
cugcccccugguggacaguccu

SEQ ID NO: 2052101 - RNA, 14 nt, Human
cugcccccuucucc

SEQ ID NO: 2052102 - RNA, 16 nt, Human
cugcccccuucuccca

SEQ ID NO: 2052103 - RNA, 17 nt, Human
cugcccccuucucccac

SEQ ID NO: 2052104 - RNA, 18 nt, Human
cugcccccuucucccaca

SEQ ID NO: 2052105 - RNA, 15 nt, Human
cugcccuggugcugc

SEQ ID NO: 2052106 - RNA, 23 nt, Human
cugcccugguccagggaagcugg

SEQ ID NO: 2052107 - RNA, 14 nt, Human
cugcccuggugcug

SEQ ID NO: 2052108 - RNA, 13 nt, Human
cugcccuggugcu

SEQ ID NO: 2052109 - RNA, 12 nt, Human
cugcccuggugc

SEQ ID NO: 2052110 - RNA, 20 nt, Human
cugcccugguccagggaagc

SEQ ID NO: 2052111 - RNA, 21 nt, Human
cugcccugguccagggaagcu

SEQ ID NO: 2052112 - RNA, 19 nt, Human
cugcccccuucucccacac

SEQ ID NO: 2052113 - RNA, 20 nt, Human
cugcccccuucucccacacu

SEQ ID NO: 2052114 - RNA, 22 nt, Human
cugcccccuucucccacacugc

SEQ ID NO: 2052115 - RNA, 24 nt, Human
cugcccugggauguccacagaugc

SEQ ID NO: 2052116 - RNA, 14 nt, Human
cugcccugguccag

SEQ ID NO: 2052117 - RNA, 15 nt, Human
cugcccugguccagg

SEQ ID NO: 2052118 - RNA, 23 nt, Human
cugcccuggugcugccacacuuc

SEQ ID NO: 2052119 - RNA, 18 nt, Human
cuguugcccuuucuguac

SEQ ID NO: 2052120 - RNA, 20 nt, Human
cuguugcccuuucuguacca

SEQ ID NO: 2052121 - RNA, 21 nt, Human
cuguugcccuuucuguaccau

SEQ ID NO: 2052122 - RNA, 12 nt, Human
cuguugccucau

SEQ ID NO: 2052123 - RNA, 14 nt, Human
cuguugccucaucu

SEQ ID NO: 2052124 - RNA, 15 nt, Human
cuguuguguucguuc

SEQ ID NO: 2052125 - RNA, 17 nt, Human
cuguuguguucguucuu

SEQ ID NO: 2052126 - RNA, 22 nt, Human
cuguuguguacguggagaggga

SEQ ID NO: 2052127 - RNA, 15 nt, Human
cuguuggccagugug

SEQ ID NO: 2052128 - RNA, 16 nt, Human
cuguugucauugcuuu

SEQ ID NO: 2052129 - RNA, 17 nt, Human
cuguugucauugcuuua

SEQ ID NO: 2052130 - RNA, 18 nt, Human
cuguugucauugcuuuac

SEQ ID NO: 2052131 - RNA, 12 nt, Human
cuguuggccagu

SEQ ID NO: 2052132 - RNA, 13 nt, Human
cuuaaaagccauc

SEQ ID NO: 2052133 - RNA, 17 nt, Human
cuuaaaagccaucaugu

SEQ ID NO: 2052134 - RNA, 21 nt, Human
cuuaaaagccaucauguaaau

SEQ ID NO: 2052135 - RNA, 17 nt, Human
cuguuguuguuaaugaa

SEQ ID NO: 2052136 - RNA, 22 nt, Human
cuguuguuguuaaugaaaaugu

SEQ ID NO: 2052137 - RNA, 23 nt, Human
cuguuguuguuaaugaaaauguc

SEQ ID NO: 2052138 - RNA, 15 nt, Human
cuuaaaacuuuucaa

SEQ ID NO: 2052139 - RNA, 12 nt, Human
cuuaaaacuccu

SEQ ID NO: 2052140 - RNA, 13 nt, Human
cuguuguuguuaa

SEQ ID NO: 2052141 - RNA, 17 nt, Human
cuguuguuauggaaacu

SEQ ID NO: 2052142 - RNA, 22 nt, Human
cuuaaaauagcaacacucuaua

SEQ ID NO: 2052143 - RNA, 14 nt, Human
cuuaaacugugugg

SEQ ID NO: 2052144 - RNA, 15 nt, Human
cuuaaacugugugga

SEQ ID NO: 2052145 - RNA, 23 nt, Human
cuuaaacuguguggacugugaug

SEQ ID NO: 2052146 - RNA, 18 nt, Human
cugugaacgauuuagaaa

SEQ ID NO: 2052147 - RNA, 15 nt, Human
cugugcucuggacag

SEQ ID NO: 2052148 - RNA, 17 nt, Human
cugugcucuggacaggc

SEQ ID NO: 2052149 - RNA, 15 nt, Human
cugugagcaagaagu

SEQ ID NO: 2052150 - RNA, 22 nt, Human
cugugaacgauuuagaaagaag

SEQ ID NO: 2052151 - RNA, 12 nt, Human
cuguucagcugg

SEQ ID NO: 2052152 - RNA, 22 nt, Human
cuguucagcuccagcucaccag

SEQ ID NO: 2052153 - RNA, 19 nt, Human
cuguucagcuccagcucac

SEQ ID NO: 2052154 - RNA, 18 nt, Human
cuguucagcuccagcuca

SEQ ID NO: 2052155 - RNA, 16 nt, Human
cuguucagcuccagcu

SEQ ID NO: 2052156 - RNA, 13 nt, Human
cuguucacucuac

SEQ ID NO: 2052157 - RNA, 15 nt, Human
cuguucagcuccagc

SEQ ID NO: 2052158 - RNA, 12 nt, Human
cuguucacccac

SEQ ID NO: 2052159 - RNA, 14 nt, Human
cuguucacccacag

SEQ ID NO: 2052160 - RNA, 18 nt, Human
cuguucacccacagggcu

SEQ ID NO: 2052161 - RNA, 19 nt, Human
cugugcucuggacaggcau

SEQ ID NO: 2052162 - RNA, 18 nt, Human
cugugcucuggacaggca

SEQ ID NO: 2052163 - RNA, 13 nt, Human
cugugagccaguc

SEQ ID NO: 2052164 - RNA, 14 nt, Human
cugugagccagucu

SEQ ID NO: 2052165 - RNA, 13 nt, Human
cuguguauuuaau

SEQ ID NO: 2052166 - RNA, 17 nt, Human
cuguguauuuaauugua

SEQ ID NO: 2052167 - RNA, 20 nt, Human
cuguguauuuaauuguaaac

SEQ ID NO: 2052168 - RNA, 21 nt, Human
cuguguauuuaauuguaaacu

SEQ ID NO: 2052169 - RNA, 22 nt, Human
cuguguauuuaauuguaaacug

SEQ ID NO: 2052170 - RNA, 23 nt, Human
cuguguauuuaauuguaaacugu

SEQ ID NO: 2052171 - RNA, 13 nt, Human
cuguguauguaca

SEQ ID NO: 2052172 - RNA, 14 nt, Human
cuguguauguacau

SEQ ID NO: 2052173 - RNA, 15 nt, Human
cuguguauguacaua

SEQ ID NO: 2052174 - RNA, 18 nt, Human
cuguguauguacauauau

SEQ ID NO: 2052175 - RNA, 22 nt, Human
cugugucagguggggcagcuug

SEQ ID NO: 2052176 - RNA, 22 nt, Human
cugugucauuuggcuuuccagu

SEQ ID NO: 2052177 - RNA, 14 nt, Human
cuguguccaacucc

SEQ ID NO: 2052178 - RNA, 16 nt, Human
cuguguccaacuccag

SEQ ID NO: 2052179 - RNA, 17 nt, Human
cuguguccaacuccagu

SEQ ID NO: 2052180 - RNA, 18 nt, Human
cuguguccaacuccagua

SEQ ID NO: 2052181 - RNA, 19 nt, Human
cuguguccaacuccaguac

SEQ ID NO: 2052182 - RNA, 17 nt, Human
cuguuacugucuucagu

SEQ ID NO: 2052183 - RNA, 15 nt, Human
cuguuagcuguuauu

SEQ ID NO: 2052184 - RNA, 16 nt, Human
cuguuagcuguuauuu

SEQ ID NO: 2052185 - RNA, 13 nt, Human
cuguuagaacacu

SEQ ID NO: 2052186 - RNA, 14 nt, Human
cuguuagaacacua

SEQ ID NO: 2052187 - RNA, 15 nt, Human
cuguuagaacacuau

SEQ ID NO: 2052188 - RNA, 16 nt, Human
cuguuagaacacuauu

SEQ ID NO: 2052189 - RNA, 17 nt, Human
cuguuagaacacuauuu

SEQ ID NO: 2052190 - RNA, 18 nt, Human
cuguuagaacacuauuuu

SEQ ID NO: 2052191 - RNA, 19 nt, Human
cuguuagaacacuauuuuc

SEQ ID NO: 2052192 - RNA, 21 nt, Human
cuguuagaacacuauuuucag

SEQ ID NO: 2052193 - RNA, 22 nt, Human
cuguuagaacacuauuuucaga

SEQ ID NO: 2052194 - RNA, 23 nt, Human
cuguuagaacacuauuuucagaa

SEQ ID NO: 2052195 - RNA, 12 nt, Human
cuggucucucua

SEQ ID NO: 2052196 - RNA, 12 nt, Human
cuguccuuaccc

SEQ ID NO: 2052197 - RNA, 17 nt, Human
cuguccuuacccaucug

SEQ ID NO: 2052198 - RNA, 19 nt, Human
cuguccuuacccaucugca

SEQ ID NO: 2052199 - RNA, 15 nt, Human
cuguccuucucucac

SEQ ID NO: 2052200 - RNA, 22 nt, Human
cuguccuuuccaguggccuggc

SEQ ID NO: 2052201 - RNA, 16 nt, Human
cuguccuugcacacuc

SEQ ID NO: 2052202 - RNA, 20 nt, Human
cuguccuucucucaccuccu

SEQ ID NO: 2052203 - RNA, 23 nt, Human
cuguccuucucucaccuccuaaa

SEQ ID NO: 2052204 - RNA, 18 nt, Human
cuguaggaagguuaaugu

SEQ ID NO: 2052205 - RNA, 16 nt, Human
cugucaguaugacauu

SEQ ID NO: 2052206 - RNA, 18 nt, Human
cuguagcauuacaguggg

SEQ ID NO: 2052207 - RNA, 17 nt, Human
cuguagcauuacagugg

SEQ ID NO: 2052208 - RNA, 20 nt, Human
cuguccugggagugagcugg

SEQ ID NO: 2052209 - RNA, 14 nt, Human
cuguccugggagug

SEQ ID NO: 2052210 - RNA, 13 nt, Human
cuguccugggagu

SEQ ID NO: 2052211 - RNA, 14 nt, Human
cugucauuugagca

SEQ ID NO: 2052212 - RNA, 18 nt, Human
cugucagugcagcccgug

SEQ ID NO: 2052213 - RNA, 19 nt, Human
cugucagugcagcccgugu

SEQ ID NO: 2052214 - RNA, 14 nt, Human
cugucagucugcuu

SEQ ID NO: 2052215 - RNA, 15 nt, Human
cugucagugcagccc

SEQ ID NO: 2052216 - RNA, 14 nt, Human
cugguuuuucaguu

SEQ ID NO: 2052217 - RNA, 15 nt, Human
cugguuuuucaguuu

SEQ ID NO: 2052218 - RNA, 16 nt, Human
cugguuuuucaguuuu

SEQ ID NO: 2052219 - RNA, 18 nt, Human
cugguuuuccuaaaugca

SEQ ID NO: 2052220 - RNA, 13 nt, Human
cuguaagcucuuu

SEQ ID NO: 2052221 - RNA, 20 nt, Human
cuguacuucaaguuaaagug

SEQ ID NO: 2052222 - RNA, 17 nt, Human
cuguacuugaugacaga

SEQ ID NO: 2052223 - RNA, 18 nt, Human
cuguagauugcuucugua

SEQ ID NO: 2052224 - RNA, 19 nt, Human
cuguagauugcuucuguag

SEQ ID NO: 2052225 - RNA, 21 nt, Human
cuguagauugcuucuguagua

SEQ ID NO: 2052226 - RNA, 15 nt, Human
cuguagagugggagc

SEQ ID NO: 2052227 - RNA, 16 nt, Human
cuguaaauuauuuuaa

SEQ ID NO: 2052228 - RNA, 17 nt, Human
cuguaaauuauuuuaaa

SEQ ID NO: 2052229 - RNA, 18 nt, Human
cuguaaauuauuuuaaau

SEQ ID NO: 2052230 - RNA, 20 nt, Human
cuguaaauuauuuuaaauua

SEQ ID NO: 2052231 - RNA, 22 nt, Human
cuguaaauuauuuuaaauuaua

SEQ ID NO: 2052232 - RNA, 15 nt, Human
cuguaaaaacugugg

SEQ ID NO: 2052233 - RNA, 23 nt, Human
cuguaagaagagacugggaagau

SEQ ID NO: 2052234 - RNA, 17 nt, Human
cuguaagaagagacugg

SEQ ID NO: 2052235 - RNA, 20 nt, Human
cuguaagaagagacugggaa

SEQ ID NO: 2052236 - RNA, 22 nt, Human
cuguaagaagagacugggaaga

SEQ ID NO: 2052237 - RNA, 16 nt, Human
cuguaagacugauaau

SEQ ID NO: 2052238 - RNA, 16 nt, Human
cuuccauuccacaucc

SEQ ID NO: 2052239 - RNA, 14 nt, Human
cuucccaacugcaa

SEQ ID NO: 2052240 - RNA, 15 nt, Human
cuucccaacugcaag

SEQ ID NO: 2052241 - RNA, 16 nt, Human
cuucccaacugcaagu

SEQ ID NO: 2052242 - RNA, 16 nt, Human
cuuccauuugugugug

SEQ ID NO: 2052243 - RNA, 17 nt, Human
cuuccaugagaacagca

SEQ ID NO: 2052244 - RNA, 12 nt, Human
cuuccauuuaua

SEQ ID NO: 2052245 - RNA, 21 nt, Human
cuuccaugagaacagcagggu

SEQ ID NO: 2052246 - RNA, 15 nt, Human
cuuacaugagaacag

SEQ ID NO: 2052247 - RNA, 16 nt, Human
cuuacaugagaacaga

SEQ ID NO: 2052248 - RNA, 17 nt, Human
cuuacaugagaacagac

SEQ ID NO: 2052249 - RNA, 14 nt, Human
cuuacauguuuucu

SEQ ID NO: 2052250 - RNA, 21 nt, Human
cuuacauguuuucuuugcuuu

SEQ ID NO: 2052251 - RNA, 15 nt, Human
cuuccaucucgccac

SEQ ID NO: 2052252 - RNA, 17 nt, Human
cuuccaucccuaccccc

SEQ ID NO: 2052253 - RNA, 19 nt, Human
cuuccaucccuacccccua

SEQ ID NO: 2052254 - RNA, 12 nt, Human
cuuccaucccua

SEQ ID NO: 2052255 - RNA, 14 nt, Human
cuuccaucccuacc

SEQ ID NO: 2052256 - RNA, 15 nt, Human
cuuccaucccuaccc

SEQ ID NO: 2052257 - RNA, 16 nt, Human
cuuccaucccuacccc

SEQ ID NO: 2052258 - RNA, 20 nt, Human
cuuacauuagcaguuugcuu

SEQ ID NO: 2052259 - RNA, 14 nt, Human
cuuacaugcauuug

SEQ ID NO: 2052260 - RNA, 12 nt, Human
cuuccucccucc

SEQ ID NO: 2052261 - RNA, 13 nt, Human
cuuccucccuccc

SEQ ID NO: 2052262 - RNA, 14 nt, Human
cuuccucccucccu

SEQ ID NO: 2052263 - RNA, 18 nt, Human
cuuccucccucccucuuu

SEQ ID NO: 2052264 - RNA, 16 nt, Human
cuucuaauugccaugu

SEQ ID NO: 2052265 - RNA, 14 nt, Human
cuucuaaucugcua

SEQ ID NO: 2052266 - RNA, 16 nt, Human
cuucuaaucugcuaug

SEQ ID NO: 2052267 - RNA, 21 nt, Human
cuucuaaucugcuaugcuuga

SEQ ID NO: 2052268 - RNA, 22 nt, Human
cuucuaaucugcuaugcuugaa

SEQ ID NO: 2052269 - RNA, 13 nt, Human
cuuccucugcuga

SEQ ID NO: 2052270 - RNA, 12 nt, Human
cuuccucugcug

SEQ ID NO: 2052271 - RNA, 11 nt, Human
cuuccucugcu

SEQ ID NO: 2052272 - RNA, 21 nt, Human
cuuccucuccacugccuucga

SEQ ID NO: 2052273 - RNA, 19 nt, Human
cuuccucuccacugccuuc

SEQ ID NO: 2052274 - RNA, 17 nt, Human
cuuccucuccacugccu

SEQ ID NO: 2052275 - RNA, 16 nt, Human
cuuccucuccacugcc

SEQ ID NO: 2052276 - RNA, 21 nt, Human
cuucucugcuccaccacaucc

SEQ ID NO: 2052277 - RNA, 22 nt, Human
cuucucugcuccaccacauccu

SEQ ID NO: 2052278 - RNA, 22 nt, Human
cuucucuguauuccuagaaacu

SEQ ID NO: 2052279 - RNA, 13 nt, Human
cuucucugcccau

SEQ ID NO: 2052280 - RNA, 15 nt, Human
cuucucugcccauuc

SEQ ID NO: 2052281 - RNA, 16 nt, Human
cuucucugcccauucc

SEQ ID NO: 2052282 - RNA, 17 nt, Human
cuucucugcccauuccc

SEQ ID NO: 2052283 - RNA, 19 nt, Human
cuucucugcccauucccca

SEQ ID NO: 2052284 - RNA, 21 nt, Human
cuucucugcccauuccccagc

SEQ ID NO: 2052285 - RNA, 22 nt, Human
cuucucugcccauuccccagcc

SEQ ID NO: 2052286 - RNA, 23 nt, Human
cuucucugcccauuccccagccu

SEQ ID NO: 2052287 - RNA, 11 nt, Human
cuucucugcuc

SEQ ID NO: 2052288 - RNA, 12 nt, Human
cuucucugcucc

SEQ ID NO: 2052289 - RNA, 13 nt, Human
cuucucugcucca

SEQ ID NO: 2052290 - RNA, 14 nt, Human
cuucucugcuccac

SEQ ID NO: 2052291 - RNA, 15 nt, Human
cuucucugcuccacc

SEQ ID NO: 2052292 - RNA, 16 nt, Human
cuucucugcuccacca

SEQ ID NO: 2052293 - RNA, 23 nt, Human
cuucuauggacugguuguugcca

SEQ ID NO: 2052294 - RNA, 18 nt, Human
cuucuacugagccuucag

SEQ ID NO: 2052295 - RNA, 13 nt, Human
cuucuacacucuc

SEQ ID NO: 2052296 - RNA, 14 nt, Human
cuucuacacucucc

SEQ ID NO: 2052297 - RNA, 17 nt, Human
cuucuacacucuccugg

SEQ ID NO: 2052298 - RNA, 18 nt, Human
cuucuacacucuccuggg

SEQ ID NO: 2052299 - RNA, 15 nt, Human
cuucuaccaacugga

SEQ ID NO: 2052300 - RNA, 17 nt, Human
cuucuaccaacuggaag

SEQ ID NO: 2052301 - RNA, 18 nt, Human
cuucuaccaacuggaagc

SEQ ID NO: 2052302 - RNA, 15 nt, Human
cuucuaauugccaug

SEQ ID NO: 2052303 - RNA, 13 nt, Human
cuucuucuucaga

SEQ ID NO: 2052304 - RNA, 14 nt, Human
cuucuucuucagaa

SEQ ID NO: 2052305 - RNA, 22 nt, Human
cuucucuuuaacucaggacucc

SEQ ID NO: 2052306 - RNA, 19 nt, Human
cuucuucugucaucuaccu

SEQ ID NO: 2052307 - RNA, 15 nt, Human
cuucuuacaugcauu

SEQ ID NO: 2052308 - RNA, 13 nt, Human
cuucuuauacauu

SEQ ID NO: 2052309 - RNA, 16 nt, Human
cuucuuauacauuuga

SEQ ID NO: 2052310 - RNA, 14 nt, Human
cuucuuauucucac

SEQ ID NO: 2052311 - RNA, 17 nt, Human
cuucuuauucucacucc

SEQ ID NO: 2052312 - RNA, 21 nt, Human
cuucuucggggaacuccugga

SEQ ID NO: 2052313 - RNA, 17 nt, Human
cuuucacccacagaaag

SEQ ID NO: 2052314 - RNA, 18 nt, Human
cuuucacccacagaaaga

SEQ ID NO: 2052315 - RNA, 19 nt, Human
cuuucacccacagaaagag

SEQ ID NO: 2052316 - RNA, 20 nt, Human
cuuucacccacagaaagaga

SEQ ID NO: 2052317 - RNA, 17 nt, Human
cuuucacaguaccaucu

SEQ ID NO: 2052318 - RNA, 19 nt, Human
cuuucacaguaccaucuga

SEQ ID NO: 2052319 - RNA, 16 nt, Human
cuuucacauagauguc

SEQ ID NO: 2052320 - RNA, 14 nt, Human
cuuucacacuucca

SEQ ID NO: 2052321 - RNA, 15 nt, Human
cuuucacacuuccac

SEQ ID NO: 2052322 - RNA, 16 nt, Human
cuuucacacuuccacc

SEQ ID NO: 2052323 - RNA, 19 nt, Human
cuuucacacuuccaccagc

SEQ ID NO: 2052324 - RNA, 20 nt, Human
cuuucacacuuccaccagcc

SEQ ID NO: 2052325 - RNA, 21 nt, Human
cuuucacacuuccaccagccu

SEQ ID NO: 2052326 - RNA, 23 nt, Human
cuuucacacuuccaccagccugc

SEQ ID NO: 2052327 - RNA, 20 nt, Human
cuuuaaugucacaggcaggu

SEQ ID NO: 2052328 - RNA, 19 nt, Human
cuuuaaugucacaggcagg

SEQ ID NO: 2052329 - RNA, 18 nt, Human
cuuuaaugucacaggcag

SEQ ID NO: 2052330 - RNA, 17 nt, Human
cuuuaaugucacaggca

SEQ ID NO: 2052331 - RNA, 22 nt, Human
cuuuaaugucacaggcaggucc

SEQ ID NO: 2052332 - RNA, 14 nt, Human
cuuuaagacauacu

SEQ ID NO: 2052333 - RNA, 12 nt, Human
cuuuaaggaaaa

SEQ ID NO: 2052334 - RNA, 23 nt, Human
cuuuaagacauacuccuuccauc

SEQ ID NO: 2052335 - RNA, 15 nt, Human
cuugguccuugauuu

SEQ ID NO: 2052336 - RNA, 22 nt, Human
cuuggucuaacuuuugugugaa

SEQ ID NO: 2052337 - RNA, 20 nt, Human
cuuggucugauuucaggaua

SEQ ID NO: 2052338 - RNA, 13 nt, Human
cuugguuauacau

SEQ ID NO: 2052339 - RNA, 17 nt, Human
cuugguuauacaugaca

SEQ ID NO: 2052340 - RNA, 19 nt, Human
cuugguuauacaugacacu

SEQ ID NO: 2052341 - RNA, 13 nt, Human
cuugucuguagau

SEQ ID NO: 2052342 - RNA, 14 nt, Human
cuugucucugggcu

SEQ ID NO: 2052343 - RNA, 13 nt, Human
cuugucucugggc

SEQ ID NO: 2052344 - RNA, 11 nt, Human
cuugucuuaaa

SEQ ID NO: 2052345 - RNA, 18 nt, Human
cuugucuuaaauaaaaga

SEQ ID NO: 2052346 - RNA, 14 nt, Human
cuugucuuguucac

SEQ ID NO: 2052347 - RNA, 17 nt, Human
cuugguucaucaguguu

SEQ ID NO: 2052348 - RNA, 17 nt, Human
cuugguucccuugugug

SEQ ID NO: 2052349 - RNA, 21 nt, Human
cuugauggcuccgaacacccu

SEQ ID NO: 2052350 - RNA, 16 nt, Human
cuugauggucagacac

SEQ ID NO: 2052351 - RNA, 22 nt, Human
cuugauggucagacacaaacaa

SEQ ID NO: 2052352 - RNA, 16 nt, Human
cuugaugguuuauguu

SEQ ID NO: 2052353 - RNA, 15 nt, Human
cuugauguguuaucu

SEQ ID NO: 2052354 - RNA, 20 nt, Human
cuugaugucuuuguuaagac

SEQ ID NO: 2052355 - RNA, 22 nt, Human
cuugauuuaucacacaaagcag

SEQ ID NO: 2052356 - RNA, 21 nt, Human
cuugauuuaucacacaaagca

SEQ ID NO: 2052357 - RNA, 15 nt, Human
cuugccgaaacugga

SEQ ID NO: 2052358 - RNA, 17 nt, Human
cuugccgaaacuggaag

SEQ ID NO: 2052359 - RNA, 18 nt, Human
cuugccgaaacuggaagu

SEQ ID NO: 2052360 - RNA, 20 nt, Human
cuugccgaaacuggaaguua

SEQ ID NO: 2052361 - RNA, 17 nt, Human
cuugccuccauggugcc

SEQ ID NO: 2052362 - RNA, 19 nt, Human
cuugccuccauggugccuc

SEQ ID NO: 2052363 - RNA, 20 nt, Human
cuugccuccauggugccucu

SEQ ID NO: 2052364 - RNA, 21 nt, Human
cuugccuccauggugccucug

SEQ ID NO: 2052365 - RNA, 22 nt, Human
cuugccuccauggugccucugg

SEQ ID NO: 2052366 - RNA, 12 nt, Human
cuugccuccugu

SEQ ID NO: 2052367 - RNA, 15 nt, Human
cuugccuccugugua

SEQ ID NO: 2052368 - RNA, 14 nt, Human
gaaacuuacacaca

SEQ ID NO: 2052369 - RNA, 15 nt, Human
gaaacuuacacacaa

SEQ ID NO: 2052370 - RNA, 15 nt, Human
gaaacuguugccaga

SEQ ID NO: 2052371 - RNA, 17 nt, Human
gaaacuguugccagaga

SEQ ID NO: 2052372 - RNA, 21 nt, Human
gaaacuguugccagagaugga

SEQ ID NO: 2052373 - RNA, 23 nt, Human
gaaacuguugccagagauggagg

SEQ ID NO: 2052374 - RNA, 16 nt, Human
gaaacuuaucuuacaa

SEQ ID NO: 2052375 - RNA, 19 nt, Human
gaaacuuaucuuacaaagu

SEQ ID NO: 2052376 - RNA, 21 nt, Human
gaaacuuaucuuacaaagugu

SEQ ID NO: 2052377 - RNA, 17 nt, Human
gaaacuucaagcaccag

SEQ ID NO: 2052378 - RNA, 22 nt, Human
gaaacuucaagcaccagggaag

SEQ ID NO: 2052379 - RNA, 18 nt, Human
gaaagaaguggggacaga

SEQ ID NO: 2052380 - RNA, 16 nt, Human
gaaagaagaaaagguu

SEQ ID NO: 2052381 - RNA, 13 nt, Human
gaaacuuccaaga

SEQ ID NO: 2052382 - RNA, 11 nt, Human
gaaagaaggaa

SEQ ID NO: 2052383 - RNA, 13 nt, Human
gaaagaaggaaga

SEQ ID NO: 2052384 - RNA, 14 nt, Human
gaaagacagagcug

SEQ ID NO: 2052385 - RNA, 16 nt, Human
gaaagacagagcuggg

SEQ ID NO: 2052386 - RNA, 17 nt, Human
gaaacuuguuagaaaug

SEQ ID NO: 2052387 - RNA, 20 nt, Human
gaaacuuguuagaaaugcaa

SEQ ID NO: 2052388 - RNA, 19 nt, Human
gaacaacuaggcuucagca

SEQ ID NO: 2052389 - RNA, 21 nt, Human
gaacaacuaggcuucagcaua

SEQ ID NO: 2052390 - RNA, 13 nt, Human
gaacaagccuaaa

SEQ ID NO: 2052391 - RNA, 16 nt, Human
gaacaaccucggcucc

SEQ ID NO: 2052392 - RNA, 20 nt, Human
gaacaaccucggcuccugga

SEQ ID NO: 2052393 - RNA, 21 nt, Human
gaacaaccucggcuccuggac

SEQ ID NO: 2052394 - RNA, 15 nt, Human
gaacaacuacuguga

SEQ ID NO: 2052395 - RNA, 22 nt, Human
gaaauuuuucagaugcuucugg

SEQ ID NO: 2052396 - RNA, 17 nt, Human
gaaauuuuucagaugcu

SEQ ID NO: 2052397 - RNA, 20 nt, Human
gaaauuuuucagaugcuucu

SEQ ID NO: 2052398 - RNA, 14 nt, Human
gaaaugaauaauuu

SEQ ID NO: 2052399 - RNA, 18 nt, Human
gaaaugaauaauuuccca

SEQ ID NO: 2052400 - RNA, 19 nt, Human
gaaaugaauaauuucccaa

SEQ ID NO: 2052401 - RNA, 19 nt, Human
gaaauuuuuauuaaauuau

SEQ ID NO: 2052402 - RNA, 13 nt, Human
gaaaugaauaauu

SEQ ID NO: 2052403 - RNA, 18 nt, Human
gaaauuuuuauuaaauua

SEQ ID NO: 2052404 - RNA, 13 nt, Human
gaaaugaaauuuu

SEQ ID NO: 2052405 - RNA, 16 nt, Human
gaaaugaaauuuuacc

SEQ ID NO: 2052406 - RNA, 17 nt, Human
gaaaugaaauuuuacca

SEQ ID NO: 2052407 - RNA, 19 nt, Human
gaaaugaaauuuuaccaag

SEQ ID NO: 2052408 - RNA, 21 nt, Human
gaaaguacuucuccacccugc

SEQ ID NO: 2052409 - RNA, 14 nt, Human
gaaaguaauuucuu

SEQ ID NO: 2052410 - RNA, 15 nt, Human
gaaaguaauuucuuc

SEQ ID NO: 2052411 - RNA, 16 nt, Human
gaaaguaauuucuucu

SEQ ID NO: 2052412 - RNA, 19 nt, Human
gaaaguaauuucuucucaa

SEQ ID NO: 2052413 - RNA, 16 nt, Human
gaaagguuuacauugu

SEQ ID NO: 2052414 - RNA, 14 nt, Human
gaaagguuuacauu

SEQ ID NO: 2052415 - RNA, 18 nt, Human
gaaagacuaucuaaaugu

SEQ ID NO: 2052416 - RNA, 21 nt, Human
gaaagacggauugcauuagaa

SEQ ID NO: 2052417 - RNA, 16 nt, Human
gaaagacagcuucuca

SEQ ID NO: 2052418 - RNA, 17 nt, Human
gaaagacagcuucucau

SEQ ID NO: 2052419 - RNA, 14 nt, Human
gaaaauuuuaaaaa

SEQ ID NO: 2052420 - RNA, 22 nt, Human
gaaaauuaggauuucaugauuu

SEQ ID NO: 2052421 - RNA, 18 nt, Human
gaaaauuaggauuucaug

SEQ ID NO: 2052422 - RNA, 15 nt, Human
gaaaauuaacacugc

SEQ ID NO: 2052423 - RNA, 13 nt, Human
gaaaauuaacacu

SEQ ID NO: 2052424 - RNA, 18 nt, Human
gaaaauguuuuguaagaa

SEQ ID NO: 2052425 - RNA, 19 nt, Human
gaaaauguuuuguaagaaa

SEQ ID NO: 2052426 - RNA, 22 nt, Human
gaaaauguuuuguaagaaacca

SEQ ID NO: 2052427 - RNA, 20 nt, Human
gaaaauguuuuucugccagg

SEQ ID NO: 2052428 - RNA, 15 nt, Human
gaaaagccauguuua

SEQ ID NO: 2052429 - RNA, 16 nt, Human
gaaaagccauguuuaa

SEQ ID NO: 2052430 - RNA, 17 nt, Human
gaaaagccauguuuaag

SEQ ID NO: 2052431 - RNA, 18 nt, Human
gaaaagccauguuuaaga

SEQ ID NO: 2052432 - RNA, 19 nt, Human
gaaaagccauguuuaagau

SEQ ID NO: 2052433 - RNA, 20 nt, Human
gaaaagccauguuuaagauu

SEQ ID NO: 2052434 - RNA, 21 nt, Human
gaaaagccauguuuaagauuu

SEQ ID NO: 2052435 - RNA, 16 nt, Human
gaaaagcaccugccga

SEQ ID NO: 2052436 - RNA, 17 nt, Human
gaaaagcaccugccgac

SEQ ID NO: 2052437 - RNA, 16 nt, Human
gaaaacugacagagga

SEQ ID NO: 2052438 - RNA, 19 nt, Human
gaaaacugcaacuuguaaa

SEQ ID NO: 2052439 - RNA, 21 nt, Human
gaaaacuacauuuuaacaugg

SEQ ID NO: 2052440 - RNA, 20 nt, Human
gaaaacuagagcucuaagcc

SEQ ID NO: 2052441 - RNA, 20 nt, Human
gaaaacuugaauucauagaa

SEQ ID NO: 2052442 - RNA, 21 nt, Human
gaaaacuugaauucauagaaa

SEQ ID NO: 2052443 - RNA, 11 nt, Human
cuuuugcuaaa

SEQ ID NO: 2052444 - RNA, 17 nt, Human
cuuuugucuaugggacu

SEQ ID NO: 2052445 - RNA, 16 nt, Human
cuuuuggucuguguga

SEQ ID NO: 2052446 - RNA, 15 nt, Human
cuuuuggucugugug

SEQ ID NO: 2052447 - RNA, 17 nt, Human
cuuuuggguuucugccc

SEQ ID NO: 2052448 - RNA, 19 nt, Human
cuuuuggguuucugcccug

SEQ ID NO: 2052449 - RNA, 20 nt, Human
cuuuuggguuucugcccugc

SEQ ID NO: 2052450 - RNA, 14 nt, Human
cuuuuuuuuaaguu

SEQ ID NO: 2052451 - RNA, 23 nt, Human
cuuuuguguacaguguguaaagu

SEQ ID NO: 2052452 - RNA, 14 nt, Human
cuuuuguguacagu

SEQ ID NO: 2052453 - RNA, 15 nt, Human
gaaaaaauacauuuu

SEQ ID NO: 2052454 - RNA, 17 nt, Human
gaaaaaauacauuuuau

SEQ ID NO: 2052455 - RNA, 21 nt, Human
gaaaaaaaaagucagacugcu

SEQ ID NO: 2052456 - RNA, 10 nt, Human
gaaaaaauac

SEQ ID NO: 2052457 - RNA, 13 nt, Human
gaaaaaauacauu

SEQ ID NO: 2052458 - RNA, 14 nt, Human
gaaaaaauacauuu

SEQ ID NO: 2052459 - RNA, 19 nt, Human
gaaaaaauauuuuccugcc

SEQ ID NO: 2052460 - RNA, 20 nt, Human
gaaugaugauccuaggcauu

SEQ ID NO: 2052461 - RNA, 13 nt, Human
gaaugaugaagcu

SEQ ID NO: 2052462 - RNA, 23 nt, Human
gaaugauucuaauuuuuaagcaa

SEQ ID NO: 2052463 - RNA, 16 nt, Human
gaaugauuuccaaaga

SEQ ID NO: 2052464 - RNA, 20 nt, Human
gaaugauuuccaaagagaaa

SEQ ID NO: 2052465 - RNA, 17 nt, Human
gaauguuugccucugcc

SEQ ID NO: 2052466 - RNA, 16 nt, Human
gaauguuugccucugc

SEQ ID NO: 2052467 - RNA, 15 nt, Human
gaauguuugccucug

SEQ ID NO: 2052468 - RNA, 22 nt, Human
gaaugauuuccaaagagaaaaa

SEQ ID NO: 2052469 - RNA, 19 nt, Human
gaauguuugccucugccuc

SEQ ID NO: 2052470 - RNA, 18 nt, Human
gaauguuugccucugccu

SEQ ID NO: 2052471 - RNA, 12 nt, Human
gaauuaaaacaa

SEQ ID NO: 2052472 - RNA, 13 nt, Human
gaauuaaaacaau

SEQ ID NO: 2052473 - RNA, 15 nt, Human
gaauuaaaacaaugu

SEQ ID NO: 2052474 - RNA, 20 nt, Human
gaauuaaauuaggaauaaau

SEQ ID NO: 2052475 - RNA, 21 nt, Human
gaauuaaauuaggaauaaaua

SEQ ID NO: 2052476 - RNA, 22 nt, Human
gaauuacauguaaaacauuauc

SEQ ID NO: 2052477 - RNA, 18 nt, Human
gaauuaaguuagggaaug

SEQ ID NO: 2052478 - RNA, 21 nt, Human
gaauuaaguuagggaauggca

SEQ ID NO: 2052479 - RNA, 13 nt, Human
gaauuaaauuuaa

SEQ ID NO: 2052480 - RNA, 15 nt, Human
gaauuaaccuggugc

SEQ ID NO: 2052481 - RNA, 16 nt, Human
gaauuaaccuggugcu

SEQ ID NO: 2052482 - RNA, 18 nt, Human
gaauuaaccuggugcugg

SEQ ID NO: 2052483 - RNA, 19 nt, Human
gaauuaaccuggugcugga

SEQ ID NO: 2052484 - RNA, 22 nt, Human
gaauuaaccuggugcuggauau

SEQ ID NO: 2052485 - RNA, 16 nt, Human
gaauuaagaggauaca

SEQ ID NO: 2052486 - RNA, 21 nt, Human
gaauuacauguaaaacauuau

SEQ ID NO: 2052487 - RNA, 19 nt, Human
gaauuaaugacagagccag

SEQ ID NO: 2052488 - RNA, 21 nt, Human
gacacagcucuucuccaggcu

SEQ ID NO: 2052489 - RNA, 20 nt, Human
gacacagcucuucuccaggc

SEQ ID NO: 2052490 - RNA, 19 nt, Human
gacacagcucuucuccagg

SEQ ID NO: 2052491 - RNA, 12 nt, Human
gacacagcucuu

SEQ ID NO: 2052492 - RNA, 14 nt, Human
gacaaagucuccag

SEQ ID NO: 2052493 - RNA, 16 nt, Human
gacaaagucuccagcc

SEQ ID NO: 2052494 - RNA, 17 nt, Human
gacaaagucuccagccc

SEQ ID NO: 2052495 - RNA, 19 nt, Human
gacaaagucuccagcccac

SEQ ID NO: 2052496 - RNA, 15 nt, Human
gacacagaacacaga

SEQ ID NO: 2052497 - RNA, 12 nt, Human
gacaaacccuuc

SEQ ID NO: 2052498 - RNA, 21 nt, Human
gacaaagacaaauucuguuuc

SEQ ID NO: 2052499 - RNA, 14 nt, Human
gacaaagacaaauu

SEQ ID NO: 2052500 - RNA, 17 nt, Human
gacaaaggacauuuguu

SEQ ID NO: 2052501 - RNA, 16 nt, Human
gacaaagcugcuaaau

SEQ ID NO: 2052502 - RNA, 18 nt, Human
gacaaagcugcuaaaucu

SEQ ID NO: 2052503 - RNA, 19 nt, Human
gacaaagcugcuaaaucuc

SEQ ID NO: 2052504 - RNA, 20 nt, Human
gacaaagcugcuaaaucucc

SEQ ID NO: 2052505 - RNA, 20 nt, Human
gacaaagccaaacucugcca

SEQ ID NO: 2052506 - RNA, 16 nt, Human
gaauuauuuuuuuucu

SEQ ID NO: 2052507 - RNA, 22 nt, Human
gaauuuuuuucaucuucucugg

SEQ ID NO: 2052508 - RNA, 16 nt, Human
gacaaaaacagccuca

SEQ ID NO: 2052509 - RNA, 17 nt, Human
gacaaaaacagccucac

SEQ ID NO: 2052510 - RNA, 18 nt, Human
gacaaaaacagccucaca

SEQ ID NO: 2052511 - RNA, 20 nt, Human
gacaaaaacagccucacaga

SEQ ID NO: 2052512 - RNA, 15 nt, Human
gacaaaccagaagca

SEQ ID NO: 2052513 - RNA, 20 nt, Human
gaauuuuuuucaucuucucu

SEQ ID NO: 2052514 - RNA, 17 nt, Human
gaauuuuuuauucuugu

SEQ ID NO: 2052515 - RNA, 18 nt, Human
gaauuuuuuauucuugug

SEQ ID NO: 2052516 - RNA, 19 nt, Human
gaauuuuuuauucuuguga

SEQ ID NO: 2052517 - RNA, 22 nt, Human
gaauuuuuuauucuugugaaua

SEQ ID NO: 2052518 - RNA, 16 nt, Human
gaauuuuuuucaucuu

SEQ ID NO: 2052519 - RNA, 15 nt, Human
gaauguuuuccuucu

SEQ ID NO: 2052520 - RNA, 21 nt, Human
gaauauaccccuuaguguuug

SEQ ID NO: 2052521 - RNA, 11 nt, Human
gaauauauuau

SEQ ID NO: 2052522 - RNA, 12 nt, Human
gaauauauuaua

SEQ ID NO: 2052523 - RNA, 18 nt, Human
gaauaugauuaguaaaga

SEQ ID NO: 2052524 - RNA, 19 nt, Human
gaauaugacggaagaacau

SEQ ID NO: 2052525 - RNA, 19 nt, Human
gaauaugagcuuuauguaa

SEQ ID NO: 2052526 - RNA, 22 nt, Human
gaauaugaacggugagcauugu

SEQ ID NO: 2052527 - RNA, 14 nt, Human
gaauaugacagcug

SEQ ID NO: 2052528 - RNA, 15 nt, Human
gaauaugacggaaga

SEQ ID NO: 2052529 - RNA, 17 nt, Human
gaauaugacggaagaac

SEQ ID NO: 2052530 - RNA, 19 nt, Human
gaauaugauuaguaaagaa

SEQ ID NO: 2052531 - RNA, 23 nt, Human
gacauugcggacagccacggcca

SEQ ID NO: 2052532 - RNA, 17 nt, Human
gacauugcggacagcca

SEQ ID NO: 2052533 - RNA, 15 nt, Human
gacacuucagagagc

SEQ ID NO: 2052534 - RNA, 17 nt, Human
gacacuucagagagcug

SEQ ID NO: 2052535 - RNA, 18 nt, Human
gacacuucagagagcugg

SEQ ID NO: 2052536 - RNA, 19 nt, Human
gacacuucagagagcuggu

SEQ ID NO: 2052537 - RNA, 20 nt, Human
gacacuucagagagcuggua

SEQ ID NO: 2052538 - RNA, 23 nt, Human
gacacuucagagagcugguaguu

SEQ ID NO: 2052539 - RNA, 23 nt, Human
gacacuggcucauauuccugcag

SEQ ID NO: 2052540 - RNA, 21 nt, Human
gacacuuuucaugugugauuu

SEQ ID NO: 2052541 - RNA, 17 nt, Human
gacacuugauacuuguu

SEQ ID NO: 2052542 - RNA, 18 nt, Human
gacagcuccuucuguccu

SEQ ID NO: 2052543 - RNA, 17 nt, Human
gacagcuccuucugucc

SEQ ID NO: 2052544 - RNA, 16 nt, Human
gacagcuccuucuguc

SEQ ID NO: 2052545 - RNA, 19 nt, Human
gacagcuccuucuguccua

SEQ ID NO: 2052546 - RNA, 15 nt, Human
gacauguucccuucu

SEQ ID NO: 2052547 - RNA, 16 nt, Human
gacauguucccuucuc

SEQ ID NO: 2052548 - RNA, 14 nt, Human
gacaugugguggga

SEQ ID NO: 2052549 - RNA, 16 nt, Human
gacauguggugggaca

SEQ ID NO: 2052550 - RNA, 22 nt, Human
gacauguggugggacagggacc

SEQ ID NO: 2052551 - RNA, 13 nt, Human
gacauguggaaag

SEQ ID NO: 2052552 - RNA, 18 nt, Human
gacauguggaaagugaau

SEQ ID NO: 2052553 - RNA, 19 nt, Human
gacauguggaaagugaauu

SEQ ID NO: 2052554 - RNA, 23 nt, Human
gacauguggaaagugaauuugaa

SEQ ID NO: 2052555 - RNA, 14 nt, Human
gaccuccagcuguu

SEQ ID NO: 2052556 - RNA, 12 nt, Human
gaccucccccuc

SEQ ID NO: 2052557 - RNA, 14 nt, Human
gaccucccccuccu

SEQ ID NO: 2052558 - RNA, 15 nt, Human
gaccucccccuccuu

SEQ ID NO: 2052559 - RNA, 16 nt, Human
gaccucccccuccuuc

SEQ ID NO: 2052560 - RNA, 17 nt, Human
gaccucccccuccuucc

SEQ ID NO: 2052561 - RNA, 19 nt, Human
gaccucccccuccuuccca

SEQ ID NO: 2052562 - RNA, 13 nt, Human
gaccucugccuga

SEQ ID NO: 2052563 - RNA, 13 nt, Human
gaccucguccucc

SEQ ID NO: 2052564 - RNA, 15 nt, Human
gaccucguccucccc

SEQ ID NO: 2052565 - RNA, 20 nt, Human
gaccccucuggccaggaugg

SEQ ID NO: 2052566 - RNA, 16 nt, Human
gaccccucuggccagg

SEQ ID NO: 2052567 - RNA, 18 nt, Human
gaccccucuggccaggau

SEQ ID NO: 2052568 - RNA, 17 nt, Human
gacccggaggggccugg

SEQ ID NO: 2052569 - RNA, 23 nt, Human
gacccggagcuaacacuggcccc

SEQ ID NO: 2052570 - RNA, 13 nt, Human
gaccccucuggcc

SEQ ID NO: 2052571 - RNA, 15 nt, Human
gaccccucuggccag

SEQ ID NO: 2052572 - RNA, 20 nt, Human
gacccggaggggccuggcag

SEQ ID NO: 2052573 - RNA, 19 nt, Human
gacccggaggggccuggca

SEQ ID NO: 2052574 - RNA, 18 nt, Human
gacccggaggggccuggc

SEQ ID NO: 2052575 - RNA, 15 nt, Human
gacccucuccacccc

SEQ ID NO: 2052576 - RNA, 16 nt, Human
gacccucuccacccca

SEQ ID NO: 2052577 - RNA, 17 nt, Human
gacccucuccaccccau

SEQ ID NO: 2052578 - RNA, 20 nt, Human
gacccucugacccuagcucu

SEQ ID NO: 2052579 - RNA, 21 nt, Human
gaccucaggugauccacccac

SEQ ID NO: 2052580 - RNA, 20 nt, Human
gaccucaggugauccaccca

SEQ ID NO: 2052581 - RNA, 19 nt, Human
gaccucaggugauccaccc

SEQ ID NO: 2052582 - RNA, 21 nt, Human
gaccucaggugagaagcagag

SEQ ID NO: 2052583 - RNA, 18 nt, Human
gaccucaggugagaagca

SEQ ID NO: 2052584 - RNA, 19 nt, Human
gaccucaggugagaagcag

SEQ ID NO: 2052585 - RNA, 13 nt, Human
gagcaggggcagg

SEQ ID NO: 2052586 - RNA, 16 nt, Human
gagcaggggcagggug

SEQ ID NO: 2052587 - RNA, 16 nt, Human
gagcaguccugccuca

SEQ ID NO: 2052588 - RNA, 20 nt, Human
gagcaguccugccucagccu

SEQ ID NO: 2052589 - RNA, 19 nt, Human
gagcaucucuugaggccag

SEQ ID NO: 2052590 - RNA, 20 nt, Human
gagcaucucuugaggccagg

SEQ ID NO: 2052591 - RNA, 22 nt, Human
gagcaucucuugaggccaggag

SEQ ID NO: 2052592 - RNA, 23 nt, Human
gagcaucucuugaggccaggagu

SEQ ID NO: 2052593 - RNA, 18 nt, Human
gagcaucucuugaggcca

SEQ ID NO: 2052594 - RNA, 17 nt, Human
gagccccgaggccuucu

SEQ ID NO: 2052595 - RNA, 17 nt, Human
gagccccacccucagau

SEQ ID NO: 2052596 - RNA, 12 nt, Human
gagccccuccua

SEQ ID NO: 2052597 - RNA, 14 nt, Human
gagccccgaggccu

SEQ ID NO: 2052598 - RNA, 13 nt, Human
gagccccgaggcc

SEQ ID NO: 2052599 - RNA, 16 nt, Human
gagccccacccucaga

SEQ ID NO: 2052600 - RNA, 14 nt, Human
gagccccacacgga

SEQ ID NO: 2052601 - RNA, 16 nt, Human
gagccccacacggagg

SEQ ID NO: 2052602 - RNA, 19 nt, Human
gagcuguuuauggccucag

SEQ ID NO: 2052603 - RNA, 18 nt, Human
gagcuguuuauggccuca

SEQ ID NO: 2052604 - RNA, 16 nt, Human
gagcuguuuauggccu

SEQ ID NO: 2052605 - RNA, 17 nt, Human
gagcuguuuauggccuc

SEQ ID NO: 2052606 - RNA, 13 nt, Human
gagcccuggcagg

SEQ ID NO: 2052607 - RNA, 23 nt, Human
gagcccuggcaggaugacccugc

SEQ ID NO: 2052608 - RNA, 14 nt, Human
gagcccugguggca

SEQ ID NO: 2052609 - RNA, 13 nt, Human
gagcccugguggc

SEQ ID NO: 2052610 - RNA, 16 nt, Human
gagcuggcgucugucu

SEQ ID NO: 2052611 - RNA, 18 nt, Human
gaggggcaacgaagaaaa

SEQ ID NO: 2052612 - RNA, 20 nt, Human
gaggggcaacgaagaaaaaa

SEQ ID NO: 2052613 - RNA, 18 nt, Human
gaggggcagaacagccgc

SEQ ID NO: 2052614 - RNA, 22 nt, Human
gaggggacuauuuaugaaggca

SEQ ID NO: 2052615 - RNA, 13 nt, Human
gaggggagcucug

SEQ ID NO: 2052616 - RNA, 18 nt, Human
gaggggagcucugucugu

SEQ ID NO: 2052617 - RNA, 21 nt, Human
gaggggaggaucacuggagcc

SEQ ID NO: 2052618 - RNA, 21 nt, Human
gaggggacgcugguagagaug

SEQ ID NO: 2052619 - RNA, 15 nt, Human
gagggcccuaccuga

SEQ ID NO: 2052620 - RNA, 20 nt, Human
gaggcugaaagaggccaaug

SEQ ID NO: 2052621 - RNA, 16 nt, Human
gaggcugaggcaagag

SEQ ID NO: 2052622 - RNA, 16 nt, Human
gaggcucuuucugggc

SEQ ID NO: 2052623 - RNA, 22 nt, Human
gaggcugagccuacagaugaac

SEQ ID NO: 2052624 - RNA, 12 nt, Human
gaggcugaggca

SEQ ID NO: 2052625 - RNA, 13 nt, Human
gaggcugaggcag

SEQ ID NO: 2052626 - RNA, 14 nt, Human
gaggcugaggcaga

SEQ ID NO: 2052627 - RNA, 13 nt, Human
gagggcccaggca

SEQ ID NO: 2052628 - RNA, 16 nt, Human
gagggcccaggcaggc

SEQ ID NO: 2052629 - RNA, 18 nt, Human
gaggacaugauggagcgc

SEQ ID NO: 2052630 - RNA, 13 nt, Human
gaggaccacuccu

SEQ ID NO: 2052631 - RNA, 22 nt, Human
gaggaccacuccuguacacuga

SEQ ID NO: 2052632 - RNA, 23 nt, Human
gaggacuuuucuuuguggcuucc

SEQ ID NO: 2052633 - RNA, 20 nt, Human
gaggacuuuucuuuguggcu

SEQ ID NO: 2052634 - RNA, 16 nt, Human
gaggacuuuucuuugu

SEQ ID NO: 2052635 - RNA, 23 nt, Human
gaggacuguugacauccaagcuu

SEQ ID NO: 2052636 - RNA, 15 nt, Human
gaggacgugggcggc

SEQ ID NO: 2052637 - RNA, 16 nt, Human
gaggacgugggcggca

SEQ ID NO: 2052638 - RNA, 18 nt, Human
gaggacgugggcggcaga

SEQ ID NO: 2052639 - RNA, 20 nt, Human
gaggacgugggcggcagaga

SEQ ID NO: 2052640 - RNA, 22 nt, Human
gaggacgugggcggcagagagg

SEQ ID NO: 2052641 - RNA, 23 nt, Human
gaggacugccccgugcagacugg

SEQ ID NO: 2052642 - RNA, 13 nt, Human
gaggagaaacaca

SEQ ID NO: 2052643 - RNA, 9 nt, Human
gaggagaaa

SEQ ID NO: 2052644 - RNA, 12 nt, Human
gaggagaagaau

SEQ ID NO: 2052645 - RNA, 20 nt, Human
gaggagaagaauuuucagac

SEQ ID NO: 2052646 - RNA, 22 nt, Human
gaggagacuagauuuaugaaua

SEQ ID NO: 2052647 - RNA, 22 nt, Human
gaggagaagaauuuucagaccc

SEQ ID NO: 2052648 - RNA, 18 nt, Human
gaggcagggucucacucu

SEQ ID NO: 2052649 - RNA, 14 nt, Human
gaggagagccuggu

SEQ ID NO: 2052650 - RNA, 20 nt, Human
gaggcagggucucacucugu

SEQ ID NO: 2052651 - RNA, 19 nt, Human
gaggcagggucucacucug

SEQ ID NO: 2052652 - RNA, 22 nt, Human
gaggcagggucucacucugucg

SEQ ID NO: 2052653 - RNA, 21 nt, Human
gagauugugccacuucacucc

SEQ ID NO: 2052654 - RNA, 17 nt, Human
gagauuggacggccuga

SEQ ID NO: 2052655 - RNA, 15 nt, Human
gagauuauguucuuu

SEQ ID NO: 2052656 - RNA, 14 nt, Human
gagauucagacugu

SEQ ID NO: 2052657 - RNA, 18 nt, Human
gagagggaaacgugcccu

SEQ ID NO: 2052658 - RNA, 12 nt, Human
gagaugccuccc

SEQ ID NO: 2052659 - RNA, 22 nt, Human
gagaugccuccaccgcugccua

SEQ ID NO: 2052660 - RNA, 23 nt, Human
gagaugccuccaccgcugccuaa

SEQ ID NO: 2052661 - RNA, 20 nt, Human
gagagcugggugucaagagg

SEQ ID NO: 2052662 - RNA, 14 nt, Human
gagagcuggggaag

SEQ ID NO: 2052663 - RNA, 13 nt, Human
gagagcuggugcc

SEQ ID NO: 2052664 - RNA, 14 nt, Human
gagagcuggugccc

SEQ ID NO: 2052665 - RNA, 17 nt, Human
gagagcuggugcccgga

SEQ ID NO: 2052666 - RNA, 23 nt, Human
gagagcuggggaagcuucuuaaa

SEQ ID NO: 2052667 - RNA, 18 nt, Human
gagagcuguucccaaauu

SEQ ID NO: 2052668 - RNA, 23 nt, Human
gagagcuuucuguccuuuuggca

SEQ ID NO: 2052669 - RNA, 19 nt, Human
gagaggaaugccuguguga

SEQ ID NO: 2052670 - RNA, 14 nt, Human
gagaggagaaacac

SEQ ID NO: 2052671 - RNA, 15 nt, Human
gagaggagaaacaca

SEQ ID NO: 2052672 - RNA, 16 nt, Human
gagaggacgugggcgg

SEQ ID NO: 2052673 - RNA, 17 nt, Human
gagaggacgugggcggc

SEQ ID NO: 2052674 - RNA, 15 nt, Human
gagaggcaauggcca

SEQ ID NO: 2052675 - RNA, 14 nt, Human
gagaggcaaugauu

SEQ ID NO: 2052676 - RNA, 19 nt, Human
gagagggacagcccacuga

SEQ ID NO: 2052677 - RNA, 12 nt, Human
gagaggccauga

SEQ ID NO: 2052678 - RNA, 13 nt, Human
gagagcugggugu

SEQ ID NO: 2052679 - RNA, 15 nt, Human
gagagcuagcagcag

SEQ ID NO: 2052680 - RNA, 21 nt, Human
gagagcuagcagcagggaggg

SEQ ID NO: 2052681 - RNA, 20 nt, Human
gagaccgucgggggcugagg

SEQ ID NO: 2052682 - RNA, 16 nt, Human
gagagcgccugccccu

SEQ ID NO: 2052683 - RNA, 22 nt, Human
gagagcgccugccccucccaga

SEQ ID NO: 2052684 - RNA, 15 nt, Human
gagacucagagggag

SEQ ID NO: 2052685 - RNA, 18 nt, Human
gagacuccgucucaagga

SEQ ID NO: 2052686 - RNA, 16 nt, Human
gagacuccaugagaag

SEQ ID NO: 2052687 - RNA, 17 nt, Human
gagacucagggccccag

SEQ ID NO: 2052688 - RNA, 21 nt, Human
gagacucagggccccagcacu

SEQ ID NO: 2052689 - RNA, 18 nt, Human
gacuuuuugguggaugua

SEQ ID NO: 2052690 - RNA, 21 nt, Human
gacuuuuugguggauguaaau

SEQ ID NO: 2052691 - RNA, 23 nt, Human
gacuuuuugguggauguaaauaa

SEQ ID NO: 2052692 - RNA, 14 nt, Human
gagaaaaaagaagu

SEQ ID NO: 2052693 - RNA, 22 nt, Human
gagaaggggaggaccucugggc

SEQ ID NO: 2052694 - RNA, 15 nt, Human
gagaaggggaggagg

SEQ ID NO: 2052695 - RNA, 23 nt, Human
gagaaggcaggaauguguggcag

SEQ ID NO: 2052696 - RNA, 15 nt, Human
gagaagggauggagg

SEQ ID NO: 2052697 - RNA, 12 nt, Human
gagaaggcagga

SEQ ID NO: 2052698 - RNA, 13 nt, Human
gagaaggcaggaa

SEQ ID NO: 2052699 - RNA, 20 nt, Human
gagaagugccccugcugccu

SEQ ID NO: 2052700 - RNA, 22 nt, Human
gagaagugccccugcugccucc

SEQ ID NO: 2052701 - RNA, 14 nt, Human
gagaagucaaacau

SEQ ID NO: 2052702 - RNA, 18 nt, Human
gagaagucaaacauuuca

SEQ ID NO: 2052703 - RNA, 16 nt, Human
gagaagugccccugcu

SEQ ID NO: 2052704 - RNA, 17 nt, Human
gagaagugccccugcug

SEQ ID NO: 2052705 - RNA, 17 nt, Human
gagaaggggaagcacuc

SEQ ID NO: 2052706 - RNA, 19 nt, Human
gagaagggggucaaagcaa

SEQ ID NO: 2052707 - RNA, 22 nt, Human
gagaagggggucaaagcaagga

SEQ ID NO: 2052708 - RNA, 15 nt, Human
gagaagguccuuaau

SEQ ID NO: 2052709 - RNA, 19 nt, Human
gagaccuggcacuggaugc

SEQ ID NO: 2052710 - RNA, 19 nt, Human
gagacggagucccaccuug

SEQ ID NO: 2052711 - RNA, 16 nt, Human
gagacggagucccacc

SEQ ID NO: 2052712 - RNA, 14 nt, Human
gagacggaguccca

SEQ ID NO: 2052713 - RNA, 23 nt, Human
gagaaugaaagggcccagagagg

SEQ ID NO: 2052714 - RNA, 15 nt, Human
gagaaugaaagggcc

SEQ ID NO: 2052715 - RNA, 23 nt, Human
gagaauauuagcuuuacuguuug

SEQ ID NO: 2052716 - RNA, 16 nt, Human
gagaauaauucuuuga

SEQ ID NO: 2052717 - RNA, 13 nt, Human
gagaauagaagga

SEQ ID NO: 2052718 - RNA, 14 nt, Human
gagaauagaaggaa

SEQ ID NO: 2052719 - RNA, 16 nt, Human
gagaauagaaggaaac

SEQ ID NO: 2052720 - RNA, 22 nt, Human
gagaauagaaggaaacuagcuu

SEQ ID NO: 2052721 - RNA, 23 nt, Human
gagaagugccccugcugccuccc

SEQ ID NO: 2052722 - RNA, 19 nt, Human
gcaagugagagcugggugu

SEQ ID NO: 2052723 - RNA, 18 nt, Human
gcaagugagagcugggug

SEQ ID NO: 2052724 - RNA, 20 nt, Human
gcacucagaagacacugaug

SEQ ID NO: 2052725 - RNA, 10 nt, Human
gcagaaacag

SEQ ID NO: 2052726 - RNA, 11 nt, Human
gcagaaacaga

SEQ ID NO: 2052727 - RNA, 23 nt, Human
gcagaaagcaaaugugaccugug

SEQ ID NO: 2052728 - RNA, 13 nt, Human
gcagaaagcagag

SEQ ID NO: 2052729 - RNA, 16 nt, Human
gcagaaagcagaggcu

SEQ ID NO: 2052730 - RNA, 17 nt, Human
gcagaaagcagaggcug

SEQ ID NO: 2052731 - RNA, 18 nt, Human
gcagaaagcagaggcugg

SEQ ID NO: 2052732 - RNA, 16 nt, Human
gcagaaaauugccuaa

SEQ ID NO: 2052733 - RNA, 21 nt, Human
gcagaaaagcaccugccgacc

SEQ ID NO: 2052734 - RNA, 20 nt, Human
gcagaaaagcaccugccgac

SEQ ID NO: 2052735 - RNA, 15 nt, Human
gcagaaaagcaccug

SEQ ID NO: 2052736 - RNA, 16 nt, Human
gcagaaaagcaccugc

SEQ ID NO: 2052737 - RNA, 17 nt, Human
gcagaaaagcaccugcc

SEQ ID NO: 2052738 - RNA, 18 nt, Human
gcagaaaagcaccugccg

SEQ ID NO: 2052739 - RNA, 12 nt, Human
gcacuccagccu

SEQ ID NO: 2052740 - RNA, 14 nt, Human
gcacuccagccugg

SEQ ID NO: 2052741 - RNA, 15 nt, Human
gcacuccagccuggg

SEQ ID NO: 2052742 - RNA, 14 nt, Human
gcagaacugagcuc

SEQ ID NO: 2052743 - RNA, 16 nt, Human
gcagaacugagcuccu

SEQ ID NO: 2052744 - RNA, 21 nt, Human
gcagaacguauugguccagcu

SEQ ID NO: 2052745 - RNA, 20 nt, Human
gcagaacaguuaagcagccg

SEQ ID NO: 2052746 - RNA, 14 nt, Human
gcagaacccuggug

SEQ ID NO: 2052747 - RNA, 16 nt, Human
gcagaacccuggugag

SEQ ID NO: 2052748 - RNA, 23 nt, Human
gcagaacagccgcuccugucugc

SEQ ID NO: 2052749 - RNA, 18 nt, Human
gcagaacugagcuccucu

SEQ ID NO: 2052750 - RNA, 12 nt, Human
gcagaggcagcg

SEQ ID NO: 2052751 - RNA, 13 nt, Human
gcagccaagcucc

SEQ ID NO: 2052752 - RNA, 17 nt, Human
gcagccaagcuccuugg

SEQ ID NO: 2052753 - RNA, 20 nt, Human
gcagccaagcuccuugggag

SEQ ID NO: 2052754 - RNA, 15 nt, Human
gcagcaucugcuaau

SEQ ID NO: 2052755 - RNA, 19 nt, Human
gcagcaucuucacuucuaa

SEQ ID NO: 2052756 - RNA, 21 nt, Human
gcagccaaacccaugaggcaa

SEQ ID NO: 2052757 - RNA, 17 nt, Human
gcagcaugaccugugac

SEQ ID NO: 2052758 - RNA, 14 nt, Human
gcagcauaugagga

SEQ ID NO: 2052759 - RNA, 17 nt, Human
gcagcagugagucucuu

SEQ ID NO: 2052760 - RNA, 21 nt, Human
gcagcagugagucucuucaga

SEQ ID NO: 2052761 - RNA, 22 nt, Human
gcagaggcuggaggcagggccu

SEQ ID NO: 2052762 - RNA, 16 nt, Human
gcagagggcagaggcu

SEQ ID NO: 2052763 - RNA, 18 nt, Human
gcagagggcagaggcugg

SEQ ID NO: 2052764 - RNA, 19 nt, Human
gcagagggcagaggcugga

SEQ ID NO: 2052765 - RNA, 11 nt, Human
gcagaggcugg

SEQ ID NO: 2052766 - RNA, 19 nt, Human
gcagaggcuggaggcaggg

SEQ ID NO: 2052767 - RNA, 21 nt, Human
gcagaggcuggaggcagggcc

SEQ ID NO: 2052768 - RNA, 12 nt, Human
gcagaggcuggc

SEQ ID NO: 2052769 - RNA, 14 nt, Human
gcagaggcuggccu

SEQ ID NO: 2052770 - RNA, 17 nt, Human
gcagaggcuggccucag

SEQ ID NO: 2052771 - RNA, 18 nt, Human
gcagaggcuggccucaga

SEQ ID NO: 2052772 - RNA, 19 nt, Human
gcagaggcuggccucagac

SEQ ID NO: 2052773 - RNA, 15 nt, Human
gcagcucuccccuuc

SEQ ID NO: 2052774 - RNA, 18 nt, Human
gcagcccaccccucaaca

SEQ ID NO: 2052775 - RNA, 13 nt, Human
gcacuccagccug

SEQ ID NO: 2052776 - RNA, 15 nt, Human
gcagccagcucucag

SEQ ID NO: 2052777 - RNA, 16 nt, Human
gcagccagcucucagc

SEQ ID NO: 2052778 - RNA, 17 nt, Human
gcagccagcucucagcc

SEQ ID NO: 2052779 - RNA, 18 nt, Human
gcagccagcucucagcca

SEQ ID NO: 2052780 - RNA, 12 nt, Human
gcagccaggcug

SEQ ID NO: 2052781 - RNA, 13 nt, Human
gcagccaggcugc

SEQ ID NO: 2052782 - RNA, 14 nt, Human
gcagccaggcugcc

SEQ ID NO: 2052783 - RNA, 17 nt, Human
gcagccaggcugccaag

SEQ ID NO: 2052784 - RNA, 13 nt, Human
gcagccagcccag

SEQ ID NO: 2052785 - RNA, 15 nt, Human
gcagccagcccagcc

SEQ ID NO: 2052786 - RNA, 16 nt, Human
gcagccagcccagccc

SEQ ID NO: 2052787 - RNA, 17 nt, Human
gcagccagcccagccca

SEQ ID NO: 2052788 - RNA, 13 nt, Human
gcagccagcucuc

SEQ ID NO: 2052789 - RNA, 21 nt, Human
gcagccagcccagcccagcug

SEQ ID NO: 2052790 - RNA, 23 nt, Human
gcagccagcccagcccagcuggu

SEQ ID NO: 2052791 - RNA, 21 nt, Human
gcagugaugcuggaugcuccu

SEQ ID NO: 2052792 - RNA, 14 nt, Human
gcaguuggccagag

SEQ ID NO: 2052793 - RNA, 22 nt, Human
gcaguuggccagagagccuggu

SEQ ID NO: 2052794 - RNA, 20 nt, Human
gcagcugagaaaaugaguga

SEQ ID NO: 2052795 - RNA, 14 nt, Human
gcagcugccagaga

SEQ ID NO: 2052796 - RNA, 15 nt, Human
gcagcugccagagaa

SEQ ID NO: 2052797 - RNA, 14 nt, Human
gcagcugauuuuaa

SEQ ID NO: 2052798 - RNA, 15 nt, Human
gcagcugauuuuaac

SEQ ID NO: 2052799 - RNA, 17 nt, Human
gcagcugauuuuaacaa

SEQ ID NO: 2052800 - RNA, 18 nt, Human
gcagcugauuuuaacaau

SEQ ID NO: 2052801 - RNA, 16 nt, Human
gcagucuacccaccuc

SEQ ID NO: 2052802 - RNA, 18 nt, Human
gcagucucggguggcuag

SEQ ID NO: 2052803 - RNA, 15 nt, Human
gcagucucucuuacc

SEQ ID NO: 2052804 - RNA, 22 nt, Human
gcagucucucuuacccuucugu

SEQ ID NO: 2052805 - RNA, 16 nt, Human
gcagucuggaggggca

SEQ ID NO: 2052806 - RNA, 12 nt, Human
gcagucuggagg

SEQ ID NO: 2052807 - RNA, 13 nt, Human
gcagucuggaggg

SEQ ID NO: 2052808 - RNA, 14 nt, Human
gcagucuggagggg

SEQ ID NO: 2052809 - RNA, 15 nt, Human
gcagucuggaggggc

SEQ ID NO: 2052810 - RNA, 21 nt, Human
gcagugaauugugaccaaguu

SEQ ID NO: 2052811 - RNA, 14 nt, Human
gcagugaauuguga

SEQ ID NO: 2052812 - RNA, 18 nt, Human
gcagugacgugcaccugu

SEQ ID NO: 2052813 - RNA, 18 nt, Human
gcagugacuguggccaug

SEQ ID NO: 2052814 - RNA, 22 nt, Human
gcagugacuguggccauggucc

SEQ ID NO: 2052815 - RNA, 20 nt, Human
gcagugagccaagauugcgc

SEQ ID NO: 2052816 - RNA, 21 nt, Human
gcagugagccgcaucuucucc

SEQ ID NO: 2052817 - RNA, 14 nt, Human
gcagugagcugaga

SEQ ID NO: 2052818 - RNA, 14 nt, Human
gcagugagcugugu

SEQ ID NO: 2052819 - RNA, 22 nt, Human
gcagugagggguauaucugggc

SEQ ID NO: 2052820 - RNA, 18 nt, Human
gcagugagucucuucaga

SEQ ID NO: 2052821 - RNA, 12 nt, Human
gcauccaggcac

SEQ ID NO: 2052822 - RNA, 17 nt, Human
gcauccauguguggacu

SEQ ID NO: 2052823 - RNA, 12 nt, Human
gcauccauuccu

SEQ ID NO: 2052824 - RNA, 14 nt, Human
gcauccauuccuca

SEQ ID NO: 2052825 - RNA, 15 nt, Human
gcauccauuccucag

SEQ ID NO: 2052826 - RNA, 16 nt, Human
gcauccauuccucagg

SEQ ID NO: 2052827 - RNA, 18 nt, Human
gcauccauuccucaggga

SEQ ID NO: 2052828 - RNA, 21 nt, Human
gcauccauuccucagggacag

SEQ ID NO: 2052829 - RNA, 17 nt, Human
gcauccguaguucccug

SEQ ID NO: 2052830 - RNA, 19 nt, Human
gcauccguaguucccugaa

SEQ ID NO: 2052831 - RNA, 18 nt, Human
gcauccguaguucccuga

SEQ ID NO: 2052832 - RNA, 15 nt, Human
gcauccucaguuccu

SEQ ID NO: 2052833 - RNA, 20 nt, Human
gcauccucaguuccugcagc

SEQ ID NO: 2052834 - RNA, 21 nt, Human
gcauccucaguuccugcagca

SEQ ID NO: 2052835 - RNA, 20 nt, Human
gcaucccaguggccucaacc

SEQ ID NO: 2052836 - RNA, 23 nt, Human
gcaucccaguggccucaacccuc

SEQ ID NO: 2052837 - RNA, 14 nt, Human
gcaucccaguggcc

SEQ ID NO: 2052838 - RNA, 15 nt, Human
gcaucccaguggccu

SEQ ID NO: 2052839 - RNA, 16 nt, Human
gcaucccaguggccuc

SEQ ID NO: 2052840 - RNA, 17 nt, Human
gcaucccaguggccuca

SEQ ID NO: 2052841 - RNA, 13 nt, Human
gcaucccagggga

SEQ ID NO: 2052842 - RNA, 14 nt, Human
gcaucccaggggac

SEQ ID NO: 2052843 - RNA, 15 nt, Human
gcaucccaggggacc

SEQ ID NO: 2052844 - RNA, 16 nt, Human
gcaucccaggggacca

SEQ ID NO: 2052845 - RNA, 19 nt, Human
gcaucccaggggaccacac

SEQ ID NO: 2052846 - RNA, 21 nt, Human
gcaucccaggggaccacaccu

SEQ ID NO: 2052847 - RNA, 17 nt, Human
gcaucccugaggcugga

SEQ ID NO: 2052848 - RNA, 20 nt, Human
gcaucccugaggcuggacuc

SEQ ID NO: 2052849 - RNA, 12 nt, Human
gcaucuaaacuu

SEQ ID NO: 2052850 - RNA, 15 nt, Human
gcaucuaaacuuuaa

SEQ ID NO: 2052851 - RNA, 16 nt, Human
gcaucuaaacuuuaau

SEQ ID NO: 2052852 - RNA, 19 nt, Human
gcaucuaaacuuuaauaug

SEQ ID NO: 2052853 - RNA, 20 nt, Human
gcaucuaaacuuuaauaugu

SEQ ID NO: 2052854 - RNA, 21 nt, Human
gcaucuaaacuuuaauaugua

SEQ ID NO: 2052855 - RNA, 22 nt, Human
gcauggcguagagggugcugcc

SEQ ID NO: 2052856 - RNA, 23 nt, Human
gcauggcguagagggugcugccc

SEQ ID NO: 2052857 - RNA, 13 nt, Human
gcauggcuccagu

SEQ ID NO: 2052858 - RNA, 14 nt, Human
gcauggcuccaguc

SEQ ID NO: 2052859 - RNA, 13 nt, Human
gcauccuggcacc

SEQ ID NO: 2052860 - RNA, 15 nt, Human
gcauggcuccagucu

SEQ ID NO: 2052861 - RNA, 21 nt, Human
gcauggcuccagucugcugcc

SEQ ID NO: 2052862 - RNA, 22 nt, Human
gcauggcuccagucugcugccc

SEQ ID NO: 2052863 - RNA, 22 nt, Human
gcaugguauuugagacauucca

SEQ ID NO: 2052864 - RNA, 21 nt, Human
gcaugggugaagggagagcca

SEQ ID NO: 2052865 - RNA, 18 nt, Human
gcaugggggccucagggc

SEQ ID NO: 2052866 - RNA, 15 nt, Human
gcauggguuuuguag

SEQ ID NO: 2052867 - RNA, 16 nt, Human
gcauggguuuuguagg

SEQ ID NO: 2052868 - RNA, 19 nt, Human
gcaugguggcgcaagccug

SEQ ID NO: 2052869 - RNA, 13 nt, Human
gcaugguggcaug

SEQ ID NO: 2052870 - RNA, 14 nt, Human
gcauggugcaugcc

SEQ ID NO: 2052871 - RNA, 15 nt, Human
gcauuuacuuugugu

SEQ ID NO: 2052872 - RNA, 12 nt, Human
gcauguguauuu

SEQ ID NO: 2052873 - RNA, 20 nt, Human
gcauguguauuuccagugca

SEQ ID NO: 2052874 - RNA, 21 nt, Human
gcauguguauuuccagugcaa

SEQ ID NO: 2052875 - RNA, 17 nt, Human
gcaaccuguaagacuga

SEQ ID NO: 2052876 - RNA, 20 nt, Human
gcaaccuccgccucuugggu

SEQ ID NO: 2052877 - RNA, 19 nt, Human
gcaaccuccgccucuuggg

SEQ ID NO: 2052878 - RNA, 16 nt, Human
gcaacccccagccugc

SEQ ID NO: 2052879 - RNA, 15 nt, Human
gcaacccccagccug

SEQ ID NO: 2052880 - RNA, 14 nt, Human
gcaacccccagccu

SEQ ID NO: 2052881 - RNA, 20 nt, Human
gcaaccacaggcagcauuua

SEQ ID NO: 2052882 - RNA, 15 nt, Human
gcaaccagagcacug

SEQ ID NO: 2052883 - RNA, 16 nt, Human
gcaaccagagcacugu

SEQ ID NO: 2052884 - RNA, 17 nt, Human
gcaaccagagcacugua

SEQ ID NO: 2052885 - RNA, 18 nt, Human
gcaaccagagcacuguau

SEQ ID NO: 2052886 - RNA, 19 nt, Human
gcaaccagagcacuguaua

SEQ ID NO: 2052887 - RNA, 18 nt, Human
gcaaaauuauagaaguuu

SEQ ID NO: 2052888 - RNA, 23 nt, Human
gcaaaauuauagaaguuuagauu

SEQ ID NO: 2052889 - RNA, 13 nt, Human
gcaacaggcuggg

SEQ ID NO: 2052890 - RNA, 15 nt, Human
gcaacaggcugggcu

SEQ ID NO: 2052891 - RNA, 14 nt, Human
gcaacaggcugggc

SEQ ID NO: 2052892 - RNA, 21 nt, Human
gcaaaaggcaguggggcuggg

SEQ ID NO: 2052893 - RNA, 21 nt, Human
gcaaaagguucacuaaagcag

SEQ ID NO: 2052894 - RNA, 20 nt, Human
gcaaaagguucacuaaagca

SEQ ID NO: 2052895 - RNA, 19 nt, Human
gcaacaggcugggcuucag

SEQ ID NO: 2052896 - RNA, 16 nt, Human
gcaacaggcugggcuu

SEQ ID NO: 2052897 - RNA, 17 nt, Human
gcaacaguagcauagga

SEQ ID NO: 2052898 - RNA, 23 nt, Human
gcaacaugcuucaugaaaauccu

SEQ ID NO: 2052899 - RNA, 18 nt, Human
gcaacaucuagcaaaugu

SEQ ID NO: 2052900 - RNA, 15 nt, Human
gcaagugagagcugg

SEQ ID NO: 2052901 - RNA, 16 nt, Human
gcaagugagagcuggg

SEQ ID NO: 2052902 - RNA, 12 nt, Human
gauucuucugcu

SEQ ID NO: 2052903 - RNA, 15 nt, Human
gauucuucugcuuca

SEQ ID NO: 2052904 - RNA, 13 nt, Human
gauucuucugcuu

SEQ ID NO: 2052905 - RNA, 20 nt, Human
gauucuucugcuucagccuc

SEQ ID NO: 2052906 - RNA, 19 nt, Human
gauuuaauaacauaacaaa

SEQ ID NO: 2052907 - RNA, 19 nt, Human
gauuuacagccucacuuga

SEQ ID NO: 2052908 - RNA, 14 nt, Human
gauuuaauuugcca

SEQ ID NO: 2052909 - RNA, 15 nt, Human
gauuuaauuugccaa

SEQ ID NO: 2052910 - RNA, 16 nt, Human
gauuuaauuugccaaa

SEQ ID NO: 2052911 - RNA, 20 nt, Human
gauuuaauuugccaaaauaa

SEQ ID NO: 2052912 - RNA, 23 nt, Human
gauuuaauuugccaaaauaaugu

SEQ ID NO: 2052913 - RNA, 14 nt, Human
gauuuauuuuguua

SEQ ID NO: 2052914 - RNA, 17 nt, Human
gcaaaaacgaaagcugg

SEQ ID NO: 2052915 - RNA, 17 nt, Human
gcaaaagaugcuucuca

SEQ ID NO: 2052916 - RNA, 22 nt, Human
gcaaaagaugcuucucacugcc

SEQ ID NO: 2052917 - RNA, 14 nt, Human
gcaaaaaggcagga

SEQ ID NO: 2052918 - RNA, 15 nt, Human
gauuucaagccugcc

SEQ ID NO: 2052919 - RNA, 18 nt, Human
gauggaaccgcaggaagc

SEQ ID NO: 2052920 - RNA, 19 nt, Human
gauggaaccgcaggaagcu

SEQ ID NO: 2052921 - RNA, 20 nt, Human
gauggaaccgcaggaagcug

SEQ ID NO: 2052922 - RNA, 22 nt, Human
gauggaaccgcaggaagcugcu

SEQ ID NO: 2052923 - RNA, 21 nt, Human
gauggaaguugcagugagcug

SEQ ID NO: 2052924 - RNA, 17 nt, Human
gauacaugucuuucucc

SEQ ID NO: 2052925 - RNA, 21 nt, Human
gauacauuuguauguugugaa

SEQ ID NO: 2052926 - RNA, 19 nt, Human
gauaccaagaugccaucug

SEQ ID NO: 2052927 - RNA, 20 nt, Human
gauacuggaaguuuugcauu

SEQ ID NO: 2052928 - RNA, 16 nt, Human
gauacuggaaguuuug

SEQ ID NO: 2052929 - RNA, 19 nt, Human
gauacuggaaguuuugcau

SEQ ID NO: 2052930 - RNA, 15 nt, Human
gauacugcccggggc

SEQ ID NO: 2052931 - RNA, 17 nt, Human
gauaccagguugaaaga

SEQ ID NO: 2052932 - RNA, 20 nt, Human
gauaccagguugaaagaccu

SEQ ID NO: 2052933 - RNA, 21 nt, Human
gauaccaucagcaaagaauuu

SEQ ID NO: 2052934 - RNA, 17 nt, Human
gauacucugucagaugg

SEQ ID NO: 2052935 - RNA, 14 nt, Human
gauacuggaaguuu

SEQ ID NO: 2052936 - RNA, 19 nt, Human
gauccaagcuggucccacu

SEQ ID NO: 2052937 - RNA, 17 nt, Human
gauccaagcugguccca

SEQ ID NO: 2052938 - RNA, 16 nt, Human
gauccaagcugguccc

SEQ ID NO: 2052939 - RNA, 12 nt, Human
gauccaagcugg

SEQ ID NO: 2052940 - RNA, 21 nt, Human
gaucaaaaucuguagagcagg

SEQ ID NO: 2052941 - RNA, 16 nt, Human
gaucaaauucuacaac

SEQ ID NO: 2052942 - RNA, 19 nt, Human
gauccacccaccucagccu

SEQ ID NO: 2052943 - RNA, 18 nt, Human
gauccacccaccucagcc

SEQ ID NO: 2052944 - RNA, 21 nt, Human
gauccaagcuggucccacuca

SEQ ID NO: 2052945 - RNA, 14 nt, Human
gauccacacacaga

SEQ ID NO: 2052946 - RNA, 15 nt, Human
gauccacacacagag

SEQ ID NO: 2052947 - RNA, 21 nt, Human
gauccacccaccucagccucc

SEQ ID NO: 2052948 - RNA, 20 nt, Human
gauccacccaccucagccuc

SEQ ID NO: 2052949 - RNA, 22 nt, Human
gauccacccaccucagccuccc

SEQ ID NO: 2052950 - RNA, 18 nt, Human
gauccacacacagaggaa

SEQ ID NO: 2052951 - RNA, 16 nt, Human
gauccacacacagagg

SEQ ID NO: 2052952 - RNA, 17 nt, Human
gauccacacacagagga

SEQ ID NO: 2052953 - RNA, 19 nt, Human
gauccacacacagaggaag

SEQ ID NO: 2052954 - RNA, 14 nt, Human
gauagaaauaaaua

SEQ ID NO: 2052955 - RNA, 16 nt, Human
gauagaaauaaauagc

SEQ ID NO: 2052956 - RNA, 20 nt, Human
gauagaaauaaauagcuaua

SEQ ID NO: 2052957 - RNA, 17 nt, Human
gauagaagaaaaaagaa

SEQ ID NO: 2052958 - RNA, 14 nt, Human
gauagaagaacugc

SEQ ID NO: 2052959 - RNA, 16 nt, Human
gauagaagaacugcaa

SEQ ID NO: 2052960 - RNA, 14 nt, Human
gauagaagauguuu

SEQ ID NO: 2052961 - RNA, 16 nt, Human
gauagaagauguuugc

SEQ ID NO: 2052962 - RNA, 17 nt, Human
gauagaagauguuugcu

SEQ ID NO: 2052963 - RNA, 18 nt, Human
gauacuuugauauuuuca

SEQ ID NO: 2052964 - RNA, 13 nt, Human
gauacuuuacaug

SEQ ID NO: 2052965 - RNA, 20 nt, Human
gauacuggcaaagcagaaaa

SEQ ID NO: 2052966 - RNA, 15 nt, Human
gauacuuguuuucaa

SEQ ID NO: 2052967 - RNA, 19 nt, Human
gauauuuauggggggagaa

SEQ ID NO: 2052968 - RNA, 17 nt, Human
gauauugugaaguacau

SEQ ID NO: 2052969 - RNA, 13 nt, Human
gauauuuaagaaa

SEQ ID NO: 2052970 - RNA, 15 nt, Human
gauauuuaagaaaau

SEQ ID NO: 2052971 - RNA, 16 nt, Human
gauauuuaagaaaaua

SEQ ID NO: 2052972 - RNA, 20 nt, Human
gauauuuaagaaaauacaau

SEQ ID NO: 2052973 - RNA, 23 nt, Human
gauauuuaagaaaauacaauaaa

SEQ ID NO: 2052974 - RNA, 16 nt, Human
gauauugugaaguaca

SEQ ID NO: 2052975 - RNA, 23 nt, Human
gauauuuauauuuuuauuuuauu

SEQ ID NO: 2052976 - RNA, 19 nt, Human
gauauuuucaacgcagccc

SEQ ID NO: 2052977 - RNA, 12 nt, Human
gauauuuucaaa

SEQ ID NO: 2052978 - RNA, 18 nt, Human
gauauuuucaaauuguau

SEQ ID NO: 2052979 - RNA, 19 nt, Human
gauauuuucaaauuguauc

SEQ ID NO: 2052980 - RNA, 20 nt, Human
gauauuuucaaauuguaucu

SEQ ID NO: 2052981 - RNA, 16 nt, Human
gauauuuccaucauua

SEQ ID NO: 2052982 - RNA, 17 nt, Human
gauauuuccaucauuaa

SEQ ID NO: 2052983 - RNA, 23 nt, Human
gauauuuucaacgcagcccugcu

SEQ ID NO: 2052984 - RNA, 22 nt, Human
gauauuuucaacgcagcccugc

SEQ ID NO: 2052985 - RNA, 21 nt, Human
gauauuuucaacgcagcccug

SEQ ID NO: 2052986 - RNA, 20 nt, Human
gaucaaaagguuaauaaagu

SEQ ID NO: 2052987 - RNA, 20 nt, Human
gauauuuucuuccaagcaaa

SEQ ID NO: 2052988 - RNA, 23 nt, Human
gaucaaaagguuaauaaaguaau

SEQ ID NO: 2052989 - RNA, 22 nt, Human
gaucaaaccccgaccaccugcc

SEQ ID NO: 2052990 - RNA, 19 nt, Human
gaucucuugagccugggag

SEQ ID NO: 2052991 - RNA, 12 nt, Human
gaucugaacaga

SEQ ID NO: 2052992 - RNA, 19 nt, Human
gaucugaacagaaauacca

SEQ ID NO: 2052993 - RNA, 22 nt, Human
gaucccacuccuaggacauguu

SEQ ID NO: 2052994 - RNA, 17 nt, Human
gaucugaugcaagcaag

SEQ ID NO: 2052995 - RNA, 13 nt, Human
gaucugacugcac

SEQ ID NO: 2052996 - RNA, 14 nt, Human
gaucugacugcacg

SEQ ID NO: 2052997 - RNA, 18 nt, Human
gaucucuugagccuggga

SEQ ID NO: 2052998 - RNA, 17 nt, Human
gaucccagcucacguca

SEQ ID NO: 2052999 - RNA, 19 nt, Human
gaucccagcucacgucaca

SEQ ID NO: 2053000 - RNA, 14 nt, Human
gauccaccugucuc

SEQ ID NO: 2053001 - RNA, 18 nt, Human
gauccaccugucucagcc

SEQ ID NO: 2053002 - RNA, 19 nt, Human
gauccaccugucucagccu

SEQ ID NO: 2053003 - RNA, 22 nt, Human
gauggaaaaaccacccccaaau

SEQ ID NO: 2053004 - RNA, 15 nt, Human
gauggaaaaggaaga

SEQ ID NO: 2053005 - RNA, 17 nt, Human
gauggaaaaggaagacu

SEQ ID NO: 2053006 - RNA, 14 nt, Human
gauggaaacaaagu

SEQ ID NO: 2053007 - RNA, 15 nt, Human
gauggaaacaaagug

SEQ ID NO: 2053008 - RNA, 16 nt, Human
gauggaaacaaagugg

SEQ ID NO: 2053009 - RNA, 20 nt, Human
gauggaacccuuuuggcccc

SEQ ID NO: 2053010 - RNA, 22 nt, Human
gauggaacccuuuuggcccccg

SEQ ID NO: 2053011 - RNA, 17 nt, Human
gauggaaccgcaggaag

SEQ ID NO: 2053012 - RNA, 20 nt, Human
gaugauuugcuaucaaaaua

SEQ ID NO: 2053013 - RNA, 15 nt, Human
gaugcuucugggaga

SEQ ID NO: 2053014 - RNA, 24 nt, Human
gaugcuugccuagggccuggucca

SEQ ID NO: 2053015 - RNA, 13 nt, Human
gaugauuguacag

SEQ ID NO: 2053016 - RNA, 13 nt, Human
gaugauccuaggc

SEQ ID NO: 2053017 - RNA, 14 nt, Human
gaugauccuaggca

SEQ ID NO: 2053018 - RNA, 20 nt, Human
gaugaucagcuguuugucau

SEQ ID NO: 2053019 - RNA, 22 nt, Human
gaugauccaugaguuugcccug

SEQ ID NO: 2053020 - RNA, 23 nt, Human
gaugauccaugaguuugcccugg

SEQ ID NO: 2053021 - RNA, 19 nt, Human
gaugaucagcuguuuguca

SEQ ID NO: 2053022 - RNA, 22 nt, Human
gcccaggccccugccacccugg

SEQ ID NO: 2053023 - RNA, 13 nt, Human
gcccacuggauca

SEQ ID NO: 2053024 - RNA, 21 nt, Human
gcccaggccccugccacccug

SEQ ID NO: 2053025 - RNA, 20 nt, Human
gcccaggccccugccacccu

SEQ ID NO: 2053026 - RNA, 12 nt, Human
gcccaggccccu

SEQ ID NO: 2053027 - RNA, 11 nt, Human
gcccaggcccc

SEQ ID NO: 2053028 - RNA, 14 nt, Human
gcccaggcaggcca

SEQ ID NO: 2053029 - RNA, 15 nt, Human
gcccaggagagccag

SEQ ID NO: 2053030 - RNA, 11 nt, Human
gcccaggcagg

SEQ ID NO: 2053031 - RNA, 15 nt, Human
gcccaggauggcuuu

SEQ ID NO: 2053032 - RNA, 10 nt, Human
gcccaggaga

SEQ ID NO: 2053033 - RNA, 11 nt, Human
gcccaggagac

SEQ ID NO: 2053034 - RNA, 18 nt, Human
gcccaggagagccagccc

SEQ ID NO: 2053035 - RNA, 20 nt, Human
gcccaggaauuugaagcugc

SEQ ID NO: 2053036 - RNA, 18 nt, Human
gcauuuacuuuguguuca

SEQ ID NO: 2053037 - RNA, 17 nt, Human
gcauuuacuuugaauuu

SEQ ID NO: 2053038 - RNA, 16 nt, Human
gcauuuagcacaaaaa

SEQ ID NO: 2053039 - RNA, 13 nt, Human
gccauuaccaugg

SEQ ID NO: 2053040 - RNA, 16 nt, Human
gccauuaccauggaga

SEQ ID NO: 2053041 - RNA, 14 nt, Human
gccauugcacucca

SEQ ID NO: 2053042 - RNA, 15 nt, Human
gccauugcacuccag

SEQ ID NO: 2053043 - RNA, 18 nt, Human
gccauugcacuccagccu

SEQ ID NO: 2053044 - RNA, 19 nt, Human
gccauugcacuccagccug

SEQ ID NO: 2053045 - RNA, 21 nt, Human
gccauugcacuccagccuggg

SEQ ID NO: 2053046 - RNA, 17 nt, Human
gccauugccaccaggag

SEQ ID NO: 2053047 - RNA, 18 nt, Human
gccauugccaccaggaga

SEQ ID NO: 2053048 - RNA, 19 nt, Human
gccauugccaccaggagaa

SEQ ID NO: 2053049 - RNA, 18 nt, Human
gccauuaccauggagaca

SEQ ID NO: 2053050 - RNA, 23 nt, Human
gcccacuucaggguucuccucuc

SEQ ID NO: 2053051 - RNA, 13 nt, Human
gcccacuucaggg

SEQ ID NO: 2053052 - RNA, 13 nt, Human
gcccacuucugcc

SEQ ID NO: 2053053 - RNA, 21 nt, Human
gcccacgcuggagugcaguga

SEQ ID NO: 2053054 - RNA, 19 nt, Human
gcccacgcuggagugcagu

SEQ ID NO: 2053055 - RNA, 23 nt, Human
gcccacgcuggagugcagugagc

SEQ ID NO: 2053056 - RNA, 17 nt, Human
gccccaaacaaauaugc

SEQ ID NO: 2053057 - RNA, 19 nt, Human
gccccaaacaaauaugcaa

SEQ ID NO: 2053058 - RNA, 18 nt, Human
gccccaaacaaauaugca

SEQ ID NO: 2053059 - RNA, 20 nt, Human
gccccaaacgggcugcccug

SEQ ID NO: 2053060 - RNA, 15 nt, Human
gccccaaaggaagcu

SEQ ID NO: 2053061 - RNA, 18 nt, Human
gccccaacccaaaccugg

SEQ ID NO: 2053062 - RNA, 19 nt, Human
gccccaacccaaaccugga

SEQ ID NO: 2053063 - RNA, 20 nt, Human
gccccaacccaaaccuggag

SEQ ID NO: 2053064 - RNA, 21 nt, Human
gccccaacccaaaccuggaga

SEQ ID NO: 2053065 - RNA, 22 nt, Human
gccccaacccaaaccuggagau

SEQ ID NO: 2053066 - RNA, 14 nt, Human
gccccaacuccugg

SEQ ID NO: 2053067 - RNA, 15 nt, Human
gccccaacuccugga

SEQ ID NO: 2053068 - RNA, 16 nt, Human
gccccaacuccuggaa

SEQ ID NO: 2053069 - RNA, 17 nt, Human
gccccaacuccuggaag

SEQ ID NO: 2053070 - RNA, 18 nt, Human
gccccaacuccuggaagc

SEQ ID NO: 2053071 - RNA, 11 nt, Human
gccccaccacc

SEQ ID NO: 2053072 - RNA, 13 nt, Human
gccccaccaccua

SEQ ID NO: 2053073 - RNA, 12 nt, Human
gccccacccagg

SEQ ID NO: 2053074 - RNA, 15 nt, Human
gccccacccaggagg

SEQ ID NO: 2053075 - RNA, 12 nt, Human
gcccccagacgc

SEQ ID NO: 2053076 - RNA, 14 nt, Human
gccccaccaccuag

SEQ ID NO: 2053077 - RNA, 15 nt, Human
gccccaccaccuagg

SEQ ID NO: 2053078 - RNA, 18 nt, Human
gccccaccaccuaggcca

SEQ ID NO: 2053079 - RNA, 20 nt, Human
gccccaccaccuaggccacu

SEQ ID NO: 2053080 - RNA, 23 nt, Human
gccccaccaccuaggccacuccu

SEQ ID NO: 2053081 - RNA, 11 nt, Human
gccccacccag

SEQ ID NO: 2053082 - RNA, 16 nt, Human
gccccugcugguucag

SEQ ID NO: 2053083 - RNA, 15 nt, Human
gccccugcugguuca

SEQ ID NO: 2053084 - RNA, 12 nt, Human
gccccugcuggu

SEQ ID NO: 2053085 - RNA, 18 nt, Human
gcccccagcuguggguac

SEQ ID NO: 2053086 - RNA, 13 nt, Human
gccucgaacuggc

SEQ ID NO: 2053087 - RNA, 16 nt, Human
gccucgaacuggcugc

SEQ ID NO: 2053088 - RNA, 14 nt, Human
gccucugggacugg

SEQ ID NO: 2053089 - RNA, 23 nt, Human
gccuccucucucaguuuuuauau

SEQ ID NO: 2053090 - RNA, 20 nt, Human
gccuccucuaacaggggcug

SEQ ID NO: 2053091 - RNA, 22 nt, Human
gccuccucuaacaggggcuggu

SEQ ID NO: 2053092 - RNA, 13 nt, Human
gccuccucugucc

SEQ ID NO: 2053093 - RNA, 16 nt, Human
gccuccucuguccagg

SEQ ID NO: 2053094 - RNA, 22 nt, Human
gccucaucuauaacaugcauuu

SEQ ID NO: 2053095 - RNA, 18 nt, Human
gccuccaccccccagaac

SEQ ID NO: 2053096 - RNA, 12 nt, Human
gccuccaccgcu

SEQ ID NO: 2053097 - RNA, 18 nt, Human
gccuccaccgcugccuaa

SEQ ID NO: 2053098 - RNA, 17 nt, Human
gccuagcacucacaugc

SEQ ID NO: 2053099 - RNA, 18 nt, Human
gccuagcacucacaugcu

SEQ ID NO: 2053100 - RNA, 23 nt, Human
gccuagcacucacaugcuggaca

SEQ ID NO: 2053101 - RNA, 17 nt, Human
gccuacaggagugagca

SEQ ID NO: 2053102 - RNA, 14 nt, Human
gccuacagaugaac

SEQ ID NO: 2053103 - RNA, 22 nt, Human
gccuaaucccugggcauugcuu

SEQ ID NO: 2053104 - RNA, 17 nt, Human
gccuagauccacacaca

SEQ ID NO: 2053105 - RNA, 20 nt, Human
gccuagauccacacacagag

SEQ ID NO: 2053106 - RNA, 23 nt, Human
gccuagauccacacacagaggaa

SEQ ID NO: 2053107 - RNA, 17 nt, Human
gcccgucuucagccuag

SEQ ID NO: 2053108 - RNA, 18 nt, Human
gcccgucuucagccuagc

SEQ ID NO: 2053109 - RNA, 14 nt, Human
gcccgucuucagcc

SEQ ID NO: 2053110 - RNA, 15 nt, Human
gcccgucuucagccu

SEQ ID NO: 2053111 - RNA, 16 nt, Human
gcccgucuucagccua

SEQ ID NO: 2053112 - RNA, 16 nt, Human
gcccuguggaagggac

SEQ ID NO: 2053113 - RNA, 17 nt, Human
gcccuguggaagggacu

SEQ ID NO: 2053114 - RNA, 23 nt, Human
gcccuguggaagggacuaggagc

SEQ ID NO: 2053115 - RNA, 21 nt, Human
gcccuuccaugucgccucugc

SEQ ID NO: 2053116 - RNA, 12 nt, Human
gcccuuccaugu

SEQ ID NO: 2053117 - RNA, 21 nt, Human
gcccuucagcauccucaguuc

SEQ ID NO: 2053118 - RNA, 16 nt, Human
gcccuucacaguguuu

SEQ ID NO: 2053119 - RNA, 12 nt, Human
gcccuuccucuc

SEQ ID NO: 2053120 - RNA, 22 nt, Human
gcccuuccaugucgccucugca

SEQ ID NO: 2053121 - RNA, 15 nt, Human
gcccuuccucuccac

SEQ ID NO: 2053122 - RNA, 14 nt, Human
gcccuuccucucca

SEQ ID NO: 2053123 - RNA, 22 nt, Human
gccgcuccugucugccagccag

SEQ ID NO: 2053124 - RNA, 20 nt, Human
gccgcuccugucugccagcc

SEQ ID NO: 2053125 - RNA, 21 nt, Human
gccgcuccugucugccagcca

SEQ ID NO: 2053126 - RNA, 15 nt, Human
gccgcuccugucugc

SEQ ID NO: 2053127 - RNA, 19 nt, Human
gccgcuccugucugccagc

SEQ ID NO: 2053128 - RNA, 22 nt, Human
gccggcacccacaagugccacu

SEQ ID NO: 2053129 - RNA, 16 nt, Human
gccuacaggagugagc

SEQ ID NO: 2053130 - RNA, 14 nt, Human
gccuaaucccuggg

SEQ ID NO: 2053131 - RNA, 16 nt, Human
gccuaaucccugggca

SEQ ID NO: 2053132 - RNA, 23 nt, Human
gccuaaucccugggcauugcuuu

SEQ ID NO: 2053133 - RNA, 18 nt, Human
gcucaggggcguguggcu

SEQ ID NO: 2053134 - RNA, 15 nt, Human
gcucagaagugacca

SEQ ID NO: 2053135 - RNA, 12 nt, Human
gcucagaacaca

SEQ ID NO: 2053136 - RNA, 14 nt, Human
gcucagaacacauu

SEQ ID NO: 2053137 - RNA, 18 nt, Human
gcucaagcaauccuccug

SEQ ID NO: 2053138 - RNA, 23 nt, Human
gcucaagcaauccuccugaguga

SEQ ID NO: 2053139 - RNA, 13 nt, Human
gcucaggaggcuu

SEQ ID NO: 2053140 - RNA, 15 nt, Human
gcucaggaggcuugg

SEQ ID NO: 2053141 - RNA, 13 nt, Human
gcucaggaguuug

SEQ ID NO: 2053142 - RNA, 16 nt, Human
gcucaggaggcuugga

SEQ ID NO: 2053143 - RNA, 17 nt, Human
gcucaggaggcuuggaa

SEQ ID NO: 2053144 - RNA, 20 nt, Human
gcuaggaccccuccaugugg

SEQ ID NO: 2053145 - RNA, 22 nt, Human
gcuaggaccccuccaugugggc

SEQ ID NO: 2053146 - RNA, 20 nt, Human
gcuaggugggccagccccuc

SEQ ID NO: 2053147 - RNA, 21 nt, Human
gcuaggugggccagccccucc

SEQ ID NO: 2053148 - RNA, 17 nt, Human
gcuaggugggccagccc

SEQ ID NO: 2053149 - RNA, 18 nt, Human
gcuaggugggccagcccc

SEQ ID NO: 2053150 - RNA, 19 nt, Human
gcuaggugggccagccccu

SEQ ID NO: 2053151 - RNA, 15 nt, Human
gcuaggguggcccuu

SEQ ID NO: 2053152 - RNA, 19 nt, Human
gcuaggugcuaauuaauaa

SEQ ID NO: 2053153 - RNA, 14 nt, Human
gcuaggugggccag

SEQ ID NO: 2053154 - RNA, 14 nt, Human
gcuaggguggcccu

SEQ ID NO: 2053155 - RNA, 16 nt, Human
gcuaguugggcuuccu

SEQ ID NO: 2053156 - RNA, 14 nt, Human
gcuaguugggcuuc

SEQ ID NO: 2053157 - RNA, 14 nt, Human
gcuaguugaaucua

SEQ ID NO: 2053158 - RNA, 18 nt, Human
gcuauucaguaauaacuc

SEQ ID NO: 2053159 - RNA, 16 nt, Human
gcuauuucccaagcug

SEQ ID NO: 2053160 - RNA, 21 nt, Human
gcuauuucccaagcuggagug

SEQ ID NO: 2053161 - RNA, 12 nt, Human
gcucaaaggcac

SEQ ID NO: 2053162 - RNA, 14 nt, Human
gcucaaaggcacag

SEQ ID NO: 2053163 - RNA, 16 nt, Human
gcucaaaggcacagug

SEQ ID NO: 2053164 - RNA, 21 nt, Human
gcucaaaggcacagugaaggc

SEQ ID NO: 2053165 - RNA, 18 nt, Human
gcuaagugaaaaggucau

SEQ ID NO: 2053166 - RNA, 13 nt, Human
gcuaagugaaaag

SEQ ID NO: 2053167 - RNA, 22 nt, Human
gcuaagugauccucccaccuca

SEQ ID NO: 2053168 - RNA, 18 nt, Human
gcuaagugauccucccac

SEQ ID NO: 2053169 - RNA, 23 nt, Human
gcgauucuucugcuucagccucc

SEQ ID NO: 2053170 - RNA, 18 nt, Human
gccuucguuaacugugua

SEQ ID NO: 2053171 - RNA, 13 nt, Human
gcgcaaaacugaa

SEQ ID NO: 2053172 - RNA, 12 nt, Human
gcgcaagccugu

SEQ ID NO: 2053173 - RNA, 13 nt, Human
gcgcaagccugua

SEQ ID NO: 2053174 - RNA, 23 nt, Human
gcgcaagccuguaaucccagcua

SEQ ID NO: 2053175 - RNA, 21 nt, Human
gcgcaagccuguaaucccagc

SEQ ID NO: 2053176 - RNA, 22 nt, Human
gcgcaagccuguaaucccagcu

SEQ ID NO: 2053177 - RNA, 22 nt, Human
gcgauucuucugcuucagccuc

SEQ ID NO: 2053178 - RNA, 14 nt, Human
gccuugaagccacu

SEQ ID NO: 2053179 - RNA, 15 nt, Human
gccuugaagccacug

SEQ ID NO: 2053180 - RNA, 17 nt, Human
gccuggcuccgcugugu

SEQ ID NO: 2053181 - RNA, 19 nt, Human
gccuggcuccgcugugugg

SEQ ID NO: 2053182 - RNA, 19 nt, Human
gccucugucauaucuucac

SEQ ID NO: 2053183 - RNA, 21 nt, Human
gccucugucauaucuucacaa

SEQ ID NO: 2053184 - RNA, 13 nt, Human
gccucugggccuc

SEQ ID NO: 2053185 - RNA, 15 nt, Human
gccucgaacuccugg

SEQ ID NO: 2053186 - RNA, 16 nt, Human
gccucgaacuccuggg

SEQ ID NO: 2053187 - RNA, 19 nt, Human
gccucgaacuccugggcuc

SEQ ID NO: 2053188 - RNA, 20 nt, Human
gccucgaacuccugggcuca

SEQ ID NO: 2053189 - RNA, 21 nt, Human
gccucgaacuccugggcucaa

SEQ ID NO: 2053190 - RNA, 13 nt, Human
gccuggcuucugg

SEQ ID NO: 2053191 - RNA, 16 nt, Human
gccugggcaacagagc

SEQ ID NO: 2053192 - RNA, 19 nt, Human
gccugggcaacagagcaag

SEQ ID NO: 2053193 - RNA, 20 nt, Human
gccugggcaacagagcaaga

SEQ ID NO: 2053194 - RNA, 20 nt, Human
gccugggcaacacagcgaga

SEQ ID NO: 2053195 - RNA, 22 nt, Human
gccugggcaacauagugagacc

SEQ ID NO: 2053196 - RNA, 12 nt, Human
gccugggcaaga

SEQ ID NO: 2053197 - RNA, 14 nt, Human
gccugugcugcccg

SEQ ID NO: 2053198 - RNA, 15 nt, Human
gccugugcugcccgu

SEQ ID NO: 2053199 - RNA, 19 nt, Human
gccugugccucugggacug

SEQ ID NO: 2053200 - RNA, 13 nt, Human
gccugugcuguga

SEQ ID NO: 2053201 - RNA, 14 nt, Human
gccugugcugugac

SEQ ID NO: 2053202 - RNA, 18 nt, Human
gccuguggcaguaaagag

SEQ ID NO: 2053203 - RNA, 19 nt, Human
gccuguggcaguaaagaga

SEQ ID NO: 2053204 - RNA, 22 nt, Human
gccuguggcaguaaagagaaac

SEQ ID NO: 2053205 - RNA, 22 nt, Human
gccuguggcaucuuugccuugg

SEQ ID NO: 2053206 - RNA, 16 nt, Human
gccugugcugcccguc

SEQ ID NO: 2053207 - RNA, 23 nt, Human
gccugugcugcccgucuucagcc

SEQ ID NO: 2053208 - RNA, 17 nt, Human
gccuguucagcuccagc

SEQ ID NO: 2053209 - RNA, 16 nt, Human
gccuguucagcuccag

SEQ ID NO: 2053210 - RNA, 14 nt, Human
gccuguucagcucc

SEQ ID NO: 2053211 - RNA, 15 nt, Human
gccuguucagcucca

SEQ ID NO: 2053212 - RNA, 16 nt, Human
gccuucucugaaggac

SEQ ID NO: 2053213 - RNA, 15 nt, Human
gccuucucugaagga

SEQ ID NO: 2053214 - RNA, 21 nt, Human
gccuucuugugaucuugcucu

SEQ ID NO: 2053215 - RNA, 22 nt, Human
gccuucuucggggaacuccugg

SEQ ID NO: 2053216 - RNA, 23 nt, Human
gccuucuucggggaacuccugga

SEQ ID NO: 2053217 - RNA, 18 nt, Human
gccuucuuauucucacuc

SEQ ID NO: 2053218 - RNA, 19 nt, Human
gccuucuuauucucacucc

SEQ ID NO: 2053219 - RNA, 20 nt, Human
gccuucuuauucucacucca

SEQ ID NO: 2053220 - RNA, 21 nt, Human
gccuucuuauucucacuccac

SEQ ID NO: 2053221 - RNA, 23 nt, Human
gccuucuuauucucacuccacca

SEQ ID NO: 2053222 - RNA, 12 nt, Human
gcggcagagagg

SEQ ID NO: 2053223 - RNA, 22 nt, Human
gcggcugagucaugaucucccu

SEQ ID NO: 2053224 - RNA, 23 nt, Human
gcggcugagucaugaucucccug

SEQ ID NO: 2053225 - RNA, 21 nt, Human
gcggcuacucagcagcccucc

SEQ ID NO: 2053226 - RNA, 22 nt, Human
gcggcuacucagcagcccuccu

SEQ ID NO: 2053227 - RNA, 13 nt, Human
gcggcuacucagc

SEQ ID NO: 2053228 - RNA, 19 nt, Human
gcggcuacucagcagcccu

SEQ ID NO: 2053229 - RNA, 20 nt, Human
gcggcuacucagcagcccuc

SEQ ID NO: 2053230 - RNA, 16 nt, Human
gcggccuuuggcuuca

SEQ ID NO: 2053231 - RNA, 20 nt, Human
gcggccuuuguugcucagca

SEQ ID NO: 2053232 - RNA, 14 nt, Human
gcggcaggagggag

SEQ ID NO: 2053233 - RNA, 22 nt, Human
gcggcaggagggagguuuguga

SEQ ID NO: 2053234 - RNA, 18 nt, Human
gcguuagaaugaggagga

SEQ ID NO: 2053235 - RNA, 16 nt, Human
gcguuacuaauuggcc

SEQ ID NO: 2053236 - RNA, 22 nt, Human
gcguuagaaugaggaggaagga

SEQ ID NO: 2053237 - RNA, 14 nt, Human
gcuaaggcaccagc

SEQ ID NO: 2053238 - RNA, 15 nt, Human
gcuaaggcaccagcc

SEQ ID NO: 2053239 - RNA, 19 nt, Human
gcgggaccgguacagaaag

SEQ ID NO: 2053240 - RNA, 20 nt, Human
gcgggaccgguacagaaagg

SEQ ID NO: 2053241 - RNA, 23 nt, Human
gcgggacgagacccuacaggaga

SEQ ID NO: 2053242 - RNA, 15 nt, Human
gcggcuggcagccca

SEQ ID NO: 2053243 - RNA, 15 nt, Human
gcggcuggugcaggg

SEQ ID NO: 2053244 - RNA, 13 nt, Human
gcgggaaggaggg

SEQ ID NO: 2053245 - RNA, 14 nt, Human
gcgggaaggagggu

SEQ ID NO: 2053246 - RNA, 19 nt, Human
gcuguaucccaugagccuc

SEQ ID NO: 2053247 - RNA, 17 nt, Human
gcuguaucccaugagcc

SEQ ID NO: 2053248 - RNA, 13 nt, Human
gcuguaggugugc

SEQ ID NO: 2053249 - RNA, 18 nt, Human
gcugugaguguaagugug

SEQ ID NO: 2053250 - RNA, 22 nt, Human
gcugugaguguaagugugagua

SEQ ID NO: 2053251 - RNA, 20 nt, Human
gcuguuggcugggggccuca

SEQ ID NO: 2053252 - RNA, 16 nt, Human
gcuguuggcugggggc

SEQ ID NO: 2053253 - RNA, 15 nt, Human
gcuguuggcuggggg

SEQ ID NO: 2053254 - RNA, 13 nt, Human
gcugugcucugga

SEQ ID NO: 2053255 - RNA, 14 nt, Human
gcugugcuaugaau

SEQ ID NO: 2053256 - RNA, 15 nt, Human
gcugugcuaugaauu

SEQ ID NO: 2053257 - RNA, 16 nt, Human
gcugugcuaugaauuu

SEQ ID NO: 2053258 - RNA, 15 nt, Human
gcugugccucugccu

SEQ ID NO: 2053259 - RNA, 14 nt, Human
gcugugccucugcc

SEQ ID NO: 2053260 - RNA, 16 nt, Human
gcugugccucugccug

SEQ ID NO: 2053261 - RNA, 21 nt, Human
gcugugcgcugacaaccaccg

SEQ ID NO: 2053262 - RNA, 16 nt, Human
gcugugcucuggacag

SEQ ID NO: 2053263 - RNA, 15 nt, Human
gcugugcucuggaca

SEQ ID NO: 2053264 - RNA, 18 nt, Human
gcugugcucuggacaggc

SEQ ID NO: 2053265 - RNA, 13 nt, Human
gcugguaguuagu

SEQ ID NO: 2053266 - RNA, 21 nt, Human
gcugguagagauggaggagga

SEQ ID NO: 2053267 - RNA, 23 nt, Human
gcugguagagauggaggaggagg

SEQ ID NO: 2053268 - RNA, 15 nt, Human
gcugguaagggccaa

SEQ ID NO: 2053269 - RNA, 18 nt, Human
gcugguaagggccaaguc

SEQ ID NO: 2053270 - RNA, 23 nt, Human
gcugguaagggccaagucccacc

SEQ ID NO: 2053271 - RNA, 14 nt, Human
gcugguagagaugg

SEQ ID NO: 2053272 - RNA, 15 nt, Human
gcugguagagaugga

SEQ ID NO: 2053273 - RNA, 17 nt, Human
gcugguagagauggagg

SEQ ID NO: 2053274 - RNA, 18 nt, Human
gcugguagagauggagga

SEQ ID NO: 2053275 - RNA, 23 nt, Human
gcuggcuguuggcugggggccuc

SEQ ID NO: 2053276 - RNA, 20 nt, Human
gcuggcuguuggcugggggc

SEQ ID NO: 2053277 - RNA, 19 nt, Human
gcuggcugcccagaccccu

SEQ ID NO: 2053278 - RNA, 14 nt, Human
gcugggcagguugg

SEQ ID NO: 2053279 - RNA, 12 nt, Human
gcugggcccaga

SEQ ID NO: 2053280 - RNA, 14 nt, Human
gcugggcccagaag

SEQ ID NO: 2053281 - RNA, 13 nt, Human
gcugggcccagag

SEQ ID NO: 2053282 - RNA, 14 nt, Human
gcugggcccagagg

SEQ ID NO: 2053283 - RNA, 15 nt, Human
gcugggcccagaggc

SEQ ID NO: 2053284 - RNA, 16 nt, Human
gcugggcccagaggca

SEQ ID NO: 2053285 - RNA, 18 nt, Human
gcugggcccagaggcaca

SEQ ID NO: 2053286 - RNA, 19 nt, Human
gcugggcccagaggcacag

SEQ ID NO: 2053287 - RNA, 20 nt, Human
gcugggcccagaggcacagc

SEQ ID NO: 2053288 - RNA, 21 nt, Human
gcugggcccagaggcacagcc

SEQ ID NO: 2053289 - RNA, 22 nt, Human
gcugcucuuaugccauuuguuu

SEQ ID NO: 2053290 - RNA, 14 nt, Human
gcuggcgugcagug

SEQ ID NO: 2053291 - RNA, 11 nt, Human
gcuggcugccu

SEQ ID NO: 2053292 - RNA, 13 nt, Human
gcuggcugcagug

SEQ ID NO: 2053293 - RNA, 14 nt, Human
gcuggcugcaguga

SEQ ID NO: 2053294 - RNA, 20 nt, Human
gcuggcugccuuagaaccuu

SEQ ID NO: 2053295 - RNA, 14 nt, Human
gcuggcugccuuag

SEQ ID NO: 2053296 - RNA, 19 nt, Human
gcuggcuguuggcuggggg

SEQ ID NO: 2053297 - RNA, 18 nt, Human
gcuggcuguuggcugggg

SEQ ID NO: 2053298 - RNA, 21 nt, Human
gcuggcggcuacucagcagcc

SEQ ID NO: 2053299 - RNA, 18 nt, Human
gcuggcgugcaguggugc

SEQ ID NO: 2053300 - RNA, 15 nt, Human
gcuggcgugcagugg

SEQ ID NO: 2053301 - RNA, 16 nt, Human
gcugagaggagagaga

SEQ ID NO: 2053302 - RNA, 22 nt, Human
gcugagaggcagacuucccuga

SEQ ID NO: 2053303 - RNA, 17 nt, Human
gcugagcaccaggggau

SEQ ID NO: 2053304 - RNA, 23 nt, Human
gcugagggugagugggugaauaa

SEQ ID NO: 2053305 - RNA, 14 nt, Human
gcugaggugggagg

SEQ ID NO: 2053306 - RNA, 17 nt, Human
gcugaggucucuugagg

SEQ ID NO: 2053307 - RNA, 15 nt, Human
gcugaggugagagga

SEQ ID NO: 2053308 - RNA, 19 nt, Human
gcugaggugagaggaucag

SEQ ID NO: 2053309 - RNA, 11 nt, Human
gcugagcccug

SEQ ID NO: 2053310 - RNA, 12 nt, Human
gcugagcccugg

SEQ ID NO: 2053311 - RNA, 14 nt, Human
gcugaggcaauucu

SEQ ID NO: 2053312 - RNA, 19 nt, Human
gcugaggauuucaagccug

SEQ ID NO: 2053313 - RNA, 20 nt, Human
gcugaggauuucaagccugc

SEQ ID NO: 2053314 - RNA, 18 nt, Human
gcugaggauuucaagccu

SEQ ID NO: 2053315 - RNA, 15 nt, Human
gcugaggcaauucua

SEQ ID NO: 2053316 - RNA, 13 nt, Human
gcugaggcagaag

SEQ ID NO: 2053317 - RNA, 15 nt, Human
gcugaggcagaagaa

SEQ ID NO: 2053318 - RNA, 16 nt, Human
gcugaggcagaagaau

SEQ ID NO: 2053319 - RNA, 15 nt, Human
gcugaggcaggagga

SEQ ID NO: 2053320 - RNA, 18 nt, Human
gcugcacccucaggcagg

SEQ ID NO: 2053321 - RNA, 19 nt, Human
gcugcacccucaggcaggu

SEQ ID NO: 2053322 - RNA, 20 nt, Human
gcugcaagugacaucucuuu

SEQ ID NO: 2053323 - RNA, 13 nt, Human
gcugccuccccaa

SEQ ID NO: 2053324 - RNA, 12 nt, Human
gcugccucccug

SEQ ID NO: 2053325 - RNA, 19 nt, Human
gcugccucccuguccaccc

SEQ ID NO: 2053326 - RNA, 21 nt, Human
gcugccuccccaacccugccc

SEQ ID NO: 2053327 - RNA, 23 nt, Human
gcugccuccccaacccugccccu

SEQ ID NO: 2053328 - RNA, 15 nt, Human
gcugccuccccaacc

SEQ ID NO: 2053329 - RNA, 17 nt, Human
gcugccuccccaacccu

SEQ ID NO: 2053330 - RNA, 19 nt, Human
gcugccuccccaacccugc

SEQ ID NO: 2053331 - RNA, 20 nt, Human
gcugccuccccaacccugcc

SEQ ID NO: 2053332 - RNA, 18 nt, Human
gcugccucucgguggcca

SEQ ID NO: 2053333 - RNA, 16 nt, Human
gcugccucucccauca

SEQ ID NO: 2053334 - RNA, 13 nt, Human
gcugccuguucag

SEQ ID NO: 2053335 - RNA, 12 nt, Human
gcugccuguuca

SEQ ID NO: 2053336 - RNA, 20 nt, Human
gcugccuguaguuaggaaau

SEQ ID NO: 2053337 - RNA, 17 nt, Human
gcugccuguucagcucc

SEQ ID NO: 2053338 - RNA, 15 nt, Human
gcugccugagcaccu

SEQ ID NO: 2053339 - RNA, 18 nt, Human
gcugccugagcaccuccc

SEQ ID NO: 2053340 - RNA, 22 nt, Human
gcugccugagcaccucccagcc

SEQ ID NO: 2053341 - RNA, 23 nt, Human
gcugccugagcaccucccagccc

SEQ ID NO: 2053342 - RNA, 12 nt, Human
gcugccuguagu

SEQ ID NO: 2053343 - RNA, 13 nt, Human
gcugccuguaguu

SEQ ID NO: 2053344 - RNA, 15 nt, Human
gcugccuguaguuag

SEQ ID NO: 2053345 - RNA, 16 nt, Human
gcugccuguaguuagg

SEQ ID NO: 2053346 - RNA, 19 nt, Human
gcugccuguaguuaggaaa

SEQ ID NO: 2053347 - RNA, 12 nt, Human
gcugccucacuu

SEQ ID NO: 2053348 - RNA, 19 nt, Human
gcugcccuccaucccgaca

SEQ ID NO: 2053349 - RNA, 21 nt, Human
gcugcccuccaucccgacaug

SEQ ID NO: 2053350 - RNA, 14 nt, Human
gcugcccuccaucc

SEQ ID NO: 2053351 - RNA, 16 nt, Human
gcugcccuaggcuccg

SEQ ID NO: 2053352 - RNA, 15 nt, Human
gcugcccuccauccc

SEQ ID NO: 2053353 - RNA, 15 nt, Human
gcugcccuaggcucc

SEQ ID NO: 2053354 - RNA, 21 nt, Human
gcugcccgucuucagccuagc

SEQ ID NO: 2053355 - RNA, 16 nt, Human
gcugcccgucuucagc

SEQ ID NO: 2053356 - RNA, 19 nt, Human
gcugcccgucuucagccua

SEQ ID NO: 2053357 - RNA, 20 nt, Human
gcugcccgucuucagccuag

SEQ ID NO: 2053358 - RNA, 17 nt, Human
gcugccccuggcucuga

SEQ ID NO: 2053359 - RNA, 14 nt, Human
gcugccccucccug

SEQ ID NO: 2053360 - RNA, 18 nt, Human
gcugccccucccugccag

SEQ ID NO: 2053361 - RNA, 22 nt, Human
gcugccccucccugccagcacc

SEQ ID NO: 2053362 - RNA, 14 nt, Human
gcugcccccgcuca

SEQ ID NO: 2053363 - RNA, 21 nt, Human
gcugcccccgcucaugggccc

SEQ ID NO: 2053364 - RNA, 20 nt, Human
ggaaaggccagcuggcagca

SEQ ID NO: 2053365 - RNA, 22 nt, Human
ggaaaggccagcuggcagcaga

SEQ ID NO: 2053366 - RNA, 12 nt, Human
ggaaaggcucag

SEQ ID NO: 2053367 - RNA, 18 nt, Human
ggaaaucucaccccaucc

SEQ ID NO: 2053368 - RNA, 19 nt, Human
ggaaaggcucagucucagg

SEQ ID NO: 2053369 - RNA, 14 nt, Human
ggaagcccagcucc

SEQ ID NO: 2053370 - RNA, 16 nt, Human
ggaagcccagcuccag

SEQ ID NO: 2053371 - RNA, 22 nt, Human
ggacagugcuucagccugaggc

SEQ ID NO: 2053372 - RNA, 23 nt, Human
ggacagugcuucagccugaggcu

SEQ ID NO: 2053373 - RNA, 18 nt, Human
ggacagugcuucagccug

SEQ ID NO: 2053374 - RNA, 19 nt, Human
ggacagugcuucagccuga

SEQ ID NO: 2053375 - RNA, 20 nt, Human
ggacagugcuucagccugag

SEQ ID NO: 2053376 - RNA, 21 nt, Human
ggacagugcuucagccugagg

SEQ ID NO: 2053377 - RNA, 14 nt, Human
ggacagugcuucag

SEQ ID NO: 2053378 - RNA, 19 nt, Human
ggacaguccugggagaacc

SEQ ID NO: 2053379 - RNA, 16 nt, Human
ggacagugcuucagcc

SEQ ID NO: 2053380 - RNA, 17 nt, Human
ggacagugcuucagccu

SEQ ID NO: 2053381 - RNA, 13 nt, Human
ggacaguccuggg

SEQ ID NO: 2053382 - RNA, 14 nt, Human
ggacaguccuggga

SEQ ID NO: 2053383 - RNA, 15 nt, Human
ggacaguccugggag

SEQ ID NO: 2053384 - RNA, 16 nt, Human
ggacaguccugggaga

SEQ ID NO: 2053385 - RNA, 14 nt, Human
ggacauauucauuu

SEQ ID NO: 2053386 - RNA, 17 nt, Human
ggacagggaggugaccc

SEQ ID NO: 2053387 - RNA, 22 nt, Human
ggacaggcccggcgcgguggcu

SEQ ID NO: 2053388 - RNA, 11 nt, Human
ggacaggcccg

SEQ ID NO: 2053389 - RNA, 22 nt, Human
ggacagggcauggccagguggc

SEQ ID NO: 2053390 - RNA, 15 nt, Human
ggacagggcauggcc

SEQ ID NO: 2053391 - RNA, 15 nt, Human
ggacaggucugggag

SEQ ID NO: 2053392 - RNA, 20 nt, Human
ggacaggucugggagaggca

SEQ ID NO: 2053393 - RNA, 13 nt, Human
ggacacagcucuu

SEQ ID NO: 2053394 - RNA, 13 nt, Human
ggacaccaggagu

SEQ ID NO: 2053395 - RNA, 22 nt, Human
ggaaucaagaugucagacuggc

SEQ ID NO: 2053396 - RNA, 13 nt, Human
ggaauauuuuauu

SEQ ID NO: 2053397 - RNA, 15 nt, Human
ggaauauuuuauuca

SEQ ID NO: 2053398 - RNA, 19 nt, Human
ggaauauuuuauucaaggu

SEQ ID NO: 2053399 - RNA, 16 nt, Human
ggaaucaacagggcag

SEQ ID NO: 2053400 - RNA, 17 nt, Human
ggaaucaacagggcagc

SEQ ID NO: 2053401 - RNA, 18 nt, Human
ggaaucaacagggcagca

SEQ ID NO: 2053402 - RNA, 12 nt, Human
ggacacagcucu

SEQ ID NO: 2053403 - RNA, 13 nt, Human
ggacacacaaggu

SEQ ID NO: 2053404 - RNA, 21 nt, Human
ggacacacaaggugcaaauca

SEQ ID NO: 2053405 - RNA, 13 nt, Human
ggaauaugagcuu

SEQ ID NO: 2053406 - RNA, 22 nt, Human
ggaauauuccccuaucucuaga

SEQ ID NO: 2053407 - RNA, 23 nt, Human
ggaauauaaggaaagcaauaaau

SEQ ID NO: 2053408 - RNA, 12 nt, Human
ggaauacagugu

SEQ ID NO: 2053409 - RNA, 14 nt, Human
ggaauagcauguca

SEQ ID NO: 2053410 - RNA, 17 nt, Human
ggaauagcaugucacua

SEQ ID NO: 2053411 - RNA, 20 nt, Human
ggaagcggagguugcaggga

SEQ ID NO: 2053412 - RNA, 22 nt, Human
ggaagcggagguugcagggagc

SEQ ID NO: 2053413 - RNA, 16 nt, Human
ggaagccgugcccugc

SEQ ID NO: 2053414 - RNA, 23 nt, Human
ggaagcgaugaauuuggagacuc

SEQ ID NO: 2053415 - RNA, 18 nt, Human
gcuuuggacacacacagc

SEQ ID NO: 2053416 - RNA, 19 nt, Human
gcuuuggacacacacagcu

SEQ ID NO: 2053417 - RNA, 22 nt, Human
gcuuuggacacacacagcuucu

SEQ ID NO: 2053418 - RNA, 21 nt, Human
gcuuugcuuaugguaauaaaa

SEQ ID NO: 2053419 - RNA, 14 nt, Human
gcuuuggaagccau

SEQ ID NO: 2053420 - RNA, 22 nt, Human
gcuuuccuuuuucccaauaaau

SEQ ID NO: 2053421 - RNA, 18 nt, Human
gcuuugcccaaccucagc

SEQ ID NO: 2053422 - RNA, 19 nt, Human
gcuuugcccaaccucagca

SEQ ID NO: 2053423 - RNA, 22 nt, Human
gcuuugccuuccacgcugucuc

SEQ ID NO: 2053424 - RNA, 13 nt, Human
gcuuugccuucca

SEQ ID NO: 2053425 - RNA, 18 nt, Human
gcuuugccuuccacgcug

SEQ ID NO: 2053426 - RNA, 24 nt, Human
gcuuugccuuccacgcugucucca

SEQ ID NO: 2053427 - RNA, 13 nt, Human
gcuguuuccauag

SEQ ID NO: 2053428 - RNA, 11 nt, Human
gcuguuuccuu

SEQ ID NO: 2053429 - RNA, 14 nt, Human
gcuguuuauggccu

SEQ ID NO: 2053430 - RNA, 15 nt, Human
gcuguuuauggccuc

SEQ ID NO: 2053431 - RNA, 16 nt, Human
gcuguuuauggccuca

SEQ ID NO: 2053432 - RNA, 23 nt, Human
gcuguuuauggccucagcugccu

SEQ ID NO: 2053433 - RNA, 17 nt, Human
gcuguuuauggccucag

SEQ ID NO: 2053434 - RNA, 22 nt, Human
gcuguuuauggccucagcugcc

SEQ ID NO: 2053435 - RNA, 12 nt, Human
gcuuaaugaaaa

SEQ ID NO: 2053436 - RNA, 23 nt, Human
gcuuucuacccagcgagcccugg

SEQ ID NO: 2053437 - RNA, 20 nt, Human
gcuuugcauuccuacaaaga

SEQ ID NO: 2053438 - RNA, 22 nt, Human
gcuuugcauuccuacaaagaug

SEQ ID NO: 2053439 - RNA, 16 nt, Human
gcuuugauuccaucuc

SEQ ID NO: 2053440 - RNA, 17 nt, Human
gcuuugauuccaucucc

SEQ ID NO: 2053441 - RNA, 20 nt, Human
gcuuugauuccaucuccuug

SEQ ID NO: 2053442 - RNA, 21 nt, Human
gcuuugauuuagauugaguaa

SEQ ID NO: 2053443 - RNA, 22 nt, Human
gcuuucuacccagcgagcccug

SEQ ID NO: 2053444 - RNA, 19 nt, Human
gcuuucuacccagcgagcc

SEQ ID NO: 2053445 - RNA, 13 nt, Human
gcuuucuacccag

SEQ ID NO: 2053446 - RNA, 23 nt, Human
gcuuuccuggagagucucacucc

SEQ ID NO: 2053447 - RNA, 23 nt, Human
gcuugggcuuccauuugugugug

SEQ ID NO: 2053448 - RNA, 18 nt, Human
gcuuuuccccggucccuu

SEQ ID NO: 2053449 - RNA, 19 nt, Human
gcuuuucccuaagccaagg

SEQ ID NO: 2053450 - RNA, 22 nt, Human
gcuuuuccccggucccuugaga

SEQ ID NO: 2053451 - RNA, 15 nt, Human
gcuuuugcuggucac

SEQ ID NO: 2053452 - RNA, 19 nt, Human
gcuuuugcuggucacugcc

SEQ ID NO: 2053453 - RNA, 21 nt, Human
gcuuuugcuggucacugccau

SEQ ID NO: 2053454 - RNA, 22 nt, Human
gcuuuugcuggucacugccaug

SEQ ID NO: 2053455 - RNA, 13 nt, Human
ggaaaaaaacuuu

SEQ ID NO: 2053456 - RNA, 14 nt, Human
ggaaaaaaacuuuu

SEQ ID NO: 2053457 - RNA, 23 nt, Human
ggaaaaaaacuuuuauaaauuaa

SEQ ID NO: 2053458 - RNA, 15 nt, Human
gcuuuuuaauauuga

SEQ ID NO: 2053459 - RNA, 20 nt, Human
ggaaacagcuaaugggacac

SEQ ID NO: 2053460 - RNA, 14 nt, Human
ggaaaaaaaugacu

SEQ ID NO: 2053461 - RNA, 14 nt, Human
ggaaacagucauuu

SEQ ID NO: 2053462 - RNA, 15 nt, Human
ggaaacaggaccaca

SEQ ID NO: 2053463 - RNA, 22 nt, Human
ggaaacucaccugcuggccccu

SEQ ID NO: 2053464 - RNA, 21 nt, Human
ggaaacucaccugcuggcccc

SEQ ID NO: 2053465 - RNA, 17 nt, Human
ggaaacuggaugagguc

SEQ ID NO: 2053466 - RNA, 14 nt, Human
ggaaagcagcucaa

SEQ ID NO: 2053467 - RNA, 22 nt, Human
ggaaagcagcucaaaggcacag

SEQ ID NO: 2053468 - RNA, 15 nt, Human
ggaaagcagcucaaa

SEQ ID NO: 2053469 - RNA, 19 nt, Human
ggaaagcagcucaaaggca

SEQ ID NO: 2053470 - RNA, 18 nt, Human
ggaaagcaucaccucagg

SEQ ID NO: 2053471 - RNA, 19 nt, Human
ggaaagcaucaccucaggc

SEQ ID NO: 2053472 - RNA, 13 nt, Human
ggaaagccucugc

SEQ ID NO: 2053473 - RNA, 21 nt, Human
ggaaaggaguagaaaaagcag

SEQ ID NO: 2053474 - RNA, 15 nt, Human
ggaaaggccagcugg

SEQ ID NO: 2053475 - RNA, 18 nt, Human
ggaaaggccagcuggcag

SEQ ID NO: 2053476 - RNA, 16 nt, Human
ggaaaggauauuuucu

SEQ ID NO: 2053477 - RNA, 14 nt, Human
ggaaagccucugcu

SEQ ID NO: 2053478 - RNA, 16 nt, Human
ggaaagccucugcugc

SEQ ID NO: 2053479 - RNA, 21 nt, Human
ggaaacuuccaagaccugacu

SEQ ID NO: 2053480 - RNA, 15 nt, Human
ggaaagcaauaaaug

SEQ ID NO: 2053481 - RNA, 18 nt, Human
ggaaacuguugccagaga

SEQ ID NO: 2053482 - RNA, 17 nt, Human
ggaaacuguugccagag

SEQ ID NO: 2053483 - RNA, 16 nt, Human
ggaaagaaagaaggaa

SEQ ID NO: 2053484 - RNA, 23 nt, Human
ggaaagaauuccuacaauauaua

SEQ ID NO: 2053485 - RNA, 15 nt, Human
ggcucacugcagccu

SEQ ID NO: 2053486 - RNA, 14 nt, Human
ggcucacugcagcc

SEQ ID NO: 2053487 - RNA, 13 nt, Human
ggcucacugcagc

SEQ ID NO: 2053488 - RNA, 20 nt, Human
ggcuccccuuuuucuuccuc

SEQ ID NO: 2053489 - RNA, 22 nt, Human
ggcucgucggggggacagcucc

SEQ ID NO: 2053490 - RNA, 12 nt, Human
ggcugcccuggu

SEQ ID NO: 2053491 - RNA, 14 nt, Human
ggcuggcagguaug

SEQ ID NO: 2053492 - RNA, 24 nt, Human
ggcugacuagaagggccaguccug

SEQ ID NO: 2053493 - RNA, 19 nt, Human
ggcugacuagaagggccag

SEQ ID NO: 2053494 - RNA, 22 nt, Human
ggcugacuagaagggccagucc

SEQ ID NO: 2053495 - RNA, 13 nt, Human
ggcugaccccccu

SEQ ID NO: 2053496 - RNA, 17 nt, Human
ggcugaccccccucagg

SEQ ID NO: 2053497 - RNA, 21 nt, Human
ggcugaccuugaacuccuggg

SEQ ID NO: 2053498 - RNA, 17 nt, Human
ggcugacccagucccug

SEQ ID NO: 2053499 - RNA, 18 nt, Human
ggcugacccagucccugg

SEQ ID NO: 2053500 - RNA, 19 nt, Human
ggcugacccagucccuggg

SEQ ID NO: 2053501 - RNA, 22 nt, Human
ggcugacccagucccuggggga

SEQ ID NO: 2053502 - RNA, 13 nt, Human
ggcugaaagacag

SEQ ID NO: 2053503 - RNA, 21 nt, Human
ggcugagacugcgggaugguc

SEQ ID NO: 2053504 - RNA, 12 nt, Human
ggcugcccugcc

SEQ ID NO: 2053505 - RNA, 13 nt, Human
ggcugcccugcca

SEQ ID NO: 2053506 - RNA, 22 nt, Human
ggcugcccuggaggaaccgaaa

SEQ ID NO: 2053507 - RNA, 15 nt, Human
ggcuggccucagacu

SEQ ID NO: 2053508 - RNA, 11 nt, Human
aaaaaaacuuu

SEQ ID NO: 2053509 - RNA, 13 nt, Human
aaaaaaacuuuua

SEQ ID NO: 2053510 - RNA, 13 nt, Human
aaaaaaagacaag

SEQ ID NO: 2053511 - RNA, 11 nt, Human
aaaaaaauaag

SEQ ID NO: 2053512 - RNA, 12 nt, Human
aaaaaaauaaua

SEQ ID NO: 2053513 - RNA, 12 nt, Human
aaaaaaaugaca

SEQ ID NO: 2053514 - RNA, 12 nt, Human
aaaaaaaugacu

SEQ ID NO: 2053515 - RNA, 13 nt, Human
aaaaaaaugacua

SEQ ID NO: 2053516 - RNA, 12 nt, Human
aaaaaaauuggc

SEQ ID NO: 2053517 - RNA, 22 nt, Human
aaaaaacugcugacuguuuucu

SEQ ID NO: 2053518 - RNA, 21 nt, Human
aaaaagcagcuaccagguguu

SEQ ID NO: 2053519 - RNA, 17 nt, Human
aaaaagcacuaguauaa

SEQ ID NO: 2053520 - RNA, 13 nt, Human
aaaaagcagacag

SEQ ID NO: 2053521 - RNA, 21 nt, Human
aaaaagcagacagaagucacu

SEQ ID NO: 2053522 - RNA, 13 nt, Human
aaaaagcagcuac

SEQ ID NO: 2053523 - RNA, 15 nt, Human
aaaaaacagaggcca

SEQ ID NO: 2053524 - RNA, 11 nt, Human
aaaaaacuuuu

SEQ ID NO: 2053525 - RNA, 21 nt, Human
aaaaauaaaaacugacuccuu

SEQ ID NO: 2053526 - RNA, 14 nt, Human
aaaaauacaugcau

SEQ ID NO: 2053527 - RNA, 14 nt, Human
aaaaauacauuuua

SEQ ID NO: 2053528 - RNA, 12 nt, Human
aaaaauaauuuu

SEQ ID NO: 2053529 - RNA, 15 nt, Human
aaaaauacauuuuau

SEQ ID NO: 2053530 - RNA, 14 nt, Human
aaaaauacucuaau

SEQ ID NO: 2053531 - RNA, 15 nt, Human
aaaaauacucuaauu

SEQ ID NO: 2053532 - RNA, 16 nt, Human
aaaaauacucuaauuc

SEQ ID NO: 2053533 - RNA, 17 nt, Human
aaaaauacucuaauucu

SEQ ID NO: 2053534 - RNA, 19 nt, Human
aaaaauacucuaauucuaa

SEQ ID NO: 2053535 - RNA, 22 nt, Human
aaaaauacucuaauucuaacca

SEQ ID NO: 2053536 - RNA, 14 nt, Human
ggcuggguuggagg

SEQ ID NO: 2053537 - RNA, 12 nt, Human
aaaaaguuuaaa

SEQ ID NO: 2053538 - RNA, 14 nt, Human
aaaaaguuuaaaau

SEQ ID NO: 2053539 - RNA, 16 nt, Human
aaaaaguuuaaaaugu

SEQ ID NO: 2053540 - RNA, 18 nt, Human
aaaaaguuugccagaagu

SEQ ID NO: 2053541 - RNA, 17 nt, Human
aaaaaguuugccagaag

SEQ ID NO: 2053542 - RNA, 12 nt, Human
aaaaaggcagga

SEQ ID NO: 2053543 - RNA, 14 nt, Human
aaaaaggaggaaga

SEQ ID NO: 2053544 - RNA, 17 nt, Human
ggccgccugcgggcugc

SEQ ID NO: 2053545 - RNA, 15 nt, Human
ggcccucaccccugc

SEQ ID NO: 2053546 - RNA, 18 nt, Human
ggcccucaccccugcccu

SEQ ID NO: 2053547 - RNA, 20 nt, Human
ggcccucaccccugcccugg

SEQ ID NO: 2053548 - RNA, 21 nt, Human
ggcccucaccccugcccuggg

SEQ ID NO: 2053549 - RNA, 22 nt, Human
ggcccucaccccugcccuggga

SEQ ID NO: 2053550 - RNA, 17 nt, Human
ggccucagguuugccug

SEQ ID NO: 2053551 - RNA, 11 nt, Human
ggccucagggc

SEQ ID NO: 2053552 - RNA, 17 nt, Human
ggccucagcugccucac

SEQ ID NO: 2053553 - RNA, 22 nt, Human
ggccucagcugccucacuuccu

SEQ ID NO: 2053554 - RNA, 13 nt, Human
ggccucagcugcc

SEQ ID NO: 2053555 - RNA, 15 nt, Human
ggccucagcugccuc

SEQ ID NO: 2053556 - RNA, 16 nt, Human
ggccucagcugccuca

SEQ ID NO: 2053557 - RNA, 13 nt, Human
ggccucagugcca

SEQ ID NO: 2053558 - RNA, 20 nt, Human
ggccucaguggacuuuccac

SEQ ID NO: 2053559 - RNA, 22 nt, Human
ggccucaguggacuuuccaccc

SEQ ID NO: 2053560 - RNA, 16 nt, Human
ggccagaugcaccagc

SEQ ID NO: 2053561 - RNA, 15 nt, Human
ggccagaugcaccag

SEQ ID NO: 2053562 - RNA, 22 nt, Human
ggccagagggagugacagaggc

SEQ ID NO: 2053563 - RNA, 21 nt, Human
ggccagaugcacaucccugga

SEQ ID NO: 2053564 - RNA, 20 nt, Human
ggccagaugcacaucccugg

SEQ ID NO: 2053565 - RNA, 23 nt, Human
ggccagaugcacaucccuggaag

SEQ ID NO: 2053566 - RNA, 13 nt, Human
ggccccagcacua

SEQ ID NO: 2053567 - RNA, 16 nt, Human
ggccccagcacuaaag

SEQ ID NO: 2053568 - RNA, 21 nt, Human
ggccccagcacuaaagcagug

SEQ ID NO: 2053569 - RNA, 15 nt, Human
ggcccgucauguucc

SEQ ID NO: 2053570 - RNA, 21 nt, Human
ggccagaucuguuaagugguu

SEQ ID NO: 2053571 - RNA, 22 nt, Human
ggccugaugcucccuccccugc

SEQ ID NO: 2053572 - RNA, 23 nt, Human
ggccugaugcucccuccccugcc

SEQ ID NO: 2053573 - RNA, 15 nt, Human
ggccugaugcucccu

SEQ ID NO: 2053574 - RNA, 17 nt, Human
ggccugaugcucccucc

SEQ ID NO: 2053575 - RNA, 18 nt, Human
ggccugaugcucccuccc

SEQ ID NO: 2053576 - RNA, 20 nt, Human
ggccugaugcucccuccccu

SEQ ID NO: 2053577 - RNA, 13 nt, Human
ggccugcacuaau

SEQ ID NO: 2053578 - RNA, 13 nt, Human
ggccugccagacg

SEQ ID NO: 2053579 - RNA, 15 nt, Human
ggccuggcagccgug

SEQ ID NO: 2053580 - RNA, 14 nt, Human
ggccuggcagccgu

SEQ ID NO: 2053581 - RNA, 19 nt, Human
ggccuggcauggcaccugu

SEQ ID NO: 2053582 - RNA, 15 nt, Human
ggccuggccagaugc

SEQ ID NO: 2053583 - RNA, 12 nt, Human
ggccuggccaga

SEQ ID NO: 2053584 - RNA, 18 nt, Human
ggccuuacaccucguuag

SEQ ID NO: 2053585 - RNA, 16 nt, Human
ggccuggccagaugca

SEQ ID NO: 2053586 - RNA, 11 nt, Human
ggccugccugu

SEQ ID NO: 2053587 - RNA, 17 nt, Human
ggccugccuagcacuca

SEQ ID NO: 2053588 - RNA, 18 nt, Human
ggccugccuugaagccac

SEQ ID NO: 2053589 - RNA, 17 nt, Human
ggccugcugggcucucc

SEQ ID NO: 2053590 - RNA, 19 nt, Human
ggccugcugggcucuccac

SEQ ID NO: 2053591 - RNA, 19 nt, Human
ggcuaagagcuagcgcugc

SEQ ID NO: 2053592 - RNA, 15 nt, Human
ggcuaacuggaagca

SEQ ID NO: 2053593 - RNA, 17 nt, Human
ggcgugacucacccaag

SEQ ID NO: 2053594 - RNA, 15 nt, Human
ggcgugaggauggga

SEQ ID NO: 2053595 - RNA, 22 nt, Human
ggcgcaagccuguaaucccagc

SEQ ID NO: 2053596 - RNA, 15 nt, Human
ggcgugacucaccca

SEQ ID NO: 2053597 - RNA, 14 nt, Human
ggcgcaagccugua

SEQ ID NO: 2053598 - RNA, 16 nt, Human
ggccuuccccagccuc

SEQ ID NO: 2053599 - RNA, 15 nt, Human
ggcgagucacugccu

SEQ ID NO: 2053600 - RNA, 21 nt, Human
ggcgaggggaggguggcaggu

SEQ ID NO: 2053601 - RNA, 16 nt, Human
ggcgagucacugccuc

SEQ ID NO: 2053602 - RNA, 17 nt, Human
ggcgauccaccugucuc

SEQ ID NO: 2053603 - RNA, 18 nt, Human
ggcgauccaccugucuca

SEQ ID NO: 2053604 - RNA, 22 nt, Human
ggcgauccaccugucucagccu

SEQ ID NO: 2053605 - RNA, 15 nt, Human
ggccuuccccagccu

SEQ ID NO: 2053606 - RNA, 17 nt, Human
ggccuuccccagccucu

SEQ ID NO: 2053607 - RNA, 20 nt, Human
ggcuaagagcuagcgcugcc

SEQ ID NO: 2053608 - RNA, 14 nt, Human
ggcuaacuggaagc

SEQ ID NO: 2053609 - RNA, 19 nt, Human
ggcuaagaguguccuagga

SEQ ID NO: 2053610 - RNA, 15 nt, Human
ggcuaaggcaccagc

SEQ ID NO: 2053611 - RNA, 16 nt, Human
ggcuaaggcaccagcc

SEQ ID NO: 2053612 - RNA, 20 nt, Human
ggcuaagugauccucccacc

SEQ ID NO: 2053613 - RNA, 16 nt, Human
ggcuaauguacugcau

SEQ ID NO: 2053614 - RNA, 16 nt, Human
ggcuacucagcagccc

SEQ ID NO: 2053615 - RNA, 23 nt, Human
ggcuacucacucaaguucaagga

SEQ ID NO: 2053616 - RNA, 15 nt, Human
ggcuacucagcagcc

SEQ ID NO: 2053617 - RNA, 12 nt, Human
ggcuacccuccc

SEQ ID NO: 2053618 - RNA, 17 nt, Human
ggcuacucagcagcccu

SEQ ID NO: 2053619 - RNA, 18 nt, Human
ggcuacucagcagcccuc

SEQ ID NO: 2053620 - RNA, 20 nt, Human
ggcuacucagcagcccuccu

SEQ ID NO: 2053621 - RNA, 21 nt, Human
ggcuacucagcagcccuccuc

SEQ ID NO: 2053622 - RNA, 20 nt, Human
ggcuagaggccagccccacc

SEQ ID NO: 2053623 - RNA, 16 nt, Human
ggcuagaggccagccc

SEQ ID NO: 2053624 - RNA, 18 nt, Human
ggcuagaggccagcccca

SEQ ID NO: 2053625 - RNA, 15 nt, Human
ggagggggagggggu

SEQ ID NO: 2053626 - RNA, 19 nt, Human
ggaggguuggggaggggcg

SEQ ID NO: 2053627 - RNA, 19 nt, Human
ggagggugggagagcccag

SEQ ID NO: 2053628 - RNA, 17 nt, Human
ggagguggcagcccugu

SEQ ID NO: 2053629 - RNA, 15 nt, Human
ggaggguggcaggug

SEQ ID NO: 2053630 - RNA, 15 nt, Human
ggagggucaggaagg

SEQ ID NO: 2053631 - RNA, 16 nt, Human
ggagggucaggaagga

SEQ ID NO: 2053632 - RNA, 13 nt, Human
ggagguggcuggg

SEQ ID NO: 2053633 - RNA, 20 nt, Human
ggaggcggagcuugcaguga

SEQ ID NO: 2053634 - RNA, 16 nt, Human
ggaggcuauguggagu

SEQ ID NO: 2053635 - RNA, 14 nt, Human
ggagggucaggaag

SEQ ID NO: 2053636 - RNA, 12 nt, Human
ggaggcuggagg

SEQ ID NO: 2053637 - RNA, 20 nt, Human
ggaggcuggaggaagggggg

SEQ ID NO: 2053638 - RNA, 13 nt, Human
ggaggcuggcagg

SEQ ID NO: 2053639 - RNA, 16 nt, Human
ggaggcuugucagagc

SEQ ID NO: 2053640 - RNA, 17 nt, Human
ggaggcuugucagagcu

SEQ ID NO: 2053641 - RNA, 18 nt, Human
ggaggcuugucagagcug

SEQ ID NO: 2053642 - RNA, 19 nt, Human
ggaggcuugucagagcugg

SEQ ID NO: 2053643 - RNA, 20 nt, Human
ggaggcuugucagagcuggg

SEQ ID NO: 2053644 - RNA, 22 nt, Human
ggaggcuugucagagcugggag

SEQ ID NO: 2053645 - RNA, 12 nt, Human
ggagugggacag

SEQ ID NO: 2053646 - RNA, 18 nt, Human
ggagugggacagagucug

SEQ ID NO: 2053647 - RNA, 16 nt, Human
ggaguguguauuguuc

SEQ ID NO: 2053648 - RNA, 17 nt, Human
ggaguguguauuguucc

SEQ ID NO: 2053649 - RNA, 17 nt, Human
ggagugggacagagucu

SEQ ID NO: 2053650 - RNA, 21 nt, Human
ggaguucaagaccagccuggc

SEQ ID NO: 2053651 - RNA, 15 nt, Human
ggaguuagaggccag

SEQ ID NO: 2053652 - RNA, 16 nt, Human
ggaguuagaggccagc

SEQ ID NO: 2053653 - RNA, 18 nt, Human
ggaguuagaggccagccu

SEQ ID NO: 2053654 - RNA, 19 nt, Human
ggaguuagaggccagccug

SEQ ID NO: 2053655 - RNA, 21 nt, Human
ggaguuagaggccagccuggc

SEQ ID NO: 2053656 - RNA, 15 nt, Human
ggaguguuucauggg

SEQ ID NO: 2053657 - RNA, 18 nt, Human
ggaguguguauuguuccc

SEQ ID NO: 2053658 - RNA, 19 nt, Human
ggaguguguauuguuccca

SEQ ID NO: 2053659 - RNA, 18 nt, Human
ggaucucuugagccuggg

SEQ ID NO: 2053660 - RNA, 17 nt, Human
ggaucucccagggcuac

SEQ ID NO: 2053661 - RNA, 23 nt, Human
ggaucucucuagugauggucaga

SEQ ID NO: 2053662 - RNA, 18 nt, Human
ggaguucgagaccagccu

SEQ ID NO: 2053663 - RNA, 19 nt, Human
ggaucggaggcuugucaga

SEQ ID NO: 2053664 - RNA, 23 nt, Human
ggaucggaggcuugucagagcug

SEQ ID NO: 2053665 - RNA, 12 nt, Human
ggaucuaccagc

SEQ ID NO: 2053666 - RNA, 13 nt, Human
ggaucuaccagca

SEQ ID NO: 2053667 - RNA, 18 nt, Human
ggaucuaccagcauaaau

SEQ ID NO: 2053668 - RNA, 20 nt, Human
ggauuguaucaaguggcaug

SEQ ID NO: 2053669 - RNA, 20 nt, Human
ggaugguccuggggcucugu

SEQ ID NO: 2053670 - RNA, 22 nt, Human
ggaugguccuggggcucugugc

SEQ ID NO: 2053671 - RNA, 23 nt, Human
ggaugguacuagggggaagugac

SEQ ID NO: 2053672 - RNA, 14 nt, Human
ggaugguccugggg

SEQ ID NO: 2053673 - RNA, 16 nt, Human
ggaugguccuggggcu

SEQ ID NO: 2053674 - RNA, 20 nt, Human
ggaucuuucacccacagaaa

SEQ ID NO: 2053675 - RNA, 22 nt, Human
ggaucuuucacccacagaaaga

SEQ ID NO: 2053676 - RNA, 14 nt, Human
ggcagccugccugg

SEQ ID NO: 2053677 - RNA, 12 nt, Human
ggcaggggcgga

SEQ ID NO: 2053678 - RNA, 15 nt, Human
ggcagggguggagga

SEQ ID NO: 2053679 - RNA, 23 nt, Human
ggcagggguggaggagagccugg

SEQ ID NO: 2053680 - RNA, 22 nt, Human
ggcaucacagggcagagccggg

SEQ ID NO: 2053681 - RNA, 23 nt, Human
ggcaucacagggcagagccggga

SEQ ID NO: 2053682 - RNA, 18 nt, Human
ggcaucaccuuaggcagg

SEQ ID NO: 2053683 - RNA, 20 nt, Human
ggcaucaccuuaggcaggga

SEQ ID NO: 2053684 - RNA, 23 nt, Human
ggcaucaccuuaggcagggaagu

SEQ ID NO: 2053685 - RNA, 23 nt, Human
ggcaucaugcaucuuacugaagg

SEQ ID NO: 2053686 - RNA, 14 nt, Human
ggcauuugcugaau

SEQ ID NO: 2053687 - RNA, 14 nt, Human
ggcaucuccugugc

SEQ ID NO: 2053688 - RNA, 22 nt, Human
ggccagagagccuggugcugcu

SEQ ID NO: 2053689 - RNA, 18 nt, Human
ggccagagagccuggugc

SEQ ID NO: 2053690 - RNA, 21 nt, Human
ggccagagagccuggugcugc

SEQ ID NO: 2053691 - RNA, 19 nt, Human
ggccagagggagugacaga

SEQ ID NO: 2053692 - RNA, 17 nt, Human
ggccagagggagugaca

SEQ ID NO: 2053693 - RNA, 11 nt, Human
ggccaaggacu

SEQ ID NO: 2053694 - RNA, 13 nt, Human
ggccaaggacugc

SEQ ID NO: 2053695 - RNA, 15 nt, Human
ggccaaggacugccg

SEQ ID NO: 2053696 - RNA, 17 nt, Human
ggccaaggacugccgac

SEQ ID NO: 2053697 - RNA, 14 nt, Human
ggccagaccagagc

SEQ ID NO: 2053698 - RNA, 15 nt, Human
ggccagaccagagcu

SEQ ID NO: 2053699 - RNA, 16 nt, Human
ggccagaccagagcuc

SEQ ID NO: 2053700 - RNA, 18 nt, Human
ggccagaccagagcucug

SEQ ID NO: 2053701 - RNA, 19 nt, Human
ggccagaccagagcucugg

SEQ ID NO: 2053702 - RNA, 23 nt, Human
ggccagaccagagcucuggagcc

SEQ ID NO: 2053703 - RNA, 13 nt, Human
ggccaagaggcug

SEQ ID NO: 2053704 - RNA, 18 nt, Human
ggcacaccgggcacucag

SEQ ID NO: 2053705 - RNA, 14 nt, Human
ggcacauggaggag

SEQ ID NO: 2053706 - RNA, 21 nt, Human
ggcacauuuccccagaccuga

SEQ ID NO: 2053707 - RNA, 16 nt, Human
ggcaccaaagccacca

SEQ ID NO: 2053708 - RNA, 16 nt, Human
ggcaccaagcccacag

SEQ ID NO: 2053709 - RNA, 22 nt, Human
ggcaccacugcacuccagccug

SEQ ID NO: 2053710 - RNA, 16 nt, Human
ggcacauuuccccaga

SEQ ID NO: 2053711 - RNA, 20 nt, Human
ggcacauuuccccagaccug

SEQ ID NO: 2053712 - RNA, 12 nt, Human
ggcacauuuuuu

SEQ ID NO: 2053713 - RNA, 13 nt, Human
ggcacauuuuuuu

SEQ ID NO: 2053714 - RNA, 18 nt, Human
ggcacauuuuuuuuuuua

SEQ ID NO: 2053715 - RNA, 23 nt, Human
ggcacauuuuuuuuuuuaauuuu

SEQ ID NO: 2053716 - RNA, 14 nt, Human
ggauuuuugucuug

SEQ ID NO: 2053717 - RNA, 16 nt, Human
ggauuuuugucuugug

SEQ ID NO: 2053718 - RNA, 15 nt, Human
ggcaaaaaggcagga

SEQ ID NO: 2053719 - RNA, 13 nt, Human
ggauuucucccag

SEQ ID NO: 2053720 - RNA, 15 nt, Human
ggcaaaaaaauuaaa

SEQ ID NO: 2053721 - RNA, 18 nt, Human
ggcaggaggaucacuuga

SEQ ID NO: 2053722 - RNA, 24 nt, Human
ggcaggaggauugcuugagcccag

SEQ ID NO: 2053723 - RNA, 14 nt, Human
ggcaggagggaggu

SEQ ID NO: 2053724 - RNA, 14 nt, Human
ggcaggagggcccu

SEQ ID NO: 2053725 - RNA, 15 nt, Human
ggcaggaugacccug

SEQ ID NO: 2053726 - RNA, 18 nt, Human
ggcagggaaaggcucuga

SEQ ID NO: 2053727 - RNA, 23 nt, Human
ggcagggaaggggaggcagccgg

SEQ ID NO: 2053728 - RNA, 15 nt, Human
ggcagggcaucuccu

SEQ ID NO: 2053729 - RNA, 13 nt, Human
ggcagggagggga

SEQ ID NO: 2053730 - RNA, 15 nt, Human
ggcagggaggcacca

SEQ ID NO: 2053731 - RNA, 21 nt, Human
ggcagccccauucugccugcc

SEQ ID NO: 2053732 - RNA, 20 nt, Human
ggcagccccauucugccugc

SEQ ID NO: 2053733 - RNA, 16 nt, Human
ggcagccccauucugc

SEQ ID NO: 2053734 - RNA, 13 nt, Human
ggcagccccagca

SEQ ID NO: 2053735 - RNA, 14 nt, Human
ggcagccccagcac

SEQ ID NO: 2053736 - RNA, 23 nt, Human
ggcagccccagcaccaccagguc

SEQ ID NO: 2053737 - RNA, 16 nt, Human
ggcagccugcguggcu

SEQ ID NO: 2053738 - RNA, 19 nt, Human
ggcagccugcguggcugac

SEQ ID NO: 2053739 - RNA, 22 nt, Human
ggcagccugcguggcugacccc

SEQ ID NO: 2053740 - RNA, 11 nt, Human
ggcagccugga

SEQ ID NO: 2053741 - RNA, 22 nt, Human
ggcagccccauucugccugccc

SEQ ID NO: 2053742 - RNA, 19 nt, Human
ggcagccaaacccaugagg

SEQ ID NO: 2053743 - RNA, 20 nt, Human
ggcagccaaacccaugaggc

SEQ ID NO: 2053744 - RNA, 16 nt, Human
ggcagccaaacccaug

SEQ ID NO: 2053745 - RNA, 18 nt, Human
ggcagccaaacccaugag

SEQ ID NO: 2053746 - RNA, 17 nt, Human
ggcagcauagcaagaca

SEQ ID NO: 2053747 - RNA, 19 nt, Human
ggcagcauagcaagacaca

SEQ ID NO: 2053748 - RNA, 15 nt, Human
aaaaucugcuaggga

SEQ ID NO: 2053749 - RNA, 16 nt, Human
aaaaucucucucuguu

SEQ ID NO: 2053750 - RNA, 12 nt, Human
aaaaucugucca

SEQ ID NO: 2053751 - RNA, 18 nt, Human
aaaaucuguagagcaggg

SEQ ID NO: 2053752 - RNA, 13 nt, Human
aaaaugacaauga

SEQ ID NO: 2053753 - RNA, 13 nt, Human
aaaaugacagaug

SEQ ID NO: 2053754 - RNA, 15 nt, Human
aaaaugacagauguu

SEQ ID NO: 2053755 - RNA, 17 nt, Human
aaaaugacagauguuga

SEQ ID NO: 2053756 - RNA, 14 nt, Human
aaaaugacauccca

SEQ ID NO: 2053757 - RNA, 18 nt, Human
aaaaugacagauguugaa

SEQ ID NO: 2053758 - RNA, 21 nt, Human
aaaaugacuaaaaauauuaua

SEQ ID NO: 2053759 - RNA, 21 nt, Human
aaaaugcuguauuagucacag

SEQ ID NO: 2053760 - RNA, 23 nt, Human
aaaaugcuguauuagucacagag

SEQ ID NO: 2053761 - RNA, 17 nt, Human
aaaaugcccuuaaauca

SEQ ID NO: 2053762 - RNA, 14 nt, Human
aaaaugauuuuacu

SEQ ID NO: 2053763 - RNA, 23 nt, Human
aaaaugauuuuacuuagcaaugu

SEQ ID NO: 2053764 - RNA, 15 nt, Human
aaaaugagaacaugu

SEQ ID NO: 2053765 - RNA, 18 nt, Human
aaaaugagaacauguugg

SEQ ID NO: 2053766 - RNA, 20 nt, Human
aaaaugagaacauguuggua

SEQ ID NO: 2053767 - RNA, 23 nt, Human
aaaaugagaacauguugguauuu

SEQ ID NO: 2053768 - RNA, 15 nt, Human
aaaaugccaaucucu

SEQ ID NO: 2053769 - RNA, 18 nt, Human
aaaaugcaacaacaugua

SEQ ID NO: 2053770 - RNA, 15 nt, Human
aaaauauuccugcau

SEQ ID NO: 2053771 - RNA, 13 nt, Human
aaaauaugauauu

SEQ ID NO: 2053772 - RNA, 13 nt, Human
aaaauaucauuca

SEQ ID NO: 2053773 - RNA, 14 nt, Human
aaaauaucauucag

SEQ ID NO: 2053774 - RNA, 16 nt, Human
aaaauaucauucagca

SEQ ID NO: 2053775 - RNA, 14 nt, Human
aaaauagaagaaua

SEQ ID NO: 2053776 - RNA, 16 nt, Human
aaaauauuuuccugcc

SEQ ID NO: 2053777 - RNA, 13 nt, Human
aaaauauuuuaua

SEQ ID NO: 2053778 - RNA, 17 nt, Human
aaaauauuuuauaauuu

SEQ ID NO: 2053779 - RNA, 18 nt, Human
aaaauauuuuauaauuuu

SEQ ID NO: 2053780 - RNA, 11 nt, Human
aaaauaugcau

SEQ ID NO: 2053781 - RNA, 12 nt, Human
aaaauacauuuu

SEQ ID NO: 2053782 - RNA, 13 nt, Human
aaaauacauuuua

SEQ ID NO: 2053783 - RNA, 15 nt, Human
aaaauacaguauucu

SEQ ID NO: 2053784 - RNA, 14 nt, Human
aaaauaauuuuaug

SEQ ID NO: 2053785 - RNA, 15 nt, Human
aaaauaauuuuauga

SEQ ID NO: 2053786 - RNA, 18 nt, Human
aaaauaauuuuaugaacu

SEQ ID NO: 2053787 - RNA, 14 nt, Human
aaaauacaauaaac

SEQ ID NO: 2053788 - RNA, 15 nt, Human
aaaauacaauaaacu

SEQ ID NO: 2053789 - RNA, 14 nt, Human
aaaauacauuuuau

SEQ ID NO: 2053790 - RNA, 16 nt, Human
aaaauaacuucaagca

SEQ ID NO: 2053791 - RNA, 12 nt, Human
aaaauaauaaau

SEQ ID NO: 2053792 - RNA, 13 nt, Human
aaaauaauaaauu

SEQ ID NO: 2053793 - RNA, 16 nt, Human
aaaauaauaaauugca

SEQ ID NO: 2053794 - RNA, 13 nt, Human
aaaauaauaauaa

SEQ ID NO: 2053795 - RNA, 22 nt, Human
aaaauaauugauuucaagaccu

SEQ ID NO: 2053796 - RNA, 16 nt, Human
aaaauaauugauuuca

SEQ ID NO: 2053797 - RNA, 12 nt, Human
aaaauaauuuua

SEQ ID NO: 2053798 - RNA, 11 nt, Human
aaaauaauaaa

SEQ ID NO: 2053799 - RNA, 13 nt, Human
aaaauaaugucuu

SEQ ID NO: 2053800 - RNA, 18 nt, Human
aaaauaaugucuuguuaa

SEQ ID NO: 2053801 - RNA, 20 nt, Human
aaaauaaugucuuguuaaua

SEQ ID NO: 2053802 - RNA, 23 nt, Human
aaaauaaugucuuguuaauauuc

SEQ ID NO: 2053803 - RNA, 11 nt, Human
aaaaggcagga

SEQ ID NO: 2053804 - RNA, 19 nt, Human
aaaaggacaggcagaaaga

SEQ ID NO: 2053805 - RNA, 20 nt, Human
aaaaggacaggcagaaagag

SEQ ID NO: 2053806 - RNA, 21 nt, Human
aaaaggacaggcagaaagagu

SEQ ID NO: 2053807 - RNA, 17 nt, Human
aaaagguuaauaaagua

SEQ ID NO: 2053808 - RNA, 19 nt, Human
aaaagguucacuaaagcag

SEQ ID NO: 2053809 - RNA, 19 nt, Human
aaaagguucuuacugcuug

SEQ ID NO: 2053810 - RNA, 22 nt, Human
aaaaggugccugugaggcaggg

SEQ ID NO: 2053811 - RNA, 16 nt, Human
aaaauaaccccaaaau

SEQ ID NO: 2053812 - RNA, 20 nt, Human
aaaaggugccugugaggcag

SEQ ID NO: 2053813 - RNA, 16 nt, Human
aaaagguuaauaaagu

SEQ ID NO: 2053814 - RNA, 16 nt, Human
aaaaggacaccuuuua

SEQ ID NO: 2053815 - RNA, 22 nt, Human
aaaaggagccaauuuaaagaaa

SEQ ID NO: 2053816 - RNA, 18 nt, Human
gggcccaagacagaugcc

SEQ ID NO: 2053817 - RNA, 12 nt, Human
gggccagaggca

SEQ ID NO: 2053818 - RNA, 16 nt, Human
gggcgugacucaccca

SEQ ID NO: 2053819 - RNA, 21 nt, Human
gggcggugagaggggaacaga

SEQ ID NO: 2053820 - RNA, 23 nt, Human
gggccugccuagcacucacaugc

SEQ ID NO: 2053821 - RNA, 22 nt, Human
gggccucgguguggagaagcgg

SEQ ID NO: 2053822 - RNA, 17 nt, Human
gggccucggagccucau

SEQ ID NO: 2053823 - RNA, 14 nt, Human
gggccucagugcca

SEQ ID NO: 2053824 - RNA, 13 nt, Human
gggccucagugcc

SEQ ID NO: 2053825 - RNA, 15 nt, Human
gggccucagugccac

SEQ ID NO: 2053826 - RNA, 16 nt, Human
gggccucaaggacuug

SEQ ID NO: 2053827 - RNA, 13 nt, Human
gggccucacucca

SEQ ID NO: 2053828 - RNA, 14 nt, Human
gggccucacuccag

SEQ ID NO: 2053829 - RNA, 19 nt, Human
gggccucagggcagccugc

SEQ ID NO: 2053830 - RNA, 15 nt, Human
gggccucggagccuc

SEQ ID NO: 2053831 - RNA, 11 nt, Human
gggcuggggca

SEQ ID NO: 2053832 - RNA, 22 nt, Human
gggcuggggcaggaggggagug

SEQ ID NO: 2053833 - RNA, 13 nt, Human
gggcugggcagcu

SEQ ID NO: 2053834 - RNA, 14 nt, Human
gggcugggcagcug

SEQ ID NO: 2053835 - RNA, 16 nt, Human
aaaaugguaaaauugc

SEQ ID NO: 2053836 - RNA, 17 nt, Human
aaaaugguaaaauugca

SEQ ID NO: 2053837 - RNA, 21 nt, Human
gggcugcccuggugcugccac

SEQ ID NO: 2053838 - RNA, 17 nt, Human
gggcugcugaccuccac

SEQ ID NO: 2053839 - RNA, 15 nt, Human
gggcugcuccuccag

SEQ ID NO: 2053840 - RNA, 16 nt, Human
gggcugcuccuccagg

SEQ ID NO: 2053841 - RNA, 18 nt, Human
gggcugcuccuccagggc

SEQ ID NO: 2053842 - RNA, 19 nt, Human
gggcugcuccuccagggcc

SEQ ID NO: 2053843 - RNA, 11 nt, Human
gggcugcuccu

SEQ ID NO: 2053844 - RNA, 14 nt, Human
gggcugcuccucau

SEQ ID NO: 2053845 - RNA, 11 nt, Human
gggcucagccu

SEQ ID NO: 2053846 - RNA, 12 nt, Human
gggcucagccug

SEQ ID NO: 2053847 - RNA, 13 nt, Human
gggcucagccugg

SEQ ID NO: 2053848 - RNA, 19 nt, Human
gggcucagcggggacagcu

SEQ ID NO: 2053849 - RNA, 17 nt, Human
gggcucagcggggacag

SEQ ID NO: 2053850 - RNA, 18 nt, Human
gggcuaguugggcuuccu

SEQ ID NO: 2053851 - RNA, 22 nt, Human
gggcucagcaaaagaugcuucu

SEQ ID NO: 2053852 - RNA, 15 nt, Human
gggcuaguugggcuu

SEQ ID NO: 2053853 - RNA, 14 nt, Human
gggcucagcucugg

SEQ ID NO: 2053854 - RNA, 18 nt, Human
gggcucagcucuggcuca

SEQ ID NO: 2053855 - RNA, 22 nt, Human
gggcucagcucuggcucacaga

SEQ ID NO: 2053856 - RNA, 23 nt, Human
gggcucagcucuggcucacagac

SEQ ID NO: 2053857 - RNA, 16 nt, Human
gggcucagccuggugg

SEQ ID NO: 2053858 - RNA, 20 nt, Human
gggcucagccuggugggccu

SEQ ID NO: 2053859 - RNA, 21 nt, Human
gggcucagcggggacagcucc

SEQ ID NO: 2053860 - RNA, 21 nt, Human
gggcuccccuucgcguauuuc

SEQ ID NO: 2053861 - RNA, 18 nt, Human
gggcuccccuuucgccca

SEQ ID NO: 2053862 - RNA, 20 nt, Human
gggcuccccuuucgcccaca

SEQ ID NO: 2053863 - RNA, 13 nt, Human
gguauagaaaugc

SEQ ID NO: 2053864 - RNA, 22 nt, Human
gguauaucauuauaacugaagg

SEQ ID NO: 2053865 - RNA, 14 nt, Human
gguaucaggugcug

SEQ ID NO: 2053866 - RNA, 23 nt, Human
gguauaucugggcuggccaguug

SEQ ID NO: 2053867 - RNA, 15 nt, Human
gguauaucugggcug

SEQ ID NO: 2053868 - RNA, 13 nt, Human
gguauauucauuu

SEQ ID NO: 2053869 - RNA, 18 nt, Human
gguaucaaacagcucagg

SEQ ID NO: 2053870 - RNA, 21 nt, Human
gguaucaaacagcucaggcug

SEQ ID NO: 2053871 - RNA, 23 nt, Human
gguaagaagccgggaacagacaa

SEQ ID NO: 2053872 - RNA, 17 nt, Human
gguaagagaauguuaua

SEQ ID NO: 2053873 - RNA, 13 nt, Human
gguaagcuuccag

SEQ ID NO: 2053874 - RNA, 18 nt, Human
gguaagcuuccaggaaaa

SEQ ID NO: 2053875 - RNA, 13 nt, Human
gguaaggugccuu

SEQ ID NO: 2053876 - RNA, 13 nt, Human
gguagggguuggg

SEQ ID NO: 2053877 - RNA, 21 nt, Human
gguaggaauagcaugucacua

SEQ ID NO: 2053878 - RNA, 16 nt, Human
ggucauagcagugcuu

SEQ ID NO: 2053879 - RNA, 19 nt, Human
ggucagugaggcccaggga

SEQ ID NO: 2053880 - RNA, 14 nt, Human
ggucaguggcucuu

SEQ ID NO: 2053881 - RNA, 19 nt, Human
gguaucauuuucugcauuu

SEQ ID NO: 2053882 - RNA, 12 nt, Human
gguauccugccc

SEQ ID NO: 2053883 - RNA, 15 nt, Human
gguauccugcccagu

SEQ ID NO: 2053884 - RNA, 17 nt, Human
gguauccugcccagugu

SEQ ID NO: 2053885 - RNA, 18 nt, Human
gguauccugcccaguguu

SEQ ID NO: 2053886 - RNA, 19 nt, Human
gguaucaggugcugccauc

SEQ ID NO: 2053887 - RNA, 12 nt, Human
ggucaguaccca

SEQ ID NO: 2053888 - RNA, 17 nt, Human
ggucaguacccaccuga

SEQ ID NO: 2053889 - RNA, 20 nt, Human
ggucaguacccaccugagcu

SEQ ID NO: 2053890 - RNA, 21 nt, Human
ggucaguacccaccugagcuu

SEQ ID NO: 2053891 - RNA, 22 nt, Human
aaacuugauguguuaucucuua

SEQ ID NO: 2053892 - RNA, 21 nt, Human
aaacuuuagaguagcaugaga

SEQ ID NO: 2053893 - RNA, 23 nt, Human
aaacuuccaugaggccaaacguu

SEQ ID NO: 2053894 - RNA, 19 nt, Human
aaacuugaauucauagaaa

SEQ ID NO: 2053895 - RNA, 17 nt, Human
gguccagcuugcucuuc

SEQ ID NO: 2053896 - RNA, 18 nt, Human
gguccagcuugcucuuca

SEQ ID NO: 2053897 - RNA, 23 nt, Human
aaacuuccagugcaacacugaag

SEQ ID NO: 2053898 - RNA, 13 nt, Human
gguaaaauucuaa

SEQ ID NO: 2053899 - RNA, 14 nt, Human
gguaaaauucuaaa

SEQ ID NO: 2053900 - RNA, 14 nt, Human
gguaaaauugcaug

SEQ ID NO: 2053901 - RNA, 13 nt, Human
gguaaaacacuug

SEQ ID NO: 2053902 - RNA, 13 nt, Human
gguaaauuucugu

SEQ ID NO: 2053903 - RNA, 11 nt, Human
gguaaauuauu

SEQ ID NO: 2053904 - RNA, 20 nt, Human
ggguuuugccauguuggcca

SEQ ID NO: 2053905 - RNA, 16 nt, Human
ggguuuuccacccugg

SEQ ID NO: 2053906 - RNA, 17 nt, Human
ggguuuuccacccugga

SEQ ID NO: 2053907 - RNA, 23 nt, Human
ggguuuugccauguuggccaggc

SEQ ID NO: 2053908 - RNA, 18 nt, Human
ggguguaacaggucuccu

SEQ ID NO: 2053909 - RNA, 19 nt, Human
ggguguaacaggucuccuc

SEQ ID NO: 2053910 - RNA, 23 nt, Human
ggguguauuuauuuuccucccca

SEQ ID NO: 2053911 - RNA, 14 nt, Human
aaacuuacacacaa

SEQ ID NO: 2053912 - RNA, 21 nt, Human
aaacuuagugcggacaaguuu

SEQ ID NO: 2053913 - RNA, 14 nt, Human
aaacuuaucuuaca

SEQ ID NO: 2053914 - RNA, 16 nt, Human
aaacuuaucuuacaaa

SEQ ID NO: 2053915 - RNA, 20 nt, Human
aaacuuaucuuacaaagugu

SEQ ID NO: 2053916 - RNA, 16 nt, Human
ggguggcuagucagag

SEQ ID NO: 2053917 - RNA, 18 nt, Human
ggguggcuagucagagag

SEQ ID NO: 2053918 - RNA, 16 nt, Human
aaacuucaagcaccag

SEQ ID NO: 2053919 - RNA, 20 nt, Human
aaacgcauggaguguguauu

SEQ ID NO: 2053920 - RNA, 17 nt, Human
aaacguuuuguuugaaa

SEQ ID NO: 2053921 - RNA, 14 nt, Human
aaacguuucaguaa

SEQ ID NO: 2053922 - RNA, 21 nt, Human
aaacguuucaguaauaaaaca

SEQ ID NO: 2053923 - RNA, 22 nt, Human
aaacguuucaguaauaaaacau

SEQ ID NO: 2053924 - RNA, 16 nt, Human
aaacguuuuauugugu

SEQ ID NO: 2053925 - RNA, 21 nt, Human
aaacguuuuauuguguuuuua

SEQ ID NO: 2053926 - RNA, 14 nt, Human
aaacuguucucuau

SEQ ID NO: 2053927 - RNA, 23 nt, Human
aaacuguucucuauuagacuuua

SEQ ID NO: 2053928 - RNA, 16 nt, Human
aaacuguugccagaga

SEQ ID NO: 2053929 - RNA, 22 nt, Human
aaacuguugccagagauggagg

SEQ ID NO: 2053930 - RNA, 14 nt, Human
aaacuuaagaaaca

SEQ ID NO: 2053931 - RNA, 18 nt, Human
aaacuuaaccgcaucaga

SEQ ID NO: 2053932 - RNA, 20 nt, Human
aaacuuaaccgcaucagaag

SEQ ID NO: 2053933 - RNA, 19 nt, Human
aaacuguuaauaguucagg

SEQ ID NO: 2053934 - RNA, 19 nt, Human
aaacauuuugucauauaag

SEQ ID NO: 2053935 - RNA, 22 nt, Human
aaacauuuucacacaauacaau

SEQ ID NO: 2053936 - RNA, 16 nt, Human
aaacauuuucacacaa

SEQ ID NO: 2053937 - RNA, 14 nt, Human
aaacauuuucacac

SEQ ID NO: 2053938 - RNA, 13 nt, Human
aaacauuuucaca

SEQ ID NO: 2053939 - RNA, 23 nt, Human
ggguccuucccucuccccaagac

SEQ ID NO: 2053940 - RNA, 18 nt, Human
ggguccuggcuccugagg

SEQ ID NO: 2053941 - RNA, 16 nt, Human
ggguccuucccucucc

SEQ ID NO: 2053942 - RNA, 18 nt, Human
ggguccuucccucucccc

SEQ ID NO: 2053943 - RNA, 13 nt, Human
ggguccuggcucc

SEQ ID NO: 2053944 - RNA, 18 nt, Human
gggucagggaccaaggac

SEQ ID NO: 2053945 - RNA, 23 nt, Human
gggucaaguuauuaauuucuuca

SEQ ID NO: 2053946 - RNA, 12 nt, Human
gggucaaggaau

SEQ ID NO: 2053947 - RNA, 13 nt, Human
gggucaaguuauu

SEQ ID NO: 2053948 - RNA, 10 nt, Human
ggguauccug

SEQ ID NO: 2053949 - RNA, 18 nt, Human
aaaccuuauuguaccucu

SEQ ID NO: 2053950 - RNA, 17 nt, Human
aaaccuuauuguaccuc

SEQ ID NO: 2053951 - RNA, 16 nt, Human
aaaccuuauuguaccu

SEQ ID NO: 2053952 - RNA, 14 nt, Human
aaacgaaggccucu

SEQ ID NO: 2053953 - RNA, 19 nt, Human
aaacgagucaauccccuca

SEQ ID NO: 2053954 - RNA, 16 nt, Human
aaacgaaacugcucua

SEQ ID NO: 2053955 - RNA, 13 nt, Human
aaacgaaagcugg

SEQ ID NO: 2053956 - RNA, 14 nt, Human
aaacgaaagcuggg

SEQ ID NO: 2053957 - RNA, 14 nt, Human
aaaccugauguuaa

SEQ ID NO: 2053958 - RNA, 19 nt, Human
aaaccugauguuaaaauuc

SEQ ID NO: 2053959 - RNA, 15 nt, Human
aaaccuggaugucac

SEQ ID NO: 2053960 - RNA, 11 nt, Human
aaaccuggaga

SEQ ID NO: 2053961 - RNA, 12 nt, Human
aaaccuggagau

SEQ ID NO: 2053962 - RNA, 16 nt, Human
aaaccacuagaacucu

SEQ ID NO: 2053963 - RNA, 12 nt, Human
aaaccagaagca

SEQ ID NO: 2053964 - RNA, 21 nt, Human
aaacauuuuguggucauuaag

SEQ ID NO: 2053965 - RNA, 22 nt, Human
ggggccaugagcuccagacccc

SEQ ID NO: 2053966 - RNA, 14 nt, Human
ggggccaugaggcc

SEQ ID NO: 2053967 - RNA, 11 nt, Human
gggcugggugu

SEQ ID NO: 2053968 - RNA, 20 nt, Human
ggggccaugagcuccagacc

SEQ ID NO: 2053969 - RNA, 21 nt, Human
ggggccaugagcuccagaccc

SEQ ID NO: 2053970 - RNA, 10 nt, Human
ggggccccuu

SEQ ID NO: 2053971 - RNA, 21 nt, Human
ggggccccuuuuuacuccccu

SEQ ID NO: 2053972 - RNA, 22 nt, Human
ggggccccuuuuuacuccccuu

SEQ ID NO: 2053973 - RNA, 16 nt, Human
ggggcccgccuggcag

SEQ ID NO: 2053974 - RNA, 21 nt, Human
ggggcccgccuggcagaacug

SEQ ID NO: 2053975 - RNA, 23 nt, Human
ggggcccgccuggcagaacugag

SEQ ID NO: 2053976 - RNA, 14 nt, Human
ggggccccagggcu

SEQ ID NO: 2053977 - RNA, 16 nt, Human
ggggccaugaggccuc

SEQ ID NO: 2053978 - RNA, 18 nt, Human
aaaauguauguguaagua

SEQ ID NO: 2053979 - RNA, 17 nt, Human
aaaaugguguuuucaug

SEQ ID NO: 2053980 - RNA, 20 nt, Human
aaaaugguguuuucauguaa

SEQ ID NO: 2053981 - RNA, 23 nt, Human
aaaaugguguuuucauguaaaua

SEQ ID NO: 2053982 - RNA, 12 nt, Human
aaaaugucugua

SEQ ID NO: 2053983 - RNA, 21 nt, Human
aaaaugucuguagcuccucaa

SEQ ID NO: 2053984 - RNA, 18 nt, Human
gggguagcuagaggaacc

SEQ ID NO: 2053985 - RNA, 19 nt, Human
gggguagcuagaggaacca

SEQ ID NO: 2053986 - RNA, 22 nt, Human
ggggucagggaccaaggacccc

SEQ ID NO: 2053987 - RNA, 17 nt, Human
ggggucaaagcaaggau

SEQ ID NO: 2053988 - RNA, 19 nt, Human
ggggguugcaguggagagg

SEQ ID NO: 2053989 - RNA, 22 nt, Human
gggguaaaauuccuuagcuuag

SEQ ID NO: 2053990 - RNA, 13 nt, Human
gggggcuggggca

SEQ ID NO: 2053991 - RNA, 15 nt, Human
gggggccaacaccag

SEQ ID NO: 2053992 - RNA, 17 nt, Human
gggggccaccuccccag

SEQ ID NO: 2053993 - RNA, 14 nt, Human
gggggcagggcaug

SEQ ID NO: 2053994 - RNA, 20 nt, Human
gggggcugccuggcccccag

SEQ ID NO: 2053995 - RNA, 17 nt, Human
gggggaucacagccucu

SEQ ID NO: 2053996 - RNA, 11 nt, Human
gggggcagagg

SEQ ID NO: 2053997 - RNA, 12 nt, Human
gggggcagaggg

SEQ ID NO: 2053998 - RNA, 13 nt, Human
gggggcagagggc

SEQ ID NO: 2053999 - RNA, 16 nt, Human
guaaagcuagaaauga

SEQ ID NO: 2054000 - RNA, 15 nt, Human
guaaagcuagaaaug

SEQ ID NO: 2054001 - RNA, 13 nt, Human
guaaacugcccug

SEQ ID NO: 2054002 - RNA, 14 nt, Human
guaaacugcccugu

SEQ ID NO: 2054003 - RNA, 15 nt, Human
guaaacuauuuaucu

SEQ ID NO: 2054004 - RNA, 16 nt, Human
guaaacuauuuaucug

SEQ ID NO: 2054005 - RNA, 21 nt, Human
guaaacuauuuaucuguguuu

SEQ ID NO: 2054006 - RNA, 19 nt, Human
guaaacuguacuagucugu

SEQ ID NO: 2054007 - RNA, 12 nt, Human
guaacaagaaaa

SEQ ID NO: 2054008 - RNA, 14 nt, Human
guaacaagaaaaca

SEQ ID NO: 2054009 - RNA, 15 nt, Human
guaacaagaaaacau

SEQ ID NO: 2054010 - RNA, 16 nt, Human
guaacaagaaaacaua

SEQ ID NO: 2054011 - RNA, 13 nt, Human
guaacaagaaagg

SEQ ID NO: 2054012 - RNA, 14 nt, Human
guaacaagaaagga

SEQ ID NO: 2054013 - RNA, 16 nt, Human
guaacaagaaaggaga

SEQ ID NO: 2054014 - RNA, 14 nt, Human
guaacaagagugau

SEQ ID NO: 2054015 - RNA, 21 nt, Human
guaacaagagugauucuugcu

SEQ ID NO: 2054016 - RNA, 20 nt, Human
guaacaggaaaauuuuaaaa

SEQ ID NO: 2054017 - RNA, 16 nt, Human
guaacagcugaggucu

SEQ ID NO: 2054018 - RNA, 14 nt, Human
guaacauaugcaaa

SEQ ID NO: 2054019 - RNA, 15 nt, Human
guaacauaugcaaac

SEQ ID NO: 2054020 - RNA, 19 nt, Human
guaacauaugcaaacauaa

SEQ ID NO: 2054021 - RNA, 16 nt, Human
guaacaagccacccca

SEQ ID NO: 2054022 - RNA, 19 nt, Human
guaacaggaaaauuuuaaa

SEQ ID NO: 2054023 - RNA, 22 nt, Human
aaaguuaaacauugaaguaaug

SEQ ID NO: 2054024 - RNA, 15 nt, Human
aaaguuaaaaaaaau

SEQ ID NO: 2054025 - RNA, 22 nt, Human
aaaguuaaaaaaaauaauaaau

SEQ ID NO: 2054026 - RNA, 16 nt, Human
aaaguuaaacauugaa

SEQ ID NO: 2054027 - RNA, 20 nt, Human
aaaguuaaccuaccuguaac

SEQ ID NO: 2054028 - RNA, 17 nt, Human
aaaguuacaaauugcuu

SEQ ID NO: 2054029 - RNA, 19 nt, Human
aaaguguuggcuaaugaag

SEQ ID NO: 2054030 - RNA, 11 nt, Human
aaaguguuuuc

SEQ ID NO: 2054031 - RNA, 14 nt, Human
aaaguguuuucaga

SEQ ID NO: 2054032 - RNA, 15 nt, Human
aaaguguuuucagag

SEQ ID NO: 2054033 - RNA, 16 nt, Human
aaaguguuuucagagc

SEQ ID NO: 2054034 - RNA, 15 nt, Human
aaaguguuuccuuca

SEQ ID NO: 2054035 - RNA, 16 nt, Human
aaaguguauuuuauaa

SEQ ID NO: 2054036 - RNA, 19 nt, Human
aaaguguauuuuauaaaau

SEQ ID NO: 2054037 - RNA, 20 nt, Human
aaaguguauuuuauaaaauu

SEQ ID NO: 2054038 - RNA, 21 nt, Human
aaaguguauuuuauaaaauua

SEQ ID NO: 2054039 - RNA, 12 nt, Human
guaaaauugcau

SEQ ID NO: 2054040 - RNA, 13 nt, Human
guaaaauugcaug

SEQ ID NO: 2054041 - RNA, 14 nt, Human
guaaaauugcaugg

SEQ ID NO: 2054042 - RNA, 12 nt, Human
guaaaauucuaa

SEQ ID NO: 2054043 - RNA, 13 nt, Human
guaaaauucuaaa

SEQ ID NO: 2054044 - RNA, 14 nt, Human
guaaaauucuaaau

SEQ ID NO: 2054045 - RNA, 22 nt, Human
guaaaauucuaaauaaaauaua

SEQ ID NO: 2054046 - RNA, 16 nt, Human
guaaaauugaaaggca

SEQ ID NO: 2054047 - RNA, 20 nt, Human
guaaacaaacuguguaacug

SEQ ID NO: 2054048 - RNA, 16 nt, Human
guaaacgcugucccua

SEQ ID NO: 2054049 - RNA, 20 nt, Human
guaaacgcugucccuaguaa

SEQ ID NO: 2054050 - RNA, 16 nt, Human
guaaacguuucaguaa

SEQ ID NO: 2054051 - RNA, 21 nt, Human
guaaacguuucaguaauaaaa

SEQ ID NO: 2054052 - RNA, 23 nt, Human
guaaacguuucaguaauaaaaca

SEQ ID NO: 2054053 - RNA, 23 nt, Human
guaaacuaaugaguuucuuuuau

SEQ ID NO: 2054054 - RNA, 16 nt, Human
guaaucccagcuacuu

SEQ ID NO: 2054055 - RNA, 20 nt, Human
guaaucccagcuacuuggga

SEQ ID NO: 2054056 - RNA, 20 nt, Human
guaaucauuucuugggcccu

SEQ ID NO: 2054057 - RNA, 23 nt, Human
guaauccuagcacuuugggaggc

SEQ ID NO: 2054058 - RNA, 13 nt, Human
guacaaggcaugg

SEQ ID NO: 2054059 - RNA, 22 nt, Human
guacaauaaguguuuuuguauu

SEQ ID NO: 2054060 - RNA, 12 nt, Human
guacaauauuua

SEQ ID NO: 2054061 - RNA, 13 nt, Human
guacaauauuuaa

SEQ ID NO: 2054062 - RNA, 14 nt, Human
guacaaaagggaca

SEQ ID NO: 2054063 - RNA, 16 nt, Human
guacaaaagggacaug

SEQ ID NO: 2054064 - RNA, 14 nt, Human
guacaaaauaaagu

SEQ ID NO: 2054065 - RNA, 21 nt, Human
guacaaaauaaaguuacauug

SEQ ID NO: 2054066 - RNA, 16 nt, Human
guaauaaacuguguuu

SEQ ID NO: 2054067 - RNA, 13 nt, Human
guaauaaacucau

SEQ ID NO: 2054068 - RNA, 16 nt, Human
guaauaaugugaauca

SEQ ID NO: 2054069 - RNA, 17 nt, Human
guaauaaugugaaucau

SEQ ID NO: 2054070 - RNA, 21 nt, Human
guaagugugaguaagagcugg

SEQ ID NO: 2054071 - RNA, 20 nt, Human
guaagugugaguaagagcug

SEQ ID NO: 2054072 - RNA, 23 nt, Human
guaaguugaauggccugccuuga

SEQ ID NO: 2054073 - RNA, 18 nt, Human
guaaccugagauggcccu

SEQ ID NO: 2054074 - RNA, 20 nt, Human
guaaccugagauggcccucu

SEQ ID NO: 2054075 - RNA, 21 nt, Human
guaaccugagauggcccucug

SEQ ID NO: 2054076 - RNA, 15 nt, Human
aaauaucagacuagu

SEQ ID NO: 2054077 - RNA, 18 nt, Human
aaauaucaguuacucagc

SEQ ID NO: 2054078 - RNA, 20 nt, Human
aaauaucaguuacucagccc

SEQ ID NO: 2054079 - RNA, 13 nt, Human
aaauaucauucag

SEQ ID NO: 2054080 - RNA, 14 nt, Human
aaauaucauucagc

SEQ ID NO: 2054081 - RNA, 15 nt, Human
aaauaucauucagca

SEQ ID NO: 2054082 - RNA, 17 nt, Human
aaauaucauucagcaac

SEQ ID NO: 2054083 - RNA, 18 nt, Human
aaauaucauuuauuuuuu

SEQ ID NO: 2054084 - RNA, 16 nt, Human
aaauaucauucagcaa

SEQ ID NO: 2054085 - RNA, 14 nt, Human
aaauaucaaucauu

SEQ ID NO: 2054086 - RNA, 18 nt, Human
aaauaucaaucauuuucc

SEQ ID NO: 2054087 - RNA, 20 nt, Human
aaauaucaaucauuuuccuu

SEQ ID NO: 2054088 - RNA, 22 nt, Human
aaauaucaaucauuuuccuuuu

SEQ ID NO: 2054089 - RNA, 12 nt, Human
aaauauauguau

SEQ ID NO: 2054090 - RNA, 14 nt, Human
aaauauauguaugu

SEQ ID NO: 2054091 - RNA, 15 nt, Human
aaauauauguaugua

SEQ ID NO: 2054092 - RNA, 16 nt, Human
aaauauauguauguaa

SEQ ID NO: 2054093 - RNA, 19 nt, Human
aaauauauguauguaaaaa

SEQ ID NO: 2054094 - RNA, 20 nt, Human
aaauauauguauguaaaaau

SEQ ID NO: 2054095 - RNA, 23 nt, Human
aaauauauauguguguguauguu

SEQ ID NO: 2054096 - RNA, 17 nt, Human
aaauauauauguugauu

SEQ ID NO: 2054097 - RNA, 17 nt, Human
aaauauauucucuuugg

SEQ ID NO: 2054098 - RNA, 14 nt, Human
guacaauauuuaaa

SEQ ID NO: 2054099 - RNA, 18 nt, Human
guacaauauuuaaaauuu

SEQ ID NO: 2054100 - RNA, 14 nt, Human
guacaauauuuuaa

SEQ ID NO: 2054101 - RNA, 15 nt, Human
guacaauauuuuaag

SEQ ID NO: 2054102 - RNA, 16 nt, Human
guacaauauuuuaagc

SEQ ID NO: 2054103 - RNA, 17 nt, Human
guacaauauuuuaagca

SEQ ID NO: 2054104 - RNA, 18 nt, Human
guacaauauuuuaagcau

SEQ ID NO: 2054105 - RNA, 19 nt, Human
guacaauauuuuaagcauu

SEQ ID NO: 2054106 - RNA, 20 nt, Human
guacaauauuuuaagcauua

SEQ ID NO: 2054107 - RNA, 22 nt, Human
guacaauauuuuaagcauuacu

SEQ ID NO: 2054108 - RNA, 24 nt, Human
guacaauauuuuaagcauuacucu

SEQ ID NO: 2054109 - RNA, 16 nt, Human
guacacacacauacac

SEQ ID NO: 2054110 - RNA, 14 nt, Human
guacacacuuuauu

SEQ ID NO: 2054111 - RNA, 15 nt, Human
guacacacuuuauuu

SEQ ID NO: 2054112 - RNA, 15 nt, Human
guacacagacuauug

SEQ ID NO: 2054113 - RNA, 17 nt, Human
aaauaccagugugguuu

SEQ ID NO: 2054114 - RNA, 13 nt, Human
aaauauagaauuu

SEQ ID NO: 2054115 - RNA, 16 nt, Human
aaauauagaauuuuua

SEQ ID NO: 2054116 - RNA, 21 nt, Human
aaauacgccagaacugcuuua

SEQ ID NO: 2054117 - RNA, 20 nt, Human
aaauauuccugcauuuguga

SEQ ID NO: 2054118 - RNA, 19 nt, Human
aaauauuaagaaagacuau

SEQ ID NO: 2054119 - RNA, 15 nt, Human
aaauauugaugaaaa

SEQ ID NO: 2054120 - RNA, 19 nt, Human
aaaucagccugcuccagcu

SEQ ID NO: 2054121 - RNA, 21 nt, Human
aaaucagccugcuccagcugu

SEQ ID NO: 2054122 - RNA, 23 nt, Human
aaaucagccugcuccagcuguuc

SEQ ID NO: 2054123 - RNA, 20 nt, Human
aaauauguuagcaaagaguu

SEQ ID NO: 2054124 - RNA, 16 nt, Human
aaauauguugaugaaa

SEQ ID NO: 2054125 - RNA, 19 nt, Human
aaauauguugaugaaaaau

SEQ ID NO: 2054126 - RNA, 19 nt, Human
aaauauguccauaucuaac

SEQ ID NO: 2054127 - RNA, 21 nt, Human
aaauauguccauaucuaacca

SEQ ID NO: 2054128 - RNA, 10 nt, Human
aaauaugcaa

SEQ ID NO: 2054129 - RNA, 12 nt, Human
aaauaugcaucu

SEQ ID NO: 2054130 - RNA, 12 nt, Human
aaauaucugaaa

SEQ ID NO: 2054131 - RNA, 14 nt, Human
aaauaucugaaaau

SEQ ID NO: 2054132 - RNA, 17 nt, Human
aaauaucugaaaaugua

SEQ ID NO: 2054133 - RNA, 18 nt, Human
aaauaucugaaaauguau

SEQ ID NO: 2054134 - RNA, 19 nt, Human
aaauaucugaaaauguaug

SEQ ID NO: 2054135 - RNA, 21 nt, Human
aaauaucugaaaauguaugug

SEQ ID NO: 2054136 - RNA, 22 nt, Human
aaauaucugaaaauguaugugu

SEQ ID NO: 2054137 - RNA, 23 nt, Human
aaauaucugaaaauguaugugua

SEQ ID NO: 2054138 - RNA, 19 nt, Human
aaauaugauauugcauaug

SEQ ID NO: 2054139 - RNA, 14 nt, Human
aaagcuagaaauga

SEQ ID NO: 2054140 - RNA, 16 nt, Human
aaagcuaggccuggcc

SEQ ID NO: 2054141 - RNA, 14 nt, Human
aaagcuaggccugg

SEQ ID NO: 2054142 - RNA, 19 nt, Human
aaagcagaauaguauuuuu

SEQ ID NO: 2054143 - RNA, 13 nt, Human
aaagcagcaucug

SEQ ID NO: 2054144 - RNA, 12 nt, Human
aaagcagaaaau

SEQ ID NO: 2054145 - RNA, 22 nt, Human
aaagcagaacaguuaagcagcc

SEQ ID NO: 2054146 - RNA, 22 nt, Human
aaagcaguagaaauaauaugca

SEQ ID NO: 2054147 - RNA, 17 nt, Human
aaagcaguaacugacaa

SEQ ID NO: 2054148 - RNA, 17 nt, Human
aaagcugacgaggcugg

SEQ ID NO: 2054149 - RNA, 19 nt, Human
aaagcugacgaggcugggc

SEQ ID NO: 2054150 - RNA, 15 nt, Human
aaagcugaagccgcc

SEQ ID NO: 2054151 - RNA, 19 nt, Human
aaagcugauuacugucaau

SEQ ID NO: 2054152 - RNA, 22 nt, Human
aaagcugauuacugucaauaaa

SEQ ID NO: 2054153 - RNA, 18 nt, Human
aaagcagucacuuuuccu

SEQ ID NO: 2054154 - RNA, 23 nt, Human
aaagcuguggccagcuuguuauu

SEQ ID NO: 2054155 - RNA, 14 nt, Human
gguggacccaggga

SEQ ID NO: 2054156 - RNA, 14 nt, Human
gguggcaccagcag

SEQ ID NO: 2054157 - RNA, 20 nt, Human
gguggcaccagcagccugga

SEQ ID NO: 2054158 - RNA, 21 nt, Human
aaagcagaggcuggccucaga

SEQ ID NO: 2054159 - RNA, 23 nt, Human
aaagcagaggcuggccucagacu

SEQ ID NO: 2054160 - RNA, 18 nt, Human
gguggcagcccuguaggg

SEQ ID NO: 2054161 - RNA, 15 nt, Human
gguggcagcccugua

SEQ ID NO: 2054162 - RNA, 14 nt, Human
aaacuuuauuuuau

SEQ ID NO: 2054163 - RNA, 15 nt, Human
aaacuuuauuuuaua

SEQ ID NO: 2054164 - RNA, 19 nt, Human
aaacuuuauuuuauauaau

SEQ ID NO: 2054165 - RNA, 21 nt, Human
aaacuuuauuuuauauaauaa

SEQ ID NO: 2054166 - RNA, 14 nt, Human
ggugcugcuucccu

SEQ ID NO: 2054167 - RNA, 21 nt, Human
ggugcugcuucccucugccug

SEQ ID NO: 2054168 - RNA, 16 nt, Human
ggugcuggauauuuuc

SEQ ID NO: 2054169 - RNA, 14 nt, Human
gguggacaguccug

SEQ ID NO: 2054170 - RNA, 15 nt, Human
gguggacaguccugg

SEQ ID NO: 2054171 - RNA, 16 nt, Human
gguggacaguccuggg

SEQ ID NO: 2054172 - RNA, 17 nt, Human
gguggacaguccuggga

SEQ ID NO: 2054173 - RNA, 18 nt, Human
gguggacaguccugggag

SEQ ID NO: 2054174 - RNA, 12 nt, Human
gguggacccagg

SEQ ID NO: 2054175 - RNA, 20 nt, Human
aaagggcccagagagggugg

SEQ ID NO: 2054176 - RNA, 20 nt, Human
aaagggcagggcaucuccug

SEQ ID NO: 2054177 - RNA, 18 nt, Human
aaaggggcagaaaaacuc

SEQ ID NO: 2054178 - RNA, 13 nt, Human
aaaggggggaggg

SEQ ID NO: 2054179 - RNA, 14 nt, Human
aaaggggggagggg

SEQ ID NO: 2054180 - RNA, 18 nt, Human
aaaggggggagggggagg

SEQ ID NO: 2054181 - RNA, 18 nt, Human
aaagguuauuuucuccug

SEQ ID NO: 2054182 - RNA, 17 nt, Human
aaagguucacuaaagca

SEQ ID NO: 2054183 - RNA, 18 nt, Human
aaaggggucccauagagg

SEQ ID NO: 2054184 - RNA, 17 nt, Human
aaaggugguaugugugu

SEQ ID NO: 2054185 - RNA, 19 nt, Human
aaaggugguaugugugugu

SEQ ID NO: 2054186 - RNA, 21 nt, Human
aaaggugguauguguguguau

SEQ ID NO: 2054187 - RNA, 18 nt, Human
aaagguggugaggcaaua

SEQ ID NO: 2054188 - RNA, 22 nt, Human
aaaggugguauguguguguaug

SEQ ID NO: 2054189 - RNA, 21 nt, Human
aaaggugccugugaggcaggg

SEQ ID NO: 2054190 - RNA, 19 nt, Human
aaagguggacuggaagggg

SEQ ID NO: 2054191 - RNA, 12 nt, Human
gguggcuggguu

SEQ ID NO: 2054192 - RNA, 18 nt, Human
gguggcuggguuggaggg

SEQ ID NO: 2054193 - RNA, 18 nt, Human
ggugggcugagcccuggc

SEQ ID NO: 2054194 - RNA, 15 nt, Human
ggugggcugagcccu

SEQ ID NO: 2054195 - RNA, 17 nt, Human
ggugggcugagcccugg

SEQ ID NO: 2054196 - RNA, 15 nt, Human
ggugggagagcccag

SEQ ID NO: 2054197 - RNA, 16 nt, Human
ggugggagagcccagc

SEQ ID NO: 2054198 - RNA, 13 nt, Human
ggugggcugagcc

SEQ ID NO: 2054199 - RNA, 20 nt, Human
ggugggaggaucucuugagc

SEQ ID NO: 2054200 - RNA, 16 nt, Human
aaagugguauagaaau

SEQ ID NO: 2054201 - RNA, 17 nt, Human
aaagugguauagaaaug

SEQ ID NO: 2054202 - RNA, 20 nt, Human
aaagugguauagaaaugcug

SEQ ID NO: 2054203 - RNA, 21 nt, Human
aaaguauccugcuucugauau

SEQ ID NO: 2054204 - RNA, 15 nt, Human
aaaguaucgggggcu

SEQ ID NO: 2054205 - RNA, 19 nt, Human
aaaguaucgggggcugggg

SEQ ID NO: 2054206 - RNA, 20 nt, Human
aaaguaucgggggcuggggc

SEQ ID NO: 2054207 - RNA, 14 nt, Human
aaaguagauuaaga

SEQ ID NO: 2054208 - RNA, 20 nt, Human
aaaguagaagucuuagaugu

SEQ ID NO: 2054209 - RNA, 22 nt, Human
aaaguagaagucuuagauguau

SEQ ID NO: 2054210 - RNA, 22 nt, Human
aaaguaauuucuucucaaaggg

SEQ ID NO: 2054211 - RNA, 13 nt, Human
gguuuguauauug

SEQ ID NO: 2054212 - RNA, 19 nt, Human
gguuuggggagcagagaca

SEQ ID NO: 2054213 - RNA, 19 nt, Human
gguuuguguuugaguuuua

SEQ ID NO: 2054214 - RNA, 18 nt, Human
gguuuuaauugaaggaaa

SEQ ID NO: 2054215 - RNA, 19 nt, Human
aaaguaagcccuugaagau

SEQ ID NO: 2054216 - RNA, 19 nt, Human
aaaguaaguaccacucagg

SEQ ID NO: 2054217 - RNA, 15 nt, Human
gguuuuauauuuuua

SEQ ID NO: 2054218 - RNA, 12 nt, Human
gguuucuagcau

SEQ ID NO: 2054219 - RNA, 14 nt, Human
gguucccccagccc

SEQ ID NO: 2054220 - RNA, 15 nt, Human
gguucccccagcccu

SEQ ID NO: 2054221 - RNA, 13 nt, Human
gguucccccagcc

SEQ ID NO: 2054222 - RNA, 16 nt, Human
gguucccccagcccug

SEQ ID NO: 2054223 - RNA, 21 nt, Human
gguuccggaauccuguccuca

SEQ ID NO: 2054224 - RNA, 23 nt, Human
gguucguggaaagggugcugcuu

SEQ ID NO: 2054225 - RNA, 18 nt, Human
gguucuacaaucuauuua

SEQ ID NO: 2054226 - RNA, 13 nt, Human
gguguuuauacag

SEQ ID NO: 2054227 - RNA, 11 nt, Human
gguguggggga

SEQ ID NO: 2054228 - RNA, 13 nt, Human
ggugugggggaag

SEQ ID NO: 2054229 - RNA, 17 nt, Human
gguguugacaugugcuu

SEQ ID NO: 2054230 - RNA, 13 nt, Human
gguguguuuuugg

SEQ ID NO: 2054231 - RNA, 14 nt, Human
gguguguuuuuggg

SEQ ID NO: 2054232 - RNA, 22 nt, Human
gguguguuuuugggaugucuua

SEQ ID NO: 2054233 - RNA, 14 nt, Human
gguguguguagcca

SEQ ID NO: 2054234 - RNA, 13 nt, Human
gguggggcugcuc

SEQ ID NO: 2054235 - RNA, 17 nt, Human
gguggggcugcuccucc

SEQ ID NO: 2054236 - RNA, 18 nt, Human
gguggggcugcuccucca

SEQ ID NO: 2054237 - RNA, 22 nt, Human
gguggggcugcuccuccagggc

SEQ ID NO: 2054238 - RNA, 13 nt, Human
ggugggggccucg

SEQ ID NO: 2054239 - RNA, 14 nt, Human
gguguggagaagcg

SEQ ID NO: 2054240 - RNA, 23 nt, Human
gguguggagaagcggcuggcagc

SEQ ID NO: 2054241 - RNA, 12 nt, Human
gguguggagaag

SEQ ID NO: 2054242 - RNA, 23 nt, Human
aagauggcacuuauaaccaaagc

SEQ ID NO: 2054243 - RNA, 15 nt, Human
aagauggaugugcuu

SEQ ID NO: 2054244 - RNA, 14 nt, Human
aagauggauucuca

SEQ ID NO: 2054245 - RNA, 16 nt, Human
aagauggauucucaga

SEQ ID NO: 2054246 - RNA, 17 nt, Human
aagauggauucucagau

SEQ ID NO: 2054247 - RNA, 21 nt, Human
aagauggauucucagauauuu

SEQ ID NO: 2054248 - RNA, 21 nt, Human
aagauggauugguguaaaagg

SEQ ID NO: 2054249 - RNA, 16 nt, Human
aagauggcugugccuc

SEQ ID NO: 2054250 - RNA, 17 nt, Human
aagauggcugacuuugc

SEQ ID NO: 2054251 - RNA, 23 nt, Human
aagaucaaaagguuaauaaagua

SEQ ID NO: 2054252 - RNA, 20 nt, Human
aagaucaaaagguuaauaaa

SEQ ID NO: 2054253 - RNA, 14 nt, Human
aagcaaaauauuau

SEQ ID NO: 2054254 - RNA, 13 nt, Human
aagcaaaauauua

SEQ ID NO: 2054255 - RNA, 18 nt, Human
aagcaaaugugaccugug

SEQ ID NO: 2054256 - RNA, 18 nt, Human
aagcaaaaacgaaagcug

SEQ ID NO: 2054257 - RNA, 20 nt, Human
aagcaaaaacgaaagcuggg

SEQ ID NO: 2054258 - RNA, 14 nt, Human
aagcaaauguuaca

SEQ ID NO: 2054259 - RNA, 19 nt, Human
gugucagguggggcagcuu

SEQ ID NO: 2054260 - RNA, 23 nt, Human
gugucacuacucacagucucuuu

SEQ ID NO: 2054261 - RNA, 18 nt, Human
gugugaaagucagaugcc

SEQ ID NO: 2054262 - RNA, 23 nt, Human
gugugaaccaccacacccagccc

SEQ ID NO: 2054263 - RNA, 13 nt, Human
gugucuguauuua

SEQ ID NO: 2054264 - RNA, 14 nt, Human
gugucuguauuuau

SEQ ID NO: 2054265 - RNA, 18 nt, Human
gugucagguggggcagcu

SEQ ID NO: 2054266 - RNA, 14 nt, Human
gugucagguggggc

SEQ ID NO: 2054267 - RNA, 22 nt, Human
gugucaccugaagacucauucu

SEQ ID NO: 2054268 - RNA, 15 nt, Human
aagagguauaaagcu

SEQ ID NO: 2054269 - RNA, 18 nt, Human
guguaugugcgugugugc

SEQ ID NO: 2054270 - RNA, 22 nt, Human
guguauguuugcacacuugugu

SEQ ID NO: 2054271 - RNA, 18 nt, Human
guguauguuugcacacuu

SEQ ID NO: 2054272 - RNA, 14 nt, Human
gugucaccugaaga

SEQ ID NO: 2054273 - RNA, 12 nt, Human
guguauuguucc

SEQ ID NO: 2054274 - RNA, 19 nt, Human
guguauucuaguuuuguca

SEQ ID NO: 2054275 - RNA, 14 nt, Human
gugcugcugcugcu

SEQ ID NO: 2054276 - RNA, 15 nt, Human
gugcugcugcugcug

SEQ ID NO: 2054277 - RNA, 19 nt, Human
gugguucuacaaucuauuu

SEQ ID NO: 2054278 - RNA, 18 nt, Human
gugguuuaguguaaaaau

SEQ ID NO: 2054279 - RNA, 19 nt, Human
gugguuuaguguaaaaaug

SEQ ID NO: 2054280 - RNA, 20 nt, Human
gugguuuaguguaaaaauga

SEQ ID NO: 2054281 - RNA, 19 nt, Human
gugguuuucuuuugccaug

SEQ ID NO: 2054282 - RNA, 12 nt, Human
guguaaaaauga

SEQ ID NO: 2054283 - RNA, 15 nt, Human
guguaaaaaugagaa

SEQ ID NO: 2054284 - RNA, 16 nt, Human
guguaaaaaugagaac

SEQ ID NO: 2054285 - RNA, 20 nt, Human
guguaaaaaugagaacaugu

SEQ ID NO: 2054286 - RNA, 16 nt, Human
gugguuuuugagccau

SEQ ID NO: 2054287 - RNA, 12 nt, Human
guguaacagcug

SEQ ID NO: 2054288 - RNA, 15 nt, Human
guguaacagcugagg

SEQ ID NO: 2054289 - RNA, 21 nt, Human
guguaacagcugaggucucuu

SEQ ID NO: 2054290 - RNA, 20 nt, Human
guguaacugcccaaagcagc

SEQ ID NO: 2054291 - RNA, 18 nt, Human
guguaacuggcaguuuuc

SEQ ID NO: 2054292 - RNA, 17 nt, Human
guguaacaggucuccuc

SEQ ID NO: 2054293 - RNA, 19 nt, Human
guguaacaggucuccucuu

SEQ ID NO: 2054294 - RNA, 15 nt, Human
guguaacauaugcaa

SEQ ID NO: 2054295 - RNA, 21 nt, Human
guguaaccugagauggcccuc

SEQ ID NO: 2054296 - RNA, 23 nt, Human
guguaaccugagauggcccucug

SEQ ID NO: 2054297 - RNA, 17 nt, Human
aagagggagaagcauga

SEQ ID NO: 2054298 - RNA, 18 nt, Human
aagagggagaagcaugaa

SEQ ID NO: 2054299 - RNA, 15 nt, Human
aagaggccaaugccc

SEQ ID NO: 2054300 - RNA, 14 nt, Human
aagaggcagggucu

SEQ ID NO: 2054301 - RNA, 19 nt, Human
guguaacugcccaaagcag

SEQ ID NO: 2054302 - RNA, 11 nt, Human
aagaggcaggg

SEQ ID NO: 2054303 - RNA, 13 nt, Human
aagauaggcucug

SEQ ID NO: 2054304 - RNA, 14 nt, Human
aagauaggcucugc

SEQ ID NO: 2054305 - RNA, 15 nt, Human
aagauaggcucugca

SEQ ID NO: 2054306 - RNA, 16 nt, Human
aagauaggcucugcac

SEQ ID NO: 2054307 - RNA, 17 nt, Human
aagauaggcucugcaca

SEQ ID NO: 2054308 - RNA, 18 nt, Human
aagauaggcucugcacag

SEQ ID NO: 2054309 - RNA, 22 nt, Human
aagagggucugaggaauccaga

SEQ ID NO: 2054310 - RNA, 13 nt, Human
guguuucuuuagu

SEQ ID NO: 2054311 - RNA, 16 nt, Human
guguuucuuuaguuuu

SEQ ID NO: 2054312 - RNA, 17 nt, Human
aagcacagaaaacuaga

SEQ ID NO: 2054313 - RNA, 19 nt, Human
aagcacagaaggaggagga

SEQ ID NO: 2054314 - RNA, 15 nt, Human
aagcacagugccugc

SEQ ID NO: 2054315 - RNA, 17 nt, Human
aagcaccuccugccucg

SEQ ID NO: 2054316 - RNA, 14 nt, Human
aagcaccccaugcc

SEQ ID NO: 2054317 - RNA, 19 nt, Human
aagcaccgccuccaaaugc

SEQ ID NO: 2054318 - RNA, 12 nt, Human
aagcacccuuga

SEQ ID NO: 2054319 - RNA, 12 nt, Human
aagcaccugccg

SEQ ID NO: 2054320 - RNA, 13 nt, Human
aagcaccugccga

SEQ ID NO: 2054321 - RNA, 17 nt, Human
aagcaccugccgaccuc

SEQ ID NO: 2054322 - RNA, 20 nt, Human
aagcaccugccgaccucguc

SEQ ID NO: 2054323 - RNA, 21 nt, Human
aagcacgugguaaaacacuug

SEQ ID NO: 2054324 - RNA, 21 nt, Human
aagcacuccucccugauguac

SEQ ID NO: 2054325 - RNA, 23 nt, Human
aagcacuccucccugauguacag

SEQ ID NO: 2054326 - RNA, 12 nt, Human
aagcacucgugu

SEQ ID NO: 2054327 - RNA, 16 nt, Human
aagcaccuccugccuc

SEQ ID NO: 2054328 - RNA, 15 nt, Human
aagcaccuccugccu

SEQ ID NO: 2054329 - RNA, 14 nt, Human
aagcaccuccugcc

SEQ ID NO: 2054330 - RNA, 13 nt, Human
aagcaccuccugc

SEQ ID NO: 2054331 - RNA, 16 nt, Human
aagcacaucugcauuu

SEQ ID NO: 2054332 - RNA, 20 nt, Human
aagccaaagcuaggccuggc

SEQ ID NO: 2054333 - RNA, 14 nt, Human
aagccaagcagcca

SEQ ID NO: 2054334 - RNA, 16 nt, Human
aagccaagcagccaag

SEQ ID NO: 2054335 - RNA, 17 nt, Human
aagccaagcagccaagc

SEQ ID NO: 2054336 - RNA, 18 nt, Human
aagccaaagcuaggccug

SEQ ID NO: 2054337 - RNA, 17 nt, Human
aagccaaagcuaggccu

SEQ ID NO: 2054338 - RNA, 13 nt, Human
aagccaagggccu

SEQ ID NO: 2054339 - RNA, 16 nt, Human
aagccaagggccucuu

SEQ ID NO: 2054340 - RNA, 22 nt, Human
aagccaagucagcuuugccuuc

SEQ ID NO: 2054341 - RNA, 16 nt, Human
aagcauggagaacagu

SEQ ID NO: 2054342 - RNA, 22 nt, Human
aagcauuguuugcuuauuguuc

SEQ ID NO: 2054343 - RNA, 23 nt, Human
aagcauuguuugcuuauuguucc

SEQ ID NO: 2054344 - RNA, 11 nt, Human
aagcauuguuu

SEQ ID NO: 2054345 - RNA, 14 nt, Human
aagcauuguuugcu

SEQ ID NO: 2054346 - RNA, 20 nt, Human
aagcauuguuugcuuauugu

SEQ ID NO: 2054347 - RNA, 21 nt, Human
aagcauuguuugcuuauuguu

SEQ ID NO: 2054348 - RNA, 16 nt, Human
aagcauuuacuuugaa

SEQ ID NO: 2054349 - RNA, 16 nt, Human
aagccaaagacuuagu

SEQ ID NO: 2054350 - RNA, 17 nt, Human
aagcauauuguuauuau

SEQ ID NO: 2054351 - RNA, 23 nt, Human
aagcauauuguuauuauauaauu

SEQ ID NO: 2054352 - RNA, 14 nt, Human
aagcaucaaacucu

SEQ ID NO: 2054353 - RNA, 14 nt, Human
aagcaucacaaaug

SEQ ID NO: 2054354 - RNA, 15 nt, Human
aagcaucacaaauga

SEQ ID NO: 2054355 - RNA, 21 nt, Human
aagcaucacaaaugauauuaa

SEQ ID NO: 2054356 - RNA, 15 nt, Human
aagcaucaccucagg

SEQ ID NO: 2054357 - RNA, 16 nt, Human
aagcaucaccucaggc

SEQ ID NO: 2054358 - RNA, 18 nt, Human
aagcaucaccucaggcca

SEQ ID NO: 2054359 - RNA, 19 nt, Human
aagcaucaccucaggccag

SEQ ID NO: 2054360 - RNA, 23 nt, Human
aagcaucaccucaggccaggugc

SEQ ID NO: 2054361 - RNA, 15 nt, Human
aagcaucaaacucuu

SEQ ID NO: 2054362 - RNA, 13 nt, Human
aagcaugaaaaag

SEQ ID NO: 2054363 - RNA, 16 nt, Human
aagcauguaggagaau

SEQ ID NO: 2054364 - RNA, 17 nt, Human
aagcaugucucaauagu

SEQ ID NO: 2054365 - RNA, 13 nt, Human
aagcauguggcau

SEQ ID NO: 2054366 - RNA, 19 nt, Human
aagcauguggcauguucau

SEQ ID NO: 2054367 - RNA, 12 nt, Human
guuaauaaaagu

SEQ ID NO: 2054368 - RNA, 16 nt, Human
guuaauauucuuucaa

SEQ ID NO: 2054369 - RNA, 17 nt, Human
guuaauauucuuucaau

SEQ ID NO: 2054370 - RNA, 12 nt, Human
aagcccagcucc

SEQ ID NO: 2054371 - RNA, 13 nt, Human
aagcccagcucca

SEQ ID NO: 2054372 - RNA, 14 nt, Human
aagcccagcuccag

SEQ ID NO: 2054373 - RNA, 15 nt, Human
aagcccagcuccagg

SEQ ID NO: 2054374 - RNA, 21 nt, Human
aagcccagcuccagggccaga

SEQ ID NO: 2054375 - RNA, 16 nt, Human
aagcccaaccuccuga

SEQ ID NO: 2054376 - RNA, 18 nt, Human
aagcccaauauuauaauu

SEQ ID NO: 2054377 - RNA, 17 nt, Human
aagcccaaccuccugac

SEQ ID NO: 2054378 - RNA, 22 nt, Human
aagcccaaccuccugaccuguc

SEQ ID NO: 2054379 - RNA, 20 nt, Human
aagccauucuaaggaaauua

SEQ ID NO: 2054380 - RNA, 17 nt, Human
guuacugaucaugcauu

SEQ ID NO: 2054381 - RNA, 18 nt, Human
guuacugaucaugcauug

SEQ ID NO: 2054382 - RNA, 19 nt, Human
guuacugaucaugcauugu

SEQ ID NO: 2054383 - RNA, 17 nt, Human
guuaaucaacugaaagu

SEQ ID NO: 2054384 - RNA, 13 nt, Human
guuagagaugccu

SEQ ID NO: 2054385 - RNA, 18 nt, Human
guuagagaugccucccug

SEQ ID NO: 2054386 - RNA, 16 nt, Human
guuacuguuauagagg

SEQ ID NO: 2054387 - RNA, 10 nt, Human
guuauuuaaa

SEQ ID NO: 2054388 - RNA, 22 nt, Human
guuagaguccaacguggggcag

SEQ ID NO: 2054389 - RNA, 16 nt, Human
aagccucccacgacug

SEQ ID NO: 2054390 - RNA, 19 nt, Human
aagccuccauuuaguucuu

SEQ ID NO: 2054391 - RNA, 15 nt, Human
aagccuccuccagcc

SEQ ID NO: 2054392 - RNA, 20 nt, Human
aagccuccauuuaguucuuu

SEQ ID NO: 2054393 - RNA, 22 nt, Human
aagccuccauuuaguucuuugu

SEQ ID NO: 2054394 - RNA, 17 nt, Human
aagccuguaaucccagc

SEQ ID NO: 2054395 - RNA, 15 nt, Human
aagcuaggugcuaau

SEQ ID NO: 2054396 - RNA, 22 nt, Human
aagcuaggguggcccuugcagu

SEQ ID NO: 2054397 - RNA, 15 nt, Human
aagcuaggguggccc

SEQ ID NO: 2054398 - RNA, 19 nt, Human
aagcuaggguggcccuugc

SEQ ID NO: 2054399 - RNA, 16 nt, Human
aagccuucauugccuu

SEQ ID NO: 2054400 - RNA, 16 nt, Human
aagccuuccacacuca

SEQ ID NO: 2054401 - RNA, 23 nt, Human
guuauuuucuuugaaauuguuua

SEQ ID NO: 2054402 - RNA, 15 nt, Human
guucagcugcuucuc

SEQ ID NO: 2054403 - RNA, 13 nt, Human
guuauuuucuccu

SEQ ID NO: 2054404 - RNA, 23 nt, Human
guucagcuuguaaauagcucagg

SEQ ID NO: 2054405 - RNA, 15 nt, Human
guucaggagucccaa

SEQ ID NO: 2054406 - RNA, 18 nt, Human
guucaggagucccaagga

SEQ ID NO: 2054407 - RNA, 22 nt, Human
guucaggguuggccccugcccg

SEQ ID NO: 2054408 - RNA, 21 nt, Human
guucaggguuggccccugccc

SEQ ID NO: 2054409 - RNA, 20 nt, Human
guucaggagucccaaggaaa

SEQ ID NO: 2054410 - RNA, 21 nt, Human
guucaggagucccaaggaaag

SEQ ID NO: 2054411 - RNA, 20 nt, Human
guucaggguuggccccugcc

SEQ ID NO: 2054412 - RNA, 21 nt, Human
aagccgugauuuucauugcug

SEQ ID NO: 2054413 - RNA, 14 nt, Human
aagccguggcuucc

SEQ ID NO: 2054414 - RNA, 13 nt, Human
aagccguggcuuc

SEQ ID NO: 2054415 - RNA, 15 nt, Human
aagccguggcuuccc

SEQ ID NO: 2054416 - RNA, 14 nt, Human
aagccgugcccugc

SEQ ID NO: 2054417 - RNA, 18 nt, Human
guucagguaacaggcaga

SEQ ID NO: 2054418 - RNA, 17 nt, Human
guucagguaacaggcag

SEQ ID NO: 2054419 - RNA, 14 nt, Human
guucaguaccacau

SEQ ID NO: 2054420 - RNA, 19 nt, Human
guucaggggacucagcccu

SEQ ID NO: 2054421 - RNA, 13 nt, Human
guucagguagcug

SEQ ID NO: 2054422 - RNA, 15 nt, Human
guucaggggacucag

SEQ ID NO: 2054423 - RNA, 18 nt, Human
guucaggggacucagccc

SEQ ID NO: 2054424 - RNA, 22 nt, Human
guucaguaacagggccuugcua

SEQ ID NO: 2054425 - RNA, 13 nt, Human
guucagucuuuca

SEQ ID NO: 2054426 - RNA, 16 nt, Human
guucuuaagacgugau

SEQ ID NO: 2054427 - RNA, 15 nt, Human
guucucucuauggua

SEQ ID NO: 2054428 - RNA, 18 nt, Human
guucucucuaugguaaag

SEQ ID NO: 2054429 - RNA, 23 nt, Human
guucucucuaugguaaagauauu

SEQ ID NO: 2054430 - RNA, 13 nt, Human
guucucucugccu

SEQ ID NO: 2054431 - RNA, 17 nt, Human
guucucucugccuguga

SEQ ID NO: 2054432 - RNA, 22 nt, Human
guucucucugccugugagccag

SEQ ID NO: 2054433 - RNA, 16 nt, Human
guucuguuuuguuuug

SEQ ID NO: 2054434 - RNA, 23 nt, Human
guucuguuuuguuuuguuuuuua

SEQ ID NO: 2054435 - RNA, 14 nt, Human
guucucugaggaca

SEQ ID NO: 2054436 - RNA, 12 nt, Human
guucucugagga

SEQ ID NO: 2054437 - RNA, 15 nt, Human
guucucucuucucca

SEQ ID NO: 2054438 - RNA, 19 nt, Human
guucuucuaccacccacca

SEQ ID NO: 2054439 - RNA, 14 nt, Human
guucuucgaggugg

SEQ ID NO: 2054440 - RNA, 19 nt, Human
guucuugccacugcacucc

SEQ ID NO: 2054441 - RNA, 22 nt, Human
guugaccuaagauuuauuuugu

SEQ ID NO: 2054442 - RNA, 23 nt, Human
guugauagcaagugaauuuuucu

SEQ ID NO: 2054443 - RNA, 19 nt, Human
guugacuugacagaacacu

SEQ ID NO: 2054444 - RNA, 20 nt, Human
guugacuugacagaacacug

SEQ ID NO: 2054445 - RNA, 12 nt, Human
guugagaaauga

SEQ ID NO: 2054446 - RNA, 14 nt, Human
guugacuuucaggu

SEQ ID NO: 2054447 - RNA, 22 nt, Human
guugauagcaagugaauuuuuc

SEQ ID NO: 2054448 - RNA, 17 nt, Human
aagcucugcuccucucc

SEQ ID NO: 2054449 - RNA, 17 nt, Human
aagcucagacugguuga

SEQ ID NO: 2054450 - RNA, 13 nt, Human
aagcucagcccac

SEQ ID NO: 2054451 - RNA, 14 nt, Human
aagcucagcccacc

SEQ ID NO: 2054452 - RNA, 17 nt, Human
aagcucuugaagacacu

SEQ ID NO: 2054453 - RNA, 21 nt, Human
aagcucuggugacaccagccu

SEQ ID NO: 2054454 - RNA, 20 nt, Human
aagcucuggugacaccagcc

SEQ ID NO: 2054455 - RNA, 20 nt, Human
aagcucuugaagacacugaa

SEQ ID NO: 2054456 - RNA, 19 nt, Human
aagcucuugaagacacuga

SEQ ID NO: 2054457 - RNA, 19 nt, Human
aagcucacaguuccucgcc

SEQ ID NO: 2054458 - RNA, 20 nt, Human
aagcucacaguuccucgccc

SEQ ID NO: 2054459 - RNA, 22 nt, Human
aagcucacaguuccucgcccug

SEQ ID NO: 2054460 - RNA, 23 nt, Human
aagcucacaguuccucgcccugg

SEQ ID NO: 2054461 - RNA, 14 nt, Human
aagcuuaguauaaa

SEQ ID NO: 2054462 - RNA, 23 nt, Human
aagcuuccuuuguuuuuuuuucc

SEQ ID NO: 2054463 - RNA, 22 nt, Human
aagcuucgaggcccagcgaccu

SEQ ID NO: 2054464 - RNA, 20 nt, Human
aagcuucuuaaaugagaagg

SEQ ID NO: 2054465 - RNA, 22 nt, Human
aagcuucuuaaaugagaaggaa

SEQ ID NO: 2054466 - RNA, 16 nt, Human
aagcuuccauuccaca

SEQ ID NO: 2054467 - RNA, 21 nt, Human
aagcuuggcuguagaaggaga

SEQ ID NO: 2054468 - RNA, 15 nt, Human
aagcuuaaaaaaaac

SEQ ID NO: 2054469 - RNA, 16 nt, Human
aagcuuaaaaaaaacu

SEQ ID NO: 2054470 - RNA, 16 nt, Human
aagcucuuugaaacaa

SEQ ID NO: 2054471 - RNA, 21 nt, Human
aagcucuugaagacacugaaa

SEQ ID NO: 2054472 - RNA, 15 nt, Human
guucccccagcccug

SEQ ID NO: 2054473 - RNA, 16 nt, Human
guucccccagcccugu

SEQ ID NO: 2054474 - RNA, 17 nt, Human
guucccccagcccugug

SEQ ID NO: 2054475 - RNA, 20 nt, Human
guucccccagcccuguggaa

SEQ ID NO: 2054476 - RNA, 13 nt, Human
guucccccagccc

SEQ ID NO: 2054477 - RNA, 14 nt, Human
guucccccagcccu

SEQ ID NO: 2054478 - RNA, 13 nt, Human
guucccuuugcuc

SEQ ID NO: 2054479 - RNA, 17 nt, Human
guucccuuugcuccacc

SEQ ID NO: 2054480 - RNA, 18 nt, Human
guucccuuugcuccaccc

SEQ ID NO: 2054481 - RNA, 20 nt, Human
guucccuuugcuccacccca

SEQ ID NO: 2054482 - RNA, 19 nt, Human
guuccggaauccuguccuc

SEQ ID NO: 2054483 - RNA, 22 nt, Human
guuccggaauccuguccucagc

SEQ ID NO: 2054484 - RNA, 17 nt, Human
guucccugaaaacccag

SEQ ID NO: 2054485 - RNA, 18 nt, Human
guucccugaaaacccaga

SEQ ID NO: 2054486 - RNA, 19 nt, Human
guucccugaaaacccagag

SEQ ID NO: 2054487 - RNA, 20 nt, Human
guucccugaaaacccagaga

SEQ ID NO: 2054488 - RNA, 21 nt, Human
guucccugaaaacccagagag

SEQ ID NO: 2054489 - RNA, 13 nt, Human
guucccuucuccu

SEQ ID NO: 2054490 - RNA, 12 nt, Human
guucccuuggcc

SEQ ID NO: 2054491 - RNA, 13 nt, Human
guucccuuggccu

SEQ ID NO: 2054492 - RNA, 14 nt, Human
guucccuuggccuc

SEQ ID NO: 2054493 - RNA, 15 nt, Human
guucccuuggccuca

SEQ ID NO: 2054494 - RNA, 16 nt, Human
guucccuuggccucag

SEQ ID NO: 2054495 - RNA, 14 nt, Human
aaguuacacauuuu

SEQ ID NO: 2054496 - RNA, 13 nt, Human
aaguuagcucagg

SEQ ID NO: 2054497 - RNA, 23 nt, Human
aaguuaagaauguucuuauguug

SEQ ID NO: 2054498 - RNA, 20 nt, Human
aaguuacaaauugcuugaaa

SEQ ID NO: 2054499 - RNA, 11 nt, Human
aaguuaagaau

SEQ ID NO: 2054500 - RNA, 13 nt, Human
aaguuaacagaga

SEQ ID NO: 2054501 - RNA, 13 nt, Human
aagugugugugcg

SEQ ID NO: 2054502 - RNA, 11 nt, Human
aagugugugug

SEQ ID NO: 2054503 - RNA, 17 nt, Human
aaguguguuuccuucag

SEQ ID NO: 2054504 - RNA, 21 nt, Human
aaguguguuuccuucagugca

SEQ ID NO: 2054505 - RNA, 14 nt, Human
aaguuagcucagga

SEQ ID NO: 2054506 - RNA, 15 nt, Human
aaguuagcucaggag

SEQ ID NO: 2054507 - RNA, 18 nt, Human
aaguuauaaaucaauguc

SEQ ID NO: 2054508 - RNA, 19 nt, Human
aaguuauaaaucaauguca

SEQ ID NO: 2054509 - RNA, 20 nt, Human
aaguuauaaaucaaugucac

SEQ ID NO: 2054510 - RNA, 14 nt, Human
aaguuauuuauuuu

SEQ ID NO: 2054511 - RNA, 14 nt, Human
aaguuauuaauauu

SEQ ID NO: 2054512 - RNA, 16 nt, Human
aaguuauauaaagaga

SEQ ID NO: 2054513 - RNA, 19 nt, Human
aaguuauauaaagagaaaa

SEQ ID NO: 2054514 - RNA, 20 nt, Human
aaguuauauaaagagaaaau

SEQ ID NO: 2054515 - RNA, 21 nt, Human
aaguuauauaaagagaaaauu

SEQ ID NO: 2054516 - RNA, 22 nt, Human
aaguuauauaaagagaaaauug

SEQ ID NO: 2054517 - RNA, 23 nt, Human
aaguuauauaaagagaaaauuga

SEQ ID NO: 2054518 - RNA, 15 nt, Human
aaguguccgagaacu

SEQ ID NO: 2054519 - RNA, 17 nt, Human
aaguguccgagaacuaa

SEQ ID NO: 2054520 - RNA, 19 nt, Human
aagugucucaguccaccug

SEQ ID NO: 2054521 - RNA, 14 nt, Human
aagugucugugugc

SEQ ID NO: 2054522 - RNA, 12 nt, Human
aagugccccugc

SEQ ID NO: 2054523 - RNA, 13 nt, Human
aagugccccugcu

SEQ ID NO: 2054524 - RNA, 21 nt, Human
aagugccagucuugugucugc

SEQ ID NO: 2054525 - RNA, 16 nt, Human
aagugcaugcucucug

SEQ ID NO: 2054526 - RNA, 21 nt, Human
aagugccacugcccgagcugg

SEQ ID NO: 2054527 - RNA, 22 nt, Human
aagugccacugcccgagcuggu

SEQ ID NO: 2054528 - RNA, 23 nt, Human
aagugccacugcccgagcuggug

SEQ ID NO: 2054529 - RNA, 12 nt, Human
aaguguguaugu

SEQ ID NO: 2054530 - RNA, 22 nt, Human
aaguguguaugugcgugugugc

SEQ ID NO: 2054531 - RNA, 13 nt, Human
aagugugguagag

SEQ ID NO: 2054532 - RNA, 13 nt, Human
aagugugagcaaa

SEQ ID NO: 2054533 - RNA, 11 nt, Human
aagugugagua

SEQ ID NO: 2054534 - RNA, 18 nt, Human
aagugugaguaagagcug

SEQ ID NO: 2054535 - RNA, 19 nt, Human
aagugugaguaagagcugg

SEQ ID NO: 2054536 - RNA, 20 nt, Human
aagugugaguaagagcuggu

SEQ ID NO: 2054537 - RNA, 21 nt, Human
aagugugaguaagagcuggug

SEQ ID NO: 2054538 - RNA, 20 nt, Human
aaguucccuacuuccuguga

SEQ ID NO: 2054539 - RNA, 14 nt, Human
aaguuccucuagug

SEQ ID NO: 2054540 - RNA, 17 nt, Human
aaguucccuacuuccug

SEQ ID NO: 2054541 - RNA, 14 nt, Human
aaguucccuacuuc

SEQ ID NO: 2054542 - RNA, 17 nt, Human
aaguuuccccaccagug

SEQ ID NO: 2054543 - RNA, 22 nt, Human
aaguuuccaagcaaauguuaca

SEQ ID NO: 2054544 - RNA, 24 nt, Human
aaguuuccaagcaaauguuacaua

SEQ ID NO: 2054545 - RNA, 20 nt, Human
aaguuccuuauguauauuua

SEQ ID NO: 2054546 - RNA, 13 nt, Human
aaguuauuucuug

SEQ ID NO: 2054547 - RNA, 15 nt, Human
aaguuauuucuuguu

SEQ ID NO: 2054548 - RNA, 19 nt, Human
aaguuauuucuuguuuguu

SEQ ID NO: 2054549 - RNA, 11 nt, Human
aaguucaagga

SEQ ID NO: 2054550 - RNA, 15 nt, Human
aaguucaaggaccaa

SEQ ID NO: 2054551 - RNA, 16 nt, Human
uaaaaugguguuuuca

SEQ ID NO: 2054552 - RNA, 20 nt, Human
aaguuugagaucagccuggg

SEQ ID NO: 2054553 - RNA, 15 nt, Human
uaaaauguauaaguu

SEQ ID NO: 2054554 - RNA, 16 nt, Human
uaaaauguauaaguug

SEQ ID NO: 2054555 - RNA, 12 nt, Human
uaaaauugcaug

SEQ ID NO: 2054556 - RNA, 13 nt, Human
uaaaauugcaugg

SEQ ID NO: 2054557 - RNA, 21 nt, Human
uaaaauugcauggguuuugua

SEQ ID NO: 2054558 - RNA, 22 nt, Human
uaaaauugcauggguuuuguag

SEQ ID NO: 2054559 - RNA, 13 nt, Human
uaaaauugaaagg

SEQ ID NO: 2054560 - RNA, 12 nt, Human
uaaaauucuaaa

SEQ ID NO: 2054561 - RNA, 13 nt, Human
uaaaauucuaaau

SEQ ID NO: 2054562 - RNA, 14 nt, Human
uaaaauucuaaaua

SEQ ID NO: 2054563 - RNA, 18 nt, Human
uaaaaugugauuuuucug

SEQ ID NO: 2054564 - RNA, 19 nt, Human
uaaaaugugauuuuucuga

SEQ ID NO: 2054565 - RNA, 21 nt, Human
aagugauucuccugccucagc

SEQ ID NO: 2054566 - RNA, 12 nt, Human
aagugcaggcug

SEQ ID NO: 2054567 - RNA, 13 nt, Human
aagugcaggcugg

SEQ ID NO: 2054568 - RNA, 17 nt, Human
aagugcaggcuggcacc

SEQ ID NO: 2054569 - RNA, 21 nt, Human
aagugcaggcuggcaccgccu

SEQ ID NO: 2054570 - RNA, 23 nt, Human
aagugauccucccaccucagccu

SEQ ID NO: 2054571 - RNA, 14 nt, Human
uaaaauaucauuca

SEQ ID NO: 2054572 - RNA, 15 nt, Human
uaaaauaucauucag

SEQ ID NO: 2054573 - RNA, 17 nt, Human
uaaaauaucauucagca

SEQ ID NO: 2054574 - RNA, 16 nt, Human
uaaaauaucauucagc

SEQ ID NO: 2054575 - RNA, 23 nt, Human
aagugaucaauaaaaugugauuu

SEQ ID NO: 2054576 - RNA, 20 nt, Human
aagugauccucccaccucag

SEQ ID NO: 2054577 - RNA, 19 nt, Human
aagugauccucccaccuca

SEQ ID NO: 2054578 - RNA, 13 nt, Human
aagugauccuccc

SEQ ID NO: 2054579 - RNA, 16 nt, Human
uaaaauauaauuguuu

SEQ ID NO: 2054580 - RNA, 22 nt, Human
uaaaauauaauuguuuuuuauc

SEQ ID NO: 2054581 - RNA, 19 nt, Human
uaaaauauauauguugauu

SEQ ID NO: 2054582 - RNA, 17 nt, Human
uaaaauauauuucagau

SEQ ID NO: 2054583 - RNA, 21 nt, Human
uaaaauagcaacacucuauau

SEQ ID NO: 2054584 - RNA, 23 nt, Human
uaaaauagccacuuaccuucaau

SEQ ID NO: 2054585 - RNA, 15 nt, Human
uaaaauagccacuua

SEQ ID NO: 2054586 - RNA, 21 nt, Human
uaaaauagccacuuaccuuca

SEQ ID NO: 2054587 - RNA, 20 nt, Human
uaaaaguacauguuaaacuu

SEQ ID NO: 2054588 - RNA, 13 nt, Human
uaaaagugaucaa

SEQ ID NO: 2054589 - RNA, 15 nt, Human
uaaaagugaucaaua

SEQ ID NO: 2054590 - RNA, 20 nt, Human
uaaaauaaccccgggcaaga

SEQ ID NO: 2054591 - RNA, 21 nt, Human
uaaaauaacuaguguugcuug

SEQ ID NO: 2054592 - RNA, 13 nt, Human
uaaaauaaauaaa

SEQ ID NO: 2054593 - RNA, 13 nt, Human
uaaaauaaaguau

SEQ ID NO: 2054594 - RNA, 17 nt, Human
uaaaauaaaguauauau

SEQ ID NO: 2054595 - RNA, 24 nt, Human
uaaaauaacuaguguugcuuggac

SEQ ID NO: 2054596 - RNA, 21 nt, Human
uaaaagaaagccucagagaau

SEQ ID NO: 2054597 - RNA, 17 nt, Human
uaaaagaaaugcacaau

SEQ ID NO: 2054598 - RNA, 20 nt, Human
uaaaagaaaugcacaauguc

SEQ ID NO: 2054599 - RNA, 21 nt, Human
uaaaagaaaugcacaaugucu

SEQ ID NO: 2054600 - RNA, 22 nt, Human
uaaaagaaaugcacaaugucuu

SEQ ID NO: 2054601 - RNA, 23 nt, Human
uaaaagaaaugcacaaugucuug

SEQ ID NO: 2054602 - RNA, 22 nt, Human
uaaaagaaagccucagagaauu

SEQ ID NO: 2054603 - RNA, 23 nt, Human
uaaaacuuuuuauauuuuauaca

SEQ ID NO: 2054604 - RNA, 13 nt, Human
uaaaacuuuuuau

SEQ ID NO: 2054605 - RNA, 16 nt, Human
uaaaacuuugcugcca

SEQ ID NO: 2054606 - RNA, 16 nt, Human
uaaaaaguauauguua

SEQ ID NO: 2054607 - RNA, 20 nt, Human
uaaaaagggcagggcaucuc

SEQ ID NO: 2054608 - RNA, 19 nt, Human
uaaaaaggcaccuauaaaa

SEQ ID NO: 2054609 - RNA, 12 nt, Human
uaaaaauacaaa

SEQ ID NO: 2054610 - RNA, 14 nt, Human
uaaaaauacaaaca

SEQ ID NO: 2054611 - RNA, 15 nt, Human
uaaaaauacaaacaa

SEQ ID NO: 2054612 - RNA, 16 nt, Human
uaaaaagucugcauua

SEQ ID NO: 2054613 - RNA, 23 nt, Human
uaaaaagucugcauuacauuccu

SEQ ID NO: 2054614 - RNA, 16 nt, Human
aagucagguccaauuu

SEQ ID NO: 2054615 - RNA, 15 nt, Human
aagucagguccaauu

SEQ ID NO: 2054616 - RNA, 18 nt, Human
aagucagcucuucuccau

SEQ ID NO: 2054617 - RNA, 19 nt, Human
aagucagcuuugccuucca

SEQ ID NO: 2054618 - RNA, 22 nt, Human
uaaaaaugagguacucuccugg

SEQ ID NO: 2054619 - RNA, 13 nt, Human
uaaaaaugagaac

SEQ ID NO: 2054620 - RNA, 14 nt, Human
uaaaaaugagaaca

SEQ ID NO: 2054621 - RNA, 18 nt, Human
uaaaaaugagaacauguu

SEQ ID NO: 2054622 - RNA, 15 nt, Human
uaaaaaugagguacu

SEQ ID NO: 2054623 - RNA, 13 nt, Human
uaaaacccaagug

SEQ ID NO: 2054624 - RNA, 16 nt, Human
uaaaacuggcaucuga

SEQ ID NO: 2054625 - RNA, 19 nt, Human
uaaaacuggcaucugacac

SEQ ID NO: 2054626 - RNA, 13 nt, Human
uaaaacugucccu

SEQ ID NO: 2054627 - RNA, 14 nt, Human
uaaaacuuugcugc

SEQ ID NO: 2054628 - RNA, 15 nt, Human
uaaaacuuugcugcc

SEQ ID NO: 2054629 - RNA, 16 nt, Human
aagucagacugcuggg

SEQ ID NO: 2054630 - RNA, 17 nt, Human
aagucagacugcuggga

SEQ ID NO: 2054631 - RNA, 20 nt, Human
aagucagacugcugggacug

SEQ ID NO: 2054632 - RNA, 16 nt, Human
aagucaaaaggugccu

SEQ ID NO: 2054633 - RNA, 19 nt, Human
aagucaaaaggugccugug

SEQ ID NO: 2054634 - RNA, 23 nt, Human
aagucaaagacauucugacaucu

SEQ ID NO: 2054635 - RNA, 22 nt, Human
aagucacugcacagugcaucuc

SEQ ID NO: 2054636 - RNA, 22 nt, Human
aagucaaaguaaaacuugcugc

SEQ ID NO: 2054637 - RNA, 14 nt, Human
aagucaaaguaaaa

SEQ ID NO: 2054638 - RNA, 21 nt, Human
aaguauucuuauuuaaugaaa

SEQ ID NO: 2054639 - RNA, 23 nt, Human
aaguauucuuauuuaaugaaaga

SEQ ID NO: 2054640 - RNA, 20 nt, Human
aaguacuucuccacccugcu

SEQ ID NO: 2054641 - RNA, 19 nt, Human
aaguacuucuccacccugc

SEQ ID NO: 2054642 - RNA, 18 nt, Human
aaguacuucuccacccug

SEQ ID NO: 2054643 - RNA, 19 nt, Human
aaguacuaagcgcuagagg

SEQ ID NO: 2054644 - RNA, 16 nt, Human
aaguacuguguacaga

SEQ ID NO: 2054645 - RNA, 16 nt, Human
aaguaauuucuucuca

SEQ ID NO: 2054646 - RNA, 22 nt, Human
aaguaauuucuucucaaagggu

SEQ ID NO: 2054647 - RNA, 16 nt, Human
aaguaauugugaaaaa

SEQ ID NO: 2054648 - RNA, 17 nt, Human
guuuuaucucugucuac

SEQ ID NO: 2054649 - RNA, 19 nt, Human
guuuugauuuaauaacaua

SEQ ID NO: 2054650 - RNA, 11 nt, Human
aaguaauuauc

SEQ ID NO: 2054651 - RNA, 13 nt, Human
aaguaauuaucgg

SEQ ID NO: 2054652 - RNA, 15 nt, Human
aaguaauuaucggga

SEQ ID NO: 2054653 - RNA, 22 nt, Human
aaguaauuaucgggaacagugu

SEQ ID NO: 2054654 - RNA, 23 nt, Human
aaguaauuaucgggaacaguguu

SEQ ID NO: 2054655 - RNA, 13 nt, Human
aaguacuauguau

SEQ ID NO: 2054656 - RNA, 19 nt, Human
guuuuaacuagaauuuauu

SEQ ID NO: 2054657 - RNA, 13 nt, Human
guuuuauuguguu

SEQ ID NO: 2054658 - RNA, 11 nt, Human
guuuuaugaua

SEQ ID NO: 2054659 - RNA, 19 nt, Human
guuuuauauuuuuauagac

SEQ ID NO: 2054660 - RNA, 16 nt, Human
guuuuaauugaaggaa

SEQ ID NO: 2054661 - RNA, 17 nt, Human
guuuuaauugaaggaaa

SEQ ID NO: 2054662 - RNA, 19 nt, Human
guuuuaauugaaggaaaga

SEQ ID NO: 2054663 - RNA, 20 nt, Human
guuuuaauugaaggaaagau

SEQ ID NO: 2054664 - RNA, 22 nt, Human
guuuugauguuuguggccucag

SEQ ID NO: 2054665 - RNA, 23 nt, Human
guuuugauguuuguggccucaga

SEQ ID NO: 2054666 - RNA, 23 nt, Human
guuuugagguuuccuucagacag

SEQ ID NO: 2054667 - RNA, 21 nt, Human
guuuugauguuuguggccuca

SEQ ID NO: 2054668 - RNA, 13 nt, Human
guuugcuuauugu

SEQ ID NO: 2054669 - RNA, 14 nt, Human
guuugcuuauuguu

SEQ ID NO: 2054670 - RNA, 15 nt, Human
guuugcuuauuguuc

SEQ ID NO: 2054671 - RNA, 16 nt, Human
guuugcuuauuguucc

SEQ ID NO: 2054672 - RNA, 17 nt, Human
guuugcuuauuguucca

SEQ ID NO: 2054673 - RNA, 19 nt, Human
guuugcuucaacugucucc

SEQ ID NO: 2054674 - RNA, 18 nt, Human
guuugcuuauuguuccaa

SEQ ID NO: 2054675 - RNA, 18 nt, Human
aaguaagaaagugaagca

SEQ ID NO: 2054676 - RNA, 20 nt, Human
aaguaagaaagugaagcaaa

SEQ ID NO: 2054677 - RNA, 20 nt, Human
guuugcuuuguaugcacuuu

SEQ ID NO: 2054678 - RNA, 19 nt, Human
guuuuaaauuuauuucaaa

SEQ ID NO: 2054679 - RNA, 12 nt, Human
guuuuaaaauua

SEQ ID NO: 2054680 - RNA, 14 nt, Human
guuuuaaaauuaaa

SEQ ID NO: 2054681 - RNA, 15 nt, Human
guuucaauucagugc

SEQ ID NO: 2054682 - RNA, 23 nt, Human
guuucaaccaagucaugugcauu

SEQ ID NO: 2054683 - RNA, 15 nt, Human
guuuauuacuuauuu

SEQ ID NO: 2054684 - RNA, 16 nt, Human
guuuauuacuuauuug

SEQ ID NO: 2054685 - RNA, 17 nt, Human
guuuauuacuuauuugg

SEQ ID NO: 2054686 - RNA, 17 nt, Human
guuuaugcaaggaagga

SEQ ID NO: 2054687 - RNA, 21 nt, Human
guuuaugauaauaaaggcacc

SEQ ID NO: 2054688 - RNA, 13 nt, Human
guuuauggccuca

SEQ ID NO: 2054689 - RNA, 14 nt, Human
guuuauggccucag

SEQ ID NO: 2054690 - RNA, 15 nt, Human
guuuauggccucagc

SEQ ID NO: 2054691 - RNA, 18 nt, Human
guuuauggccucagcugc

SEQ ID NO: 2054692 - RNA, 22 nt, Human
guuuauggccucagcugccuca

SEQ ID NO: 2054693 - RNA, 23 nt, Human
guuuauggccucagcugccucac

SEQ ID NO: 2054694 - RNA, 13 nt, Human
guuuaugagccag

SEQ ID NO: 2054695 - RNA, 13 nt, Human
guuguuuguaaau

SEQ ID NO: 2054696 - RNA, 15 nt, Human
guuguuuguaaauaa

SEQ ID NO: 2054697 - RNA, 20 nt, Human
guuguuuguaaauaagagau

SEQ ID NO: 2054698 - RNA, 19 nt, Human
guuguuuuuugaaaacaug

SEQ ID NO: 2054699 - RNA, 20 nt, Human
guuuaaaaaaguuuaaaaug

SEQ ID NO: 2054700 - RNA, 21 nt, Human
guuuaaaaaaguuuaaaaugu

SEQ ID NO: 2054701 - RNA, 22 nt, Human
guuuaaaaaaguuuaaaaugua

SEQ ID NO: 2054702 - RNA, 23 nt, Human
guuuaaaaaaguuuaaaauguau

SEQ ID NO: 2054703 - RNA, 12 nt, Human
guuuaaguguug

SEQ ID NO: 2054704 - RNA, 21 nt, Human
guuuaagugacugauggcuaa

SEQ ID NO: 2054705 - RNA, 16 nt, Human
guuuaaaguguauuau

SEQ ID NO: 2054706 - RNA, 19 nt, Human
guuuaaaguguauuauaac

SEQ ID NO: 2054707 - RNA, 21 nt, Human
guuuaaaguguauuauaacag

SEQ ID NO: 2054708 - RNA, 23 nt, Human
guuuaaaguguauuauaacagug

SEQ ID NO: 2054709 - RNA, 13 nt, Human
guuuaaaguucug

SEQ ID NO: 2054710 - RNA, 17 nt, Human
guuuaaaguucugugua

SEQ ID NO: 2054711 - RNA, 20 nt, Human
guuuaaaguucuguguauuu

SEQ ID NO: 2054712 - RNA, 21 nt, Human
guuuaaaguucuguguauuua

SEQ ID NO: 2054713 - RNA, 17 nt, Human
aaggaaaauaguaaugu

SEQ ID NO: 2054714 - RNA, 16 nt, Human
aaggcugggggaagaa

SEQ ID NO: 2054715 - RNA, 14 nt, Human
aaggcugggggaag

SEQ ID NO: 2054716 - RNA, 19 nt, Human
aaggcugggggaagaagcu

SEQ ID NO: 2054717 - RNA, 22 nt, Human
aaggcugggggaagaagcucuc

SEQ ID NO: 2054718 - RNA, 22 nt, Human
aaggcuguccuuacccaucugc

SEQ ID NO: 2054719 - RNA, 20 nt, Human
guuucacugacuuagaacca

SEQ ID NO: 2054720 - RNA, 21 nt, Human
guuucacuuucacauagaugu

SEQ ID NO: 2054721 - RNA, 21 nt, Human
aagggcuuacacguggaggaa

SEQ ID NO: 2054722 - RNA, 12 nt, Human
aagguaguuuuu

SEQ ID NO: 2054723 - RNA, 22 nt, Human
aagguaguuuuuaccuaccaca

SEQ ID NO: 2054724 - RNA, 20 nt, Human
aagguagcccuggccagagg

SEQ ID NO: 2054725 - RNA, 18 nt, Human
aagggggcaucuggccuu

SEQ ID NO: 2054726 - RNA, 21 nt, Human
aagggggguugcaguggagag

SEQ ID NO: 2054727 - RNA, 13 nt, Human
aaggggggagggg

SEQ ID NO: 2054728 - RNA, 16 nt, Human
aaggggggagggggag

SEQ ID NO: 2054729 - RNA, 11 nt, Human
aagguauaauu

SEQ ID NO: 2054730 - RNA, 23 nt, Human
aagguuucagaaagaagugggga

SEQ ID NO: 2054731 - RNA, 17 nt, Human
aagguuuguauauuguc

SEQ ID NO: 2054732 - RNA, 16 nt, Human
aagguuucugaaaauu

SEQ ID NO: 2054733 - RNA, 15 nt, Human
aaguaacuugucuua

SEQ ID NO: 2054734 - RNA, 18 nt, Human
aaguaacuugucuuaaau

SEQ ID NO: 2054735 - RNA, 22 nt, Human
aaguaacuugucuuaaauaaaa

SEQ ID NO: 2054736 - RNA, 17 nt, Human
aaguaacaagagugauu

SEQ ID NO: 2054737 - RNA, 20 nt, Human
aaguaacaagagugauucuu

SEQ ID NO: 2054738 - RNA, 15 nt, Human
aaguaaaugucugug

SEQ ID NO: 2054739 - RNA, 18 nt, Human
aaguaaaugucuguggcc

SEQ ID NO: 2054740 - RNA, 23 nt, Human
gucuaggcaggaccuguggccaa

SEQ ID NO: 2054741 - RNA, 12 nt, Human
gucuagggagag

SEQ ID NO: 2054742 - RNA, 14 nt, Human
gucuagggagagac

SEQ ID NO: 2054743 - RNA, 21 nt, Human
gucuaggagcugggaggaaaa

SEQ ID NO: 2054744 - RNA, 13 nt, Human
gucuaggagcugg

SEQ ID NO: 2054745 - RNA, 19 nt, Human
gucuagcagagcaggggca

SEQ ID NO: 2054746 - RNA, 22 nt, Human
gucuaugggacucaaugcacug

SEQ ID NO: 2054747 - RNA, 22 nt, Human
gucuaggucaguacccaccuga

SEQ ID NO: 2054748 - RNA, 22 nt, Human
gucuaguuccugaugacccagg

SEQ ID NO: 2054749 - RNA, 12 nt, Human
gucgccucugca

SEQ ID NO: 2054750 - RNA, 14 nt, Human
gucgauauuuccau

SEQ ID NO: 2054751 - RNA, 14 nt, Human
guccucuuuucuga

SEQ ID NO: 2054752 - RNA, 16 nt, Human
guccucuuucagaaaa

SEQ ID NO: 2054753 - RNA, 17 nt, Human
guccucuuucagaaaac

SEQ ID NO: 2054754 - RNA, 18 nt, Human
guccucuuucagaaaaca

SEQ ID NO: 2054755 - RNA, 19 nt, Human
guccucuuucagaaaacag

SEQ ID NO: 2054756 - RNA, 20 nt, Human
guccucuuucagaaaacaga

SEQ ID NO: 2054757 - RNA, 23 nt, Human
guccucuuucagaaaacagaaaa

SEQ ID NO: 2054758 - RNA, 15 nt, Human
guccucuuucaaagg

SEQ ID NO: 2054759 - RNA, 12 nt, Human
gucgaggcagga

SEQ ID NO: 2054760 - RNA, 16 nt, Human
gucgaggacagggagg

SEQ ID NO: 2054761 - RNA, 14 nt, Human
guccuuucccucca

SEQ ID NO: 2054762 - RNA, 15 nt, Human
guccuuucccuccac

SEQ ID NO: 2054763 - RNA, 15 nt, Human
guccuuuucacuaca

SEQ ID NO: 2054764 - RNA, 18 nt, Human
guccuuuucacuacacca

SEQ ID NO: 2054765 - RNA, 15 nt, Human
guccuuuccaguggc

SEQ ID NO: 2054766 - RNA, 22 nt, Human
guccuuuccaguggccuggcuc

SEQ ID NO: 2054767 - RNA, 23 nt, Human
guccuuuccaguggccuggcucc

SEQ ID NO: 2054768 - RNA, 13 nt, Human
guccuuucccucc

SEQ ID NO: 2054769 - RNA, 21 nt, Human
aacauucgaucucauucagua

SEQ ID NO: 2054770 - RNA, 17 nt, Human
guccucguagccaucuc

SEQ ID NO: 2054771 - RNA, 18 nt, Human
aacauugggaaaucuuau

SEQ ID NO: 2054772 - RNA, 22 nt, Human
guccuccucggaucaccgagag

SEQ ID NO: 2054773 - RNA, 21 nt, Human
guccuccucggaucaccgaga

SEQ ID NO: 2054774 - RNA, 19 nt, Human
aacauuccguuuacauuuu

SEQ ID NO: 2054775 - RNA, 22 nt, Human
aacauuccguuuacauuuuaga

SEQ ID NO: 2054776 - RNA, 17 nt, Human
aacauguauaauauuuu

SEQ ID NO: 2054777 - RNA, 20 nt, Human
aacauagacuagagaaaccg

SEQ ID NO: 2054778 - RNA, 21 nt, Human
aacauagugagaccccugucu

SEQ ID NO: 2054779 - RNA, 12 nt, Human
aacauaaagguu

SEQ ID NO: 2054780 - RNA, 13 nt, Human
aacauaaaaaguu

SEQ ID NO: 2054781 - RNA, 22 nt, Human
aacauaaaaaguuaaaaaaaau

SEQ ID NO: 2054782 - RNA, 14 nt, Human
aacauauaauauau

SEQ ID NO: 2054783 - RNA, 17 nt, Human
aacauauaauauauguu

SEQ ID NO: 2054784 - RNA, 21 nt, Human
aacauauaauauauguuuuaa

SEQ ID NO: 2054785 - RNA, 16 nt, Human
gucccuuccaggccau

SEQ ID NO: 2054786 - RNA, 16 nt, Human
gucccuugagaccuca

SEQ ID NO: 2054787 - RNA, 21 nt, Human
guccgguggaaggccuucuuu

SEQ ID NO: 2054788 - RNA, 17 nt, Human
guccgguguccuuuuca

SEQ ID NO: 2054789 - RNA, 14 nt, Human
gucccuugagaccu

SEQ ID NO: 2054790 - RNA, 24 nt, Human
guccgguguccuuuucacuacacc

SEQ ID NO: 2054791 - RNA, 19 nt, Human
gucccuuccccucccuggc

SEQ ID NO: 2054792 - RNA, 20 nt, Human
gucccuuccccucccuggcu

SEQ ID NO: 2054793 - RNA, 22 nt, Human
gucccuuccccucccuggcucc

SEQ ID NO: 2054794 - RNA, 19 nt, Human
gucccuucucuuaauuuaa

SEQ ID NO: 2054795 - RNA, 17 nt, Human
aacagucaaaacagaga

SEQ ID NO: 2054796 - RNA, 17 nt, Human
aaauuucucuacugucu

SEQ ID NO: 2054797 - RNA, 18 nt, Human
aaauuugaaccaaaacau

SEQ ID NO: 2054798 - RNA, 10 nt, Human
aaauuugaau

SEQ ID NO: 2054799 - RNA, 19 nt, Human
aacacaaacgggcucagca

SEQ ID NO: 2054800 - RNA, 20 nt, Human
aaauuugaauggguccauuu

SEQ ID NO: 2054801 - RNA, 12 nt, Human
aacacacagaca

SEQ ID NO: 2054802 - RNA, 16 nt, Human
aacacaccaggcugug

SEQ ID NO: 2054803 - RNA, 14 nt, Human
aacacacauaaagg

SEQ ID NO: 2054804 - RNA, 15 nt, Human
aacacacauaaagga

SEQ ID NO: 2054805 - RNA, 18 nt, Human
aacacacauaaaggauaa

SEQ ID NO: 2054806 - RNA, 15 nt, Human
aacacaccaggcugu

SEQ ID NO: 2054807 - RNA, 18 nt, Human
aacacagcaauuccucag

SEQ ID NO: 2054808 - RNA, 16 nt, Human
aacacagcauguguau

SEQ ID NO: 2054809 - RNA, 18 nt, Human
aacacagcauguguauuu

SEQ ID NO: 2054810 - RNA, 21 nt, Human
aacacacacacacacaacaaa

SEQ ID NO: 2054811 - RNA, 13 nt, Human
aacacaauguuau

SEQ ID NO: 2054812 - RNA, 17 nt, Human
aacacaauguuauucgu

SEQ ID NO: 2054813 - RNA, 14 nt, Human
aacacacaaaggua

SEQ ID NO: 2054814 - RNA, 15 nt, Human
aacacaaggugggca

SEQ ID NO: 2054815 - RNA, 23 nt, Human
aacacaaguagaugccugaacuu

SEQ ID NO: 2054816 - RNA, 20 nt, Human
gucagucugcuuauccuucc

SEQ ID NO: 2054817 - RNA, 19 nt, Human
aacacaaagcggggggagg

SEQ ID NO: 2054818 - RNA, 23 nt, Human
aacacugguggaggauggaaagg

SEQ ID NO: 2054819 - RNA, 17 nt, Human
gucauuugagcagggcu

SEQ ID NO: 2054820 - RNA, 21 nt, Human
aacacucacauuuauucugcu

SEQ ID NO: 2054821 - RNA, 12 nt, Human
aacacuauuuuc

SEQ ID NO: 2054822 - RNA, 15 nt, Human
aacacuauuuucaga

SEQ ID NO: 2054823 - RNA, 16 nt, Human
aacacuauuuucagaa

SEQ ID NO: 2054824 - RNA, 17 nt, Human
aacacuauuuucagaau

SEQ ID NO: 2054825 - RNA, 18 nt, Human
aacacuauuuucagaauc

SEQ ID NO: 2054826 - RNA, 19 nt, Human
aacacuauuuucagaaucu

SEQ ID NO: 2054827 - RNA, 19 nt, Human
aacacagcgagacuccguc

SEQ ID NO: 2054828 - RNA, 15 nt, Human
aacacuggccccuag

SEQ ID NO: 2054829 - RNA, 12 nt, Human
aacacuggcccc

SEQ ID NO: 2054830 - RNA, 13 nt, Human
aacacuggccccu

SEQ ID NO: 2054831 - RNA, 23 nt, Human
aacacaccaggcugugggccuca

SEQ ID NO: 2054832 - RNA, 17 nt, Human
aacacugggggagggga

SEQ ID NO: 2054833 - RNA, 16 nt, Human
aacacugggggagggg

SEQ ID NO: 2054834 - RNA, 20 nt, Human
guccaaccuaaccccuuucc

SEQ ID NO: 2054835 - RNA, 21 nt, Human
guccaaccuaaccccuuuccu

SEQ ID NO: 2054836 - RNA, 20 nt, Human
guccaacccgaggcccgcau

SEQ ID NO: 2054837 - RNA, 14 nt, Human
guccaaccuaaccc

SEQ ID NO: 2054838 - RNA, 17 nt, Human
guccaaccuaaccccuu

SEQ ID NO: 2054839 - RNA, 22 nt, Human
guccaaauguccuccagaagcc

SEQ ID NO: 2054840 - RNA, 21 nt, Human
guccaaacugccuaagcccuc

SEQ ID NO: 2054841 - RNA, 14 nt, Human
guccaaacugccua

SEQ ID NO: 2054842 - RNA, 19 nt, Human
gucauuugagcagggcuca

SEQ ID NO: 2054843 - RNA, 14 nt, Human
guccaaaggaggcu

SEQ ID NO: 2054844 - RNA, 16 nt, Human
guccaaaggaggcugg

SEQ ID NO: 2054845 - RNA, 20 nt, Human
guccaaaggaggcuggcagg

SEQ ID NO: 2054846 - RNA, 12 nt, Human
guccaucccagc

SEQ ID NO: 2054847 - RNA, 11 nt, Human
gucccacagcu

SEQ ID NO: 2054848 - RNA, 12 nt, Human
gucccacagcuu

SEQ ID NO: 2054849 - RNA, 15 nt, Human
gucccacagcuuggg

SEQ ID NO: 2054850 - RNA, 22 nt, Human
gucccaaggcaaggggugccug

SEQ ID NO: 2054851 - RNA, 19 nt, Human
gucccgucaggacguugag

SEQ ID NO: 2054852 - RNA, 12 nt, Human
gucccuuccccu

SEQ ID NO: 2054853 - RNA, 13 nt, Human
gucccuuccccuc

SEQ ID NO: 2054854 - RNA, 14 nt, Human
gucccuuccccucc

SEQ ID NO: 2054855 - RNA, 17 nt, Human
gucccuuccccucccug

SEQ ID NO: 2054856 - RNA, 18 nt, Human
gucccuuccccucccugg

SEQ ID NO: 2054857 - RNA, 15 nt, Human
gucccggggcuccac

SEQ ID NO: 2054858 - RNA, 13 nt, Human
guccccagcccac

SEQ ID NO: 2054859 - RNA, 15 nt, Human
guccccagcccacug

SEQ ID NO: 2054860 - RNA, 16 nt, Human
gucacuguuucucugc

SEQ ID NO: 2054861 - RNA, 20 nt, Human
gucacuuaccuagauuuaca

SEQ ID NO: 2054862 - RNA, 13 nt, Human
gucacuguuucuc

SEQ ID NO: 2054863 - RNA, 15 nt, Human
gucacuguuucucug

SEQ ID NO: 2054864 - RNA, 17 nt, Human
gucaggaaggaugagca

SEQ ID NO: 2054865 - RNA, 18 nt, Human
gucaggaaggaugagcau

SEQ ID NO: 2054866 - RNA, 17 nt, Human
gucaggaacagaaggau

SEQ ID NO: 2054867 - RNA, 15 nt, Human
gucaggaacagaagg

SEQ ID NO: 2054868 - RNA, 16 nt, Human
gucaggaacagaagga

SEQ ID NO: 2054869 - RNA, 22 nt, Human
gucagguggggcagcuugaggg

SEQ ID NO: 2054870 - RNA, 18 nt, Human
gucagguggggcagcuug

SEQ ID NO: 2054871 - RNA, 17 nt, Human
gucagguggggcagcuu

SEQ ID NO: 2054872 - RNA, 16 nt, Human
gucagguggggcagcu

SEQ ID NO: 2054873 - RNA, 14 nt, Human
gucagugaggccca

SEQ ID NO: 2054874 - RNA, 23 nt, Human
gucagugaggcccagggagaggc

SEQ ID NO: 2054875 - RNA, 15 nt, Human
gucaguggcucuuuu

SEQ ID NO: 2054876 - RNA, 22 nt, Human
gucagugggaacgugacugccc

SEQ ID NO: 2054877 - RNA, 16 nt, Human
gucagugcagcccgug

SEQ ID NO: 2054878 - RNA, 23 nt, Human
gucagugcagcccguguggcccc

SEQ ID NO: 2054879 - RNA, 19 nt, Human
gucagguuauacuccuccu

SEQ ID NO: 2054880 - RNA, 22 nt, Human
gucagucaugauggcaccacug

SEQ ID NO: 2054881 - RNA, 13 nt, Human
gucaguacccacc

SEQ ID NO: 2054882 - RNA, 18 nt, Human
gucaguacccaccugagc

SEQ ID NO: 2054883 - RNA, 19 nt, Human
gucaguacccaccugagcu

SEQ ID NO: 2054884 - RNA, 20 nt, Human
gucaguacccaccugagcuu

SEQ ID NO: 2054885 - RNA, 15 nt, Human
gucacaucacaggac

SEQ ID NO: 2054886 - RNA, 14 nt, Human
gucacauacaauua

SEQ ID NO: 2054887 - RNA, 22 nt, Human
gucaccaaaucagcugcuacua

SEQ ID NO: 2054888 - RNA, 19 nt, Human
gucacaggacucugccucc

SEQ ID NO: 2054889 - RNA, 12 nt, Human
gucacaggcagg

SEQ ID NO: 2054890 - RNA, 18 nt, Human
gucacaggacucugccuc

SEQ ID NO: 2054891 - RNA, 17 nt, Human
gucacaggacucugccu

SEQ ID NO: 2054892 - RNA, 21 nt, Human
gucacaaauccuaaaagaagc

SEQ ID NO: 2054893 - RNA, 20 nt, Human
aaauuuaauauagcuauuuu

SEQ ID NO: 2054894 - RNA, 12 nt, Human
aaauuuaagcau

SEQ ID NO: 2054895 - RNA, 13 nt, Human
aaauuuaagcauu

SEQ ID NO: 2054896 - RNA, 14 nt, Human
aaauuuaagcauug

SEQ ID NO: 2054897 - RNA, 15 nt, Human
aaauuuaagcauugu

SEQ ID NO: 2054898 - RNA, 16 nt, Human
aaauuuaagcauuguu

SEQ ID NO: 2054899 - RNA, 17 nt, Human
aaauuuaagcauuguuu

SEQ ID NO: 2054900 - RNA, 17 nt, Human
gucaccaagcucacagu

SEQ ID NO: 2054901 - RNA, 12 nt, Human
gucacaugcuug

SEQ ID NO: 2054902 - RNA, 15 nt, Human
gucaccaagcccagu

SEQ ID NO: 2054903 - RNA, 12 nt, Human
gucaccaagccc

SEQ ID NO: 2054904 - RNA, 23 nt, Human
gucacugcacagugcaucucagc

SEQ ID NO: 2054905 - RNA, 20 nt, Human
gucacugcacagugcaucuc

SEQ ID NO: 2054906 - RNA, 16 nt, Human
gucacugacacacacg

SEQ ID NO: 2054907 - RNA, 16 nt, Human
gucacugccauggagg

SEQ ID NO: 2054908 - RNA, 20 nt, Human
gucacugccauggaggcaca

SEQ ID NO: 2054909 - RNA, 12 nt, Human
gucacugccucu

SEQ ID NO: 2054910 - RNA, 20 nt, Human
gucacugccucucccuggcc

SEQ ID NO: 2054911 - RNA, 22 nt, Human
gucacugccucucccuggcccu

SEQ ID NO: 2054912 - RNA, 23 nt, Human
gucacugccucucccuggcccuc

SEQ ID NO: 2054913 - RNA, 18 nt, Human
guauuuaucuauuguaag

SEQ ID NO: 2054914 - RNA, 19 nt, Human
guauuuaucuauuguaaga

SEQ ID NO: 2054915 - RNA, 20 nt, Human
guauuuaucuauuguaagau

SEQ ID NO: 2054916 - RNA, 17 nt, Human
guauuuauauauuuaua

SEQ ID NO: 2054917 - RNA, 15 nt, Human
guauuuauauauuua

SEQ ID NO: 2054918 - RNA, 16 nt, Human
guauuuauauauuuau

SEQ ID NO: 2054919 - RNA, 12 nt, Human
guauuuauauau

SEQ ID NO: 2054920 - RNA, 13 nt, Human
guauuuauauauu

SEQ ID NO: 2054921 - RNA, 16 nt, Human
guauugugauuaucaa

SEQ ID NO: 2054922 - RNA, 18 nt, Human
guauuguucccagugaca

SEQ ID NO: 2054923 - RNA, 11 nt, Human
guauuguuccc

SEQ ID NO: 2054924 - RNA, 14 nt, Human
guauuguucccagu

SEQ ID NO: 2054925 - RNA, 15 nt, Human
aaaugugauuuuucu

SEQ ID NO: 2054926 - RNA, 16 nt, Human
aaaugugauuuuucug

SEQ ID NO: 2054927 - RNA, 17 nt, Human
aaaugugauuuuucuga

SEQ ID NO: 2054928 - RNA, 21 nt, Human
aaaugucucuuuaaugucaca

SEQ ID NO: 2054929 - RNA, 19 nt, Human
aaaugucuggagaauaauu

SEQ ID NO: 2054930 - RNA, 16 nt, Human
aaaugucuguggccuu

SEQ ID NO: 2054931 - RNA, 22 nt, Human
aaaugucuguggccuuguucuc

SEQ ID NO: 2054932 - RNA, 23 nt, Human
aaaugucuguggccuuguucucu

SEQ ID NO: 2054933 - RNA, 14 nt, Human
aaauguaucuuauu

SEQ ID NO: 2054934 - RNA, 15 nt, Human
aaauguauaccugua

SEQ ID NO: 2054935 - RNA, 18 nt, Human
aaauguauaccuguaacu

SEQ ID NO: 2054936 - RNA, 17 nt, Human
aaauguaucuuauucac

SEQ ID NO: 2054937 - RNA, 18 nt, Human
aaauguaugauuacauca

SEQ ID NO: 2054938 - RNA, 16 nt, Human
aaaucauguacauuuc

SEQ ID NO: 2054939 - RNA, 10 nt, Human
aaaucauguu

SEQ ID NO: 2054940 - RNA, 13 nt, Human
aaaucauguuaug

SEQ ID NO: 2054941 - RNA, 16 nt, Human
aaaucauguuaugaua

SEQ ID NO: 2054942 - RNA, 18 nt, Human
aaaucauguuaugauaaa

SEQ ID NO: 2054943 - RNA, 17 nt, Human
aaaucauguacauuucu

SEQ ID NO: 2054944 - RNA, 18 nt, Human
guauucuaguuuugucaa

SEQ ID NO: 2054945 - RNA, 13 nt, Human
aaauuuaaaacaa

SEQ ID NO: 2054946 - RNA, 14 nt, Human
aaauuuaaaacaaa

SEQ ID NO: 2054947 - RNA, 16 nt, Human
aaauuuaaaacaaaca

SEQ ID NO: 2054948 - RNA, 18 nt, Human
aaauuuaaaacaaacaac

SEQ ID NO: 2054949 - RNA, 23 nt, Human
aaauuuaaaagacacuguuuaca

SEQ ID NO: 2054950 - RNA, 12 nt, Human
aaauuuaaaaaa

SEQ ID NO: 2054951 - RNA, 22 nt, Human
aaauuguaucuagugcagcuga

SEQ ID NO: 2054952 - RNA, 15 nt, Human
aaauucuacaacaca

SEQ ID NO: 2054953 - RNA, 19 nt, Human
aaauucuauaggaacauau

SEQ ID NO: 2054954 - RNA, 22 nt, Human
aaauucuauaggaacauaugaa

SEQ ID NO: 2054955 - RNA, 23 nt, Human
aaauucuauaggaacauaugaaa

SEQ ID NO: 2054956 - RNA, 21 nt, Human
aaauucuauucugaucuuauu

SEQ ID NO: 2054957 - RNA, 19 nt, Human
aaauucuauuacaguaugu

SEQ ID NO: 2054958 - RNA, 20 nt, Human
aaauucucagucaguaauug

SEQ ID NO: 2054959 - RNA, 16 nt, Human
aaauucacaagcugcc

SEQ ID NO: 2054960 - RNA, 18 nt, Human
aaauucacaaguuguguu

SEQ ID NO: 2054961 - RNA, 19 nt, Human
aaauucacaaguuguguuu

SEQ ID NO: 2054962 - RNA, 16 nt, Human
aaauuccccacccuga

SEQ ID NO: 2054963 - RNA, 22 nt, Human
aaauuccuuagcuuagaccuca

SEQ ID NO: 2054964 - RNA, 22 nt, Human
aaauucuaaauaaaauauaauu

SEQ ID NO: 2054965 - RNA, 21 nt, Human
aaauucgcugcaaccuguuga

SEQ ID NO: 2054966 - RNA, 23 nt, Human
aaauuccuuagcuuagaccucag

SEQ ID NO: 2054967 - RNA, 16 nt, Human
aaauucacaauagaaa

SEQ ID NO: 2054968 - RNA, 17 nt, Human
aaauuccagaaaggaua

SEQ ID NO: 2054969 - RNA, 21 nt, Human
aaauuccagaaaggauauuua

SEQ ID NO: 2054970 - RNA, 20 nt, Human
aaauucccagauuugaagac

SEQ ID NO: 2054971 - RNA, 13 nt, Human
aaauuccacugga

SEQ ID NO: 2054972 - RNA, 15 nt, Human
aaauuagccgggcgu

SEQ ID NO: 2054973 - RNA, 18 nt, Human
aaauguggcauuugugau

SEQ ID NO: 2054974 - RNA, 15 nt, Human
aaauguggcuccugg

SEQ ID NO: 2054975 - RNA, 19 nt, Human
aaauuaggauuucaugauu

SEQ ID NO: 2054976 - RNA, 13 nt, Human
aaauuaucuauuu

SEQ ID NO: 2054977 - RNA, 14 nt, Human
aaauuaucuauuug

SEQ ID NO: 2054978 - RNA, 16 nt, Human
aaauuaucuauuugua

SEQ ID NO: 2054979 - RNA, 20 nt, Human
aaauuaucuauuuguauaua

SEQ ID NO: 2054980 - RNA, 18 nt, Human
aaauuaggauuucaugau

SEQ ID NO: 2054981 - RNA, 19 nt, Human
aaauuagcugugugaaaua

SEQ ID NO: 2054982 - RNA, 18 nt, Human
aaauuaggaauaaauaaa

SEQ ID NO: 2054983 - RNA, 17 nt, Human
aaauuagcugugugaaa

SEQ ID NO: 2054984 - RNA, 18 nt, Human
aaauuagcugugugaaau

SEQ ID NO: 2054985 - RNA, 14 nt, Human
aaauuaggaauaaa

SEQ ID NO: 2054986 - RNA, 15 nt, Human
aaauuaggaauaaau

SEQ ID NO: 2054987 - RNA, 16 nt, Human
aaauuaggaauaaaua

SEQ ID NO: 2054988 - RNA, 20 nt, Human
aaauuauguuacaucuguuu

SEQ ID NO: 2054989 - RNA, 20 nt, Human
gucuuguguuucuuuaguuu

SEQ ID NO: 2054990 - RNA, 16 nt, Human
gucuuguuaauauucu

SEQ ID NO: 2054991 - RNA, 21 nt, Human
gucuuguuaauauucuuucaa

SEQ ID NO: 2054992 - RNA, 22 nt, Human
gucuuguuaauauucuuucaau

SEQ ID NO: 2054993 - RNA, 22 nt, Human
gucuuguuuuuuuuuuccacuu

SEQ ID NO: 2054994 - RNA, 14 nt, Human
gucuuauuuauuau

SEQ ID NO: 2054995 - RNA, 14 nt, Human
gucuuauuuuuaga

SEQ ID NO: 2054996 - RNA, 15 nt, Human
gucuuauuuuuagau

SEQ ID NO: 2054997 - RNA, 21 nt, Human
gucuucaauuuguauaaaaug

SEQ ID NO: 2054998 - RNA, 14 nt, Human
gucuucaagggcug

SEQ ID NO: 2054999 - RNA, 15 nt, Human
gucuucaagggcugc

SEQ ID NO: 2055000 - RNA, 14 nt, Human
gucuucaagggcuu

SEQ ID NO: 2055001 - RNA, 13 nt, Human
gucuugugacuag

SEQ ID NO: 2055002 - RNA, 19 nt, Human
gucuugugacuagugcuga

SEQ ID NO: 2055003 - RNA, 20 nt, Human
gucuugugacuagugcugaa

SEQ ID NO: 2055004 - RNA, 21 nt, Human
gucuugugacuagugcugaag

SEQ ID NO: 2055005 - RNA, 16 nt, Human
gucuggaaugcagugg

SEQ ID NO: 2055006 - RNA, 15 nt, Human
gucuggaaugcagug

SEQ ID NO: 2055007 - RNA, 18 nt, Human
gucuggaaugcaguggua

SEQ ID NO: 2055008 - RNA, 13 nt, Human
gucuuaaauaaaa

SEQ ID NO: 2055009 - RNA, 16 nt, Human
gucuuaaauaaaagaa

SEQ ID NO: 2055010 - RNA, 20 nt, Human
gucuuaaauaaaagaaaugc

SEQ ID NO: 2055011 - RNA, 11 nt, Human
gucugaaaugg

SEQ ID NO: 2055012 - RNA, 13 nt, Human
gucugaauguucu

SEQ ID NO: 2055013 - RNA, 14 nt, Human
gucugaagcagaug

SEQ ID NO: 2055014 - RNA, 14 nt, Human
gucucaaaaaaaca

SEQ ID NO: 2055015 - RNA, 17 nt, Human
gucucaaaaaaagaaaa

SEQ ID NO: 2055016 - RNA, 14 nt, Human
gucugacaggcaau

SEQ ID NO: 2055017 - RNA, 13 nt, Human
gucugacaggcaa

SEQ ID NO: 2055018 - RNA, 12 nt, Human
gucugacaggca

SEQ ID NO: 2055019 - RNA, 14 nt, Human
gucugaauguucug

SEQ ID NO: 2055020 - RNA, 15 nt, Human
gucugaauguucuga

SEQ ID NO: 2055021 - RNA, 17 nt, Human
gucugaauguucugaca

SEQ ID NO: 2055022 - RNA, 18 nt, Human
gucugaauguucugacau

SEQ ID NO: 2055023 - RNA, 20 nt, Human
gucugaauguucugacauua

SEQ ID NO: 2055024 - RNA, 18 nt, Human
gucugacaggcaaugcug

SEQ ID NO: 2055025 - RNA, 15 nt, Human
gucugacaggcaaug

SEQ ID NO: 2055026 - RNA, 20 nt, Human
gucugacaggcaaugcuggc

SEQ ID NO: 2055027 - RNA, 16 nt, Human
gucugcuucugcaccu

SEQ ID NO: 2055028 - RNA, 21 nt, Human
gucugcuucugcaccuuaucu

SEQ ID NO: 2055029 - RNA, 23 nt, Human
gucugcuucugcaccuuaucuua

SEQ ID NO: 2055030 - RNA, 17 nt, Human
aacguuuuuccuguucu

SEQ ID NO: 2055031 - RNA, 15 nt, Human
aacguuuugaacuaa

SEQ ID NO: 2055032 - RNA, 20 nt, Human
aacguuuugaacuaauaaaa

SEQ ID NO: 2055033 - RNA, 13 nt, Human
aacguuuuauugu

SEQ ID NO: 2055034 - RNA, 18 nt, Human
aacguuucaguaauaaaa

SEQ ID NO: 2055035 - RNA, 21 nt, Human
aacguuucaguaauaaaacau

SEQ ID NO: 2055036 - RNA, 15 nt, Human
aacguuuuauugugu

SEQ ID NO: 2055037 - RNA, 13 nt, Human
aacgugcccucug

SEQ ID NO: 2055038 - RNA, 18 nt, Human
aacguuuuguuugaaaaa

SEQ ID NO: 2055039 - RNA, 17 nt, Human
aacuagggaagauaaua

SEQ ID NO: 2055040 - RNA, 15 nt, Human
aacuauguugauaaa

SEQ ID NO: 2055041 - RNA, 15 nt, Human
aacuaguccuuuacu

SEQ ID NO: 2055042 - RNA, 20 nt, Human
aacuagugguggcucugaga

SEQ ID NO: 2055043 - RNA, 12 nt, Human
aacuauguacaa

SEQ ID NO: 2055044 - RNA, 13 nt, Human
aacuauguacaau

SEQ ID NO: 2055045 - RNA, 15 nt, Human
aacuauguacaauau

SEQ ID NO: 2055046 - RNA, 16 nt, Human
aacuauguacaauauu

SEQ ID NO: 2055047 - RNA, 19 nt, Human
aacuauguacaauauuuua

SEQ ID NO: 2055048 - RNA, 20 nt, Human
aacuauguacaauauuuuaa

SEQ ID NO: 2055049 - RNA, 22 nt, Human
aacuauguacaauauuuuaagc

SEQ ID NO: 2055050 - RNA, 23 nt, Human
aaccuggucacaggacucugccu

SEQ ID NO: 2055051 - RNA, 15 nt, Human
aaccuuauuguaccu

SEQ ID NO: 2055052 - RNA, 19 nt, Human
aaccuuauuguaccucucu

SEQ ID NO: 2055053 - RNA, 18 nt, Human
aaccuuauuguaccucuc

SEQ ID NO: 2055054 - RNA, 17 nt, Human
aaccuuauuguaccucu

SEQ ID NO: 2055055 - RNA, 16 nt, Human
aaccuuauuguaccuc

SEQ ID NO: 2055056 - RNA, 15 nt, Human
gucuuucuuuggugc

SEQ ID NO: 2055057 - RNA, 19 nt, Human
gucuuucuuuggugccuuu

SEQ ID NO: 2055058 - RNA, 13 nt, Human
gucuuucuggaga

SEQ ID NO: 2055059 - RNA, 13 nt, Human
aacguggcccaga

SEQ ID NO: 2055060 - RNA, 12 nt, Human
aacgugaaaaug

SEQ ID NO: 2055061 - RNA, 15 nt, Human
aacgugaugaucagc

SEQ ID NO: 2055062 - RNA, 20 nt, Human
aacgugaugaucagcuguuu

SEQ ID NO: 2055063 - RNA, 19 nt, Human
aaccuuccaucucgccacc

SEQ ID NO: 2055064 - RNA, 13 nt, Human
aaccuuccugucu

SEQ ID NO: 2055065 - RNA, 21 nt, Human
aaccuuccugucuucauccuu

SEQ ID NO: 2055066 - RNA, 13 nt, Human
aaccuuccaucuc

SEQ ID NO: 2055067 - RNA, 17 nt, Human
aaccuuccaucucgcca

SEQ ID NO: 2055068 - RNA, 23 nt, Human
aaccuucugcccauccugucugu

SEQ ID NO: 2055069 - RNA, 19 nt, Human
gugaaguuuaauugacuua

SEQ ID NO: 2055070 - RNA, 18 nt, Human
aacuccuggaaauaucag

SEQ ID NO: 2055071 - RNA, 23 nt, Human
gugaauaauacaguaucucaggg

SEQ ID NO: 2055072 - RNA, 15 nt, Human
aacuccaccaaccca

SEQ ID NO: 2055073 - RNA, 23 nt, Human
aacuccaccaacccaucagaagg

SEQ ID NO: 2055074 - RNA, 16 nt, Human
aacuccucauuguaaa

SEQ ID NO: 2055075 - RNA, 18 nt, Human
gugacaguggauugcauu

SEQ ID NO: 2055076 - RNA, 14 nt, Human
gugacaucaguggc

SEQ ID NO: 2055077 - RNA, 15 nt, Human
gugacaucaguggca

SEQ ID NO: 2055078 - RNA, 18 nt, Human
gugacaucaguggcaugg

SEQ ID NO: 2055079 - RNA, 21 nt, Human
gugacagugagguccuggggg

SEQ ID NO: 2055080 - RNA, 15 nt, Human
gugacagugccuggg

SEQ ID NO: 2055081 - RNA, 17 nt, Human
gugacagugccugggaa

SEQ ID NO: 2055082 - RNA, 23 nt, Human
gugacagugccugggaauguauu

SEQ ID NO: 2055083 - RNA, 17 nt, Human
gugacagaguucacuau

SEQ ID NO: 2055084 - RNA, 18 nt, Human
gugacagaguucacuaua

SEQ ID NO: 2055085 - RNA, 22 nt, Human
gugacagagugagacucugucu

SEQ ID NO: 2055086 - RNA, 20 nt, Human
gugacagagugagacucugu

SEQ ID NO: 2055087 - RNA, 23 nt, Human
gugacagaggcagccccauucug

SEQ ID NO: 2055088 - RNA, 16 nt, Human
gugagacucugucuca

SEQ ID NO: 2055089 - RNA, 14 nt, Human
gugagacucugucu

SEQ ID NO: 2055090 - RNA, 16 nt, Human
gugagacccugucucu

SEQ ID NO: 2055091 - RNA, 16 nt, Human
gugagacccccacacc

SEQ ID NO: 2055092 - RNA, 17 nt, Human
gugagacccccacaccu

SEQ ID NO: 2055093 - RNA, 22 nt, Human
gugagacccugucucaaaaaaa

SEQ ID NO: 2055094 - RNA, 14 nt, Human
gugagacccccaca

SEQ ID NO: 2055095 - RNA, 15 nt, Human
gugagacccccacac

SEQ ID NO: 2055096 - RNA, 16 nt, Human
gugacuucagcucugu

SEQ ID NO: 2055097 - RNA, 15 nt, Human
gugacuguaucugug

SEQ ID NO: 2055098 - RNA, 19 nt, Human
gugacuguaucuguguaga

SEQ ID NO: 2055099 - RNA, 18 nt, Human
gugacuguggcacacgcc

SEQ ID NO: 2055100 - RNA, 11 nt, Human
aacucuuugcc

SEQ ID NO: 2055101 - RNA, 16 nt, Human
aacugcauuggcuuug

SEQ ID NO: 2055102 - RNA, 20 nt, Human
aacugcauugagaacugcau

SEQ ID NO: 2055103 - RNA, 16 nt, Human
aacugcauuagaaauu

SEQ ID NO: 2055104 - RNA, 14 nt, Human
aacugcauugagaa

SEQ ID NO: 2055105 - RNA, 23 nt, Human
aacucuucccccucucccaguug

SEQ ID NO: 2055106 - RNA, 22 nt, Human
aacucucuccacccuauaugua

SEQ ID NO: 2055107 - RNA, 16 nt, Human
gugagaccccugucuc

SEQ ID NO: 2055108 - RNA, 21 nt, Human
gugaggcuuaacaaugucuug

SEQ ID NO: 2055109 - RNA, 12 nt, Human
aacucucuccac

SEQ ID NO: 2055110 - RNA, 18 nt, Human
gugagacucugucucaaa

SEQ ID NO: 2055111 - RNA, 19 nt, Human
gugagucaccaagcccagu

SEQ ID NO: 2055112 - RNA, 17 nt, Human
gugagucaccaagccca

SEQ ID NO: 2055113 - RNA, 18 nt, Human
gugagagcgaggcugagc

SEQ ID NO: 2055114 - RNA, 19 nt, Human
aagaaagcccuuaggaaga

SEQ ID NO: 2055115 - RNA, 16 nt, Human
aagaaagccagucuua

SEQ ID NO: 2055116 - RNA, 19 nt, Human
aagaaagccagucuuaaca

SEQ ID NO: 2055117 - RNA, 23 nt, Human
aagaaagagcaacaauccaucuc

SEQ ID NO: 2055118 - RNA, 16 nt, Human
aagaaacccgacagag

SEQ ID NO: 2055119 - RNA, 18 nt, Human
aagaaacccgacagaggg

SEQ ID NO: 2055120 - RNA, 12 nt, Human
aagaaacacuga

SEQ ID NO: 2055121 - RNA, 11 nt, Human
aagaaacccaa

SEQ ID NO: 2055122 - RNA, 13 nt, Human
aagaaacaaaccc

SEQ ID NO: 2055123 - RNA, 16 nt, Human
aagaaacaaacccguu

SEQ ID NO: 2055124 - RNA, 22 nt, Human
aagaaacacacugaggcaggga

SEQ ID NO: 2055125 - RNA, 21 nt, Human
aacuuuagcagaaucaaaaug

SEQ ID NO: 2055126 - RNA, 12 nt, Human
aagaaaaaauac

SEQ ID NO: 2055127 - RNA, 14 nt, Human
aagaaaaaauacau

SEQ ID NO: 2055128 - RNA, 16 nt, Human
aagaaaaaauacauuu

SEQ ID NO: 2055129 - RNA, 17 nt, Human
aagaaaaaugagccugg

SEQ ID NO: 2055130 - RNA, 18 nt, Human
aagaaaaaugagccuggc

SEQ ID NO: 2055131 - RNA, 19 nt, Human
aagaaaaaauauuuucccu

SEQ ID NO: 2055132 - RNA, 22 nt, Human
aacuuuagaguagcaugagaga

SEQ ID NO: 2055133 - RNA, 13 nt, Human
aagaaaaagaaaa

SEQ ID NO: 2055134 - RNA, 18 nt, Human
aagaaaaagaaaaagaaa

SEQ ID NO: 2055135 - RNA, 18 nt, Human
gugcauuuuugugaaaug

SEQ ID NO: 2055136 - RNA, 22 nt, Human
gugcauuuuugugaaaugaaaa

SEQ ID NO: 2055137 - RNA, 15 nt, Human
gugcucccuaccacc

SEQ ID NO: 2055138 - RNA, 18 nt, Human
gugcucccuaccaccucc

SEQ ID NO: 2055139 - RNA, 13 nt, Human
gugcucagggcug

SEQ ID NO: 2055140 - RNA, 14 nt, Human
gugcucuggacagg

SEQ ID NO: 2055141 - RNA, 13 nt, Human
gugcucuggacag

SEQ ID NO: 2055142 - RNA, 16 nt, Human
gugcucugaucaucca

SEQ ID NO: 2055143 - RNA, 21 nt, Human
gugcuacaugacgacaaagcu

SEQ ID NO: 2055144 - RNA, 16 nt, Human
gugcuacugauuguuu

SEQ ID NO: 2055145 - RNA, 16 nt, Human
aagaauacaaacauau

SEQ ID NO: 2055146 - RNA, 14 nt, Human
aagaagcaaauuuu

SEQ ID NO: 2055147 - RNA, 21 nt, Human
aagaauaauaugcugccaaau

SEQ ID NO: 2055148 - RNA, 11 nt, Human
aagaaaacacu

SEQ ID NO: 2055149 - RNA, 17 nt, Human
aagaagaugacuuccca

SEQ ID NO: 2055150 - RNA, 17 nt, Human
gugcauuuucccagaua

SEQ ID NO: 2055151 - RNA, 16 nt, Human
gugcauuuuugugaaa

SEQ ID NO: 2055152 - RNA, 18 nt, Human
gugcacgcacacugucug

SEQ ID NO: 2055153 - RNA, 18 nt, Human
gugcaccuguacucagga

SEQ ID NO: 2055154 - RNA, 21 nt, Human
gugcaccuguacucaggaggc

SEQ ID NO: 2055155 - RNA, 15 nt, Human
gugcacccacucugc

SEQ ID NO: 2055156 - RNA, 21 nt, Human
gugcacaugcacgugugugca

SEQ ID NO: 2055157 - RNA, 13 nt, Human
gugaucuccauau

SEQ ID NO: 2055158 - RNA, 15 nt, Human
gugaucugaacagaa

SEQ ID NO: 2055159 - RNA, 18 nt, Human
gugaucuugcucuaucuc

SEQ ID NO: 2055160 - RNA, 24 nt, Human
gugaucuugcucuaucucacagca

SEQ ID NO: 2055161 - RNA, 22 nt, Human
gugaucuuggcuuacugcagcc

SEQ ID NO: 2055162 - RNA, 23 nt, Human
gugaugguuccccuguucacucu

SEQ ID NO: 2055163 - RNA, 12 nt, Human
gugaucugggaa

SEQ ID NO: 2055164 - RNA, 12 nt, Human
gugaucuccaua

SEQ ID NO: 2055165 - RNA, 14 nt, Human
gugauguuuguccu

SEQ ID NO: 2055166 - RNA, 22 nt, Human
gugaugguuccccuguucacuc

SEQ ID NO: 2055167 - RNA, 13 nt, Human
gugauuaaggucu

SEQ ID NO: 2055168 - RNA, 20 nt, Human
gugcaagugugugcaugugu

SEQ ID NO: 2055169 - RNA, 15 nt, Human
gugcaagugugugca

SEQ ID NO: 2055170 - RNA, 22 nt, Human
gugcaagugugugcacaugugu

SEQ ID NO: 2055171 - RNA, 14 nt, Human
gugcaagugugugc

SEQ ID NO: 2055172 - RNA, 11 nt, Human
aacugaaaaca

SEQ ID NO: 2055173 - RNA, 14 nt, Human
aacugcccugucua

SEQ ID NO: 2055174 - RNA, 21 nt, Human
aacugucaaagaaucaaucca

SEQ ID NO: 2055175 - RNA, 17 nt, Human
aacuguccucuuucaga

SEQ ID NO: 2055176 - RNA, 19 nt, Human
aacuguccucuuucagaaa

SEQ ID NO: 2055177 - RNA, 20 nt, Human
aacuguccucuuucagaaaa

SEQ ID NO: 2055178 - RNA, 21 nt, Human
aacuguccucuuucagaaaac

SEQ ID NO: 2055179 - RNA, 14 nt, Human
aacugcccaaagca

SEQ ID NO: 2055180 - RNA, 14 nt, Human
aacugcauuagaaa

SEQ ID NO: 2055181 - RNA, 13 nt, Human
aacuguguaugua

SEQ ID NO: 2055182 - RNA, 15 nt, Human
aacuguguauguaca

SEQ ID NO: 2055183 - RNA, 17 nt, Human
aacuguguauguacaua

SEQ ID NO: 2055184 - RNA, 18 nt, Human
aacuguguggacugugau

SEQ ID NO: 2055185 - RNA, 21 nt, Human
aacugucuccuaccucugcuc

SEQ ID NO: 2055186 - RNA, 13 nt, Human
aacuguguaacug

SEQ ID NO: 2055187 - RNA, 17 nt, Human
aacuucuaauugccaug

SEQ ID NO: 2055188 - RNA, 15 nt, Human
aacuucuaauugcca

SEQ ID NO: 2055189 - RNA, 16 nt, Human
aacuucuaauugccau

SEQ ID NO: 2055190 - RNA, 20 nt, Human
aacuucgaaagcaucauuau

SEQ ID NO: 2055191 - RNA, 22 nt, Human
aacuguguaacugcccaaagca

SEQ ID NO: 2055192 - RNA, 22 nt, Human
aacuucagagggaaaguaaaua

SEQ ID NO: 2055193 - RNA, 24 nt, Human
aacuucuuuguaaucguuaugugu

SEQ ID NO: 2055194 - RNA, 19 nt, Human
aacuugagcgugaaucugu

SEQ ID NO: 2055195 - RNA, 22 nt, Human
aacuugagcgugaaucuguauc

SEQ ID NO: 2055196 - RNA, 15 nt, Human
aacuugagcauguua

SEQ ID NO: 2055197 - RNA, 13 nt, Human
uaggacuguagaa

SEQ ID NO: 2055198 - RNA, 14 nt, Human
uaggacuguagaaa

SEQ ID NO: 2055199 - RNA, 18 nt, Human
uaggacucugaggcucuu

SEQ ID NO: 2055200 - RNA, 22 nt, Human
uaggagaauugcuugaaccugg

SEQ ID NO: 2055201 - RNA, 14 nt, Human
uaggagagaaggua

SEQ ID NO: 2055202 - RNA, 19 nt, Human
uaggagacacauccagcaa

SEQ ID NO: 2055203 - RNA, 14 nt, Human
uaggagaccaaggc

SEQ ID NO: 2055204 - RNA, 21 nt, Human
uaggagaccaaggcgggagca

SEQ ID NO: 2055205 - RNA, 14 nt, Human
uaggagcugggagg

SEQ ID NO: 2055206 - RNA, 18 nt, Human
uaggagcugggaggaaaa

SEQ ID NO: 2055207 - RNA, 12 nt, Human
uaggagcaugag

SEQ ID NO: 2055208 - RNA, 21 nt, Human
uaggagagagaucaugagaaa

SEQ ID NO: 2055209 - RNA, 16 nt, Human
uaggagauaccagguu

SEQ ID NO: 2055210 - RNA, 22 nt, Human
uaggagauaccagguugaaaga

SEQ ID NO: 2055211 - RNA, 21 nt, Human
uagcuuacaagccagcuggag

SEQ ID NO: 2055212 - RNA, 20 nt, Human
uagcuguuauuucuauuuuu

SEQ ID NO: 2055213 - RNA, 17 nt, Human
uagcuguuauuucuauu

SEQ ID NO: 2055214 - RNA, 13 nt, Human
uagcuguugagcu

SEQ ID NO: 2055215 - RNA, 17 nt, Human
uagcuguugagcuguuu

SEQ ID NO: 2055216 - RNA, 16 nt, Human
uagcuguugagcuguu

SEQ ID NO: 2055217 - RNA, 14 nt, Human
uagcugugugaaau

SEQ ID NO: 2055218 - RNA, 14 nt, Human
uagcuguggugagg

SEQ ID NO: 2055219 - RNA, 18 nt, Human
uagcuguggugagguggg

SEQ ID NO: 2055220 - RNA, 23 nt, Human
uaggaaaucuuguccagagacaa

SEQ ID NO: 2055221 - RNA, 20 nt, Human
uaggaaauaaaaccuuucaa

SEQ ID NO: 2055222 - RNA, 14 nt, Human
uaggacucugaggc

SEQ ID NO: 2055223 - RNA, 15 nt, Human
uaggacucugaggcu

SEQ ID NO: 2055224 - RNA, 16 nt, Human
uaggacucugaggcuc

SEQ ID NO: 2055225 - RNA, 15 nt, Human
uagggaccuggggaa

SEQ ID NO: 2055226 - RNA, 16 nt, Human
uagggaccuggggaag

SEQ ID NO: 2055227 - RNA, 18 nt, Human
uagggaccuggggaagca

SEQ ID NO: 2055228 - RNA, 13 nt, Human
uagggacuuaaaa

SEQ ID NO: 2055229 - RNA, 14 nt, Human
uagggacuuaaaaa

SEQ ID NO: 2055230 - RNA, 21 nt, Human
uagggaauggcacagcccaaa

SEQ ID NO: 2055231 - RNA, 17 nt, Human
uagggaaggccaccugc

SEQ ID NO: 2055232 - RNA, 20 nt, Human
uaggcagauugaaaaggaca

SEQ ID NO: 2055233 - RNA, 13 nt, Human
uaggcagcagcuu

SEQ ID NO: 2055234 - RNA, 16 nt, Human
uaggcauuugcugaau

SEQ ID NO: 2055235 - RNA, 20 nt, Human
uaggcauuugcugaauacag

SEQ ID NO: 2055236 - RNA, 13 nt, Human
uaggcacccaucc

SEQ ID NO: 2055237 - RNA, 18 nt, Human
uaggcacccauccuagag

SEQ ID NO: 2055238 - RNA, 19 nt, Human
uaggcacccauccuagaga

SEQ ID NO: 2055239 - RNA, 10 nt, Human
acaauaaacu

SEQ ID NO: 2055240 - RNA, 20 nt, Human
acaagacuuuccccauacuc

SEQ ID NO: 2055241 - RNA, 12 nt, Human
acaauaauuuca

SEQ ID NO: 2055242 - RNA, 13 nt, Human
acaauaauuucag

SEQ ID NO: 2055243 - RNA, 21 nt, Human
acaauaaguuaacuauuuuau

SEQ ID NO: 2055244 - RNA, 22 nt, Human
acaauaacuacuguguuccugg

SEQ ID NO: 2055245 - RNA, 18 nt, Human
acaauaacuacuguguuc

SEQ ID NO: 2055246 - RNA, 19 nt, Human
acaauaacuacuguguucc

SEQ ID NO: 2055247 - RNA, 20 nt, Human
acaauaacuacuguguuccu

SEQ ID NO: 2055248 - RNA, 21 nt, Human
acaauaacuacuguguuccug

SEQ ID NO: 2055249 - RNA, 12 nt, Human
acaauaaaugua

SEQ ID NO: 2055250 - RNA, 13 nt, Human
acaauaaauguau

SEQ ID NO: 2055251 - RNA, 16 nt, Human
acaauaaauguauuca

SEQ ID NO: 2055252 - RNA, 18 nt, Human
acaauaaauguauucaaa

SEQ ID NO: 2055253 - RNA, 19 nt, Human
acaauaaauguauucaaau

SEQ ID NO: 2055254 - RNA, 20 nt, Human
acaauaaauguauucaaaua

SEQ ID NO: 2055255 - RNA, 15 nt, Human
acaauaaaugugcuu

SEQ ID NO: 2055256 - RNA, 16 nt, Human
acaauaacuacugugu

SEQ ID NO: 2055257 - RNA, 17 nt, Human
acaauaacuacuguguu

SEQ ID NO: 2055258 - RNA, 14 nt, Human
acaauaaaugugca

SEQ ID NO: 2055259 - RNA, 19 nt, Human
acaaucaugaaauaugcau

SEQ ID NO: 2055260 - RNA, 18 nt, Human
acaaucaugaaauaugca

SEQ ID NO: 2055261 - RNA, 11 nt, Human
acaaucuauuu

SEQ ID NO: 2055262 - RNA, 17 nt, Human
acaaucuauuuauugga

SEQ ID NO: 2055263 - RNA, 14 nt, Human
uagcuauauccaug

SEQ ID NO: 2055264 - RNA, 15 nt, Human
uagcuauauccaugu

SEQ ID NO: 2055265 - RNA, 13 nt, Human
uagcuagaggaac

SEQ ID NO: 2055266 - RNA, 14 nt, Human
uagcuagaggaacc

SEQ ID NO: 2055267 - RNA, 15 nt, Human
uagcuagaggaacca

SEQ ID NO: 2055268 - RNA, 16 nt, Human
uagcuauauccaugua

SEQ ID NO: 2055269 - RNA, 17 nt, Human
uagcuauauccauguac

SEQ ID NO: 2055270 - RNA, 18 nt, Human
uagcuauauccauguacu

SEQ ID NO: 2055271 - RNA, 19 nt, Human
uagcuauauccauguacug

SEQ ID NO: 2055272 - RNA, 20 nt, Human
uagcuauauccauguacugu

SEQ ID NO: 2055273 - RNA, 21 nt, Human
uagcuauauccauguacugua

SEQ ID NO: 2055274 - RNA, 22 nt, Human
uagcuauauccauguacuguag

SEQ ID NO: 2055275 - RNA, 15 nt, Human
uagcuacaggaagca

SEQ ID NO: 2055276 - RNA, 20 nt, Human
uagcuacaggaagcacccca

SEQ ID NO: 2055277 - RNA, 13 nt, Human
uagcuaauggaaa

SEQ ID NO: 2055278 - RNA, 21 nt, Human
acaaagauguuugucagauau

SEQ ID NO: 2055279 - RNA, 22 nt, Human
acaaagauguuugucagauaug

SEQ ID NO: 2055280 - RNA, 23 nt, Human
acaaagauguuugucagauauga

SEQ ID NO: 2055281 - RNA, 24 nt, Human
acaaagauguuugucagauaugau

SEQ ID NO: 2055282 - RNA, 21 nt, Human
acaaagcagaauaguauuuuu

SEQ ID NO: 2055283 - RNA, 18 nt, Human
acaaaggcuuauuaauuu

SEQ ID NO: 2055284 - RNA, 15 nt, Human
aauuguuaagauaug

SEQ ID NO: 2055285 - RNA, 16 nt, Human
uagagcacacuguagc

SEQ ID NO: 2055286 - RNA, 17 nt, Human
uagagcacacuguagca

SEQ ID NO: 2055287 - RNA, 13 nt, Human
uagagaugccucc

SEQ ID NO: 2055288 - RNA, 14 nt, Human
uagagaugccuccc

SEQ ID NO: 2055289 - RNA, 15 nt, Human
uagagaugccucccu

SEQ ID NO: 2055290 - RNA, 16 nt, Human
uagagaugccucccug

SEQ ID NO: 2055291 - RNA, 14 nt, Human
uagagauggaggag

SEQ ID NO: 2055292 - RNA, 19 nt, Human
uagagauggaggaggaggc

SEQ ID NO: 2055293 - RNA, 19 nt, Human
uagagauggggaaagaauu

SEQ ID NO: 2055294 - RNA, 17 nt, Human
uagagauaguacauaaa

SEQ ID NO: 2055295 - RNA, 17 nt, Human
uagagaugacugagucc

SEQ ID NO: 2055296 - RNA, 15 nt, Human
uagaggccagccugg

SEQ ID NO: 2055297 - RNA, 20 nt, Human
uagaggccagccccacccag

SEQ ID NO: 2055298 - RNA, 16 nt, Human
uagaggccagccuggc

SEQ ID NO: 2055299 - RNA, 15 nt, Human
uagauauaugcucug

SEQ ID NO: 2055300 - RNA, 18 nt, Human
uagaggccagccccaccc

SEQ ID NO: 2055301 - RNA, 19 nt, Human
uagaggcagggaggggacu

SEQ ID NO: 2055302 - RNA, 23 nt, Human
uagaugagcccagcccuguucug

SEQ ID NO: 2055303 - RNA, 20 nt, Human
uagaugagaauucagcugcc

SEQ ID NO: 2055304 - RNA, 22 nt, Human
uagaugagaauucagcugcccc

SEQ ID NO: 2055305 - RNA, 19 nt, Human
uagauauaugcucugcaug

SEQ ID NO: 2055306 - RNA, 15 nt, Human
uagauaucuuuuuau

SEQ ID NO: 2055307 - RNA, 19 nt, Human
uagauaucuuuuuauugau

SEQ ID NO: 2055308 - RNA, 20 nt, Human
uagauaucuuuuuauugaug

SEQ ID NO: 2055309 - RNA, 21 nt, Human
uagauaucuuuuuauugaugu

SEQ ID NO: 2055310 - RNA, 22 nt, Human
uagauaucuuuuuauugaugug

SEQ ID NO: 2055311 - RNA, 23 nt, Human
uagccacuuaccuucaauaaagu

SEQ ID NO: 2055312 - RNA, 14 nt, Human
uagccaauguggga

SEQ ID NO: 2055313 - RNA, 20 nt, Human
uagccacaaaauugggaaag

SEQ ID NO: 2055314 - RNA, 18 nt, Human
uagccacuuaccuucaau

SEQ ID NO: 2055315 - RNA, 22 nt, Human
uagccacuuaccuucaauaaag

SEQ ID NO: 2055316 - RNA, 11 nt, Human
acaacagaagu

SEQ ID NO: 2055317 - RNA, 13 nt, Human
acaacagaaguca

SEQ ID NO: 2055318 - RNA, 11 nt, Human
acaacaaaaau

SEQ ID NO: 2055319 - RNA, 13 nt, Human
acaacaaaaauuu

SEQ ID NO: 2055320 - RNA, 10 nt, Human
acaacaaaaa

SEQ ID NO: 2055321 - RNA, 14 nt, Human
acaacaaaaaauaa

SEQ ID NO: 2055322 - RNA, 17 nt, Human
acaacaaaaagcuuccc

SEQ ID NO: 2055323 - RNA, 12 nt, Human
uagcauguaaug

SEQ ID NO: 2055324 - RNA, 14 nt, Human
uagaugcugacugu

SEQ ID NO: 2055325 - RNA, 23 nt, Human
uagaugcugacuguacuccuccc

SEQ ID NO: 2055326 - RNA, 20 nt, Human
uagccaaaaaugucuaaaag

SEQ ID NO: 2055327 - RNA, 20 nt, Human
uagccaaggugggcugagcc

SEQ ID NO: 2055328 - RNA, 21 nt, Human
uagccaaggugggcugagccc

SEQ ID NO: 2055329 - RNA, 23 nt, Human
uagccaaggugggcugagcccug

SEQ ID NO: 2055330 - RNA, 22 nt, Human
uagcauuuugcuaaaugugaau

SEQ ID NO: 2055331 - RNA, 16 nt, Human
uagcauuuugcuaaau

SEQ ID NO: 2055332 - RNA, 17 nt, Human
uagcaugucacuaaagc

SEQ ID NO: 2055333 - RNA, 21 nt, Human
uagugaaucacguaaagcuag

SEQ ID NO: 2055334 - RNA, 23 nt, Human
uagugaauuaucccuuuucuuga

SEQ ID NO: 2055335 - RNA, 20 nt, Human
uaguguuuggguauauucau

SEQ ID NO: 2055336 - RNA, 23 nt, Human
uaguuaauauugugaagaaaaau

SEQ ID NO: 2055337 - RNA, 24 nt, Human
uagugaaaccccaucucuacugaa

SEQ ID NO: 2055338 - RNA, 16 nt, Human
uagucccuuccccucc

SEQ ID NO: 2055339 - RNA, 20 nt, Human
uagucccuuccccucccugg

SEQ ID NO: 2055340 - RNA, 22 nt, Human
uagucccuuccccucccuggcu

SEQ ID NO: 2055341 - RNA, 23 nt, Human
uagucccuuccccucccuggcuc

SEQ ID NO: 2055342 - RNA, 20 nt, Human
uaguaccuucagauccuacc

SEQ ID NO: 2055343 - RNA, 14 nt, Human
uaguaccuuugcuc

SEQ ID NO: 2055344 - RNA, 16 nt, Human
uaguaccuuugcucuu

SEQ ID NO: 2055345 - RNA, 13 nt, Human
uaguacccaccug

SEQ ID NO: 2055346 - RNA, 14 nt, Human
uaguacccaccuga

SEQ ID NO: 2055347 - RNA, 17 nt, Human
uaguacccaccugagcu

SEQ ID NO: 2055348 - RNA, 15 nt, Human
uagucccagcuacuc

SEQ ID NO: 2055349 - RNA, 14 nt, Human
uagucccuuccccu

SEQ ID NO: 2055350 - RNA, 15 nt, Human
uagucccuuccccuc

SEQ ID NO: 2055351 - RNA, 20 nt, Human
uagucccagcuacucaggag

SEQ ID NO: 2055352 - RNA, 16 nt, Human
uaguacuauaucuguu

SEQ ID NO: 2055353 - RNA, 17 nt, Human
uaguacuauaucuguuu

SEQ ID NO: 2055354 - RNA, 23 nt, Human
uaguacuauaucuguuuuacugc

SEQ ID NO: 2055355 - RNA, 14 nt, Human
uagucccagcuacu

SEQ ID NO: 2055356 - RNA, 21 nt, Human
uagucccagcuacucagaagc

SEQ ID NO: 2055357 - RNA, 12 nt, Human
uaguaaagaaau

SEQ ID NO: 2055358 - RNA, 13 nt, Human
uaguaaagaaaug

SEQ ID NO: 2055359 - RNA, 14 nt, Human
uaguaaagaaauga

SEQ ID NO: 2055360 - RNA, 13 nt, Human
uaguaaagaaauu

SEQ ID NO: 2055361 - RNA, 12 nt, Human
acacauaaagga

SEQ ID NO: 2055362 - RNA, 13 nt, Human
acacauaaaggau

SEQ ID NO: 2055363 - RNA, 14 nt, Human
acacauaaaggaua

SEQ ID NO: 2055364 - RNA, 18 nt, Human
acacauaaaggauaaacu

SEQ ID NO: 2055365 - RNA, 15 nt, Human
acacaguugcuguca

SEQ ID NO: 2055366 - RNA, 22 nt, Human
acacaguugcugucauaagaau

SEQ ID NO: 2055367 - RNA, 23 nt, Human
uaguacagguaaggugagggaau

SEQ ID NO: 2055368 - RNA, 12 nt, Human
uaguacauaaag

SEQ ID NO: 2055369 - RNA, 21 nt, Human
uaguacauaaaggugguaugu

SEQ ID NO: 2055370 - RNA, 16 nt, Human
acacaguauuacuucu

SEQ ID NO: 2055371 - RNA, 13 nt, Human
acacacuuuauuu

SEQ ID NO: 2055372 - RNA, 18 nt, Human
acacaguauuacuucugc

SEQ ID NO: 2055373 - RNA, 22 nt, Human
acacaguauuacuucugcuaca

SEQ ID NO: 2055374 - RNA, 19 nt, Human
acacaguauuacuucugcu

SEQ ID NO: 2055375 - RNA, 22 nt, Human
acacagugcugaccagacagcc

SEQ ID NO: 2055376 - RNA, 19 nt, Human
acaaugugaaaagaaaaau

SEQ ID NO: 2055377 - RNA, 22 nt, Human
acaaugucaaggugcuguuguc

SEQ ID NO: 2055378 - RNA, 17 nt, Human
acaaugugaaaagaaaa

SEQ ID NO: 2055379 - RNA, 13 nt, Human
acacacacacaca

SEQ ID NO: 2055380 - RNA, 22 nt, Human
acacacaaauuaucuuaaaacu

SEQ ID NO: 2055381 - RNA, 13 nt, Human
acacacaacaaaa

SEQ ID NO: 2055382 - RNA, 14 nt, Human
acacacaacaaaaa

SEQ ID NO: 2055383 - RNA, 15 nt, Human
acacacaacaaaaau

SEQ ID NO: 2055384 - RNA, 14 nt, Human
acacacacaaagag

SEQ ID NO: 2055385 - RNA, 16 nt, Human
acacacacaaagagag

SEQ ID NO: 2055386 - RNA, 12 nt, Human
acacaauguuau

SEQ ID NO: 2055387 - RNA, 13 nt, Human
acacaauguuauu

SEQ ID NO: 2055388 - RNA, 16 nt, Human
acacaauguuauucgu

SEQ ID NO: 2055389 - RNA, 14 nt, Human
acacaaugugucug

SEQ ID NO: 2055390 - RNA, 14 nt, Human
acacaauaugaaua

SEQ ID NO: 2055391 - RNA, 11 nt, Human
acaaugucuug

SEQ ID NO: 2055392 - RNA, 22 nt, Human
acacacaaaauguacccaguau

SEQ ID NO: 2055393 - RNA, 14 nt, Human
acacacaacaauua

SEQ ID NO: 2055394 - RNA, 22 nt, Human
uagggaggaccuuaucugugcg

SEQ ID NO: 2055395 - RNA, 21 nt, Human
acacacgcgugcacacaccag

SEQ ID NO: 2055396 - RNA, 20 nt, Human
acacaccagagcccaccuug

SEQ ID NO: 2055397 - RNA, 15 nt, Human
acacaccagagccca

SEQ ID NO: 2055398 - RNA, 14 nt, Human
acacaccagagccc

SEQ ID NO: 2055399 - RNA, 22 nt, Human
acacacacgcgugcacacacca

SEQ ID NO: 2055400 - RNA, 17 nt, Human
acacacaccacacauac

SEQ ID NO: 2055401 - RNA, 15 nt, Human
acacacacacacaca

SEQ ID NO: 2055402 - RNA, 14 nt, Human
acacacaaagagag

SEQ ID NO: 2055403 - RNA, 14 nt, Human
acacacagcucugu

SEQ ID NO: 2055404 - RNA, 13 nt, Human
acacacagcucug

SEQ ID NO: 2055405 - RNA, 17 nt, Human
acacacagcucuguccu

SEQ ID NO: 2055406 - RNA, 22 nt, Human
acacauauaaacaucacacaca

SEQ ID NO: 2055407 - RNA, 14 nt, Human
acacauauaaacau

SEQ ID NO: 2055408 - RNA, 13 nt, Human
acacauagauuca

SEQ ID NO: 2055409 - RNA, 17 nt, Human
acacauagauucaccug

SEQ ID NO: 2055410 - RNA, 19 nt, Human
acacauagauucaccugua

SEQ ID NO: 2055411 - RNA, 22 nt, Human
acacauagauucaccuguaaaa

SEQ ID NO: 2055412 - RNA, 17 nt, Human
acacauagcauguaaug

SEQ ID NO: 2055413 - RNA, 18 nt, Human
uaguucauccaauccuca

SEQ ID NO: 2055414 - RNA, 20 nt, Human
uaguucauccaauccucacu

SEQ ID NO: 2055415 - RNA, 15 nt, Human
uaguuacuauaugcc

SEQ ID NO: 2055416 - RNA, 14 nt, Human
uaguuacucauuca

SEQ ID NO: 2055417 - RNA, 14 nt, Human
uaguucauccaauc

SEQ ID NO: 2055418 - RNA, 20 nt, Human
uauaaaaaccccaaacuguu

SEQ ID NO: 2055419 - RNA, 15 nt, Human
uauaaaaaaaaugaa

SEQ ID NO: 2055420 - RNA, 16 nt, Human
uauaaaaaaaaugaaa

SEQ ID NO: 2055421 - RNA, 17 nt, Human
uauaaaaaaaaugaaau

SEQ ID NO: 2055422 - RNA, 19 nt, Human
uauaaaaaaaaugaaaugu

SEQ ID NO: 2055423 - RNA, 23 nt, Human
uauaaaaaaaaugaaauguuuua

SEQ ID NO: 2055424 - RNA, 23 nt, Human
acaccauguuugagcucagaccc

SEQ ID NO: 2055425 - RNA, 17 nt, Human
acacccgacuccucaaa

SEQ ID NO: 2055426 - RNA, 22 nt, Human
acacccucgaagcgcgccacuc

SEQ ID NO: 2055427 - RNA, 12 nt, Human
acacccucuccc

SEQ ID NO: 2055428 - RNA, 13 nt, Human
acacccucuccca

SEQ ID NO: 2055429 - RNA, 16 nt, Human
acacccucucccagga

SEQ ID NO: 2055430 - RNA, 22 nt, Human
acacucacauuuauucugcuca

SEQ ID NO: 2055431 - RNA, 20 nt, Human
acacucacauuuauucugcu

SEQ ID NO: 2055432 - RNA, 13 nt, Human
acacuauuuucag

SEQ ID NO: 2055433 - RNA, 14 nt, Human
acacuauuuucaga

SEQ ID NO: 2055434 - RNA, 15 nt, Human
acacuauuuucagaa

SEQ ID NO: 2055435 - RNA, 16 nt, Human
acacuauuuucagaau

SEQ ID NO: 2055436 - RNA, 19 nt, Human
acacuauuuucagaaucug

SEQ ID NO: 2055437 - RNA, 20 nt, Human
acacuauuuuuuuuucuuuu

SEQ ID NO: 2055438 - RNA, 15 nt, Human
acacucaaaagcugg

SEQ ID NO: 2055439 - RNA, 22 nt, Human
acacuaugguauuugaguguuu

SEQ ID NO: 2055440 - RNA, 16 nt, Human
acacuauucacuaaaa

SEQ ID NO: 2055441 - RNA, 19 nt, Human
acacuaugguauuugagug

SEQ ID NO: 2055442 - RNA, 18 nt, Human
acacuaugguauuugagu

SEQ ID NO: 2055443 - RNA, 17 nt, Human
acacuaugguauuugag

SEQ ID NO: 2055444 - RNA, 15 nt, Human
acacuaaccuggguu

SEQ ID NO: 2055445 - RNA, 15 nt, Human
acacuagucugugug

SEQ ID NO: 2055446 - RNA, 20 nt, Human
acacuagucugugugcugug

SEQ ID NO: 2055447 - RNA, 17 nt, Human
acacccucucccaggac

SEQ ID NO: 2055448 - RNA, 14 nt, Human
acaccgggccugga

SEQ ID NO: 2055449 - RNA, 16 nt, Human
acaccgggcacucaga

SEQ ID NO: 2055450 - RNA, 21 nt, Human
acaccucugcacaagcugcac

SEQ ID NO: 2055451 - RNA, 20 nt, Human
acacuaaccacgcuggaccu

SEQ ID NO: 2055452 - RNA, 15 nt, Human
acaccuuuuaacuca

SEQ ID NO: 2055453 - RNA, 17 nt, Human
acaccuuuuaacucacc

SEQ ID NO: 2055454 - RNA, 15 nt, Human
acaccuguacuggag

SEQ ID NO: 2055455 - RNA, 16 nt, Human
acaccuguacuggaga

SEQ ID NO: 2055456 - RNA, 16 nt, Human
acaccuguagucccag

SEQ ID NO: 2055457 - RNA, 17 nt, Human
acaccuguagucccagc

SEQ ID NO: 2055458 - RNA, 19 nt, Human
acaccuguagucccagcua

SEQ ID NO: 2055459 - RNA, 11 nt, Human
acaccuggccc

SEQ ID NO: 2055460 - RNA, 12 nt, Human
acaccuggcccu

SEQ ID NO: 2055461 - RNA, 14 nt, Human
acaccuggcccugg

SEQ ID NO: 2055462 - RNA, 15 nt, Human
acaccuggcccuggg

SEQ ID NO: 2055463 - RNA, 17 nt, Human
acaccuggcccuggggc

SEQ ID NO: 2055464 - RNA, 18 nt, Human
acaccuggcccuggggcc

SEQ ID NO: 2055465 - RNA, 19 nt, Human
acaccuggcccuggggccu

SEQ ID NO: 2055466 - RNA, 20 nt, Human
acaccuggcccuggggccug

SEQ ID NO: 2055467 - RNA, 21 nt, Human
acaccuguagucccagcuacu

SEQ ID NO: 2055468 - RNA, 15 nt, Human
acaccuuauauuuac

SEQ ID NO: 2055469 - RNA, 18 nt, Human
uaugaacggugagcauug

SEQ ID NO: 2055470 - RNA, 15 nt, Human
uaugaacugcaugua

SEQ ID NO: 2055471 - RNA, 15 nt, Human
uaugguaaagauauu

SEQ ID NO: 2055472 - RNA, 12 nt, Human
acagccuggcac

SEQ ID NO: 2055473 - RNA, 22 nt, Human
uauggguguguguuugugugag

SEQ ID NO: 2055474 - RNA, 21 nt, Human
uauggguaucaaacagcucag

SEQ ID NO: 2055475 - RNA, 23 nt, Human
uauggggggccaacaccagggau

SEQ ID NO: 2055476 - RNA, 20 nt, Human
uauggggcugaacggggaga

SEQ ID NO: 2055477 - RNA, 19 nt, Human
uauggggggccaacaccag

SEQ ID NO: 2055478 - RNA, 21 nt, Human
uaugaacauagacuagagaaa

SEQ ID NO: 2055479 - RNA, 20 nt, Human
uaugcugccaaauuuuggcc

SEQ ID NO: 2055480 - RNA, 22 nt, Human
uaugcugccaaauuuuggccaa

SEQ ID NO: 2055481 - RNA, 16 nt, Human
uaugcugccaaauuuu

SEQ ID NO: 2055482 - RNA, 16 nt, Human
uaugcuacuacaaaaa

SEQ ID NO: 2055483 - RNA, 15 nt, Human
uaugcuuauacacuu

SEQ ID NO: 2055484 - RNA, 13 nt, Human
uaugcuguauuuu

SEQ ID NO: 2055485 - RNA, 15 nt, Human
uaugcuguauuuucu

SEQ ID NO: 2055486 - RNA, 16 nt, Human
uaugcuguauuuucuu

SEQ ID NO: 2055487 - RNA, 20 nt, Human
uaugcuguauuuucuuuuua

SEQ ID NO: 2055488 - RNA, 22 nt, Human
uaugaaauuuaauauagcuauu

SEQ ID NO: 2055489 - RNA, 20 nt, Human
uaugaaauuuaauauagcua

SEQ ID NO: 2055490 - RNA, 14 nt, Human
uaucuuuugagaac

SEQ ID NO: 2055491 - RNA, 15 nt, Human
uaucuuuuuauugau

SEQ ID NO: 2055492 - RNA, 16 nt, Human
uaucuuuuuauugaug

SEQ ID NO: 2055493 - RNA, 17 nt, Human
uaucuuuuuauugaugu

SEQ ID NO: 2055494 - RNA, 18 nt, Human
uaucuuuuuauugaugug

SEQ ID NO: 2055495 - RNA, 19 nt, Human
uaucuuuuuauugaugugc

SEQ ID NO: 2055496 - RNA, 17 nt, Human
uaucuuuguaauuauuu

SEQ ID NO: 2055497 - RNA, 13 nt, Human
uaucuuuucuaca

SEQ ID NO: 2055498 - RNA, 14 nt, Human
uaucuuuucuacag

SEQ ID NO: 2055499 - RNA, 16 nt, Human
uaucuuuucuacagca

SEQ ID NO: 2055500 - RNA, 19 nt, Human
uaucuuuucuacagcaaau

SEQ ID NO: 2055501 - RNA, 19 nt, Human
acagccgucagccaaaugu

SEQ ID NO: 2055502 - RNA, 16 nt, Human
acagccggggccugcc

SEQ ID NO: 2055503 - RNA, 18 nt, Human
acagccggggccugccua

SEQ ID NO: 2055504 - RNA, 17 nt, Human
acagccgucagccaaau

SEQ ID NO: 2055505 - RNA, 19 nt, Human
acagccgcuccugucugcc

SEQ ID NO: 2055506 - RNA, 20 nt, Human
acagccgcuccugucugcca

SEQ ID NO: 2055507 - RNA, 23 nt, Human
acagccgcuccugucugccagcc

SEQ ID NO: 2055508 - RNA, 24 nt, Human
acagccgcuccugucugccagcca

SEQ ID NO: 2055509 - RNA, 14 nt, Human
acagccucacagaa

SEQ ID NO: 2055510 - RNA, 18 nt, Human
acagccucacuugaaugu

SEQ ID NO: 2055511 - RNA, 20 nt, Human
acagccgucagccaaaugua

SEQ ID NO: 2055512 - RNA, 17 nt, Human
acagccucacagaagaa

SEQ ID NO: 2055513 - RNA, 23 nt, Human
acagccgcagccucccucugacc

SEQ ID NO: 2055514 - RNA, 14 nt, Human
acagccgcuccugu

SEQ ID NO: 2055515 - RNA, 18 nt, Human
acagccgcuccugucugc

SEQ ID NO: 2055516 - RNA, 19 nt, Human
acagauaggccuucuugug

SEQ ID NO: 2055517 - RNA, 22 nt, Human
acagaucucugcuuuggaaauc

SEQ ID NO: 2055518 - RNA, 17 nt, Human
acagaucuccaaagcuu

SEQ ID NO: 2055519 - RNA, 20 nt, Human
acagaucauagauuucugau

SEQ ID NO: 2055520 - RNA, 21 nt, Human
acagaucauagauuucugauu

SEQ ID NO: 2055521 - RNA, 14 nt, Human
acagagacaccugc

SEQ ID NO: 2055522 - RNA, 23 nt, Human
acagagaacuagugguggcucug

SEQ ID NO: 2055523 - RNA, 15 nt, Human
acagagacaccugca

SEQ ID NO: 2055524 - RNA, 20 nt, Human
acagaugcaaugugcuacug

SEQ ID NO: 2055525 - RNA, 19 nt, Human
acagaugaacucuuucugg

SEQ ID NO: 2055526 - RNA, 16 nt, Human
acagaugcaaugugcu

SEQ ID NO: 2055527 - RNA, 17 nt, Human
acagaugcaaugugcua

SEQ ID NO: 2055528 - RNA, 13 nt, Human
acagauugcugcu

SEQ ID NO: 2055529 - RNA, 16 nt, Human
acagauugcugcuucu

SEQ ID NO: 2055530 - RNA, 17 nt, Human
acagauugcugcuucug

SEQ ID NO: 2055531 - RNA, 20 nt, Human
uaucauuuauuuuuuacauu

SEQ ID NO: 2055532 - RNA, 14 nt, Human
uaucauuuucugca

SEQ ID NO: 2055533 - RNA, 21 nt, Human
uaucauuuucugcauuuaacc

SEQ ID NO: 2055534 - RNA, 21 nt, Human
uauauuuauaacucaucauaa

SEQ ID NO: 2055535 - RNA, 16 nt, Human
uaucaacccagaaaca

SEQ ID NO: 2055536 - RNA, 17 nt, Human
uaucaacccagaaacac

SEQ ID NO: 2055537 - RNA, 12 nt, Human
uaucaagcuaau

SEQ ID NO: 2055538 - RNA, 23 nt, Human
uaucaagccaguacgugcuaaca

SEQ ID NO: 2055539 - RNA, 13 nt, Human
uaucaagcuaaua

SEQ ID NO: 2055540 - RNA, 15 nt, Human
uaucaagcuaauaaa

SEQ ID NO: 2055541 - RNA, 23 nt, Human
uaucaagcuaauaaaauaucauu

SEQ ID NO: 2055542 - RNA, 21 nt, Human
uaucaaggucguuuuuuucau

SEQ ID NO: 2055543 - RNA, 19 nt, Human
uauccacccagcccauucu

SEQ ID NO: 2055544 - RNA, 20 nt, Human
uauccacccagcccauucuc

SEQ ID NO: 2055545 - RNA, 21 nt, Human
uauccacuguuuauucaacaa

SEQ ID NO: 2055546 - RNA, 14 nt, Human
uaucccuuccuuuu

SEQ ID NO: 2055547 - RNA, 18 nt, Human
uauccggacagagcacgu

SEQ ID NO: 2055548 - RNA, 16 nt, Human
uaucccuuuucuugac

SEQ ID NO: 2055549 - RNA, 17 nt, Human
acagagaaagagagaga

SEQ ID NO: 2055550 - RNA, 18 nt, Human
acagagaaaguacuucuc

SEQ ID NO: 2055551 - RNA, 11 nt, Human
acagagaaagu

SEQ ID NO: 2055552 - RNA, 15 nt, Human
acagagaaggcagga

SEQ ID NO: 2055553 - RNA, 12 nt, Human
acagagaaggaa

SEQ ID NO: 2055554 - RNA, 13 nt, Human
acagagaaggaau

SEQ ID NO: 2055555 - RNA, 15 nt, Human
acagagaaggaaugu

SEQ ID NO: 2055556 - RNA, 19 nt, Human
acagagaaggaaugucuuu

SEQ ID NO: 2055557 - RNA, 21 nt, Human
acagagaaggaaugucuuugg

SEQ ID NO: 2055558 - RNA, 22 nt, Human
acagagaaggaaugucuuuggu

SEQ ID NO: 2055559 - RNA, 16 nt, Human
acagagaaggcagcag

SEQ ID NO: 2055560 - RNA, 14 nt, Human
acagagaaggcagg

SEQ ID NO: 2055561 - RNA, 16 nt, Human
acagagaaggcaggaa

SEQ ID NO: 2055562 - RNA, 13 nt, Human
uaucuaucuuaua

SEQ ID NO: 2055563 - RNA, 13 nt, Human
uaucuauuguaag

SEQ ID NO: 2055564 - RNA, 14 nt, Human
uaucuauuguaaga

SEQ ID NO: 2055565 - RNA, 15 nt, Human
uaucuauuguaagau

SEQ ID NO: 2055566 - RNA, 18 nt, Human
uaucuauuguaagauaaa

SEQ ID NO: 2055567 - RNA, 19 nt, Human
uaucuauuguaagauaaaa

SEQ ID NO: 2055568 - RNA, 19 nt, Human
uaucuauuuguauauauac

SEQ ID NO: 2055569 - RNA, 20 nt, Human
uaucuauuuguauauauaca

SEQ ID NO: 2055570 - RNA, 16 nt, Human
uauauuagcauuuagu

SEQ ID NO: 2055571 - RNA, 23 nt, Human
uauauuagcauuuaguccaaugu

SEQ ID NO: 2055572 - RNA, 14 nt, Human
uauauuaucaugca

SEQ ID NO: 2055573 - RNA, 20 nt, Human
uauauuaucaugcaaaugcu

SEQ ID NO: 2055574 - RNA, 21 nt, Human
uauauuuagauuguuaaaaua

SEQ ID NO: 2055575 - RNA, 12 nt, Human
uauauuuauaac

SEQ ID NO: 2055576 - RNA, 14 nt, Human
uauauuuauaacuc

SEQ ID NO: 2055577 - RNA, 15 nt, Human
uauauuuauaacuca

SEQ ID NO: 2055578 - RNA, 16 nt, Human
uauauuuauaacucau

SEQ ID NO: 2055579 - RNA, 19 nt, Human
uauauugucagauauuuuu

SEQ ID NO: 2055580 - RNA, 21 nt, Human
uauaauuuuuuucaauauuua

SEQ ID NO: 2055581 - RNA, 15 nt, Human
uauaauuuuuuaaag

SEQ ID NO: 2055582 - RNA, 18 nt, Human
uauaauuuuuuucaauau

SEQ ID NO: 2055583 - RNA, 20 nt, Human
uauaauuuuuuuauguuuug

SEQ ID NO: 2055584 - RNA, 22 nt, Human
uauaauuuuuuuauguuuuguu

SEQ ID NO: 2055585 - RNA, 19 nt, Human
uauaauuuuuaaaguauau

SEQ ID NO: 2055586 - RNA, 19 nt, Human
uauaauuuuuuagagagcu

SEQ ID NO: 2055587 - RNA, 17 nt, Human
acagaaauuagccgggc

SEQ ID NO: 2055588 - RNA, 22 nt, Human
acaggcauguucucugaggaca

SEQ ID NO: 2055589 - RNA, 20 nt, Human
acaggcauguucucugagga

SEQ ID NO: 2055590 - RNA, 19 nt, Human
acaggcauguucucugagg

SEQ ID NO: 2055591 - RNA, 18 nt, Human
acaggcauguucucugag

SEQ ID NO: 2055592 - RNA, 15 nt, Human
acaggcauguucucu

SEQ ID NO: 2055593 - RNA, 22 nt, Human
uaugugaauauggacucaguuu

SEQ ID NO: 2055594 - RNA, 12 nt, Human
uaugugaaugau

SEQ ID NO: 2055595 - RNA, 22 nt, Human
uaugugaaugaucucucugaau

SEQ ID NO: 2055596 - RNA, 19 nt, Human
uaugugacaauuuuguaca

SEQ ID NO: 2055597 - RNA, 20 nt, Human
acaggauagauaacucuuug

SEQ ID NO: 2055598 - RNA, 13 nt, Human
uaugugagugugu

SEQ ID NO: 2055599 - RNA, 15 nt, Human
uauguuuuguuucug

SEQ ID NO: 2055600 - RNA, 18 nt, Human
uauguuuuguuucugaaa

SEQ ID NO: 2055601 - RNA, 16 nt, Human
uaugugugaggagcug

SEQ ID NO: 2055602 - RNA, 21 nt, Human
uaugugugaggagcugcuggc

SEQ ID NO: 2055603 - RNA, 18 nt, Human
uauguguaugugccauuu

SEQ ID NO: 2055604 - RNA, 15 nt, Human
uaugugugaggagcu

SEQ ID NO: 2055605 - RNA, 23 nt, Human
uaugugaguguguguuugugcug

SEQ ID NO: 2055606 - RNA, 14 nt, Human
uauguuuuugugua

SEQ ID NO: 2055607 - RNA, 18 nt, Human
uauguuuuuguguauuug

SEQ ID NO: 2055608 - RNA, 18 nt, Human
uauguuuuuuauuaugcu

SEQ ID NO: 2055609 - RNA, 17 nt, Human
acaggaaaagcugcuga

SEQ ID NO: 2055610 - RNA, 16 nt, Human
acaggaaaagcugcug

SEQ ID NO: 2055611 - RNA, 15 nt, Human
acaggaaaagcugcu

SEQ ID NO: 2055612 - RNA, 15 nt, Human
acaggaagcacccca

SEQ ID NO: 2055613 - RNA, 20 nt, Human
acaggaagcaccccaugcca

SEQ ID NO: 2055614 - RNA, 17 nt, Human
acaggaagucuucaggg

SEQ ID NO: 2055615 - RNA, 11 nt, Human
acagccuggca

SEQ ID NO: 2055616 - RNA, 16 nt, Human
acagcggggccccagg

SEQ ID NO: 2055617 - RNA, 20 nt, Human
acagcuuucaugauuagcaa

SEQ ID NO: 2055618 - RNA, 19 nt, Human
acagcuuuuaguacccacc

SEQ ID NO: 2055619 - RNA, 21 nt, Human
acagcuuuuaguacccaccug

SEQ ID NO: 2055620 - RNA, 22 nt, Human
acagcuuuuaguacccaccuga

SEQ ID NO: 2055621 - RNA, 23 nt, Human
acagcuuuuaguacccaccugag

SEQ ID NO: 2055622 - RNA, 14 nt, Human
acaggaaaaaaacu

SEQ ID NO: 2055623 - RNA, 16 nt, Human
acaggaaaaaaacuuu

SEQ ID NO: 2055624 - RNA, 17 nt, Human
acaggaaaaaaacuuuu

SEQ ID NO: 2055625 - RNA, 22 nt, Human
acaggaaaaaaacuuuuauaaa

SEQ ID NO: 2055626 - RNA, 23 nt, Human
acaggaaaaaaacuuuuauaaau

SEQ ID NO: 2055627 - RNA, 13 nt, Human
acaggcaggucca

SEQ ID NO: 2055628 - RNA, 14 nt, Human
acaggaucagucug

SEQ ID NO: 2055629 - RNA, 16 nt, Human
acaggagugagcacua

SEQ ID NO: 2055630 - RNA, 16 nt, Human
acaggcagguccaggg

SEQ ID NO: 2055631 - RNA, 14 nt, Human
acaggcagguccag

SEQ ID NO: 2055632 - RNA, 14 nt, Human
acaggcauguucuc

SEQ ID NO: 2055633 - RNA, 14 nt, Human
acaggaccagauuu

SEQ ID NO: 2055634 - RNA, 14 nt, Human
acaggacucugccu

SEQ ID NO: 2055635 - RNA, 20 nt, Human
acaggacagugcuucagccu

SEQ ID NO: 2055636 - RNA, 22 nt, Human
acaggacagugcuucagccuga

SEQ ID NO: 2055637 - RNA, 20 nt, Human
acaggacagcauggugcaug

SEQ ID NO: 2055638 - RNA, 22 nt, Human
acaggacagcauggugcaugcc

SEQ ID NO: 2055639 - RNA, 17 nt, Human
acaggacagugcuucag

SEQ ID NO: 2055640 - RNA, 23 nt, Human
acaggcugggcuucaguggcagc

SEQ ID NO: 2055641 - RNA, 22 nt, Human
acaggcugggcuucaguggcag

SEQ ID NO: 2055642 - RNA, 12 nt, Human
acaggcugggcu

SEQ ID NO: 2055643 - RNA, 12 nt, Human
acagggacccac

SEQ ID NO: 2055644 - RNA, 16 nt, Human
acagggagcugggaca

SEQ ID NO: 2055645 - RNA, 12 nt, Human
acaguacaggca

SEQ ID NO: 2055646 - RNA, 20 nt, Human
acaguacaggcagcacagag

SEQ ID NO: 2055647 - RNA, 13 nt, Human
acaguacaggcag

SEQ ID NO: 2055648 - RNA, 14 nt, Human
acaguacaggcagc

SEQ ID NO: 2055649 - RNA, 16 nt, Human
acaguacaggcagcac

SEQ ID NO: 2055650 - RNA, 18 nt, Human
acaguacaggcagcacag

SEQ ID NO: 2055651 - RNA, 20 nt, Human
acagggcacaccgggcacuc

SEQ ID NO: 2055652 - RNA, 12 nt, Human
acagggcacacc

SEQ ID NO: 2055653 - RNA, 15 nt, Human
acaguaccaucugaa

SEQ ID NO: 2055654 - RNA, 17 nt, Human
acagucacaugcuugau

SEQ ID NO: 2055655 - RNA, 22 nt, Human
acagucaaggaguggcuuacua

SEQ ID NO: 2055656 - RNA, 17 nt, Human
acaguagugagaagaau

SEQ ID NO: 2055657 - RNA, 18 nt, Human
acaguagugagaagaaua

SEQ ID NO: 2055658 - RNA, 20 nt, Human
acaguagugagaagaauauu

SEQ ID NO: 2055659 - RNA, 21 nt, Human
acaguagugagaagaauauug

SEQ ID NO: 2055660 - RNA, 18 nt, Human
uauucaccauguaaaaca

SEQ ID NO: 2055661 - RNA, 19 nt, Human
uauucaccauguaaaacaa

SEQ ID NO: 2055662 - RNA, 20 nt, Human
uauucaccauguaaaacaaa

SEQ ID NO: 2055663 - RNA, 18 nt, Human
uauucaauuccucuggga

SEQ ID NO: 2055664 - RNA, 17 nt, Human
uauucaauuccucuggg

SEQ ID NO: 2055665 - RNA, 16 nt, Human
uauucaauuccucugg

SEQ ID NO: 2055666 - RNA, 15 nt, Human
uauucaauuccucug

SEQ ID NO: 2055667 - RNA, 14 nt, Human
uauucaauuccucu

SEQ ID NO: 2055668 - RNA, 14 nt, Human
acaggcucaauauu

SEQ ID NO: 2055669 - RNA, 18 nt, Human
uauucaguugguaagcuu

SEQ ID NO: 2055670 - RNA, 23 nt, Human
uauucaguugguaagcuuccagg

SEQ ID NO: 2055671 - RNA, 21 nt, Human
uauucagugcuguggccuggg

SEQ ID NO: 2055672 - RNA, 16 nt, Human
uauucaguuaagaaaa

SEQ ID NO: 2055673 - RNA, 17 nt, Human
uauucaguuaagaaaaa

SEQ ID NO: 2055674 - RNA, 18 nt, Human
uauucaguuaagaaaaaa

SEQ ID NO: 2055675 - RNA, 21 nt, Human
uauucaguuaagaaaaaaaua

SEQ ID NO: 2055676 - RNA, 14 nt, Human
uauucaguaaaaaa

SEQ ID NO: 2055677 - RNA, 20 nt, Human
uauucaguaauaacucuacc

SEQ ID NO: 2055678 - RNA, 15 nt, Human
uauucagugcugugg

SEQ ID NO: 2055679 - RNA, 18 nt, Human
uauucagugcuguggccu

SEQ ID NO: 2055680 - RNA, 22 nt, Human
uauucagugcuguggccugggc

SEQ ID NO: 2055681 - RNA, 10 nt, Human
uauuaaaauc

SEQ ID NO: 2055682 - RNA, 13 nt, Human
uauuaaaaucuua

SEQ ID NO: 2055683 - RNA, 13 nt, Human
uauuacuucugcu

SEQ ID NO: 2055684 - RNA, 14 nt, Human
uauuacuuauuugg

SEQ ID NO: 2055685 - RNA, 14 nt, Human
uauuacuucugcua

SEQ ID NO: 2055686 - RNA, 18 nt, Human
uauuagucauagaagaac

SEQ ID NO: 2055687 - RNA, 14 nt, Human
uauuagcuuuacug

SEQ ID NO: 2055688 - RNA, 16 nt, Human
uauuagcuuuacuguu

SEQ ID NO: 2055689 - RNA, 14 nt, Human
aauugacuuauuua

SEQ ID NO: 2055690 - RNA, 12 nt, Human
uacuguaguuuu

SEQ ID NO: 2055691 - RNA, 14 nt, Human
uacuguacuuaaua

SEQ ID NO: 2055692 - RNA, 13 nt, Human
uacuguaguuuuu

SEQ ID NO: 2055693 - RNA, 15 nt, Human
uacuguaguuuuucu

SEQ ID NO: 2055694 - RNA, 20 nt, Human
aauugccauguacaguaugu

SEQ ID NO: 2055695 - RNA, 22 nt, Human
aauugaucauuuuccccccacu

SEQ ID NO: 2055696 - RNA, 20 nt, Human
aauugcauuuuuuaaaacaa

SEQ ID NO: 2055697 - RNA, 21 nt, Human
aauugcauuuuuuaaaacaag

SEQ ID NO: 2055698 - RNA, 14 nt, Human
aauugccaaagcug

SEQ ID NO: 2055699 - RNA, 12 nt, Human
aauugcauuucc

SEQ ID NO: 2055700 - RNA, 13 nt, Human
aauugauaauaaa

SEQ ID NO: 2055701 - RNA, 14 nt, Human
aauugauaauaaac

SEQ ID NO: 2055702 - RNA, 15 nt, Human
aauugauaauaaacu

SEQ ID NO: 2055703 - RNA, 22 nt, Human
aauugauaauaaacuguccucu

SEQ ID NO: 2055704 - RNA, 19 nt, Human
aauugaggucugcucggcc

SEQ ID NO: 2055705 - RNA, 12 nt, Human
uacucuguguca

SEQ ID NO: 2055706 - RNA, 17 nt, Human
uacuggaaguuuugcau

SEQ ID NO: 2055707 - RNA, 14 nt, Human
uacuggagaagucu

SEQ ID NO: 2055708 - RNA, 12 nt, Human
uacucuggccuc

SEQ ID NO: 2055709 - RNA, 15 nt, Human
uacucugucagaugg

SEQ ID NO: 2055710 - RNA, 12 nt, Human
uacucugucucc

SEQ ID NO: 2055711 - RNA, 13 nt, Human
uacucugucuccc

SEQ ID NO: 2055712 - RNA, 19 nt, Human
uacucugaagggcaucaug

SEQ ID NO: 2055713 - RNA, 22 nt, Human
uacucugaagggcaucaugcau

SEQ ID NO: 2055714 - RNA, 21 nt, Human
uacucugaaauuguaacuaaa

SEQ ID NO: 2055715 - RNA, 12 nt, Human
uacucugaaggg

SEQ ID NO: 2055716 - RNA, 18 nt, Human
uacuggaaguuuugcauu

SEQ ID NO: 2055717 - RNA, 23 nt, Human
uacuggaaguuuugcauuuaugg

SEQ ID NO: 2055718 - RNA, 23 nt, Human
uacugggaaagggauuuucagcc

SEQ ID NO: 2055719 - RNA, 20 nt, Human
uacuacuguggaaaaauauu

SEQ ID NO: 2055720 - RNA, 22 nt, Human
uacuacuguggaaaaauauuua

SEQ ID NO: 2055721 - RNA, 20 nt, Human
uacuaucaugucaaacguga

SEQ ID NO: 2055722 - RNA, 13 nt, Human
uacuacuccugua

SEQ ID NO: 2055723 - RNA, 17 nt, Human
uacuacuccuguaggaa

SEQ ID NO: 2055724 - RNA, 14 nt, Human
uacuauguaucaau

SEQ ID NO: 2055725 - RNA, 15 nt, Human
uacuauggaguacca

SEQ ID NO: 2055726 - RNA, 22 nt, Human
uacucuccuggaaauauuaaga

SEQ ID NO: 2055727 - RNA, 23 nt, Human
uacucuccuggaaauauuaagaa

SEQ ID NO: 2055728 - RNA, 16 nt, Human
uacuauaucuguuuua

SEQ ID NO: 2055729 - RNA, 20 nt, Human
uacuauaucuguuuuacugc

SEQ ID NO: 2055730 - RNA, 13 nt, Human
uacuauccuggcu

SEQ ID NO: 2055731 - RNA, 20 nt, Human
uacuauccuggcuuugccca

SEQ ID NO: 2055732 - RNA, 12 nt, Human
uacuauguauca

SEQ ID NO: 2055733 - RNA, 13 nt, Human
uacuauguaucaa

SEQ ID NO: 2055734 - RNA, 22 nt, Human
uacgccaggggaaaaucagccu

SEQ ID NO: 2055735 - RNA, 14 nt, Human
aauuccucugggaa

SEQ ID NO: 2055736 - RNA, 13 nt, Human
aauuccucuggga

SEQ ID NO: 2055737 - RNA, 13 nt, Human
aauucccuggacc

SEQ ID NO: 2055738 - RNA, 20 nt, Human
aauuccuagauaaaaagaug

SEQ ID NO: 2055739 - RNA, 23 nt, Human
aauucccuaucuuuuaguuuuag

SEQ ID NO: 2055740 - RNA, 10 nt, Human
aauucccuau

SEQ ID NO: 2055741 - RNA, 22 nt, Human
aauucccuaucuuuuaguuuua

SEQ ID NO: 2055742 - RNA, 13 nt, Human
aauuauucaguua

SEQ ID NO: 2055743 - RNA, 17 nt, Human
aauuauucaguuaagaa

SEQ ID NO: 2055744 - RNA, 18 nt, Human
aauuauucaguuaagaaa

SEQ ID NO: 2055745 - RNA, 20 nt, Human
aauuauucaguuaagaaaaa

SEQ ID NO: 2055746 - RNA, 14 nt, Human
aauuagguuaacua

SEQ ID NO: 2055747 - RNA, 22 nt, Human
aauuagguuaacuauguacaau

SEQ ID NO: 2055748 - RNA, 17 nt, Human
aauuagggguugcuaag

SEQ ID NO: 2055749 - RNA, 20 nt, Human
aauuagggguugcuaagaag

SEQ ID NO: 2055750 - RNA, 16 nt, Human
aauuagguuuuguaca

SEQ ID NO: 2055751 - RNA, 17 nt, Human
aauuagguuuuguacaa

SEQ ID NO: 2055752 - RNA, 17 nt, Human
aauuaguauuuauuuaa

SEQ ID NO: 2055753 - RNA, 18 nt, Human
aauuaguauuuauuuaau

SEQ ID NO: 2055754 - RNA, 12 nt, Human
aauuauuuuaau

SEQ ID NO: 2055755 - RNA, 16 nt, Human
aauuauuuuaauuagg

SEQ ID NO: 2055756 - RNA, 17 nt, Human
aauuauuuuaauuaggu

SEQ ID NO: 2055757 - RNA, 17 nt, Human
aauuauuuuuaauaugu

SEQ ID NO: 2055758 - RNA, 17 nt, Human
aauuauuuuuacaguuc

SEQ ID NO: 2055759 - RNA, 19 nt, Human
aauuauuuuuuuucuuuua

SEQ ID NO: 2055760 - RNA, 16 nt, Human
aauuauuuuuuuucuu

SEQ ID NO: 2055761 - RNA, 13 nt, Human
aauucaaaaaugu

SEQ ID NO: 2055762 - RNA, 14 nt, Human
aauucaaaaaugua

SEQ ID NO: 2055763 - RNA, 16 nt, Human
aauucaaaaauguaca

SEQ ID NO: 2055764 - RNA, 17 nt, Human
aauucaaaaauguacaa

SEQ ID NO: 2055765 - RNA, 22 nt, Human
aauucaaaaauguacaaaauaa

SEQ ID NO: 2055766 - RNA, 17 nt, Human
aauucauucuggucucu

SEQ ID NO: 2055767 - RNA, 15 nt, Human
aauucacaagcugcc

SEQ ID NO: 2055768 - RNA, 16 nt, Human
aauucacaagcugccu

SEQ ID NO: 2055769 - RNA, 18 nt, Human
aauucacaagcugccucc

SEQ ID NO: 2055770 - RNA, 18 nt, Human
aauucaacccuuugcccc

SEQ ID NO: 2055771 - RNA, 14 nt, Human
aauucaacccuuug

SEQ ID NO: 2055772 - RNA, 21 nt, Human
aauucaaccacuguaaaauga

SEQ ID NO: 2055773 - RNA, 14 nt, Human
aauuccaaaggaau

SEQ ID NO: 2055774 - RNA, 13 nt, Human
aauuccacuggac

SEQ ID NO: 2055775 - RNA, 14 nt, Human
aauuccacuggacu

SEQ ID NO: 2055776 - RNA, 22 nt, Human
aauuccacugucaagaaagagc

SEQ ID NO: 2055777 - RNA, 14 nt, Human
aauuccacugucaa

SEQ ID NO: 2055778 - RNA, 21 nt, Human
aauuccacuggacuugagcuu

SEQ ID NO: 2055779 - RNA, 12 nt, Human
aauuccccagau

SEQ ID NO: 2055780 - RNA, 14 nt, Human
aauuccccacccug

SEQ ID NO: 2055781 - RNA, 20 nt, Human
aauuccagaaaggauauuua

SEQ ID NO: 2055782 - RNA, 21 nt, Human
aauucccagcugucuguguca

SEQ ID NO: 2055783 - RNA, 16 nt, Human
aauucccauuuugcaa

SEQ ID NO: 2055784 - RNA, 17 nt, Human
aauucccauuuugcaaa

SEQ ID NO: 2055785 - RNA, 19 nt, Human
aauucccauuuugcaaaau

SEQ ID NO: 2055786 - RNA, 21 nt, Human
aauucccauuuugcaaaauuu

SEQ ID NO: 2055787 - RNA, 22 nt, Human
aauucccauuuugcaaaauuuc

SEQ ID NO: 2055788 - RNA, 15 nt, Human
aauuacuacaaaauu

SEQ ID NO: 2055789 - RNA, 17 nt, Human
aauuacuacaaaauuug

SEQ ID NO: 2055790 - RNA, 15 nt, Human
uaccuguauucccag

SEQ ID NO: 2055791 - RNA, 13 nt, Human
uaccugugaaaua

SEQ ID NO: 2055792 - RNA, 14 nt, Human
aauuagccgggcgu

SEQ ID NO: 2055793 - RNA, 15 nt, Human
aauuagccaagugug

SEQ ID NO: 2055794 - RNA, 16 nt, Human
aauuacuacaaaauuu

SEQ ID NO: 2055795 - RNA, 16 nt, Human
aauuagcugugugaaa

SEQ ID NO: 2055796 - RNA, 17 nt, Human
aauuaggaagugauuau

SEQ ID NO: 2055797 - RNA, 21 nt, Human
aauuaggaaguguaacagcug

SEQ ID NO: 2055798 - RNA, 20 nt, Human
aauuaggaauaaauaaaaau

SEQ ID NO: 2055799 - RNA, 22 nt, Human
aauuaggaaguguaacagcuga

SEQ ID NO: 2055800 - RNA, 17 nt, Human
uacauugcuggucuugu

SEQ ID NO: 2055801 - RNA, 19 nt, Human
uacauugcuggucuuguaa

SEQ ID NO: 2055802 - RNA, 21 nt, Human
uacauugcuggucuuguaaga

SEQ ID NO: 2055803 - RNA, 22 nt, Human
uacauugcuggucuuguaagag

SEQ ID NO: 2055804 - RNA, 10 nt, Human
uaccaccucc

SEQ ID NO: 2055805 - RNA, 14 nt, Human
uaccacucaggcca

SEQ ID NO: 2055806 - RNA, 16 nt, Human
uacauguggcccaaca

SEQ ID NO: 2055807 - RNA, 13 nt, Human
uacaugugggagc

SEQ ID NO: 2055808 - RNA, 13 nt, Human
aauuaaugacaga

SEQ ID NO: 2055809 - RNA, 11 nt, Human
aauuaagaaug

SEQ ID NO: 2055810 - RNA, 16 nt, Human
aauuaagaauguucuc

SEQ ID NO: 2055811 - RNA, 21 nt, Human
aauguucucucuucuccaccu

SEQ ID NO: 2055812 - RNA, 12 nt, Human
aauguucugaca

SEQ ID NO: 2055813 - RNA, 14 nt, Human
aauguucugacauu

SEQ ID NO: 2055814 - RNA, 15 nt, Human
aauguucugacauua

SEQ ID NO: 2055815 - RNA, 17 nt, Human
aauguucugacauuaac

SEQ ID NO: 2055816 - RNA, 19 nt, Human
aauguucugacauuaacag

SEQ ID NO: 2055817 - RNA, 20 nt, Human
aauguucugacauuaacagu

SEQ ID NO: 2055818 - RNA, 12 nt, Human
aauuaaccuggu

SEQ ID NO: 2055819 - RNA, 20 nt, Human
aauuaacauugggaaaucuu

SEQ ID NO: 2055820 - RNA, 18 nt, Human
aauuaaccuggugcugga

SEQ ID NO: 2055821 - RNA, 13 nt, Human
aauuaaccuggug

SEQ ID NO: 2055822 - RNA, 14 nt, Human
aauuaaccuggugc

SEQ ID NO: 2055823 - RNA, 15 nt, Human
aauuaaccuggugcu

SEQ ID NO: 2055824 - RNA, 16 nt, Human
aauuaaccuggugcug

SEQ ID NO: 2055825 - RNA, 14 nt, Human
aauguuaaagucag

SEQ ID NO: 2055826 - RNA, 15 nt, Human
aauguuaaagucagu

SEQ ID NO: 2055827 - RNA, 16 nt, Human
uacaggugugagucac

SEQ ID NO: 2055828 - RNA, 17 nt, Human
uacagauugcugcuucu

SEQ ID NO: 2055829 - RNA, 13 nt, Human
uacauaugaaauu

SEQ ID NO: 2055830 - RNA, 13 nt, Human
uacauaugcuuua

SEQ ID NO: 2055831 - RNA, 14 nt, Human
uacauaugcuuuaa

SEQ ID NO: 2055832 - RNA, 17 nt, Human
uacauaugcuuuaagaa

SEQ ID NO: 2055833 - RNA, 21 nt, Human
uacauaugcuuuaagaaucga

SEQ ID NO: 2055834 - RNA, 15 nt, Human
uacauauguaaaaua

SEQ ID NO: 2055835 - RNA, 16 nt, Human
uacauauguaaaauaa

SEQ ID NO: 2055836 - RNA, 20 nt, Human
uacauauguaaaauaaaauu

SEQ ID NO: 2055837 - RNA, 19 nt, Human
uacagaugucccauuuuca

SEQ ID NO: 2055838 - RNA, 23 nt, Human
uacauacacauauauacacacac

SEQ ID NO: 2055839 - RNA, 14 nt, Human
uacauauauauauu

SEQ ID NO: 2055840 - RNA, 17 nt, Human
uacauauguaaaauaaa

SEQ ID NO: 2055841 - RNA, 14 nt, Human
aauguauuauucug

SEQ ID NO: 2055842 - RNA, 16 nt, Human
aauguauuauucugca

SEQ ID NO: 2055843 - RNA, 19 nt, Human
aaugugaaaagaaaaauga

SEQ ID NO: 2055844 - RNA, 17 nt, Human
aaugugccuaguucuuu

SEQ ID NO: 2055845 - RNA, 19 nt, Human
aaugugcuacugauuguuu

SEQ ID NO: 2055846 - RNA, 13 nt, Human
aaugugcccccag

SEQ ID NO: 2055847 - RNA, 16 nt, Human
aaugugauuuuucuga

SEQ ID NO: 2055848 - RNA, 14 nt, Human
aauguauaaguuga

SEQ ID NO: 2055849 - RNA, 13 nt, Human
aauguauaccugu

SEQ ID NO: 2055850 - RNA, 17 nt, Human
aauguauaccuguaacu

SEQ ID NO: 2055851 - RNA, 20 nt, Human
aauguauaccuguaacugca

SEQ ID NO: 2055852 - RNA, 19 nt, Human
aauguauguguaaguauuc

SEQ ID NO: 2055853 - RNA, 20 nt, Human
aauguauguguaaguauucu

SEQ ID NO: 2055854 - RNA, 13 nt, Human
aauguaucaggaa

SEQ ID NO: 2055855 - RNA, 15 nt, Human
aauguaucaggaaau

SEQ ID NO: 2055856 - RNA, 14 nt, Human
aauguaucaggaaa

SEQ ID NO: 2055857 - RNA, 17 nt, Human
aauguauuauucugcag

SEQ ID NO: 2055858 - RNA, 13 nt, Human
uacagauaggccu

SEQ ID NO: 2055859 - RNA, 17 nt, Human
uacagauaggccuucuu

SEQ ID NO: 2055860 - RNA, 19 nt, Human
uacagauaggccuucuugu

SEQ ID NO: 2055861 - RNA, 20 nt, Human
uacagauaggccuucuugug

SEQ ID NO: 2055862 - RNA, 13 nt, Human
uacagacguaugc

SEQ ID NO: 2055863 - RNA, 17 nt, Human
aauguaagaaucauugu

SEQ ID NO: 2055864 - RNA, 23 nt, Human
aauguaagaaucauuguaaacau

SEQ ID NO: 2055865 - RNA, 15 nt, Human
uacacuaaaagguga

SEQ ID NO: 2055866 - RNA, 14 nt, Human
aauggacucaaacu

SEQ ID NO: 2055867 - RNA, 12 nt, Human
aauggcagccuu

SEQ ID NO: 2055868 - RNA, 17 nt, Human
aauggcacagcccaaag

SEQ ID NO: 2055869 - RNA, 20 nt, Human
aauggcacagcccaaagaag

SEQ ID NO: 2055870 - RNA, 16 nt, Human
aauggcagccuuggca

SEQ ID NO: 2055871 - RNA, 19 nt, Human
aauggcacagcccaaagaa

SEQ ID NO: 2055872 - RNA, 14 nt, Human
aauggccugccuug

SEQ ID NO: 2055873 - RNA, 20 nt, Human
aauggccugccuugaagcca

SEQ ID NO: 2055874 - RNA, 19 nt, Human
aauggcgugaacccgggag

SEQ ID NO: 2055875 - RNA, 22 nt, Human
aauggccugccuugaagccacu

SEQ ID NO: 2055876 - RNA, 22 nt, Human
aaugcuguauuagucacagaga

SEQ ID NO: 2055877 - RNA, 16 nt, Human
aaugcuguugccucau

SEQ ID NO: 2055878 - RNA, 20 nt, Human
aaugcuuaucaucuaaagau

SEQ ID NO: 2055879 - RNA, 21 nt, Human
aaugcuuccugacaaucaacu

SEQ ID NO: 2055880 - RNA, 22 nt, Human
aaugcagcgaaccaauauuugu

SEQ ID NO: 2055881 - RNA, 21 nt, Human
aaugccauggacagaagaagg

SEQ ID NO: 2055882 - RNA, 13 nt, Human
aaugccauucucu

SEQ ID NO: 2055883 - RNA, 19 nt, Human
uaauagcgucauaacuaga

SEQ ID NO: 2055884 - RNA, 14 nt, Human
uaauauuugcugac

SEQ ID NO: 2055885 - RNA, 15 nt, Human
aaucuuauauuccau

SEQ ID NO: 2055886 - RNA, 22 nt, Human
uaaucuuuggguaacuucaaaa

SEQ ID NO: 2055887 - RNA, 20 nt, Human
uaaucccagcuacucaggag

SEQ ID NO: 2055888 - RNA, 12 nt, Human
uaaucuuugggu

SEQ ID NO: 2055889 - RNA, 13 nt, Human
uaaugaaaauguc

SEQ ID NO: 2055890 - RNA, 14 nt, Human
uaaugaaaauguca

SEQ ID NO: 2055891 - RNA, 15 nt, Human
uaaugaaaaugucag

SEQ ID NO: 2055892 - RNA, 17 nt, Human
uaaugaaugaaacauuu

SEQ ID NO: 2055893 - RNA, 15 nt, Human
uaauauuuuuaauua

SEQ ID NO: 2055894 - RNA, 14 nt, Human
uaauauuuuuaauu

SEQ ID NO: 2055895 - RNA, 19 nt, Human
uaaucccagcuacuuggga

SEQ ID NO: 2055896 - RNA, 19 nt, Human
uaaucccagcacuuuggga

SEQ ID NO: 2055897 - RNA, 11 nt, Human
uaaucagccuc

SEQ ID NO: 2055898 - RNA, 20 nt, Human
uaaucagcaagaauuugauc

SEQ ID NO: 2055899 - RNA, 21 nt, Human
uaaucagcaagaauuugaucg

SEQ ID NO: 2055900 - RNA, 13 nt, Human
aaugacacagucu

SEQ ID NO: 2055901 - RNA, 13 nt, Human
aaugaauuuuguu

SEQ ID NO: 2055902 - RNA, 17 nt, Human
aaugaauuuuuaugaua

SEQ ID NO: 2055903 - RNA, 17 nt, Human
aaugaaugcauaaaaug

SEQ ID NO: 2055904 - RNA, 19 nt, Human
aaugaauggacucaaacug

SEQ ID NO: 2055905 - RNA, 13 nt, Human
aaucuuucugcag

SEQ ID NO: 2055906 - RNA, 17 nt, Human
aaugaaacauuuuguca

SEQ ID NO: 2055907 - RNA, 16 nt, Human
aaugaaagacuguaca

SEQ ID NO: 2055908 - RNA, 17 nt, Human
aaugaaagacuguacaa

SEQ ID NO: 2055909 - RNA, 18 nt, Human
uaaugucacaggcagguc

SEQ ID NO: 2055910 - RNA, 15 nt, Human
uaaugucaccaccuu

SEQ ID NO: 2055911 - RNA, 21 nt, Human
uaaugucaccaccuucccagc

SEQ ID NO: 2055912 - RNA, 22 nt, Human
uaaugucaccaccuucccagcu

SEQ ID NO: 2055913 - RNA, 15 nt, Human
uaaugaaugcauaaa

SEQ ID NO: 2055914 - RNA, 15 nt, Human
uaaugaauggacuca

SEQ ID NO: 2055915 - RNA, 15 nt, Human
uaauguacaucuggc

SEQ ID NO: 2055916 - RNA, 13 nt, Human
uaauguacugcau

SEQ ID NO: 2055917 - RNA, 13 nt, Human
uaaugucuuguua

SEQ ID NO: 2055918 - RNA, 14 nt, Human
uaaugucuuguuaa

SEQ ID NO: 2055919 - RNA, 15 nt, Human
uaaugucuuguuaau

SEQ ID NO: 2055920 - RNA, 20 nt, Human
uaaugucuuguuaauauucu

SEQ ID NO: 2055921 - RNA, 22 nt, Human
uaaugucuuguuaauauucuuu

SEQ ID NO: 2055922 - RNA, 17 nt, Human
uaaugugggaagaaaca

SEQ ID NO: 2055923 - RNA, 18 nt, Human
uaaugugggaagaaacaa

SEQ ID NO: 2055924 - RNA, 22 nt, Human
uaaugugggaagaaacaaaccc

SEQ ID NO: 2055925 - RNA, 11 nt, Human
uaauguuacug

SEQ ID NO: 2055926 - RNA, 14 nt, Human
uaauguuacugauc

SEQ ID NO: 2055927 - RNA, 12 nt, Human
uaauguuacuga

SEQ ID NO: 2055928 - RNA, 13 nt, Human
uaauguuacugau

SEQ ID NO: 2055929 - RNA, 21 nt, Human
aauccuggggaacauagaacu

SEQ ID NO: 2055930 - RNA, 14 nt, Human
aauccuggggaaca

SEQ ID NO: 2055931 - RNA, 15 nt, Human
aauccuaaaagaagc

SEQ ID NO: 2055932 - RNA, 15 nt, Human
aauccuguccucagc

SEQ ID NO: 2055933 - RNA, 18 nt, Human
aauccuguccucagcuuc

SEQ ID NO: 2055934 - RNA, 21 nt, Human
aauccuguccucagcuucuua

SEQ ID NO: 2055935 - RNA, 18 nt, Human
aaucgaggaaccagagcc

SEQ ID NO: 2055936 - RNA, 20 nt, Human
aaucgaugggggaugcuuca

SEQ ID NO: 2055937 - RNA, 21 nt, Human
aaucgaugggggaugcuucau

SEQ ID NO: 2055938 - RNA, 23 nt, Human
aaucgcuccaccuugcagcucuc

SEQ ID NO: 2055939 - RNA, 13 nt, Human
aaucgauggggga

SEQ ID NO: 2055940 - RNA, 17 nt, Human
aaucgaggaaccagagc

SEQ ID NO: 2055941 - RNA, 19 nt, Human
aaucgaggaaccagagcca

SEQ ID NO: 2055942 - RNA, 14 nt, Human
aauccugugugguu

SEQ ID NO: 2055943 - RNA, 21 nt, Human
aauccugugugguuuagugua

SEQ ID NO: 2055944 - RNA, 22 nt, Human
aauccugugugguuuaguguaa

SEQ ID NO: 2055945 - RNA, 23 nt, Human
aauccugugugguuuaguguaaa

SEQ ID NO: 2055946 - RNA, 14 nt, Human
aauccuguugaaaa

SEQ ID NO: 2055947 - RNA, 16 nt, Human
aauccuguugaaaagc

SEQ ID NO: 2055948 - RNA, 20 nt, Human
aauccuuuuucuuuauaaac

SEQ ID NO: 2055949 - RNA, 21 nt, Human
aauccgaccacuaauugccaa

SEQ ID NO: 2055950 - RNA, 12 nt, Human
aaucauuauuua

SEQ ID NO: 2055951 - RNA, 19 nt, Human
aaucauuauuuauuaaauu

SEQ ID NO: 2055952 - RNA, 20 nt, Human
aaucauuauuuauuaaauuu

SEQ ID NO: 2055953 - RNA, 22 nt, Human
aaucauuauuuauuaaauuuuu

SEQ ID NO: 2055954 - RNA, 17 nt, Human
aaucauuaagacaacug

SEQ ID NO: 2055955 - RNA, 18 nt, Human
aaucuguguagacgaagg

SEQ ID NO: 2055956 - RNA, 16 nt, Human
aaucuuagcugccaag

SEQ ID NO: 2055957 - RNA, 19 nt, Human
aaucuuaggggagagcuuu

SEQ ID NO: 2055958 - RNA, 12 nt, Human
aaucuaagggaa

SEQ ID NO: 2055959 - RNA, 13 nt, Human
aaucuaagggaaa

SEQ ID NO: 2055960 - RNA, 20 nt, Human
uaauaaacuguccucuuuca

SEQ ID NO: 2055961 - RNA, 14 nt, Human
uaauaaacuguguu

SEQ ID NO: 2055962 - RNA, 15 nt, Human
uaauaaacuguguuu

SEQ ID NO: 2055963 - RNA, 19 nt, Human
aaucauaguacucuuugua

SEQ ID NO: 2055964 - RNA, 22 nt, Human
aaucauaguacucuuuguagca

SEQ ID NO: 2055965 - RNA, 16 nt, Human
aaucaugaaauaugca

SEQ ID NO: 2055966 - RNA, 17 nt, Human
aaucaugaaauaugcau

SEQ ID NO: 2055967 - RNA, 22 nt, Human
uaauaaacauccuucaagaacu

SEQ ID NO: 2055968 - RNA, 12 nt, Human
uaauaaacucau

SEQ ID NO: 2055969 - RNA, 15 nt, Human
uaaguugaggcauuu

SEQ ID NO: 2055970 - RNA, 17 nt, Human
uaaguugaauggccugc

SEQ ID NO: 2055971 - RNA, 14 nt, Human
uaaguucuuagaua

SEQ ID NO: 2055972 - RNA, 17 nt, Human
uaaguucuuagauaucu

SEQ ID NO: 2055973 - RNA, 19 nt, Human
uaaguucuuagauaucuuu

SEQ ID NO: 2055974 - RNA, 20 nt, Human
uaaguucuuagauaucuuuu

SEQ ID NO: 2055975 - RNA, 16 nt, Human
uaaguuggcuucuguu

SEQ ID NO: 2055976 - RNA, 20 nt, Human
uaaguuggcuucuguuucua

SEQ ID NO: 2055977 - RNA, 22 nt, Human
uaaguuggcuucuguuucuagu

SEQ ID NO: 2055978 - RNA, 13 nt, Human
uaaguacuaugua

SEQ ID NO: 2055979 - RNA, 16 nt, Human
uaaguacuauguauca

SEQ ID NO: 2055980 - RNA, 17 nt, Human
uaaguacuauguaucaa

SEQ ID NO: 2055981 - RNA, 19 nt, Human
uaaguacuauguaucaaug

SEQ ID NO: 2055982 - RNA, 20 nt, Human
uaaguauucuuauuuaauga

SEQ ID NO: 2055983 - RNA, 14 nt, Human
uaaguauucaagaa

SEQ ID NO: 2055984 - RNA, 16 nt, Human
uaaguauucaagaaag

SEQ ID NO: 2055985 - RNA, 19 nt, Human
uaaguauucuuauuuaaug

SEQ ID NO: 2055986 - RNA, 14 nt, Human
uaaguaaaugucug

SEQ ID NO: 2055987 - RNA, 16 nt, Human
uaaguaaaugucugug

SEQ ID NO: 2055988 - RNA, 12 nt, Human
uaaguaaacuaa

SEQ ID NO: 2055989 - RNA, 14 nt, Human
uaaguaaacuaaug

SEQ ID NO: 2055990 - RNA, 13 nt, Human
uaaguaaacugcc

SEQ ID NO: 2055991 - RNA, 16 nt, Human
uaagcuuaaaaaaaac

SEQ ID NO: 2055992 - RNA, 17 nt, Human
uaagcuuaaaaaaaacu

SEQ ID NO: 2055993 - RNA, 16 nt, Human
uaagcuuaugucagac

SEQ ID NO: 2055994 - RNA, 14 nt, Human
uaagcuuauuuaau

SEQ ID NO: 2055995 - RNA, 18 nt, Human
uaagcuuauuuaauuaaa

SEQ ID NO: 2055996 - RNA, 16 nt, Human
uaagcuuccaggaaaa

SEQ ID NO: 2055997 - RNA, 17 nt, Human
uaagcuuccaggaaaaa

SEQ ID NO: 2055998 - RNA, 20 nt, Human
uaagcuuccaggaaaaagga

SEQ ID NO: 2055999 - RNA, 22 nt, Human
uaagcuuccaggaaaaaggaca

SEQ ID NO: 2056000 - RNA, 22 nt, Human
uaagcuuccaggcugcauagaa

SEQ ID NO: 2056001 - RNA, 23 nt, Human
uaagcuuccaggcugcauagaag

SEQ ID NO: 2056002 - RNA, 17 nt, Human
uaaggaaaaaaagacaa

SEQ ID NO: 2056003 - RNA, 18 nt, Human
uaacauggugugcuucuu

SEQ ID NO: 2056004 - RNA, 12 nt, Human
uaacuagaacug

SEQ ID NO: 2056005 - RNA, 14 nt, Human
uaacuagaacugaa

SEQ ID NO: 2056006 - RNA, 16 nt, Human
uaacgaaguugggcaa

SEQ ID NO: 2056007 - RNA, 19 nt, Human
uaacgaaguugggcaauau

SEQ ID NO: 2056008 - RNA, 14 nt, Human
uaacgacuucaggg

SEQ ID NO: 2056009 - RNA, 23 nt, Human
uaacgacuucagggcagggcucu

SEQ ID NO: 2056010 - RNA, 17 nt, Human
uaacuagaacugaauuu

SEQ ID NO: 2056011 - RNA, 20 nt, Human
uaacuagaacugaauuuugu

SEQ ID NO: 2056012 - RNA, 18 nt, Human
uaacuagaauuuauucaa

SEQ ID NO: 2056013 - RNA, 17 nt, Human
uaacuagaauuuauuca

SEQ ID NO: 2056014 - RNA, 15 nt, Human
uaacuagaauuuauu

SEQ ID NO: 2056015 - RNA, 17 nt, Human
uaacuuccaauuuacau

SEQ ID NO: 2056016 - RNA, 16 nt, Human
uaacuuaauaguauuu

SEQ ID NO: 2056017 - RNA, 16 nt, Human
uaacuuaaaauauuuu

SEQ ID NO: 2056018 - RNA, 18 nt, Human
uaacuuaaaaaaaugaca

SEQ ID NO: 2056019 - RNA, 15 nt, Human
uaacuuuggguuaaa

SEQ ID NO: 2056020 - RNA, 19 nt, Human
uaagacagucccaucaaaa

SEQ ID NO: 2056021 - RNA, 20 nt, Human
uaagacauacuccuuccauc

SEQ ID NO: 2056022 - RNA, 16 nt, Human
uaacuuggagccccag

SEQ ID NO: 2056023 - RNA, 15 nt, Human
uaacuuuaucacauu

SEQ ID NO: 2056024 - RNA, 17 nt, Human
uaacuuuaucacauuau

SEQ ID NO: 2056025 - RNA, 21 nt, Human
uaacuuuaucacauuauuugc

SEQ ID NO: 2056026 - RNA, 19 nt, Human
uaacuuucauuaaagcauu

SEQ ID NO: 2056027 - RNA, 23 nt, Human
uaacuuucauuaaagcauuuacu

SEQ ID NO: 2056028 - RNA, 13 nt, Human
uaacuuucagaag

SEQ ID NO: 2056029 - RNA, 23 nt, Human
uaacuuucagaagagaugggcuu

SEQ ID NO: 2056030 - RNA, 22 nt, Human
uaacuugagaguagaugguuug

SEQ ID NO: 2056031 - RNA, 21 nt, Human
aauagugguucuuggaaaaau

SEQ ID NO: 2056032 - RNA, 16 nt, Human
uaacagugugguaguu

SEQ ID NO: 2056033 - RNA, 14 nt, Human
uaacagugccauug

SEQ ID NO: 2056034 - RNA, 17 nt, Human
uaacagugccauugucu

SEQ ID NO: 2056035 - RNA, 18 nt, Human
uaacagugccauugucuu

SEQ ID NO: 2056036 - RNA, 19 nt, Human
uaacagugccauugucuuu

SEQ ID NO: 2056037 - RNA, 20 nt, Human
uaacagugccauugucuuua

SEQ ID NO: 2056038 - RNA, 21 nt, Human
uaacagugccauugucuuuau

SEQ ID NO: 2056039 - RNA, 22 nt, Human
uaacagugccauugucuuuaua

SEQ ID NO: 2056040 - RNA, 23 nt, Human
uaacagugccauugucuuuauau

SEQ ID NO: 2056041 - RNA, 21 nt, Human
aauaucaguuacucagcccug

SEQ ID NO: 2056042 - RNA, 19 nt, Human
uaacagucuuacugcaggc

SEQ ID NO: 2056043 - RNA, 19 nt, Human
aauaucaguuacucagccc

SEQ ID NO: 2056044 - RNA, 22 nt, Human
aauaucaguuacucagcccugg

SEQ ID NO: 2056045 - RNA, 21 nt, Human
uaacaguucacuugcagugga

SEQ ID NO: 2056046 - RNA, 13 nt, Human
uaacaguuuucca

SEQ ID NO: 2056047 - RNA, 14 nt, Human
uaacaguuuuccau

SEQ ID NO: 2056048 - RNA, 15 nt, Human
uaacaguuuuccaug

SEQ ID NO: 2056049 - RNA, 16 nt, Human
uaacaguuuuccauga

SEQ ID NO: 2056050 - RNA, 17 nt, Human
uaacaguuuuccaugaa

SEQ ID NO: 2056051 - RNA, 19 nt, Human
uaacaguuuuccaugaaaa

SEQ ID NO: 2056052 - RNA, 21 nt, Human
uaacaguuuuccaugaaaacg

SEQ ID NO: 2056053 - RNA, 15 nt, Human
aauaucagacuagug

SEQ ID NO: 2056054 - RNA, 20 nt, Human
uaacaguuuuccaugaaaac

SEQ ID NO: 2056055 - RNA, 13 nt, Human
uaacauauaauau

SEQ ID NO: 2056056 - RNA, 20 nt, Human
uaacauauaauauauguuuu

SEQ ID NO: 2056057 - RNA, 23 nt, Human
uaacauccaauaggaaugcuaac

SEQ ID NO: 2056058 - RNA, 24 nt, Human
uaacauccaauaggaaugcuaaca

SEQ ID NO: 2056059 - RNA, 23 nt, Human
uaacauggacaugaucuucuuua

SEQ ID NO: 2056060 - RNA, 17 nt, Human
uaacauguaauuaagua

SEQ ID NO: 2056061 - RNA, 18 nt, Human
uaacauggacaugaucuu

SEQ ID NO: 2056062 - RNA, 16 nt, Human
uaacaucuucuuuccu

SEQ ID NO: 2056063 - RNA, 13 nt, Human
aauaguuggcuag

SEQ ID NO: 2056064 - RNA, 14 nt, Human
aauaguguguucug

SEQ ID NO: 2056065 - RNA, 15 nt, Human
aauaguguguucuga

SEQ ID NO: 2056066 - RNA, 17 nt, Human
aauaguguguucugauu

SEQ ID NO: 2056067 - RNA, 13 nt, Human
aauaguguguucu

SEQ ID NO: 2056068 - RNA, 14 nt, Human
aauaguuguugauu

SEQ ID NO: 2056069 - RNA, 23 nt, Human
uaaaauuuauugcuugauacuuu

SEQ ID NO: 2056070 - RNA, 12 nt, Human
aauauuccagag

SEQ ID NO: 2056071 - RNA, 20 nt, Human
aauauuccccuaucucuaga

SEQ ID NO: 2056072 - RNA, 12 nt, Human
aauauuccugaa

SEQ ID NO: 2056073 - RNA, 15 nt, Human
aauauuccugcauuu

SEQ ID NO: 2056074 - RNA, 15 nt, Human
aauauuccugaauga

SEQ ID NO: 2056075 - RNA, 20 nt, Human
aauaugcaucuaauaaaaaa

SEQ ID NO: 2056076 - RNA, 18 nt, Human
uaagagaagcuacuuugu

SEQ ID NO: 2056077 - RNA, 17 nt, Human
uaagagaaaauguaaau

SEQ ID NO: 2056078 - RNA, 14 nt, Human
uaagagaauguuau

SEQ ID NO: 2056079 - RNA, 23 nt, Human
uaagagaauguuauagugaauua

SEQ ID NO: 2056080 - RNA, 14 nt, Human
aauauuguacaguu

SEQ ID NO: 2056081 - RNA, 20 nt, Human
aauauugagaaagaaacuaa

SEQ ID NO: 2056082 - RNA, 16 nt, Human
aauauugagaaagaaa

SEQ ID NO: 2056083 - RNA, 19 nt, Human
aauauugagaaagaaacua

SEQ ID NO: 2056084 - RNA, 14 nt, Human
aauauucuuucaau

SEQ ID NO: 2056085 - RNA, 19 nt, Human
aauauucuuucaauaacga

SEQ ID NO: 2056086 - RNA, 15 nt, Human
aauauuguacaguuu

SEQ ID NO: 2056087 - RNA, 17 nt, Human
aauauuguacaguuuuu

SEQ ID NO: 2056088 - RNA, 23 nt, Human
aauauuguacaguuuuuauugcu

SEQ ID NO: 2056089 - RNA, 23 nt, Human
aauauugugaagaaaaauaaagu

SEQ ID NO: 2056090 - RNA, 17 nt, Human
aauauuuaagauaguuu

SEQ ID NO: 2056091 - RNA, 16 nt, Human
aauauuuaaggagaug

SEQ ID NO: 2056092 - RNA, 17 nt, Human
aauauuuaaggagaugu

SEQ ID NO: 2056093 - RNA, 22 nt, Human
aauauuuaaggagauguaagag

SEQ ID NO: 2056094 - RNA, 15 nt, Human
aauauuuacauauga

SEQ ID NO: 2056095 - RNA, 15 nt, Human
uaagauggauucuca

SEQ ID NO: 2056096 - RNA, 17 nt, Human
uaagauggauucucaga

SEQ ID NO: 2056097 - RNA, 18 nt, Human
uaagauggauucucagau

SEQ ID NO: 2056098 - RNA, 20 nt, Human
uaagauggauucucagauau

SEQ ID NO: 2056099 - RNA, 22 nt, Human
uaagauggauucucagauauuu

SEQ ID NO: 2056100 - RNA, 21 nt, Human
uaagauuccagagaguggcuc

SEQ ID NO: 2056101 - RNA, 14 nt, Human
uaagauuccuuuuc

SEQ ID NO: 2056102 - RNA, 16 nt, Human
uaagauuccuuuucuu

SEQ ID NO: 2056103 - RNA, 14 nt, Human
uaagauuccagaga

SEQ ID NO: 2056104 - RNA, 11 nt, Human
aauauuuauaa

SEQ ID NO: 2056105 - RNA, 16 nt, Human
uaagaugugucuucaa

SEQ ID NO: 2056106 - RNA, 21 nt, Human
uaagauggauucucagauauu

SEQ ID NO: 2056107 - RNA, 19 nt, Human
aauauuugucgauauuucc

SEQ ID NO: 2056108 - RNA, 20 nt, Human
aauauuugucgauauuucca

SEQ ID NO: 2056109 - RNA, 22 nt, Human
aauauuugucgauauuuccauc

SEQ ID NO: 2056110 - RNA, 12 nt, Human
aauauuugcuga

SEQ ID NO: 2056111 - RNA, 13 nt, Human
uaagcaagagaga

SEQ ID NO: 2056112 - RNA, 18 nt, Human
uaagcaagagagauguuu

SEQ ID NO: 2056113 - RNA, 22 nt, Human
uaagcuguuacugucuucagua

SEQ ID NO: 2056114 - RNA, 16 nt, Human
uaagcuguuuccauag

SEQ ID NO: 2056115 - RNA, 11 nt, Human
uaagcuguuuc

SEQ ID NO: 2056116 - RNA, 12 nt, Human
uaagcugcuuuu

SEQ ID NO: 2056117 - RNA, 16 nt, Human
uaagauuuauuuuguu

SEQ ID NO: 2056118 - RNA, 23 nt, Human
uaagcaacaucuagcaaauguua

SEQ ID NO: 2056119 - RNA, 23 nt, Human
uaagcaaagggagcacuggguug

SEQ ID NO: 2056120 - RNA, 14 nt, Human
uaagauuuaauuug

SEQ ID NO: 2056121 - RNA, 17 nt, Human
uaagauuuaauuugcca

SEQ ID NO: 2056122 - RNA, 18 nt, Human
uaagauuuaauuugccaa

SEQ ID NO: 2056123 - RNA, 21 nt, Human
uaagauuuaauuugccaaaau

SEQ ID NO: 2056124 - RNA, 12 nt, Human
uaagauuuaccc

SEQ ID NO: 2056125 - RNA, 13 nt, Human
uaagauuuaccca

SEQ ID NO: 2056126 - RNA, 22 nt, Human
uaagauuuacccagaaugucag

SEQ ID NO: 2056127 - RNA, 19 nt, Human
uaagauuuagagaugaauu

SEQ ID NO: 2056128 - RNA, 13 nt, Human
uaagauuuugaaa

SEQ ID NO: 2056129 - RNA, 17 nt, Human
uaagauuuugaaaacua

SEQ ID NO: 2056130 - RNA, 22 nt, Human
uaagauuuugaaaacuacauuu

SEQ ID NO: 2056131 - RNA, 21 nt, Human
ucaccauguuggccaggcugg

SEQ ID NO: 2056132 - RNA, 15 nt, Human
ucacccacagggcua

SEQ ID NO: 2056133 - RNA, 22 nt, Human
ucacccacagggcuaagagcua

SEQ ID NO: 2056134 - RNA, 15 nt, Human
ucacccacagaaaga

SEQ ID NO: 2056135 - RNA, 16 nt, Human
ucacccacagaaagag

SEQ ID NO: 2056136 - RNA, 17 nt, Human
ucacccacagaaagaga

SEQ ID NO: 2056137 - RNA, 11 nt, Human
ucacccacagg

SEQ ID NO: 2056138 - RNA, 12 nt, Human
ucacccacaggg

SEQ ID NO: 2056139 - RNA, 14 nt, Human
ucacccacagggcu

SEQ ID NO: 2056140 - RNA, 16 nt, Human
ucacccagacagcucc

SEQ ID NO: 2056141 - RNA, 17 nt, Human
ucacccagacagcuccc

SEQ ID NO: 2056142 - RNA, 19 nt, Human
ucaccccaucccacacccu

SEQ ID NO: 2056143 - RNA, 19 nt, Human
ucacccccaaggggcaguc

SEQ ID NO: 2056144 - RNA, 13 nt, Human
ucacccccaaggg

SEQ ID NO: 2056145 - RNA, 15 nt, Human
ucaccauguuggcca

SEQ ID NO: 2056146 - RNA, 16 nt, Human
ucaccauguaaaacaa

SEQ ID NO: 2056147 - RNA, 17 nt, Human
ucaccauguaaaacaaa

SEQ ID NO: 2056148 - RNA, 19 nt, Human
ucaccauguaaaacaaaaa

SEQ ID NO: 2056149 - RNA, 20 nt, Human
ucaccauguaaaacaaaaaa

SEQ ID NO: 2056150 - RNA, 21 nt, Human
ucaccauguaaaacaaaaaac

SEQ ID NO: 2056151 - RNA, 23 nt, Human
ucaccauguaaaacaaaaaacaa

SEQ ID NO: 2056152 - RNA, 14 nt, Human
ucacauagugaaag

SEQ ID NO: 2056153 - RNA, 16 nt, Human
ucacauagugaaaguu

SEQ ID NO: 2056154 - RNA, 17 nt, Human
ucaccaucucaggccac

SEQ ID NO: 2056155 - RNA, 21 nt, Human
ucaccaucucaggccaccugc

SEQ ID NO: 2056156 - RNA, 23 nt, Human
ucaccaucucaggccaccugccc

SEQ ID NO: 2056157 - RNA, 16 nt, Human
ucacauagaugucccu

SEQ ID NO: 2056158 - RNA, 17 nt, Human
ucacauagaugucccuu

SEQ ID NO: 2056159 - RNA, 18 nt, Human
ucacauacaauuauuuuu

SEQ ID NO: 2056160 - RNA, 17 nt, Human
ucacauagagugaucuu

SEQ ID NO: 2056161 - RNA, 15 nt, Human
ucacauagauguccc

SEQ ID NO: 2056162 - RNA, 18 nt, Human
ucacauaaaauagauuuu

SEQ ID NO: 2056163 - RNA, 15 nt, Human
ucacauaacagaaug

SEQ ID NO: 2056164 - RNA, 16 nt, Human
ucacauaacagaaugc

SEQ ID NO: 2056165 - RNA, 14 nt, Human
accacagcccuguc

SEQ ID NO: 2056166 - RNA, 15 nt, Human
accacagcccuguca

SEQ ID NO: 2056167 - RNA, 16 nt, Human
accacagcccugucag

SEQ ID NO: 2056168 - RNA, 17 nt, Human
accacagcccugucagu

SEQ ID NO: 2056169 - RNA, 13 nt, Human
accacagcccugu

SEQ ID NO: 2056170 - RNA, 19 nt, Human
accacaucuugcucugcug

SEQ ID NO: 2056171 - RNA, 18 nt, Human
accacaucuugcucugcu

SEQ ID NO: 2056172 - RNA, 22 nt, Human
accacaggguucaaaaugucug

SEQ ID NO: 2056173 - RNA, 23 nt, Human
accacaggguucaaaaugucugu

SEQ ID NO: 2056174 - RNA, 17 nt, Human
accacaggguucaaaau

SEQ ID NO: 2056175 - RNA, 17 nt, Human
accacaucuugcucugc

SEQ ID NO: 2056176 - RNA, 22 nt, Human
accacagguucaugccaccaug

SEQ ID NO: 2056177 - RNA, 18 nt, Human
accacaugugcacaugca

SEQ ID NO: 2056178 - RNA, 20 nt, Human
accaccacacccagcccacu

SEQ ID NO: 2056179 - RNA, 15 nt, Human
accaccacacccagc

SEQ ID NO: 2056180 - RNA, 14 nt, Human
accaaagccaccag

SEQ ID NO: 2056181 - RNA, 11 nt, Human
accaaagcuga

SEQ ID NO: 2056182 - RNA, 21 nt, Human
accaaagcugacgaggcuggg

SEQ ID NO: 2056183 - RNA, 23 nt, Human
accaaagcugacgaggcugggcc

SEQ ID NO: 2056184 - RNA, 22 nt, Human
ucacaaaauuuuauuccuauau

SEQ ID NO: 2056185 - RNA, 14 nt, Human
ucacaaaauuuuau

SEQ ID NO: 2056186 - RNA, 20 nt, Human
ucaauuuauucaagaaaagu

SEQ ID NO: 2056187 - RNA, 16 nt, Human
ucaauuuauugcacaa

SEQ ID NO: 2056188 - RNA, 17 nt, Human
ucaauuuauugcacaaa

SEQ ID NO: 2056189 - RNA, 23 nt, Human
ucaauuuauugcacaaaauauaa

SEQ ID NO: 2056190 - RNA, 13 nt, Human
ucaauuuccaaga

SEQ ID NO: 2056191 - RNA, 18 nt, Human
ucaauuuccaagagcuga

SEQ ID NO: 2056192 - RNA, 20 nt, Human
ucaauuuccaagagcugagg

SEQ ID NO: 2056193 - RNA, 16 nt, Human
ucaauuuguauaaaau

SEQ ID NO: 2056194 - RNA, 13 nt, Human
ucaauuugucauu

SEQ ID NO: 2056195 - RNA, 14 nt, Human
ucaauuugucauuu

SEQ ID NO: 2056196 - RNA, 15 nt, Human
ucaauuugucauuuu

SEQ ID NO: 2056197 - RNA, 17 nt, Human
ucaauuugucauuuuga

SEQ ID NO: 2056198 - RNA, 18 nt, Human
ucaauuugucauuuugaa

SEQ ID NO: 2056199 - RNA, 20 nt, Human
ucaauuugucauuuugaagc

SEQ ID NO: 2056200 - RNA, 21 nt, Human
ucaauuuguucagucuuucau

SEQ ID NO: 2056201 - RNA, 14 nt, Human
ucacaaccuucugu

SEQ ID NO: 2056202 - RNA, 13 nt, Human
ucacaacccaucu

SEQ ID NO: 2056203 - RNA, 12 nt, Human
ucacaaaggaau

SEQ ID NO: 2056204 - RNA, 21 nt, Human
ucacaaaggaauggaggcucu

SEQ ID NO: 2056205 - RNA, 18 nt, Human
ucacacugcaagagccuu

SEQ ID NO: 2056206 - RNA, 21 nt, Human
ucacacugcaagagccuuggu

SEQ ID NO: 2056207 - RNA, 18 nt, Human
ucacacuuccaccagccu

SEQ ID NO: 2056208 - RNA, 19 nt, Human
ucacacuuccaccagccug

SEQ ID NO: 2056209 - RNA, 16 nt, Human
ucacacuucugugaga

SEQ ID NO: 2056210 - RNA, 20 nt, Human
ucacacugcaagagccuugg

SEQ ID NO: 2056211 - RNA, 21 nt, Human
ucacagaugugugauucacag

SEQ ID NO: 2056212 - RNA, 22 nt, Human
ucacacuucugugagaccccca

SEQ ID NO: 2056213 - RNA, 23 nt, Human
ucacacuucugugagacccccac

SEQ ID NO: 2056214 - RNA, 23 nt, Human
ucacagaugugugauucacagug

SEQ ID NO: 2056215 - RNA, 20 nt, Human
ucacacuuccaccagccugc

SEQ ID NO: 2056216 - RNA, 16 nt, Human
ucacagcacacucagc

SEQ ID NO: 2056217 - RNA, 13 nt, Human
ucacagccucuga

SEQ ID NO: 2056218 - RNA, 19 nt, Human
ucacguaaagcuagaaaug

SEQ ID NO: 2056219 - RNA, 20 nt, Human
ucacguaaagcuagaaauga

SEQ ID NO: 2056220 - RNA, 13 nt, Human
ucacgucacacuu

SEQ ID NO: 2056221 - RNA, 12 nt, Human
ucacguguguga

SEQ ID NO: 2056222 - RNA, 16 nt, Human
ucacgugugugacuca

SEQ ID NO: 2056223 - RNA, 17 nt, Human
ucacgugugugacucag

SEQ ID NO: 2056224 - RNA, 23 nt, Human
accaccacuuaugccccuagaag

SEQ ID NO: 2056225 - RNA, 12 nt, Human
ucacuaacauua

SEQ ID NO: 2056226 - RNA, 14 nt, Human
ucacuaacauuaua

SEQ ID NO: 2056227 - RNA, 15 nt, Human
ucacuaacauuauau

SEQ ID NO: 2056228 - RNA, 16 nt, Human
ucacuaacauuauauu

SEQ ID NO: 2056229 - RNA, 19 nt, Human
ucacuaacauuauauugca

SEQ ID NO: 2056230 - RNA, 21 nt, Human
ucacuaacauuauauugcaau

SEQ ID NO: 2056231 - RNA, 22 nt, Human
ucacuaacauuauauugcaaug

SEQ ID NO: 2056232 - RNA, 18 nt, Human
ucacguaaagcuagaaau

SEQ ID NO: 2056233 - RNA, 19 nt, Human
ucaccuggggugugggagg

SEQ ID NO: 2056234 - RNA, 13 nt, Human
ucaccuguaaaac

SEQ ID NO: 2056235 - RNA, 14 nt, Human
ucaccuguaaaacu

SEQ ID NO: 2056236 - RNA, 16 nt, Human
ucaccuguaaaacuuu

SEQ ID NO: 2056237 - RNA, 17 nt, Human
ucaccuguaaaacuuua

SEQ ID NO: 2056238 - RNA, 18 nt, Human
ucaccuguaaaacuuuau

SEQ ID NO: 2056239 - RNA, 19 nt, Human
ucaccuguaaaacuuuauu

SEQ ID NO: 2056240 - RNA, 14 nt, Human
accaggacucccuc

SEQ ID NO: 2056241 - RNA, 15 nt, Human
accaggacucccucc

SEQ ID NO: 2056242 - RNA, 16 nt, Human
accaggacucccuccu

SEQ ID NO: 2056243 - RNA, 20 nt, Human
ucaccugggcaccuggggag

SEQ ID NO: 2056244 - RNA, 22 nt, Human
accagcgugugacuacuccccc

SEQ ID NO: 2056245 - RNA, 15 nt, Human
accacuaugaagcua

SEQ ID NO: 2056246 - RNA, 17 nt, Human
accacuaggacucugag

SEQ ID NO: 2056247 - RNA, 13 nt, Human
accacuagaacuc

SEQ ID NO: 2056248 - RNA, 20 nt, Human
accacuagaacucuccaucu

SEQ ID NO: 2056249 - RNA, 16 nt, Human
accagcuuagauuuua

SEQ ID NO: 2056250 - RNA, 20 nt, Human
accaggaauguuaaagucag

SEQ ID NO: 2056251 - RNA, 17 nt, Human
accaggacaggaccaga

SEQ ID NO: 2056252 - RNA, 14 nt, Human
accaggacaggacc

SEQ ID NO: 2056253 - RNA, 15 nt, Human
accaggacaggacca

SEQ ID NO: 2056254 - RNA, 14 nt, Human
ucacugcagccucg

SEQ ID NO: 2056255 - RNA, 15 nt, Human
ucacugcagccucga

SEQ ID NO: 2056256 - RNA, 15 nt, Human
ucacugcagccucaa

SEQ ID NO: 2056257 - RNA, 23 nt, Human
ucacuguugcccaggcuggcgug

SEQ ID NO: 2056258 - RNA, 14 nt, Human
ucacugcagccuca

SEQ ID NO: 2056259 - RNA, 13 nt, Human
ucacuauaaaugg

SEQ ID NO: 2056260 - RNA, 22 nt, Human
ucacuacccaucgguguccauu

SEQ ID NO: 2056261 - RNA, 17 nt, Human
ucacuauaaaugguguu

SEQ ID NO: 2056262 - RNA, 13 nt, Human
ucacuaugcauuu

SEQ ID NO: 2056263 - RNA, 15 nt, Human
ucacuaugcauuuua

SEQ ID NO: 2056264 - RNA, 13 nt, Human
accagucugaagu

SEQ ID NO: 2056265 - RNA, 14 nt, Human
accagucugaaguu

SEQ ID NO: 2056266 - RNA, 19 nt, Human
accagucugaaguuucauu

SEQ ID NO: 2056267 - RNA, 21 nt, Human
accagucugaaguuucauuua

SEQ ID NO: 2056268 - RNA, 23 nt, Human
accagucugaaguuucauuuaug

SEQ ID NO: 2056269 - RNA, 18 nt, Human
accaguauacaagauaag

SEQ ID NO: 2056270 - RNA, 19 nt, Human
accagucaucagcuauuca

SEQ ID NO: 2056271 - RNA, 10 nt, Human
ucacuugagu

SEQ ID NO: 2056272 - RNA, 22 nt, Human
ucacuugaggucaggaguuccu

SEQ ID NO: 2056273 - RNA, 14 nt, Human
ucacuguuucucug

SEQ ID NO: 2056274 - RNA, 17 nt, Human
ucacuguuucucugcug

SEQ ID NO: 2056275 - RNA, 14 nt, Human
ucacuugagcccag

SEQ ID NO: 2056276 - RNA, 18 nt, Human
ucacuguuucucugcugu

SEQ ID NO: 2056277 - RNA, 13 nt, Human
ucacuugaaugug

SEQ ID NO: 2056278 - RNA, 11 nt, Human
acauuuuguau

SEQ ID NO: 2056279 - RNA, 17 nt, Human
accaaaauuauuucaga

SEQ ID NO: 2056280 - RNA, 12 nt, Human
accaaaaugaca

SEQ ID NO: 2056281 - RNA, 16 nt, Human
accaaaaugacaauga

SEQ ID NO: 2056282 - RNA, 16 nt, Human
accaaaauuauuucag

SEQ ID NO: 2056283 - RNA, 15 nt, Human
accaaaagaacaaga

SEQ ID NO: 2056284 - RNA, 15 nt, Human
acauugcaauagaaa

SEQ ID NO: 2056285 - RNA, 16 nt, Human
acauugcaauagaaau

SEQ ID NO: 2056286 - RNA, 14 nt, Human
acauugcaauagaa

SEQ ID NO: 2056287 - RNA, 16 nt, Human
acauugaccaagaacu

SEQ ID NO: 2056288 - RNA, 17 nt, Human
acauugaccaagaacug

SEQ ID NO: 2056289 - RNA, 18 nt, Human
acauugaccaagaacugc

SEQ ID NO: 2056290 - RNA, 19 nt, Human
acauugaccaagaacugca

SEQ ID NO: 2056291 - RNA, 20 nt, Human
acauugaccaagaacugcau

SEQ ID NO: 2056292 - RNA, 12 nt, Human
acauugucugcg

SEQ ID NO: 2056293 - RNA, 12 nt, Human
acauugucaaua

SEQ ID NO: 2056294 - RNA, 13 nt, Human
acauugucaauaa

SEQ ID NO: 2056295 - RNA, 14 nt, Human
acauugucaauaaa

SEQ ID NO: 2056296 - RNA, 20 nt, Human
acauuuucacacaauacaau

SEQ ID NO: 2056297 - RNA, 15 nt, Human
acauuuucacacaau

SEQ ID NO: 2056298 - RNA, 13 nt, Human
acauuuucacaca

SEQ ID NO: 2056299 - RNA, 16 nt, Human
acauugcagucugcuu

SEQ ID NO: 2056300 - RNA, 22 nt, Human
ucaaguccucuuuucugagagg

SEQ ID NO: 2056301 - RNA, 22 nt, Human
ucaaguccuuaccucuuccgga

SEQ ID NO: 2056302 - RNA, 20 nt, Human
ucaaguccugccucuuaaau

SEQ ID NO: 2056303 - RNA, 18 nt, Human
ucaaguccuuaccucuuc

SEQ ID NO: 2056304 - RNA, 19 nt, Human
ucaaguccugccucuuaaa

SEQ ID NO: 2056305 - RNA, 14 nt, Human
ucaagucucugcug

SEQ ID NO: 2056306 - RNA, 16 nt, Human
ucaagucucugcuggc

SEQ ID NO: 2056307 - RNA, 17 nt, Human
ucaagucucugcuggcc

SEQ ID NO: 2056308 - RNA, 19 nt, Human
ucaagucucugcuggccca

SEQ ID NO: 2056309 - RNA, 22 nt, Human
ucaacugucuccuaccucugcu

SEQ ID NO: 2056310 - RNA, 20 nt, Human
ucaacuugagcauguuacug

SEQ ID NO: 2056311 - RNA, 16 nt, Human
ucaacuugagcauguu

SEQ ID NO: 2056312 - RNA, 14 nt, Human
ucaacuuuaugcag

SEQ ID NO: 2056313 - RNA, 17 nt, Human
ucaauauuccugaauga

SEQ ID NO: 2056314 - RNA, 18 nt, Human
ucaauauuccugaaugaa

SEQ ID NO: 2056315 - RNA, 21 nt, Human
ucaauauuccugaaugaaaua

SEQ ID NO: 2056316 - RNA, 22 nt, Human
ucaauauuccugaaugaaauau

SEQ ID NO: 2056317 - RNA, 14 nt, Human
ucaauauuccugaa

SEQ ID NO: 2056318 - RNA, 12 nt, Human
ucaagucuuccc

SEQ ID NO: 2056319 - RNA, 17 nt, Human
ucaagucugugccugga

SEQ ID NO: 2056320 - RNA, 20 nt, Human
ucaagucugugccuggagcu

SEQ ID NO: 2056321 - RNA, 21 nt, Human
ucaagucugugccuggagcuc

SEQ ID NO: 2056322 - RNA, 12 nt, Human
acauugaaagag

SEQ ID NO: 2056323 - RNA, 15 nt, Human
acauugaaguaauga

SEQ ID NO: 2056324 - RNA, 18 nt, Human
acauugaaguaaugaauu

SEQ ID NO: 2056325 - RNA, 19 nt, Human
acauugaaguaaugaauuu

SEQ ID NO: 2056326 - RNA, 20 nt, Human
acauugaaguaaugaauuuu

SEQ ID NO: 2056327 - RNA, 20 nt, Human
ucaauccugugugguuuagu

SEQ ID NO: 2056328 - RNA, 21 nt, Human
ucaaucugaagauacaugucu

SEQ ID NO: 2056329 - RNA, 13 nt, Human
ucaauauuuauua

SEQ ID NO: 2056330 - RNA, 12 nt, Human
ucaauauuuauu

SEQ ID NO: 2056331 - RNA, 20 nt, Human
ucaauauuuauuauuuucac

SEQ ID NO: 2056332 - RNA, 11 nt, Human
ucaauauuuau

SEQ ID NO: 2056333 - RNA, 10 nt, Human
ucaauauuua

SEQ ID NO: 2056334 - RNA, 13 nt, Human
acaugaauaugau

SEQ ID NO: 2056335 - RNA, 15 nt, Human
acaugaaugcacacu

SEQ ID NO: 2056336 - RNA, 19 nt, Human
acaugaaguguguuuccuu

SEQ ID NO: 2056337 - RNA, 21 nt, Human
acaugaaguguguuuccuuca

SEQ ID NO: 2056338 - RNA, 17 nt, Human
acagucauuugcgcaca

SEQ ID NO: 2056339 - RNA, 21 nt, Human
acagucauuugcgcacaacuu

SEQ ID NO: 2056340 - RNA, 15 nt, Human
acauguaauuaagua

SEQ ID NO: 2056341 - RNA, 21 nt, Human
acauggugaaaccucaucucu

SEQ ID NO: 2056342 - RNA, 16 nt, Human
acauggguagcuucug

SEQ ID NO: 2056343 - RNA, 21 nt, Human
acaugguaaacgcugucccua

SEQ ID NO: 2056344 - RNA, 13 nt, Human
acaugggaguuua

SEQ ID NO: 2056345 - RNA, 16 nt, Human
acauggggaggaagga

SEQ ID NO: 2056346 - RNA, 20 nt, Human
acauggggaguguuucaugg

SEQ ID NO: 2056347 - RNA, 17 nt, Human
acaugggguuggcuggg

SEQ ID NO: 2056348 - RNA, 20 nt, Human
acaugggguuggcugggccc

SEQ ID NO: 2056349 - RNA, 21 nt, Human
acaugggguuggcugggccca

SEQ ID NO: 2056350 - RNA, 16 nt, Human
acaugggguuuucaau

SEQ ID NO: 2056351 - RNA, 18 nt, Human
acaugggguuuucaauuu

SEQ ID NO: 2056352 - RNA, 22 nt, Human
acaugggguuuucaauuuugca

SEQ ID NO: 2056353 - RNA, 17 nt, Human
acauguaauuaaguacu

SEQ ID NO: 2056354 - RNA, 19 nt, Human
acauguaauuaaguacuau

SEQ ID NO: 2056355 - RNA, 21 nt, Human
acauguaauuaaguacuaugu

SEQ ID NO: 2056356 - RNA, 22 nt, Human
acauguaauuaaguacuaugua

SEQ ID NO: 2056357 - RNA, 22 nt, Human
acaugggaaacuuccaagaccu

SEQ ID NO: 2056358 - RNA, 20 nt, Human
acauggcuugccacagcucu

SEQ ID NO: 2056359 - RNA, 17 nt, Human
acauggaacucauuccu

SEQ ID NO: 2056360 - RNA, 14 nt, Human
acauggaagggaag

SEQ ID NO: 2056361 - RNA, 20 nt, Human
acaugcuucaugaaaauccu

SEQ ID NO: 2056362 - RNA, 21 nt, Human
acaugcuucaugaaaauccua

SEQ ID NO: 2056363 - RNA, 23 nt, Human
acaugcuucaugaaaauccuacc

SEQ ID NO: 2056364 - RNA, 14 nt, Human
acauggcuuaguuu

SEQ ID NO: 2056365 - RNA, 19 nt, Human
acauggcuuaguuuucaua

SEQ ID NO: 2056366 - RNA, 12 nt, Human
ucaaauuucaca

SEQ ID NO: 2056367 - RNA, 15 nt, Human
ucaaccaauguagaa

SEQ ID NO: 2056368 - RNA, 14 nt, Human
ucaacaacuacuac

SEQ ID NO: 2056369 - RNA, 20 nt, Human
ucaaccccaccacuucuuuu

SEQ ID NO: 2056370 - RNA, 18 nt, Human
ucaacccccauuucuauu

SEQ ID NO: 2056371 - RNA, 18 nt, Human
ucaaccauuccccauggg

SEQ ID NO: 2056372 - RNA, 14 nt, Human
ucaacccagaaaca

SEQ ID NO: 2056373 - RNA, 15 nt, Human
ucaacccagaaacac

SEQ ID NO: 2056374 - RNA, 15 nt, Human
ucaaccauuccccau

SEQ ID NO: 2056375 - RNA, 23 nt, Human
ucaaccacuguaaaaugaaauua

SEQ ID NO: 2056376 - RNA, 14 nt, Human
ucaaccagcagaug

SEQ ID NO: 2056377 - RNA, 13 nt, Human
ucaaauuuaaagg

SEQ ID NO: 2056378 - RNA, 20 nt, Human
acauucugacaucuuaguau

SEQ ID NO: 2056379 - RNA, 14 nt, Human
acauucgaucucau

SEQ ID NO: 2056380 - RNA, 16 nt, Human
acauucgaucucauuc

SEQ ID NO: 2056381 - RNA, 19 nt, Human
acauucgaucucauucagu

SEQ ID NO: 2056382 - RNA, 21 nt, Human
acauucgaucucauucaguau

SEQ ID NO: 2056383 - RNA, 23 nt, Human
acauucgaucucauucaguauua

SEQ ID NO: 2056384 - RNA, 23 nt, Human
acauguaauuaaguacuauguau

SEQ ID NO: 2056385 - RNA, 23 nt, Human
acauuccgacaaccgaugcucca

SEQ ID NO: 2056386 - RNA, 16 nt, Human
acauuccguuuacauu

SEQ ID NO: 2056387 - RNA, 23 nt, Human
acauuccguuuacauuuuagaca

SEQ ID NO: 2056388 - RNA, 12 nt, Human
acccuucuuuuc

SEQ ID NO: 2056389 - RNA, 13 nt, Human
acccuucuuucca

SEQ ID NO: 2056390 - RNA, 20 nt, Human
acccuucuuuccauuucucu

SEQ ID NO: 2056391 - RNA, 13 nt, Human
acccuucugugcc

SEQ ID NO: 2056392 - RNA, 14 nt, Human
acccuucugugccc

SEQ ID NO: 2056393 - RNA, 16 nt, Human
acccuucugugcccag

SEQ ID NO: 2056394 - RNA, 17 nt, Human
acccuucugugcccagc

SEQ ID NO: 2056395 - RNA, 18 nt, Human
acccuucugugcccagcu

SEQ ID NO: 2056396 - RNA, 21 nt, Human
acccuucugugcccagcucag

SEQ ID NO: 2056397 - RNA, 23 nt, Human
acccuuuccuuccuucccuggcu

SEQ ID NO: 2056398 - RNA, 21 nt, Human
acccuuuccuuccuucccugg

SEQ ID NO: 2056399 - RNA, 22 nt, Human
acccuuuccuuccuucccuggc

SEQ ID NO: 2056400 - RNA, 15 nt, Human
acccuuuccuuccuu

SEQ ID NO: 2056401 - RNA, 17 nt, Human
acccuuuccuuccuucc

SEQ ID NO: 2056402 - RNA, 18 nt, Human
acccuuuccuuccuuccc

SEQ ID NO: 2056403 - RNA, 19 nt, Human
acccuuuccuuccuucccu

SEQ ID NO: 2056404 - RNA, 14 nt, Human
acccuuuccuuccu

SEQ ID NO: 2056405 - RNA, 13 nt, Human
acccuugaaaaga

SEQ ID NO: 2056406 - RNA, 21 nt, Human
acccuuuuggguuucugcccu

SEQ ID NO: 2056407 - RNA, 19 nt, Human
acccuuuuggguuucugcc

SEQ ID NO: 2056408 - RNA, 16 nt, Human
acccuugaaaagacau

SEQ ID NO: 2056409 - RNA, 21 nt, Human
acccgggaggcggagcuugca

SEQ ID NO: 2056410 - RNA, 12 nt, Human
acccucgcuggc

SEQ ID NO: 2056411 - RNA, 14 nt, Human
acccucgcuggccc

SEQ ID NO: 2056412 - RNA, 15 nt, Human
acccucgcuggcccc

SEQ ID NO: 2056413 - RNA, 16 nt, Human
acccucgcuggccccc

SEQ ID NO: 2056414 - RNA, 17 nt, Human
acccucgcuggccccca

SEQ ID NO: 2056415 - RNA, 20 nt, Human
acccucgcuggcccccacug

SEQ ID NO: 2056416 - RNA, 22 nt, Human
acccucgcuggcccccacuggc

SEQ ID NO: 2056417 - RNA, 20 nt, Human
acccucguggccuuccccag

SEQ ID NO: 2056418 - RNA, 14 nt, Human
acccucguggccuu

SEQ ID NO: 2056419 - RNA, 16 nt, Human
acccugaaagcccuga

SEQ ID NO: 2056420 - RNA, 18 nt, Human
acccugaaagcccugagc

SEQ ID NO: 2056421 - RNA, 14 nt, Human
acccucuccacccc

SEQ ID NO: 2056422 - RNA, 15 nt, Human
acccucuccacccca

SEQ ID NO: 2056423 - RNA, 16 nt, Human
acccucuccaccccau

SEQ ID NO: 2056424 - RNA, 14 nt, Human
acccucucccagga

SEQ ID NO: 2056425 - RNA, 15 nt, Human
acccucucccaggac

SEQ ID NO: 2056426 - RNA, 15 nt, Human
acccucugacccuag

SEQ ID NO: 2056427 - RNA, 21 nt, Human
acccugaauuuggccugcacu

SEQ ID NO: 2056428 - RNA, 20 nt, Human
acccggccccugcugguuca

SEQ ID NO: 2056429 - RNA, 17 nt, Human
acccggccccugcuggu

SEQ ID NO: 2056430 - RNA, 22 nt, Human
acccggccccugcugguucagg

SEQ ID NO: 2056431 - RNA, 21 nt, Human
acccggcgguccccuccgcca

SEQ ID NO: 2056432 - RNA, 16 nt, Human
acccggccccugcugg

SEQ ID NO: 2056433 - RNA, 15 nt, Human
acccggccccugcug

SEQ ID NO: 2056434 - RNA, 21 nt, Human
acccggaggggccuggcagcc

SEQ ID NO: 2056435 - RNA, 18 nt, Human
acccggaggggccuggca

SEQ ID NO: 2056436 - RNA, 14 nt, Human
acccggccccugcu

SEQ ID NO: 2056437 - RNA, 22 nt, Human
ucagguaacaggcagauacagg

SEQ ID NO: 2056438 - RNA, 21 nt, Human
ucagguaacaggcagauacag

SEQ ID NO: 2056439 - RNA, 23 nt, Human
ucagguaacaggcagauacagga

SEQ ID NO: 2056440 - RNA, 21 nt, Human
ucaggguucuccucuccccuc

SEQ ID NO: 2056441 - RNA, 16 nt, Human
ucaggguuggccccug

SEQ ID NO: 2056442 - RNA, 15 nt, Human
ucaggguucuccucu

SEQ ID NO: 2056443 - RNA, 12 nt, Human
ucagggggccag

SEQ ID NO: 2056444 - RNA, 13 nt, Human
ucagggggccagg

SEQ ID NO: 2056445 - RNA, 12 nt, Human
ucagggcugaca

SEQ ID NO: 2056446 - RNA, 18 nt, Human
ucagcuuuuugucuuuuc

SEQ ID NO: 2056447 - RNA, 22 nt, Human
ucagggcugacacguccacccc

SEQ ID NO: 2056448 - RNA, 16 nt, Human
ucaggggacucagccc

SEQ ID NO: 2056449 - RNA, 18 nt, Human
ucaggggacucagcccug

SEQ ID NO: 2056450 - RNA, 16 nt, Human
ucaggggagucccguc

SEQ ID NO: 2056451 - RNA, 20 nt, Human
ucaggggagucccgucagga

SEQ ID NO: 2056452 - RNA, 22 nt, Human
ucagcuuguaaauagcucaggu

SEQ ID NO: 2056453 - RNA, 21 nt, Human
ucagcuuguaaauagcucagg

SEQ ID NO: 2056454 - RNA, 15 nt, Human
ucagcuccagcucac

SEQ ID NO: 2056455 - RNA, 14 nt, Human
ucagcuccagcuca

SEQ ID NO: 2056456 - RNA, 15 nt, Human
ucagcuuugccuucc

SEQ ID NO: 2056457 - RNA, 16 nt, Human
ucagcuuugccuucca

SEQ ID NO: 2056458 - RNA, 22 nt, Human
ucagcuuugccuuccacgcugu

SEQ ID NO: 2056459 - RNA, 12 nt, Human
accccugcccug

SEQ ID NO: 2056460 - RNA, 13 nt, Human
accccugcccugg

SEQ ID NO: 2056461 - RNA, 14 nt, Human
accccugcccuggg

SEQ ID NO: 2056462 - RNA, 15 nt, Human
accccugcccuggga

SEQ ID NO: 2056463 - RNA, 16 nt, Human
accccugcccuugucc

SEQ ID NO: 2056464 - RNA, 13 nt, Human
accccucuggcca

SEQ ID NO: 2056465 - RNA, 14 nt, Human
accccucuggccag

SEQ ID NO: 2056466 - RNA, 15 nt, Human
accccucuggccagg

SEQ ID NO: 2056467 - RNA, 16 nt, Human
accccucuaccaagcu

SEQ ID NO: 2056468 - RNA, 18 nt, Human
accccucuaccaagcugu

SEQ ID NO: 2056469 - RNA, 23 nt, Human
accccuccuuccuugaccagcag

SEQ ID NO: 2056470 - RNA, 14 nt, Human
acccccucuagaaa

SEQ ID NO: 2056471 - RNA, 21 nt, Human
accccuccuuccuugaccagc

SEQ ID NO: 2056472 - RNA, 22 nt, Human
accccuccuuccuugaccagca

SEQ ID NO: 2056473 - RNA, 18 nt, Human
accccucuggccaggaug

SEQ ID NO: 2056474 - RNA, 19 nt, Human
accccauagugaccggcug

SEQ ID NO: 2056475 - RNA, 18 nt, Human
accccaucucuacaaaaa

SEQ ID NO: 2056476 - RNA, 21 nt, Human
accccauagugaccggcugcu

SEQ ID NO: 2056477 - RNA, 15 nt, Human
accccaucccacacc

SEQ ID NO: 2056478 - RNA, 17 nt, Human
acccccucccuggccug

SEQ ID NO: 2056479 - RNA, 20 nt, Human
acccccucccuggccuguuc

SEQ ID NO: 2056480 - RNA, 22 nt, Human
acccccucccuggccuguucug

SEQ ID NO: 2056481 - RNA, 23 nt, Human
ucagcggggacagcuccuucugu

SEQ ID NO: 2056482 - RNA, 21 nt, Human
ucagcggggacagcuccuucu

SEQ ID NO: 2056483 - RNA, 20 nt, Human
ucagcggggacagcuccuuc

SEQ ID NO: 2056484 - RNA, 19 nt, Human
ucagcggggacagcuccuu

SEQ ID NO: 2056485 - RNA, 18 nt, Human
ucagcuaaagcccaaccu

SEQ ID NO: 2056486 - RNA, 12 nt, Human
ucagcuccagcu

SEQ ID NO: 2056487 - RNA, 18 nt, Human
ucagcuccacuuucagug

SEQ ID NO: 2056488 - RNA, 15 nt, Human
ucagcuacuaaugau

SEQ ID NO: 2056489 - RNA, 20 nt, Human
ucagcuacuaaugauguuuu

SEQ ID NO: 2056490 - RNA, 24 nt, Human
ucagccuucccccucccagggcca

SEQ ID NO: 2056491 - RNA, 21 nt, Human
ucagccuuccccuugcccagg

SEQ ID NO: 2056492 - RNA, 22 nt, Human
ucagccuuccccuugcccaggg

SEQ ID NO: 2056493 - RNA, 23 nt, Human
ucagccuuccccuugcccagggc

SEQ ID NO: 2056494 - RNA, 17 nt, Human
ucagccugugcugcccg

SEQ ID NO: 2056495 - RNA, 21 nt, Human
ucagccuucccccucccaggg

SEQ ID NO: 2056496 - RNA, 22 nt, Human
ucagccuucccccucccagggc

SEQ ID NO: 2056497 - RNA, 12 nt, Human
ucagccugugcu

SEQ ID NO: 2056498 - RNA, 16 nt, Human
ucagccugugcugccc

SEQ ID NO: 2056499 - RNA, 21 nt, Human
accccuggcuuuucacugcug

SEQ ID NO: 2056500 - RNA, 20 nt, Human
accccuggcuuuucacugcu

SEQ ID NO: 2056501 - RNA, 19 nt, Human
accccuggcuuuucacugc

SEQ ID NO: 2056502 - RNA, 18 nt, Human
accccuggcuuuucacug

SEQ ID NO: 2056503 - RNA, 17 nt, Human
accccuggcuuuucacu

SEQ ID NO: 2056504 - RNA, 17 nt, Human
ucagccuggugggccuc

SEQ ID NO: 2056505 - RNA, 18 nt, Human
ucagccuggugggccucc

SEQ ID NO: 2056506 - RNA, 19 nt, Human
ucagccuggugggccuccu

SEQ ID NO: 2056507 - RNA, 12 nt, Human
ucagauuugaac

SEQ ID NO: 2056508 - RNA, 21 nt, Human
ucagauuugaacucuucaauc

SEQ ID NO: 2056509 - RNA, 23 nt, Human
accaguguguggcuuucagagcc

SEQ ID NO: 2056510 - RNA, 21 nt, Human
accagugugguuuguguuuga

SEQ ID NO: 2056511 - RNA, 13 nt, Human
accauaacccagg

SEQ ID NO: 2056512 - RNA, 23 nt, Human
accauaacccaggaaugaagaua

SEQ ID NO: 2056513 - RNA, 15 nt, Human
ucagcaaaagaugcu

SEQ ID NO: 2056514 - RNA, 15 nt, Human
ucagauuuuccugug

SEQ ID NO: 2056515 - RNA, 16 nt, Human
ucagauuuuccugugg

SEQ ID NO: 2056516 - RNA, 12 nt, Human
accccagccuaa

SEQ ID NO: 2056517 - RNA, 13 nt, Human
accccagcauccu

SEQ ID NO: 2056518 - RNA, 13 nt, Human
accccagagugug

SEQ ID NO: 2056519 - RNA, 23 nt, Human
acccaggagguggagguugcagu

SEQ ID NO: 2056520 - RNA, 11 nt, Human
accccacacuu

SEQ ID NO: 2056521 - RNA, 22 nt, Human
accccaccacgauguggcccug

SEQ ID NO: 2056522 - RNA, 21 nt, Human
accccacacuuguuccagcuc

SEQ ID NO: 2056523 - RNA, 12 nt, Human
accccacccccu

SEQ ID NO: 2056524 - RNA, 21 nt, Human
accccacccccuucagugccc

SEQ ID NO: 2056525 - RNA, 22 nt, Human
accccacccccuucagugccca

SEQ ID NO: 2056526 - RNA, 17 nt, Human
ucagcccucccugcccc

SEQ ID NO: 2056527 - RNA, 23 nt, Human
acccaggaggcagagguugcagu

SEQ ID NO: 2056528 - RNA, 19 nt, Human
acccaggagggagggggcu

SEQ ID NO: 2056529 - RNA, 11 nt, Human
acccaggaggu

SEQ ID NO: 2056530 - RNA, 14 nt, Human
acccaggaggugga

SEQ ID NO: 2056531 - RNA, 20 nt, Human
acccaggagguggagguugc

SEQ ID NO: 2056532 - RNA, 21 nt, Human
acccaggagguggagguugca

SEQ ID NO: 2056533 - RNA, 23 nt, Human
acccaggagccccgaggccuucu

SEQ ID NO: 2056534 - RNA, 19 nt, Human
acccaggagccccgaggcc

SEQ ID NO: 2056535 - RNA, 16 nt, Human
ucagcccucccugccc

SEQ ID NO: 2056536 - RNA, 15 nt, Human
ucagcccucccugcc

SEQ ID NO: 2056537 - RNA, 14 nt, Human
ucagcccucccugc

SEQ ID NO: 2056538 - RNA, 13 nt, Human
ucagcccucccug

SEQ ID NO: 2056539 - RNA, 14 nt, Human
ucagcccucagaau

SEQ ID NO: 2056540 - RNA, 13 nt, Human
ucagccaggagcu

SEQ ID NO: 2056541 - RNA, 12 nt, Human
ucagccaggagc

SEQ ID NO: 2056542 - RNA, 16 nt, Human
ucaguuuucaggagug

SEQ ID NO: 2056543 - RNA, 14 nt, Human
ucagugggagaaaa

SEQ ID NO: 2056544 - RNA, 14 nt, Human
ucaguuuuaucuuu

SEQ ID NO: 2056545 - RNA, 16 nt, Human
ucagugggagaaaaca

SEQ ID NO: 2056546 - RNA, 13 nt, Human
ucaguuuuaacua

SEQ ID NO: 2056547 - RNA, 11 nt, Human
ucaguggcagc

SEQ ID NO: 2056548 - RNA, 21 nt, Human
ucaguggacuuuccacccccu

SEQ ID NO: 2056549 - RNA, 23 nt, Human
ucaguggacuuuccacccccucc

SEQ ID NO: 2056550 - RNA, 12 nt, Human
ucagugcuucuu

SEQ ID NO: 2056551 - RNA, 19 nt, Human
ucaguggacuuuccacccc

SEQ ID NO: 2056552 - RNA, 15 nt, Human
ucagugcuucgcaga

SEQ ID NO: 2056553 - RNA, 12 nt, Human
ucaguggcagcu

SEQ ID NO: 2056554 - RNA, 22 nt, Human
ucagugggaacgugacugcccc

SEQ ID NO: 2056555 - RNA, 23 nt, Human
ucagugggaacgugacugcccca

SEQ ID NO: 2056556 - RNA, 12 nt, Human
ucagugggagaa

SEQ ID NO: 2056557 - RNA, 13 nt, Human
ucagugggagaaa

SEQ ID NO: 2056558 - RNA, 19 nt, Human
ucaguggcauggcuccagu

SEQ ID NO: 2056559 - RNA, 20 nt, Human
ucaguggcauggcuccaguc

SEQ ID NO: 2056560 - RNA, 15 nt, Human
ucagugggaacguga

SEQ ID NO: 2056561 - RNA, 19 nt, Human
ucagugggaacgugacugc

SEQ ID NO: 2056562 - RNA, 12 nt, Human
ucagugccacua

SEQ ID NO: 2056563 - RNA, 13 nt, Human
ucaguaucaggcc

SEQ ID NO: 2056564 - RNA, 16 nt, Human
ucaguauaauuuuuua

SEQ ID NO: 2056565 - RNA, 9 nt, Human
ucagugccc

SEQ ID NO: 2056566 - RNA, 16 nt, Human
ucagugcccaacuguu

SEQ ID NO: 2056567 - RNA, 13 nt, Human
ucagugcccacca

SEQ ID NO: 2056568 - RNA, 22 nt, Human
ucagugcccaccaacaucccau

SEQ ID NO: 2056569 - RNA, 18 nt, Human
ucauauaagauucauauu

SEQ ID NO: 2056570 - RNA, 16 nt, Human
ucauauaccagcaaua

SEQ ID NO: 2056571 - RNA, 17 nt, Human
ucauauaccagcaauau

SEQ ID NO: 2056572 - RNA, 14 nt, Human
ucauauauauacau

SEQ ID NO: 2056573 - RNA, 14 nt, Human
ucauauauaucuau

SEQ ID NO: 2056574 - RNA, 18 nt, Human
ucauauauggggggccaa

SEQ ID NO: 2056575 - RNA, 22 nt, Human
ucauauauggggggccaacacc

SEQ ID NO: 2056576 - RNA, 21 nt, Human
ucauaguaugguggcuggguu

SEQ ID NO: 2056577 - RNA, 19 nt, Human
ucauaguaugguggcuggg

SEQ ID NO: 2056578 - RNA, 18 nt, Human
ucauaguaugguggcugg

SEQ ID NO: 2056579 - RNA, 15 nt, Human
ucauaguaugguggc

SEQ ID NO: 2056580 - RNA, 14 nt, Human
ucauaaccuagccu

SEQ ID NO: 2056581 - RNA, 16 nt, Human
ucauaaaauaaaguau

SEQ ID NO: 2056582 - RNA, 12 nt, Human
ucauaaaauaaa

SEQ ID NO: 2056583 - RNA, 16 nt, Human
ucauaacagugccauu

SEQ ID NO: 2056584 - RNA, 17 nt, Human
ucauaacagugccauug

SEQ ID NO: 2056585 - RNA, 20 nt, Human
ucauaacagugccauugucu

SEQ ID NO: 2056586 - RNA, 22 nt, Human
ucauaacagugccauugucuuu

SEQ ID NO: 2056587 - RNA, 23 nt, Human
ucauaacagugccauugucuuua

SEQ ID NO: 2056588 - RNA, 15 nt, Human
ucauaucuucacaau

SEQ ID NO: 2056589 - RNA, 15 nt, Human
ucauauuuacuucuu

SEQ ID NO: 2056590 - RNA, 23 nt, Human
ucauauuuacuucuuauacauuu

SEQ ID NO: 2056591 - RNA, 17 nt, Human
accgagucucuucucca

SEQ ID NO: 2056592 - RNA, 16 nt, Human
accgagucucuucucc

SEQ ID NO: 2056593 - RNA, 17 nt, Human
accgaggcuggagcugg

SEQ ID NO: 2056594 - RNA, 18 nt, Human
accgaggcuggagcuggc

SEQ ID NO: 2056595 - RNA, 11 nt, Human
ucaugauuuuu

SEQ ID NO: 2056596 - RNA, 12 nt, Human
ucaugaagccca

SEQ ID NO: 2056597 - RNA, 15 nt, Human
ucaugaaauaugcau

SEQ ID NO: 2056598 - RNA, 14 nt, Human
ucaugaaauaugca

SEQ ID NO: 2056599 - RNA, 12 nt, Human
ucaugaacacau

SEQ ID NO: 2056600 - RNA, 22 nt, Human
ucaugaacacaucagcuagcaa

SEQ ID NO: 2056601 - RNA, 20 nt, Human
ucaucuaccauuuucugguu

SEQ ID NO: 2056602 - RNA, 22 nt, Human
ucaucuaccauuuucugguucu

SEQ ID NO: 2056603 - RNA, 16 nt, Human
ucaucuaccuuuucuc

SEQ ID NO: 2056604 - RNA, 17 nt, Human
ucaucuaccuuuucucu

SEQ ID NO: 2056605 - RNA, 18 nt, Human
ucaucuaccuuuucucuu

SEQ ID NO: 2056606 - RNA, 20 nt, Human
ucaucguaggugauuugaag

SEQ ID NO: 2056607 - RNA, 12 nt, Human
ucaucccacucc

SEQ ID NO: 2056608 - RNA, 13 nt, Human
ucauccuuuucuc

SEQ ID NO: 2056609 - RNA, 14 nt, Human
ucauccuuuucucc

SEQ ID NO: 2056610 - RNA, 19 nt, Human
ucauccuuuucuccuaucu

SEQ ID NO: 2056611 - RNA, 22 nt, Human
ucauccuuuucuccuaucuuca

SEQ ID NO: 2056612 - RNA, 19 nt, Human
accuccugcccaggagagc

SEQ ID NO: 2056613 - RNA, 20 nt, Human
accuccugcccaggagagcc

SEQ ID NO: 2056614 - RNA, 21 nt, Human
accuccugcccaggagagcca

SEQ ID NO: 2056615 - RNA, 17 nt, Human
ucaugcauagucccagc

SEQ ID NO: 2056616 - RNA, 18 nt, Human
ucaugcauagucccagcu

SEQ ID NO: 2056617 - RNA, 20 nt, Human
ucaugcaaaugcuguauucu

SEQ ID NO: 2056618 - RNA, 13 nt, Human
ucaugcaaugaca

SEQ ID NO: 2056619 - RNA, 15 nt, Human
ucaugcaaugacauc

SEQ ID NO: 2056620 - RNA, 16 nt, Human
ucaugcaaugacaucu

SEQ ID NO: 2056621 - RNA, 19 nt, Human
ucauguggaauauaaagau

SEQ ID NO: 2056622 - RNA, 18 nt, Human
ucauguggaauauaaaga

SEQ ID NO: 2056623 - RNA, 16 nt, Human
ucauguuucuuaaaug

SEQ ID NO: 2056624 - RNA, 11 nt, Human
ucauguuucuu

SEQ ID NO: 2056625 - RNA, 15 nt, Human
ucauguuucuuaaau

SEQ ID NO: 2056626 - RNA, 18 nt, Human
accuaccuguaacuuuuu

SEQ ID NO: 2056627 - RNA, 17 nt, Human
accuaccuucaaagcug

SEQ ID NO: 2056628 - RNA, 18 nt, Human
accuaccuucaaagcuga

SEQ ID NO: 2056629 - RNA, 19 nt, Human
accucacgcaccucccauc

SEQ ID NO: 2056630 - RNA, 22 nt, Human
accucacgcaccucccauccua

SEQ ID NO: 2056631 - RNA, 15 nt, Human
accucacgcaccucc

SEQ ID NO: 2056632 - RNA, 16 nt, Human
accucacgcaccuccc

SEQ ID NO: 2056633 - RNA, 17 nt, Human
accucacgcaccuccca

SEQ ID NO: 2056634 - RNA, 18 nt, Human
accucacgcaccucccau

SEQ ID NO: 2056635 - RNA, 19 nt, Human
accucacccgaggcugccc

SEQ ID NO: 2056636 - RNA, 16 nt, Human
accuauuuuagacaaa

SEQ ID NO: 2056637 - RNA, 14 nt, Human
accuauuugacaua

SEQ ID NO: 2056638 - RNA, 17 nt, Human
accuagggaggaccuua

SEQ ID NO: 2056639 - RNA, 24 nt, Human
accuagggaggaccuuaucugugc

SEQ ID NO: 2056640 - RNA, 17 nt, Human
accuaggccacuccucc

SEQ ID NO: 2056641 - RNA, 18 nt, Human
accuaggccacuccucca

SEQ ID NO: 2056642 - RNA, 15 nt, Human
accuagggaggaccu

SEQ ID NO: 2056643 - RNA, 12 nt, Human
accuauguuugc

SEQ ID NO: 2056644 - RNA, 17 nt, Human
accuauuucaaaaauuu

SEQ ID NO: 2056645 - RNA, 18 nt, Human
accuauuucaaaaauuug

SEQ ID NO: 2056646 - RNA, 20 nt, Human
accuauuucaaaaauuugga

SEQ ID NO: 2056647 - RNA, 20 nt, Human
accuagggauguucuggccc

SEQ ID NO: 2056648 - RNA, 21 nt, Human
accuccccuauccacccagcc

SEQ ID NO: 2056649 - RNA, 23 nt, Human
accuccccuauccacccagccca

SEQ ID NO: 2056650 - RNA, 13 nt, Human
accuccccuccuu

SEQ ID NO: 2056651 - RNA, 17 nt, Human
accuccccuccuugccu

SEQ ID NO: 2056652 - RNA, 19 nt, Human
accuccccuccuugccucc

SEQ ID NO: 2056653 - RNA, 20 nt, Human
accuccccuccuugccuccu

SEQ ID NO: 2056654 - RNA, 21 nt, Human
accuccccuccuugccuccug

SEQ ID NO: 2056655 - RNA, 22 nt, Human
accuccccuccuugccuccugu

SEQ ID NO: 2056656 - RNA, 14 nt, Human
accucccccuccuu

SEQ ID NO: 2056657 - RNA, 15 nt, Human
accucccccuccuuc

SEQ ID NO: 2056658 - RNA, 16 nt, Human
accucccccuccuucc

SEQ ID NO: 2056659 - RNA, 21 nt, Human
accucccccuccuucccagcu

SEQ ID NO: 2056660 - RNA, 22 nt, Human
accucccccuccuucccagcug

SEQ ID NO: 2056661 - RNA, 14 nt, Human
accuccccuaucca

SEQ ID NO: 2056662 - RNA, 17 nt, Human
accuccccuauccaccc

SEQ ID NO: 2056663 - RNA, 18 nt, Human
accuccccuauccaccca

SEQ ID NO: 2056664 - RNA, 19 nt, Human
accuccccuauccacccag

SEQ ID NO: 2056665 - RNA, 20 nt, Human
accuccccuauccacccagc

SEQ ID NO: 2056666 - RNA, 16 nt, Human
accuccugcaauaaaa

SEQ ID NO: 2056667 - RNA, 12 nt, Human
accuccugccca

SEQ ID NO: 2056668 - RNA, 13 nt, Human
accuccugcccag

SEQ ID NO: 2056669 - RNA, 14 nt, Human
accuccugcccagg

SEQ ID NO: 2056670 - RNA, 15 nt, Human
accuccugcccagga

SEQ ID NO: 2056671 - RNA, 16 nt, Human
accuccugcccaggag

SEQ ID NO: 2056672 - RNA, 17 nt, Human
accuccugcccaggaga

SEQ ID NO: 2056673 - RNA, 18 nt, Human
accuccugcccaggagag

SEQ ID NO: 2056674 - RNA, 15 nt, Human
accuccacagcuucc

SEQ ID NO: 2056675 - RNA, 13 nt, Human
accuccagcuguu

SEQ ID NO: 2056676 - RNA, 12 nt, Human
accucccagccc

SEQ ID NO: 2056677 - RNA, 13 nt, Human
accucccagcccc

SEQ ID NO: 2056678 - RNA, 16 nt, Human
accucccagccccugc

SEQ ID NO: 2056679 - RNA, 21 nt, Human
accucccagccccugccccuc

SEQ ID NO: 2056680 - RNA, 15 nt, Human
accucccauccuaau

SEQ ID NO: 2056681 - RNA, 20 nt, Human
accucccacaaaggagagcu

SEQ ID NO: 2056682 - RNA, 12 nt, Human
accucccaccuu

SEQ ID NO: 2056683 - RNA, 14 nt, Human
accucccaccuuug

SEQ ID NO: 2056684 - RNA, 15 nt, Human
accucccaccuuugg

SEQ ID NO: 2056685 - RNA, 16 nt, Human
accucccaccuuuggu

SEQ ID NO: 2056686 - RNA, 20 nt, Human
acucaagacuuccagagccu

SEQ ID NO: 2056687 - RNA, 15 nt, Human
acuaugguauuugag

SEQ ID NO: 2056688 - RNA, 17 nt, Human
acucaagaggcugaggc

SEQ ID NO: 2056689 - RNA, 18 nt, Human
acucaagaggcugaggca

SEQ ID NO: 2056690 - RNA, 16 nt, Human
acuaugguauuugagu

SEQ ID NO: 2056691 - RNA, 14 nt, Human
acucaagaggcuga

SEQ ID NO: 2056692 - RNA, 15 nt, Human
acucaagaggcugag

SEQ ID NO: 2056693 - RNA, 16 nt, Human
acuauguugcccaggc

SEQ ID NO: 2056694 - RNA, 15 nt, Human
acuauguugcccagg

SEQ ID NO: 2056695 - RNA, 14 nt, Human
acuauguugcccag

SEQ ID NO: 2056696 - RNA, 22 nt, Human
acucaagugucucaguccaccu

SEQ ID NO: 2056697 - RNA, 23 nt, Human
acucaagugucucaguccaccug

SEQ ID NO: 2056698 - RNA, 17 nt, Human
acucacaacagcugccu

SEQ ID NO: 2056699 - RNA, 16 nt, Human
acucaaugcacugaca

SEQ ID NO: 2056700 - RNA, 11 nt, Human
acucaagccaa

SEQ ID NO: 2056701 - RNA, 14 nt, Human
acucaagccaagca

SEQ ID NO: 2056702 - RNA, 16 nt, Human
acucaagccaagcagc

SEQ ID NO: 2056703 - RNA, 17 nt, Human
acucaagccaagcagcc

SEQ ID NO: 2056704 - RNA, 19 nt, Human
acucaagccaagcagccaa

SEQ ID NO: 2056705 - RNA, 22 nt, Human
acucaagccaagcagccaagcu

SEQ ID NO: 2056706 - RNA, 16 nt, Human
acuaucuaaauguuga

SEQ ID NO: 2056707 - RNA, 21 nt, Human
acuaucuaaauguugaaagau

SEQ ID NO: 2056708 - RNA, 14 nt, Human
acuaucaaacugaa

SEQ ID NO: 2056709 - RNA, 19 nt, Human
acuaucaaacugaagccag

SEQ ID NO: 2056710 - RNA, 22 nt, Human
acuauagccuaggugacagagu

SEQ ID NO: 2056711 - RNA, 20 nt, Human
acuauagccuaggugacaga

SEQ ID NO: 2056712 - RNA, 14 nt, Human
acuagaggcaggga

SEQ ID NO: 2056713 - RNA, 15 nt, Human
acuagaggcagggag

SEQ ID NO: 2056714 - RNA, 16 nt, Human
acuagaccuccagcug

SEQ ID NO: 2056715 - RNA, 16 nt, Human
acuagacguucauuug

SEQ ID NO: 2056716 - RNA, 18 nt, Human
acuauagccuaggugaca

SEQ ID NO: 2056717 - RNA, 16 nt, Human
acuagaggcagggagg

SEQ ID NO: 2056718 - RNA, 23 nt, Human
uccccacccugaaagcccugagc

SEQ ID NO: 2056719 - RNA, 15 nt, Human
ucccauugucuucug

SEQ ID NO: 2056720 - RNA, 19 nt, Human
ucccauugucuucugaccu

SEQ ID NO: 2056721 - RNA, 22 nt, Human
ucccauugucuucugaccucua

SEQ ID NO: 2056722 - RNA, 21 nt, Human
ucccauuucuaaaggccucuu

SEQ ID NO: 2056723 - RNA, 24 nt, Human
ucccauuucuaaaggccucuuccu

SEQ ID NO: 2056724 - RNA, 12 nt, Human
uccccacccuga

SEQ ID NO: 2056725 - RNA, 14 nt, Human
ucccauuucuuaau

SEQ ID NO: 2056726 - RNA, 19 nt, Human
ucccauuuucagacugcuu

SEQ ID NO: 2056727 - RNA, 21 nt, Human
ucccauuuucagacugcuuua

SEQ ID NO: 2056728 - RNA, 22 nt, Human
ucccauuuucagacugcuuuaa

SEQ ID NO: 2056729 - RNA, 23 nt, Human
ucccauuuucagacugcuuuaaa

SEQ ID NO: 2056730 - RNA, 13 nt, Human
ucccauuuugcaa

SEQ ID NO: 2056731 - RNA, 21 nt, Human
ucccauuuugcaaaauuucca

SEQ ID NO: 2056732 - RNA, 22 nt, Human
ucccauuuugcaaaauuuccag

SEQ ID NO: 2056733 - RNA, 13 nt, Human
ucccagcuacuca

SEQ ID NO: 2056734 - RNA, 22 nt, Human
ucccagcuacucaagaggcuga

SEQ ID NO: 2056735 - RNA, 14 nt, Human
ucccagcuacucag

SEQ ID NO: 2056736 - RNA, 16 nt, Human
ucccagcuacucagaa

SEQ ID NO: 2056737 - RNA, 19 nt, Human
ucccagcuacucagaagcc

SEQ ID NO: 2056738 - RNA, 21 nt, Human
ucccagcuacucagaagccug

SEQ ID NO: 2056739 - RNA, 23 nt, Human
ucccagcuacucagaagccugag

SEQ ID NO: 2056740 - RNA, 10 nt, Human
ucccagccug

SEQ ID NO: 2056741 - RNA, 18 nt, Human
ucccagcggcuggugcag

SEQ ID NO: 2056742 - RNA, 19 nt, Human
ucccagcggcuggugcagg

SEQ ID NO: 2056743 - RNA, 20 nt, Human
ucccagcggcuggugcaggg

SEQ ID NO: 2056744 - RNA, 21 nt, Human
ucccagcggcuggugcagggc

SEQ ID NO: 2056745 - RNA, 22 nt, Human
ucccagcggcuggugcagggcc

SEQ ID NO: 2056746 - RNA, 23 nt, Human
ucccagcggcuggugcagggccu

SEQ ID NO: 2056747 - RNA, 13 nt, Human
ucccagccccugc

SEQ ID NO: 2056748 - RNA, 19 nt, Human
ucccagccccugccccuca

SEQ ID NO: 2056749 - RNA, 22 nt, Human
ucccagcccuuugggaggcuga

SEQ ID NO: 2056750 - RNA, 16 nt, Human
ucccagcucacgucac

SEQ ID NO: 2056751 - RNA, 17 nt, Human
ucccagcucacgucaca

SEQ ID NO: 2056752 - RNA, 21 nt, Human
ucccagcucuagacaacccug

SEQ ID NO: 2056753 - RNA, 20 nt, Human
ucccagcucuagacaacccu

SEQ ID NO: 2056754 - RNA, 16 nt, Human
ucccagcuacuuggga

SEQ ID NO: 2056755 - RNA, 17 nt, Human
ucccagcuacucaggag

SEQ ID NO: 2056756 - RNA, 15 nt, Human
ucccagcuacucagg

SEQ ID NO: 2056757 - RNA, 16 nt, Human
ucccagcuacucagga

SEQ ID NO: 2056758 - RNA, 16 nt, Human
ucccagcuacucggga

SEQ ID NO: 2056759 - RNA, 18 nt, Human
ucccagcuacuugggagg

SEQ ID NO: 2056760 - RNA, 17 nt, Human
ucccagcuacuugggag

SEQ ID NO: 2056761 - RNA, 19 nt, Human
ucccagcuacuugggaggc

SEQ ID NO: 2056762 - RNA, 20 nt, Human
acuacugcuaccacaacuau

SEQ ID NO: 2056763 - RNA, 13 nt, Human
acuacuguguucc

SEQ ID NO: 2056764 - RNA, 22 nt, Human
acuacuguggaaaaauauuuaa

SEQ ID NO: 2056765 - RNA, 15 nt, Human
acuacuguguuccug

SEQ ID NO: 2056766 - RNA, 18 nt, Human
acuacuguggaaaaauau

SEQ ID NO: 2056767 - RNA, 19 nt, Human
acuacuguggaaaaauauu

SEQ ID NO: 2056768 - RNA, 20 nt, Human
acuacuguggaaaaauauuu

SEQ ID NO: 2056769 - RNA, 21 nt, Human
acuacuguggaaaaauauuua

SEQ ID NO: 2056770 - RNA, 21 nt, Human
acuacuguguuccuggcaaua

SEQ ID NO: 2056771 - RNA, 16 nt, Human
acuacuguguuccugg

SEQ ID NO: 2056772 - RNA, 18 nt, Human
acuacuguguuccuggca

SEQ ID NO: 2056773 - RNA, 19 nt, Human
acuagacucccaagcugga

SEQ ID NO: 2056774 - RNA, 20 nt, Human
acuagacuugaggaaaccag

SEQ ID NO: 2056775 - RNA, 11 nt, Human
acuagagaaac

SEQ ID NO: 2056776 - RNA, 12 nt, Human
acuagagaaacc

SEQ ID NO: 2056777 - RNA, 11 nt, Human
ucccccagccc

SEQ ID NO: 2056778 - RNA, 15 nt, Human
uccccagguggcuga

SEQ ID NO: 2056779 - RNA, 18 nt, Human
uccccagguggcugaccc

SEQ ID NO: 2056780 - RNA, 19 nt, Human
uccccagguggcugaccca

SEQ ID NO: 2056781 - RNA, 20 nt, Human
uccccagguggcugacccag

SEQ ID NO: 2056782 - RNA, 17 nt, Human
uccccaggggucccagc

SEQ ID NO: 2056783 - RNA, 18 nt, Human
uccccaggggucccagcc

SEQ ID NO: 2056784 - RNA, 20 nt, Human
uccccaggggucccagccac

SEQ ID NO: 2056785 - RNA, 22 nt, Human
uccccaggggucccagccaccc

SEQ ID NO: 2056786 - RNA, 23 nt, Human
uccccaggggucccagccacccc

SEQ ID NO: 2056787 - RNA, 10 nt, Human
uccccagggg

SEQ ID NO: 2056788 - RNA, 14 nt, Human
uccccaggggagag

SEQ ID NO: 2056789 - RNA, 23 nt, Human
uccccaggggagagggucuggag

SEQ ID NO: 2056790 - RNA, 18 nt, Human
ucccauuuuggaaguuuu

SEQ ID NO: 2056791 - RNA, 19 nt, Human
ucccauuuuggaaguuuuc

SEQ ID NO: 2056792 - RNA, 17 nt, Human
acguaaagcuagaaaug

SEQ ID NO: 2056793 - RNA, 18 nt, Human
acguaaagcuagaaauga

SEQ ID NO: 2056794 - RNA, 18 nt, Human
acggugggcauuugugag

SEQ ID NO: 2056795 - RNA, 19 nt, Human
acggugggcauuugugagg

SEQ ID NO: 2056796 - RNA, 14 nt, Human
acgucaaacaugaa

SEQ ID NO: 2056797 - RNA, 16 nt, Human
acgucaaacaugaagu

SEQ ID NO: 2056798 - RNA, 17 nt, Human
acgucaaacaugaagug

SEQ ID NO: 2056799 - RNA, 17 nt, Human
acgucaagucuccuucc

SEQ ID NO: 2056800 - RNA, 22 nt, Human
acguaaaucuguucaaggaauc

SEQ ID NO: 2056801 - RNA, 18 nt, Human
acguaaccacggaaaaga

SEQ ID NO: 2056802 - RNA, 16 nt, Human
uccagugucucggagg

SEQ ID NO: 2056803 - RNA, 15 nt, Human
acguuaccaggcagg

SEQ ID NO: 2056804 - RNA, 13 nt, Human
acguucaccccuc

SEQ ID NO: 2056805 - RNA, 23 nt, Human
acgugugugacucagaugucucu

SEQ ID NO: 2056806 - RNA, 15 nt, Human
acguccugccaccug

SEQ ID NO: 2056807 - RNA, 16 nt, Human
acguccugccaccugg

SEQ ID NO: 2056808 - RNA, 22 nt, Human
acguguguuucuagagccugcu

SEQ ID NO: 2056809 - RNA, 12 nt, Human
acgucccuccac

SEQ ID NO: 2056810 - RNA, 22 nt, Human
acgucccuccacguucaccccu

SEQ ID NO: 2056811 - RNA, 18 nt, Human
acuaacaaccaaagacua

SEQ ID NO: 2056812 - RNA, 21 nt, Human
acuacaaaaaaguuguuaacu

SEQ ID NO: 2056813 - RNA, 13 nt, Human
acuacaaaauuug

SEQ ID NO: 2056814 - RNA, 14 nt, Human
acuacaaaauuuga

SEQ ID NO: 2056815 - RNA, 16 nt, Human
acuacaaaauuugaaa

SEQ ID NO: 2056816 - RNA, 18 nt, Human
acuacaaaauuugaaauu

SEQ ID NO: 2056817 - RNA, 15 nt, Human
acuacacauucaaua

SEQ ID NO: 2056818 - RNA, 19 nt, Human
acuacacauucaauaagca

SEQ ID NO: 2056819 - RNA, 17 nt, Human
acuaauuugauguuuac

SEQ ID NO: 2056820 - RNA, 16 nt, Human
acuaacagauaagcaa

SEQ ID NO: 2056821 - RNA, 13 nt, Human
acuaacagauaag

SEQ ID NO: 2056822 - RNA, 15 nt, Human
acuaaaugcccugcu

SEQ ID NO: 2056823 - RNA, 17 nt, Human
acuaaagcaguagaaau

SEQ ID NO: 2056824 - RNA, 20 nt, Human
acuaaaucuguaagcucuuu

SEQ ID NO: 2056825 - RNA, 23 nt, Human
acuaaaucuguaagcucuuugaa

SEQ ID NO: 2056826 - RNA, 17 nt, Human
acuaaagcaggccuuuu

SEQ ID NO: 2056827 - RNA, 20 nt, Human
acuaaagcaggccuuuugau

SEQ ID NO: 2056828 - RNA, 12 nt, Human
acuaaagagaga

SEQ ID NO: 2056829 - RNA, 14 nt, Human
acuaaagagagaau

SEQ ID NO: 2056830 - RNA, 16 nt, Human
acuaaagagagaaugu

SEQ ID NO: 2056831 - RNA, 21 nt, Human
acuaaagagagaauguagaua

SEQ ID NO: 2056832 - RNA, 13 nt, Human
acguuuaaagugu

SEQ ID NO: 2056833 - RNA, 14 nt, Human
acguuuaaagugua

SEQ ID NO: 2056834 - RNA, 13 nt, Human
acguuuaaaguuc

SEQ ID NO: 2056835 - RNA, 14 nt, Human
acguuuaaaguucu

SEQ ID NO: 2056836 - RNA, 15 nt, Human
acguuuaaaguucug

SEQ ID NO: 2056837 - RNA, 18 nt, Human
acguuuaaaguucugugu

SEQ ID NO: 2056838 - RNA, 22 nt, Human
acguuuaaaguucuguguauuu

SEQ ID NO: 2056839 - RNA, 18 nt, Human
ucccagauacuugggggg

SEQ ID NO: 2056840 - RNA, 15 nt, Human
ucccagagugcuggg

SEQ ID NO: 2056841 - RNA, 16 nt, Human
ucccagauacuugggg

SEQ ID NO: 2056842 - RNA, 17 nt, Human
ucccagaacacacucca

SEQ ID NO: 2056843 - RNA, 19 nt, Human
ucccagaacacacuccauc

SEQ ID NO: 2056844 - RNA, 20 nt, Human
ucccagaacacacuccauca

SEQ ID NO: 2056845 - RNA, 18 nt, Human
ucccagaaggaccuccug

SEQ ID NO: 2056846 - RNA, 20 nt, Human
ucccagaaggaccuccugag

SEQ ID NO: 2056847 - RNA, 20 nt, Human
ucccagagacaggaaaaucc

SEQ ID NO: 2056848 - RNA, 17 nt, Human
ucccagagacaggaaaa

SEQ ID NO: 2056849 - RNA, 18 nt, Human
ucccagagacaggaaaau

SEQ ID NO: 2056850 - RNA, 13 nt, Human
ucccagacuugcu

SEQ ID NO: 2056851 - RNA, 16 nt, Human
ucccagagacaggaaa

SEQ ID NO: 2056852 - RNA, 23 nt, Human
acuacaccauguuugagcucaga

SEQ ID NO: 2056853 - RNA, 15 nt, Human
acuacacuccagccu

SEQ ID NO: 2056854 - RNA, 17 nt, Human
acuacacuccagccuga

SEQ ID NO: 2056855 - RNA, 18 nt, Human
acuacacuccagccugag

SEQ ID NO: 2056856 - RNA, 19 nt, Human
acuacacuccagccugagc

SEQ ID NO: 2056857 - RNA, 20 nt, Human
acuacacuccagccugagca

SEQ ID NO: 2056858 - RNA, 14 nt, Human
acgaacccaccugc

SEQ ID NO: 2056859 - RNA, 19 nt, Human
uccaggcgaugugcaagug

SEQ ID NO: 2056860 - RNA, 14 nt, Human
acgaaacugcucua

SEQ ID NO: 2056861 - RNA, 22 nt, Human
uccaggcuccuuuagcgcccag

SEQ ID NO: 2056862 - RNA, 12 nt, Human
uccaggcuccuu

SEQ ID NO: 2056863 - RNA, 10 nt, Human
uccaggcucc

SEQ ID NO: 2056864 - RNA, 22 nt, Human
uccaggccugugaggugcagag

SEQ ID NO: 2056865 - RNA, 22 nt, Human
uccaggcaauggccuaaacuuc

SEQ ID NO: 2056866 - RNA, 12 nt, Human
uccagaccccca

SEQ ID NO: 2056867 - RNA, 13 nt, Human
uccagacccccac

SEQ ID NO: 2056868 - RNA, 13 nt, Human
uccagacacuuuu

SEQ ID NO: 2056869 - RNA, 13 nt, Human
uccagaccccugg

SEQ ID NO: 2056870 - RNA, 14 nt, Human
uccagacccccacc

SEQ ID NO: 2056871 - RNA, 16 nt, Human
uccagacccccacccc

SEQ ID NO: 2056872 - RNA, 17 nt, Human
uccagacccccaccccu

SEQ ID NO: 2056873 - RNA, 20 nt, Human
uccagacccccaccccuucc

SEQ ID NO: 2056874 - RNA, 21 nt, Human
uccagacccccaccccuuccc

SEQ ID NO: 2056875 - RNA, 22 nt, Human
uccagacccccaccccuucccc

SEQ ID NO: 2056876 - RNA, 14 nt, Human
uccagacccccagc

SEQ ID NO: 2056877 - RNA, 15 nt, Human
uccagacccccagca

SEQ ID NO: 2056878 - RNA, 16 nt, Human
uccagacccccagcaa

SEQ ID NO: 2056879 - RNA, 21 nt, Human
uccagacccccagcaacccuc

SEQ ID NO: 2056880 - RNA, 16 nt, Human
uccagccgccauugcc

SEQ ID NO: 2056881 - RNA, 18 nt, Human
uccagccgccauugccac

SEQ ID NO: 2056882 - RNA, 19 nt, Human
uccagccgccauugccacc

SEQ ID NO: 2056883 - RNA, 20 nt, Human
uccagccgccauugccacca

SEQ ID NO: 2056884 - RNA, 21 nt, Human
uccagccgccauugccaccag

SEQ ID NO: 2056885 - RNA, 22 nt, Human
uccagccgccauugccaccagg

SEQ ID NO: 2056886 - RNA, 23 nt, Human
uccagccgccauugccaccagga

SEQ ID NO: 2056887 - RNA, 11 nt, Human
uccagccuggg

SEQ ID NO: 2056888 - RNA, 21 nt, Human
uccacuccuuccugccaccug

SEQ ID NO: 2056889 - RNA, 21 nt, Human
uccacugugccaugugccagg

SEQ ID NO: 2056890 - RNA, 18 nt, Human
uccagaauggucuuucua

SEQ ID NO: 2056891 - RNA, 16 nt, Human
uccagaauugaccuuu

SEQ ID NO: 2056892 - RNA, 19 nt, Human
uccacugucacuguuucuc

SEQ ID NO: 2056893 - RNA, 22 nt, Human
uccacugucacuguuucucugc

SEQ ID NO: 2056894 - RNA, 23 nt, Human
uccacucuacccucccacccccu

SEQ ID NO: 2056895 - RNA, 20 nt, Human
uccacucuacccucccaccc

SEQ ID NO: 2056896 - RNA, 21 nt, Human
uccacucuacccucccacccc

SEQ ID NO: 2056897 - RNA, 17 nt, Human
uccacucuacccuccca

SEQ ID NO: 2056898 - RNA, 18 nt, Human
uccacucuacccucccac

SEQ ID NO: 2056899 - RNA, 14 nt, Human
accuuuuuaucucc

SEQ ID NO: 2056900 - RNA, 14 nt, Human
accuuuuuccuucc

SEQ ID NO: 2056901 - RNA, 13 nt, Human
uccacuccuuccu

SEQ ID NO: 2056902 - RNA, 14 nt, Human
uccacuccuuccug

SEQ ID NO: 2056903 - RNA, 15 nt, Human
accuuuuuccuuccu

SEQ ID NO: 2056904 - RNA, 14 nt, Human
accuuuuauuacau

SEQ ID NO: 2056905 - RNA, 15 nt, Human
accuuuuauccacuu

SEQ ID NO: 2056906 - RNA, 11 nt, Human
accuuuucucu

SEQ ID NO: 2056907 - RNA, 20 nt, Human
accuugaacuggguacuugu

SEQ ID NO: 2056908 - RNA, 18 nt, Human
accuugaacuccugggcu

SEQ ID NO: 2056909 - RNA, 18 nt, Human
accuugaacacuggggga

SEQ ID NO: 2056910 - RNA, 21 nt, Human
accuugaacacugggggaggg

SEQ ID NO: 2056911 - RNA, 23 nt, Human
ucauuccccagguggcugaccca

SEQ ID NO: 2056912 - RNA, 12 nt, Human
ucauuccccagg

SEQ ID NO: 2056913 - RNA, 14 nt, Human
ucauuccccaggug

SEQ ID NO: 2056914 - RNA, 17 nt, Human
ucauuccuaacacagca

SEQ ID NO: 2056915 - RNA, 14 nt, Human
ucauuccugaaaga

SEQ ID NO: 2056916 - RNA, 18 nt, Human
ucauuccuaacacagcau

SEQ ID NO: 2056917 - RNA, 16 nt, Human
ucauuccugaaagaaa

SEQ ID NO: 2056918 - RNA, 20 nt, Human
ucauuccugaaagaaacagu

SEQ ID NO: 2056919 - RNA, 21 nt, Human
ucauuccugaaagaaacaguu

SEQ ID NO: 2056920 - RNA, 22 nt, Human
ucauuccugaaagaaacaguua

SEQ ID NO: 2056921 - RNA, 13 nt, Human
ucauuccugccug

SEQ ID NO: 2056922 - RNA, 17 nt, Human
ucauuccugccugucuc

SEQ ID NO: 2056923 - RNA, 19 nt, Human
ucauuccugccugucuccu

SEQ ID NO: 2056924 - RNA, 19 nt, Human
accuuuuaaauccuguuga

SEQ ID NO: 2056925 - RNA, 20 nt, Human
accuuuuaaauccuguugaa

SEQ ID NO: 2056926 - RNA, 21 nt, Human
accuuuuaaauccuguugaaa

SEQ ID NO: 2056927 - RNA, 22 nt, Human
accuuuuaaauccuguugaaaa

SEQ ID NO: 2056928 - RNA, 23 nt, Human
accuuuuaaauccuguugaaaag

SEQ ID NO: 2056929 - RNA, 14 nt, Human
accuuuuaacucac

SEQ ID NO: 2056930 - RNA, 18 nt, Human
acgcgguacaaaggaaaa

SEQ ID NO: 2056931 - RNA, 12 nt, Human
acgcggccgaga

SEQ ID NO: 2056932 - RNA, 17 nt, Human
acgccugcuugucccug

SEQ ID NO: 2056933 - RNA, 21 nt, Human
acgccugcuugucccugccca

SEQ ID NO: 2056934 - RNA, 16 nt, Human
acgccuguaaucccag

SEQ ID NO: 2056935 - RNA, 17 nt, Human
acgccuguaaucccagc

SEQ ID NO: 2056936 - RNA, 20 nt, Human
acgccuguaaucccagcacu

SEQ ID NO: 2056937 - RNA, 18 nt, Human
acgccuguaaucccagca

SEQ ID NO: 2056938 - RNA, 19 nt, Human
acgccuguaaucccagcac

SEQ ID NO: 2056939 - RNA, 21 nt, Human
acgccuguaaucccagcacuu

SEQ ID NO: 2056940 - RNA, 16 nt, Human
acgccuguaguccuag

SEQ ID NO: 2056941 - RNA, 19 nt, Human
acgccuguaaucccagcag

SEQ ID NO: 2056942 - RNA, 14 nt, Human
acgccuuguucuug

SEQ ID NO: 2056943 - RNA, 18 nt, Human
acgccuuguucuuggcca

SEQ ID NO: 2056944 - RNA, 15 nt, Human
acgaacccaccugcu

SEQ ID NO: 2056945 - RNA, 16 nt, Human
acgaacccaccugcug

SEQ ID NO: 2056946 - RNA, 16 nt, Human
acgccuaugaucccag

SEQ ID NO: 2056947 - RNA, 17 nt, Human
acgccuaugaucccagc

SEQ ID NO: 2056948 - RNA, 18 nt, Human
acgccuaugaucccagca

SEQ ID NO: 2056949 - RNA, 16 nt, Human
acgcucccucccccug

SEQ ID NO: 2056950 - RNA, 17 nt, Human
acgcucccucccccugc

SEQ ID NO: 2056951 - RNA, 19 nt, Human
acgcucccucccccugccc

SEQ ID NO: 2056952 - RNA, 13 nt, Human
acgcuggaccuug

SEQ ID NO: 2056953 - RNA, 22 nt, Human
acgcucuccuuucuuucuaacu

SEQ ID NO: 2056954 - RNA, 16 nt, Human
acgcuggagugcagug

SEQ ID NO: 2056955 - RNA, 15 nt, Human
acgcuggagugcagu

SEQ ID NO: 2056956 - RNA, 23 nt, Human
acgcuggaccuugaacuggguac

SEQ ID NO: 2056957 - RNA, 20 nt, Human
acgcuggaccuugaacuggg

SEQ ID NO: 2056958 - RNA, 18 nt, Human
acgcuggagugcagugag

SEQ ID NO: 2056959 - RNA, 17 nt, Human
acgcuggagugcaguga

SEQ ID NO: 2056960 - RNA, 23 nt, Human
acggagucccaccuuggcugcag

SEQ ID NO: 2056961 - RNA, 20 nt, Human
acggauccauguagcaggac

SEQ ID NO: 2056962 - RNA, 18 nt, Human
acggcuuuuacuuaaacc

SEQ ID NO: 2056963 - RNA, 21 nt, Human
acggauccauguagcaggacu

SEQ ID NO: 2056964 - RNA, 12 nt, Human
acggccaggcca

SEQ ID NO: 2056965 - RNA, 18 nt, Human
acggcucacugcagccuc

SEQ ID NO: 2056966 - RNA, 17 nt, Human
acggcucacugcagccu

SEQ ID NO: 2056967 - RNA, 16 nt, Human
acggcucacugcagcc

SEQ ID NO: 2056968 - RNA, 18 nt, Human
uccagugcaacacugaag

SEQ ID NO: 2056969 - RNA, 18 nt, Human
uccagugagcuuaucaug

SEQ ID NO: 2056970 - RNA, 14 nt, Human
uccagugcaauugu

SEQ ID NO: 2056971 - RNA, 16 nt, Human
uccaguggccuggcuc

SEQ ID NO: 2056972 - RNA, 17 nt, Human
uccaguggccuggcucc

SEQ ID NO: 2056973 - RNA, 20 nt, Human
uccaguggccuggcuccgcu

SEQ ID NO: 2056974 - RNA, 22 nt, Human
uccaguggccuggcuccgcugu

SEQ ID NO: 2056975 - RNA, 23 nt, Human
uccaguggccuggcuccgcugug

SEQ ID NO: 2056976 - RNA, 19 nt, Human
uccaguggaagaagaaaac

SEQ ID NO: 2056977 - RNA, 22 nt, Human
uccaguggaagaagaaaacacu

SEQ ID NO: 2056978 - RNA, 13 nt, Human
uccagucugcugc

SEQ ID NO: 2056979 - RNA, 14 nt, Human
uccagucugcugcc

SEQ ID NO: 2056980 - RNA, 15 nt, Human
uccagucugcugccc

SEQ ID NO: 2056981 - RNA, 17 nt, Human
uccaguaccuuugucac

SEQ ID NO: 2056982 - RNA, 15 nt, Human
uccaguacuggagcu

SEQ ID NO: 2056983 - RNA, 21 nt, Human
uccaguacuggagcuucucuu

SEQ ID NO: 2056984 - RNA, 13 nt, Human
uccaguccugcuc

SEQ ID NO: 2056985 - RNA, 14 nt, Human
uccaguccugcucu

SEQ ID NO: 2056986 - RNA, 15 nt, Human
uccaguccugcucuc

SEQ ID NO: 2056987 - RNA, 16 nt, Human
uccaguccugcucucu

SEQ ID NO: 2056988 - RNA, 17 nt, Human
uccaguccugcucucua

SEQ ID NO: 2056989 - RNA, 21 nt, Human
uccaguccugcucucuaccca

SEQ ID NO: 2056990 - RNA, 16 nt, Human
acugcaacuucugccu

SEQ ID NO: 2056991 - RNA, 20 nt, Human
acugcaacuuguaaaugugg

SEQ ID NO: 2056992 - RNA, 14 nt, Human
acugcaacuucugc

SEQ ID NO: 2056993 - RNA, 14 nt, Human
acugagcagacugg

SEQ ID NO: 2056994 - RNA, 23 nt, Human
acugagcagacuggugagcagac

SEQ ID NO: 2056995 - RNA, 13 nt, Human
acugagcagacug

SEQ ID NO: 2056996 - RNA, 12 nt, Human
acugagcagacu

SEQ ID NO: 2056997 - RNA, 18 nt, Human
acugagcauagugguggg

SEQ ID NO: 2056998 - RNA, 14 nt, Human
acugcaccgggcca

SEQ ID NO: 2056999 - RNA, 20 nt, Human
acugcacuauagccuaggug

SEQ ID NO: 2057000 - RNA, 16 nt, Human
acugcaccgggccaca

SEQ ID NO: 2057001 - RNA, 15 nt, Human
acugcaauagagacu

SEQ ID NO: 2057002 - RNA, 16 nt, Human
acugcaauagagacug

SEQ ID NO: 2057003 - RNA, 17 nt, Human
acugcaauagagacugu

SEQ ID NO: 2057004 - RNA, 18 nt, Human
acugcaauagagacugua

SEQ ID NO: 2057005 - RNA, 19 nt, Human
acugcaauagagacuguag

SEQ ID NO: 2057006 - RNA, 23 nt, Human
acugcacagugcaucucagccca

SEQ ID NO: 2057007 - RNA, 22 nt, Human
acugcacagugcaucucagccc

SEQ ID NO: 2057008 - RNA, 18 nt, Human
acugcaagagccuuggug

SEQ ID NO: 2057009 - RNA, 20 nt, Human
acugcaagugagcaaaccug

SEQ ID NO: 2057010 - RNA, 15 nt, Human
acugcaagagccuug

SEQ ID NO: 2057011 - RNA, 16 nt, Human
acugcaagagccuugg

SEQ ID NO: 2057012 - RNA, 17 nt, Human
acugcaagagccuuggu

SEQ ID NO: 2057013 - RNA, 15 nt, Human
acugcaagucacaaa

SEQ ID NO: 2057014 - RNA, 17 nt, Human
acugcaagucacaaagg

SEQ ID NO: 2057015 - RNA, 18 nt, Human
acugcaagucacaaagga

SEQ ID NO: 2057016 - RNA, 19 nt, Human
acugcaagucacaaaggaa

SEQ ID NO: 2057017 - RNA, 20 nt, Human
acugcaagucacaaaggaau

SEQ ID NO: 2057018 - RNA, 21 nt, Human
acugcaagucacaaaggaaug

SEQ ID NO: 2057019 - RNA, 17 nt, Human
acugcacucuagccgga

SEQ ID NO: 2057020 - RNA, 18 nt, Human
acugcacucuagccggag

SEQ ID NO: 2057021 - RNA, 14 nt, Human
uccugaugacccag

SEQ ID NO: 2057022 - RNA, 15 nt, Human
uccugaugacccagg

SEQ ID NO: 2057023 - RNA, 16 nt, Human
uccugaugacccaggc

SEQ ID NO: 2057024 - RNA, 17 nt, Human
uccugaugacccaggcu

SEQ ID NO: 2057025 - RNA, 20 nt, Human
uccugaugacccaggcugcc

SEQ ID NO: 2057026 - RNA, 22 nt, Human
uccugaugacccaggcugccug

SEQ ID NO: 2057027 - RNA, 16 nt, Human
acugcacuccagccug

SEQ ID NO: 2057028 - RNA, 21 nt, Human
acugcacuauagccuagguga

SEQ ID NO: 2057029 - RNA, 14 nt, Human
acugcacuccagcc

SEQ ID NO: 2057030 - RNA, 16 nt, Human
acugcacguggcuucu

SEQ ID NO: 2057031 - RNA, 19 nt, Human
acugcacguggcuucugau

SEQ ID NO: 2057032 - RNA, 20 nt, Human
acugcacguggcuucugaug

SEQ ID NO: 2057033 - RNA, 15 nt, Human
acugcacuccagccu

SEQ ID NO: 2057034 - RNA, 17 nt, Human
acugcacuccagccugg

SEQ ID NO: 2057035 - RNA, 18 nt, Human
acugcacuccagccuggg

SEQ ID NO: 2057036 - RNA, 19 nt, Human
acugcacuccagccugggc

SEQ ID NO: 2057037 - RNA, 20 nt, Human
acugcacuccagccugggca

SEQ ID NO: 2057038 - RNA, 20 nt, Human
acugcacuccagccugggcg

SEQ ID NO: 2057039 - RNA, 21 nt, Human
acugcacuccagccugggcga

SEQ ID NO: 2057040 - RNA, 19 nt, Human
acugcacuccagccugggu

SEQ ID NO: 2057041 - RNA, 20 nt, Human
acugcacuccagccugggug

SEQ ID NO: 2057042 - RNA, 15 nt, Human
uccuggaaauauuaa

SEQ ID NO: 2057043 - RNA, 23 nt, Human
uccugcgggcuuuuccccggucc

SEQ ID NO: 2057044 - RNA, 21 nt, Human
uccuggaagcuguguccuugc

SEQ ID NO: 2057045 - RNA, 14 nt, Human
uccuggaagcugug

SEQ ID NO: 2057046 - RNA, 22 nt, Human
uccuggaaaggcucagucucag

SEQ ID NO: 2057047 - RNA, 16 nt, Human
uccuggaaaggcucag

SEQ ID NO: 2057048 - RNA, 19 nt, Human
uccuggaaaggcucagucu

SEQ ID NO: 2057049 - RNA, 17 nt, Human
uccugggagugagcugg

SEQ ID NO: 2057050 - RNA, 14 nt, Human
uccugggagugagc

SEQ ID NO: 2057051 - RNA, 12 nt, Human
uccugggaguga

SEQ ID NO: 2057052 - RNA, 19 nt, Human
uccugggagaaccucaggc

SEQ ID NO: 2057053 - RNA, 20 nt, Human
uccugggagaaccucaggcu

SEQ ID NO: 2057054 - RNA, 17 nt, Human
uccugggagaaccucag

SEQ ID NO: 2057055 - RNA, 18 nt, Human
uccugggagaaccucagg

SEQ ID NO: 2057056 - RNA, 15 nt, Human
uccuggcuuugccca

SEQ ID NO: 2057057 - RNA, 16 nt, Human
uccuggcuuugcccaa

SEQ ID NO: 2057058 - RNA, 17 nt, Human
uccuggcuuugcccaac

SEQ ID NO: 2057059 - RNA, 23 nt, Human
uccuggcuuugcccaaccucagc

SEQ ID NO: 2057060 - RNA, 13 nt, Human
uccuggcucagcc

SEQ ID NO: 2057061 - RNA, 16 nt, Human
uccuggcucagccuca

SEQ ID NO: 2057062 - RNA, 13 nt, Human
uccuggcuccuga

SEQ ID NO: 2057063 - RNA, 16 nt, Human
uccuggcuccugaggg

SEQ ID NO: 2057064 - RNA, 14 nt, Human
uccugccugugcug

SEQ ID NO: 2057065 - RNA, 20 nt, Human
uccugcgggcuuuuccccgg

SEQ ID NO: 2057066 - RNA, 12 nt, Human
uccugcgggcuu

SEQ ID NO: 2057067 - RNA, 12 nt, Human
uccugccugugc

SEQ ID NO: 2057068 - RNA, 14 nt, Human
uccugccuggccag

SEQ ID NO: 2057069 - RNA, 16 nt, Human
uccugccuggccaggc

SEQ ID NO: 2057070 - RNA, 14 nt, Human
uccugccuggucuc

SEQ ID NO: 2057071 - RNA, 17 nt, Human
uccugccuggucuccug

SEQ ID NO: 2057072 - RNA, 18 nt, Human
uccugccuggucuccugc

SEQ ID NO: 2057073 - RNA, 21 nt, Human
uccugccuggucuccugcccc

SEQ ID NO: 2057074 - RNA, 23 nt, Human
uccugccuggucuccugccccca

SEQ ID NO: 2057075 - RNA, 20 nt, Human
uccugccugucuccuuugca

SEQ ID NO: 2057076 - RNA, 17 nt, Human
uccugcagccuggaggc

SEQ ID NO: 2057077 - RNA, 14 nt, Human
uccugcagccugga

SEQ ID NO: 2057078 - RNA, 12 nt, Human
uccugccuggcc

SEQ ID NO: 2057079 - RNA, 13 nt, Human
uccugccuggcca

SEQ ID NO: 2057080 - RNA, 13 nt, Human
acugaacauucca

SEQ ID NO: 2057081 - RNA, 16 nt, Human
acugaacauuccagag

SEQ ID NO: 2057082 - RNA, 18 nt, Human
acucuuuuuguuuuuugu

SEQ ID NO: 2057083 - RNA, 19 nt, Human
acugaacauguacacuggu

SEQ ID NO: 2057084 - RNA, 12 nt, Human
acucuuguaaga

SEQ ID NO: 2057085 - RNA, 13 nt, Human
acucuuguaagau

SEQ ID NO: 2057086 - RNA, 14 nt, Human
acucuuguaagauu

SEQ ID NO: 2057087 - RNA, 15 nt, Human
acucuuguaagauuu

SEQ ID NO: 2057088 - RNA, 16 nt, Human
acucuuguaagauuuu

SEQ ID NO: 2057089 - RNA, 18 nt, Human
acucuuguaagauuuuga

SEQ ID NO: 2057090 - RNA, 19 nt, Human
acucuuguaagauuuugaa

SEQ ID NO: 2057091 - RNA, 20 nt, Human
acucuuguaagauuuugaaa

SEQ ID NO: 2057092 - RNA, 21 nt, Human
acucuuguaagauuuugaaaa

SEQ ID NO: 2057093 - RNA, 22 nt, Human
acucuuguaagauuuugaaaac

SEQ ID NO: 2057094 - RNA, 23 nt, Human
acucuuguaagauuuugaaaacu

SEQ ID NO: 2057095 - RNA, 14 nt, Human
uccugaaugaaaua

SEQ ID NO: 2057096 - RNA, 19 nt, Human
uccugaaugaaauaucaga

SEQ ID NO: 2057097 - RNA, 18 nt, Human
acucugcccuacucacuc

SEQ ID NO: 2057098 - RNA, 19 nt, Human
uccugaaacuuacacacaa

SEQ ID NO: 2057099 - RNA, 18 nt, Human
uccugaaagaaacaguua

SEQ ID NO: 2057100 - RNA, 21 nt, Human
uccugaaagaaacaguuaacu

SEQ ID NO: 2057101 - RNA, 19 nt, Human
uccucuuuccaucuacccu

SEQ ID NO: 2057102 - RNA, 11 nt, Human
uccucccuccc

SEQ ID NO: 2057103 - RNA, 14 nt, Human
uccucccucccucu

SEQ ID NO: 2057104 - RNA, 11 nt, Human
uccucuuucca

SEQ ID NO: 2057105 - RNA, 12 nt, Human
uccucuuuccau

SEQ ID NO: 2057106 - RNA, 14 nt, Human
acugacuccuuaga

SEQ ID NO: 2057107 - RNA, 15 nt, Human
acugacccacagccu

SEQ ID NO: 2057108 - RNA, 20 nt, Human
acugacccacagccucugcc

SEQ ID NO: 2057109 - RNA, 18 nt, Human
acugacccucccuuccug

SEQ ID NO: 2057110 - RNA, 17 nt, Human
acugaccggaggcaaaa

SEQ ID NO: 2057111 - RNA, 23 nt, Human
acugagaaaacgaaacugcucua

SEQ ID NO: 2057112 - RNA, 16 nt, Human
acugagagaucugcug

SEQ ID NO: 2057113 - RNA, 17 nt, Human
acugagagaucugcugu

SEQ ID NO: 2057114 - RNA, 21 nt, Human
acugagcaagacccugucucu

SEQ ID NO: 2057115 - RNA, 17 nt, Human
acucuuaggaagagaaa

SEQ ID NO: 2057116 - RNA, 14 nt, Human
acucuugaccucag

SEQ ID NO: 2057117 - RNA, 20 nt, Human
acucuuaggaagagaaacca

SEQ ID NO: 2057118 - RNA, 19 nt, Human
acucuuaggaagagaaacc

SEQ ID NO: 2057119 - RNA, 16 nt, Human
acucuugaccucaggu

SEQ ID NO: 2057120 - RNA, 15 nt, Human
acucuugaccucagg

SEQ ID NO: 2057121 - RNA, 15 nt, Human
acucuuaguuacuca

SEQ ID NO: 2057122 - RNA, 22 nt, Human
uccucacccugauuucuugcuu

SEQ ID NO: 2057123 - RNA, 21 nt, Human
uccucccaggcgccccuuccc

SEQ ID NO: 2057124 - RNA, 19 nt, Human
uccucccaggcgccccuuc

SEQ ID NO: 2057125 - RNA, 13 nt, Human
uccucccaggcgc

SEQ ID NO: 2057126 - RNA, 22 nt, Human
uccucauaguaugguggcuggg

SEQ ID NO: 2057127 - RNA, 24 nt, Human
uccucagggacagagacaccugca

SEQ ID NO: 2057128 - RNA, 13 nt, Human
uccucaggcugcu

SEQ ID NO: 2057129 - RNA, 19 nt, Human
uccucaggcugcuggagga

SEQ ID NO: 2057130 - RNA, 16 nt, Human
uccucagggacagaga

SEQ ID NO: 2057131 - RNA, 18 nt, Human
uccucagggacagagaca

SEQ ID NO: 2057132 - RNA, 22 nt, Human
uccucagggacagagacaccug

SEQ ID NO: 2057133 - RNA, 17 nt, Human
uccucacucccagucca

SEQ ID NO: 2057134 - RNA, 12 nt, Human
uccucacuccca

SEQ ID NO: 2057135 - RNA, 13 nt, Human
uccucacucccag

SEQ ID NO: 2057136 - RNA, 14 nt, Human
uccucacucccagu

SEQ ID NO: 2057137 - RNA, 12 nt, Human
uccucaccucug

SEQ ID NO: 2057138 - RNA, 13 nt, Human
uccucaccucugg

SEQ ID NO: 2057139 - RNA, 15 nt, Human
uccucaccucuggac

SEQ ID NO: 2057140 - RNA, 16 nt, Human
uccucaccucuggacu

SEQ ID NO: 2057141 - RNA, 20 nt, Human
uccucaccucuggacuggcu

SEQ ID NO: 2057142 - RNA, 21 nt, Human
uccucaccucuggacuggcua

SEQ ID NO: 2057143 - RNA, 22 nt, Human
uccucaccucuggacuggcuag

SEQ ID NO: 2057144 - RNA, 23 nt, Human
uccucaccucuggacuggcuaga

SEQ ID NO: 2057145 - RNA, 13 nt, Human
acuccuuccugcc

SEQ ID NO: 2057146 - RNA, 20 nt, Human
acuccuuccugccaccugcu

SEQ ID NO: 2057147 - RNA, 15 nt, Human
acuccugggcucaag

SEQ ID NO: 2057148 - RNA, 21 nt, Human
acuccugggcucaagcagucu

SEQ ID NO: 2057149 - RNA, 16 nt, Human
acuccuggggccucuu

SEQ ID NO: 2057150 - RNA, 21 nt, Human
acuccuggggccucuuggguc

SEQ ID NO: 2057151 - RNA, 21 nt, Human
acuccuuccugccaccugcug

SEQ ID NO: 2057152 - RNA, 14 nt, Human
acucuccccucuua

SEQ ID NO: 2057153 - RNA, 22 nt, Human
acucuccgcggugguuguuggg

SEQ ID NO: 2057154 - RNA, 18 nt, Human
acucuccuggaaauauua

SEQ ID NO: 2057155 - RNA, 12 nt, Human
acucugccuccu

SEQ ID NO: 2057156 - RNA, 13 nt, Human
acucugccagcca

SEQ ID NO: 2057157 - RNA, 16 nt, Human
acucugccagccacau

SEQ ID NO: 2057158 - RNA, 16 nt, Human
acucugaguuuaccau

SEQ ID NO: 2057159 - RNA, 21 nt, Human
acucugaguuuaccauuugua

SEQ ID NO: 2057160 - RNA, 22 nt, Human
acucugaguuuaccauuuguaa

SEQ ID NO: 2057161 - RNA, 12 nt, Human
acucugauguaa

SEQ ID NO: 2057162 - RNA, 14 nt, Human
acucugauguaaau

SEQ ID NO: 2057163 - RNA, 17 nt, Human
acucugauguaaaugaa

SEQ ID NO: 2057164 - RNA, 16 nt, Human
acucugccuccucuuc

SEQ ID NO: 2057165 - RNA, 21 nt, Human
acucucuccacccuauaugua

SEQ ID NO: 2057166 - RNA, 13 nt, Human
acucucuccaccc

SEQ ID NO: 2057167 - RNA, 20 nt, Human
acucucuccacccuauaugu

SEQ ID NO: 2057168 - RNA, 11 nt, Human
acucuccuggg

SEQ ID NO: 2057169 - RNA, 12 nt, Human
acucuccugggc

SEQ ID NO: 2057170 - RNA, 13 nt, Human
acucuccugggcc

SEQ ID NO: 2057171 - RNA, 14 nt, Human
acucuccugggccc

SEQ ID NO: 2057172 - RNA, 15 nt, Human
acucuccugggcccc

SEQ ID NO: 2057173 - RNA, 16 nt, Human
acucuccugggccccu

SEQ ID NO: 2057174 - RNA, 17 nt, Human
acucuccugggccccuc

SEQ ID NO: 2057175 - RNA, 18 nt, Human
acucuccugggccccucc

SEQ ID NO: 2057176 - RNA, 21 nt, Human
acucugaggcucuuucugggc

SEQ ID NO: 2057177 - RNA, 23 nt, Human
acucugaggcucuuucugggcca

SEQ ID NO: 2057178 - RNA, 20 nt, Human
acuccucaaaagcaaaugag

SEQ ID NO: 2057179 - RNA, 21 nt, Human
acuccucaaaagcaaaugaga

SEQ ID NO: 2057180 - RNA, 14 nt, Human
acuccaugagaagc

SEQ ID NO: 2057181 - RNA, 17 nt, Human
acuccaugagaagccgu

SEQ ID NO: 2057182 - RNA, 14 nt, Human
acuccaucagcuua

SEQ ID NO: 2057183 - RNA, 19 nt, Human
acuccaucucaaaaaauaa

SEQ ID NO: 2057184 - RNA, 16 nt, Human
acucacaugcuggaca

SEQ ID NO: 2057185 - RNA, 18 nt, Human
acucacaugcuggacagg

SEQ ID NO: 2057186 - RNA, 21 nt, Human
acuccagaccccuggcuuuuc

SEQ ID NO: 2057187 - RNA, 19 nt, Human
acuccagaccccuggcuuu

SEQ ID NO: 2057188 - RNA, 18 nt, Human
acuccagaccccuggcuu

SEQ ID NO: 2057189 - RNA, 13 nt, Human
acuccagaucugc

SEQ ID NO: 2057190 - RNA, 15 nt, Human
acuccagaucugcac

SEQ ID NO: 2057191 - RNA, 16 nt, Human
acucacagagacacag

SEQ ID NO: 2057192 - RNA, 17 nt, Human
acucacagagacacagg

SEQ ID NO: 2057193 - RNA, 18 nt, Human
acucacagagacacaggg

SEQ ID NO: 2057194 - RNA, 15 nt, Human
acuccagaccccugg

SEQ ID NO: 2057195 - RNA, 13 nt, Human
acuccagaccccu

SEQ ID NO: 2057196 - RNA, 11 nt, Human
acuccuggccu

SEQ ID NO: 2057197 - RNA, 16 nt, Human
acuccucccugaugua

SEQ ID NO: 2057198 - RNA, 17 nt, Human
acuccucccugauguac

SEQ ID NO: 2057199 - RNA, 20 nt, Human
acuccucccugauguacagu

SEQ ID NO: 2057200 - RNA, 12 nt, Human
acuccucccagg

SEQ ID NO: 2057201 - RNA, 19 nt, Human
acuccucauuguaaacaaa

SEQ ID NO: 2057202 - RNA, 14 nt, Human
acuccuggccucaa

SEQ ID NO: 2057203 - RNA, 13 nt, Human
acuccuggccuca

SEQ ID NO: 2057204 - RNA, 12 nt, Human
acuccuggccuc

SEQ ID NO: 2057205 - RNA, 13 nt, Human
uccuaggcauuug

SEQ ID NO: 2057206 - RNA, 12 nt, Human
uccuagcugugu

SEQ ID NO: 2057207 - RNA, 14 nt, Human
uccuagcugugugc

SEQ ID NO: 2057208 - RNA, 15 nt, Human
uccuagcugugugca

SEQ ID NO: 2057209 - RNA, 21 nt, Human
uccuagcuugggaggcuuccc

SEQ ID NO: 2057210 - RNA, 22 nt, Human
uccuagcuugggaggcuucccc

SEQ ID NO: 2057211 - RNA, 18 nt, Human
uccuaggaguauccucau

SEQ ID NO: 2057212 - RNA, 15 nt, Human
uccguaguucccuga

SEQ ID NO: 2057213 - RNA, 14 nt, Human
uccguaguucccug

SEQ ID NO: 2057214 - RNA, 15 nt, Human
uccuacucuguguca

SEQ ID NO: 2057215 - RNA, 13 nt, Human
uccguauuucaga

SEQ ID NO: 2057216 - RNA, 14 nt, Human
uccuacucuguguc

SEQ ID NO: 2057217 - RNA, 13 nt, Human
uccuacucugugu

SEQ ID NO: 2057218 - RNA, 18 nt, Human
uccggugugccugcagcc

SEQ ID NO: 2057219 - RNA, 19 nt, Human
uccggugugccugcagccc

SEQ ID NO: 2057220 - RNA, 15 nt, Human
ucccuuugaaaugaa

SEQ ID NO: 2057221 - RNA, 18 nt, Human
uccgguggaaggccuucu

SEQ ID NO: 2057222 - RNA, 12 nt, Human
uccggugugccu

SEQ ID NO: 2057223 - RNA, 15 nt, Human
uccggugugccugca

SEQ ID NO: 2057224 - RNA, 17 nt, Human
uccggugugccugcagc

SEQ ID NO: 2057225 - RNA, 16 nt, Human
ucccuuggccucagaa

SEQ ID NO: 2057226 - RNA, 12 nt, Human
ucccuuggccuc

SEQ ID NO: 2057227 - RNA, 13 nt, Human
ucccuuggccuca

SEQ ID NO: 2057228 - RNA, 14 nt, Human
ucccuuggccucag

SEQ ID NO: 2057229 - RNA, 12 nt, Human
acuccuggaaau

SEQ ID NO: 2057230 - RNA, 13 nt, Human
acuccuggaagcu

SEQ ID NO: 2057231 - RNA, 16 nt, Human
acuccuggaagcugug

SEQ ID NO: 2057232 - RNA, 22 nt, Human
agaaagcccuuaggaagaauuu

SEQ ID NO: 2057233 - RNA, 20 nt, Human
agaaagcccuuaggaagaau

SEQ ID NO: 2057234 - RNA, 15 nt, Human
agaaagccucagaga

SEQ ID NO: 2057235 - RNA, 21 nt, Human
agaaagccucagagaauugcu

SEQ ID NO: 2057236 - RNA, 14 nt, Human
agaaauaugugguu

SEQ ID NO: 2057237 - RNA, 15 nt, Human
agaaauaugugguuu

SEQ ID NO: 2057238 - RNA, 16 nt, Human
agaaaugcaaauucuc

SEQ ID NO: 2057239 - RNA, 18 nt, Human
agaaaugcaaauucucaa

SEQ ID NO: 2057240 - RNA, 13 nt, Human
agaaaugcacaau

SEQ ID NO: 2057241 - RNA, 19 nt, Human
agaaaugcacaaugucuug

SEQ ID NO: 2057242 - RNA, 13 nt, Human
agaaaugaaauuu

SEQ ID NO: 2057243 - RNA, 14 nt, Human
agaaaugaaauuuu

SEQ ID NO: 2057244 - RNA, 18 nt, Human
agaaaugaaauuuuacca

SEQ ID NO: 2057245 - RNA, 19 nt, Human
agaaaugaaauuuuaccaa

SEQ ID NO: 2057246 - RNA, 20 nt, Human
agaaaugaaauuuuaccaag

SEQ ID NO: 2057247 - RNA, 23 nt, Human
agaaaugaaauuuuaccaaguua

SEQ ID NO: 2057248 - RNA, 12 nt, Human
agaaaugaauaa

SEQ ID NO: 2057249 - RNA, 19 nt, Human
agaaaugaauaauuuccca

SEQ ID NO: 2057250 - RNA, 23 nt, Human
agaaaugaccaauauuauacuaa

SEQ ID NO: 2057251 - RNA, 14 nt, Human
ucuccuuucaggga

SEQ ID NO: 2057252 - RNA, 15 nt, Human
ucuccuuucuuucua

SEQ ID NO: 2057253 - RNA, 16 nt, Human
ucuccuuucacaaccu

SEQ ID NO: 2057254 - RNA, 19 nt, Human
ucuccuuagucuucucaua

SEQ ID NO: 2057255 - RNA, 14 nt, Human
acuuuugugugaaa

SEQ ID NO: 2057256 - RNA, 17 nt, Human
ucuccuuugcaggcuca

SEQ ID NO: 2057257 - RNA, 21 nt, Human
agaaagccaaaucaaaauaug

SEQ ID NO: 2057258 - RNA, 21 nt, Human
ucugaaggacauugcggacag

SEQ ID NO: 2057259 - RNA, 22 nt, Human
agaaaugcauccauuccucagg

SEQ ID NO: 2057260 - RNA, 18 nt, Human
agaaaugcauccauuccu

SEQ ID NO: 2057261 - RNA, 22 nt, Human
ucugaaggacauugcggacagc

SEQ ID NO: 2057262 - RNA, 12 nt, Human
ucugaauguaau

SEQ ID NO: 2057263 - RNA, 14 nt, Human
ucugaauguaauuu

SEQ ID NO: 2057264 - RNA, 16 nt, Human
ucugaauguaauuugu

SEQ ID NO: 2057265 - RNA, 20 nt, Human
ucugaauguaauuuguguaa

SEQ ID NO: 2057266 - RNA, 21 nt, Human
ucugaauguaauuuguguaau

SEQ ID NO: 2057267 - RNA, 23 nt, Human
ucugaauguaauuuguguaauaa

SEQ ID NO: 2057268 - RNA, 12 nt, Human
ucugaauguucu

SEQ ID NO: 2057269 - RNA, 13 nt, Human
ucugaauguucug

SEQ ID NO: 2057270 - RNA, 14 nt, Human
ucugaauguucuga

SEQ ID NO: 2057271 - RNA, 16 nt, Human
ucugaauguucugaca

SEQ ID NO: 2057272 - RNA, 17 nt, Human
ucugaauguucugacau

SEQ ID NO: 2057273 - RNA, 19 nt, Human
ucugaauguucugacauua

SEQ ID NO: 2057274 - RNA, 22 nt, Human
ucugaauguucugacauuaaca

SEQ ID NO: 2057275 - RNA, 12 nt, Human
ucugacucccaa

SEQ ID NO: 2057276 - RNA, 19 nt, Human
ucugacucccaaagagcug

SEQ ID NO: 2057277 - RNA, 15 nt, Human
ucugacacacagcuc

SEQ ID NO: 2057278 - RNA, 14 nt, Human
ucugacacacagcu

SEQ ID NO: 2057279 - RNA, 13 nt, Human
ucugacacacagc

SEQ ID NO: 2057280 - RNA, 23 nt, Human
ucugaauguucugacauuaacag

SEQ ID NO: 2057281 - RNA, 14 nt, Human
ucugaauuccaagu

SEQ ID NO: 2057282 - RNA, 13 nt, Human
ucugcaggcaggg

SEQ ID NO: 2057283 - RNA, 21 nt, Human
ucugaugcaagcaagaaacac

SEQ ID NO: 2057284 - RNA, 14 nt, Human
ucugcaggcagggc

SEQ ID NO: 2057285 - RNA, 16 nt, Human
ucugaugcaagcaaga

SEQ ID NO: 2057286 - RNA, 12 nt, Human
ucugaugaaucu

SEQ ID NO: 2057287 - RNA, 13 nt, Human
ucugaugaaucuu

SEQ ID NO: 2057288 - RNA, 14 nt, Human
ucugaugaaucuug

SEQ ID NO: 2057289 - RNA, 17 nt, Human
ucugaucguucuuucua

SEQ ID NO: 2057290 - RNA, 21 nt, Human
ucugaucauccacugugccau

SEQ ID NO: 2057291 - RNA, 17 nt, Human
ucugaucauccacugug

SEQ ID NO: 2057292 - RNA, 20 nt, Human
agaaagccagucuuaacauu

SEQ ID NO: 2057293 - RNA, 22 nt, Human
ucugacucuccgcggugguugu

SEQ ID NO: 2057294 - RNA, 14 nt, Human
ucugacugcacgug

SEQ ID NO: 2057295 - RNA, 20 nt, Human
ucugacugcacguggcuucu

SEQ ID NO: 2057296 - RNA, 23 nt, Human
ucugagaaggggaggaccucugg

SEQ ID NO: 2057297 - RNA, 17 nt, Human
ucugagaagguccuuaa

SEQ ID NO: 2057298 - RNA, 18 nt, Human
ucugagaagguccuuaau

SEQ ID NO: 2057299 - RNA, 20 nt, Human
ucugagaagguccuuaauga

SEQ ID NO: 2057300 - RNA, 16 nt, Human
ucugagucaacuccuu

SEQ ID NO: 2057301 - RNA, 23 nt, Human
ucugaguaucuccucgcaagcug

SEQ ID NO: 2057302 - RNA, 18 nt, Human
ucugaguaucuccucgca

SEQ ID NO: 2057303 - RNA, 20 nt, Human
agaaauugcauuuccugaca

SEQ ID NO: 2057304 - RNA, 17 nt, Human
agaaauugcauuuccug

SEQ ID NO: 2057305 - RNA, 23 nt, Human
agaaauuccuugauucacaauga

SEQ ID NO: 2057306 - RNA, 22 nt, Human
agaacuggacucaggaugccca

SEQ ID NO: 2057307 - RNA, 22 nt, Human
agaacugcuuuaucccacggaa

SEQ ID NO: 2057308 - RNA, 23 nt, Human
agaacugcauggaccuaacauuc

SEQ ID NO: 2057309 - RNA, 15 nt, Human
agaacuggacucagg

SEQ ID NO: 2057310 - RNA, 16 nt, Human
agaacuggacucagga

SEQ ID NO: 2057311 - RNA, 17 nt, Human
agaacuggacucaggau

SEQ ID NO: 2057312 - RNA, 20 nt, Human
agaacuggacucaggaugcc

SEQ ID NO: 2057313 - RNA, 17 nt, Human
agaagaauugaacccag

SEQ ID NO: 2057314 - RNA, 20 nt, Human
agaagaauugaacccaggag

SEQ ID NO: 2057315 - RNA, 14 nt, Human
agaagaauauuguu

SEQ ID NO: 2057316 - RNA, 20 nt, Human
agaagaauauuguuccuaag

SEQ ID NO: 2057317 - RNA, 22 nt, Human
agaagaauauuguuccuaaguu

SEQ ID NO: 2057318 - RNA, 19 nt, Human
agaagaauugaacccagga

SEQ ID NO: 2057319 - RNA, 22 nt, Human
agaagaauuuucagaccccagc

SEQ ID NO: 2057320 - RNA, 23 nt, Human
agaagaauuuucagaccccagcg

SEQ ID NO: 2057321 - RNA, 13 nt, Human
agaagaacaucca

SEQ ID NO: 2057322 - RNA, 12 nt, Human
agaagaaaugaa

SEQ ID NO: 2057323 - RNA, 13 nt, Human
agaagaaaugaaa

SEQ ID NO: 2057324 - RNA, 14 nt, Human
agaagaaaugaaau

SEQ ID NO: 2057325 - RNA, 17 nt, Human
agaagaaaugaaauuuu

SEQ ID NO: 2057326 - RNA, 18 nt, Human
agaagaaaugaaauuuua

SEQ ID NO: 2057327 - RNA, 19 nt, Human
agaagaaaugaaauuuuac

SEQ ID NO: 2057328 - RNA, 20 nt, Human
agaagaauacaaacauauuu

SEQ ID NO: 2057329 - RNA, 19 nt, Human
agaagaacuagagguuuua

SEQ ID NO: 2057330 - RNA, 23 nt, Human
agaagaacuagagguuuuaugau

SEQ ID NO: 2057331 - RNA, 18 nt, Human
agaagauuuugaaauuuu

SEQ ID NO: 2057332 - RNA, 17 nt, Human
agaagcaacagaaaaaa

SEQ ID NO: 2057333 - RNA, 21 nt, Human
agaagcccaauauuauaauuu

SEQ ID NO: 2057334 - RNA, 17 nt, Human
agaagccaaaagauugg

SEQ ID NO: 2057335 - RNA, 13 nt, Human
ucugcuucagcuu

SEQ ID NO: 2057336 - RNA, 14 nt, Human
ucugcuucagcuug

SEQ ID NO: 2057337 - RNA, 20 nt, Human
ucugcuugccgaaacuggaa

SEQ ID NO: 2057338 - RNA, 18 nt, Human
ucugcuugcucuuguccu

SEQ ID NO: 2057339 - RNA, 13 nt, Human
ucugcuucagccu

SEQ ID NO: 2057340 - RNA, 23 nt, Human
ucugcuccacccuuggccugucu

SEQ ID NO: 2057341 - RNA, 20 nt, Human
ucugcuccacccuuggccug

SEQ ID NO: 2057342 - RNA, 21 nt, Human
ucugcuccacccuuggccugu

SEQ ID NO: 2057343 - RNA, 15 nt, Human
ucugcuucagccucc

SEQ ID NO: 2057344 - RNA, 14 nt, Human
ucugcuucagccuc

SEQ ID NO: 2057345 - RNA, 10 nt, Human
ucugcuccac

SEQ ID NO: 2057346 - RNA, 12 nt, Human
ucugcuccacca

SEQ ID NO: 2057347 - RNA, 14 nt, Human
ucugcuccaccaca

SEQ ID NO: 2057348 - RNA, 20 nt, Human
ucugcuccaccacauccucc

SEQ ID NO: 2057349 - RNA, 12 nt, Human
ucugcuccaccc

SEQ ID NO: 2057350 - RNA, 14 nt, Human
ucugcuccacccuu

SEQ ID NO: 2057351 - RNA, 15 nt, Human
ucugcuccacccuug

SEQ ID NO: 2057352 - RNA, 16 nt, Human
ucugcuccacccuugg

SEQ ID NO: 2057353 - RNA, 17 nt, Human
ucugcuccacccuuggc

SEQ ID NO: 2057354 - RNA, 18 nt, Human
ucugcuccacccuuggcc

SEQ ID NO: 2057355 - RNA, 19 nt, Human
ucugcuccacccuuggccu

SEQ ID NO: 2057356 - RNA, 20 nt, Human
ucugcucacauaucugucau

SEQ ID NO: 2057357 - RNA, 19 nt, Human
ucugcucacauaucuguca

SEQ ID NO: 2057358 - RNA, 21 nt, Human
ucugcuaacuuggagccccag

SEQ ID NO: 2057359 - RNA, 22 nt, Human
ucugccugcccaggccccugcc

SEQ ID NO: 2057360 - RNA, 21 nt, Human
ucugccugcccaggccccugc

SEQ ID NO: 2057361 - RNA, 12 nt, Human
ucugccuguccc

SEQ ID NO: 2057362 - RNA, 22 nt, Human
ucugcgugguuccuuucucagc

SEQ ID NO: 2057363 - RNA, 15 nt, Human
ucugcgucuguguug

SEQ ID NO: 2057364 - RNA, 18 nt, Human
ucugcccucccuccuucc

SEQ ID NO: 2057365 - RNA, 14 nt, Human
ucugcccugcccac

SEQ ID NO: 2057366 - RNA, 18 nt, Human
ucugcccugcccuagcuc

SEQ ID NO: 2057367 - RNA, 16 nt, Human
ucuguugcccaggcug

SEQ ID NO: 2057368 - RNA, 18 nt, Human
ucuguugccacaacccug

SEQ ID NO: 2057369 - RNA, 17 nt, Human
ucuguuggccaguguga

SEQ ID NO: 2057370 - RNA, 12 nt, Human
ucuguuggccag

SEQ ID NO: 2057371 - RNA, 12 nt, Human
ucuguugaaguu

SEQ ID NO: 2057372 - RNA, 16 nt, Human
agaauucuuacauguu

SEQ ID NO: 2057373 - RNA, 17 nt, Human
agaauucuuacauguuu

SEQ ID NO: 2057374 - RNA, 19 nt, Human
agaauucuuacauguuuuc

SEQ ID NO: 2057375 - RNA, 20 nt, Human
agaauucuuacauguuuucu

SEQ ID NO: 2057376 - RNA, 23 nt, Human
agaauucuuacauguuuucuuug

SEQ ID NO: 2057377 - RNA, 14 nt, Human
agaauucuuucaag

SEQ ID NO: 2057378 - RNA, 17 nt, Human
agaauucuucaggugga

SEQ ID NO: 2057379 - RNA, 13 nt, Human
agaauucuuucaa

SEQ ID NO: 2057380 - RNA, 16 nt, Human
agaauugaacccagga

SEQ ID NO: 2057381 - RNA, 17 nt, Human
agaauugaacccaggag

SEQ ID NO: 2057382 - RNA, 15 nt, Human
ucuguuguguucguu

SEQ ID NO: 2057383 - RNA, 12 nt, Human
ucuguuguuuuu

SEQ ID NO: 2057384 - RNA, 17 nt, Human
ucuguuuaaaguagauu

SEQ ID NO: 2057385 - RNA, 18 nt, Human
ucugucagaugggaagac

SEQ ID NO: 2057386 - RNA, 19 nt, Human
ucugucagaugggaagaca

SEQ ID NO: 2057387 - RNA, 23 nt, Human
ucugggccaaguuccucuagugc

SEQ ID NO: 2057388 - RNA, 18 nt, Human
ucugggccaagucaaaga

SEQ ID NO: 2057389 - RNA, 23 nt, Human
ucuguauuugaaucagccuacag

SEQ ID NO: 2057390 - RNA, 21 nt, Human
ucugugaacgauuuagaaaga

SEQ ID NO: 2057391 - RNA, 17 nt, Human
ucugugaacgauuuaga

SEQ ID NO: 2057392 - RNA, 17 nt, Human
ucugugaaaugcuggca

SEQ ID NO: 2057393 - RNA, 20 nt, Human
ucugugaaaugcuggcauuu

SEQ ID NO: 2057394 - RNA, 16 nt, Human
agacacaggcccggcu

SEQ ID NO: 2057395 - RNA, 17 nt, Human
agacacaggauagauaa

SEQ ID NO: 2057396 - RNA, 23 nt, Human
agacacaggauagauaacucuuu

SEQ ID NO: 2057397 - RNA, 13 nt, Human
agacacaggcccg

SEQ ID NO: 2057398 - RNA, 12 nt, Human
agacacaggccc

SEQ ID NO: 2057399 - RNA, 13 nt, Human
agacacacacaca

SEQ ID NO: 2057400 - RNA, 21 nt, Human
agaauuuuaagugcuuuguaa

SEQ ID NO: 2057401 - RNA, 22 nt, Human
agaauuuuaagugcuuuguaau

SEQ ID NO: 2057402 - RNA, 12 nt, Human
agacacacacac

SEQ ID NO: 2057403 - RNA, 22 nt, Human
agaauugaacccaggaggugga

SEQ ID NO: 2057404 - RNA, 18 nt, Human
agaauugaacccaggagg

SEQ ID NO: 2057405 - RNA, 19 nt, Human
agaauugaacccaggaggu

SEQ ID NO: 2057406 - RNA, 20 nt, Human
agaauugauauacacggaug

SEQ ID NO: 2057407 - RNA, 21 nt, Human
agaauugaucauuuucccccc

SEQ ID NO: 2057408 - RNA, 22 nt, Human
agaauugaucauuuucccccca

SEQ ID NO: 2057409 - RNA, 16 nt, Human
agaauuuuaagugcuu

SEQ ID NO: 2057410 - RNA, 13 nt, Human
agaauuuuaaauu

SEQ ID NO: 2057411 - RNA, 15 nt, Human
agaauuuuaaauuau

SEQ ID NO: 2057412 - RNA, 18 nt, Human
agaauuuuaaauuauaac

SEQ ID NO: 2057413 - RNA, 20 nt, Human
agacacuucuaaaugaagug

SEQ ID NO: 2057414 - RNA, 15 nt, Human
agacacuugauacuu

SEQ ID NO: 2057415 - RNA, 18 nt, Human
agacacuguuuacaagaa

SEQ ID NO: 2057416 - RNA, 19 nt, Human
agacacuguuuacaagaaa

SEQ ID NO: 2057417 - RNA, 20 nt, Human
agacacuguuuacaagaaaa

SEQ ID NO: 2057418 - RNA, 22 nt, Human
agacacuguuuacaagaaaaaa

SEQ ID NO: 2057419 - RNA, 22 nt, Human
agacagagccccacccucagau

SEQ ID NO: 2057420 - RNA, 24 nt, Human
agacagagccccacccucagaugc

SEQ ID NO: 2057421 - RNA, 17 nt, Human
agacaccuugacagggc

SEQ ID NO: 2057422 - RNA, 19 nt, Human
agacaccguucauucaggc

SEQ ID NO: 2057423 - RNA, 12 nt, Human
agacaccucaga

SEQ ID NO: 2057424 - RNA, 14 nt, Human
agacaccucagagc

SEQ ID NO: 2057425 - RNA, 15 nt, Human
agacaccucagagcc

SEQ ID NO: 2057426 - RNA, 16 nt, Human
agacaccucagagccc

SEQ ID NO: 2057427 - RNA, 14 nt, Human
agacaccugcaccu

SEQ ID NO: 2057428 - RNA, 16 nt, Human
agacaccugcaccucc

SEQ ID NO: 2057429 - RNA, 17 nt, Human
agacaccugcaccuccc

SEQ ID NO: 2057430 - RNA, 21 nt, Human
agacaccugcaccucccccca

SEQ ID NO: 2057431 - RNA, 18 nt, Human
agacaccuugacagggca

SEQ ID NO: 2057432 - RNA, 20 nt, Human
agacaccugcaccucccccc

SEQ ID NO: 2057433 - RNA, 19 nt, Human
agacacugaccauccacuc

SEQ ID NO: 2057434 - RNA, 15 nt, Human
agacacagggcaucc

SEQ ID NO: 2057435 - RNA, 21 nt, Human
agacacagggcauccaacuga

SEQ ID NO: 2057436 - RNA, 21 nt, Human
agaauugauuucccuucuucu

SEQ ID NO: 2057437 - RNA, 17 nt, Human
agacacauccagcaauu

SEQ ID NO: 2057438 - RNA, 13 nt, Human
agaauucagcugc

SEQ ID NO: 2057439 - RNA, 14 nt, Human
agaauucagcugcc

SEQ ID NO: 2057440 - RNA, 15 nt, Human
agaauucagcugccc

SEQ ID NO: 2057441 - RNA, 16 nt, Human
agaauucagcugcccc

SEQ ID NO: 2057442 - RNA, 17 nt, Human
agaauucagcugccccc

SEQ ID NO: 2057443 - RNA, 14 nt, Human
ucugggcaggaccu

SEQ ID NO: 2057444 - RNA, 18 nt, Human
ucugggcaggaccucaga

SEQ ID NO: 2057445 - RNA, 19 nt, Human
ucugggcaggaccucagag

SEQ ID NO: 2057446 - RNA, 12 nt, Human
ucugggccaagu

SEQ ID NO: 2057447 - RNA, 16 nt, Human
ucugggccaaguuccu

SEQ ID NO: 2057448 - RNA, 19 nt, Human
ucugggccaaguuccucua

SEQ ID NO: 2057449 - RNA, 14 nt, Human
agaauguuuuccuu

SEQ ID NO: 2057450 - RNA, 16 nt, Human
agaauguuuuccuucu

SEQ ID NO: 2057451 - RNA, 14 nt, Human
agaaugucagaaaa

SEQ ID NO: 2057452 - RNA, 15 nt, Human
agaaugucagaaaaa

SEQ ID NO: 2057453 - RNA, 17 nt, Human
agaaugucagaaaaaca

SEQ ID NO: 2057454 - RNA, 15 nt, Human
agaaugucagauucc

SEQ ID NO: 2057455 - RNA, 18 nt, Human
agaaugucagauuccuuu

SEQ ID NO: 2057456 - RNA, 19 nt, Human
agaaugucagauuccuuuc

SEQ ID NO: 2057457 - RNA, 21 nt, Human
agaaugucagauuccuuuccc

SEQ ID NO: 2057458 - RNA, 14 nt, Human
agaaucauacuuag

SEQ ID NO: 2057459 - RNA, 16 nt, Human
agaaucagugcaaaga

SEQ ID NO: 2057460 - RNA, 14 nt, Human
agaaucauuauuua

SEQ ID NO: 2057461 - RNA, 17 nt, Human
agaaucauuauuuauua

SEQ ID NO: 2057462 - RNA, 20 nt, Human
agaaucauuauuuauuaaau

SEQ ID NO: 2057463 - RNA, 21 nt, Human
agaaucauuauuuauuaaauu

SEQ ID NO: 2057464 - RNA, 22 nt, Human
agaaucauuauuuauuaaauuu

SEQ ID NO: 2057465 - RNA, 13 nt, Human
agaaucauugcuu

SEQ ID NO: 2057466 - RNA, 14 nt, Human
agaaucauugcuua

SEQ ID NO: 2057467 - RNA, 13 nt, Human
agaaucauuguaa

SEQ ID NO: 2057468 - RNA, 11 nt, Human
agaauauuuau

SEQ ID NO: 2057469 - RNA, 14 nt, Human
agaauauuguuccu

SEQ ID NO: 2057470 - RNA, 15 nt, Human
agaauauuguuccua

SEQ ID NO: 2057471 - RNA, 16 nt, Human
agaauauuguuccuaa

SEQ ID NO: 2057472 - RNA, 20 nt, Human
agaauauuguuccuaaguuc

SEQ ID NO: 2057473 - RNA, 21 nt, Human
agaauauuguuccuaaguucu

SEQ ID NO: 2057474 - RNA, 22 nt, Human
agaauauuguuccuaaguucuu

SEQ ID NO: 2057475 - RNA, 23 nt, Human
agaauauuagcuuuacuguuugu

SEQ ID NO: 2057476 - RNA, 22 nt, Human
agaauauuuauuaccucugaua

SEQ ID NO: 2057477 - RNA, 13 nt, Human
agaaucagccuag

SEQ ID NO: 2057478 - RNA, 19 nt, Human
agaauauuuauuaccucug

SEQ ID NO: 2057479 - RNA, 16 nt, Human
agaauauuuauuaccu

SEQ ID NO: 2057480 - RNA, 15 nt, Human
agaauggggugcaug

SEQ ID NO: 2057481 - RNA, 14 nt, Human
agaaucccuguuca

SEQ ID NO: 2057482 - RNA, 15 nt, Human
agaaucccuguucau

SEQ ID NO: 2057483 - RNA, 16 nt, Human
agaaucccuguucauu

SEQ ID NO: 2057484 - RNA, 18 nt, Human
ucugcuuugacugagcag

SEQ ID NO: 2057485 - RNA, 23 nt, Human
agaaguggaccaggacaggacca

SEQ ID NO: 2057486 - RNA, 18 nt, Human
agaagggaaggggagagg

SEQ ID NO: 2057487 - RNA, 16 nt, Human
agaaggcuggggcuau

SEQ ID NO: 2057488 - RNA, 12 nt, Human
agaagggaaaca

SEQ ID NO: 2057489 - RNA, 14 nt, Human
agaagggaaacagu

SEQ ID NO: 2057490 - RNA, 15 nt, Human
agaagggaaacaguc

SEQ ID NO: 2057491 - RNA, 16 nt, Human
agaagggaaacaguca

SEQ ID NO: 2057492 - RNA, 17 nt, Human
agaaggccaagaggcug

SEQ ID NO: 2057493 - RNA, 13 nt, Human
agaaggccaagag

SEQ ID NO: 2057494 - RNA, 15 nt, Human
agaaggcagggaaag

SEQ ID NO: 2057495 - RNA, 13 nt, Human
agaaggcagcagg

SEQ ID NO: 2057496 - RNA, 20 nt, Human
agaaguggggacagagcaga

SEQ ID NO: 2057497 - RNA, 17 nt, Human
agaagugggccaggaca

SEQ ID NO: 2057498 - RNA, 18 nt, Human
agaagugggccaggacag

SEQ ID NO: 2057499 - RNA, 19 nt, Human
agaagugggccaggacagg

SEQ ID NO: 2057500 - RNA, 23 nt, Human
agaagugggccaggacaggcccg

SEQ ID NO: 2057501 - RNA, 16 nt, Human
agaaguguuucaugca

SEQ ID NO: 2057502 - RNA, 15 nt, Human
agaaguuaagcaaca

SEQ ID NO: 2057503 - RNA, 19 nt, Human
agaaguguccgagaacuaa

SEQ ID NO: 2057504 - RNA, 18 nt, Human
agaaguuuagauuuuaau

SEQ ID NO: 2057505 - RNA, 19 nt, Human
agaaguuaagcaacaucua

SEQ ID NO: 2057506 - RNA, 19 nt, Human
agaauauuagcuuuacugu

SEQ ID NO: 2057507 - RNA, 20 nt, Human
agaauauuagcuuuacuguu

SEQ ID NO: 2057508 - RNA, 21 nt, Human
agaauauuagcuuuacuguuu

SEQ ID NO: 2057509 - RNA, 16 nt, Human
agaauagaugcugacu

SEQ ID NO: 2057510 - RNA, 12 nt, Human
agaauagaagga

SEQ ID NO: 2057511 - RNA, 13 nt, Human
agaauagaaggaa

SEQ ID NO: 2057512 - RNA, 14 nt, Human
agaauagaaggaaa

SEQ ID NO: 2057513 - RNA, 15 nt, Human
agaauagaaggaaac

SEQ ID NO: 2057514 - RNA, 16 nt, Human
agaauagaaggaaacu

SEQ ID NO: 2057515 - RNA, 17 nt, Human
agaauagaaggaaacua

SEQ ID NO: 2057516 - RNA, 20 nt, Human
agaauagaaggaaacuagcu

SEQ ID NO: 2057517 - RNA, 22 nt, Human
agaauaauaugcugccaaauuu

SEQ ID NO: 2057518 - RNA, 14 nt, Human
agaauaauaagagg

SEQ ID NO: 2057519 - RNA, 23 nt, Human
agaauaauaugcugccaaauuuu

SEQ ID NO: 2057520 - RNA, 21 nt, Human
ucuauuaccacugaagauaga

SEQ ID NO: 2057521 - RNA, 14 nt, Human
ucuauuagacuuua

SEQ ID NO: 2057522 - RNA, 18 nt, Human
ucuauuagacuuuagaaa

SEQ ID NO: 2057523 - RNA, 19 nt, Human
ucuauuagacuuuagaaau

SEQ ID NO: 2057524 - RNA, 22 nt, Human
ucuauggguaucaaacagcuca

SEQ ID NO: 2057525 - RNA, 19 nt, Human
ucuauucucuccucagacu

SEQ ID NO: 2057526 - RNA, 23 nt, Human
ucuaugggacucaaugcacugac

SEQ ID NO: 2057527 - RNA, 16 nt, Human
ucuauagacucuagga

SEQ ID NO: 2057528 - RNA, 13 nt, Human
ucuaugguaaaga

SEQ ID NO: 2057529 - RNA, 17 nt, Human
ucuaugguaaagauauu

SEQ ID NO: 2057530 - RNA, 22 nt, Human
ucuaugguaaagauauuauuca

SEQ ID NO: 2057531 - RNA, 13 nt, Human
ucuauagacucua

SEQ ID NO: 2057532 - RNA, 19 nt, Human
ucucacuauguugcccagg

SEQ ID NO: 2057533 - RNA, 17 nt, Human
ucucacuauguugccca

SEQ ID NO: 2057534 - RNA, 15 nt, Human
ucucaccccauccca

SEQ ID NO: 2057535 - RNA, 21 nt, Human
ucucaccccaucccacacccu

SEQ ID NO: 2057536 - RNA, 17 nt, Human
ucucaccccaucccaca

SEQ ID NO: 2057537 - RNA, 19 nt, Human
ucucaccccaucccacacc

SEQ ID NO: 2057538 - RNA, 22 nt, Human
ucuauuuguauauauacauaac

SEQ ID NO: 2057539 - RNA, 12 nt, Human
ucuauuuuaauu

SEQ ID NO: 2057540 - RNA, 13 nt, Human
ucuauuuauugga

SEQ ID NO: 2057541 - RNA, 22 nt, Human
ucuauuuauuuacugagcuucu

SEQ ID NO: 2057542 - RNA, 15 nt, Human
ucuauuuauuuacug

SEQ ID NO: 2057543 - RNA, 13 nt, Human
ucuauuuagcaug

SEQ ID NO: 2057544 - RNA, 17 nt, Human
ucuauugcuggcaaaga

SEQ ID NO: 2057545 - RNA, 16 nt, Human
ucuauugggauuuucu

SEQ ID NO: 2057546 - RNA, 15 nt, Human
ucuauuggguucauu

SEQ ID NO: 2057547 - RNA, 14 nt, Human
ucuauuuaagugua

SEQ ID NO: 2057548 - RNA, 22 nt, Human
ucuauugcuggcaaagacagaa

SEQ ID NO: 2057549 - RNA, 14 nt, Human
ucuaguugaggagu

SEQ ID NO: 2057550 - RNA, 19 nt, Human
ucuaguugaggaguuuccu

SEQ ID NO: 2057551 - RNA, 20 nt, Human
ucuaguugaggaguuuccua

SEQ ID NO: 2057552 - RNA, 21 nt, Human
ucuaguugaggaguuuccuaa

SEQ ID NO: 2057553 - RNA, 15 nt, Human
ucuauaacaugcauu

SEQ ID NO: 2057554 - RNA, 19 nt, Human
ucuagaauuuuaagugcuu

SEQ ID NO: 2057555 - RNA, 13 nt, Human
ucuagacaacccu

SEQ ID NO: 2057556 - RNA, 17 nt, Human
ucuagacaacccugcaa

SEQ ID NO: 2057557 - RNA, 22 nt, Human
acuuccccgcauuccaggcucc

SEQ ID NO: 2057558 - RNA, 17 nt, Human
acuucauagauuuccuu

SEQ ID NO: 2057559 - RNA, 19 nt, Human
ucuagagccugcuggaucu

SEQ ID NO: 2057560 - RNA, 20 nt, Human
ucuagagccgugaugccucc

SEQ ID NO: 2057561 - RNA, 14 nt, Human
ucuagagagggaau

SEQ ID NO: 2057562 - RNA, 22 nt, Human
ucuagagagggaauucucuugg

SEQ ID NO: 2057563 - RNA, 23 nt, Human
ucuagagagggaauucucuuggc

SEQ ID NO: 2057564 - RNA, 16 nt, Human
ucuagagauaguacau

SEQ ID NO: 2057565 - RNA, 20 nt, Human
ucuagagauaguacauaaag

SEQ ID NO: 2057566 - RNA, 20 nt, Human
ucuacagcuaaucagcauuc

SEQ ID NO: 2057567 - RNA, 16 nt, Human
ucuacagaugucccau

SEQ ID NO: 2057568 - RNA, 17 nt, Human
ucuacagaugucccauu

SEQ ID NO: 2057569 - RNA, 14 nt, Human
ucuacagcaaauuu

SEQ ID NO: 2057570 - RNA, 16 nt, Human
ucuacagcaaauuuau

SEQ ID NO: 2057571 - RNA, 17 nt, Human
ucuacagcaaauuuaua

SEQ ID NO: 2057572 - RNA, 18 nt, Human
ucuacagcaaauuuauaa

SEQ ID NO: 2057573 - RNA, 19 nt, Human
ucuacagcaaauuuauaau

SEQ ID NO: 2057574 - RNA, 22 nt, Human
ucuacagcaaauuuauaauuuu

SEQ ID NO: 2057575 - RNA, 19 nt, Human
ucuaauagaacucaguuuu

SEQ ID NO: 2057576 - RNA, 23 nt, Human
ucuacagcuaaucagcauucuca

SEQ ID NO: 2057577 - RNA, 19 nt, Human
ucuacccagcgagcccugg

SEQ ID NO: 2057578 - RNA, 21 nt, Human
ucuacagaggccaugggccuc

SEQ ID NO: 2057579 - RNA, 18 nt, Human
uccugggagugagcuggu

SEQ ID NO: 2057580 - RNA, 23 nt, Human
uccugggagaaccucaggcuucc

SEQ ID NO: 2057581 - RNA, 21 nt, Human
ucuacccuggcacuauaaugu

SEQ ID NO: 2057582 - RNA, 13 nt, Human
ucuacccagccca

SEQ ID NO: 2057583 - RNA, 14 nt, Human
ucuacccagcccau

SEQ ID NO: 2057584 - RNA, 15 nt, Human
ucuacccagcccauc

SEQ ID NO: 2057585 - RNA, 16 nt, Human
ucuacccagcccaucu

SEQ ID NO: 2057586 - RNA, 17 nt, Human
ucuacccagcccaucuu

SEQ ID NO: 2057587 - RNA, 20 nt, Human
ucuacccagcccaucuugcc

SEQ ID NO: 2057588 - RNA, 21 nt, Human
ucuacccagcccaucuugccu

SEQ ID NO: 2057589 - RNA, 20 nt, Human
ucuacccagcgagcccuggu

SEQ ID NO: 2057590 - RNA, 19 nt, Human
ucuacccuggcacuauaau

SEQ ID NO: 2057591 - RNA, 14 nt, Human
ucuacccuggcacu

SEQ ID NO: 2057592 - RNA, 23 nt, Human
acuucaggguucuccucuccccu

SEQ ID NO: 2057593 - RNA, 21 nt, Human
acuucaggguucuccucuccc

SEQ ID NO: 2057594 - RNA, 22 nt, Human
acuucaggguucuccucucccc

SEQ ID NO: 2057595 - RNA, 16 nt, Human
acuuauuaucuucagg

SEQ ID NO: 2057596 - RNA, 15 nt, Human
acuuauucauugugg

SEQ ID NO: 2057597 - RNA, 20 nt, Human
acuuauucauugugguuauu

SEQ ID NO: 2057598 - RNA, 15 nt, Human
acuuagguguggggg

SEQ ID NO: 2057599 - RNA, 17 nt, Human
acuuaguauauuuucuu

SEQ ID NO: 2057600 - RNA, 18 nt, Human
acuuaggcaugcacagcu

SEQ ID NO: 2057601 - RNA, 21 nt, Human
acuuaggcaugcacagcugua

SEQ ID NO: 2057602 - RNA, 23 nt, Human
acuuauguuacugguguccagcu

SEQ ID NO: 2057603 - RNA, 23 nt, Human
acuuacagauaggccuucuugug

SEQ ID NO: 2057604 - RNA, 14 nt, Human
acuuagcuuaucaa

SEQ ID NO: 2057605 - RNA, 16 nt, Human
acuuagcuuaucaauu

SEQ ID NO: 2057606 - RNA, 17 nt, Human
acuuagcuuaucaauuu

SEQ ID NO: 2057607 - RNA, 19 nt, Human
acuuagcuuaucaauuugu

SEQ ID NO: 2057608 - RNA, 20 nt, Human
acuuagcuuaucaauuuguc

SEQ ID NO: 2057609 - RNA, 21 nt, Human
acuuagcuuaucaauuuguca

SEQ ID NO: 2057610 - RNA, 22 nt, Human
acuuagcuuaucaauuugucau

SEQ ID NO: 2057611 - RNA, 21 nt, Human
acuuagcuugaaggaucuguu

SEQ ID NO: 2057612 - RNA, 18 nt, Human
acuuacacaucuuccaca

SEQ ID NO: 2057613 - RNA, 17 nt, Human
acuuacacuuuaugcac

SEQ ID NO: 2057614 - RNA, 21 nt, Human
acuuaacagaugcaaugugcu

SEQ ID NO: 2057615 - RNA, 14 nt, Human
acuuaacagaugca

SEQ ID NO: 2057616 - RNA, 17 nt, Human
acuuaaauuuuaauuua

SEQ ID NO: 2057617 - RNA, 16 nt, Human
acuuaaccgcaucaga

SEQ ID NO: 2057618 - RNA, 17 nt, Human
acuuaaccgcaucagaa

SEQ ID NO: 2057619 - RNA, 18 nt, Human
acuuaaccgcaucagaag

SEQ ID NO: 2057620 - RNA, 16 nt, Human
acuuaaccggaguucg

SEQ ID NO: 2057621 - RNA, 14 nt, Human
acuuaaauguuacc

SEQ ID NO: 2057622 - RNA, 18 nt, Human
acuguugccagagaugga

SEQ ID NO: 2057623 - RNA, 18 nt, Human
acuuaaauaucaaucauu

SEQ ID NO: 2057624 - RNA, 13 nt, Human
acuuaaaugaaag

SEQ ID NO: 2057625 - RNA, 14 nt, Human
acuguugccagaga

SEQ ID NO: 2057626 - RNA, 16 nt, Human
acuuacacuuuaugca

SEQ ID NO: 2057627 - RNA, 16 nt, Human
acuuaagaaacacuga

SEQ ID NO: 2057628 - RNA, 19 nt, Human
acuugcacgcccaugugug

SEQ ID NO: 2057629 - RNA, 21 nt, Human
acuugaugaguguaacaagaa

SEQ ID NO: 2057630 - RNA, 22 nt, Human
acuugaugaguguaacaagaaa

SEQ ID NO: 2057631 - RNA, 16 nt, Human
acuugauggucagaca

SEQ ID NO: 2057632 - RNA, 22 nt, Human
acuugauggucagacacaaaca

SEQ ID NO: 2057633 - RNA, 23 nt, Human
acuugauggucagacacaaacaa

SEQ ID NO: 2057634 - RNA, 23 nt, Human
ucucacuauguugcccaggcagg

SEQ ID NO: 2057635 - RNA, 22 nt, Human
ucucacuauguugcccaggcag

SEQ ID NO: 2057636 - RNA, 21 nt, Human
ucucacuauguugcccaggca

SEQ ID NO: 2057637 - RNA, 20 nt, Human
ucucacuauguugcccaggc

SEQ ID NO: 2057638 - RNA, 22 nt, Human
acuugcagacucuacagaggcc

SEQ ID NO: 2057639 - RNA, 19 nt, Human
acuugcagacucuacagag

SEQ ID NO: 2057640 - RNA, 23 nt, Human
acuugcagacucuacagaggcca

SEQ ID NO: 2057641 - RNA, 12 nt, Human
ucucacuccacc

SEQ ID NO: 2057642 - RNA, 21 nt, Human
acuugcugaaucggaaucucu

SEQ ID NO: 2057643 - RNA, 22 nt, Human
acuuguggacacagcucuucuc

SEQ ID NO: 2057644 - RNA, 19 nt, Human
acuuguggacacagcucuu

SEQ ID NO: 2057645 - RNA, 15 nt, Human
acuugucuuuuucug

SEQ ID NO: 2057646 - RNA, 17 nt, Human
acuugucuuuuucugga

SEQ ID NO: 2057647 - RNA, 17 nt, Human
acuugcugccugaagaa

SEQ ID NO: 2057648 - RNA, 23 nt, Human
acuugcugccugaagaacaguaa

SEQ ID NO: 2057649 - RNA, 14 nt, Human
acuugcugcuauuu

SEQ ID NO: 2057650 - RNA, 15 nt, Human
acuugcugcuauuuu

SEQ ID NO: 2057651 - RNA, 17 nt, Human
acuugcugcuauuuuac

SEQ ID NO: 2057652 - RNA, 16 nt, Human
acuugucuuuuucugg

SEQ ID NO: 2057653 - RNA, 15 nt, Human
ucucagccaacgagu

SEQ ID NO: 2057654 - RNA, 21 nt, Human
ucucagccgcuucugacugcu

SEQ ID NO: 2057655 - RNA, 21 nt, Human
ucucagcaaugauuacucuuu

SEQ ID NO: 2057656 - RNA, 11 nt, Human
ucucagccucc

SEQ ID NO: 2057657 - RNA, 18 nt, Human
ucucaggcaugccugugu

SEQ ID NO: 2057658 - RNA, 20 nt, Human
ucucaggcaugccuguguga

SEQ ID NO: 2057659 - RNA, 21 nt, Human
ucucaggcaugccugugugac

SEQ ID NO: 2057660 - RNA, 13 nt, Human
ucucaggccaccu

SEQ ID NO: 2057661 - RNA, 18 nt, Human
ucucaggccaccugcccc

SEQ ID NO: 2057662 - RNA, 19 nt, Human
ucucaggccaccugccccc

SEQ ID NO: 2057663 - RNA, 20 nt, Human
ucucaggaucaagaaagugu

SEQ ID NO: 2057664 - RNA, 21 nt, Human
ucucaggaccuagggauguuc

SEQ ID NO: 2057665 - RNA, 16 nt, Human
ucucaggaccuaggga

SEQ ID NO: 2057666 - RNA, 15 nt, Human
ucucaggagcauggg

SEQ ID NO: 2057667 - RNA, 14 nt, Human
ucucauuugucaca

SEQ ID NO: 2057668 - RNA, 16 nt, Human
ucucauuugucacaca

SEQ ID NO: 2057669 - RNA, 21 nt, Human
ucucaggccaccugcccccuu

SEQ ID NO: 2057670 - RNA, 14 nt, Human
agaaaaaauacauu

SEQ ID NO: 2057671 - RNA, 16 nt, Human
agaaaaaauacauuuu

SEQ ID NO: 2057672 - RNA, 18 nt, Human
agaaaaaauacauuuuau

SEQ ID NO: 2057673 - RNA, 18 nt, Human
agaaaaaauaacacacau

SEQ ID NO: 2057674 - RNA, 11 nt, Human
agaaaaaauac

SEQ ID NO: 2057675 - RNA, 17 nt, Human
agaaaaaauauuuuccc

SEQ ID NO: 2057676 - RNA, 17 nt, Human
ucuccuuagucuucuca

SEQ ID NO: 2057677 - RNA, 22 nt, Human
agaaaaaauacauuuuauauua

SEQ ID NO: 2057678 - RNA, 18 nt, Human
ucuccuuagucuucucau

SEQ ID NO: 2057679 - RNA, 21 nt, Human
acuuuuuauauuuuauacauu

SEQ ID NO: 2057680 - RNA, 14 nt, Human
agaaaaaagaaugu

SEQ ID NO: 2057681 - RNA, 16 nt, Human
agaaaaaagaauguca

SEQ ID NO: 2057682 - RNA, 22 nt, Human
agaaaaaagaaugucagaaaaa

SEQ ID NO: 2057683 - RNA, 17 nt, Human
acuuuuuauauuuuaua

SEQ ID NO: 2057684 - RNA, 22 nt, Human
acuuuggugcgggcacaauaaa

SEQ ID NO: 2057685 - RNA, 23 nt, Human
acuuuggugcgggcacaauaaau

SEQ ID NO: 2057686 - RNA, 17 nt, Human
acuuuggaaguuugugu

SEQ ID NO: 2057687 - RNA, 18 nt, Human
acuuuggaaguuuguguu

SEQ ID NO: 2057688 - RNA, 21 nt, Human
acuuuggaaguuuguguucug

SEQ ID NO: 2057689 - RNA, 23 nt, Human
ucuccgaccagacaccuugacag

SEQ ID NO: 2057690 - RNA, 17 nt, Human
ucuccgaccagacaccu

SEQ ID NO: 2057691 - RNA, 12 nt, Human
ucuccucacuga

SEQ ID NO: 2057692 - RNA, 14 nt, Human
ucuccucagacugc

SEQ ID NO: 2057693 - RNA, 12 nt, Human
ucuccacccugc

SEQ ID NO: 2057694 - RNA, 23 nt, Human
ucuccccagcaagugagagcugg

SEQ ID NO: 2057695 - RNA, 17 nt, Human
ucuccuccauacucagg

SEQ ID NO: 2057696 - RNA, 18 nt, Human
ucuccuccauacucagga

SEQ ID NO: 2057697 - RNA, 19 nt, Human
acuuucuguugccacaacc

SEQ ID NO: 2057698 - RNA, 19 nt, Human
ugacuauuuuucagaaucu

SEQ ID NO: 2057699 - RNA, 21 nt, Human
ugacucguauaugucucaggu

SEQ ID NO: 2057700 - RNA, 16 nt, Human
ugacuuaacugcauuu

SEQ ID NO: 2057701 - RNA, 22 nt, Human
ugacuguuuuuuaaacuaggaa

SEQ ID NO: 2057702 - RNA, 21 nt, Human
ugacuguuuucucuugagagg

SEQ ID NO: 2057703 - RNA, 13 nt, Human
ugacucucuguga

SEQ ID NO: 2057704 - RNA, 15 nt, Human
ugacucucugugacc

SEQ ID NO: 2057705 - RNA, 14 nt, Human
ugacuagugcugaa

SEQ ID NO: 2057706 - RNA, 15 nt, Human
ugacuagugcugaag

SEQ ID NO: 2057707 - RNA, 17 nt, Human
ugacuagugcugaagcu

SEQ ID NO: 2057708 - RNA, 18 nt, Human
ugacuagugcugaagcuu

SEQ ID NO: 2057709 - RNA, 22 nt, Human
ugacuagugcugaagcuuauua

SEQ ID NO: 2057710 - RNA, 21 nt, Human
ugacuagugcugaagcuuauu

SEQ ID NO: 2057711 - RNA, 16 nt, Human
ugacuaucaaacugaa

SEQ ID NO: 2057712 - RNA, 22 nt, Human
ugacuaucaaacugaagccaga

SEQ ID NO: 2057713 - RNA, 20 nt, Human
ugacuauugaaguugcagau

SEQ ID NO: 2057714 - RNA, 19 nt, Human
ugaccugccaggcacacug

SEQ ID NO: 2057715 - RNA, 16 nt, Human
ugaccugccaggcaca

SEQ ID NO: 2057716 - RNA, 20 nt, Human
ugaccugccccgcccagcug

SEQ ID NO: 2057717 - RNA, 13 nt, Human
ugaccugccccgc

SEQ ID NO: 2057718 - RNA, 19 nt, Human
ugaccugccccgcccagcu

SEQ ID NO: 2057719 - RNA, 17 nt, Human
agaugugauaaggauca

SEQ ID NO: 2057720 - RNA, 13 nt, Human
agaugucuuuagg

SEQ ID NO: 2057721 - RNA, 23 nt, Human
agaugucuuuaggcagcagcuuu

SEQ ID NO: 2057722 - RNA, 15 nt, Human
agaugucuuuaggca

SEQ ID NO: 2057723 - RNA, 12 nt, Human
ugaccugucacc

SEQ ID NO: 2057724 - RNA, 14 nt, Human
ugacuuaugggccc

SEQ ID NO: 2057725 - RNA, 16 nt, Human
agauuagaucuuuuaa

SEQ ID NO: 2057726 - RNA, 15 nt, Human
agauuagaucuuuua

SEQ ID NO: 2057727 - RNA, 21 nt, Human
agauuacccccucauuguuua

SEQ ID NO: 2057728 - RNA, 13 nt, Human
agauucauauuua

SEQ ID NO: 2057729 - RNA, 16 nt, Human
agauucauauuuacuu

SEQ ID NO: 2057730 - RNA, 19 nt, Human
agauuccagagaguggcuc

SEQ ID NO: 2057731 - RNA, 22 nt, Human
agauuccagagaguggcuccuc

SEQ ID NO: 2057732 - RNA, 21 nt, Human
agauuccagagaguggcuccu

SEQ ID NO: 2057733 - RNA, 19 nt, Human
agauucauauuuacuucuu

SEQ ID NO: 2057734 - RNA, 12 nt, Human
agauucccagag

SEQ ID NO: 2057735 - RNA, 13 nt, Human
agauucccagaga

SEQ ID NO: 2057736 - RNA, 14 nt, Human
agauuguuaaaaua

SEQ ID NO: 2057737 - RNA, 15 nt, Human
agauuguuaaaauaa

SEQ ID NO: 2057738 - RNA, 14 nt, Human
agauucccagagac

SEQ ID NO: 2057739 - RNA, 15 nt, Human
agauuucagucuuuu

SEQ ID NO: 2057740 - RNA, 17 nt, Human
agauuucagucuuuucc

SEQ ID NO: 2057741 - RNA, 13 nt, Human
agauuuguuuugu

SEQ ID NO: 2057742 - RNA, 14 nt, Human
agauuuguuuugug

SEQ ID NO: 2057743 - RNA, 21 nt, Human
agauuuuaauuuugaauaaau

SEQ ID NO: 2057744 - RNA, 17 nt, Human
agauuuuacaaaagaug

SEQ ID NO: 2057745 - RNA, 18 nt, Human
agauuuuacaaaagaugu

SEQ ID NO: 2057746 - RNA, 19 nt, Human
agauuuuacaaaagaugua

SEQ ID NO: 2057747 - RNA, 20 nt, Human
agauuuuacaaaagauguau

SEQ ID NO: 2057748 - RNA, 17 nt, Human
agauuuuaauuuugaau

SEQ ID NO: 2057749 - RNA, 14 nt, Human
agauuuuaauuuug

SEQ ID NO: 2057750 - RNA, 16 nt, Human
agauuuuaaucaaauu

SEQ ID NO: 2057751 - RNA, 18 nt, Human
agauuuuaaucaaauuug

SEQ ID NO: 2057752 - RNA, 15 nt, Human
agauuuuaaucaaau

SEQ ID NO: 2057753 - RNA, 22 nt, Human
agauuuuaaauucacaauagaa

SEQ ID NO: 2057754 - RNA, 13 nt, Human
agauuuuaaauuc

SEQ ID NO: 2057755 - RNA, 19 nt, Human
agauuuuaaauucacaaua

SEQ ID NO: 2057756 - RNA, 16 nt, Human
agaucguucucugccu

SEQ ID NO: 2057757 - RNA, 20 nt, Human
agaucuaagccuuuccauaa

SEQ ID NO: 2057758 - RNA, 17 nt, Human
agaucguuaguaucuaa

SEQ ID NO: 2057759 - RNA, 16 nt, Human
agaucguuaguaucua

SEQ ID NO: 2057760 - RNA, 13 nt, Human
agaucuccaaagc

SEQ ID NO: 2057761 - RNA, 14 nt, Human
agaucuccaaagcu

SEQ ID NO: 2057762 - RNA, 15 nt, Human
agaucuccaaagcuu

SEQ ID NO: 2057763 - RNA, 21 nt, Human
agaucuccaaagcuuuccugg

SEQ ID NO: 2057764 - RNA, 22 nt, Human
agaucuccaaagcuuuccugga

SEQ ID NO: 2057765 - RNA, 19 nt, Human
agaucuaggugaggauuga

SEQ ID NO: 2057766 - RNA, 15 nt, Human
agaugcaaggaccag

SEQ ID NO: 2057767 - RNA, 23 nt, Human
ugaccaacauggagaaacccugu

SEQ ID NO: 2057768 - RNA, 22 nt, Human
ugaccaaccuuuucccaaccau

SEQ ID NO: 2057769 - RNA, 14 nt, Human
ugaccaagaacugc

SEQ ID NO: 2057770 - RNA, 15 nt, Human
ugaccaagaacugca

SEQ ID NO: 2057771 - RNA, 16 nt, Human
ugaccaagaacugcau

SEQ ID NO: 2057772 - RNA, 18 nt, Human
ugaccaagaacugcaugg

SEQ ID NO: 2057773 - RNA, 19 nt, Human
ugaccaagaacugcaugga

SEQ ID NO: 2057774 - RNA, 15 nt, Human
ugaccaagagagaaa

SEQ ID NO: 2057775 - RNA, 14 nt, Human
ugaccaagcaggaa

SEQ ID NO: 2057776 - RNA, 16 nt, Human
ugaccaagagagaaag

SEQ ID NO: 2057777 - RNA, 17 nt, Human
ugaccaagagagaaaga

SEQ ID NO: 2057778 - RNA, 18 nt, Human
ugaccaagagagaaagaa

SEQ ID NO: 2057779 - RNA, 15 nt, Human
ugaccaagcaggaag

SEQ ID NO: 2057780 - RNA, 16 nt, Human
ugaccaagcaggaagc

SEQ ID NO: 2057781 - RNA, 17 nt, Human
ugaccaagcaggaagcu

SEQ ID NO: 2057782 - RNA, 18 nt, Human
ugaccaagcaggaagcuc

SEQ ID NO: 2057783 - RNA, 19 nt, Human
ugaccaagcaggaagcuca

SEQ ID NO: 2057784 - RNA, 21 nt, Human
ugaccaagcaggaagcucaga

SEQ ID NO: 2057785 - RNA, 13 nt, Human
ugaccaaguuaua

SEQ ID NO: 2057786 - RNA, 16 nt, Human
ugaccaaguuauaaau

SEQ ID NO: 2057787 - RNA, 20 nt, Human
ugaccaaguuauaaaucaau

SEQ ID NO: 2057788 - RNA, 22 nt, Human
agaucccagaaggaccuccuga

SEQ ID NO: 2057789 - RNA, 13 nt, Human
agaucccagcuca

SEQ ID NO: 2057790 - RNA, 21 nt, Human
agauccccaaaacaggccagg

SEQ ID NO: 2057791 - RNA, 15 nt, Human
agauccuaccccuga

SEQ ID NO: 2057792 - RNA, 15 nt, Human
agaucccgccucuuc

SEQ ID NO: 2057793 - RNA, 19 nt, Human
agaucccgccucuucuucu

SEQ ID NO: 2057794 - RNA, 22 nt, Human
agaucccgccucuucuucuuca

SEQ ID NO: 2057795 - RNA, 12 nt, Human
agaugccagagc

SEQ ID NO: 2057796 - RNA, 13 nt, Human
agaugccagagca

SEQ ID NO: 2057797 - RNA, 21 nt, Human
agaugccagagcaaagggcca

SEQ ID NO: 2057798 - RNA, 17 nt, Human
agaugcaaggaccagga

SEQ ID NO: 2057799 - RNA, 18 nt, Human
agaugcaaggaccaggac

SEQ ID NO: 2057800 - RNA, 13 nt, Human
agaugcacaugag

SEQ ID NO: 2057801 - RNA, 18 nt, Human
agaugcaaugugcuacug

SEQ ID NO: 2057802 - RNA, 20 nt, Human
agaugcaaggaccaggacuc

SEQ ID NO: 2057803 - RNA, 16 nt, Human
agaugcacaugagcug

SEQ ID NO: 2057804 - RNA, 19 nt, Human
agaugcaaugugcuacuga

SEQ ID NO: 2057805 - RNA, 12 nt, Human
agauguauccuu

SEQ ID NO: 2057806 - RNA, 17 nt, Human
agauguauccuuccaau

SEQ ID NO: 2057807 - RNA, 22 nt, Human
ugacagggcacaccgggcacuc

SEQ ID NO: 2057808 - RNA, 21 nt, Human
ugacagggcacaccgggcacu

SEQ ID NO: 2057809 - RNA, 19 nt, Human
ugacaggcaaugcuggcug
